United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 23

SEQ ID NO: 996441 - RNA, 22 nt, Human
uacaaaugaguuguaugaacca

SEQ ID NO: 996442 - RNA, 22 nt, Human
gggccaugagagguucaucaac

SEQ ID NO: 996443 - RNA, 22 nt, Human
ugccugucuuuccucccucgua

SEQ ID NO: 996444 - RNA, 22 nt, Human
gcucugcugacagcugggacag

SEQ ID NO: 996445 - RNA, 22 nt, Human
uauucacaggcuggagugaugu

SEQ ID NO: 996446 - RNA, 22 nt, Human
auugucuucuggucuuaucuuu

SEQ ID NO: 996447 - RNA, 22 nt, Human
gcaggcugugaggcucagaugg

SEQ ID NO: 996448 - RNA, 22 nt, Human
ugcaccugagaggucucugagg

SEQ ID NO: 996449 - RNA, 22 nt, Human
ccagagccucuuaugaagaucg

SEQ ID NO: 996450 - RNA, 22 nt, Human
acaaaugcagcauaaagugaac

SEQ ID NO: 996451 - RNA, 22 nt, Human
uggccugguuauauugcuauca

SEQ ID NO: 996452 - RNA, 22 nt, Human
caucaaauggcaagugaaagcu

SEQ ID NO: 996453 - RNA, 22 nt, Human
aaacccaucugucugucugcag

SEQ ID NO: 996454 - RNA, 22 nt, Human
ugcuguuauacuuagcugguua

SEQ ID NO: 996455 - RNA, 22 nt, Human
uuggcacagagcugcagccugg

SEQ ID NO: 996456 - RNA, 22 nt, Human
aggggugaaggcccgauaggag

SEQ ID NO: 996457 - RNA, 18 nt, Human
uggcagagugucuguucu

SEQ ID NO: 996458 - RNA, 22 nt, Human
cccugagagugagugccaccuu

SEQ ID NO: 996459 - RNA, 22 nt, Human
cccagcaucccagugggcagca

SEQ ID NO: 996460 - RNA, 22 nt, Human
ucaggcugcccguucagggcuc

SEQ ID NO: 996461 - RNA, 22 nt, Human
uuucacaagacagcuacuguug

SEQ ID NO: 996462 - RNA, 22 nt, Human
gcucugcugaagccccuugcau

SEQ ID NO: 996463 - RNA, 19 nt, Human
gcugugugaccuugggcaa

SEQ ID NO: 996464 - RNA, 17 nt, Human
ugguggcuggagucagg

SEQ ID NO: 996465 - RNA, 22 nt, Human
cuggcacaugcucccugagugg

SEQ ID NO: 996466 - RNA, 22 nt, Human
cugugaggcccugggugcugga

SEQ ID NO: 996467 - RNA, 22 nt, Human
ggacacaguggaagacagcuug

SEQ ID NO: 996468 - RNA, 22 nt, Human
ccugagcuggaagagcuugugc

SEQ ID NO: 996469 - RNA, 22 nt, Human
agccuggaggccaggagacagu

SEQ ID NO: 996470 - RNA, 22 nt, Human
acagccagaggagccaggcugg

SEQ ID NO: 996471 - RNA, 22 nt, Human
gggugcaggcagcccaggcagg

SEQ ID NO: 996472 - RNA, 21 nt, Human
uggcucaguugcugggcacag

SEQ ID NO: 996473 - RNA, 22 nt, Human
aggucauuacaauuaucauuuu

SEQ ID NO: 996474 - RNA, 22 nt, Human
gcagggacaacugugcaccuga

SEQ ID NO: 996475 - RNA, 22 nt, Human
ggagucagccugucagagugua

SEQ ID NO: 996476 - RNA, 22 nt, Human
cuggagccagccagggcccucu

SEQ ID NO: 996477 - RNA, 22 nt, Human
uuagaaaggagcuuauuucuuu

SEQ ID NO: 996478 - RNA, 23 nt, Human
ggcacugaagcuacaauggugag

SEQ ID NO: 996479 - RNA, 22 nt, Human
ccagccuggacugggucuugug

SEQ ID NO: 996480 - RNA, 22 nt, Human
uaauaaaugaaagugcuggcau

SEQ ID NO: 996481 - RNA, 20 nt, Human
gaggcucugggcauggcgcc

SEQ ID NO: 996482 - RNA, 22 nt, Human
gaaggccauugcguccugggau

SEQ ID NO: 996483 - RNA, 22 nt, Human
cacaaaaguaggaggcaggcgg

SEQ ID NO: 996484 - RNA, 22 nt, Human
ugggcagauuaaugcaguggcu

SEQ ID NO: 996485 - RNA, 22 nt, Human
cccagcccugaccuauuggaaa

SEQ ID NO: 996486 - RNA, 22 nt, Human
gucagaggaauggaugagugau

SEQ ID NO: 996487 - RNA, 22 nt, Human
ccuggccucgugcucacggcuc

SEQ ID NO: 996488 - RNA, 18 nt, Human
gcugccugcauuccucac

SEQ ID NO: 996489 - RNA, 23 nt, Human
cccagcagauuguaaagugucca

SEQ ID NO: 996490 - RNA, 22 nt, Human
ucuggagaacuugcaagaggau

SEQ ID NO: 996491 - RNA, 22 nt, Human
cucuggaguucuucaagcuacu

SEQ ID NO: 996492 - RNA, 22 nt, Human
agccacagugcaagagagaaaa

SEQ ID NO: 996493 - RNA, 22 nt, Human
gggcugggaauggcuaaguaug

SEQ ID NO: 996494 - RNA, 22 nt, Human
aagagcuggaugaagaaaucaa

SEQ ID NO: 996495 - RNA, 22 nt, Human
cacugcaguuccccagugcgca

SEQ ID NO: 996496 - RNA, 21 nt, Human
gugucaugguugacuuuggca

SEQ ID NO: 996497 - RNA, 22 nt, Human
cuggccaggcuugggacagaca

SEQ ID NO: 996498 - RNA, 22 nt, Human
uuagaaacccagacucuuaggu

SEQ ID NO: 996499 - RNA, 22 nt, Human
uccuggccucgcuguccaccuu

SEQ ID NO: 996500 - RNA, 20 nt, Human
aucuggcucagauccugcag

SEQ ID NO: 996501 - RNA, 22 nt, Human
uuucagugcuucuguuuaccgg

SEQ ID NO: 996502 - RNA, 20 nt, Human
ccugucugcaauggagguca

SEQ ID NO: 996503 - RNA, 23 nt, Human
cugaggccugcugcguucagguu

SEQ ID NO: 996504 - RNA, 22 nt, Human
ggcaccugcucaucuggacuca

SEQ ID NO: 996505 - RNA, 22 nt, Human
acacagaaccucauagccucuc

SEQ ID NO: 996506 - RNA, 22 nt, Human
cuggcucccucgcugaggugcu

SEQ ID NO: 996507 - RNA, 22 nt, Human
ccacagagacaggguccuugcu

SEQ ID NO: 996508 - RNA, 22 nt, Human
uucacauuugcccuuaugugug

SEQ ID NO: 996509 - RNA, 22 nt, Human
aggggacacggcuucuccaggg

SEQ ID NO: 996510 - RNA, 22 nt, Human
gcugggcuucucaaugcugccu

SEQ ID NO: 996511 - RNA, 22 nt, Human
ucccagagacagagccuccucc

SEQ ID NO: 996512 - RNA, 22 nt, Human
ucugggcuuuacacugugcuua

SEQ ID NO: 996513 - RNA, 22 nt, Human
ucuggcucauaggaaggccauu

SEQ ID NO: 996514 - RNA, 22 nt, Human
uuuccauauuuggucuuuggga

SEQ ID NO: 996515 - RNA, 22 nt, Human
aggcucagagaugaguaagcac

SEQ ID NO: 996516 - RNA, 22 nt, Human
gccuggcaggccuguuggggcu

SEQ ID NO: 996517 - RNA, 22 nt, Human
aaacauugcuaaauaaugcugc

SEQ ID NO: 996518 - RNA, 22 nt, Human
ggcugcagcagagggacucacg

SEQ ID NO: 996519 - RNA, 22 nt, Human
gagccaggcaccuucuguguug

SEQ ID NO: 996520 - RNA, 22 nt, Human
gaacccaguccaggugcagccu

SEQ ID NO: 996521 - RNA, 22 nt, Human
augccacugacauggacaauuu

SEQ ID NO: 996522 - RNA, 22 nt, Human
ugcccuuggguaacuugcugau

SEQ ID NO: 996523 - RNA, 18 nt, Human
uggagccauugccaccau

SEQ ID NO: 996524 - RNA, 22 nt, Human
aaacuacuaugggaauguacuu

SEQ ID NO: 996525 - RNA, 22 nt, Human
uccagggcuggguuggcucagc

SEQ ID NO: 996526 - RNA, 22 nt, Human
ucucagagaucuuucugcaugu

SEQ ID NO: 996527 - RNA, 22 nt, Human
aauucauccaugaacaauucca

SEQ ID NO: 996528 - RNA, 22 nt, Human
ugcaggagcugugcggugaggg

SEQ ID NO: 996529 - RNA, 22 nt, Human
auuuggauucuuauuuagcacu

SEQ ID NO: 996530 - RNA, 22 nt, Human
aaacagaaauuuccucaugcuc

SEQ ID NO: 996531 - RNA, 22 nt, Human
ucuggccaacccucaaguugua

SEQ ID NO: 996532 - RNA, 22 nt, Human
ggagagaaauugagguagcaag

SEQ ID NO: 996533 - RNA, 22 nt, Human
cuauuagguuggugcaaaagua

SEQ ID NO: 996534 - RNA, 20 nt, Human
ggccugagcauggcuggcag

SEQ ID NO: 996535 - RNA, 22 nt, Human
aagauguaucuuuccuuuaauu

SEQ ID NO: 996536 - RNA, 22 nt, Human
cuguccuuacugcuucuggcuu

SEQ ID NO: 996537 - RNA, 22 nt, Human
ccagcuccuucugucuguggag

SEQ ID NO: 996538 - RNA, 22 nt, Human
agagcuguucagcagccagguu

SEQ ID NO: 996539 - RNA, 18 nt, Human
auguauguacauauuuau

SEQ ID NO: 996540 - RNA, 22 nt, Human
guaaaucccauccuuucucugg

SEQ ID NO: 996541 - RNA, 22 nt, Human
cagcuggcagcccuggcccugc

SEQ ID NO: 996542 - RNA, 22 nt, Human
gccuggcacauugcaguggauu

SEQ ID NO: 996543 - RNA, 22 nt, Human
aggcacugacucaagggagcca

SEQ ID NO: 996544 - RNA, 22 nt, Human
cuagagaggcagauguccugug

SEQ ID NO: 996545 - RNA, 19 nt, Human
ccagcccugucacuucuug

SEQ ID NO: 996546 - RNA, 22 nt, Human
gccugcagggugaugggcugcc

SEQ ID NO: 996547 - RNA, 22 nt, Human
aggucauuuuugccuucuauuu

SEQ ID NO: 996548 - RNA, 22 nt, Human
gagaggcugacuggcuguccug

SEQ ID NO: 996549 - RNA, 19 nt, Human
gcugucugaugcugagguc

SEQ ID NO: 996550 - RNA, 22 nt, Human
uauaaaguuucgaaagauguau

SEQ ID NO: 996551 - RNA, 22 nt, Human
gccagcuggagacuggcagggg

SEQ ID NO: 996552 - RNA, 22 nt, Human
cucucuggcuuggcacggagau

SEQ ID NO: 996553 - RNA, 22 nt, Human
gggagguucuguucgcacuuga

SEQ ID NO: 996554 - RNA, 22 nt, Human
uuggccaaggaccuuuuuggag

SEQ ID NO: 996555 - RNA, 21 nt, Human
ugagccaggcugacggcugug

SEQ ID NO: 996556 - RNA, 22 nt, Human
ggagaccagaaggaagcuucga

SEQ ID NO: 996557 - RNA, 22 nt, Human
agggugccugcugcagguucag

SEQ ID NO: 996558 - RNA, 22 nt, Human
cagcugggagcuccauuagaua

SEQ ID NO: 996559 - RNA, 22 nt, Human
cacuaaguaagcuccucuacaa

SEQ ID NO: 996560 - RNA, 22 nt, Human
cugagauggaguuuugcucuug

SEQ ID NO: 996561 - RNA, 22 nt, Human
auggccaaagccacagcagagg

SEQ ID NO: 996562 - RNA, 22 nt, Human
cuggagagaccgaaagaggcug

SEQ ID NO: 996563 - RNA, 22 nt, Human
agugaaauagcauuuaugaagc

SEQ ID NO: 996564 - RNA, 19 nt, Human
uggucuaaaugugugcccc

SEQ ID NO: 996565 - RNA, 23 nt, Human
gccugggacugguagugugaccu

SEQ ID NO: 996566 - RNA, 22 nt, Human
ccuguguguaggccaggggagu

SEQ ID NO: 996567 - RNA, 22 nt, Human
uucuucaauuauuggaaagaaa

SEQ ID NO: 996568 - RNA, 22 nt, Human
gccuucaguaguauccucauga

SEQ ID NO: 996569 - RNA, 23 nt, Human
gccaggcuccggucuguggccac

SEQ ID NO: 996570 - RNA, 22 nt, Human
aaacugccuccugggcaacuaa

SEQ ID NO: 996571 - RNA, 19 nt, Human
acagaaauguaagugagac

SEQ ID NO: 996572 - RNA, 19 nt, Human
ucuggagcugaugcaggug

SEQ ID NO: 996573 - RNA, 22 nt, Human
aaagucauacauggugcuuacu

SEQ ID NO: 996574 - RNA, 22 nt, Human
ugaaaucuuuaguuucuguccc

SEQ ID NO: 996575 - RNA, 22 nt, Human
uuguuauaaagacuaaauaugu

SEQ ID NO: 996576 - RNA, 19 nt, Human
ggcuccuguggcugcagcc

SEQ ID NO: 996577 - RNA, 22 nt, Human
ggccucucuggcauggcugccc

SEQ ID NO: 996578 - RNA, 22 nt, Human
auguuguagcauaugaaauaua

SEQ ID NO: 996579 - RNA, 20 nt, Human
ucacauccucucccaacaug

SEQ ID NO: 996580 - RNA, 22 nt, Human
ggccucugccccagccacaccu

SEQ ID NO: 996581 - RNA, 22 nt, Human
uauguacagggauagaacuuga

SEQ ID NO: 996582 - RNA, 21 nt, Human
aaagugguaaggauuauuuug

SEQ ID NO: 996583 - RNA, 22 nt, Human
ggucccaggaaucuguguucua

SEQ ID NO: 996584 - RNA, 22 nt, Human
cauuaagauuuuuuucuacugg

SEQ ID NO: 996585 - RNA, 22 nt, Human
gucaaguuaagauaaggucaug

SEQ ID NO: 996586 - RNA, 22 nt, Human
caggugcucccagagaagugcu

SEQ ID NO: 996587 - RNA, 22 nt, Human
agccucugucaagcuuuucaaa

SEQ ID NO: 996588 - RNA, 22 nt, Human
ccugcagagccacgugccagcg

SEQ ID NO: 996589 - RNA, 22 nt, Human
acaggcugcccgcuccccaccu

SEQ ID NO: 996590 - RNA, 22 nt, Human
guccuggggauacagaagugaa

SEQ ID NO: 996591 - RNA, 18 nt, Human
gggcaagcggcugucacc

SEQ ID NO: 996592 - RNA, 22 nt, Human
ccugcagguccccggaugcgca

SEQ ID NO: 996593 - RNA, 22 nt, Human
aaauauaauuucugccucaaua

SEQ ID NO: 996594 - RNA, 22 nt, Human
ggcucaggcuggagugcagugg

SEQ ID NO: 996595 - RNA, 22 nt, Human
ugcauugcauuugucaugaaga

SEQ ID NO: 996596 - RNA, 19 nt, Human
ucacaggcaucuccccaga

SEQ ID NO: 996597 - RNA, 22 nt, Human
gggcccagcgugguuccaucug

SEQ ID NO: 996598 - RNA, 23 nt, Human
uggcucugagagguucagaugcu

SEQ ID NO: 996599 - RNA, 22 nt, Human
uggcagaguaggauggcccugu

SEQ ID NO: 996600 - RNA, 22 nt, Human
aucaaaguaggcauauguuuuu

SEQ ID NO: 996601 - RNA, 22 nt, Human
cuggggcucacuuuggucaggc

SEQ ID NO: 996602 - RNA, 22 nt, Human
gggcugcugccaaucacagccu

SEQ ID NO: 996603 - RNA, 22 nt, Human
ucucagaguuuacggggcugaa

SEQ ID NO: 996604 - RNA, 22 nt, Human
gagccugaauuugaccugcuua

SEQ ID NO: 996605 - RNA, 23 nt, Human
aggauguaggauguauggcagag

SEQ ID NO: 996606 - RNA, 22 nt, Human
uagaauaugugguguauacuuu

SEQ ID NO: 996607 - RNA, 22 nt, Human
ucugucacuuauuaagauggau

SEQ ID NO: 996608 - RNA, 17 nt, Human
gcagccagugcagcagg

SEQ ID NO: 996609 - RNA, 22 nt, Human
agacaggacacaagcugcauaa

SEQ ID NO: 996610 - RNA, 22 nt, Human
cugaagcaaaggaucgagcuaa

SEQ ID NO: 996611 - RNA, 22 nt, Human
gggcccuggauuuaagcaugga

SEQ ID NO: 996612 - RNA, 22 nt, Human
uggcagagucugggcuugggca

SEQ ID NO: 996613 - RNA, 22 nt, Human
gggcacugcuuugcucugucac

SEQ ID NO: 996614 - RNA, 22 nt, Human
agucucugugagcucccaaugg

SEQ ID NO: 996615 - RNA, 22 nt, Human
gugccugcagcaauccauggca

SEQ ID NO: 996616 - RNA, 22 nt, Human
aguauuucuaguugguucuacu

SEQ ID NO: 996617 - RNA, 22 nt, Human
ccugugcccucagccuggcucu

SEQ ID NO: 996618 - RNA, 19 nt, Human
uccuccuuacuuccucuug

SEQ ID NO: 996619 - RNA, 22 nt, Human
auucacaaauaacaggugcaga

SEQ ID NO: 996620 - RNA, 21 nt, Human
gcaggguccuuuccauuccua

SEQ ID NO: 996621 - RNA, 22 nt, Human
uaaaugugucuauggacccgcc

SEQ ID NO: 996622 - RNA, 22 nt, Human
agccaggcugcaguuggcuggc

SEQ ID NO: 996623 - RNA, 22 nt, Human
ucuggcucuuugggugauugua

SEQ ID NO: 996624 - RNA, 22 nt, Human
cugaaggaagcagaagcgaggu

SEQ ID NO: 996625 - RNA, 22 nt, Human
auuuacagaagcauguaauagc

SEQ ID NO: 996626 - RNA, 22 nt, Human
ggguacaaagauuucauaagau

SEQ ID NO: 996627 - RNA, 22 nt, Human
ucuguagcaagugagaggcauu

SEQ ID NO: 996628 - RNA, 22 nt, Human
cuggcagcauuaacagagagca

SEQ ID NO: 996629 - RNA, 22 nt, Human
uauuaugagguauuuggacuuu

SEQ ID NO: 996630 - RNA, 22 nt, Human
ggcagcaguggcugcuauuguc

SEQ ID NO: 996631 - RNA, 22 nt, Human
ugcugccacugguagucucauu

SEQ ID NO: 996632 - RNA, 17 nt, Human
uucaagauauugaaaug

SEQ ID NO: 996633 - RNA, 22 nt, Human
aagguacagaaauuaacaagga

SEQ ID NO: 996634 - RNA, 22 nt, Human
ggaguuggugagcaccaggcuu

SEQ ID NO: 996635 - RNA, 22 nt, Human
cugcagaggguuugagcauccu

SEQ ID NO: 996636 - RNA, 22 nt, Human
uacaguaaagcugcuaugaauu

SEQ ID NO: 996637 - RNA, 22 nt, Human
cagccagcuggcacugugagua

SEQ ID NO: 996638 - RNA, 22 nt, Human
acuaacauguuaaucaaaagaa

SEQ ID NO: 996639 - RNA, 23 nt, Human
aacaccaaggcucagagagauaa

SEQ ID NO: 996640 - RNA, 22 nt, Human
agggugcagaaggagccuagga

SEQ ID NO: 996641 - RNA, 22 nt, Human
auggccaaaucuaaacuguugg

SEQ ID NO: 996642 - RNA, 22 nt, Human
caguuuuucaaaauuacaugau

SEQ ID NO: 996643 - RNA, 22 nt, Human
acccuggguucccgcagcacca

SEQ ID NO: 996644 - RNA, 22 nt, Human
cagcauggggcuuggagucagc

SEQ ID NO: 996645 - RNA, 22 nt, Human
gcucugcuaauauuguaguacc

SEQ ID NO: 996646 - RNA, 22 nt, Human
gcucccagcauugcugcugaau

SEQ ID NO: 996647 - RNA, 22 nt, Human
cagcugaguguuggcauguuca

SEQ ID NO: 996648 - RNA, 22 nt, Human
gccauuuagggaggcaagguga

SEQ ID NO: 996649 - RNA, 22 nt, Human
aaacauucucagcccugcuugc

SEQ ID NO: 996650 - RNA, 22 nt, Human
ccacacugaaccucagugucuu

SEQ ID NO: 996651 - RNA, 22 nt, Human
aacacauauuuauauaugcaca

SEQ ID NO: 996652 - RNA, 22 nt, Human
ucaaaaguuucacauagagaua

SEQ ID NO: 996653 - RNA, 20 nt, Human
acaauagauuugagcaaagu

SEQ ID NO: 996654 - RNA, 17 nt, Human
cugcuuugugcaacgcu

SEQ ID NO: 996655 - RNA, 22 nt, Human
uuaugcuaguauaguccuuaga

SEQ ID NO: 996656 - RNA, 22 nt, Human
aaggucauggcaaauuacuuuu

SEQ ID NO: 996657 - RNA, 22 nt, Human
caaaaguagugaaguuguacau

SEQ ID NO: 996658 - RNA, 22 nt, Human
cccucccaggaguggccagaga

SEQ ID NO: 996659 - RNA, 22 nt, Human
cagucauuggcuaaagcucccu

SEQ ID NO: 996660 - RNA, 22 nt, Human
ccuguguggccaggcuggaguc

SEQ ID NO: 996661 - RNA, 22 nt, Human
uggcaggggaggugcuugcuua

SEQ ID NO: 996662 - RNA, 22 nt, Human
agaaaguucugugaguuguuca

SEQ ID NO: 996663 - RNA, 22 nt, Human
aacuaacagucauuaaaagaac

SEQ ID NO: 996664 - RNA, 22 nt, Human
cauggcagaaaccugagcugcu

SEQ ID NO: 996665 - RNA, 22 nt, Human
ucaggagucugugcaguuccac

SEQ ID NO: 996666 - RNA, 22 nt, Human
caugucuguguacacaugcaca

SEQ ID NO: 996667 - RNA, 20 nt, Human
uccuggccucccuggggcuc

SEQ ID NO: 996668 - RNA, 19 nt, Human
gcuuuuuguugucaaaggu

SEQ ID NO: 996669 - RNA, 22 nt, Human
ggccugaggcgucccagcugug

SEQ ID NO: 996670 - RNA, 22 nt, Human
uuugcauuuauaaguuggugga

SEQ ID NO: 996671 - RNA, 22 nt, Human
augugcuaaacucaacaaaucu

SEQ ID NO: 996672 - RNA, 22 nt, Human
ucugugaacaucacauugacag

SEQ ID NO: 996673 - RNA, 23 nt, Human
cccagagcacagccuccagaugc

SEQ ID NO: 996674 - RNA, 22 nt, Human
acaaaggugcgucccuucagcu

SEQ ID NO: 996675 - RNA, 22 nt, Human
ccucccaccguaucucaguggc

SEQ ID NO: 996676 - RNA, 22 nt, Human
ucagcugaaguggagaagcaga

SEQ ID NO: 996677 - RNA, 22 nt, Human
gaggccuggcugggaggaggug

SEQ ID NO: 996678 - RNA, 22 nt, Human
aagauuuacuagcauaauagcu

SEQ ID NO: 996679 - RNA, 19 nt, Human
auuugaaagcugugcuugc

SEQ ID NO: 996680 - RNA, 22 nt, Human
gaaaugcaggcuuggauucagc

SEQ ID NO: 996681 - RNA, 21 nt, Human
ggcccugguuacgccuccucu

SEQ ID NO: 996682 - RNA, 22 nt, Human
caauguguguguuuuucucaac

SEQ ID NO: 996683 - RNA, 22 nt, Human
ugccaggcccugugcuggaugc

SEQ ID NO: 996684 - RNA, 22 nt, Human
ucaaugauuagaguuuagugug

SEQ ID NO: 996685 - RNA, 22 nt, Human
uaagucaugauucuguguuacu

SEQ ID NO: 996686 - RNA, 22 nt, Human
gaggcagcaaaauauaucauaa

SEQ ID NO: 996687 - RNA, 18 nt, Human
uggacaggguggagaaaa

SEQ ID NO: 996688 - RNA, 22 nt, Human
cccaggcuggagugcaauggca

SEQ ID NO: 996689 - RNA, 22 nt, Human
ugaagcccugugucagcuucca

SEQ ID NO: 996690 - RNA, 22 nt, Human
agugaaaucagguuuugacugc

SEQ ID NO: 996691 - RNA, 22 nt, Human
agagcagaggcauggccguggg

SEQ ID NO: 996692 - RNA, 22 nt, Human
cuugggagacacaagaagacau

SEQ ID NO: 996693 - RNA, 22 nt, Human
auuugucuuugagugcccugcu

SEQ ID NO: 996694 - RNA, 22 nt, Human
uuagaaaucaccucugaagauc

SEQ ID NO: 996695 - RNA, 22 nt, Human
aggcuauuuccacucuucucau

SEQ ID NO: 996696 - RNA, 22 nt, Human
cuguccuguggaccugaggacg

SEQ ID NO: 996697 - RNA, 23 nt, Human
cagguggcuccacgagggguggg

SEQ ID NO: 996698 - RNA, 22 nt, Human
gaggaaaauggaguguaauuaa

SEQ ID NO: 996699 - RNA, 22 nt, Human
cuccaggccauggcugcggagg

SEQ ID NO: 996700 - RNA, 22 nt, Human
cccagcucucugcucuuagccu

SEQ ID NO: 996701 - RNA, 22 nt, Human
uuagugauuacuacauagauga

SEQ ID NO: 996702 - RNA, 22 nt, Human
uaggccagcccuuaguccuguc

SEQ ID NO: 996703 - RNA, 22 nt, Human
guuugaaugcaguaugcauuuu

SEQ ID NO: 996704 - RNA, 22 nt, Human
aaaugcauguagaauaauagag

SEQ ID NO: 996705 - RNA, 22 nt, Human
agggccugacacccuugccagc

SEQ ID NO: 996706 - RNA, 22 nt, Human
uagagaaauaagcuuugccuug

SEQ ID NO: 996707 - RNA, 22 nt, Human
cauuuaaagguuguggguaaaa

SEQ ID NO: 996708 - RNA, 22 nt, Human
agcaccuucacaggcucucagg

SEQ ID NO: 996709 - RNA, 19 nt, Human
agcuccugggcucugggcc

SEQ ID NO: 996710 - RNA, 22 nt, Human
gugcaugucggggugcauguca

SEQ ID NO: 996711 - RNA, 22 nt, Human
uauccaaaguuucucagaaacu

SEQ ID NO: 996712 - RNA, 22 nt, Human
gaaagaagcuuuagauggcuau

SEQ ID NO: 996713 - RNA, 22 nt, Human
agcagcagaggucagaaaggua

SEQ ID NO: 996714 - RNA, 22 nt, Human
aggcacugggggaugagcaagg

SEQ ID NO: 996715 - RNA, 22 nt, Human
ccagucccagcucugccaugcu

SEQ ID NO: 996716 - RNA, 22 nt, Human
agccucugcacgggcacgggug

SEQ ID NO: 996717 - RNA, 22 nt, Human
agagcuggacgucugagcccua

SEQ ID NO: 996718 - RNA, 22 nt, Human
gccccagccaaggugacacgaa

SEQ ID NO: 996719 - RNA, 17 nt, Human
cacaggugugguuugag

SEQ ID NO: 996720 - RNA, 22 nt, Human
acauuuuuuagagucccacauu

SEQ ID NO: 996721 - RNA, 23 nt, Human
agcagccagagauccucggcccu

SEQ ID NO: 996722 - RNA, 22 nt, Human
ccagcagcccucuuccaagacu

SEQ ID NO: 996723 - RNA, 22 nt, Human
ucugcucagugcuuaucucuaa

SEQ ID NO: 996724 - RNA, 21 nt, Human
acagaacuguauagugauaaa

SEQ ID NO: 996725 - RNA, 22 nt, Human
ucagcaggcaggaggcaugcca

SEQ ID NO: 996726 - RNA, 19 nt, Human
acuuccugcccgcuccuuu

SEQ ID NO: 996727 - RNA, 23 nt, Human
ucagaaugcacugaauuuacccu

SEQ ID NO: 996728 - RNA, 22 nt, Human
ucuguaaaacuucuuuguaaau

SEQ ID NO: 996729 - RNA, 22 nt, Human
ggcgugggaaguggggcuucug

SEQ ID NO: 996730 - RNA, 17 nt, Human
cagacaggcugucaccc

SEQ ID NO: 996731 - RNA, 22 nt, Human
aagaggaaaugauugacuauau

SEQ ID NO: 996732 - RNA, 22 nt, Human
gagcagugguugaacagaggca

SEQ ID NO: 996733 - RNA, 22 nt, Human
gucacaggccuggaugaggggc

SEQ ID NO: 996734 - RNA, 19 nt, Human
ccagagcccgccagauggg

SEQ ID NO: 996735 - RNA, 22 nt, Human
uuacaggggacauuggggacau

SEQ ID NO: 996736 - RNA, 22 nt, Human
ucaaaguuuguggcaauuuauu

SEQ ID NO: 996737 - RNA, 22 nt, Human
cugugccaguguauuccuguga

SEQ ID NO: 996738 - RNA, 17 nt, Human
agguggcugcugcgccu

SEQ ID NO: 996739 - RNA, 22 nt, Human
ccagcuccucuucccaguguca

SEQ ID NO: 996740 - RNA, 22 nt, Human
gcugcagcccggcgcgccugag

SEQ ID NO: 996741 - RNA, 22 nt, Human
uuccauaaugagauucccagcc

SEQ ID NO: 996742 - RNA, 22 nt, Human
acagggaacaggaauauacaaa

SEQ ID NO: 996743 - RNA, 22 nt, Human
guuugucuuaauuaggcaucga

SEQ ID NO: 996744 - RNA, 22 nt, Human
auugacaauuagcccuuaggug

SEQ ID NO: 996745 - RNA, 19 nt, Human
ugaggccaaggucacagau

SEQ ID NO: 996746 - RNA, 22 nt, Human
acaugcauucucuaaaagcaaa

SEQ ID NO: 996747 - RNA, 22 nt, Human
ggacucuguuuuccugaucacu

SEQ ID NO: 996748 - RNA, 22 nt, Human
ugucaugcagguuuguuauaga

SEQ ID NO: 996749 - RNA, 22 nt, Human
ccagucccgcaugguccagaau

SEQ ID NO: 996750 - RNA, 22 nt, Human
cagcugccccuccagggcuggg

SEQ ID NO: 996751 - RNA, 22 nt, Human
aaaguguugggauuacaggugu

SEQ ID NO: 996752 - RNA, 22 nt, Human
ggugccagccuagugcaguggu

SEQ ID NO: 996753 - RNA, 22 nt, Human
ggucugaguggggccugagauu

SEQ ID NO: 996754 - RNA, 22 nt, Human
cuggccauguugccucugagac

SEQ ID NO: 996755 - RNA, 22 nt, Human
augcuauacucaaagaaauuca

SEQ ID NO: 996756 - RNA, 22 nt, Human
uccugcagaccucagucagguc

SEQ ID NO: 996757 - RNA, 22 nt, Human
aaaaaugcuuggacuuaauaaa

SEQ ID NO: 996758 - RNA, 22 nt, Human
ugggcagauguggcucuccuug

SEQ ID NO: 996759 - RNA, 22 nt, Human
uagccuucucaagacaaaguug

SEQ ID NO: 996760 - RNA, 19 nt, Human
gucaucuuuuaauaaugug

SEQ ID NO: 996761 - RNA, 22 nt, Human
gauuuagagaauguuuuguaag

SEQ ID NO: 996762 - RNA, 20 nt, Human
ggcucugcuugugagcagcc

SEQ ID NO: 996763 - RNA, 22 nt, Human
cacuggggaaaacaggcuucuu

SEQ ID NO: 996764 - RNA, 22 nt, Human
uguaaucauuacaguacaugga

SEQ ID NO: 996765 - RNA, 17 nt, Human
aaaauucuguaaagagg

SEQ ID NO: 996766 - RNA, 21 nt, Human
acagggcaugcagcuggcugu

SEQ ID NO: 996767 - RNA, 22 nt, Human
cuccuggaggauagugacuggg

SEQ ID NO: 996768 - RNA, 22 nt, Human
ugaagacacauacaagggaaug

SEQ ID NO: 996769 - RNA, 22 nt, Human
uaggagaggugaauggcacacu

SEQ ID NO: 996770 - RNA, 22 nt, Human
auggacagugugaagcagauag

SEQ ID NO: 996771 - RNA, 22 nt, Human
cauugcccaguaggaucaccag

SEQ ID NO: 996772 - RNA, 22 nt, Human
cugcccugcuugaugacagcga

SEQ ID NO: 996773 - RNA, 22 nt, Human
ugcauuccuccaccuccugcac

SEQ ID NO: 996774 - RNA, 22 nt, Human
ugccagccagguucugaggcua

SEQ ID NO: 996775 - RNA, 22 nt, Human
uucagcaagaauuuacugagcu

SEQ ID NO: 996776 - RNA, 22 nt, Human
uucaagauaauaggaaugaaaa

SEQ ID NO: 996777 - RNA, 22 nt, Human
cauggacucugguuuggggagc

SEQ ID NO: 996778 - RNA, 20 nt, Human
uucauucauuccacaacuuc

SEQ ID NO: 996779 - RNA, 20 nt, Human
gccuggaggcaaugggaaga

SEQ ID NO: 996780 - RNA, 22 nt, Human
auguuauuuuggaaaauacaaa

SEQ ID NO: 996781 - RNA, 20 nt, Human
ggcugugcccuuccguggcc

SEQ ID NO: 996782 - RNA, 22 nt, Human
accuguuuguguccauuaguga

SEQ ID NO: 996783 - RNA, 22 nt, Human
caggagccccaggcugacaaua

SEQ ID NO: 996784 - RNA, 18 nt, Human
gaggccugagaaccaggu

SEQ ID NO: 996785 - RNA, 22 nt, Human
cuuucacaguccugacugagcg

SEQ ID NO: 996786 - RNA, 22 nt, Human
auggaaagcuaagccauuuacc

SEQ ID NO: 996787 - RNA, 22 nt, Human
uagcugcccaucuuuccuuuag

SEQ ID NO: 996788 - RNA, 22 nt, Human
ucaugcacaugugucaccauca

SEQ ID NO: 996789 - RNA, 22 nt, Human
agccuggagaggcgccauacac

SEQ ID NO: 996790 - RNA, 22 nt, Human
cacugcuuauaaauucuaggca

SEQ ID NO: 996791 - RNA, 22 nt, Human
uccaagggcagcagccauagcc

SEQ ID NO: 996792 - RNA, 21 nt, Human
uucaagauauuuaaaaggugg

SEQ ID NO: 996793 - RNA, 22 nt, Human
cauugcacaucugagaagagau

SEQ ID NO: 996794 - RNA, 22 nt, Human
aaugcuagugugauauguaagg

SEQ ID NO: 996795 - RNA, 22 nt, Human
aagccgggccugagaaaugaca

SEQ ID NO: 996796 - RNA, 22 nt, Human
cucucccagucaggcucaggau

SEQ ID NO: 996797 - RNA, 22 nt, Human
agggaaugcuccguauaaaucu

SEQ ID NO: 996798 - RNA, 22 nt, Human
uccuuuccagccucaccucagc

SEQ ID NO: 996799 - RNA, 22 nt, Human
ucagagugaggcgucaacauga

SEQ ID NO: 996800 - RNA, 22 nt, Human
ccagcccuguaaggaugaggca

SEQ ID NO: 996801 - RNA, 22 nt, Human
uaauuuaauuccauggauucua

SEQ ID NO: 996802 - RNA, 22 nt, Human
aggggccugguuggccucuguu

SEQ ID NO: 996803 - RNA, 22 nt, Human
ucaaagucauggcuaguaauga

SEQ ID NO: 996804 - RNA, 16 nt, Human
agcagggcgggaagga

SEQ ID NO: 996805 - RNA, 22 nt, Human
cagccuccugggacacucaccg

SEQ ID NO: 996806 - RNA, 22 nt, Human
gcauugaguccacucugucuuu

SEQ ID NO: 996807 - RNA, 22 nt, Human
ucuggccaggauggcaagacca

SEQ ID NO: 996808 - RNA, 20 nt, Human
agcugguuaucuuaauucuu

SEQ ID NO: 996809 - RNA, 22 nt, Human
cucaggauuuacuaauuucaag

SEQ ID NO: 996810 - RNA, 21 nt, Human
acagacagggccagugucccc

SEQ ID NO: 996811 - RNA, 22 nt, Human
ggcagcugggucacaccgaucu

SEQ ID NO: 996812 - RNA, 22 nt, Human
cagggcugcuggccgugcccuc

SEQ ID NO: 996813 - RNA, 22 nt, Human
ucugacauuuugagaaugacau

SEQ ID NO: 996814 - RNA, 21 nt, Human
augaagucuaugcuucugugu

SEQ ID NO: 996815 - RNA, 22 nt, Human
ugcccuguuccugccuccagcu

SEQ ID NO: 996816 - RNA, 22 nt, Human
cagagcuggagggaacccuggc

SEQ ID NO: 996817 - RNA, 22 nt, Human
gugugccagacaugaugcuaug

SEQ ID NO: 996818 - RNA, 22 nt, Human
gcugagguggagauugcaguga

SEQ ID NO: 996819 - RNA, 22 nt, Human
caagagcuacccugugccauau

SEQ ID NO: 996820 - RNA, 22 nt, Human
auuuuucucuuuccacugagau

SEQ ID NO: 996821 - RNA, 22 nt, Human
gcacucugccaggucuccugau

SEQ ID NO: 996822 - RNA, 22 nt, Human
uauuucugauugcucaugaggc

SEQ ID NO: 996823 - RNA, 22 nt, Human
gaggugggaugugugugcuacu

SEQ ID NO: 996824 - RNA, 22 nt, Human
agagccuggacuuuucugagcc

SEQ ID NO: 996825 - RNA, 22 nt, Human
ucccaagugucuuggaccaggg

SEQ ID NO: 996826 - RNA, 19 nt, Human
ccucuccgcccaccagccc

SEQ ID NO: 996827 - RNA, 22 nt, Human
cuguggcuaggaagcuguggga

SEQ ID NO: 996828 - RNA, 22 nt, Human
cugggaggugaacagaaaaacu

SEQ ID NO: 996829 - RNA, 18 nt, Human
aagaggaggagcagguug

SEQ ID NO: 996830 - RNA, 22 nt, Human
cugccugugcaugcagucagaa

SEQ ID NO: 996831 - RNA, 22 nt, Human
auugaaagauauacuguucuca

SEQ ID NO: 996832 - RNA, 22 nt, Human
uacaguaucuucuggcaagcau

SEQ ID NO: 996833 - RNA, 22 nt, Human
uuguaacagcuguuuauauagu

SEQ ID NO: 996834 - RNA, 22 nt, Human
cauucacaucuuguuccaucac

SEQ ID NO: 996835 - RNA, 22 nt, Human
ggcuucuccagguacugagcau

SEQ ID NO: 996836 - RNA, 22 nt, Human
aaaugauggaaaugaggcugaa

SEQ ID NO: 996837 - RNA, 22 nt, Human
cccuggcaugcaugucccuggc

SEQ ID NO: 996838 - RNA, 22 nt, Human
agcccagguugaggcugcagug

SEQ ID NO: 996839 - RNA, 22 nt, Human
uccauuuuguagguaugcuaca

SEQ ID NO: 996840 - RNA, 22 nt, Human
gaaaucugaacucuguauccuu

SEQ ID NO: 996841 - RNA, 22 nt, Human
gacaucauagggugggaggaaa

SEQ ID NO: 996842 - RNA, 22 nt, Human
cucagggccaaggaugcuguug

SEQ ID NO: 996843 - RNA, 22 nt, Human
aucuggcucuuccuggaguucc

SEQ ID NO: 996844 - RNA, 22 nt, Human
aguguuucucagaagggccuau

SEQ ID NO: 996845 - RNA, 22 nt, Human
acacugaauaauugagaguuga

SEQ ID NO: 996846 - RNA, 22 nt, Human
gcuaggagauugagcucugaag

SEQ ID NO: 996847 - RNA, 22 nt, Human
ucccagagcagaugugcuaaag

SEQ ID NO: 996848 - RNA, 22 nt, Human
ucuggagcaacagagcaggaca

SEQ ID NO: 996849 - RNA, 17 nt, Human
ggccuguguggcugcag

SEQ ID NO: 996850 - RNA, 22 nt, Human
cagagcagugaggaguugugua

SEQ ID NO: 996851 - RNA, 22 nt, Human
ucuccuggcccugucgccaucu

SEQ ID NO: 996852 - RNA, 22 nt, Human
gcaggaguguauuugcauguaa

SEQ ID NO: 996853 - RNA, 22 nt, Human
cuggagcugucuucacaggccu

SEQ ID NO: 996854 - RNA, 22 nt, Human
gcugccacgaucucugcuguag

SEQ ID NO: 996855 - RNA, 22 nt, Human
gugucccaaucuacuuuucccu

SEQ ID NO: 996856 - RNA, 22 nt, Human
gagcagcugguaggugaaccca

SEQ ID NO: 996857 - RNA, 22 nt, Human
gaggccugguuugcaugagaau

SEQ ID NO: 996858 - RNA, 22 nt, Human
ggcacugagaacaggcugacuu

SEQ ID NO: 996859 - RNA, 22 nt, Human
guggugcaggccagcaggggcg

SEQ ID NO: 996860 - RNA, 22 nt, Human
ugucuguacaaauuuucugugu

SEQ ID NO: 996861 - RNA, 22 nt, Human
ucuccuggauagauacuaucca

SEQ ID NO: 996862 - RNA, 22 nt, Human
gacuccugggccucugagaggc

SEQ ID NO: 996863 - RNA, 22 nt, Human
uaugcacacauguaugcaugug

SEQ ID NO: 996864 - RNA, 22 nt, Human
cacaggugcuccucggggagcu

SEQ ID NO: 996865 - RNA, 22 nt, Human
agagccuggaccugagcuacaa

SEQ ID NO: 996866 - RNA, 22 nt, Human
uagagcuauuuagagcauuuua

SEQ ID NO: 996867 - RNA, 22 nt, Human
ucugugacuugcgggaggagaa

SEQ ID NO: 996868 - RNA, 22 nt, Human
gacccagcuuaagucacauguu

SEQ ID NO: 996869 - RNA, 22 nt, Human
caggcacugugcugagcucugc

SEQ ID NO: 996870 - RNA, 22 nt, Human
ugcagccaggaaauauuugcug

SEQ ID NO: 996871 - RNA, 22 nt, Human
cuauuuaugugcuauuuuguau

SEQ ID NO: 996872 - RNA, 22 nt, Human
cagaagcagugagagaugugca

SEQ ID NO: 996873 - RNA, 22 nt, Human
aggcccugcccagugccacaag

SEQ ID NO: 996874 - RNA, 19 nt, Human
ucugucacuggggguauuc

SEQ ID NO: 996875 - RNA, 22 nt, Human
aagcugccuuccaugugaggaa

SEQ ID NO: 996876 - RNA, 22 nt, Human
ucacauuuguuccucugcacuu

SEQ ID NO: 996877 - RNA, 23 nt, Human
auuugagaaaguauuuuuaagac

SEQ ID NO: 996878 - RNA, 22 nt, Human
aggccagcucacccuggcuccu

SEQ ID NO: 996879 - RNA, 22 nt, Human
ucuggagcuuccucauuuacag

SEQ ID NO: 996880 - RNA, 22 nt, Human
agcagagcggggccuccggaag

SEQ ID NO: 996881 - RNA, 22 nt, Human
cuuaacagagagaaguguugcu

SEQ ID NO: 996882 - RNA, 22 nt, Human
guggccaauuuccaucuguaag

SEQ ID NO: 996883 - RNA, 22 nt, Human
agggaagaagcugguaguaggu

SEQ ID NO: 996884 - RNA, 22 nt, Human
aggcaguggcugagaccagggg

SEQ ID NO: 996885 - RNA, 22 nt, Human
auaagaaacauuauucuuucca

SEQ ID NO: 996886 - RNA, 22 nt, Human
gauuucaaggauguuagaggug

SEQ ID NO: 996887 - RNA, 23 nt, Human
agacagaggcugaggcuggccgc

SEQ ID NO: 996888 - RNA, 22 nt, Human
acagaauauugguuacuguugc

SEQ ID NO: 996889 - RNA, 22 nt, Human
caccaucagcagcaggugucaa

SEQ ID NO: 996890 - RNA, 22 nt, Human
uuucuguuaggcaucauuuuaa

SEQ ID NO: 996891 - RNA, 22 nt, Human
uccucuggggucagggcacuac

SEQ ID NO: 996892 - RNA, 22 nt, Human
cagcauuggguuaccuuuguuu

SEQ ID NO: 996893 - RNA, 22 nt, Human
uggucaacaggcagggaugaaa

SEQ ID NO: 996894 - RNA, 22 nt, Human
uccuggccuugcgucuugggag

SEQ ID NO: 996895 - RNA, 22 nt, Human
aggcccaguuauccuacuuguu

SEQ ID NO: 996896 - RNA, 22 nt, Human
ucugagcuacgaugccugucac

SEQ ID NO: 996897 - RNA, 23 nt, Human
ccugggcauuggcugcagcuucu

SEQ ID NO: 996898 - RNA, 22 nt, Human
aacauuucagcaaauaagaaca

SEQ ID NO: 996899 - RNA, 17 nt, Human
agcugagcuggccaggg

SEQ ID NO: 996900 - RNA, 18 nt, Human
ugcagcaagugcuaaaua

SEQ ID NO: 996901 - RNA, 20 nt, Human
cagagaccugucuucacaga

SEQ ID NO: 996902 - RNA, 17 nt, Human
ucaggcugggugcagug

SEQ ID NO: 996903 - RNA, 22 nt, Human
ccaggugggaggaaagcagaga

SEQ ID NO: 996904 - RNA, 22 nt, Human
gggaccaggugggugcauuccg

SEQ ID NO: 996905 - RNA, 22 nt, Human
ucaaugaugcugaagguagcgu

SEQ ID NO: 996906 - RNA, 22 nt, Human
uccaagggcaacaauggaacac

SEQ ID NO: 996907 - RNA, 22 nt, Human
ggaugcaggaguugaagaagga

SEQ ID NO: 996908 - RNA, 22 nt, Human
aggccaaagcaagacccuguaa

SEQ ID NO: 996909 - RNA, 22 nt, Human
aggcagaggagaaugaucuucc

SEQ ID NO: 996910 - RNA, 17 nt, Human
ucagcaggggccaagcu

SEQ ID NO: 996911 - RNA, 22 nt, Human
uggcaacaccuggaagacaugg

SEQ ID NO: 996912 - RNA, 22 nt, Human
uccuggagaauccugccaccug

SEQ ID NO: 996913 - RNA, 22 nt, Human
uggggcugugagacuacaggau

SEQ ID NO: 996914 - RNA, 22 nt, Human
ggucaggggcugcucuacagag

SEQ ID NO: 996915 - RNA, 22 nt, Human
gggcccuggacguggcggcaga

SEQ ID NO: 996916 - RNA, 22 nt, Human
ccuccaggcugaauaucuagaa

SEQ ID NO: 996917 - RNA, 22 nt, Human
ccugaggggcugcaggccagcu

SEQ ID NO: 996918 - RNA, 22 nt, Human
caagggcuucaaguggccaaga

SEQ ID NO: 996919 - RNA, 23 nt, Human
gccugggacucaggaggagcuca

SEQ ID NO: 996920 - RNA, 22 nt, Human
gaaaaaugagcugaugucaggg

SEQ ID NO: 996921 - RNA, 19 nt, Human
ccugggaggcggagguugc

SEQ ID NO: 996922 - RNA, 22 nt, Human
uggcagagagagugcagucgac

SEQ ID NO: 996923 - RNA, 22 nt, Human
agagauaugaguaguugugaca

SEQ ID NO: 996924 - RNA, 22 nt, Human
uguguauucagcaagcgaaaca

SEQ ID NO: 996925 - RNA, 22 nt, Human
acaaacuaccuacagauguuca

SEQ ID NO: 996926 - RNA, 22 nt, Human
ccagaaaaugcagaacauagaa

SEQ ID NO: 996927 - RNA, 22 nt, Human
gccaggugggagacagacagca

SEQ ID NO: 996928 - RNA, 22 nt, Human
gccuugccucagccauggaaac

SEQ ID NO: 996929 - RNA, 22 nt, Human
auuauguagguuaggugguugu

SEQ ID NO: 996930 - RNA, 18 nt, Human
cugaaggauccaggugua

SEQ ID NO: 996931 - RNA, 19 nt, Human
uuucuuaggccuuuggccu

SEQ ID NO: 996932 - RNA, 22 nt, Human
aggcugcuucagcugcagggag

SEQ ID NO: 996933 - RNA, 22 nt, Human
cugcagcuccccugagaucaag

SEQ ID NO: 996934 - RNA, 22 nt, Human
ugaggugaagaguggagcucag

SEQ ID NO: 996935 - RNA, 22 nt, Human
uuuaguagaugcagcauuauuu

SEQ ID NO: 996936 - RNA, 22 nt, Human
ggccacuccgcugcuacuggaa

SEQ ID NO: 996937 - RNA, 22 nt, Human
gcaguggcaccgcuggcucugg

SEQ ID NO: 996938 - RNA, 17 nt, Human
cagugcagagcccuuuc

SEQ ID NO: 996939 - RNA, 22 nt, Human
gcaggagccaggccgagcuggu

SEQ ID NO: 996940 - RNA, 22 nt, Human
uuuuuccuuggaugugucucuc

SEQ ID NO: 996941 - RNA, 22 nt, Human
ugguccagacauuucugaggua

SEQ ID NO: 996942 - RNA, 22 nt, Human
cacugaaggacaguaggaaggg

SEQ ID NO: 996943 - RNA, 22 nt, Human
aagggagguaaagcuauuuaaa

SEQ ID NO: 996944 - RNA, 22 nt, Human
cucugucccagacccaccucuc

SEQ ID NO: 996945 - RNA, 21 nt, Human
gccagagcaguacaaugaggu

SEQ ID NO: 996946 - RNA, 22 nt, Human
ucauacauaacuuguacaguga

SEQ ID NO: 996947 - RNA, 22 nt, Human
uugaaauauggauugaccuuga

SEQ ID NO: 996948 - RNA, 22 nt, Human
gccugccuucggugcgcagcgg

SEQ ID NO: 996949 - RNA, 22 nt, Human
gagcugccuacauugccaagag

SEQ ID NO: 996950 - RNA, 22 nt, Human
uccucagacuucccuuugugua

SEQ ID NO: 996951 - RNA, 22 nt, Human
acucucugguauuggcaaguuu

SEQ ID NO: 996952 - RNA, 22 nt, Human
aaugaugguuucaucacuugaa

SEQ ID NO: 996953 - RNA, 15 nt, Human
ugggcagaucacuug

SEQ ID NO: 996954 - RNA, 17 nt, Human
ucuggccuuccugaacu

SEQ ID NO: 996955 - RNA, 22 nt, Human
ugucaccucuuuggcugcagcu

SEQ ID NO: 996956 - RNA, 22 nt, Human
cugcagagguugguucuaagau

SEQ ID NO: 996957 - RNA, 22 nt, Human
cugcucuguuaauuaaacuuug

SEQ ID NO: 996958 - RNA, 22 nt, Human
uccucacagucaacacuuugag

SEQ ID NO: 996959 - RNA, 22 nt, Human
agccagacauggcuccugcucc

SEQ ID NO: 996960 - RNA, 22 nt, Human
ccagcuccugggucuuagucag

SEQ ID NO: 996961 - RNA, 19 nt, Human
cugagagaugcuucacaca

SEQ ID NO: 996962 - RNA, 22 nt, Human
agagcugaauuuggguggugga

SEQ ID NO: 996963 - RNA, 17 nt, Human
agaggcagauacuugga

SEQ ID NO: 996964 - RNA, 22 nt, Human
auaacagaugugaagugcuaau

SEQ ID NO: 996965 - RNA, 22 nt, Human
gccaggcucagcagucaaccug

SEQ ID NO: 996966 - RNA, 22 nt, Human
cuagaaaaauacuuuauuguga

SEQ ID NO: 996967 - RNA, 22 nt, Human
cugccugugccaaugcuccuuu

SEQ ID NO: 996968 - RNA, 22 nt, Human
auaucuuuguuuuugccaagau

SEQ ID NO: 996969 - RNA, 22 nt, Human
agcugccaucugaagaacugca

SEQ ID NO: 996970 - RNA, 22 nt, Human
gcuccuggcucuggccaaggga

SEQ ID NO: 996971 - RNA, 19 nt, Human
ggacacagaaagcugcauu

SEQ ID NO: 996972 - RNA, 22 nt, Human
ugaaaucuuauacuuugguagu

SEQ ID NO: 996973 - RNA, 22 nt, Human
agcaggagcccuuaucaccagg

SEQ ID NO: 996974 - RNA, 22 nt, Human
acccagagccagggucaggagc

SEQ ID NO: 996975 - RNA, 22 nt, Human
ugggccugauucuugaauccug

SEQ ID NO: 996976 - RNA, 22 nt, Human
cugaggcaugaaugugggcuuu

SEQ ID NO: 996977 - RNA, 22 nt, Human
uuagugucuucuucauccucug

SEQ ID NO: 996978 - RNA, 22 nt, Human
ugcagcagacugaguaugagaa

SEQ ID NO: 996979 - RNA, 20 nt, Human
cagggccacgcuccaaggca

SEQ ID NO: 996980 - RNA, 22 nt, Human
ccaaggagaaugacaccaugga

SEQ ID NO: 996981 - RNA, 22 nt, Human
gggcugcugcugccagcgacac

SEQ ID NO: 996982 - RNA, 22 nt, Human
aggaccugacuggcuccugcuu

SEQ ID NO: 996983 - RNA, 22 nt, Human
caaagugcugagauuacaggua

SEQ ID NO: 996984 - RNA, 22 nt, Human
ccagagaccagaacauggggau

SEQ ID NO: 996985 - RNA, 22 nt, Human
caguggcaugguugacugcagu

SEQ ID NO: 996986 - RNA, 22 nt, Human
aggggugaaagagggcccucaa

SEQ ID NO: 996987 - RNA, 22 nt, Human
cacucugcaggccaaaccaaag

SEQ ID NO: 996988 - RNA, 22 nt, Human
cugagccaaccacagcaggagc

SEQ ID NO: 996989 - RNA, 22 nt, Human
agagccugaggccaggaaaaug

SEQ ID NO: 996990 - RNA, 22 nt, Human
cagggugccaaagaacaaauau

SEQ ID NO: 996991 - RNA, 22 nt, Human
ggccucugaggacagccuuggc

SEQ ID NO: 996992 - RNA, 22 nt, Human
uccuugaagcuuguaucuaaua

SEQ ID NO: 996993 - RNA, 22 nt, Human
caggccugagacaucugagaua

SEQ ID NO: 996994 - RNA, 22 nt, Human
cuggccaaugccuggggaauag

SEQ ID NO: 996995 - RNA, 18 nt, Human
uggcucagauggcuuuaa

SEQ ID NO: 996996 - RNA, 22 nt, Human
cauugcacugcagcccgggcaa

SEQ ID NO: 996997 - RNA, 22 nt, Human
uacauucuggaaaggcacagac

SEQ ID NO: 996998 - RNA, 22 nt, Human
ccugugugcacacgaggccaug

SEQ ID NO: 996999 - RNA, 22 nt, Human
gaagcagcuuucuggugaggag

SEQ ID NO: 997000 - RNA, 22 nt, Human
uaagaacaguagaacaguaggu

SEQ ID NO: 997001 - RNA, 22 nt, Human
gguacaaggagugaagguuugg

SEQ ID NO: 997002 - RNA, 22 nt, Human
gcuuccuagaucugugguacuc

SEQ ID NO: 997003 - RNA, 22 nt, Human
acuucuggugucauacugcauu

SEQ ID NO: 997004 - RNA, 23 nt, Human
ccugcagcugcuggggcuccacc

SEQ ID NO: 997005 - RNA, 22 nt, Human
acacagaguauuuagaaggggu

SEQ ID NO: 997006 - RNA, 19 nt, Human
cauaauacaguggaucuga

SEQ ID NO: 997007 - RNA, 22 nt, Human
uaguuacagcaggcaggauaua

SEQ ID NO: 997008 - RNA, 18 nt, Human
ccuggcagccaugcgcgc

SEQ ID NO: 997009 - RNA, 22 nt, Human
ggcugcuguacugaugucaguu

SEQ ID NO: 997010 - RNA, 22 nt, Human
cugucaccuguucacugcagca

SEQ ID NO: 997011 - RNA, 22 nt, Human
aaauguguuugauaggaauauu

SEQ ID NO: 997012 - RNA, 22 nt, Human
gccugugcauagcagcggacuc

SEQ ID NO: 997013 - RNA, 22 nt, Human
aagcacuuagaagagugccugc

SEQ ID NO: 997014 - RNA, 22 nt, Human
ggaugcugcuaucaggcuucga

SEQ ID NO: 997015 - RNA, 22 nt, Human
gaggccugguuuccagcauccu

SEQ ID NO: 997016 - RNA, 22 nt, Human
cacaggcuugucagcaugaggc

SEQ ID NO: 997017 - RNA, 22 nt, Human
acucugcuggcugcagggcagc

SEQ ID NO: 997018 - RNA, 22 nt, Human
ggcucugggucuguggggagcg

SEQ ID NO: 997019 - RNA, 22 nt, Human
caggguagacaguaggugucug

SEQ ID NO: 997020 - RNA, 17 nt, Human
uggacccuugggccucc

SEQ ID NO: 997021 - RNA, 22 nt, Human
uauccaauucaccauugauggg

SEQ ID NO: 997022 - RNA, 22 nt, Human
gggcuggaggagauccagaggc

SEQ ID NO: 997023 - RNA, 22 nt, Human
aaaaguucccugguuagaaaag

SEQ ID NO: 997024 - RNA, 22 nt, Human
cccuccccacaaagcuucacac

SEQ ID NO: 997025 - RNA, 22 nt, Human
agauuucagguuggggcagaag

SEQ ID NO: 997026 - RNA, 22 nt, Human
acuggcaguggcagcagaaaga

SEQ ID NO: 997027 - RNA, 22 nt, Human
aaaugucugagacuucugaacu

SEQ ID NO: 997028 - RNA, 22 nt, Human
augaaagaugauuuaaaguacu

SEQ ID NO: 997029 - RNA, 22 nt, Human
gcuccagaugaaaggccagagg

SEQ ID NO: 997030 - RNA, 22 nt, Human
cagggcuggauccuccagacuc

SEQ ID NO: 997031 - RNA, 22 nt, Human
gucuuuauuugagauugucauu

SEQ ID NO: 997032 - RNA, 22 nt, Human
uggcucagugcauucacaguaa

SEQ ID NO: 997033 - RNA, 22 nt, Human
aggaaaaauaaggcagcagggc

SEQ ID NO: 997034 - RNA, 22 nt, Human
caggaggaaaugugacccugcu

SEQ ID NO: 997035 - RNA, 22 nt, Human
aguaaaaauugaggugcaaaau

SEQ ID NO: 997036 - RNA, 21 nt, Human
cuguuucuugugaagugacac

SEQ ID NO: 997037 - RNA, 22 nt, Human
aaggcacugaaaaauugugugu

SEQ ID NO: 997038 - RNA, 22 nt, Human
uaaaugcaagugcuccugggag

SEQ ID NO: 997039 - RNA, 22 nt, Human
gagcccucucuguaggcaagua

SEQ ID NO: 997040 - RNA, 22 nt, Human
aggcuccuaucgcuuucagcaa

SEQ ID NO: 997041 - RNA, 22 nt, Human
uggcucaggagggaucuuugcu

SEQ ID NO: 997042 - RNA, 22 nt, Human
ggcagauggaagaggcuggguc

SEQ ID NO: 997043 - RNA, 22 nt, Human
gaggcagcuuggggcugugggu

SEQ ID NO: 997044 - RNA, 20 nt, Human
uggcuccugcgguggaacca

SEQ ID NO: 997045 - RNA, 22 nt, Human
auacauauaugguacuuccugg

SEQ ID NO: 997046 - RNA, 22 nt, Human
ucagggcauggcugcacuuggc

SEQ ID NO: 997047 - RNA, 22 nt, Human
cugagggccuuggcuccugccc

SEQ ID NO: 997048 - RNA, 22 nt, Human
cagucucagaggugggaguggg

SEQ ID NO: 997049 - RNA, 22 nt, Human
gcugccacauuuucaggacuaa

SEQ ID NO: 997050 - RNA, 22 nt, Human
ccugucaggguuugccucagaa

SEQ ID NO: 997051 - RNA, 22 nt, Human
gagcccaggcagagguugcagu

SEQ ID NO: 997052 - RNA, 22 nt, Human
ugucacuucaggaaugcaggga

SEQ ID NO: 997053 - RNA, 22 nt, Human
cacagguggcuccaaguuagag

SEQ ID NO: 997054 - RNA, 22 nt, Human
aaaugcaauuguauguacucca

SEQ ID NO: 997055 - RNA, 22 nt, Human
cagaggccucacuuccagccag

SEQ ID NO: 997056 - RNA, 22 nt, Human
aucuucaacuugaucauuugaa

SEQ ID NO: 997057 - RNA, 22 nt, Human
agaaagaacgcacuugugcugc

SEQ ID NO: 997058 - RNA, 22 nt, Human
ucagcagugcagggugaggcag

SEQ ID NO: 997059 - RNA, 22 nt, Human
uuauuaguguugauauuaggau

SEQ ID NO: 997060 - RNA, 22 nt, Human
aggccagggucccacacucgca

SEQ ID NO: 997061 - RNA, 22 nt, Human
cuuguacauagagaagaagccu

SEQ ID NO: 997062 - RNA, 22 nt, Human
agcagccauuuaaaaugaauug

SEQ ID NO: 997063 - RNA, 22 nt, Human
ccuggagcgcgggucaagcugg

SEQ ID NO: 997064 - RNA, 22 nt, Human
ggaggccaaggcgggcggauca

SEQ ID NO: 997065 - RNA, 22 nt, Human
gggcugccuuucuucugggagc

SEQ ID NO: 997066 - RNA, 22 nt, Human
gagauggggucagcugggacau

SEQ ID NO: 997067 - RNA, 22 nt, Human
uuccaguugguagaauguaagg

SEQ ID NO: 997068 - RNA, 21 nt, Human
gcagagccggggcgagaaggc

SEQ ID NO: 997069 - RNA, 22 nt, Human
cuucugaggcagcuauucaguu

SEQ ID NO: 997070 - RNA, 22 nt, Human
aaaguuagaaugauaucaacga

SEQ ID NO: 997071 - RNA, 22 nt, Human
aaguuauaucaucucauugacg

SEQ ID NO: 997072 - RNA, 22 nt, Human
cugggcugcaucaaagaggcau

SEQ ID NO: 997073 - RNA, 22 nt, Human
gcugucugcaucucuagagcuu

SEQ ID NO: 997074 - RNA, 22 nt, Human
uggcagcacuagguacugagcu

SEQ ID NO: 997075 - RNA, 21 nt, Human
gggccuggcugcgcaggacgg

SEQ ID NO: 997076 - RNA, 22 nt, Human
cuacucugaauugaagugauau

SEQ ID NO: 997077 - RNA, 22 nt, Human
gcaccacaucaaugaggggagc

SEQ ID NO: 997078 - RNA, 22 nt, Human
uccagucaagcuugagaauuuc

SEQ ID NO: 997079 - RNA, 22 nt, Human
cugggaguugacgaggcuugua

SEQ ID NO: 997080 - RNA, 22 nt, Human
aaugauguauguauaaggcagg

SEQ ID NO: 997081 - RNA, 22 nt, Human
agaaaugcauuagcacauauag

SEQ ID NO: 997082 - RNA, 22 nt, Human
cauuuacuguugaaucccuagc

SEQ ID NO: 997083 - RNA, 22 nt, Human
gcucucugguuccagucaggaa

SEQ ID NO: 997084 - RNA, 22 nt, Human
accagagcuggcagaguaucaa

SEQ ID NO: 997085 - RNA, 22 nt, Human
cuuaggaugaguuuuugcguuu

SEQ ID NO: 997086 - RNA, 22 nt, Human
uucacaggaggguggaugcaug

SEQ ID NO: 997087 - RNA, 22 nt, Human
gguuugcauucugaaaggcuca

SEQ ID NO: 997088 - RNA, 22 nt, Human
gcaguaaaaaaggauaugugca

SEQ ID NO: 997089 - RNA, 22 nt, Human
gagcagcuguccccaaagcuuc

SEQ ID NO: 997090 - RNA, 22 nt, Human
uuuuaaguuaauauaauugagg

SEQ ID NO: 997091 - RNA, 22 nt, Human
guccuggggauuauagaguguu

SEQ ID NO: 997092 - RNA, 22 nt, Human
aggagcagaacuguuguggagg

SEQ ID NO: 997093 - RNA, 22 nt, Human
agcagcaggagccgugggguga

SEQ ID NO: 997094 - RNA, 22 nt, Human
ccaaaguccauaguuuacuuua

SEQ ID NO: 997095 - RNA, 22 nt, Human
cacucugagccaaaacuaauuc

SEQ ID NO: 997096 - RNA, 22 nt, Human
uuggccaauccuauuggguggg

SEQ ID NO: 997097 - RNA, 22 nt, Human
uggcucaggaucuaagcagaau

SEQ ID NO: 997098 - RNA, 22 nt, Human
ccagagcuucggggcggcugua

SEQ ID NO: 997099 - RNA, 22 nt, Human
gagguagcaugcuggaagggac

SEQ ID NO: 997100 - RNA, 22 nt, Human
ucugagaggauuccugucccga

SEQ ID NO: 997101 - RNA, 22 nt, Human
uggcucagagcagggacucugg

SEQ ID NO: 997102 - RNA, 22 nt, Human
cauugcuuugugcauauuuaaa

SEQ ID NO: 997103 - RNA, 22 nt, Human
caugagcugcugggagccuguc

SEQ ID NO: 997104 - RNA, 20 nt, Human
uuucacaaugaacaugucuc

SEQ ID NO: 997105 - RNA, 22 nt, Human
aagcagccagccaucaugcccg

SEQ ID NO: 997106 - RNA, 22 nt, Human
ggcacugacugugcagcgcacc

SEQ ID NO: 997107 - RNA, 22 nt, Human
uuuuauuggagugauaccaagc

SEQ ID NO: 997108 - RNA, 18 nt, Human
aggaagcaggaggaaggc

SEQ ID NO: 997109 - RNA, 22 nt, Human
ccugaggcccuggcugugcuga

SEQ ID NO: 997110 - RNA, 22 nt, Human
uaauuauaacaguuacaucuua

SEQ ID NO: 997111 - RNA, 22 nt, Human
uggagggcaucuguggucaggc

SEQ ID NO: 997112 - RNA, 22 nt, Human
auuugucugcuugcugccuucc

SEQ ID NO: 997113 - RNA, 22 nt, Human
uccuucagaaaaccucagucuu

SEQ ID NO: 997114 - RNA, 22 nt, Human
agggggcaggagagaccugcug

SEQ ID NO: 997115 - RNA, 22 nt, Human
acacaggggcucggcugggugc

SEQ ID NO: 997116 - RNA, 23 nt, Human
ucugggccacuugucugcacuuc

SEQ ID NO: 997117 - RNA, 22 nt, Human
gcacccagaggucagcagugcu

SEQ ID NO: 997118 - RNA, 22 nt, Human
ugggcuggcugaggcauucacu

SEQ ID NO: 997119 - RNA, 22 nt, Human
cugggggcaagcagacagcugu

SEQ ID NO: 997120 - RNA, 22 nt, Human
gaugguuugguaaaaguauguu

SEQ ID NO: 997121 - RNA, 22 nt, Human
ggcccacuugaaauggagcuca

SEQ ID NO: 997122 - RNA, 22 nt, Human
ugucucugugagaucugacgau

SEQ ID NO: 997123 - RNA, 22 nt, Human
gcucccaggaugaggagccagg

SEQ ID NO: 997124 - RNA, 22 nt, Human
cagcaggcucugaguggcugcc

SEQ ID NO: 997125 - RNA, 22 nt, Human
guguauaacuaucuaucuagua

SEQ ID NO: 997126 - RNA, 22 nt, Human
aagccaagaguuaacuauuugu

SEQ ID NO: 997127 - RNA, 22 nt, Human
cagcuugcuaauuuugacuuca

SEQ ID NO: 997128 - RNA, 22 nt, Human
ucccagagccaagcuauggaug

SEQ ID NO: 997129 - RNA, 22 nt, Human
auacauguuguaccauauguuu

SEQ ID NO: 997130 - RNA, 22 nt, Human
aaaucaguuaagaugaggccau

SEQ ID NO: 997131 - RNA, 22 nt, Human
cuauugaaaguguacaauucaa

SEQ ID NO: 997132 - RNA, 22 nt, Human
gagcaggcauucuaguggcuga

SEQ ID NO: 997133 - RNA, 22 nt, Human
ugcaguggaaagacucagacuu

SEQ ID NO: 997134 - RNA, 22 nt, Human
ugcaccuuguugcuuuuacgaa

SEQ ID NO: 997135 - RNA, 22 nt, Human
uuauuuggaaauauggcuucug

SEQ ID NO: 997136 - RNA, 22 nt, Human
uggccucucuaccaggcagccu

SEQ ID NO: 997137 - RNA, 22 nt, Human
uuguuuugcuaaagggucauca

SEQ ID NO: 997138 - RNA, 22 nt, Human
guaacugaggcagcuuuuaaga

SEQ ID NO: 997139 - RNA, 22 nt, Human
ugcaggcaggggaugagcagcc

SEQ ID NO: 997140 - RNA, 22 nt, Human
agugaaaacacuaguucuugcc

SEQ ID NO: 997141 - RNA, 22 nt, Human
ugggccugggagggcagacgcu

SEQ ID NO: 997142 - RNA, 22 nt, Human
cacagcagagggagccauugaa

SEQ ID NO: 997143 - RNA, 22 nt, Human
aagaacauuuaugauggcauuu

SEQ ID NO: 997144 - RNA, 22 nt, Human
uuuccucugacugcuccccugc

SEQ ID NO: 997145 - RNA, 22 nt, Human
gagcugugagggacacauugcu

SEQ ID NO: 997146 - RNA, 22 nt, Human
ggguccagaguugaagagguua

SEQ ID NO: 997147 - RNA, 22 nt, Human
ugcucugcaagcaggagcaaga

SEQ ID NO: 997148 - RNA, 22 nt, Human
gcucccagcaauugaggcagcc

SEQ ID NO: 997149 - RNA, 22 nt, Human
gucucagggacugcuucugggg

SEQ ID NO: 997150 - RNA, 22 nt, Human
aguccaggaguugggugacauu

SEQ ID NO: 997151 - RNA, 22 nt, Human
uuagugauaggaagccagauug

SEQ ID NO: 997152 - RNA, 22 nt, Human
ucagaggagaaguugggaaaau

SEQ ID NO: 997153 - RNA, 22 nt, Human
cuggcagcccaaccuagagucu

SEQ ID NO: 997154 - RNA, 22 nt, Human
uacauaguauucacauuguuuu

SEQ ID NO: 997155 - RNA, 22 nt, Human
ggcccagccggcgagucucgcg

SEQ ID NO: 997156 - RNA, 22 nt, Human
agcucauggugcuaucucaggg

SEQ ID NO: 997157 - RNA, 22 nt, Human
gcaguggcaugaugugggcuca

SEQ ID NO: 997158 - RNA, 22 nt, Human
ggcagaguggagugcggccucc

SEQ ID NO: 997159 - RNA, 22 nt, Human
ggucccaggauugguugcgcag

SEQ ID NO: 997160 - RNA, 22 nt, Human
gcucugggcugcccucuggaca

SEQ ID NO: 997161 - RNA, 22 nt, Human
cucaggcccacagcagacccac

SEQ ID NO: 997162 - RNA, 22 nt, Human
gcuggccugaccugaggcuggg

SEQ ID NO: 997163 - RNA, 22 nt, Human
ucagagugugacuuggucauga

SEQ ID NO: 997164 - RNA, 22 nt, Human
acagaauacuacagacugguua

SEQ ID NO: 997165 - RNA, 22 nt, Human
guggagccaggaucuccgcaca

SEQ ID NO: 997166 - RNA, 22 nt, Human
cgucccaguuccagccgcgcug

SEQ ID NO: 997167 - RNA, 22 nt, Human
gaugcugaagugaagugaucuu

SEQ ID NO: 997168 - RNA, 22 nt, Human
ugcuggcccaugaagacgcagu

SEQ ID NO: 997169 - RNA, 22 nt, Human
cauugcaccacauugcaucccu

SEQ ID NO: 997170 - RNA, 22 nt, Human
ccugggaguggcacucacagca

SEQ ID NO: 997171 - RNA, 22 nt, Human
aaggcugaggagggccugcagg

SEQ ID NO: 997172 - RNA, 22 nt, Human
auuguauuuccagcuugaaugu

SEQ ID NO: 997173 - RNA, 22 nt, Human
aggauccuccuuagaaaagacc

SEQ ID NO: 997174 - RNA, 17 nt, Human
ucuccuggcucuaucag

SEQ ID NO: 997175 - RNA, 22 nt, Human
ucagagugugagacauauugga

SEQ ID NO: 997176 - RNA, 22 nt, Human
gaggccuggucuaugagauguu

SEQ ID NO: 997177 - RNA, 19 nt, Human
cccaaggcccugggcaggc

SEQ ID NO: 997178 - RNA, 22 nt, Human
aucaguuuaacugucaagagcc

SEQ ID NO: 997179 - RNA, 22 nt, Human
gaaggagagggucaaggauaau

SEQ ID NO: 997180 - RNA, 22 nt, Human
ugaaggaaagagggaacauccc

SEQ ID NO: 997181 - RNA, 22 nt, Human
uuuguuuucaaugugucauuca

SEQ ID NO: 997182 - RNA, 22 nt, Human
ggcucaggccuguaauccuagc

SEQ ID NO: 997183 - RNA, 22 nt, Human
aaggccugaacaugaggagaug

SEQ ID NO: 997184 - RNA, 22 nt, Human
ugaaggagcucaaugaugaugc

SEQ ID NO: 997185 - RNA, 22 nt, Human
ugcauuguuuagaacucuuugg

SEQ ID NO: 997186 - RNA, 22 nt, Human
auggccaagcuuacucuguugu

SEQ ID NO: 997187 - RNA, 22 nt, Human
cacacauugaauucauucuugu

SEQ ID NO: 997188 - RNA, 22 nt, Human
uaaaugcaguacaaauuguucu

SEQ ID NO: 997189 - RNA, 22 nt, Human
ccuccuggugacaaggcaaagc

SEQ ID NO: 997190 - RNA, 22 nt, Human
ugggcacaggggaauggaugaa

SEQ ID NO: 997191 - RNA, 19 nt, Human
acccucucagugccugagg

SEQ ID NO: 997192 - RNA, 20 nt, Human
cuuccacacaagaagcacag

SEQ ID NO: 997193 - RNA, 20 nt, Human
gccuggcacccggggcuggc

SEQ ID NO: 997194 - RNA, 22 nt, Human
acauuugaggauguuaagaaug

SEQ ID NO: 997195 - RNA, 23 nt, Human
uggcucugugucacauacaggau

SEQ ID NO: 997196 - RNA, 22 nt, Human
ccugccagcauggcuuaucucc

SEQ ID NO: 997197 - RNA, 22 nt, Human
uggcucaguuccaucaucugga

SEQ ID NO: 997198 - RNA, 20 nt, Human
auuccauaguuggcacuuuu

SEQ ID NO: 997199 - RNA, 23 nt, Human
gagugcagaauagacaugcagug

SEQ ID NO: 997200 - RNA, 22 nt, Human
ugcaugcugcacacaugcguag

SEQ ID NO: 997201 - RNA, 22 nt, Human
aaaagagugacugauaaguaua

SEQ ID NO: 997202 - RNA, 22 nt, Human
ugcuuuuaagaacaaugcugcu

SEQ ID NO: 997203 - RNA, 22 nt, Human
gggcugagggguaucucauggg

SEQ ID NO: 997204 - RNA, 22 nt, Human
cugggccagaccuuguggucuu

SEQ ID NO: 997205 - RNA, 22 nt, Human
auugacaaucuacuauguucug

SEQ ID NO: 997206 - RNA, 22 nt, Human
aauaugcauguauacaugugua

SEQ ID NO: 997207 - RNA, 22 nt, Human
uacucugcaaguugaagguggc

SEQ ID NO: 997208 - RNA, 22 nt, Human
acagagaugcaaguguguauuu

SEQ ID NO: 997209 - RNA, 22 nt, Human
uuccuccacgugacaggagcca

SEQ ID NO: 997210 - RNA, 22 nt, Human
auuguggcuagacagucacaau

SEQ ID NO: 997211 - RNA, 22 nt, Human
aggagcuguuuuguucagcaaa

SEQ ID NO: 997212 - RNA, 22 nt, Human
uugaggagcaggaugggaggcu

SEQ ID NO: 997213 - RNA, 22 nt, Human
gagcugccggcccacaguacua

SEQ ID NO: 997214 - RNA, 23 nt, Human
agagcuuucuaaaauguaaaucu

SEQ ID NO: 997215 - RNA, 22 nt, Human
aagcaaaagguuacacuucugg

SEQ ID NO: 997216 - RNA, 22 nt, Human
uguuccaucaguuuuugguuga

SEQ ID NO: 997217 - RNA, 22 nt, Human
auacaugucaucauauguuugu

SEQ ID NO: 997218 - RNA, 21 nt, Human
ugugucacuaacuagaggcua

SEQ ID NO: 997219 - RNA, 22 nt, Human
agcugagcucaggcugauguaa

SEQ ID NO: 997220 - RNA, 22 nt, Human
caggcagaagaaguggaaggac

SEQ ID NO: 997221 - RNA, 22 nt, Human
aaguucaaucagaugaaaaagc

SEQ ID NO: 997222 - RNA, 20 nt, Human
ggguggaguugcggucugug

SEQ ID NO: 997223 - RNA, 22 nt, Human
cagugucuccagaugcuccaau

SEQ ID NO: 997224 - RNA, 22 nt, Human
acuggcagccacaacuggcagg

SEQ ID NO: 997225 - RNA, 22 nt, Human
ggcugccucaaagcucaagcuc

SEQ ID NO: 997226 - RNA, 22 nt, Human
agggcccauagaucgucagcuu

SEQ ID NO: 997227 - RNA, 22 nt, Human
aaaaaugaauucuucaguggca

SEQ ID NO: 997228 - RNA, 22 nt, Human
cccaaggcugcagugagcauga

SEQ ID NO: 997229 - RNA, 22 nt, Human
ccagcccugucaccaacuggag

SEQ ID NO: 997230 - RNA, 22 nt, Human
gcccagcaccucucucaggguu

SEQ ID NO: 997231 - RNA, 22 nt, Human
cagccugcuagggcaaugccuu

SEQ ID NO: 997232 - RNA, 23 nt, Human
gcucugagggcuuaucccuccca

SEQ ID NO: 997233 - RNA, 21 nt, Human
uuauugagacauuuguggaaa

SEQ ID NO: 997234 - RNA, 22 nt, Human
ugguccagaugccuuggcuuua

SEQ ID NO: 997235 - RNA, 22 nt, Human
aauaauuagugggacagagaac

SEQ ID NO: 997236 - RNA, 22 nt, Human
ugucuucaucuccaugcacaga

SEQ ID NO: 997237 - RNA, 22 nt, Human
cagacaggaauucuggcguggu

SEQ ID NO: 997238 - RNA, 22 nt, Human
aaaaauaggucaaccguguaug

SEQ ID NO: 997239 - RNA, 21 nt, Human
uaaaugugagcagggcugggc

SEQ ID NO: 997240 - RNA, 22 nt, Human
agcaguggcugaagauguuccu

SEQ ID NO: 997241 - RNA, 23 nt, Human
aacuccugaaucgugagccaucu

SEQ ID NO: 997242 - RNA, 22 nt, Human
cacuguguaagaagaugggcuu

SEQ ID NO: 997243 - RNA, 22 nt, Human
ggcacugagcugccuuggggca

SEQ ID NO: 997244 - RNA, 22 nt, Human
gacagaguuguugauguaugcu

SEQ ID NO: 997245 - RNA, 22 nt, Human
cccuggaggagcuuagagcuug

SEQ ID NO: 997246 - RNA, 22 nt, Human
cuucuuuccuuccuccaguggc

SEQ ID NO: 997247 - RNA, 22 nt, Human
aucuacaggcugaggugggagg

SEQ ID NO: 997248 - RNA, 17 nt, Human
acuccuggucugaaggg

SEQ ID NO: 997249 - RNA, 22 nt, Human
ccuggcagcaggugggcccgug

SEQ ID NO: 997250 - RNA, 22 nt, Human
gugccuuccccgguggucuguu

SEQ ID NO: 997251 - RNA, 22 nt, Human
auaaacacuucuagggcacaca

SEQ ID NO: 997252 - RNA, 22 nt, Human
gcugcagcuguaggacacaauu

SEQ ID NO: 997253 - RNA, 22 nt, Human
uuuccucuucuggcaggcaggg

SEQ ID NO: 997254 - RNA, 22 nt, Human
gcucagggaacuuuuugcaggc

SEQ ID NO: 997255 - RNA, 22 nt, Human
cagggcuggcuguggcaaucuc

SEQ ID NO: 997256 - RNA, 22 nt, Human
cucuggcuuugcucaugcaucc

SEQ ID NO: 997257 - RNA, 19 nt, Human
cugccuguuauggagagaa

SEQ ID NO: 997258 - RNA, 22 nt, Human
agcagggcagugcuucagcucu

SEQ ID NO: 997259 - RNA, 19 nt, Human
ugagugggccccugcagac

SEQ ID NO: 997260 - RNA, 22 nt, Human
ggcugagccuggagcaucuggu

SEQ ID NO: 997261 - RNA, 22 nt, Human
uugugaaauguuucaaaauagu

SEQ ID NO: 997262 - RNA, 22 nt, Human
gaugauuuuaugucuugucauu

SEQ ID NO: 997263 - RNA, 22 nt, Human
cagcagccuacaaugcacagaa

SEQ ID NO: 997264 - RNA, 22 nt, Human
agcagaacauuuucagggcugu

SEQ ID NO: 997265 - RNA, 22 nt, Human
gucaucuuugcccugugcagga

SEQ ID NO: 997266 - RNA, 22 nt, Human
uuuccuucaucaucugagagcu

SEQ ID NO: 997267 - RNA, 22 nt, Human
auuagcugaccucuaaggagcc

SEQ ID NO: 997268 - RNA, 22 nt, Human
accaggggaugguuggcacugu

SEQ ID NO: 997269 - RNA, 22 nt, Human
cucaggaggugguagaggcccu

SEQ ID NO: 997270 - RNA, 22 nt, Human
ggaaagagcccagcagugcuug

SEQ ID NO: 997271 - RNA, 22 nt, Human
agcagccacccagcugcucauu

SEQ ID NO: 997272 - RNA, 22 nt, Human
ugcagccuugccuccucccagc

SEQ ID NO: 997273 - RNA, 22 nt, Human
gaugggaggaaccugggucccu

SEQ ID NO: 997274 - RNA, 22 nt, Human
cuugaaagauuuggccucugug

SEQ ID NO: 997275 - RNA, 22 nt, Human
aagaaucauccugcaagagucu

SEQ ID NO: 997276 - RNA, 22 nt, Human
guacuucccugggaggcaagca

SEQ ID NO: 997277 - RNA, 22 nt, Human
uguggccucaaggcugcccuca

SEQ ID NO: 997278 - RNA, 22 nt, Human
ugcagaguaaaagcagaugcua

SEQ ID NO: 997279 - RNA, 22 nt, Human
agccuguggaucccugcacugg

SEQ ID NO: 997280 - RNA, 23 nt, Human
uugaaagguagcuggcagcuaga

SEQ ID NO: 997281 - RNA, 22 nt, Human
agcugucuccagauacaggauu

SEQ ID NO: 997282 - RNA, 22 nt, Human
cggcagagacggcgcuuugaac

SEQ ID NO: 997283 - RNA, 22 nt, Human
ggcucaggagaggggcuaaaag

SEQ ID NO: 997284 - RNA, 22 nt, Human
gcagccaggaaagcuggacccu

SEQ ID NO: 997285 - RNA, 22 nt, Human
aaaggucauugaaaaggaggaa

SEQ ID NO: 997286 - RNA, 22 nt, Human
gagcucauucauucauugccug

SEQ ID NO: 997287 - RNA, 22 nt, Human
cagacuggccacaucugcacug

SEQ ID NO: 997288 - RNA, 22 nt, Human
cagcagagcugugugggaaggg

SEQ ID NO: 997289 - RNA, 22 nt, Human
acucuugucucaacuuuuguau

SEQ ID NO: 997290 - RNA, 22 nt, Human
gcuggcucagggacuagaguuu

SEQ ID NO: 997291 - RNA, 22 nt, Human
gagccucguggcggccacugcg

SEQ ID NO: 997292 - RNA, 22 nt, Human
ucaaacuagccugacugguauu

SEQ ID NO: 997293 - RNA, 22 nt, Human
ggccaaaugaaaucugagcaau

SEQ ID NO: 997294 - RNA, 22 nt, Human
acaaagugcacaagaugagaac

SEQ ID NO: 997295 - RNA, 22 nt, Human
agcagcucaaagccugcaagga

SEQ ID NO: 997296 - RNA, 22 nt, Human
agaugagggguagaaaggacuu

SEQ ID NO: 997297 - RNA, 22 nt, Human
accuggcaugaagcaugccuua

SEQ ID NO: 997298 - RNA, 22 nt, Human
cagcuucucagaaagcugaggu

SEQ ID NO: 997299 - RNA, 22 nt, Human
ggaugcugggagacagcaggca

SEQ ID NO: 997300 - RNA, 22 nt, Human
agcauuuaggagaauuugagaa

SEQ ID NO: 997301 - RNA, 22 nt, Human
gcuggccucaucacugacuucu

SEQ ID NO: 997302 - RNA, 22 nt, Human
gcugagaguguaggauguuuac

SEQ ID NO: 997303 - RNA, 22 nt, Human
gcugucugucucugucccacca

SEQ ID NO: 997304 - RNA, 22 nt, Human
ugcuggaggccugacuguguuu

SEQ ID NO: 997305 - RNA, 22 nt, Human
uuugcauuauauuuauagaaga

SEQ ID NO: 997306 - RNA, 22 nt, Human
acagagcaguucuggagcuggc

SEQ ID NO: 997307 - RNA, 22 nt, Human
uccuugaauauaauaacaguag

SEQ ID NO: 997308 - RNA, 22 nt, Human
cauuagaagaacaguuauauua

SEQ ID NO: 997309 - RNA, 22 nt, Human
uggcacugggacagaugcucuc

SEQ ID NO: 997310 - RNA, 22 nt, Human
gccuggagcucggcugagggcg

SEQ ID NO: 997311 - RNA, 22 nt, Human
aaaggucagacuuaggcugggc

SEQ ID NO: 997312 - RNA, 22 nt, Human
uuuauuauucucuggagaaugu

SEQ ID NO: 997313 - RNA, 22 nt, Human
ucccuggcuguguucaggugcg

SEQ ID NO: 997314 - RNA, 22 nt, Human
gucauggaggauugugaguggu

SEQ ID NO: 997315 - RNA, 22 nt, Human
cagcuuugauucuuucugccau

SEQ ID NO: 997316 - RNA, 22 nt, Human
uugcucuguaauaaucuggggu

SEQ ID NO: 997317 - RNA, 22 nt, Human
aagacagagggaagcaaugaug

SEQ ID NO: 997318 - RNA, 22 nt, Human
ugucccagacauaaguggacau

SEQ ID NO: 997319 - RNA, 20 nt, Human
cuggguggcaagcaaggggg

SEQ ID NO: 997320 - RNA, 22 nt, Human
ugcucuguauucuauggcaguu

SEQ ID NO: 997321 - RNA, 22 nt, Human
cauuuagagucuugcaauuuua

SEQ ID NO: 997322 - RNA, 22 nt, Human
ccucaggcuuacgggcaaugga

SEQ ID NO: 997323 - RNA, 22 nt, Human
ucagagugcagcgggaggcugg

SEQ ID NO: 997324 - RNA, 22 nt, Human
ucuuuacaucacaauuguaugg

SEQ ID NO: 997325 - RNA, 22 nt, Human
acagggcauuuccucuaugugu

SEQ ID NO: 997326 - RNA, 22 nt, Human
ggcugccugcuccuccugcacg

SEQ ID NO: 997327 - RNA, 22 nt, Human
gcucugaggcugugaggugcug

SEQ ID NO: 997328 - RNA, 22 nt, Human
caaaguuaucaacugcaacauu

SEQ ID NO: 997329 - RNA, 22 nt, Human
acagggcagguggcuacugguc

SEQ ID NO: 997330 - RNA, 22 nt, Human
aggcugaggcagguggaucacc

SEQ ID NO: 997331 - RNA, 22 nt, Human
caaguaugagaaagcuauuacc

SEQ ID NO: 997332 - RNA, 22 nt, Human
agugaccauuuucagcuagagg

SEQ ID NO: 997333 - RNA, 22 nt, Human
caaaaguaaucguggcuuuugc

SEQ ID NO: 997334 - RNA, 22 nt, Human
ugggacagagugagcuuuggcc

SEQ ID NO: 997335 - RNA, 22 nt, Human
guaaauaacugguaauuggggu

SEQ ID NO: 997336 - RNA, 22 nt, Human
uuaugacaggaaaaucacagaa

SEQ ID NO: 997337 - RNA, 22 nt, Human
ugcaggugaaaauuaugaggau

SEQ ID NO: 997338 - RNA, 22 nt, Human
gggagcuguaguccagauaccg

SEQ ID NO: 997339 - RNA, 22 nt, Human
uagggcaguuucauguuaucuu

SEQ ID NO: 997340 - RNA, 22 nt, Human
cacagggcagugcugcccacuc

SEQ ID NO: 997341 - RNA, 22 nt, Human
cagugcagccaaggacaggcac

SEQ ID NO: 997342 - RNA, 22 nt, Human
agagccugugauugucaucacc

SEQ ID NO: 997343 - RNA, 22 nt, Human
uagagaaaagcagggaucagga

SEQ ID NO: 997344 - RNA, 22 nt, Human
ggccucggcccacugcugcggu

SEQ ID NO: 997345 - RNA, 22 nt, Human
guggguggaggcgucgagggca

SEQ ID NO: 997346 - RNA, 22 nt, Human
gcugggcagccccuacagagag

SEQ ID NO: 997347 - RNA, 22 nt, Human
acagcagcacuauugacauuuu

SEQ ID NO: 997348 - RNA, 22 nt, Human
auucuggauuaucaguccacca

SEQ ID NO: 997349 - RNA, 22 nt, Human
cagccuuuaagcuuggauaggu

SEQ ID NO: 997350 - RNA, 22 nt, Human
aaaucaguuagugguaggauug

SEQ ID NO: 997351 - RNA, 22 nt, Human
uccucaggaugugggguagaau

SEQ ID NO: 997352 - RNA, 22 nt, Human
uacaaacuuguuuuaaguaagu

SEQ ID NO: 997353 - RNA, 22 nt, Human
ggagcuguaacgagccauugcu

SEQ ID NO: 997354 - RNA, 22 nt, Human
guuaggauguggggacuuuggg

SEQ ID NO: 997355 - RNA, 22 nt, Human
ugggugaggaugaugaggcagc

SEQ ID NO: 997356 - RNA, 22 nt, Human
uaagucauaagucaugauguua

SEQ ID NO: 997357 - RNA, 20 nt, Human
cuuuggcaaugagaacaggg

SEQ ID NO: 997358 - RNA, 22 nt, Human
ucacguuuuacugagugagaua

SEQ ID NO: 997359 - RNA, 22 nt, Human
ggcugcuucucacucauuugca

SEQ ID NO: 997360 - RNA, 22 nt, Human
cuaagccacucaaaucuugugg

SEQ ID NO: 997361 - RNA, 22 nt, Human
ugacauaaguugguagaaagga

SEQ ID NO: 997362 - RNA, 22 nt, Human
aacagcagggggaccugcuggu

SEQ ID NO: 997363 - RNA, 22 nt, Human
uuauuagguuauucucuguacu

SEQ ID NO: 997364 - RNA, 22 nt, Human
agggcugccugcucugcauuga

SEQ ID NO: 997365 - RNA, 21 nt, Human
aggcucagagaucaaacagua

SEQ ID NO: 997366 - RNA, 22 nt, Human
auguuacacauaggcauaaaug

SEQ ID NO: 997367 - RNA, 22 nt, Human
uccuggaggcaaaugaagacuc

SEQ ID NO: 997368 - RNA, 22 nt, Human
aggccuggccccaguugcuagg

SEQ ID NO: 997369 - RNA, 22 nt, Human
cccugcugucaggugcugggag

SEQ ID NO: 997370 - RNA, 22 nt, Human
acaguaauaaguguuggugagg

SEQ ID NO: 997371 - RNA, 22 nt, Human
aggccugagguuccugugcuca

SEQ ID NO: 997372 - RNA, 22 nt, Human
ccuccuggauggauuuggugga

SEQ ID NO: 997373 - RNA, 22 nt, Human
uucuugauuucaugcaguuaag

SEQ ID NO: 997374 - RNA, 22 nt, Human
uaaaugauaauaaugcuagugu

SEQ ID NO: 997375 - RNA, 19 nt, Human
uggcuucuguuuucauguu

SEQ ID NO: 997376 - RNA, 22 nt, Human
gcucuggaagcaucugagagga

SEQ ID NO: 997377 - RNA, 22 nt, Human
uuauguagcagaaagauguuug

SEQ ID NO: 997378 - RNA, 22 nt, Human
aggcacuggucuaccccuuagu

SEQ ID NO: 997379 - RNA, 22 nt, Human
ucuagaaacaugacauugaucu

SEQ ID NO: 997380 - RNA, 22 nt, Human
gaaggaaaggucucaugccuuu

SEQ ID NO: 997381 - RNA, 22 nt, Human
acauuucuaguuguucaucucc

SEQ ID NO: 997382 - RNA, 22 nt, Human
ccagcuccaggacugggagcug

SEQ ID NO: 997383 - RNA, 22 nt, Human
agccuggaccaggggccucaga

SEQ ID NO: 997384 - RNA, 22 nt, Human
cagccugggcuccagagucccu

SEQ ID NO: 997385 - RNA, 22 nt, Human
ggucucagcccucgccagcagc

SEQ ID NO: 997386 - RNA, 22 nt, Human
uugaaaggaauacagaggccua

SEQ ID NO: 997387 - RNA, 22 nt, Human
agaccagcugccucccagggcc

SEQ ID NO: 997388 - RNA, 22 nt, Human
acaggcugcugagccauuugcu

SEQ ID NO: 997389 - RNA, 22 nt, Human
auuucacucuuaauugcuuccu

SEQ ID NO: 997390 - RNA, 22 nt, Human
uaguuauuauuguuacuaucag

SEQ ID NO: 997391 - RNA, 22 nt, Human
ucagcuggcaguucagaggcug

SEQ ID NO: 997392 - RNA, 22 nt, Human
gaacagcuucuugggagcuggg

SEQ ID NO: 997393 - RNA, 20 nt, Human
ugcagggcugccucccagcu

SEQ ID NO: 997394 - RNA, 22 nt, Human
cugaagagcucuccuguccccu

SEQ ID NO: 997395 - RNA, 22 nt, Human
aaaagggacuacucucagcucc

SEQ ID NO: 997396 - RNA, 22 nt, Human
aggggagaguuaaugugaaugu

SEQ ID NO: 997397 - RNA, 22 nt, Human
gguuugcacgauauuuccaugg

SEQ ID NO: 997398 - RNA, 22 nt, Human
auccagggauaaaaguaagguu

SEQ ID NO: 997399 - RNA, 22 nt, Human
ggauccuucuuugaccucacag

SEQ ID NO: 997400 - RNA, 22 nt, Human
gcauuuagcuuuaaaauauuuc

SEQ ID NO: 997401 - RNA, 22 nt, Human
uggcuucaucugcagcacugcc

SEQ ID NO: 997402 - RNA, 22 nt, Human
uggcugggcccccaccugccuc

SEQ ID NO: 997403 - RNA, 22 nt, Human
accugagccuagggagguugag

SEQ ID NO: 997404 - RNA, 22 nt, Human
uuaugaaagacauuucuguugg

SEQ ID NO: 997405 - RNA, 21 nt, Human
aauaaaacaguuggugucaau

SEQ ID NO: 997406 - RNA, 22 nt, Human
uagggcagaguccaggaugggc

SEQ ID NO: 997407 - RNA, 22 nt, Human
gaggggcucuugggcaugaagg

SEQ ID NO: 997408 - RNA, 21 nt, Human
uagcacuucgcuguaauuggg

SEQ ID NO: 997409 - RNA, 22 nt, Human
gcagggaggaagagaugcuucc

SEQ ID NO: 997410 - RNA, 22 nt, Human
uuagggcuuuucugaauaggcc

SEQ ID NO: 997411 - RNA, 22 nt, Human
ugaccaaagaguugcuuguauu

SEQ ID NO: 997412 - RNA, 22 nt, Human
uguguuaacacugcaugauaau

SEQ ID NO: 997413 - RNA, 22 nt, Human
uuugugaaaugaagucacaacu

SEQ ID NO: 997414 - RNA, 22 nt, Human
aaagauuugaaauuaggcauca

SEQ ID NO: 997415 - RNA, 22 nt, Human
ucucugguggcuccaucaguag

SEQ ID NO: 997416 - RNA, 22 nt, Human
gcuuccuucuaccacaucaugc

SEQ ID NO: 997417 - RNA, 22 nt, Human
aagcugccagauucagucugcu

SEQ ID NO: 997418 - RNA, 22 nt, Human
auuuccauacacccauuucuga

SEQ ID NO: 997419 - RNA, 22 nt, Human
acagagcuucccagccugagca

SEQ ID NO: 997420 - RNA, 22 nt, Human
agcugcuaugacaacaccagcc

SEQ ID NO: 997421 - RNA, 22 nt, Human
acagcagcuaaaggugucuccu

SEQ ID NO: 997422 - RNA, 22 nt, Human
caguagcauguaauaaagacag

SEQ ID NO: 997423 - RNA, 22 nt, Human
cagagcugggaucccaugggcg

SEQ ID NO: 997424 - RNA, 22 nt, Human
ugguccaagugagguggccucu

SEQ ID NO: 997425 - RNA, 22 nt, Human
cugaggucaauuaaucaacaac

SEQ ID NO: 997426 - RNA, 22 nt, Human
acacucugcucugagcuucagg

SEQ ID NO: 997427 - RNA, 22 nt, Human
cagagccauuauggagacuugc

SEQ ID NO: 997428 - RNA, 22 nt, Human
ggccucaguuucuccauggguu

SEQ ID NO: 997429 - RNA, 21 nt, Human
ugcauuccuccauccaacagg

SEQ ID NO: 997430 - RNA, 22 nt, Human
agagccugcaucaggcuugggg

SEQ ID NO: 997431 - RNA, 22 nt, Human
aggcaggggagcuggaagggua

SEQ ID NO: 997432 - RNA, 20 nt, Human
ggcagcaggaguuuccucuu

SEQ ID NO: 997433 - RNA, 22 nt, Human
cagaguguauucugcaguugca

SEQ ID NO: 997434 - RNA, 22 nt, Human
gcucucagguacaaagcugugu

SEQ ID NO: 997435 - RNA, 22 nt, Human
aaaaaugugaccacaggguguu

SEQ ID NO: 997436 - RNA, 20 nt, Human
cuguagggugcagcaggcuc

SEQ ID NO: 997437 - RNA, 22 nt, Human
ucagggcagccuaaggcaccuc

SEQ ID NO: 997438 - RNA, 22 nt, Human
ugagcccaggaguaugaggcug

SEQ ID NO: 997439 - RNA, 22 nt, Human
aaagacugguguguuacauaua

SEQ ID NO: 997440 - RNA, 21 nt, Human
accagcaggagaucagaagga

SEQ ID NO: 997441 - RNA, 22 nt, Human
acagguggccccgagggagugg

SEQ ID NO: 997442 - RNA, 22 nt, Human
aaguccaucucugccccacaca

SEQ ID NO: 997443 - RNA, 22 nt, Human
agugaaauacugucguuuuuag

SEQ ID NO: 997444 - RNA, 22 nt, Human
uaaaguucagugcaugaaugug

SEQ ID NO: 997445 - RNA, 20 nt, Human
aggcucagcugagcucuugg

SEQ ID NO: 997446 - RNA, 22 nt, Human
acagcagagugugagauagcca

SEQ ID NO: 997447 - RNA, 22 nt, Human
aggagccaggaaaccugcucug

SEQ ID NO: 997448 - RNA, 22 nt, Human
aggcucauucuugccucugagc

SEQ ID NO: 997449 - RNA, 22 nt, Human
cauugcacuccaucuugggcaa

SEQ ID NO: 997450 - RNA, 22 nt, Human
ccagcucccugaagccuggucu

SEQ ID NO: 997451 - RNA, 22 nt, Human
caggauccuggcugcauggacg

SEQ ID NO: 997452 - RNA, 22 nt, Human
ucuccugguauguaugcaccug

SEQ ID NO: 997453 - RNA, 22 nt, Human
ucugcuguccuuuauauagauu

SEQ ID NO: 997454 - RNA, 22 nt, Human
auuauaaagaacaugugugugg

SEQ ID NO: 997455 - RNA, 22 nt, Human
uuuauguaauuucauaggugug

SEQ ID NO: 997456 - RNA, 22 nt, Human
ugggcucuccuggaggacaaca

SEQ ID NO: 997457 - RNA, 22 nt, Human
uugcuuccucgaggccagcgug

SEQ ID NO: 997458 - RNA, 22 nt, Human
gccaguuccuguggagucagag

SEQ ID NO: 997459 - RNA, 22 nt, Human
uuccuggugguggugacagcac

SEQ ID NO: 997460 - RNA, 19 nt, Human
cugcugggugcugagggag

SEQ ID NO: 997461 - RNA, 22 nt, Human
cagggucuuggcgccaucaccc

SEQ ID NO: 997462 - RNA, 21 nt, Human
uggccaaacuggagcauuuga

SEQ ID NO: 997463 - RNA, 22 nt, Human
guguaaggccccagguucuuua

SEQ ID NO: 997464 - RNA, 22 nt, Human
aauguguacuuuuucaugcuca

SEQ ID NO: 997465 - RNA, 22 nt, Human
ucagcaaugagaacuggcauuu

SEQ ID NO: 997466 - RNA, 22 nt, Human
ggcucaggggccaggccugucc

SEQ ID NO: 997467 - RNA, 22 nt, Human
guguuuccucuagaagccaugg

SEQ ID NO: 997468 - RNA, 22 nt, Human
ugcugaaacaauaacauacugg

SEQ ID NO: 997469 - RNA, 22 nt, Human
auccauggaggacaagagcaau

SEQ ID NO: 997470 - RNA, 22 nt, Human
gccacccccaaguagguggucu

SEQ ID NO: 997471 - RNA, 20 nt, Human
uggagcuccagcguccaugu

SEQ ID NO: 997472 - RNA, 23 nt, Human
uuugcaaauuggacacaaccaca

SEQ ID NO: 997473 - RNA, 22 nt, Human
gggcugggauggcuugaagauu

SEQ ID NO: 997474 - RNA, 22 nt, Human
aucaaaguuucccagaaguugu

SEQ ID NO: 997475 - RNA, 22 nt, Human
aaagcugcugccaaucaggcuu

SEQ ID NO: 997476 - RNA, 22 nt, Human
uuugcuauuuuucugugcagcu

SEQ ID NO: 997477 - RNA, 22 nt, Human
caguggcuguuucuggaaggca

SEQ ID NO: 997478 - RNA, 22 nt, Human
cuggcagcuucaggacacucgg

SEQ ID NO: 997479 - RNA, 22 nt, Human
aacucugcuuauaguuugucca

SEQ ID NO: 997480 - RNA, 22 nt, Human
uagcagggaagaugaucagaau

SEQ ID NO: 997481 - RNA, 22 nt, Human
auaugucgcuacaucauuagau

SEQ ID NO: 997482 - RNA, 22 nt, Human
uggcuggggagccccgacuccc

SEQ ID NO: 997483 - RNA, 22 nt, Human
gcucccacugcagcccugagcc

SEQ ID NO: 997484 - RNA, 22 nt, Human
caggguacagaguuuucuaaac

SEQ ID NO: 997485 - RNA, 22 nt, Human
guccucugggcuuugagcaguc

SEQ ID NO: 997486 - RNA, 22 nt, Human
ucagggcaagucucagaagguu

SEQ ID NO: 997487 - RNA, 22 nt, Human
gcacagaaguaaaauacaaguc

SEQ ID NO: 997488 - RNA, 22 nt, Human
cauggaaggcaaaagacacaga

SEQ ID NO: 997489 - RNA, 22 nt, Human
gcugccuguugaagggucugug

SEQ ID NO: 997490 - RNA, 22 nt, Human
agaggucagaacaggaaagugu

SEQ ID NO: 997491 - RNA, 22 nt, Human
uccagcagguuggucaggugca

SEQ ID NO: 997492 - RNA, 22 nt, Human
uuuuauuaguggcuagaugggg

SEQ ID NO: 997493 - RNA, 22 nt, Human
aggaguggaauuacuggguucu

SEQ ID NO: 997494 - RNA, 22 nt, Human
ucccagagcucuggagguugga

SEQ ID NO: 997495 - RNA, 22 nt, Human
uuauuagguuuacauaaagguu

SEQ ID NO: 997496 - RNA, 22 nt, Human
uuuguaaaaggaggaagcaugg

SEQ ID NO: 997497 - RNA, 22 nt, Human
agugggcagcccaggaggucuu

SEQ ID NO: 997498 - RNA, 22 nt, Human
aaaugcagauuuugaugcagca

SEQ ID NO: 997499 - RNA, 22 nt, Human
uccuucaggccucauucucaua

SEQ ID NO: 997500 - RNA, 22 nt, Human
cccaggcugaugggaugggcca

SEQ ID NO: 997501 - RNA, 22 nt, Human
ucuggcuccaccuccuuuacua

SEQ ID NO: 997502 - RNA, 22 nt, Human
cuacuuuaauuuucugcagaga

SEQ ID NO: 997503 - RNA, 22 nt, Human
gagccuguguuuccuguagcca

SEQ ID NO: 997504 - RNA, 20 nt, Human
ugacucugcaaccgucucuc

SEQ ID NO: 997505 - RNA, 22 nt, Human
ucucuuccaguaagagucuuua

SEQ ID NO: 997506 - RNA, 22 nt, Human
agugaacaaagguagugagcau

SEQ ID NO: 997507 - RNA, 18 nt, Human
agcuggggccucuggucc

SEQ ID NO: 997508 - RNA, 22 nt, Human
agugggaggcggcugacgggcg

SEQ ID NO: 997509 - RNA, 22 nt, Human
ccagcagacacacaggcguggg

SEQ ID NO: 997510 - RNA, 22 nt, Human
gugccugccccacuccucagca

SEQ ID NO: 997511 - RNA, 22 nt, Human
auucuucacuguuucagaauga

SEQ ID NO: 997512 - RNA, 22 nt, Human
ggauggagaugaccauggugac

SEQ ID NO: 997513 - RNA, 22 nt, Human
caggaaaggugugucaugaugg

SEQ ID NO: 997514 - RNA, 22 nt, Human
cagcaggcagccauuucacugu

SEQ ID NO: 997515 - RNA, 16 nt, Human
ucucugcuucauaggu

SEQ ID NO: 997516 - RNA, 22 nt, Human
cauaacauccuugcuacuuuga

SEQ ID NO: 997517 - RNA, 22 nt, Human
cauggccugccuccuccuggug

SEQ ID NO: 997518 - RNA, 22 nt, Human
cucuuuccucagccacagucua

SEQ ID NO: 997519 - RNA, 22 nt, Human
cagccuuugugaacaucaggug

SEQ ID NO: 997520 - RNA, 22 nt, Human
aggcuucuacguggucccaggg

SEQ ID NO: 997521 - RNA, 22 nt, Human
uuggcagcauccaagucucggg

SEQ ID NO: 997522 - RNA, 22 nt, Human
ucacaggagggagagacaccca

SEQ ID NO: 997523 - RNA, 22 nt, Human
gaggccuggugugucucccgcu

SEQ ID NO: 997524 - RNA, 22 nt, Human
caggccuggggcuggcuuccag

SEQ ID NO: 997525 - RNA, 22 nt, Human
gccauaaauugcuggucaaaau

SEQ ID NO: 997526 - RNA, 18 nt, Human
cuucagugacagucuggc

SEQ ID NO: 997527 - RNA, 23 nt, Human
uccagcagagccuuccaggaggg

SEQ ID NO: 997528 - RNA, 18 nt, Human
aggagccuuugcacugga

SEQ ID NO: 997529 - RNA, 22 nt, Human
gagaaagacguaggcugggagg

SEQ ID NO: 997530 - RNA, 22 nt, Human
uaacuccaucucugugucugcu

SEQ ID NO: 997531 - RNA, 22 nt, Human
cugggacacccaaggaaagagc

SEQ ID NO: 997532 - RNA, 21 nt, Human
ucagaacaauuccaugccucc

SEQ ID NO: 997533 - RNA, 21 nt, Human
ggagggcagcccagacuggcu

SEQ ID NO: 997534 - RNA, 22 nt, Human
aauucacaauguguagucaugc

SEQ ID NO: 997535 - RNA, 22 nt, Human
cagggccaccguguuugcugcu

SEQ ID NO: 997536 - RNA, 22 nt, Human
gggcugugagaguggggcugcu

SEQ ID NO: 997537 - RNA, 22 nt, Human
gcacagccacugagugagaacc

SEQ ID NO: 997538 - RNA, 22 nt, Human
cagaaauggaauuuuccaucac

SEQ ID NO: 997539 - RNA, 22 nt, Human
agggccagaaucccucagucua

SEQ ID NO: 997540 - RNA, 22 nt, Human
uccuggccuccguucucugcau

SEQ ID NO: 997541 - RNA, 22 nt, Human
ccccagccuuccaugggaauug

SEQ ID NO: 997542 - RNA, 22 nt, Human
uggcuuccuggacagaugcggu

SEQ ID NO: 997543 - RNA, 22 nt, Human
gcaggcagagguggaggagaca

SEQ ID NO: 997544 - RNA, 22 nt, Human
gacagcauggugucuguucagg

SEQ ID NO: 997545 - RNA, 18 nt, Human
agccuggaggguugaagu

SEQ ID NO: 997546 - RNA, 22 nt, Human
gcaggugguccccguggagugg

SEQ ID NO: 997547 - RNA, 22 nt, Human
ucucagagaccugaacucccug

SEQ ID NO: 997548 - RNA, 22 nt, Human
ugagcuggucuugaguguagcu

SEQ ID NO: 997549 - RNA, 22 nt, Human
gcagccugaugaucuggguugu

SEQ ID NO: 997550 - RNA, 22 nt, Human
gaggggcugggcagucccugga

SEQ ID NO: 997551 - RNA, 22 nt, Human
gccuuccuuacaccugcucagc

SEQ ID NO: 997552 - RNA, 22 nt, Human
agcuggaggggccagcaggugu

SEQ ID NO: 997553 - RNA, 22 nt, Human
acagccuggacuggcucucugc

SEQ ID NO: 997554 - RNA, 22 nt, Human
augcugagugagugaaacccag

SEQ ID NO: 997555 - RNA, 22 nt, Human
cagccccucccucaggcaggug

SEQ ID NO: 997556 - RNA, 22 nt, Human
ucaucacuguaucauugauaga

SEQ ID NO: 997557 - RNA, 22 nt, Human
aaaugguauuuacucuguauua

SEQ ID NO: 997558 - RNA, 22 nt, Human
acccagaggcggagguugcagu

SEQ ID NO: 997559 - RNA, 22 nt, Human
aggacuccauguguccuggaga

SEQ ID NO: 997560 - RNA, 22 nt, Human
ccagagucuuuauauuccugaa

SEQ ID NO: 997561 - RNA, 22 nt, Human
ggaaagaccugagauaggaaua

SEQ ID NO: 997562 - RNA, 22 nt, Human
agccuggccacucagggccuga

SEQ ID NO: 997563 - RNA, 22 nt, Human
aggugcagcugacaccaugugg

SEQ ID NO: 997564 - RNA, 22 nt, Human
cagcugacgccagaguggaauu

SEQ ID NO: 997565 - RNA, 22 nt, Human
gccugguggugugcucaagugg

SEQ ID NO: 997566 - RNA, 22 nt, Human
ggucugaaaauggugaccacca

SEQ ID NO: 997567 - RNA, 22 nt, Human
uuucauguuuauggaaaaugag

SEQ ID NO: 997568 - RNA, 22 nt, Human
uccaaggguucaugugcauuca

SEQ ID NO: 997569 - RNA, 22 nt, Human
aaugagcuagaccugcuuccuc

SEQ ID NO: 997570 - RNA, 22 nt, Human
cagcagagguuggaacaguucu

SEQ ID NO: 997571 - RNA, 22 nt, Human
agcgggugcugugucagcccuc

SEQ ID NO: 997572 - RNA, 22 nt, Human
ugccucagcugaggccgcucca

SEQ ID NO: 997573 - RNA, 22 nt, Human
ugcagauucaaaugaaaugcaa

SEQ ID NO: 997574 - RNA, 22 nt, Human
agugaaauaaagcugccuaugg

SEQ ID NO: 997575 - RNA, 22 nt, Human
acugucugcaaaacucauacuc

SEQ ID NO: 997576 - RNA, 22 nt, Human
ugcugugagguugagaaggaag

SEQ ID NO: 997577 - RNA, 22 nt, Human
cccagcaguuguuggugcacau

SEQ ID NO: 997578 - RNA, 19 nt, Human
ucuggcuccgccucuuagu

SEQ ID NO: 997579 - RNA, 22 nt, Human
cagcucccgccaucgggaggca

SEQ ID NO: 997580 - RNA, 22 nt, Human
agaaauguggaggaacagggcu

SEQ ID NO: 997581 - RNA, 22 nt, Human
cucagcccagcccaggaccagg

SEQ ID NO: 997582 - RNA, 18 nt, Human
augggaggggccaagaga

SEQ ID NO: 997583 - RNA, 22 nt, Human
ugagccuguccugugcauguga

SEQ ID NO: 997584 - RNA, 22 nt, Human
uuuuggucagguuggucucgaa

SEQ ID NO: 997585 - RNA, 22 nt, Human
uccccagccgugaaggagagga

SEQ ID NO: 997586 - RNA, 22 nt, Human
agagccuguuuugugggagaug

SEQ ID NO: 997587 - RNA, 23 nt, Human
gccugccugaccugugcaaaguc

SEQ ID NO: 997588 - RNA, 22 nt, Human
cauucauuuaugaaauaucuau

SEQ ID NO: 997589 - RNA, 22 nt, Human
gcugucugcaagccaggaaaug

SEQ ID NO: 997590 - RNA, 23 nt, Human
uccugaggguuucccagccuugg

SEQ ID NO: 997591 - RNA, 22 nt, Human
aaggccugcucagcugucugug

SEQ ID NO: 997592 - RNA, 20 nt, Human
agagccuggaaaaagacauc

SEQ ID NO: 997593 - RNA, 22 nt, Human
cgcugggggaacagcgagggug

SEQ ID NO: 997594 - RNA, 22 nt, Human
uaugaguacaaggacucugucu

SEQ ID NO: 997595 - RNA, 22 nt, Human
acagagcuguacaugugccaug

SEQ ID NO: 997596 - RNA, 22 nt, Human
uggcagaguucgcugugccuuu

SEQ ID NO: 997597 - RNA, 22 nt, Human
aaaugcacaauaaaguaaaggc

SEQ ID NO: 997598 - RNA, 22 nt, Human
cugaggccucucuccugggcuu

SEQ ID NO: 997599 - RNA, 22 nt, Human
ucccagagcucugacaccagcu

SEQ ID NO: 997600 - RNA, 22 nt, Human
uuuccucugagugagcugggag

SEQ ID NO: 997601 - RNA, 22 nt, Human
gaggcugccccuuccucagcug

SEQ ID NO: 997602 - RNA, 21 nt, Human
ggccugaguauaggacaggcc

SEQ ID NO: 997603 - RNA, 22 nt, Human
ucaggaucggccuuuuuuuaag

SEQ ID NO: 997604 - RNA, 22 nt, Human
augguuuguaacccaauacucc

SEQ ID NO: 997605 - RNA, 22 nt, Human
auugucugaauccaaagcucug

SEQ ID NO: 997606 - RNA, 22 nt, Human
gccuuugcaccaucagugcaau

SEQ ID NO: 997607 - RNA, 18 nt, Human
ucuuggcagcaucuggca

SEQ ID NO: 997608 - RNA, 22 nt, Human
ugggccuccaauuccagcggga

SEQ ID NO: 997609 - RNA, 22 nt, Human
gugucccaauguucaggacggc

SEQ ID NO: 997610 - RNA, 22 nt, Human
ugugcccauuccacuugaguac

SEQ ID NO: 997611 - RNA, 22 nt, Human
agcucucaagauaagaaagaac

SEQ ID NO: 997612 - RNA, 22 nt, Human
uggggugguaauacaccguucu

SEQ ID NO: 997613 - RNA, 22 nt, Human
ggcacugggcaccggcugaggg

SEQ ID NO: 997614 - RNA, 22 nt, Human
ugugcuucuugcagcuccugua

SEQ ID NO: 997615 - RNA, 22 nt, Human
cuggcagcucuacucagagccu

SEQ ID NO: 997616 - RNA, 22 nt, Human
auauuaggaguuaaauguauua

SEQ ID NO: 997617 - RNA, 22 nt, Human
agaacagcaguuaugguucauu

SEQ ID NO: 997618 - RNA, 22 nt, Human
cagagcuggagaaguggauuua

SEQ ID NO: 997619 - RNA, 22 nt, Human
cugaaggauuuaguucuuugcu

SEQ ID NO: 997620 - RNA, 22 nt, Human
ucccagccauuccuuuaggugu

SEQ ID NO: 997621 - RNA, 22 nt, Human
guguccagggccguguugucuu

SEQ ID NO: 997622 - RNA, 22 nt, Human
uugaccauaccuccaggcaguu

SEQ ID NO: 997623 - RNA, 22 nt, Human
ucugagaguagagcugccucuu

SEQ ID NO: 997624 - RNA, 22 nt, Human
ugcucugguccucccucggcgc

SEQ ID NO: 997625 - RNA, 22 nt, Human
auacauuagaaucugguacuca

SEQ ID NO: 997626 - RNA, 22 nt, Human
ccagcucuggcuucuugcuggg

SEQ ID NO: 997627 - RNA, 22 nt, Human
cugugcuuaccugcccagguga

SEQ ID NO: 997628 - RNA, 22 nt, Human
acaggacuguggaaggaucucu

SEQ ID NO: 997629 - RNA, 22 nt, Human
agccuucagcaguucaggugcc

SEQ ID NO: 997630 - RNA, 22 nt, Human
cucacugcccugaaguuggguu

SEQ ID NO: 997631 - RNA, 22 nt, Human
ggcaccuggauguagcagugaa

SEQ ID NO: 997632 - RNA, 22 nt, Human
ucauugcagcuucagguguuca

SEQ ID NO: 997633 - RNA, 22 nt, Human
aggagcugaaacuucucauaug

SEQ ID NO: 997634 - RNA, 22 nt, Human
caggcacuagcagaaugaggcu

SEQ ID NO: 997635 - RNA, 22 nt, Human
aggagacauaacuaugaugaga

SEQ ID NO: 997636 - RNA, 22 nt, Human
ccugccuguaagauggguacaa

SEQ ID NO: 997637 - RNA, 22 nt, Human
gaggcucugugaugugccaggc

SEQ ID NO: 997638 - RNA, 22 nt, Human
auccaaaucaugucagaagaac

SEQ ID NO: 997639 - RNA, 22 nt, Human
gcugauccuuuuaugucuagcu

SEQ ID NO: 997640 - RNA, 22 nt, Human
cauuaucucuucuauaugcuag

SEQ ID NO: 997641 - RNA, 22 nt, Human
agcagcaggcuguguggacuga

SEQ ID NO: 997642 - RNA, 22 nt, Human
cagagccugccucuggcugugg

SEQ ID NO: 997643 - RNA, 22 nt, Human
aucaguuucacuugcuugcaaa

SEQ ID NO: 997644 - RNA, 22 nt, Human
uggcucugaccagguagaggag

SEQ ID NO: 997645 - RNA, 22 nt, Human
guggcugcagagggcacagcau

SEQ ID NO: 997646 - RNA, 21 nt, Human
aaguaaaucagagaaauaacc

SEQ ID NO: 997647 - RNA, 22 nt, Human
auuuaaaugcuuaagaggguuu

SEQ ID NO: 997648 - RNA, 22 nt, Human
aggaggccgggauucuggagau

SEQ ID NO: 997649 - RNA, 23 nt, Human
aaggucacagaacuuagcaagcc

SEQ ID NO: 997650 - RNA, 22 nt, Human
cacugaaggcugcagcucagcc

SEQ ID NO: 997651 - RNA, 20 nt, Human
gucaucgccggcagcaaaga

SEQ ID NO: 997652 - RNA, 22 nt, Human
gccacagggcagaugcgcagag

SEQ ID NO: 997653 - RNA, 22 nt, Human
uuuccucugcugccauugcccc

SEQ ID NO: 997654 - RNA, 22 nt, Human
ggaggcuccacugcucuuccug

SEQ ID NO: 997655 - RNA, 22 nt, Human
ccagcugcagguguuccagaug

SEQ ID NO: 997656 - RNA, 22 nt, Human
aaguuuguucagggcuuacauu

SEQ ID NO: 997657 - RNA, 22 nt, Human
aaagauuugaguucugcuuaua

SEQ ID NO: 997658 - RNA, 22 nt, Human
uguaucaaaccaaauuaauucu

SEQ ID NO: 997659 - RNA, 22 nt, Human
gcuggcagguccaagauagagc

SEQ ID NO: 997660 - RNA, 22 nt, Human
ggucccagcugcucaagaggcu

SEQ ID NO: 997661 - RNA, 22 nt, Human
uugaggaguguuuagggugagg

SEQ ID NO: 997662 - RNA, 22 nt, Human
agaauaugaggaaacugugaau

SEQ ID NO: 997663 - RNA, 18 nt, Human
ugugguggagcugccuuc

SEQ ID NO: 997664 - RNA, 22 nt, Human
aacugcuguggccuaguacuua

SEQ ID NO: 997665 - RNA, 22 nt, Human
aauaggcaguuggauaugcaag

SEQ ID NO: 997666 - RNA, 22 nt, Human
uccagccaugacucggacagug

SEQ ID NO: 997667 - RNA, 22 nt, Human
uauuagagaaaagauggaugug

SEQ ID NO: 997668 - RNA, 22 nt, Human
ccuggcugcuauagcagcaugu

SEQ ID NO: 997669 - RNA, 22 nt, Human
agccacagagcaggagaccuuu

SEQ ID NO: 997670 - RNA, 23 nt, Human
cugcagccgcguggggacgugga

SEQ ID NO: 997671 - RNA, 22 nt, Human
aaguuugagagccuuuaguaua

SEQ ID NO: 997672 - RNA, 22 nt, Human
ggaggccaaggagggcggauca

SEQ ID NO: 997673 - RNA, 22 nt, Human
agggugccuggaagccacucac

SEQ ID NO: 997674 - RNA, 22 nt, Human
aucaggauguuuggcugucaua

SEQ ID NO: 997675 - RNA, 22 nt, Human
ugcauuguaggauguuuagcag

SEQ ID NO: 997676 - RNA, 22 nt, Human
agcucccagggcugggcaaguu

SEQ ID NO: 997677 - RNA, 22 nt, Human
cucaggauuaaggaaucuaaau

SEQ ID NO: 997678 - RNA, 22 nt, Human
gaaaucugucuuuguuugaaua

SEQ ID NO: 997679 - RNA, 22 nt, Human
cugaggaugguguggucuucuc

SEQ ID NO: 997680 - RNA, 22 nt, Human
agcagccaaaugaagauuuuac

SEQ ID NO: 997681 - RNA, 22 nt, Human
uuaaagagucuacugcacaucc

SEQ ID NO: 997682 - RNA, 22 nt, Human
cauuucugggagacaugcuaga

SEQ ID NO: 997683 - RNA, 22 nt, Human
ucucaggaguagugggauccau

SEQ ID NO: 997684 - RNA, 22 nt, Human
ucaaagcaucagucaauuuagg

SEQ ID NO: 997685 - RNA, 22 nt, Human
agauacauuguucuaagcauug

SEQ ID NO: 997686 - RNA, 22 nt, Human
ucaaguauaucuagucauuagg

SEQ ID NO: 997687 - RNA, 22 nt, Human
caggggacauuaaagcuccaua

SEQ ID NO: 997688 - RNA, 22 nt, Human
augaugguaaauucaguauccg

SEQ ID NO: 997689 - RNA, 22 nt, Human
aggggcuggaguucgagguuac

SEQ ID NO: 997690 - RNA, 22 nt, Human
gcaguccucucauuggccuccu

SEQ ID NO: 997691 - RNA, 22 nt, Human
ccagggcuccauugcucauccu

SEQ ID NO: 997692 - RNA, 19 nt, Human
aggguccagggagcggcuc

SEQ ID NO: 997693 - RNA, 22 nt, Human
ucacuuuugaucccuaugcagu

SEQ ID NO: 997694 - RNA, 22 nt, Human
uggccacccagcugacgccuuc

SEQ ID NO: 997695 - RNA, 22 nt, Human
ugcagggccgcuggaggucaug

SEQ ID NO: 997696 - RNA, 19 nt, Human
ugucucagugucccuuccu

SEQ ID NO: 997697 - RNA, 22 nt, Human
agauacaucauuuauaccuuca

SEQ ID NO: 997698 - RNA, 22 nt, Human
gcugagcuagcuaucucagucu

SEQ ID NO: 997699 - RNA, 18 nt, Human
aucuuuccauagcauguu

SEQ ID NO: 997700 - RNA, 22 nt, Human
uuucacaaaugucuuuaacuug

SEQ ID NO: 997701 - RNA, 22 nt, Human
agggccagaggcaccuugcagc

SEQ ID NO: 997702 - RNA, 22 nt, Human
uagcagggucucaggagucagg

SEQ ID NO: 997703 - RNA, 22 nt, Human
cucugagagagcuggugagcac

SEQ ID NO: 997704 - RNA, 22 nt, Human
ugucccauggacacaacuucuu

SEQ ID NO: 997705 - RNA, 22 nt, Human
cugccugugccaccgccucauu

SEQ ID NO: 997706 - RNA, 22 nt, Human
cugccuggguucaaguccuguu

SEQ ID NO: 997707 - RNA, 22 nt, Human
aagcagcagaccugauuuugaa

SEQ ID NO: 997708 - RNA, 22 nt, Human
gggcaagcucuucagaagcucu

SEQ ID NO: 997709 - RNA, 22 nt, Human
aucuacagugcacaggacagcc

SEQ ID NO: 997710 - RNA, 22 nt, Human
ucugucaccgagggcauccaaa

SEQ ID NO: 997711 - RNA, 22 nt, Human
ggucccaguugcccaggucagg

SEQ ID NO: 997712 - RNA, 22 nt, Human
uuucaagagggaacugaacaca

SEQ ID NO: 997713 - RNA, 22 nt, Human
agggcagcauugccuuucucca

SEQ ID NO: 997714 - RNA, 20 nt, Human
ggcacuggaagcacacagga

SEQ ID NO: 997715 - RNA, 22 nt, Human
agcuggcauacuuugcuaggaa

SEQ ID NO: 997716 - RNA, 22 nt, Human
cccucugcucaggugcauaggc

SEQ ID NO: 997717 - RNA, 22 nt, Human
gcugccuuuugcuccucccacc

SEQ ID NO: 997718 - RNA, 22 nt, Human
gcaggccagcugugcagauggg

SEQ ID NO: 997719 - RNA, 22 nt, Human
ucugagagucucugaggcagau

SEQ ID NO: 997720 - RNA, 22 nt, Human
uagaaacagagagauaugcccc

SEQ ID NO: 997721 - RNA, 22 nt, Human
augcaucauggaaaacucaguu

SEQ ID NO: 997722 - RNA, 22 nt, Human
ucacaagaauuuguagaugaaa

SEQ ID NO: 997723 - RNA, 22 nt, Human
uaggcaauauuagacuuugucu

SEQ ID NO: 997724 - RNA, 22 nt, Human
accucugcaguagggcugugcc

SEQ ID NO: 997725 - RNA, 22 nt, Human
ugaaaaggagccuuagguaggu

SEQ ID NO: 997726 - RNA, 22 nt, Human
ggucagggggaucugugaggua

SEQ ID NO: 997727 - RNA, 22 nt, Human
gcucuggacuggggccugagaa

SEQ ID NO: 997728 - RNA, 22 nt, Human
gcucugggauuaccagccuuag

SEQ ID NO: 997729 - RNA, 22 nt, Human
cugaggcuuggaggggucuggu

SEQ ID NO: 997730 - RNA, 22 nt, Human
ugaaggaauggaggaucagagc

SEQ ID NO: 997731 - RNA, 19 nt, Human
cugaagucuuuucagcugg

SEQ ID NO: 997732 - RNA, 22 nt, Human
ugaaauguaaauaggacuagaa

SEQ ID NO: 997733 - RNA, 22 nt, Human
acuggccagguucaaaauacag

SEQ ID NO: 997734 - RNA, 22 nt, Human
cugcugagaaaagacugaggga

SEQ ID NO: 997735 - RNA, 22 nt, Human
ucaaggaggugcuuggcuucac

SEQ ID NO: 997736 - RNA, 22 nt, Human
caggucagaggcgcagccccca

SEQ ID NO: 997737 - RNA, 22 nt, Human
ucuccuggaagaauaccacacu

SEQ ID NO: 997738 - RNA, 22 nt, Human
gcuggcugaggucuagcucuuu

SEQ ID NO: 997739 - RNA, 22 nt, Human
gucccuggaauggacucugcgc

SEQ ID NO: 997740 - RNA, 20 nt, Human
gcucccugguagaaauguuu

SEQ ID NO: 997741 - RNA, 22 nt, Human
ucaugucaguuucuucuauaaa

SEQ ID NO: 997742 - RNA, 17 nt, Human
gguguauggggagggaa

SEQ ID NO: 997743 - RNA, 22 nt, Human
uguguuccuucgucuucccuuc

SEQ ID NO: 997744 - RNA, 22 nt, Human
uuucaacauauaccauaaugcc

SEQ ID NO: 997745 - RNA, 22 nt, Human
ggagauggcucugcaaggucua

SEQ ID NO: 997746 - RNA, 22 nt, Human
ugggcugccagcucuccagaug

SEQ ID NO: 997747 - RNA, 20 nt, Human
cucaggauacugcaaaguug

SEQ ID NO: 997748 - RNA, 22 nt, Human
gcucuuccauuucucuugaacu

SEQ ID NO: 997749 - RNA, 22 nt, Human
ggugcugguucaggguggcugu

SEQ ID NO: 997750 - RNA, 22 nt, Human
gcagagccaggagcccaggauc

SEQ ID NO: 997751 - RNA, 22 nt, Human
gaaccaaguaggauacaaggag

SEQ ID NO: 997752 - RNA, 22 nt, Human
ggcagcugugaagugccucaca

SEQ ID NO: 997753 - RNA, 22 nt, Human
aagggcagcuuaaauugguagc

SEQ ID NO: 997754 - RNA, 22 nt, Human
ucccagggacaccaagcuguuu

SEQ ID NO: 997755 - RNA, 22 nt, Human
ccugccugcaaaaugggacaag

SEQ ID NO: 997756 - RNA, 22 nt, Human
uuccaugugaguacacugugau

SEQ ID NO: 997757 - RNA, 22 nt, Human
aggucaaggccaaaagaguggu

SEQ ID NO: 997758 - RNA, 17 nt, Human
ggccuugggcugcucuu

SEQ ID NO: 997759 - RNA, 22 nt, Human
acaguaauuaaaauggaucugc

SEQ ID NO: 997760 - RNA, 22 nt, Human
gucuggccugccagcucuggug

SEQ ID NO: 997761 - RNA, 22 nt, Human
acagugucugacacauuguagc

SEQ ID NO: 997762 - RNA, 22 nt, Human
ggucucagaucuuuauuaaggc

SEQ ID NO: 997763 - RNA, 22 nt, Human
gggagagagagcucauguugaa

SEQ ID NO: 997764 - RNA, 22 nt, Human
caugcuuugggucagaaaugcc

SEQ ID NO: 997765 - RNA, 22 nt, Human
aucuggcucccuuggaauccgu

SEQ ID NO: 997766 - RNA, 22 nt, Human
gcucagccgaacuucagagcag

SEQ ID NO: 997767 - RNA, 22 nt, Human
gcacacagauuaggaaacagaa

SEQ ID NO: 997768 - RNA, 22 nt, Human
cuugaaagucacaugcagcccu

SEQ ID NO: 997769 - RNA, 22 nt, Human
cugucagguuggucucagagcu

SEQ ID NO: 997770 - RNA, 22 nt, Human
gccagccugugggggcucugug

SEQ ID NO: 997771 - RNA, 22 nt, Human
cugggcacaaguggcccuggau

SEQ ID NO: 997772 - RNA, 22 nt, Human
gguucacacuuucaugauuuca

SEQ ID NO: 997773 - RNA, 22 nt, Human
gccuuccugcagcucugagcgu

SEQ ID NO: 997774 - RNA, 22 nt, Human
uucacauugugcagauuauggu

SEQ ID NO: 997775 - RNA, 22 nt, Human
aagcagcauaauugcuauuuua

SEQ ID NO: 997776 - RNA, 22 nt, Human
auaagagcuagucuuuuccuug

SEQ ID NO: 997777 - RNA, 22 nt, Human
ccugggcauucuuugaguucuc

SEQ ID NO: 997778 - RNA, 22 nt, Human
ggcugcugguggaaugguaggc

SEQ ID NO: 997779 - RNA, 22 nt, Human
aauucacaaaaccagauugcuu

SEQ ID NO: 997780 - RNA, 22 nt, Human
cagggcaguaacgggaacaucu

SEQ ID NO: 997781 - RNA, 22 nt, Human
agugacugacaccuguaauccc

SEQ ID NO: 997782 - RNA, 20 nt, Human
ucccuggaggugguggcauc

SEQ ID NO: 997783 - RNA, 22 nt, Human
acugaguguaggacuuugaguu

SEQ ID NO: 997784 - RNA, 22 nt, Human
aggauguuaucugugcaggugg

SEQ ID NO: 997785 - RNA, 22 nt, Human
aagauuuccuucaguagagcua

SEQ ID NO: 997786 - RNA, 19 nt, Human
augucuguugaauuucaua

SEQ ID NO: 997787 - RNA, 22 nt, Human
cacugaaggcuaggauuagaug

SEQ ID NO: 997788 - RNA, 22 nt, Human
ucccagccuuccuuguggugaa

SEQ ID NO: 997789 - RNA, 22 nt, Human
acucugcuugcccaauggaaac

SEQ ID NO: 997790 - RNA, 22 nt, Human
aggacuucaucaccuguauaaa

SEQ ID NO: 997791 - RNA, 22 nt, Human
uggaggaugccauccaggauac

SEQ ID NO: 997792 - RNA, 22 nt, Human
aauuuagaauucgcuagcuaau

SEQ ID NO: 997793 - RNA, 22 nt, Human
ucucuggccgagagucccuggg

SEQ ID NO: 997794 - RNA, 22 nt, Human
augcaccugaacuccaucagcu

SEQ ID NO: 997795 - RNA, 22 nt, Human
ccaaaauguuugaaugcaugug

SEQ ID NO: 997796 - RNA, 22 nt, Human
ucagggaacaauguuauggcuu

SEQ ID NO: 997797 - RNA, 22 nt, Human
gcaguggcuaagcucgcaugca

SEQ ID NO: 997798 - RNA, 22 nt, Human
ucucaggggccuggaguccugg

SEQ ID NO: 997799 - RNA, 22 nt, Human
ggccugcuucucagugagcuug

SEQ ID NO: 997800 - RNA, 22 nt, Human
gguggccaggccagcucuggcc

SEQ ID NO: 997801 - RNA, 22 nt, Human
cuggagcuaggaaguccaagau

SEQ ID NO: 997802 - RNA, 22 nt, Human
aaucauaauucaaauaagcuua

SEQ ID NO: 997803 - RNA, 22 nt, Human
uacaguaacauguuguacaagc

SEQ ID NO: 997804 - RNA, 22 nt, Human
ccagagccccugagcuucccug

SEQ ID NO: 997805 - RNA, 22 nt, Human
uuucacaaguaaaguccuaagu

SEQ ID NO: 997806 - RNA, 22 nt, Human
gcagggcagccacaggcccccu

SEQ ID NO: 997807 - RNA, 20 nt, Human
gcugggggugugcugaguga

SEQ ID NO: 997808 - RNA, 22 nt, Human
uccaggaggguuuucugccuuc

SEQ ID NO: 997809 - RNA, 22 nt, Human
aagaaaugcagaaaugugcugg

SEQ ID NO: 997810 - RNA, 21 nt, Human
gauguuggaggcuggggucug

SEQ ID NO: 997811 - RNA, 22 nt, Human
agagugaucagauaucaggugu

SEQ ID NO: 997812 - RNA, 22 nt, Human
acauuucuuugcuagacagcag

SEQ ID NO: 997813 - RNA, 22 nt, Human
gcugucucauacaaggcccugc

SEQ ID NO: 997814 - RNA, 22 nt, Human
cagcagcugcgugcccaggccg

SEQ ID NO: 997815 - RNA, 22 nt, Human
aucuauuaugcugagaaacugu

SEQ ID NO: 997816 - RNA, 22 nt, Human
ccuuucucauuuuaagcauuag

SEQ ID NO: 997817 - RNA, 22 nt, Human
aaauaguuacuucugcugucuu

SEQ ID NO: 997818 - RNA, 22 nt, Human
gccuggagaagauggaacuagc

SEQ ID NO: 997819 - RNA, 22 nt, Human
aggauuuugacuuauucaggga

SEQ ID NO: 997820 - RNA, 22 nt, Human
aggugaguuacaggaggagguc

SEQ ID NO: 997821 - RNA, 22 nt, Human
uuugggaacucuaucauggaaa

SEQ ID NO: 997822 - RNA, 22 nt, Human
uaggaugagggguggccaagua

SEQ ID NO: 997823 - RNA, 22 nt, Human
gaugcacuuucuuuucaacagu

SEQ ID NO: 997824 - RNA, 22 nt, Human
cauugaaauauggaaacugaug

SEQ ID NO: 997825 - RNA, 22 nt, Human
uuccuggcugaacugaacuccu

SEQ ID NO: 997826 - RNA, 22 nt, Human
cauguacauucuguagauggag

SEQ ID NO: 997827 - RNA, 22 nt, Human
acugcuuacaaaaggaaagaau

SEQ ID NO: 997828 - RNA, 22 nt, Human
cuggccuaaaauugcuucugca

SEQ ID NO: 997829 - RNA, 22 nt, Human
aagccagauagaagaacucauu

SEQ ID NO: 997830 - RNA, 22 nt, Human
aggagaaagacuggacagccaa

SEQ ID NO: 997831 - RNA, 22 nt, Human
cccagcuccuuggaugggcagg

SEQ ID NO: 997832 - RNA, 21 nt, Human
ugauccuuucccccauguugc

SEQ ID NO: 997833 - RNA, 22 nt, Human
aauuagagaucaguucuuugac

SEQ ID NO: 997834 - RNA, 22 nt, Human
cagcuccccaugguuccugaag

SEQ ID NO: 997835 - RNA, 22 nt, Human
ucagaacauugacauucuuauu

SEQ ID NO: 997836 - RNA, 22 nt, Human
caugcaggcccgccugaauggg

SEQ ID NO: 997837 - RNA, 22 nt, Human
ccagccaggcuggcuguggagg

SEQ ID NO: 997838 - RNA, 22 nt, Human
cuccuggcuucugaaaucgugg

SEQ ID NO: 997839 - RNA, 22 nt, Human
gauggggaugagaagugagcag

SEQ ID NO: 997840 - RNA, 22 nt, Human
ccagucagccaagcugcagcgg

SEQ ID NO: 997841 - RNA, 22 nt, Human
cugggugguuuugaugugaauu

SEQ ID NO: 997842 - RNA, 19 nt, Human
gccacuccugaugcugccc

SEQ ID NO: 997843 - RNA, 22 nt, Human
caggugccucaggaugagacaa

SEQ ID NO: 997844 - RNA, 22 nt, Human
aagggcagaauagagaagaugg

SEQ ID NO: 997845 - RNA, 22 nt, Human
ggcagcagcaagguuggagcug

SEQ ID NO: 997846 - RNA, 22 nt, Human
ccaggagucaauaaaggaagcu

SEQ ID NO: 997847 - RNA, 22 nt, Human
cacaugugugcugaggacugug

SEQ ID NO: 997848 - RNA, 22 nt, Human
gcuuggaaguaggauugggaga

SEQ ID NO: 997849 - RNA, 22 nt, Human
ugcucacagcccagaacauaau

SEQ ID NO: 997850 - RNA, 22 nt, Human
ccugcacuaccuggggcugcug

SEQ ID NO: 997851 - RNA, 22 nt, Human
gccgaagcugccgucugguccu

SEQ ID NO: 997852 - RNA, 18 nt, Human
uccagcgugcuccagggc

SEQ ID NO: 997853 - RNA, 22 nt, Human
augauacaagcaaaacuaauca

SEQ ID NO: 997854 - RNA, 22 nt, Human
cuuauuauaaaauccuguuuga

SEQ ID NO: 997855 - RNA, 22 nt, Human
uucagcaaugacagccuauaua

SEQ ID NO: 997856 - RNA, 22 nt, Human
gagaagcaaucaguggccaccc

SEQ ID NO: 997857 - RNA, 22 nt, Human
ggccacaacuugcuccuagccc

SEQ ID NO: 997858 - RNA, 22 nt, Human
uauuuaauuugcucauugugau

SEQ ID NO: 997859 - RNA, 22 nt, Human
ugaacgcagguccacauggcuc

SEQ ID NO: 997860 - RNA, 20 nt, Human
aggagaugauccagagucag

SEQ ID NO: 997861 - RNA, 22 nt, Human
aagaguuaagcaacagauacca

SEQ ID NO: 997862 - RNA, 22 nt, Human
aaagguuaagguguucaagaaa

SEQ ID NO: 997863 - RNA, 22 nt, Human
uaaucacaucaggguaaauggg

SEQ ID NO: 997864 - RNA, 22 nt, Human
gguggagcuggaccaggagagg

SEQ ID NO: 997865 - RNA, 22 nt, Human
ggccccacgggggaguccuagu

SEQ ID NO: 997866 - RNA, 22 nt, Human
agcuggcccucgagagccaauu

SEQ ID NO: 997867 - RNA, 18 nt, Human
gcuccuggaccaggucac

SEQ ID NO: 997868 - RNA, 22 nt, Human
uaaaugugcacuuuacuuuuca

SEQ ID NO: 997869 - RNA, 22 nt, Human
agucauaauuauaaacaucagu

SEQ ID NO: 997870 - RNA, 22 nt, Human
cugagccauaagggaggcuggg

SEQ ID NO: 997871 - RNA, 17 nt, Human
guccugggaggagagag

SEQ ID NO: 997872 - RNA, 22 nt, Human
uagagcuguaucaaagagccuu

SEQ ID NO: 997873 - RNA, 22 nt, Human
ccugagagcgaguggccucaug

SEQ ID NO: 997874 - RNA, 22 nt, Human
uugaaggaggcuccuuuuuaaa

SEQ ID NO: 997875 - RNA, 22 nt, Human
cccaccaguacagaugguagau

SEQ ID NO: 997876 - RNA, 22 nt, Human
gcuuccucgcugggcagaggca

SEQ ID NO: 997877 - RNA, 20 nt, Human
aggcugccaggucucacauc

SEQ ID NO: 997878 - RNA, 22 nt, Human
aaaucuguaagcaauugcucag

SEQ ID NO: 997879 - RNA, 22 nt, Human
cuggcacacaaguauuuccuuu

SEQ ID NO: 997880 - RNA, 22 nt, Human
ugcccaaguccuccaccgaggu

SEQ ID NO: 997881 - RNA, 22 nt, Human
uagggcuauaagagaauaagac

SEQ ID NO: 997882 - RNA, 22 nt, Human
ugccugggggacuaaggccaaa

SEQ ID NO: 997883 - RNA, 22 nt, Human
uuaagucauuucugauuauaga

SEQ ID NO: 997884 - RNA, 18 nt, Human
aucucccauuggccaagg

SEQ ID NO: 997885 - RNA, 19 nt, Human
ucaguuuuagucaucaguu

SEQ ID NO: 997886 - RNA, 22 nt, Human
agcugcccuggcggagcugcuc

SEQ ID NO: 997887 - RNA, 22 nt, Human
uuccuggcaccaccacuucuag

SEQ ID NO: 997888 - RNA, 22 nt, Human
caagaacaguuugccaaauugg

SEQ ID NO: 997889 - RNA, 22 nt, Human
ucugucacucccugaugaugaa

SEQ ID NO: 997890 - RNA, 22 nt, Human
aaaugcacucugcuucugugac

SEQ ID NO: 997891 - RNA, 22 nt, Human
uccacuuuagcaaugauugaau

SEQ ID NO: 997892 - RNA, 22 nt, Human
agauuuccugcacugccuuuga

SEQ ID NO: 997893 - RNA, 22 nt, Human
ucauguaaguauagaaagcagu

SEQ ID NO: 997894 - RNA, 21 nt, Human
cuggacugaggagacagucgc

SEQ ID NO: 997895 - RNA, 19 nt, Human
uggcuccugccugccuucu

SEQ ID NO: 997896 - RNA, 22 nt, Human
gcucagagaaucagcagacacc

SEQ ID NO: 997897 - RNA, 22 nt, Human
gcucuggacccuggaguggcug

SEQ ID NO: 997898 - RNA, 22 nt, Human
cacugcauggaugauggcugua

SEQ ID NO: 997899 - RNA, 23 nt, Human
ucacagggcacuggcugggguug

SEQ ID NO: 997900 - RNA, 22 nt, Human
ugcaauaaggaguaauaguaaa

SEQ ID NO: 997901 - RNA, 22 nt, Human
uagggcaggggaggaaucugaa

SEQ ID NO: 997902 - RNA, 22 nt, Human
aaaugcuguguuuuaacauaga

SEQ ID NO: 997903 - RNA, 22 nt, Human
cagggccaaguuggugccuuuu

SEQ ID NO: 997904 - RNA, 22 nt, Human
agggcucugggguggcagagau

SEQ ID NO: 997905 - RNA, 22 nt, Human
uccuuggcaugccgucuucucc

SEQ ID NO: 997906 - RNA, 23 nt, Human
gggugggccaaauuagguagccu

SEQ ID NO: 997907 - RNA, 22 nt, Human
uagcagaaccagcagucaauuu

SEQ ID NO: 997908 - RNA, 22 nt, Human
acaugauuggacuccuuccccu

SEQ ID NO: 997909 - RNA, 22 nt, Human
caaggugcagcguugucaagcu

SEQ ID NO: 997910 - RNA, 22 nt, Human
aauagaauguaaucuaauacau

SEQ ID NO: 997911 - RNA, 22 nt, Human
ucuuuccuguaacugcuguuca

SEQ ID NO: 997912 - RNA, 22 nt, Human
aaaguauuuuugacaggcauua

SEQ ID NO: 997913 - RNA, 22 nt, Human
aggacccugagcgggcaugccg

SEQ ID NO: 997914 - RNA, 22 nt, Human
gauuaggagggagaggcaagua

SEQ ID NO: 997915 - RNA, 22 nt, Human
ugagagugguucagcucagaag

SEQ ID NO: 997916 - RNA, 22 nt, Human
agcagcucuggcacuguagcau

SEQ ID NO: 997917 - RNA, 22 nt, Human
uucauucccaagaguaaacaua

SEQ ID NO: 997918 - RNA, 22 nt, Human
ccagguggacggcgaguacagg

SEQ ID NO: 997919 - RNA, 19 nt, Human
agggcugcucuggccuggg

SEQ ID NO: 997920 - RNA, 22 nt, Human
ggaccugccagaacucaggcua

SEQ ID NO: 997921 - RNA, 22 nt, Human
aggagcugcaaauauuaguaau

SEQ ID NO: 997922 - RNA, 22 nt, Human
cauugcucaggcccagcaggaa

SEQ ID NO: 997923 - RNA, 22 nt, Human
gcccagcuuuuugaggcaggca

SEQ ID NO: 997924 - RNA, 22 nt, Human
agcaggugcauggcgagcgcgg

SEQ ID NO: 997925 - RNA, 22 nt, Human
cugucaggggcggguggagcgg

SEQ ID NO: 997926 - RNA, 22 nt, Human
agagcaggcauaaagcuuugaa

SEQ ID NO: 997927 - RNA, 22 nt, Human
augcaguaaauguucuaguuug

SEQ ID NO: 997928 - RNA, 22 nt, Human
cuggugccauucuguggccuag

SEQ ID NO: 997929 - RNA, 22 nt, Human
aggcucugaucagguggcugug

SEQ ID NO: 997930 - RNA, 22 nt, Human
ccagucugaggccuggugaggg

SEQ ID NO: 997931 - RNA, 22 nt, Human
guccucuguguaggcugcagac

SEQ ID NO: 997932 - RNA, 22 nt, Human
agcagggcuugccgcuuguccu

SEQ ID NO: 997933 - RNA, 22 nt, Human
cugaggccuaagacaugaauga

SEQ ID NO: 997934 - RNA, 18 nt, Human
uggccuggagacaacucu

SEQ ID NO: 997935 - RNA, 22 nt, Human
uauauuaaagugcuuugcagug

SEQ ID NO: 997936 - RNA, 22 nt, Human
uuugaaauguaucaguauaggu

SEQ ID NO: 997937 - RNA, 18 nt, Human
acaguaaagaaaggaauu

SEQ ID NO: 997938 - RNA, 22 nt, Human
aggcucagauccuuguguccug

SEQ ID NO: 997939 - RNA, 22 nt, Human
ggcaggagaaaggucucuucuu

SEQ ID NO: 997940 - RNA, 22 nt, Human
gggcacuggaaggcucucaggc

SEQ ID NO: 997941 - RNA, 22 nt, Human
ugcaacauuauuaaacuaagca

SEQ ID NO: 997942 - RNA, 22 nt, Human
ugggggagauuagagcuucuua

SEQ ID NO: 997943 - RNA, 23 nt, Human
uguagcaucucuuauuucucagc

SEQ ID NO: 997944 - RNA, 22 nt, Human
uaccuuggguugaguucauucu

SEQ ID NO: 997945 - RNA, 22 nt, Human
cugaaauuccauuucagccaca

SEQ ID NO: 997946 - RNA, 22 nt, Human
ucagaagccggaagugcuccuc

SEQ ID NO: 997947 - RNA, 22 nt, Human
gccugccucaaaaucccaguuc

SEQ ID NO: 997948 - RNA, 22 nt, Human
cagggccagccgcagcauccac

SEQ ID NO: 997949 - RNA, 22 nt, Human
agucucaggcagaggaaggcua

SEQ ID NO: 997950 - RNA, 19 nt, Human
ccuggcccugcugcgcggg

SEQ ID NO: 997951 - RNA, 17 nt, Human
gauuuccugaaguucuu

SEQ ID NO: 997952 - RNA, 22 nt, Human
ucagccagugccuugaucuugc

SEQ ID NO: 997953 - RNA, 19 nt, Human
auagaaaggguuaaagaca

SEQ ID NO: 997954 - RNA, 22 nt, Human
cuuucaaugugccugccuuggg

SEQ ID NO: 997955 - RNA, 22 nt, Human
caggaaagaaaugagaacacca

SEQ ID NO: 997956 - RNA, 22 nt, Human
aacaaauggggccuuguaugaa

SEQ ID NO: 997957 - RNA, 22 nt, Human
agcauuuaauuacaguuuaauu

SEQ ID NO: 997958 - RNA, 22 nt, Human
gcaggggcuacucugagcuucc

SEQ ID NO: 997959 - RNA, 22 nt, Human
auagucaaccuuguaauuagcc

SEQ ID NO: 997960 - RNA, 22 nt, Human
caagagcugcaaauagcgugac

SEQ ID NO: 997961 - RNA, 21 nt, Human
agcucagccgggcacaguggc

SEQ ID NO: 997962 - RNA, 22 nt, Human
caagaaauguuuacugagcauc

SEQ ID NO: 997963 - RNA, 22 nt, Human
uugaagcaugguacuuguucaa

SEQ ID NO: 997964 - RNA, 22 nt, Human
uccucaggauguggaguagaau

SEQ ID NO: 997965 - RNA, 22 nt, Human
acuuucucaggaauucacagac

SEQ ID NO: 997966 - RNA, 22 nt, Human
ucugugccuccguaacacacca

SEQ ID NO: 997967 - RNA, 22 nt, Human
uaaccuuucaggcauguagguu

SEQ ID NO: 997968 - RNA, 19 nt, Human
gaagaagcuugagaaguag

SEQ ID NO: 997969 - RNA, 22 nt, Human
uggcugggggugcuauagcugc

SEQ ID NO: 997970 - RNA, 22 nt, Human
gacacagagauaggccuguguu

SEQ ID NO: 997971 - RNA, 22 nt, Human
agcagcuccugccaugagugcu

SEQ ID NO: 997972 - RNA, 22 nt, Human
ucuggauggucagcucuuccug

SEQ ID NO: 997973 - RNA, 22 nt, Human
gucucagaccacccucuuuggc

SEQ ID NO: 997974 - RNA, 19 nt, Human
cagucccaaauucuuguca

SEQ ID NO: 997975 - RNA, 22 nt, Human
cccuggcauaaaacuucuccag

SEQ ID NO: 997976 - RNA, 22 nt, Human
augcugaggacaaagagaucaa

SEQ ID NO: 997977 - RNA, 22 nt, Human
acuuccugcuaugagcuucugu

SEQ ID NO: 997978 - RNA, 22 nt, Human
ugggcuggcccaccacaccucg

SEQ ID NO: 997979 - RNA, 22 nt, Human
gagagcugcaagguagggcggg

SEQ ID NO: 997980 - RNA, 22 nt, Human
agagcagcacguuguccccaca

SEQ ID NO: 997981 - RNA, 22 nt, Human
auauguguauuugguuagccua

SEQ ID NO: 997982 - RNA, 22 nt, Human
uccugggcccaggcugccaggg

SEQ ID NO: 997983 - RNA, 22 nt, Human
agguggggccaaaugcuacagu

SEQ ID NO: 997984 - RNA, 22 nt, Human
ccugagaccaaguugcagccau

SEQ ID NO: 997985 - RNA, 22 nt, Human
gcccccucuuuggagccagcca

SEQ ID NO: 997986 - RNA, 22 nt, Human
cagaguggcagucccaggccca

SEQ ID NO: 997987 - RNA, 22 nt, Human
accucugcuucccggguucaag

SEQ ID NO: 997988 - RNA, 22 nt, Human
gcccagcuggcuuccagcacau

SEQ ID NO: 997989 - RNA, 22 nt, Human
ggcuuccuggagaaggucugag

SEQ ID NO: 997990 - RNA, 22 nt, Human
ugggcugcagagcccggccuuc

SEQ ID NO: 997991 - RNA, 22 nt, Human
gggcagagacucagaaacagaa

SEQ ID NO: 997992 - RNA, 22 nt, Human
gccuggaggggacagucucugg

SEQ ID NO: 997993 - RNA, 20 nt, Human
uccucagaagacauuugggg

SEQ ID NO: 997994 - RNA, 22 nt, Human
caugggcucuucuggacugcac

SEQ ID NO: 997995 - RNA, 22 nt, Human
cauagaaaagaguagguaaugu

SEQ ID NO: 997996 - RNA, 20 nt, Human
acagaauaugcugguugugg

SEQ ID NO: 997997 - RNA, 22 nt, Human
gugucccagcagcacauuggcu

SEQ ID NO: 997998 - RNA, 22 nt, Human
acacccagagcgccagugccga

SEQ ID NO: 997999 - RNA, 22 nt, Human
ucaaaaaguugaagaguugggg

SEQ ID NO: 998000 - RNA, 22 nt, Human
ucucccacugcaagcccaggcu

SEQ ID NO: 998001 - RNA, 22 nt, Human
guccucagagugggcagguccu

SEQ ID NO: 998002 - RNA, 22 nt, Human
ugaaccaggaggcagccagcac

SEQ ID NO: 998003 - RNA, 22 nt, Human
ggcugaaguguaguggcucacu

SEQ ID NO: 998004 - RNA, 22 nt, Human
aacacuuucuuccuugcucagg

SEQ ID NO: 998005 - RNA, 21 nt, Human
uuccuggcggcagaaacguga

SEQ ID NO: 998006 - RNA, 18 nt, Human
cccagcuccacuucccuc

SEQ ID NO: 998007 - RNA, 22 nt, Human
gcugccuggcuuuaguccacuu

SEQ ID NO: 998008 - RNA, 22 nt, Human
aggcagugcagaguccucuucu

SEQ ID NO: 998009 - RNA, 22 nt, Human
ccucagagccuccagaaggaau

SEQ ID NO: 998010 - RNA, 17 nt, Human
uuccucucacauuuuuu

SEQ ID NO: 998011 - RNA, 23 nt, Human
uggagaugccccacucccugucu

SEQ ID NO: 998012 - RNA, 22 nt, Human
caucuggcuagcuaucauugug

SEQ ID NO: 998013 - RNA, 22 nt, Human
uaggccaggacagagcuuccag

SEQ ID NO: 998014 - RNA, 22 nt, Human
aaaaguguccagauuaugaaga

SEQ ID NO: 998015 - RNA, 22 nt, Human
acaaagucucuaauaaucuucu

SEQ ID NO: 998016 - RNA, 22 nt, Human
ucuggccugggccugccggugc

SEQ ID NO: 998017 - RNA, 22 nt, Human
aaggccugggaggccucucuuc

SEQ ID NO: 998018 - RNA, 22 nt, Human
uugauacaggccuucuagauga

SEQ ID NO: 998019 - RNA, 22 nt, Human
ggaugcuggggaccaaucucug

SEQ ID NO: 998020 - RNA, 22 nt, Human
cagagggcucuuggcugccugc

SEQ ID NO: 998021 - RNA, 22 nt, Human
guucacaauuuuuacugauugg

SEQ ID NO: 998022 - RNA, 22 nt, Human
uggcagagcccagacuccaguc

SEQ ID NO: 998023 - RNA, 22 nt, Human
acagaguaggugcugucgacug

SEQ ID NO: 998024 - RNA, 22 nt, Human
ccagagccuggcaucugcauaa

SEQ ID NO: 998025 - RNA, 20 nt, Human
agcccaggccugugugaguc

SEQ ID NO: 998026 - RNA, 22 nt, Human
agugaaauuccuggucuuuguu

SEQ ID NO: 998027 - RNA, 22 nt, Human
aggugaguugguaggaaguuug

SEQ ID NO: 998028 - RNA, 23 nt, Human
uggcccugaaucuguccuggagg

SEQ ID NO: 998029 - RNA, 22 nt, Human
ccuggagcucacugggagccgg

SEQ ID NO: 998030 - RNA, 22 nt, Human
ccuggccuuaagggcagggagc

SEQ ID NO: 998031 - RNA, 22 nt, Human
agagugggccucugagucccag

SEQ ID NO: 998032 - RNA, 22 nt, Human
uuuacugugcauuagaaucacc

SEQ ID NO: 998033 - RNA, 22 nt, Human
ggcucuggugugaagcagccuc

SEQ ID NO: 998034 - RNA, 22 nt, Human
ugccucagagugggcuugcuau

SEQ ID NO: 998035 - RNA, 22 nt, Human
gauuucuguaacacuucagaua

SEQ ID NO: 998036 - RNA, 23 nt, Human
ucuggcuccauccuuggggaucc

SEQ ID NO: 998037 - RNA, 22 nt, Human
auguaaggcugccuaugacacu

SEQ ID NO: 998038 - RNA, 22 nt, Human
cagcugccacaccucuuucucu

SEQ ID NO: 998039 - RNA, 22 nt, Human
aguucacauuccgagguacugg

SEQ ID NO: 998040 - RNA, 20 nt, Human
uacugggcaagcccacagac

SEQ ID NO: 998041 - RNA, 21 nt, Human
gcaaggcuuuuguguuuccca

SEQ ID NO: 998042 - RNA, 22 nt, Human
ucugaagaacugaguaaacaug

SEQ ID NO: 998043 - RNA, 22 nt, Human
gccuggguuccaugaucuccag

SEQ ID NO: 998044 - RNA, 22 nt, Human
uggcccugcuaugauccugcaa

SEQ ID NO: 998045 - RNA, 22 nt, Human
cucuccuggggagcacacacac

SEQ ID NO: 998046 - RNA, 17 nt, Human
agcagcugaagcagcca

SEQ ID NO: 998047 - RNA, 22 nt, Human
gccuggagcccaguguggggcu

SEQ ID NO: 998048 - RNA, 22 nt, Human
aauaacaggcucaucagaugcu

SEQ ID NO: 998049 - RNA, 22 nt, Human
aacauucaccucuaccuccuuc

SEQ ID NO: 998050 - RNA, 21 nt, Human
aaggagccuaggaggcucagg

SEQ ID NO: 998051 - RNA, 22 nt, Human
cugagggucaacuugauuguau

SEQ ID NO: 998052 - RNA, 22 nt, Human
ggcuccagggaguggagagaag

SEQ ID NO: 998053 - RNA, 22 nt, Human
gcagcauauuguacuggccugc

SEQ ID NO: 998054 - RNA, 21 nt, Human
ccaccaggucuucugcucggg

SEQ ID NO: 998055 - RNA, 22 nt, Human
cauggcagagaaggggaacugg

SEQ ID NO: 998056 - RNA, 22 nt, Human
agccaucauuucugucacuggc

SEQ ID NO: 998057 - RNA, 22 nt, Human
ugcuggcucaguuugcagacuc

SEQ ID NO: 998058 - RNA, 22 nt, Human
accagguggccccagcgugguu

SEQ ID NO: 998059 - RNA, 22 nt, Human
cugugccuaagaugcaugucuc

SEQ ID NO: 998060 - RNA, 17 nt, Human
aggcuggcucacaggga

SEQ ID NO: 998061 - RNA, 22 nt, Human
agagccuggggauuggcaaggg

SEQ ID NO: 998062 - RNA, 22 nt, Human
cggcuggggcuguccccaugac

SEQ ID NO: 998063 - RNA, 19 nt, Human
ugaagcagcaaacucucag

SEQ ID NO: 998064 - RNA, 22 nt, Human
caggcagccaggggaccugucc

SEQ ID NO: 998065 - RNA, 19 nt, Human
ccuggccagacuucugccc

SEQ ID NO: 998066 - RNA, 22 nt, Human
gucugcccucacgccagcuggg

SEQ ID NO: 998067 - RNA, 22 nt, Human
ccugggcaacauagugagaccu

SEQ ID NO: 998068 - RNA, 22 nt, Human
agucuccuuggccucaaugccu

SEQ ID NO: 998069 - RNA, 22 nt, Human
gacauucacagguaaacauucc

SEQ ID NO: 998070 - RNA, 22 nt, Human
ugucaccaugccagcuucugcc

SEQ ID NO: 998071 - RNA, 19 nt, Human
cagaccuguccagccugug

SEQ ID NO: 998072 - RNA, 22 nt, Human
gggcuucucuuuagugagcuga

SEQ ID NO: 998073 - RNA, 22 nt, Human
gccucaggacuggcauacucau

SEQ ID NO: 998074 - RNA, 22 nt, Human
cccugggcaagcccuauuuucc

SEQ ID NO: 998075 - RNA, 22 nt, Human
acuuccuguuaugugugccucu

SEQ ID NO: 998076 - RNA, 22 nt, Human
cugccagccaggccagguaggc

SEQ ID NO: 998077 - RNA, 22 nt, Human
ggaaccaggaguuacacgaguu

SEQ ID NO: 998078 - RNA, 22 nt, Human
gccuggagggauagaaugcaag

SEQ ID NO: 998079 - RNA, 22 nt, Human
cagagccacugucugccaggca

SEQ ID NO: 998080 - RNA, 20 nt, Human
cugccuggaggccucuaccu

SEQ ID NO: 998081 - RNA, 22 nt, Human
ugagggcugcuuccagagcuag

SEQ ID NO: 998082 - RNA, 22 nt, Human
aguggugcugcgcgcggagcuc

SEQ ID NO: 998083 - RNA, 20 nt, Human
ccugggcuccaggagccccg

SEQ ID NO: 998084 - RNA, 22 nt, Human
ccaggagcaaagaucacuggga

SEQ ID NO: 998085 - RNA, 22 nt, Human
acuuuggaucugauguaaucag

SEQ ID NO: 998086 - RNA, 20 nt, Human
aggcagacaaggagucuguu

SEQ ID NO: 998087 - RNA, 22 nt, Human
cagcaggcccagaguuucaugg

SEQ ID NO: 998088 - RNA, 22 nt, Human
gccacugcacuccagcccaggc

SEQ ID NO: 998089 - RNA, 22 nt, Human
aaugggagguaguaugggaggu

SEQ ID NO: 998090 - RNA, 22 nt, Human
augucuuucucacagccaguuc

SEQ ID NO: 998091 - RNA, 22 nt, Human
ucagaagaagagacuccacagc

SEQ ID NO: 998092 - RNA, 22 nt, Human
cucaccaggaacagcugcggag

SEQ ID NO: 998093 - RNA, 22 nt, Human
ucagcaguuuuauaugcagcuu

SEQ ID NO: 998094 - RNA, 22 nt, Human
cacugaguucccugacauuuca

SEQ ID NO: 998095 - RNA, 22 nt, Human
uaaaugugucuuuuuaaggccu

SEQ ID NO: 998096 - RNA, 22 nt, Human
uaguaaaaguuuaguugaaagu

SEQ ID NO: 998097 - RNA, 22 nt, Human
cagcccuggugccaagguuccc

SEQ ID NO: 998098 - RNA, 22 nt, Human
agaugauggccauguccucucc

SEQ ID NO: 998099 - RNA, 22 nt, Human
agcugccaaguuucucaguuua

SEQ ID NO: 998100 - RNA, 22 nt, Human
gcuggcaggguucucacugaaa

SEQ ID NO: 998101 - RNA, 22 nt, Human
ugugccugucacccucagagag

SEQ ID NO: 998102 - RNA, 22 nt, Human
gccugcaguucugugcuaggca

SEQ ID NO: 998103 - RNA, 22 nt, Human
ugaaaaggaguccuuguuuuca

SEQ ID NO: 998104 - RNA, 22 nt, Human
cccaggagguggagguugcagu

SEQ ID NO: 998105 - RNA, 22 nt, Human
auauauaaccuggauaaggcuu

SEQ ID NO: 998106 - RNA, 21 nt, Human
ugcuggaaaaagugguucuag

SEQ ID NO: 998107 - RNA, 22 nt, Human
gcugucacacauggccccagcu

SEQ ID NO: 998108 - RNA, 22 nt, Human
aaccaaauggaugguaagaggg

SEQ ID NO: 998109 - RNA, 22 nt, Human
acuguacacgugucauuuacag

SEQ ID NO: 998110 - RNA, 22 nt, Human
uuggccaaggucacugggugag

SEQ ID NO: 998111 - RNA, 22 nt, Human
gaagaagcaggaguguguagca

SEQ ID NO: 998112 - RNA, 22 nt, Human
ucccagaggucucugcugguuc

SEQ ID NO: 998113 - RNA, 22 nt, Human
gaguuauuugguuugcaugcag

SEQ ID NO: 998114 - RNA, 22 nt, Human
uccuggccaggaugaccuaaca

SEQ ID NO: 998115 - RNA, 22 nt, Human
agguacagggugaaaguuuaug

SEQ ID NO: 998116 - RNA, 22 nt, Human
aggaggccccuccuggguugcu

SEQ ID NO: 998117 - RNA, 22 nt, Human
ggcucagggaaugaggaagaau

SEQ ID NO: 998118 - RNA, 22 nt, Human
cccaccccuggacaggugagug

SEQ ID NO: 998119 - RNA, 22 nt, Human
caacccaaaagcguuuccauuu

SEQ ID NO: 998120 - RNA, 22 nt, Human
gccugucucuuggaacuuggua

SEQ ID NO: 998121 - RNA, 22 nt, Human
cuacauuuugugauuaugaaau

SEQ ID NO: 998122 - RNA, 22 nt, Human
agaaaugcucuuccugaccaga

SEQ ID NO: 998123 - RNA, 22 nt, Human
uaauguguugaauauuuguaca

SEQ ID NO: 998124 - RNA, 22 nt, Human
uuucaacaggaugauaauaggc

SEQ ID NO: 998125 - RNA, 22 nt, Human
ucaucacauaugucaugauuug

SEQ ID NO: 998126 - RNA, 22 nt, Human
aagagcugcccaaggugaacag

SEQ ID NO: 998127 - RNA, 22 nt, Human
auucugaguccaugggggcagg

SEQ ID NO: 998128 - RNA, 22 nt, Human
cagucccaaggaggaagcaguc

SEQ ID NO: 998129 - RNA, 22 nt, Human
ggccuuggggaggauggugucc

SEQ ID NO: 998130 - RNA, 22 nt, Human
caggggcaggugugagaucauc

SEQ ID NO: 998131 - RNA, 22 nt, Human
uuguaacaaucugucauaaaug

SEQ ID NO: 998132 - RNA, 22 nt, Human
augucccaagauacagcuagag

SEQ ID NO: 998133 - RNA, 17 nt, Human
ccaggugggaggugggg

SEQ ID NO: 998134 - RNA, 22 nt, Human
auuuauuaagcaucugcuaugu

SEQ ID NO: 998135 - RNA, 22 nt, Human
cuggcagcugugugaagaacug

SEQ ID NO: 998136 - RNA, 22 nt, Human
uggcucugcugaaccuagugca

SEQ ID NO: 998137 - RNA, 21 nt, Human
ccucugcucgggcaugcguuu

SEQ ID NO: 998138 - RNA, 22 nt, Human
agggucccgaaggagacagcaa

SEQ ID NO: 998139 - RNA, 22 nt, Human
caaaugcaugagaaauaagagg

SEQ ID NO: 998140 - RNA, 22 nt, Human
acauuucucagggaguuuugcu

SEQ ID NO: 998141 - RNA, 22 nt, Human
gccuguccuggaugcucugcaa

SEQ ID NO: 998142 - RNA, 22 nt, Human
cccagcacaggcaauuccauac

SEQ ID NO: 998143 - RNA, 22 nt, Human
uacuuucuagcucuccccaguu

SEQ ID NO: 998144 - RNA, 19 nt, Human
gcagccaggugcucuaccu

SEQ ID NO: 998145 - RNA, 23 nt, Human
cacugcagcguggucuggcagga

SEQ ID NO: 998146 - RNA, 22 nt, Human
caguggucugugcuucuguaca

SEQ ID NO: 998147 - RNA, 22 nt, Human
agugaguggacccugcaaggaa

SEQ ID NO: 998148 - RNA, 22 nt, Human
uaugcauagguaucuauacuca

SEQ ID NO: 998149 - RNA, 22 nt, Human
uuggccaacauggugaaacccc

SEQ ID NO: 998150 - RNA, 22 nt, Human
gugcucuggcuggucucccggu

SEQ ID NO: 998151 - RNA, 22 nt, Human
uccuggaguauuucuguggugu

SEQ ID NO: 998152 - RNA, 22 nt, Human
uucauuccuucuguaccuugcc

SEQ ID NO: 998153 - RNA, 22 nt, Human
ucauccaguuguggagagggaa

SEQ ID NO: 998154 - RNA, 22 nt, Human
uuauccaaacuggugaaucauu

SEQ ID NO: 998155 - RNA, 22 nt, Human
ggcacucagagauucaggcugu

SEQ ID NO: 998156 - RNA, 22 nt, Human
ccccuuccuuccucagacagcc

SEQ ID NO: 998157 - RNA, 22 nt, Human
agcuauguaacagugccaugga

SEQ ID NO: 998158 - RNA, 22 nt, Human
ucacaacuugaagcugauuuaa

SEQ ID NO: 998159 - RNA, 22 nt, Human
cuggagccacugggucuuguau

SEQ ID NO: 998160 - RNA, 22 nt, Human
uuaauuuauguccaaaccagau

SEQ ID NO: 998161 - RNA, 22 nt, Human
agcagagcgccugcucagaggg

SEQ ID NO: 998162 - RNA, 22 nt, Human
uaaauguguaaaccuccauuac

SEQ ID NO: 998163 - RNA, 22 nt, Human
uagccgcuuaauuauuugguga

SEQ ID NO: 998164 - RNA, 22 nt, Human
ucuaagccuaggaaaugaguuu

SEQ ID NO: 998165 - RNA, 22 nt, Human
cagagccagcccacuguucccg

SEQ ID NO: 998166 - RNA, 22 nt, Human
uuuccucuucuucccaugucau

SEQ ID NO: 998167 - RNA, 22 nt, Human
aagcccagaugugagaacugag

SEQ ID NO: 998168 - RNA, 22 nt, Human
acccaggagcaggcugggcagu

SEQ ID NO: 998169 - RNA, 22 nt, Human
ucaggugguccuaagugccauc

SEQ ID NO: 998170 - RNA, 22 nt, Human
cuggcaggucucgcugacgugu

SEQ ID NO: 998171 - RNA, 22 nt, Human
cccucugcugccuggcuggguc

SEQ ID NO: 998172 - RNA, 22 nt, Human
gugcugcucacaucuggaggua

SEQ ID NO: 998173 - RNA, 22 nt, Human
acugccaggauggcacuagagg

SEQ ID NO: 998174 - RNA, 22 nt, Human
aaauaauuauagcgagucuauc

SEQ ID NO: 998175 - RNA, 22 nt, Human
gugauuccuauuaguacaugca

SEQ ID NO: 998176 - RNA, 22 nt, Human
gacuccugccuccucuguuugc

SEQ ID NO: 998177 - RNA, 22 nt, Human
agccucucuuuauucccagcua

SEQ ID NO: 998178 - RNA, 22 nt, Human
ucuuuuuauauugacaaaaggu

SEQ ID NO: 998179 - RNA, 22 nt, Human
cucccaggguagggagagacua

SEQ ID NO: 998180 - RNA, 22 nt, Human
aggagggugauccgggcugguc

SEQ ID NO: 998181 - RNA, 22 nt, Human
cucugugggggagaggcagcug

SEQ ID NO: 998182 - RNA, 22 nt, Human
gaaggagacccugaagaugcug

SEQ ID NO: 998183 - RNA, 22 nt, Human
cuggcagcucugagucccuucu

SEQ ID NO: 998184 - RNA, 22 nt, Human
guaacaaaguuucuaggugcug

SEQ ID NO: 998185 - RNA, 22 nt, Human
cuucaaacccagauuaaaugca

SEQ ID NO: 998186 - RNA, 22 nt, Human
ggcagcuccucucagcaaaaga

SEQ ID NO: 998187 - RNA, 22 nt, Human
ucagccugcgucauggugacac

SEQ ID NO: 998188 - RNA, 22 nt, Human
caaugauucugcaacugugugc

SEQ ID NO: 998189 - RNA, 21 nt, Human
acagcagacaggcuuaggacc

SEQ ID NO: 998190 - RNA, 22 nt, Human
cagagcuggagcuugaauggag

SEQ ID NO: 998191 - RNA, 22 nt, Human
cagggccucauccucagagauu

SEQ ID NO: 998192 - RNA, 22 nt, Human
ucccagaggcuccagucucuau

SEQ ID NO: 998193 - RNA, 22 nt, Human
ugcuggccucggcgcugggccu

SEQ ID NO: 998194 - RNA, 22 nt, Human
aacccaggaguuggaggcugug

SEQ ID NO: 998195 - RNA, 22 nt, Human
gguggcaagggcagccaguaac

SEQ ID NO: 998196 - RNA, 22 nt, Human
caacagcuggaggcuuggcccg

SEQ ID NO: 998197 - RNA, 22 nt, Human
ucaccucucuggccgucuaccu

SEQ ID NO: 998198 - RNA, 22 nt, Human
aaacccaggguuuugucuuccc

SEQ ID NO: 998199 - RNA, 22 nt, Human
gucccucugccugugguucucu

SEQ ID NO: 998200 - RNA, 22 nt, Human
ucugcccaggaggucccauggg

SEQ ID NO: 998201 - RNA, 22 nt, Human
gcaguccuuaggagaggaagua

SEQ ID NO: 998202 - RNA, 22 nt, Human
guccuggggauuauagaguguu

SEQ ID NO: 998203 - RNA, 21 nt, Human
ggccuuggcgggggccgaauu

SEQ ID NO: 998204 - RNA, 22 nt, Human
gguggcaccuuacccugcgcag

SEQ ID NO: 998205 - RNA, 22 nt, Human
uuugcuggagaugagcgugggu

SEQ ID NO: 998206 - RNA, 22 nt, Human
aggggcuuguggaguugcuggu

SEQ ID NO: 998207 - RNA, 22 nt, Human
ucuccucuccuuucauguuguu

SEQ ID NO: 998208 - RNA, 22 nt, Human
uggggcuccuccuggcaggagg

SEQ ID NO: 998209 - RNA, 22 nt, Human
gucuccuuguggaucucaagga

SEQ ID NO: 998210 - RNA, 22 nt, Human
cagacagagucuucccaucagu

SEQ ID NO: 998211 - RNA, 22 nt, Human
gucuccugaggcauccauugaa

SEQ ID NO: 998212 - RNA, 23 nt, Human
aauagcugguaaugauagcacaa

SEQ ID NO: 998213 - RNA, 21 nt, Human
gcuccuggugcugcguggcgc

SEQ ID NO: 998214 - RNA, 22 nt, Human
gcuggccugaccugaggcuggg

SEQ ID NO: 998215 - RNA, 22 nt, Human
agggggcuccuuggugugcaga

SEQ ID NO: 998216 - RNA, 22 nt, Human
ugcauguuucuguauguuaaug

SEQ ID NO: 998217 - RNA, 22 nt, Human
ugcaugcagcuggucgggcgcc

SEQ ID NO: 998218 - RNA, 20 nt, Human
ucucuaacaugaaugcuauc

SEQ ID NO: 998219 - RNA, 22 nt, Human
cagggacugagauccagacugu

SEQ ID NO: 998220 - RNA, 22 nt, Human
uccuggggaggucgaggcugag

SEQ ID NO: 998221 - RNA, 22 nt, Human
cccagccuuugcuuccugguuc

SEQ ID NO: 998222 - RNA, 22 nt, Human
uuccuggggacuuaccgucauu

SEQ ID NO: 998223 - RNA, 22 nt, Human
agccagucggggccaugcuggg

SEQ ID NO: 998224 - RNA, 22 nt, Human
ccuccugggccuugcucuguga

SEQ ID NO: 998225 - RNA, 22 nt, Human
uuggggccgggauaagguuguu

SEQ ID NO: 998226 - RNA, 22 nt, Human
cuaguagcccauuuuggauacc

SEQ ID NO: 998227 - RNA, 22 nt, Human
ucaguccuuaucugguguucag

SEQ ID NO: 998228 - RNA, 22 nt, Human
uucucucaguuaaacuuuguga

SEQ ID NO: 998229 - RNA, 22 nt, Human
ugggcugcuucuauuggugguc

SEQ ID NO: 998230 - RNA, 17 nt, Human
ucuccuggcucuaucag

SEQ ID NO: 998231 - RNA, 22 nt, Human
cuccguggcuguggacgcagcc

SEQ ID NO: 998232 - RNA, 22 nt, Human
auggccugcagugcugccacag

SEQ ID NO: 998233 - RNA, 22 nt, Human
agucuauuuuugguucuucggg

SEQ ID NO: 998234 - RNA, 23 nt, Human
uagauccuuccaacuacucuuac

SEQ ID NO: 998235 - RNA, 18 nt, Human
uccuuucaccccuucucu

SEQ ID NO: 998236 - RNA, 22 nt, Human
ugcauccuguucuagguuuggg

SEQ ID NO: 998237 - RNA, 22 nt, Human
gcagcucucuggccugcccugg

SEQ ID NO: 998238 - RNA, 22 nt, Human
ucccagucuagagccggauugg

SEQ ID NO: 998239 - RNA, 21 nt, Human
uuccuccucuggagaagaaga

SEQ ID NO: 998240 - RNA, 22 nt, Human
auccuggguaaguuccuuuuaa

SEQ ID NO: 998241 - RNA, 22 nt, Human
ugguggcacugacaucagacac

SEQ ID NO: 998242 - RNA, 22 nt, Human
uccuccuuuccccgcuggagcc

SEQ ID NO: 998243 - RNA, 22 nt, Human
ucuccuggcauuugguugagua

SEQ ID NO: 998244 - RNA, 22 nt, Human
gcaguccuguagcgacuuuuuu

SEQ ID NO: 998245 - RNA, 22 nt, Human
uucuccucagcaaggcagcuuu

SEQ ID NO: 998246 - RNA, 22 nt, Human
uccuuacacuggggaaggugua

SEQ ID NO: 998247 - RNA, 22 nt, Human
cccuguccugcuaggcccuggu

SEQ ID NO: 998248 - RNA, 22 nt, Human
auaguagcgagaucucagcuca

SEQ ID NO: 998249 - RNA, 22 nt, Human
agguggcagacuaacagaagga

SEQ ID NO: 998250 - RNA, 22 nt, Human
cuuccagugcauagguagauca

SEQ ID NO: 998251 - RNA, 22 nt, Human
uccuggguccauggcagccgaa

SEQ ID NO: 998252 - RNA, 22 nt, Human
cuacuucuguggcucuaagaga

SEQ ID NO: 998253 - RNA, 22 nt, Human
cuggccuggcaggggaccucua

SEQ ID NO: 998254 - RNA, 22 nt, Human
acuucccacugcagugacugag

SEQ ID NO: 998255 - RNA, 22 nt, Human
ccuggggaccugccucagcccu

SEQ ID NO: 998256 - RNA, 22 nt, Human
ggccuugggauguggcugcagc

SEQ ID NO: 998257 - RNA, 22 nt, Human
ccugaguucuuauuuccaguca

SEQ ID NO: 998258 - RNA, 22 nt, Human
ggaccugaacauaaaacgaggc

SEQ ID NO: 998259 - RNA, 22 nt, Human
uggcagcagggccccuggagga

SEQ ID NO: 998260 - RNA, 22 nt, Human
gagcagcagcugggccagguuc

SEQ ID NO: 998261 - RNA, 22 nt, Human
uggccugauuuugcuaagagaa

SEQ ID NO: 998262 - RNA, 22 nt, Human
cggggccuagucuaccucggca

SEQ ID NO: 998263 - RNA, 22 nt, Human
ucuccucuauuucuguauguau

SEQ ID NO: 998264 - RNA, 22 nt, Human
ucucugugaauggcgucaccug

SEQ ID NO: 998265 - RNA, 22 nt, Human
gugccuccaggcucgacuaguc

SEQ ID NO: 998266 - RNA, 22 nt, Human
guggcagcggcccaggccgucu

SEQ ID NO: 998267 - RNA, 22 nt, Human
ucuugggcaauuucucuagagg

SEQ ID NO: 998268 - RNA, 22 nt, Human
ccaguucuuucugugugcaaca

SEQ ID NO: 998269 - RNA, 22 nt, Human
gggcuuggcuggggccaccaga

SEQ ID NO: 998270 - RNA, 22 nt, Human
ggucuccugaccuuuagucccu

SEQ ID NO: 998271 - RNA, 22 nt, Human
acauauuuugaaagcuuucuaa

SEQ ID NO: 998272 - RNA, 22 nt, Human
cccagccugaucucggccagcu

SEQ ID NO: 998273 - RNA, 20 nt, Human
cucaccagguguaggcugag

SEQ ID NO: 998274 - RNA, 22 nt, Human
accuccuccaaggagccauagg

SEQ ID NO: 998275 - RNA, 20 nt, Human
uuuuccacuccucaaaacag

SEQ ID NO: 998276 - RNA, 22 nt, Human
acuuuggugcgaagucacuuua

SEQ ID NO: 998277 - RNA, 22 nt, Human
ucuacuuccgcaaaaggcacau

SEQ ID NO: 998278 - RNA, 22 nt, Human
ucccugggguaucgcugaggca

SEQ ID NO: 998279 - RNA, 21 nt, Human
uccuccuguagaggguccugg

SEQ ID NO: 998280 - RNA, 18 nt, Human
ucaguccuccauagagcu

SEQ ID NO: 998281 - RNA, 22 nt, Human
aggccugaggaccagauaaaug

SEQ ID NO: 998282 - RNA, 22 nt, Human
ucuuccuggauggggguugaug

SEQ ID NO: 998283 - RNA, 22 nt, Human
gaggaggcuuccgggaggcacg

SEQ ID NO: 998284 - RNA, 22 nt, Human
agcuuuggcaucugacuagccg

SEQ ID NO: 998285 - RNA, 22 nt, Human
auguuugaaauuguaaguauau

SEQ ID NO: 998286 - RNA, 22 nt, Human
ucuaauuuuggcauuuuaaccu

SEQ ID NO: 998287 - RNA, 22 nt, Human
augcauaucuccuaucuccuca

SEQ ID NO: 998288 - RNA, 22 nt, Human
acuccuggguuccggagauucu

SEQ ID NO: 998289 - RNA, 22 nt, Human
auccugggaaguggccuccucc

SEQ ID NO: 998290 - RNA, 22 nt, Human
gcuccugggcccugggcuaacu

SEQ ID NO: 998291 - RNA, 22 nt, Human
auccgggguucauuuucacuga

SEQ ID NO: 998292 - RNA, 22 nt, Human
uuacccagugaagccgaggcag

SEQ ID NO: 998293 - RNA, 22 nt, Human
gagcuuggugcugccuguuguc

SEQ ID NO: 998294 - RNA, 22 nt, Human
cuccacagccccuccaguggca

SEQ ID NO: 998295 - RNA, 22 nt, Human
acaguccuguacaggccauauc

SEQ ID NO: 998296 - RNA, 22 nt, Human
ccugugggagggagcggcugga

SEQ ID NO: 998297 - RNA, 19 nt, Human
uggcagcauugguaccuug

SEQ ID NO: 998298 - RNA, 20 nt, Human
guccugggagccacagcaca

SEQ ID NO: 998299 - RNA, 22 nt, Human
caagucuagcuuggucacuugg

SEQ ID NO: 998300 - RNA, 22 nt, Human
cuguggccagagcgccguugac

SEQ ID NO: 998301 - RNA, 22 nt, Japanese encephalitis virus
caccaccauggccaugacugac

SEQ ID NO: 998302 - RNA, 22 nt, Japanese encephalitis virus
aggagguccuucgcaagaggug

SEQ ID NO: 998303 - RNA, 22 nt, Japanese encephalitis virus
uggcucgagcgagcaugcggug

SEQ ID NO: 998304 - RNA, 23 nt, Japanese encephalitis virus
ugccucuguccaaugggcuaggu

SEQ ID NO: 998305 - RNA, 22 nt, Japanese encephalitis virus
cuuccucaccaccagcuacaua

SEQ ID NO: 998306 - RNA, 22 nt, Japanese encephalitis virus
uagcugguggugaggaagaaca

SEQ ID NO: 998307 - RNA, 22 nt, Japanese encephalitis virus
aagcucaugagcaaaccuuggg

SEQ ID NO: 998308 - RNA, 22 nt, Japanese encephalitis virus
accaguccauugggcaugugua

SEQ ID NO: 998309 - RNA, 22 nt, Japanese encephalitis virus
uaguagcugauguugagauaga

SEQ ID NO: 998310 - RNA, 22 nt, Japanese encephalitis virus
cuuccucaccaccagcuacaua

SEQ ID NO: 998311 - RNA, 22 nt, Human
guaugugugcaaauguaaauau

SEQ ID NO: 998312 - RNA, 22 nt, Human
aguguguagcauuuggcaggca

SEQ ID NO: 998313 - RNA, 22 nt, Human
auggcuguagucaucugaaggc

SEQ ID NO: 998314 - RNA, 22 nt, Human
ggugugugaggagucacuuagu

SEQ ID NO: 998315 - RNA, 22 nt, Human
cugucuguacaaauguggggcc

SEQ ID NO: 998316 - RNA, 22 nt, Human
ggaggggucucuagcgaggaga

SEQ ID NO: 998317 - RNA, 22 nt, Human
uuguuuucuccacugcaucuua

SEQ ID NO: 998318 - RNA, 22 nt, Human
cugauguguuuuaguuugguaa

SEQ ID NO: 998319 - RNA, 22 nt, Human
ugugugaguaaggcugagagag

SEQ ID NO: 998320 - RNA, 22 nt, Human
aauuucucacucucuugaucac

SEQ ID NO: 998321 - RNA, 22 nt, Human
ucuuuacaucacaauuguaugg

SEQ ID NO: 998322 - RNA, 22 nt, Human
cuggagggcuucugcagguuac

SEQ ID NO: 998323 - RNA, 22 nt, Human
uggcugugucccuguccagagu

SEQ ID NO: 998324 - RNA, 19 nt, Human
uagcugccuguuaccucca

SEQ ID NO: 998325 - RNA, 22 nt, Human
gauauuuucgcagggagaauuc

SEQ ID NO: 998326 - RNA, 19 nt, Human
uuuacaaguucuuuguaug

SEQ ID NO: 998327 - RNA, 22 nt, Human
auuuacagaugaugcuauuuga

SEQ ID NO: 998328 - RNA, 19 nt, Human
uucuguguuaauuccuuua

SEQ ID NO: 998329 - RNA, 21 nt, Human
aaauuuucuuggcuguagugu

SEQ ID NO: 998330 - RNA, 22 nt, Human
ugcagcugagucacccagccau

SEQ ID NO: 998331 - RNA, 22 nt, Human
aucuuuuuacuaacacugcuua

SEQ ID NO: 998332 - RNA, 21 nt, Human
uguguauguccaaugcccuac

SEQ ID NO: 998333 - RNA, 22 nt, Human
gugugcgccgacacagccaggu

SEQ ID NO: 998334 - RNA, 22 nt, Human
agggcagugggaaagccugcuc

SEQ ID NO: 998335 - RNA, 22 nt, Human
ucucuguggagcaguguguuca

SEQ ID NO: 998336 - RNA, 22 nt, Human
uuuucucuacaaaauaaccagc

SEQ ID NO: 998337 - RNA, 20 nt, Human
uccaguauguuauuuggugu

SEQ ID NO: 998338 - RNA, 22 nt, Human
aggcugugugcuccuuaugaga

SEQ ID NO: 998339 - RNA, 22 nt, Human
uuguggcugugcaccgcugccu

SEQ ID NO: 998340 - RNA, 22 nt, Human
gauauuuugagaaauccuauga

SEQ ID NO: 998341 - RNA, 22 nt, Human
cuuuucucuguaccguauaucu

SEQ ID NO: 998342 - RNA, 22 nt, Human
ucaguguggguaagcaugcugu

SEQ ID NO: 998343 - RNA, 22 nt, Human
agcaguauucuccuguggugga

SEQ ID NO: 998344 - RNA, 19 nt, Human
cucuuuccauuguauuugc

SEQ ID NO: 998345 - RNA, 22 nt, Human
auuaacuuuugaucaguguggu

SEQ ID NO: 998346 - RNA, 22 nt, Human
accuuuuuccaaagcuucuuac

SEQ ID NO: 998347 - RNA, 22 nt, Human
gagcugccagacaugggaauga

SEQ ID NO: 998348 - RNA, 22 nt, Human
uucuucugaaacagugacagac

SEQ ID NO: 998349 - RNA, 22 nt, Human
agcuguguguuuccacugagcu

SEQ ID NO: 998350 - RNA, 20 nt, Human
cacaguauucuuccuuaaaa

SEQ ID NO: 998351 - RNA, 22 nt, Human
cgcaugugcguugauugcagug

SEQ ID NO: 998352 - RNA, 22 nt, Human
ccuuuacacguaaggcuguuga

SEQ ID NO: 998353 - RNA, 19 nt, Human
caggacagacuucaaagcc

SEQ ID NO: 998354 - RNA, 22 nt, Human
cguguguguaccugcgcauuua

SEQ ID NO: 998355 - RNA, 22 nt, Human
cagggugcuuccguggagcugu

SEQ ID NO: 998356 - RNA, 23 nt, Human
uauguguaaggagaaggagugag

SEQ ID NO: 998357 - RNA, 22 nt, Human
auggcugugaaggucacacccu

SEQ ID NO: 998358 - RNA, 22 nt, Human
cuuuacagaaagagaacucugg

SEQ ID NO: 998359 - RNA, 22 nt, Human
uugucugucccagcuugugcau

SEQ ID NO: 998360 - RNA, 22 nt, Human
cuggccccaucuggagucugag

SEQ ID NO: 998361 - RNA, 22 nt, Human
ugagggguaaguaaaggaauug

SEQ ID NO: 998362 - RNA, 17 nt, Human
agugugugaaauggugg

SEQ ID NO: 998363 - RNA, 22 nt, Human
uagggguguuucgagagagguu

SEQ ID NO: 998364 - RNA, 22 nt, Human
uguggcugccacccugaagccg

SEQ ID NO: 998365 - RNA, 22 nt, Human
uguguauguguauacacuauau

SEQ ID NO: 998366 - RNA, 22 nt, Human
ugugugaaucuauugaauauau

SEQ ID NO: 998367 - RNA, 22 nt, Human
ucugagugagggugugagauau

SEQ ID NO: 998368 - RNA, 22 nt, Human
agugugugcaugcauucgugca

SEQ ID NO: 998369 - RNA, 20 nt, Human
cugcucugcuuugcaggugg

SEQ ID NO: 998370 - RNA, 22 nt, Human
uucucuguaguugccuggugga

SEQ ID NO: 998371 - RNA, 22 nt, Human
uauuuucauucugugugacugu

SEQ ID NO: 998372 - RNA, 22 nt, Human
gcuguguuggugaagcuguagc

SEQ ID NO: 998373 - RNA, 22 nt, Human
cuggcuguaacauuuugccaua

SEQ ID NO: 998374 - RNA, 22 nt, Human
cuguguaguauuuguacacaua

SEQ ID NO: 998375 - RNA, 22 nt, Human
guguggggagcugcagccacau

SEQ ID NO: 998376 - RNA, 22 nt, Human
gacuguguccaugugcuggauu

SEQ ID NO: 998377 - RNA, 22 nt, Human
uuacauguggagucugauugca

SEQ ID NO: 998378 - RNA, 18 nt, Human
ugucucuccuuucugugu

SEQ ID NO: 998379 - RNA, 22 nt, Human
uuuucaucucugcuuuguaccu

SEQ ID NO: 998380 - RNA, 22 nt, Human
cuuuccagaccuccuuguagcu

SEQ ID NO: 998381 - RNA, 22 nt, Human
aguguuaaugguguauauuagg

SEQ ID NO: 998382 - RNA, 22 nt, Human
uauguucugacucuacauggga

SEQ ID NO: 998383 - RNA, 22 nt, Human
ucucucugagcccugcuuuuuc

SEQ ID NO: 998384 - RNA, 20 nt, Human
gaggaaaagcugccaggccu

SEQ ID NO: 998385 - RNA, 22 nt, Human
uaucugugaaauguguuuguau

SEQ ID NO: 998386 - RNA, 19 nt, Human
ucucugcuucucuuggcau

SEQ ID NO: 998387 - RNA, 22 nt, Human
uuagcaguuuccauuuugguca

SEQ ID NO: 998388 - RNA, 22 nt, Human
uuuaucuuuaggacuuugcaga

SEQ ID NO: 998389 - RNA, 22 nt, Human
guuaagaagcuagagaugaaca

SEQ ID NO: 998390 - RNA, 22 nt, Human
guuacagucaggagauauuuug

SEQ ID NO: 998391 - RNA, 22 nt, Human
gguggcugcacccuggcuaacu

SEQ ID NO: 998392 - RNA, 22 nt, Human
guuucucugucuguuacauugg

SEQ ID NO: 998393 - RNA, 22 nt, Human
uuuucugugauucugagguugg

SEQ ID NO: 998394 - RNA, 22 nt, Human
cuuuacauccuguuucccguuu

SEQ ID NO: 998395 - RNA, 22 nt, Human
uuuugucuaagaacuuugcaaa

SEQ ID NO: 998396 - RNA, 22 nt, Human
acuuuuuacaggguguauacca

SEQ ID NO: 998397 - RNA, 22 nt, Human
uuuaacagauaguuucuucugu

SEQ ID NO: 998398 - RNA, 22 nt, Human
uguuuauuacaguucuuggaau

SEQ ID NO: 998399 - RNA, 22 nt, Human
acuuuacaggcacuucaaguau

SEQ ID NO: 998400 - RNA, 22 nt, Human
agcugcccagcuaggaagaagg

SEQ ID NO: 998401 - RNA, 22 nt, Human
uggaggagaccauuccacucag

SEQ ID NO: 998402 - RNA, 22 nt, Human
uugauuuuuccagcuucuagag

SEQ ID NO: 998403 - RNA, 22 nt, Human
uucaguauauuacucuugucaa

SEQ ID NO: 998404 - RNA, 22 nt, Human
agcugugugcauuugggucuca

SEQ ID NO: 998405 - RNA, 22 nt, Human
gcuguguggcugugccgucacg

SEQ ID NO: 998406 - RNA, 22 nt, Human
ugggugugcccagauggugucc

SEQ ID NO: 998407 - RNA, 22 nt, Human
auacaguagacaaucucaugaa

SEQ ID NO: 998408 - RNA, 22 nt, Human
ucucuguggcaagcaugcugcu

SEQ ID NO: 998409 - RNA, 22 nt, Human
agcagcugagccccagcuguga

SEQ ID NO: 998410 - RNA, 22 nt, Human
gcauguguuagagugugcaugc

SEQ ID NO: 998411 - RNA, 22 nt, Human
cuguguaugacuccagagggua

SEQ ID NO: 998412 - RNA, 22 nt, Human
auuacaguggguaaacagaauu

SEQ ID NO: 998413 - RNA, 22 nt, Human
ugucuuuaagcaaacaguguuu

SEQ ID NO: 998414 - RNA, 22 nt, Human
uuauucucaucucccuacuuag

SEQ ID NO: 998415 - RNA, 22 nt, Human
uuguguguagacucagccauug

SEQ ID NO: 998416 - RNA, 22 nt, Human
acugugcuaucuacugaauuau

SEQ ID NO: 998417 - RNA, 22 nt, Human
auauuuucacagaacuugcaaa

SEQ ID NO: 998418 - RNA, 22 nt, Human
ucugcucuguacugcacuggcc

SEQ ID NO: 998419 - RNA, 22 nt, Human
uauugucuaggaauuguuuaaa

SEQ ID NO: 998420 - RNA, 23 nt, Human
ucuauuacuuauuguacucugga

SEQ ID NO: 998421 - RNA, 22 nt, Human
uuucuacucauccuuuggagaa

SEQ ID NO: 998422 - RNA, 22 nt, Human
ucaugugucugcugcagcuguu

SEQ ID NO: 998423 - RNA, 22 nt, Human
uuuaggaagaucugaaggaaga

SEQ ID NO: 998424 - RNA, 22 nt, Human
auguggcuaguggcuaugaucu

SEQ ID NO: 998425 - RNA, 22 nt, Human
ucuuucagccacuuaccugucu

SEQ ID NO: 998426 - RNA, 22 nt, Human
uacaguauuaugagugauugaa

SEQ ID NO: 998427 - RNA, 22 nt, Human
cuuucucuucgaaaaccugccc

SEQ ID NO: 998428 - RNA, 22 nt, Human
aguggcugccaagagcaaugcu

SEQ ID NO: 998429 - RNA, 22 nt, Human
gugugcuguuguucagguagaa

SEQ ID NO: 998430 - RNA, 22 nt, Human
aggcaguucucguguguguccc

SEQ ID NO: 998431 - RNA, 21 nt, Human
uuuaggaaguuuaaggcaggu

SEQ ID NO: 998432 - RNA, 22 nt, Human
guguguacaaauuucauguaaa

SEQ ID NO: 998433 - RNA, 22 nt, Human
uucuguguugugacauucuaga

SEQ ID NO: 998434 - RNA, 22 nt, Human
ugucucuuggagggucuaguga

SEQ ID NO: 998435 - RNA, 22 nt, Human
uagcugccuuugggcuccugcu

SEQ ID NO: 998436 - RNA, 22 nt, Human
cugcugugugaccauggacagg

SEQ ID NO: 998437 - RNA, 22 nt, Human
cugcucuaacugcauuaguuuu

SEQ ID NO: 998438 - RNA, 22 nt, Human
aggcugugggguucugcuuuca

SEQ ID NO: 998439 - RNA, 22 nt, Human
aguguguagcaauaugcuggca

SEQ ID NO: 998440 - RNA, 18 nt, Human
cugcccagagcauuucau

SEQ ID NO: 998441 - RNA, 22 nt, Human
auguauguuuucaguuguauua

SEQ ID NO: 998442 - RNA, 22 nt, Human
auggcugugagacaaagagcug

SEQ ID NO: 998443 - RNA, 22 nt, Human
uucugcugguguuuugugaggc

SEQ ID NO: 998444 - RNA, 22 nt, Human
uacagcuaugucuugguguucu

SEQ ID NO: 998445 - RNA, 22 nt, Human
cuuuuuauagcuauguccuaug

SEQ ID NO: 998446 - RNA, 23 nt, Human
uuacaugugugcacacauucugg

SEQ ID NO: 998447 - RNA, 22 nt, Human
uuucugucauaguuaucuuugu

SEQ ID NO: 998448 - RNA, 22 nt, Human
gcucucugcaagucagcagccu

SEQ ID NO: 998449 - RNA, 22 nt, Human
uguggcugcagacacuggagcc

SEQ ID NO: 998450 - RNA, 22 nt, Human
gcugugagaaacagggaguguc

SEQ ID NO: 998451 - RNA, 22 nt, Human
cauguguggucuguggcuaucu

SEQ ID NO: 998452 - RNA, 22 nt, Human
acaguauauuuucuugauuguu

SEQ ID NO: 998453 - RNA, 18 nt, Human
ugaacuuuggugucucuc

SEQ ID NO: 998454 - RNA, 22 nt, Human
uuacaauaguuccuucuuuugu

SEQ ID NO: 998455 - RNA, 22 nt, Human
uggccugguuguugcugccguu

SEQ ID NO: 998456 - RNA, 22 nt, Human
aguaucaucuccauuucacuga

SEQ ID NO: 998457 - RNA, 22 nt, Human
agggugugcuguugggucuuuc

SEQ ID NO: 998458 - RNA, 22 nt, Human
uggcugcguuuuccgauguauu

SEQ ID NO: 998459 - RNA, 22 nt, Human
guguguguucaauaaauuuaag

SEQ ID NO: 998460 - RNA, 22 nt, Human
uuucuuuccauacauauugcua

SEQ ID NO: 998461 - RNA, 22 nt, Human
aucuuuaccaccaaagaaugcu

SEQ ID NO: 998462 - RNA, 22 nt, Human
guuaacuugguagucuaagugu

SEQ ID NO: 998463 - RNA, 22 nt, Human
acuuguuuggucucauguuuaa

SEQ ID NO: 998464 - RNA, 22 nt, Human
ccuuuacaucugacuucuuuca

SEQ ID NO: 998465 - RNA, 22 nt, Human
uuuuauguaauccuuacugucg

SEQ ID NO: 998466 - RNA, 22 nt, Human
uagacuuuuaagucccucuuua

SEQ ID NO: 998467 - RNA, 19 nt, Human
cuguacagguugcuucugg

SEQ ID NO: 998468 - RNA, 22 nt, Human
uuacacuaagcuacuucuauau

SEQ ID NO: 998469 - RNA, 22 nt, Human
uaguauuuaaucacuuuugucu

SEQ ID NO: 998470 - RNA, 22 nt, Human
gcccacucuggagccuguuccc

SEQ ID NO: 998471 - RNA, 18 nt, Human
cucuguguuggugugaag

SEQ ID NO: 998472 - RNA, 22 nt, Human
uguuacagaaugaauuuccgga

SEQ ID NO: 998473 - RNA, 22 nt, Human
ggcuuguggcaaguguuuuaag

SEQ ID NO: 998474 - RNA, 21 nt, Human
auuuucucuggaugaugguca

SEQ ID NO: 998475 - RNA, 22 nt, Human
caguuuuaucaucugugaaaug

SEQ ID NO: 998476 - RNA, 18 nt, Human
agugugugcccuuucagg

SEQ ID NO: 998477 - RNA, 22 nt, Human
cuuuacagaauaagaauacugg

SEQ ID NO: 998478 - RNA, 22 nt, Human
cuggcugucuucugggagcugu

SEQ ID NO: 998479 - RNA, 22 nt, Human
uuguaacuuaaguuuugcauau

SEQ ID NO: 998480 - RNA, 22 nt, Human
guguguguaucugccuaucaca

SEQ ID NO: 998481 - RNA, 22 nt, Human
acagugauugguuuggggguga

SEQ ID NO: 998482 - RNA, 22 nt, Human
auauuucuccaaauguuuucaa

SEQ ID NO: 998483 - RNA, 22 nt, Human
ucugucugggugccucgaguac

SEQ ID NO: 998484 - RNA, 22 nt, Human
aguguguacucauauacuucca

SEQ ID NO: 998485 - RNA, 22 nt, Human
cuggccccgguuccuaaaaacc

SEQ ID NO: 998486 - RNA, 22 nt, Human
auguguguauauauagucauuu

SEQ ID NO: 998487 - RNA, 22 nt, Human
cugucugugaccucugcauguc

SEQ ID NO: 998488 - RNA, 22 nt, Human
uuggcuguauguacaucuguua

SEQ ID NO: 998489 - RNA, 22 nt, Human
uaugugugcauguauacauuaa

SEQ ID NO: 998490 - RNA, 22 nt, Human
uauauucuuucaccuucuuccu

SEQ ID NO: 998491 - RNA, 22 nt, Human
auguggcuccuuacucaucagc

SEQ ID NO: 998492 - RNA, 22 nt, Human
guguacugcaaaugcugcugcc

SEQ ID NO: 998493 - RNA, 22 nt, Human
aucuuuacaguguaagugcaga

SEQ ID NO: 998494 - RNA, 22 nt, Human
uagcugccaaaagggugggcua

SEQ ID NO: 998495 - RNA, 22 nt, Human
uucucucugugucauuauggac

SEQ ID NO: 998496 - RNA, 22 nt, Human
gacaguauuuaacuaguucauu

SEQ ID NO: 998497 - RNA, 22 nt, Human
uuuguaugaacugguauguagg

SEQ ID NO: 998498 - RNA, 22 nt, Human
cucucucuuguguugcugcaga

SEQ ID NO: 998499 - RNA, 22 nt, Human
cuggagggcugcagcgaggcug

SEQ ID NO: 998500 - RNA, 22 nt, Human
uuucacagcugucuuccgucuc

SEQ ID NO: 998501 - RNA, 22 nt, Human
cuuuacugccaugcauuuauaa

SEQ ID NO: 998502 - RNA, 22 nt, Human
uguggguggagugauauuagcu

SEQ ID NO: 998503 - RNA, 22 nt, Human
aaaguuugaaugauauauuagu

SEQ ID NO: 998504 - RNA, 22 nt, Human
acaguaauauugaugcucguca

SEQ ID NO: 998505 - RNA, 22 nt, Human
cuauuuucccauaugguugaca

SEQ ID NO: 998506 - RNA, 22 nt, Human
caguauguacucuuaucaugua

SEQ ID NO: 998507 - RNA, 22 nt, Human
cuauuuucauucuuacauuguc

SEQ ID NO: 998508 - RNA, 22 nt, Human
ucuuugcagaauuuaacuuugc

SEQ ID NO: 998509 - RNA, 22 nt, Human
auucucuguagauggcuugaga

SEQ ID NO: 998510 - RNA, 22 nt, Human
uguggcugcaaaggaaggcugc

SEQ ID NO: 998511 - RNA, 22 nt, Human
aguggcuguuccaggugaggac

SEQ ID NO: 998512 - RNA, 22 nt, Human
auuuuccuagucaugugcuucu

SEQ ID NO: 998513 - RNA, 22 nt, Human
aggcuguggugggcuuugagcc

SEQ ID NO: 998514 - RNA, 22 nt, Human
guauguguugaauucagggguc

SEQ ID NO: 998515 - RNA, 22 nt, Human
ggggugagaucaaggaagcccu

SEQ ID NO: 998516 - RNA, 22 nt, Human
cuuauuuaugucugucucuaau

SEQ ID NO: 998517 - RNA, 22 nt, Human
uuguguguacugguuaugggca

SEQ ID NO: 998518 - RNA, 22 nt, Human
aguguauucagaauguagcaaa

SEQ ID NO: 998519 - RNA, 22 nt, Human
auuuuccuccaugugagcaguu

SEQ ID NO: 998520 - RNA, 22 nt, Human
agcuguguccugaagacacugc

SEQ ID NO: 998521 - RNA, 22 nt, Human
uuuacuuuugguaaggucauuu

SEQ ID NO: 998522 - RNA, 23 nt, Human
ccugugugcccuuaauucacagc

SEQ ID NO: 998523 - RNA, 22 nt, Human
cuacaguacuggaugcucagcc

SEQ ID NO: 998524 - RNA, 22 nt, Human
uuauuugcugauuucaguuuca

SEQ ID NO: 998525 - RNA, 22 nt, Human
gauuuucuugggaaacaaugag

SEQ ID NO: 998526 - RNA, 22 nt, Human
acuuuguugaagaauauguuag

SEQ ID NO: 998527 - RNA, 22 nt, Human
ucuuuaagaguucauuugcaug

SEQ ID NO: 998528 - RNA, 22 nt, Human
uuauuugcccauguuuagcaga

SEQ ID NO: 998529 - RNA, 22 nt, Human
aaggcaggaugggaaaagauuu

SEQ ID NO: 998530 - RNA, 22 nt, Human
ugaggcagugcugggaagccug

SEQ ID NO: 998531 - RNA, 22 nt, Human
uucugcucaguaguaagagugc

SEQ ID NO: 998532 - RNA, 22 nt, Human
uucuucuuuaucucaguauccu

SEQ ID NO: 998533 - RNA, 22 nt, Human
uuacaguaauguauuauuuaac

SEQ ID NO: 998534 - RNA, 22 nt, Human
ucucucuucagagauaccuugc

SEQ ID NO: 998535 - RNA, 22 nt, Human
uauguggccuuuuaugucugac

SEQ ID NO: 998536 - RNA, 22 nt, Human
ggcagugagcuggagggaagga

SEQ ID NO: 998537 - RNA, 22 nt, Human
aaggcaguucacucacgcagcc

SEQ ID NO: 998538 - RNA, 22 nt, Human
uguuacagugacuaauguuuua

SEQ ID NO: 998539 - RNA, 22 nt, Human
aguggcuggcauaggaacagac

SEQ ID NO: 998540 - RNA, 22 nt, Human
ucuuugcaugugcuucuuggcc

SEQ ID NO: 998541 - RNA, 22 nt, Human
uuagaguagagccauuucuguu

SEQ ID NO: 998542 - RNA, 22 nt, Human
acaguguagaauccuguacuua

SEQ ID NO: 998543 - RNA, 22 nt, Human
gugcuguaucagaaucugcucu

SEQ ID NO: 998544 - RNA, 22 nt, Human
ucugcucugggccagcuauuaa

SEQ ID NO: 998545 - RNA, 22 nt, Human
ucuuuucuugcauuauugcacu

SEQ ID NO: 998546 - RNA, 18 nt, Human
uuccaguagcuguaucac

SEQ ID NO: 998547 - RNA, 19 nt, Human
uuaucuguguugcaguggu

SEQ ID NO: 998548 - RNA, 22 nt, Human
accguauauguuugcugugccc

SEQ ID NO: 998549 - RNA, 18 nt, Human
acagugauuguucuaugc

SEQ ID NO: 998550 - RNA, 22 nt, Human
aaguuuuaacaaguacuuacua

SEQ ID NO: 998551 - RNA, 22 nt, Human
ugugaguaauaaagucauuuuu

SEQ ID NO: 998552 - RNA, 22 nt, Human
uuacaguagauuuugaaugugg

SEQ ID NO: 998553 - RNA, 22 nt, Human
gugugugccaacuuuaugugca

SEQ ID NO: 998554 - RNA, 22 nt, Human
gugcugugugauccaugcuggc

SEQ ID NO: 998555 - RNA, 22 nt, Human
gccagccccuuagggcucuccc

SEQ ID NO: 998556 - RNA, 22 nt, Human
guauuauucucagcuuugggau

SEQ ID NO: 998557 - RNA, 20 nt, Human
aguguaugaaucuggauggg

SEQ ID NO: 998558 - RNA, 20 nt, Human
auacaguaggugcucaauau

SEQ ID NO: 998559 - RNA, 22 nt, Human
gcagcugcagguggucccaugc

SEQ ID NO: 998560 - RNA, 22 nt, Human
gagcugugauuggugucucacu

SEQ ID NO: 998561 - RNA, 22 nt, Human
uuuuccucuguuauuaguguga

SEQ ID NO: 998562 - RNA, 22 nt, Human
cuucacagagucccugauuguu

SEQ ID NO: 998563 - RNA, 23 nt, Human
uucucuuuagauuuacauuacuc

SEQ ID NO: 998564 - RNA, 22 nt, Human
aggcugugaugagccucaugga

SEQ ID NO: 998565 - RNA, 21 nt, Human
cugugucgcucucgcugggag

SEQ ID NO: 998566 - RNA, 22 nt, Human
agcugugucauccuggaaaaug

SEQ ID NO: 998567 - RNA, 20 nt, Human
auguaugcaaaugucuucca

SEQ ID NO: 998568 - RNA, 22 nt, Human
auggcuguuuagcuucucugcu

SEQ ID NO: 998569 - RNA, 22 nt, Human
gcucugugguggggcagaguuu

SEQ ID NO: 998570 - RNA, 21 nt, Human
gccuguguaaauugaguuucc

SEQ ID NO: 998571 - RNA, 22 nt, Human
agcugcccagauaggaggaggc

SEQ ID NO: 998572 - RNA, 20 nt, Human
gugugugcuccaugcaugcu

SEQ ID NO: 998573 - RNA, 22 nt, Human
uuuuccucugcagagcaguuag

SEQ ID NO: 998574 - RNA, 22 nt, Human
acagauauuaugguuucuccuu

SEQ ID NO: 998575 - RNA, 22 nt, Human
uguguguguuuauaaaucuaaa

SEQ ID NO: 998576 - RNA, 22 nt, Human
uguguguguuuacaguuucuca

SEQ ID NO: 998577 - RNA, 22 nt, Human
aggcuguguggauaauauuggg

SEQ ID NO: 998578 - RNA, 22 nt, Human
gagcugccugugugccaugaug

SEQ ID NO: 998579 - RNA, 22 nt, Human
uauuucucucacgguugccugg

SEQ ID NO: 998580 - RNA, 22 nt, Human
aacaguuugcuuuaagaggcac

SEQ ID NO: 998581 - RNA, 22 nt, Human
aggaggugacagccugcaucug

SEQ ID NO: 998582 - RNA, 22 nt, Human
ugugggugaugaauuuguucuu

SEQ ID NO: 998583 - RNA, 22 nt, Human
uugauuuucaauucauugacaa

SEQ ID NO: 998584 - RNA, 22 nt, Human
uguggcugugguuuucauaaau

SEQ ID NO: 998585 - RNA, 19 nt, Human
ucuuuucacgcauuuugaa

SEQ ID NO: 998586 - RNA, 22 nt, Human
aucuguguguucaggaaguccu

SEQ ID NO: 998587 - RNA, 22 nt, Human
uagugugucccuggggaguguu

SEQ ID NO: 998588 - RNA, 22 nt, Human
aaauaaagguccacuuuagggc

SEQ ID NO: 998589 - RNA, 22 nt, Human
uuauuuccuaaaucucuuuguu

SEQ ID NO: 998590 - RNA, 22 nt, Human
cugugaguaaugaccugucuug

SEQ ID NO: 998591 - RNA, 22 nt, Human
auguggcuugucgauauuagca

SEQ ID NO: 998592 - RNA, 22 nt, Human
cugugugcucggauggacucgu

SEQ ID NO: 998593 - RNA, 22 nt, Human
acagaauauuuggcaugcgucu

SEQ ID NO: 998594 - RNA, 18 nt, Human
gcuuuuuagugcaucuuc

SEQ ID NO: 998595 - RNA, 22 nt, Human
ccuggagggacccuggcccugu

SEQ ID NO: 998596 - RNA, 22 nt, Human
uuuacagcagcaugauuuauaa

SEQ ID NO: 998597 - RNA, 22 nt, Human
uauuuccugcauggugauguaa

SEQ ID NO: 998598 - RNA, 22 nt, Human
uaacaguacauccuuuucucuu

SEQ ID NO: 998599 - RNA, 22 nt, Human
cuucugugacguaugugaggac

SEQ ID NO: 998600 - RNA, 22 nt, Human
cucuuuacugcuacuacaaaga

SEQ ID NO: 998601 - RNA, 22 nt, Human
uucuuucugaauacaguugagu

SEQ ID NO: 998602 - RNA, 19 nt, Human
cucuuuacucccuugccuu

SEQ ID NO: 998603 - RNA, 22 nt, Human
gauguguguuuauacauauauu

SEQ ID NO: 998604 - RNA, 22 nt, Human
guuaacuuucaggugcauguuu

SEQ ID NO: 998605 - RNA, 22 nt, Human
uucucuuucugcugggcuggaa

SEQ ID NO: 998606 - RNA, 22 nt, Human
uaacucuuuacuauacauuuau

SEQ ID NO: 998607 - RNA, 23 nt, Human
uguggcugagaaauugacaacuu

SEQ ID NO: 998608 - RNA, 22 nt, Human
uuggcuguuuuaucuccuggug

SEQ ID NO: 998609 - RNA, 20 nt, Human
uauuuugcaauuaugguuca

SEQ ID NO: 998610 - RNA, 22 nt, Human
cauguauauuuuauguggagag

SEQ ID NO: 998611 - RNA, 17 nt, Human
ucugugauaguguagau

SEQ ID NO: 998612 - RNA, 22 nt, Human
ucuucuuugaaucauagugacc

SEQ ID NO: 998613 - RNA, 22 nt, Human
ggagggguggucgcgaagagca

SEQ ID NO: 998614 - RNA, 17 nt, Human
gacagcugguuccuggc

SEQ ID NO: 998615 - RNA, 22 nt, Human
auuuacagacccucccacuaag

SEQ ID NO: 998616 - RNA, 22 nt, Human
ugcagcugacccacuccagucc

SEQ ID NO: 998617 - RNA, 22 nt, Human
gugugagugaaaguaguuugau

SEQ ID NO: 998618 - RNA, 22 nt, Human
cuggccccagaguuucacuugg

SEQ ID NO: 998619 - RNA, 22 nt, Human
caggauauuuacguucugcuac

SEQ ID NO: 998620 - RNA, 22 nt, Human
aggaggugagcggucauguggu

SEQ ID NO: 998621 - RNA, 22 nt, Human
ugugccuggcccagugguguca

SEQ ID NO: 998622 - RNA, 22 nt, Human
cugugccuucugccuggaacau

SEQ ID NO: 998623 - RNA, 22 nt, Human
auguguuggauauuagugggga

SEQ ID NO: 998624 - RNA, 20 nt, Human
uucuaacuacucucccuuug

SEQ ID NO: 998625 - RNA, 22 nt, Human
uuaguuuucccaucuuuauggu

SEQ ID NO: 998626 - RNA, 18 nt, Human
auguggcuagugcaacug

SEQ ID NO: 998627 - RNA, 22 nt, Human
cagcccacgucagggccacuca

SEQ ID NO: 998628 - RNA, 22 nt, Human
uuuguguguauauguauauaga

SEQ ID NO: 998629 - RNA, 19 nt, Human
uaacucuuuccuuuucccc

SEQ ID NO: 998630 - RNA, 22 nt, Human
uuuagcuucaguucuagcuucu

SEQ ID NO: 998631 - RNA, 23 nt, Human
aguggcugagaguguuucauaug

SEQ ID NO: 998632 - RNA, 22 nt, Human
agaguauaauuagugucuucua

SEQ ID NO: 998633 - RNA, 22 nt, Human
uuuacaauagggucugaaugaa

SEQ ID NO: 998634 - RNA, 22 nt, Human
acagugaucaguuacugucugu

SEQ ID NO: 998635 - RNA, 22 nt, Human
cuucugugaaugaaguguggga

SEQ ID NO: 998636 - RNA, 22 nt, Human
cugucuguuuuguauacaggcc

SEQ ID NO: 998637 - RNA, 22 nt, Human
ugggaagggagaguguccugga

SEQ ID NO: 998638 - RNA, 22 nt, Human
aguguaugaacuuaagagagag

SEQ ID NO: 998639 - RNA, 22 nt, Human
ugcaguguuccuguggguuuau

SEQ ID NO: 998640 - RNA, 22 nt, Human
uacuuuuccagggcuggcugag

SEQ ID NO: 998641 - RNA, 22 nt, Human
ucacaguaguuguucucuguuu

SEQ ID NO: 998642 - RNA, 22 nt, Human
aguggcugcugacuuuaauaca

SEQ ID NO: 998643 - RNA, 19 nt, Human
guggccugcgcugggugcg

SEQ ID NO: 998644 - RNA, 22 nt, Human
aacuuauugaacauucucgaau

SEQ ID NO: 998645 - RNA, 22 nt, Human
auucucugccauugcgguggau

SEQ ID NO: 998646 - RNA, 22 nt, Human
uuuuacuucauuccugacuuca

SEQ ID NO: 998647 - RNA, 22 nt, Human
aguggcugucuuccaaaaucug

SEQ ID NO: 998648 - RNA, 22 nt, Human
ucucuucuuguguuuuccugcc

SEQ ID NO: 998649 - RNA, 22 nt, Human
uuuacaguccccaggugaggau

SEQ ID NO: 998650 - RNA, 22 nt, Human
ccaggcccugcuccucacacca

SEQ ID NO: 998651 - RNA, 23 nt, Human
auguggcuagugagaccaagaaa

SEQ ID NO: 998652 - RNA, 22 nt, Human
gggcuguguacuaugaggaggg

SEQ ID NO: 998653 - RNA, 22 nt, Human
uucugcugguaacuauguuuca

SEQ ID NO: 998654 - RNA, 22 nt, Human
uguaugugcuugagaagguggg

SEQ ID NO: 998655 - RNA, 22 nt, Human
uuauuugugaaucauuuaucua

SEQ ID NO: 998656 - RNA, 22 nt, Human
uguggccuuauuuguauggggg

SEQ ID NO: 998657 - RNA, 22 nt, Human
uauuuuaucugccagaguggag

SEQ ID NO: 998658 - RNA, 22 nt, Human
agcauauuguaugucuauaugu

SEQ ID NO: 998659 - RNA, 22 nt, Human
gaugugugcugcauaguauauu

SEQ ID NO: 998660 - RNA, 20 nt, Human
ugugugcuaggacuacagug

SEQ ID NO: 998661 - RNA, 22 nt, Human
guggagggugagcucauguuug

SEQ ID NO: 998662 - RNA, 22 nt, Human
gggacucugagagccugagggu

SEQ ID NO: 998663 - RNA, 22 nt, Human
uggcuguguuaccacuucaugu

SEQ ID NO: 998664 - RNA, 20 nt, Human
aguguaugaacagaugcggg

SEQ ID NO: 998665 - RNA, 22 nt, Human
ggugugugguccucucacuuag

SEQ ID NO: 998666 - RNA, 22 nt, Human
augccugucucagggucuguuu

SEQ ID NO: 998667 - RNA, 22 nt, Human
ggugugccuggggcuuagcugc

SEQ ID NO: 998668 - RNA, 22 nt, Human
guacaguaguaaaagugaauga

SEQ ID NO: 998669 - RNA, 19 nt, Human
uuucugucuguguuuugcc

SEQ ID NO: 998670 - RNA, 22 nt, Human
cuggcuguuucaaauguauaga

SEQ ID NO: 998671 - RNA, 22 nt, Human
cuggccccaggcagccugcugg

SEQ ID NO: 998672 - RNA, 22 nt, Human
acagauauaugauuguguaaau

SEQ ID NO: 998673 - RNA, 22 nt, Human
cuaacuuuauuugcuaaguaga

SEQ ID NO: 998674 - RNA, 22 nt, Human
gcuguguugggaaucauguggg

SEQ ID NO: 998675 - RNA, 22 nt, Human
uuucucucuuaaggaguuuaaa

SEQ ID NO: 998676 - RNA, 22 nt, Human
auguggcuagugcaacugagaa

SEQ ID NO: 998677 - RNA, 22 nt, Human
caguguaucauuagugugauga

SEQ ID NO: 998678 - RNA, 22 nt, Human
cuguuugugauuagcagugggu

SEQ ID NO: 998679 - RNA, 22 nt, Human
gcuuuacacagaugaauauuuc

SEQ ID NO: 998680 - RNA, 22 nt, Human
ucuuaacauauuauuuuagcac

SEQ ID NO: 998681 - RNA, 22 nt, Human
uuacaguguuacuugaugucca

SEQ ID NO: 998682 - RNA, 22 nt, Human
ucuucacaugaccuucaugucu

SEQ ID NO: 998683 - RNA, 22 nt, Human
aggggugacacauaucagugca

SEQ ID NO: 998684 - RNA, 22 nt, Human
aucucuuugauggcuccuguga

SEQ ID NO: 998685 - RNA, 22 nt, Human
gcuuuacaaguggugcagauua

SEQ ID NO: 998686 - RNA, 22 nt, Human
uaccaguaauaguaugugagau

SEQ ID NO: 998687 - RNA, 22 nt, Human
gcugagugaaaguuugcugugu

SEQ ID NO: 998688 - RNA, 22 nt, Human
uuucuucuuucccagugauggg

SEQ ID NO: 998689 - RNA, 22 nt, Human
ucucucuugaaguauuagcuag

SEQ ID NO: 998690 - RNA, 22 nt, Human
caguaauaagcuggagggugug

SEQ ID NO: 998691 - RNA, 22 nt, Human
ccuguguggaaggcaggaggcc

SEQ ID NO: 998692 - RNA, 22 nt, Human
guguggcuagaagugucuuguu

SEQ ID NO: 998693 - RNA, 22 nt, Human
ugacuuuuggaccucacugucc

SEQ ID NO: 998694 - RNA, 18 nt, Human
aagcugcccucaggcagg

SEQ ID NO: 998695 - RNA, 22 nt, Human
cuguuacauagcuuuucuuaac

SEQ ID NO: 998696 - RNA, 22 nt, Human
uauguguaaucauaucugauac

SEQ ID NO: 998697 - RNA, 21 nt, Human
ugugugggcauaucugcugca

SEQ ID NO: 998698 - RNA, 18 nt, Human
ccuguguguguugcaggc

SEQ ID NO: 998699 - RNA, 20 nt, Human
ugcccagcaagagugcaguu

SEQ ID NO: 998700 - RNA, 22 nt, Human
caguaaaugugauuuuucuugu

SEQ ID NO: 998701 - RNA, 22 nt, Human
agcuggccuuagugagcaccug

SEQ ID NO: 998702 - RNA, 22 nt, Human
uucuauuucuuaaucuuggcug

SEQ ID NO: 998703 - RNA, 22 nt, Human
ugccugugcccuuugcugggag

SEQ ID NO: 998704 - RNA, 22 nt, Human
uucugugugccagaguugugcu

SEQ ID NO: 998705 - RNA, 16 nt, Human
uuucucucugcuauuu

SEQ ID NO: 998706 - RNA, 22 nt, Human
uauauuugcuaaaugugugcaa

SEQ ID NO: 998707 - RNA, 22 nt, Human
auuacaguaaaugcuacaggca

SEQ ID NO: 998708 - RNA, 22 nt, Human
uaguauaucuuuaguacauagu

SEQ ID NO: 998709 - RNA, 22 nt, Human
ucuaaucuacaaaaggaaauuc

SEQ ID NO: 998710 - RNA, 22 nt, Human
uuuaaucuucaaaauagucuua

SEQ ID NO: 998711 - RNA, 20 nt, Human
uauauuuucucuuuggccuu

SEQ ID NO: 998712 - RNA, 22 nt, Human
cugcucuguuucuuagcugggu

SEQ ID NO: 998713 - RNA, 18 nt, Human
uguaaugcagcggguggc

SEQ ID NO: 998714 - RNA, 22 nt, Human
gcagcugccuauucagggcuug

SEQ ID NO: 998715 - RNA, 22 nt, Human
uagaguauauaggccuuugugu

SEQ ID NO: 998716 - RNA, 22 nt, Human
uuguggcugucgagaauugagg

SEQ ID NO: 998717 - RNA, 22 nt, Human
uuugacagaaaguuauuauuuu

SEQ ID NO: 998718 - RNA, 22 nt, Human
auggcuguuuugugacuucuca

SEQ ID NO: 998719 - RNA, 23 nt, Human
caacuuuuggcuacaugcuuagc

SEQ ID NO: 998720 - RNA, 22 nt, Human
cuuuuucacuguguccucacac

SEQ ID NO: 998721 - RNA, 22 nt, Human
uggagguggaguuggaaacuga

SEQ ID NO: 998722 - RNA, 22 nt, Human
uuuacacggcauuaucuucaug

SEQ ID NO: 998723 - RNA, 22 nt, Human
agcugccccaugagaggcaggu

SEQ ID NO: 998724 - RNA, 22 nt, Human
uucucugcucucacauacagaa

SEQ ID NO: 998725 - RNA, 22 nt, Human
ugggggcauggaccagccuggc

SEQ ID NO: 998726 - RNA, 22 nt, Human
aauuucucucucaugcuucaug

SEQ ID NO: 998727 - RNA, 22 nt, Human
uuuguguauguaugcuuguaca

SEQ ID NO: 998728 - RNA, 22 nt, Human
ugugagugaaugggucugaagu

SEQ ID NO: 998729 - RNA, 22 nt, Human
auggcuguguuagaugcuaagu

SEQ ID NO: 998730 - RNA, 22 nt, Human
ugugugugacaaccuaguucag

SEQ ID NO: 998731 - RNA, 22 nt, Human
uuuauaguagcaugauuuauag

SEQ ID NO: 998732 - RNA, 22 nt, Human
ucuucacagaugcauauacuuc

SEQ ID NO: 998733 - RNA, 22 nt, Human
uacauguauugauuucucuucu

SEQ ID NO: 998734 - RNA, 19 nt, Human
uguguguuuauauauguau

SEQ ID NO: 998735 - RNA, 22 nt, Human
uuaccaguuuugccauuugcua

SEQ ID NO: 998736 - RNA, 22 nt, Human
gcucucuguuauuaagaucuuu

SEQ ID NO: 998737 - RNA, 22 nt, Human
ucuuugcaacucccauuuccau

SEQ ID NO: 998738 - RNA, 22 nt, Human
gucucuuuuauggugaguugau

SEQ ID NO: 998739 - RNA, 22 nt, Human
ucugcucuguggcuucagcuaa

SEQ ID NO: 998740 - RNA, 22 nt, Human
ccguguguaugguggaacugcu

SEQ ID NO: 998741 - RNA, 22 nt, Human
aacaguaugugagauuuacaca

SEQ ID NO: 998742 - RNA, 22 nt, Human
gguguggcugugaguuuuugau

SEQ ID NO: 998743 - RNA, 22 nt, Human
uacauauacugagugauuugcu

SEQ ID NO: 998744 - RNA, 22 nt, Human
uauuuucaccuucucuggauau

SEQ ID NO: 998745 - RNA, 22 nt, Human
auggcuguaaauucagagaugg

SEQ ID NO: 998746 - RNA, 22 nt, Human
cuguggcugcagaccuuaaaca

SEQ ID NO: 998747 - RNA, 23 nt, Human
aucucucugguggucacagucag

SEQ ID NO: 998748 - RNA, 22 nt, Human
auggcugugguaucagacgcag

SEQ ID NO: 998749 - RNA, 22 nt, Human
ggcagugaaucugagagccugg

SEQ ID NO: 998750 - RNA, 22 nt, Human
uuuaacuugaucaguagagcau

SEQ ID NO: 998751 - RNA, 22 nt, Human
uguauguguccuaauucaagca

SEQ ID NO: 998752 - RNA, 22 nt, Human
uucacagugguagugcauuuag

SEQ ID NO: 998753 - RNA, 22 nt, Human
gcaguuuuagagcuuuaagaug

SEQ ID NO: 998754 - RNA, 22 nt, Human
ggaagaaagcacacaaacuuga

SEQ ID NO: 998755 - RNA, 22 nt, Human
uuuuacaguuccaugcaaagcg

SEQ ID NO: 998756 - RNA, 22 nt, Human
uuucugcucauccuaguggagc

SEQ ID NO: 998757 - RNA, 22 nt, Human
uggccagcccuucagccaugcc

SEQ ID NO: 998758 - RNA, 17 nt, Human
ugugcgcuugugugagg

SEQ ID NO: 998759 - RNA, 22 nt, Human
uuuuguauccucccuuucacug

SEQ ID NO: 998760 - RNA, 22 nt, Human
ucuggcugacauccuguaugag

SEQ ID NO: 998761 - RNA, 22 nt, Human
cuguggcucagcacggggucag

SEQ ID NO: 998762 - RNA, 22 nt, Human
uuuucucuccagguggggugau

SEQ ID NO: 998763 - RNA, 22 nt, Human
auuuacagacguggauuagugc

SEQ ID NO: 998764 - RNA, 22 nt, Human
auauauuuuuugagacagaguc

SEQ ID NO: 998765 - RNA, 22 nt, Human
ucuuuagcuagaaauacucuaa

SEQ ID NO: 998766 - RNA, 22 nt, Human
auuuacagaagcauguaauagc

SEQ ID NO: 998767 - RNA, 22 nt, Human
agauauuuugugugauguuuca

SEQ ID NO: 998768 - RNA, 22 nt, Human
uucuccuuccugguuuucaggc

SEQ ID NO: 998769 - RNA, 20 nt, Human
cugcugcccugucagccucu

SEQ ID NO: 998770 - RNA, 22 nt, Human
cuuacagugacccugcagauuu

SEQ ID NO: 998771 - RNA, 22 nt, Human
agcugcccuuuaugaugcugaa

SEQ ID NO: 998772 - RNA, 22 nt, Human
aggcuguggcccuggucuagca

SEQ ID NO: 998773 - RNA, 22 nt, Human
ugucuguaauagucacuaugug

SEQ ID NO: 998774 - RNA, 22 nt, Human
cagccacuugugaugcugggga

SEQ ID NO: 998775 - RNA, 22 nt, Human
uucucucuggaccugggaugcg

SEQ ID NO: 998776 - RNA, 22 nt, Human
uacagucagagugccuuucuaa

SEQ ID NO: 998777 - RNA, 22 nt, Human
ucucucugccaacucacagcca

SEQ ID NO: 998778 - RNA, 22 nt, Human
guguggcuguuuagugacuuuc

SEQ ID NO: 998779 - RNA, 22 nt, Human
gggcuguguuaggugcgguuac

SEQ ID NO: 998780 - RNA, 22 nt, Human
cguguaugauaaauguuaauaa

SEQ ID NO: 998781 - RNA, 22 nt, Human
ucuuaacaagcuccucagugcu

SEQ ID NO: 998782 - RNA, 22 nt, Human
cugcccacaguucucugccaug

SEQ ID NO: 998783 - RNA, 22 nt, Human
acaguauauauagucuaaaagc

SEQ ID NO: 998784 - RNA, 19 nt, Human
uuuucucgugcuugucugc

SEQ ID NO: 998785 - RNA, 22 nt, Human
ugcuguguaaaaggugauugaa

SEQ ID NO: 998786 - RNA, 22 nt, Human
aguauauuuaccauuggguggg

SEQ ID NO: 998787 - RNA, 22 nt, Human
acuuauuuauucauucagcuca

SEQ ID NO: 998788 - RNA, 22 nt, Human
cucugugucagcugggugugca

SEQ ID NO: 998789 - RNA, 22 nt, Human
cuguggcugcgcccugggggag

SEQ ID NO: 998790 - RNA, 22 nt, Human
uuuccucuucgauuaaguuugg

SEQ ID NO: 998791 - RNA, 22 nt, Human
uaguguguaugguaaugaugaa

SEQ ID NO: 998792 - RNA, 22 nt, Human
aagcuggagaguuucacagaug

SEQ ID NO: 998793 - RNA, 22 nt, Human
uugacaguauagcuuuaccuau

SEQ ID NO: 998794 - RNA, 22 nt, Human
gcagcccaggcucgcucacugc

SEQ ID NO: 998795 - RNA, 22 nt, Human
ucugugucguucugugcucugg

SEQ ID NO: 998796 - RNA, 15 nt, Human
aucucucuagcugcu

SEQ ID NO: 998797 - RNA, 22 nt, Human
uguguguauaauaaugucugca

SEQ ID NO: 998798 - RNA, 22 nt, Human
gguggcugugagcauuauguga

SEQ ID NO: 998799 - RNA, 22 nt, Human
caggacagcucaacaccuccuc

SEQ ID NO: 998800 - RNA, 22 nt, Human
guuucucuuugaagccuggcug

SEQ ID NO: 998801 - RNA, 22 nt, Human
uggcugugaauggcaaauaauc

SEQ ID NO: 998802 - RNA, 22 nt, Human
auuacagugccaccucgugguc

SEQ ID NO: 998803 - RNA, 22 nt, Human
auugucucugaauuuucagcug

SEQ ID NO: 998804 - RNA, 22 nt, Human
acaguauaccauugugacuuug

SEQ ID NO: 998805 - RNA, 18 nt, Human
uaguuucuaauggccuuu

SEQ ID NO: 998806 - RNA, 22 nt, Human
agcugugugaccuagggcaagc

SEQ ID NO: 998807 - RNA, 22 nt, Human
guggcuguauagccaagucaga

SEQ ID NO: 998808 - RNA, 22 nt, Human
uuuagaguccaaguucuucacu

SEQ ID NO: 998809 - RNA, 22 nt, Human
aguuuucugauguguagugaga

SEQ ID NO: 998810 - RNA, 22 nt, Human
ccugcucugguuuagucagucu

SEQ ID NO: 998811 - RNA, 22 nt, Human
ggaagcugccaguccaccagcu

SEQ ID NO: 998812 - RNA, 22 nt, Human
uggaggugggagggacuguccu

SEQ ID NO: 998813 - RNA, 22 nt, Human
auguaugcuuugauuuuagaug

SEQ ID NO: 998814 - RNA, 22 nt, Human
uucaguauuucaugacuuucuu

SEQ ID NO: 998815 - RNA, 22 nt, Human
ucucuacagauccuauauagaa

SEQ ID NO: 998816 - RNA, 22 nt, Human
cauguauauuucuguaugugca

SEQ ID NO: 998817 - RNA, 22 nt, Human
ugacaguagaagaugcuguuac

SEQ ID NO: 998818 - RNA, 22 nt, Human
uagcuuuuauccacugcuuuug

SEQ ID NO: 998819 - RNA, 22 nt, Human
gugaguguuaacccacugcuuc

SEQ ID NO: 998820 - RNA, 22 nt, Human
guucucucugcuuccaagaugg

SEQ ID NO: 998821 - RNA, 22 nt, Human
ugauuuucaugggugaucuuug

SEQ ID NO: 998822 - RNA, 22 nt, Human
uuacagaaucuacucgugguga

SEQ ID NO: 998823 - RNA, 22 nt, Human
ucucucugaguugagcaggagu

SEQ ID NO: 998824 - RNA, 22 nt, Human
gugaaugccgcagucuguugcu

SEQ ID NO: 998825 - RNA, 22 nt, Human
cuucuuuagggaucucuugcug

SEQ ID NO: 998826 - RNA, 22 nt, Human
ugugugcagccucugucuuugg

SEQ ID NO: 998827 - RNA, 22 nt, Human
cuuauuauaaaauccuguuuga

SEQ ID NO: 998828 - RNA, 23 nt, Human
uuuaacuuuccaauaauucauug

SEQ ID NO: 998829 - RNA, 22 nt, Human
uuucucucagccuguagaaacu

SEQ ID NO: 998830 - RNA, 22 nt, Human
cugugcugagugaugugacuua

SEQ ID NO: 998831 - RNA, 22 nt, Human
uuccucuuucucugugcuaugu

SEQ ID NO: 998832 - RNA, 22 nt, Human
uguacaguuuuaacucugaggg

SEQ ID NO: 998833 - RNA, 22 nt, Human
auacaguauguaggcuuuucag

SEQ ID NO: 998834 - RNA, 22 nt, Human
ccacucugauuuuggcuccacu

SEQ ID NO: 998835 - RNA, 22 nt, Human
aagcugccaaugguaagcugcu

SEQ ID NO: 998836 - RNA, 22 nt, Human
agcuguguaagucauguaggug

SEQ ID NO: 998837 - RNA, 22 nt, Human
uuuaacuggucuccugcugcuu

SEQ ID NO: 998838 - RNA, 19 nt, Human
guauauuuauauggcugua

SEQ ID NO: 998839 - RNA, 22 nt, Human
uucuuuacaguggguuuugaau

SEQ ID NO: 998840 - RNA, 22 nt, Human
uuacaguaugaucaacuuuuca

SEQ ID NO: 998841 - RNA, 22 nt, Human
uucuaacuuaacacuccuguga

SEQ ID NO: 998842 - RNA, 22 nt, Human
uguguugguagaucugaggucu

SEQ ID NO: 998843 - RNA, 22 nt, Human
uuuaacagaugugaaauuuuca

SEQ ID NO: 998844 - RNA, 22 nt, Human
ugaguguggggaaugucaugag

SEQ ID NO: 998845 - RNA, 22 nt, Human
gggcuguguaaugugcucuuuu

SEQ ID NO: 998846 - RNA, 22 nt, Human
ucucuuucuuuguaugucuauu

SEQ ID NO: 998847 - RNA, 20 nt, Human
ccuguguggccagcugaggc

SEQ ID NO: 998848 - RNA, 22 nt, Human
uucucuucaucucaguaaaugu

SEQ ID NO: 998849 - RNA, 22 nt, Human
uucucucugagagcaucuggaa

SEQ ID NO: 998850 - RNA, 22 nt, Human
auucucucucuaugaaaacuga

SEQ ID NO: 998851 - RNA, 22 nt, Human
guuacagugagaagauagccua

SEQ ID NO: 998852 - RNA, 22 nt, Human
uacaaguauggaaugauucuca

SEQ ID NO: 998853 - RNA, 22 nt, Human
uuaacuauuauuagcaucuuug

SEQ ID NO: 998854 - RNA, 22 nt, Human
uguagugugacauaggugucca

SEQ ID NO: 998855 - RNA, 22 nt, Human
gcaugugucccucagucugugc

SEQ ID NO: 998856 - RNA, 22 nt, Human
uacagugaggugguuuccuuua

SEQ ID NO: 998857 - RNA, 22 nt, Human
guguauggacacaugucauguu

SEQ ID NO: 998858 - RNA, 22 nt, Human
ugcgauguaugcaguauuuguu

SEQ ID NO: 998859 - RNA, 22 nt, Human
ucuacuuuucccuauacaguuu

SEQ ID NO: 998860 - RNA, 22 nt, Human
acuuuguuguuccuugucuaaa

SEQ ID NO: 998861 - RNA, 22 nt, Human
cucucuuucugaaugaggacua

SEQ ID NO: 998862 - RNA, 18 nt, Human
gugcaugcaugcucugcc

SEQ ID NO: 998863 - RNA, 22 nt, Human
aguggcugaagcaucaaaggca

SEQ ID NO: 998864 - RNA, 22 nt, Human
ugagggguugugagaaauguag

SEQ ID NO: 998865 - RNA, 22 nt, Human
aaggcaguuugggccaccaucu

SEQ ID NO: 998866 - RNA, 22 nt, Human
aacuuuucacaggcuagcucuu

SEQ ID NO: 998867 - RNA, 22 nt, Human
caaggcagaauucagacucagg

SEQ ID NO: 998868 - RNA, 22 nt, Human
acuuuacaauauccugugacuu

SEQ ID NO: 998869 - RNA, 22 nt, Human
aguuauuuacuccuuugucucu

SEQ ID NO: 998870 - RNA, 23 nt, Human
aagcugccagucugaagccuggg

SEQ ID NO: 998871 - RNA, 15 nt, Human
uaacuuuuuugggcu

SEQ ID NO: 998872 - RNA, 22 nt, Human
agcuguguaggaucauaacacg

SEQ ID NO: 998873 - RNA, 22 nt, Human
aggcugugcaauuaggguaaga

SEQ ID NO: 998874 - RNA, 22 nt, Human
cagcuggcugcaugaugccaaa

SEQ ID NO: 998875 - RNA, 22 nt, Human
aguauaucugcuucuggguccc

SEQ ID NO: 998876 - RNA, 22 nt, Human
gugcaugcacacaugugugagg

SEQ ID NO: 998877 - RNA, 23 nt, Human
uguaggcuguaguuuguaggucc

SEQ ID NO: 998878 - RNA, 22 nt, Human
ucucucuccuaguuuuuagugg

SEQ ID NO: 998879 - RNA, 22 nt, Human
ugugugugaaccauugagggcu

SEQ ID NO: 998880 - RNA, 22 nt, Human
aguacauuuuucaguggggagu

SEQ ID NO: 998881 - RNA, 22 nt, Human
uuuucugcggugugaauggccu

SEQ ID NO: 998882 - RNA, 22 nt, Human
agucauauuuagcuuguggaau

SEQ ID NO: 998883 - RNA, 22 nt, Human
uuuacagugagagcuuagugag

SEQ ID NO: 998884 - RNA, 21 nt, Human
uacagaaugcgcuucagucug

SEQ ID NO: 998885 - RNA, 22 nt, Human
guauauuuugaucacccucuau

SEQ ID NO: 998886 - RNA, 20 nt, Human
auguuucucugucgugauuu

SEQ ID NO: 998887 - RNA, 20 nt, Human
uuuaacuggccuucuggcuc

SEQ ID NO: 998888 - RNA, 22 nt, Human
uaguauaugucuaugguuguag

SEQ ID NO: 998889 - RNA, 22 nt, Human
uuucacagagaauauugccuug

SEQ ID NO: 998890 - RNA, 22 nt, Human
uuguauuugauugucauaucgu

SEQ ID NO: 998891 - RNA, 22 nt, Human
cuggcuguaagcguguuuccua

SEQ ID NO: 998892 - RNA, 22 nt, Human
uaacuucucugagccucauucc

SEQ ID NO: 998893 - RNA, 22 nt, Human
guguguauuauugcauacacau

SEQ ID NO: 998894 - RNA, 22 nt, Human
uuuuccuguuaaaucugggcac

SEQ ID NO: 998895 - RNA, 22 nt, Human
ucauauuuggggguguguguuu

SEQ ID NO: 998896 - RNA, 22 nt, Human
cgcugugugcagacugaaaaug

SEQ ID NO: 998897 - RNA, 22 nt, Human
uacacuuuucugguuacucuug

SEQ ID NO: 998898 - RNA, 22 nt, Human
ucugugcggucuguguuaugaa

SEQ ID NO: 998899 - RNA, 22 nt, Human
auguaugcauguauguaucgcu

SEQ ID NO: 998900 - RNA, 20 nt, Human
ucugugugccaucaccuaac

SEQ ID NO: 998901 - RNA, 22 nt, Human
uguggcuguggaugcuuuccag

SEQ ID NO: 998902 - RNA, 19 nt, Human
uuucucucccucaucccga

SEQ ID NO: 998903 - RNA, 22 nt, Human
auauuuguuagagucuaugugu

SEQ ID NO: 998904 - RNA, 22 nt, Human
cguguaugugccugcauucaca

SEQ ID NO: 998905 - RNA, 22 nt, Human
uccuguguucuagguauggucu

SEQ ID NO: 998906 - RNA, 22 nt, Human
ucugugugguaguuucagugaa

SEQ ID NO: 998907 - RNA, 22 nt, Human
ccuguguggaaaccgcaugacg

SEQ ID NO: 998908 - RNA, 22 nt, Human
auuuuuucagauugaguguuaa

SEQ ID NO: 998909 - RNA, 22 nt, Human
uuguacagaaaaaauucuuggu

SEQ ID NO: 998910 - RNA, 22 nt, Human
ucucucuucuuuguuaagaaug

SEQ ID NO: 998911 - RNA, 22 nt, Human
ugucuuuacuuaauaaauauac

SEQ ID NO: 998912 - RNA, 19 nt, Human
ggcugucuggcguguggau

SEQ ID NO: 998913 - RNA, 22 nt, Human
aggcugugagcaagaacaccua

SEQ ID NO: 998914 - RNA, 19 nt, Human
aguggcugggcagaagcaa

SEQ ID NO: 998915 - RNA, 22 nt, Human
cuguggugagcaacugacugaa

SEQ ID NO: 998916 - RNA, 22 nt, Human
cuguggcuuuuccggggagccu

SEQ ID NO: 998917 - RNA, 22 nt, Human
gcuuuacauuuuggaaagguga

SEQ ID NO: 998918 - RNA, 18 nt, Human
cgauguguaugugauuug

SEQ ID NO: 998919 - RNA, 22 nt, Human
uuacaguagcuuuauuuggagu

SEQ ID NO: 998920 - RNA, 22 nt, Human
guuacaguuugggcuugauuca

SEQ ID NO: 998921 - RNA, 22 nt, Human
uggccuggugucugcgaggccu

SEQ ID NO: 998922 - RNA, 22 nt, Human
gggcaggaugcaguuucagaga

SEQ ID NO: 998923 - RNA, 23 nt, Human
ugcgugugugcugaggggcgucc

SEQ ID NO: 998924 - RNA, 20 nt, Human
uguuugugccagcuuuguca

SEQ ID NO: 998925 - RNA, 22 nt, Human
ugccugugggugaugauuugau

SEQ ID NO: 998926 - RNA, 22 nt, Human
cugugccucccuuuacuuugag

SEQ ID NO: 998927 - RNA, 19 nt, Human
uuuaaagugacugguauuu

SEQ ID NO: 998928 - RNA, 20 nt, Human
uuaucugucaaucugucuca

SEQ ID NO: 998929 - RNA, 22 nt, Human
cuuuagcaacgaugaugauauu

SEQ ID NO: 998930 - RNA, 23 nt, Human
ggcucugugcuaauugcugaaaa

SEQ ID NO: 998931 - RNA, 22 nt, Human
gagugugugacuucacuuuagc

SEQ ID NO: 998932 - RNA, 22 nt, Human
uacauuaucuuguuaucuuuca

SEQ ID NO: 998933 - RNA, 22 nt, Human
uuguguguguaacuuuaugaga

SEQ ID NO: 998934 - RNA, 22 nt, Human
uuacacuuggguguggauuuua

SEQ ID NO: 998935 - RNA, 22 nt, Human
uggcagugugugagcuguuauu

SEQ ID NO: 998936 - RNA, 23 nt, Human
auuuacagcugugugagcaaguu

SEQ ID NO: 998937 - RNA, 22 nt, Human
cuguggcugucucuuucccaug

SEQ ID NO: 998938 - RNA, 23 nt, Human
ucugauguucucuuaugcuguag

SEQ ID NO: 998939 - RNA, 22 nt, Human
agccacugugcaggagcagugu

SEQ ID NO: 998940 - RNA, 22 nt, Human
uguguggaugcagcgugggucu

SEQ ID NO: 998941 - RNA, 22 nt, Human
guaucuuuaucccucguuggag

SEQ ID NO: 998942 - RNA, 22 nt, Human
ggcugcuggggacgugggagag

SEQ ID NO: 998943 - RNA, 22 nt, Human
uuacauauugucuauuguucaa

SEQ ID NO: 998944 - RNA, 21 nt, Human
ucugggugcuaguguuugcuu

SEQ ID NO: 998945 - RNA, 22 nt, Human
uguuuguggaauauucuuuaag

SEQ ID NO: 998946 - RNA, 22 nt, Human
guggguggaucaccugagguca

SEQ ID NO: 998947 - RNA, 22 nt, Human
gauauuuucauucggaugcuca

SEQ ID NO: 998948 - RNA, 22 nt, Human
aggcugugaagguuaaagacga

SEQ ID NO: 998949 - RNA, 22 nt, Human
acagcauaaucacuucuuucuu

SEQ ID NO: 998950 - RNA, 22 nt, Human
uuaacauuucuuuuccacucau

SEQ ID NO: 998951 - RNA, 22 nt, Human
gggcugugugcccacuucccau

SEQ ID NO: 998952 - RNA, 22 nt, Human
uaccaguaauugcuugugcugu

SEQ ID NO: 998953 - RNA, 22 nt, Human
uguguguauguuuacuuuuccu

SEQ ID NO: 998954 - RNA, 22 nt, Human
cugucuguaucccuguugguaa

SEQ ID NO: 998955 - RNA, 22 nt, Human
caguuuuauacacugcagcucc

SEQ ID NO: 998956 - RNA, 22 nt, Human
cuguacaggagacgucugugca

SEQ ID NO: 998957 - RNA, 22 nt, Human
uuuccucuaaacgcauuugcuu

SEQ ID NO: 998958 - RNA, 22 nt, Human
ugugggugguaaaauacaauga

SEQ ID NO: 998959 - RNA, 22 nt, Human
aggcugugauuccaccacucuc

SEQ ID NO: 998960 - RNA, 22 nt, Human
cccugcagccuugcaugccuuc

SEQ ID NO: 998961 - RNA, 22 nt, Human
cugggguggugcaggccucaug

SEQ ID NO: 998962 - RNA, 22 nt, Human
accaguaugugccuucaguguc

SEQ ID NO: 998963 - RNA, 22 nt, Human
uuuuccugggcuuucuguguaa

SEQ ID NO: 998964 - RNA, 21 nt, Human
cuuuucucuccgcaggacauu

SEQ ID NO: 998965 - RNA, 23 nt, Human
cugugugugccgaggguggccac

SEQ ID NO: 998966 - RNA, 22 nt, Human
uauguguauaccuauacaugug

SEQ ID NO: 998967 - RNA, 22 nt, Human
uuuaggaaguuucagauaggaa

SEQ ID NO: 998968 - RNA, 19 nt, Human
auacaguaagguguuugcc

SEQ ID NO: 998969 - RNA, 22 nt, Human
ucuccugccacugcuucccauu

SEQ ID NO: 998970 - RNA, 22 nt, Human
uucaguauucaaauaugucuua

SEQ ID NO: 998971 - RNA, 22 nt, Human
auguggcuuaguuaggugcccc

SEQ ID NO: 998972 - RNA, 17 nt, Human
ucucuuucccuuucugc

SEQ ID NO: 998973 - RNA, 22 nt, Human
gaacuuuugggaagccguguga

SEQ ID NO: 998974 - RNA, 22 nt, Human
gcagcugccaguccccuuccag

SEQ ID NO: 998975 - RNA, 22 nt, Human
cauguguauuauucuuguggaa

SEQ ID NO: 998976 - RNA, 20 nt, Human
uacaaguacauuauaguuau

SEQ ID NO: 998977 - RNA, 22 nt, Human
ucucuucuugauuuucacugga

SEQ ID NO: 998978 - RNA, 22 nt, Human
ccuguguggccgcacugcuccc

SEQ ID NO: 998979 - RNA, 22 nt, Human
uggaggugacggggccucguug

SEQ ID NO: 998980 - RNA, 22 nt, Human
ucuuuauuuaagucuguuguaa

SEQ ID NO: 998981 - RNA, 22 nt, Human
cccacguugaaccgcuuacaga

SEQ ID NO: 998982 - RNA, 19 nt, Human
uauguguauauguaucugu

SEQ ID NO: 998983 - RNA, 22 nt, Human
auucucucuagaagcugagaug

SEQ ID NO: 998984 - RNA, 22 nt, Human
ugcucuaagaacucuaggaauu

SEQ ID NO: 998985 - RNA, 20 nt, Human
gcccacucuaauccacuguc

SEQ ID NO: 998986 - RNA, 22 nt, Human
aagcugccacacggugaguacu

SEQ ID NO: 998987 - RNA, 22 nt, Human
uuucucugaguuguuacaaaac

SEQ ID NO: 998988 - RNA, 22 nt, Human
uuggcugugaaagcuucucaaa

SEQ ID NO: 998989 - RNA, 22 nt, Human
ugcuggcuguauaugugagagu

SEQ ID NO: 998990 - RNA, 22 nt, Human
cugugugugcuacaggcuucca

SEQ ID NO: 998991 - RNA, 22 nt, Human
uugggguguuggauggagcaag

SEQ ID NO: 998992 - RNA, 22 nt, Human
gugugguggcccuccuucaggc

SEQ ID NO: 998993 - RNA, 22 nt, Human
auauuuuccgaacuugagguag

SEQ ID NO: 998994 - RNA, 22 nt, Human
cuguguagagcggcugcgagcg

SEQ ID NO: 998995 - RNA, 22 nt, Human
acaguauaacuccaugccaccc

SEQ ID NO: 998996 - RNA, 22 nt, Human
auguggcugaucgcagagcucu

SEQ ID NO: 998997 - RNA, 22 nt, Human
cuauuuucugucucuauagagu

SEQ ID NO: 998998 - RNA, 22 nt, Human
uggcauguauuuguggugaauu

SEQ ID NO: 998999 - RNA, 22 nt, Human
aguggcugacaacuggguuaac

SEQ ID NO: 999000 - RNA, 22 nt, Human
acaguaaugauucugagucucu

SEQ ID NO: 999001 - RNA, 22 nt, Human
uguggcugggaagaagguaacu

SEQ ID NO: 999002 - RNA, 22 nt, Human
uacuguauacuacugcuguucu

SEQ ID NO: 999003 - RNA, 22 nt, Human
cuuauuuugcugaugacccagg

SEQ ID NO: 999004 - RNA, 22 nt, Human
uggcucugcaccucaguguacc

SEQ ID NO: 999005 - RNA, 22 nt, Human
ggcuguguccuguaugauuauu

SEQ ID NO: 999006 - RNA, 22 nt, Human
auuuucuucucucccuggcugc

SEQ ID NO: 999007 - RNA, 22 nt, Human
acuuucucaggaauucacagac

SEQ ID NO: 999008 - RNA, 22 nt, Human
uucugcuccaccacuuccagca

SEQ ID NO: 999009 - RNA, 21 nt, Human
ugagggguuauaacagggugg

SEQ ID NO: 999010 - RNA, 22 nt, Human
guguggcuaccucagaggagca

SEQ ID NO: 999011 - RNA, 22 nt, Human
guuauuuuaacuucucaguaau

SEQ ID NO: 999012 - RNA, 23 nt, Human
agcugugugcgcguccggguucu

SEQ ID NO: 999013 - RNA, 22 nt, Human
gcugugauugucagucuucaau

SEQ ID NO: 999014 - RNA, 22 nt, Human
auauauuuugcggucacguggc

SEQ ID NO: 999015 - RNA, 22 nt, Human
cuuucucuucacugucaugauc

SEQ ID NO: 999016 - RNA, 22 nt, Human
uuuccucuuauacaguguuuau

SEQ ID NO: 999017 - RNA, 22 nt, Human
uuuauuugucuugccauuuagu

SEQ ID NO: 999018 - RNA, 22 nt, Human
acaguuauauacauguagcugu

SEQ ID NO: 999019 - RNA, 22 nt, Human
gcccacuccagcuucucccaca

SEQ ID NO: 999020 - RNA, 22 nt, Human
ucucaucugccauuugcaggag

SEQ ID NO: 999021 - RNA, 22 nt, Human
ucuugacaacuauacuacuuac

SEQ ID NO: 999022 - RNA, 22 nt, Human
ugucuuuaguugcuuagauuug

SEQ ID NO: 999023 - RNA, 22 nt, Human
agcuguguggugucugacagcu

SEQ ID NO: 999024 - RNA, 22 nt, Human
auuuacagugugccuacuauau

SEQ ID NO: 999025 - RNA, 22 nt, Human
ugugucuguccucgguugaugc

SEQ ID NO: 999026 - RNA, 22 nt, Human
gcucucugcagccuccuuggag

SEQ ID NO: 999027 - RNA, 17 nt, Human
uauguguguuugcagca

SEQ ID NO: 999028 - RNA, 22 nt, Human
ucuucuacuauaauaauuuucu

SEQ ID NO: 999029 - RNA, 22 nt, Human
uacagauauauagugugugccu

SEQ ID NO: 999030 - RNA, 22 nt, Human
ucuuucuucuuucauaguguga

SEQ ID NO: 999031 - RNA, 22 nt, Human
uuacauuagacccacuuucaug

SEQ ID NO: 999032 - RNA, 22 nt, Human
aggggugauuugggacaggaca

SEQ ID NO: 999033 - RNA, 20 nt, Human
ggcaguuaaggcacagucau

SEQ ID NO: 999034 - RNA, 19 nt, Human
uuuucucagcuucuagcgg

SEQ ID NO: 999035 - RNA, 22 nt, Human
cugugucuccuuggugggauau

SEQ ID NO: 999036 - RNA, 22 nt, Human
gcgugugugauaugccucugca

SEQ ID NO: 999037 - RNA, 21 nt, Human
ucuguggcagcaugaugaggu

SEQ ID NO: 999038 - RNA, 22 nt, Human
caguuuuaaauuguuagauaau

SEQ ID NO: 999039 - RNA, 22 nt, Human
cuacaguagagaggauguagaa

SEQ ID NO: 999040 - RNA, 22 nt, Human
augcuguggggagugaggguag

SEQ ID NO: 999041 - RNA, 22 nt, Human
auguauauacuuacaugugugg

SEQ ID NO: 999042 - RNA, 22 nt, Human
cuguggcuucagcauucagagc

SEQ ID NO: 999043 - RNA, 23 nt, Human
ucucuuaucacaauucauuuugc

SEQ ID NO: 999044 - RNA, 22 nt, Human
cuguguacccacgugggcaccc

SEQ ID NO: 999045 - RNA, 22 nt, Human
uuaacuuuuauuucugcucgcc

SEQ ID NO: 999046 - RNA, 22 nt, Human
uggcuaguaggugaguagugcu

SEQ ID NO: 999047 - RNA, 22 nt, Human
agcugugugugaauuuggccua

SEQ ID NO: 999048 - RNA, 22 nt, Human
uuccuguucaggaaaguugugu

SEQ ID NO: 999049 - RNA, 22 nt, Human
cuuaacagcaagaucuguguca

SEQ ID NO: 999050 - RNA, 22 nt, Human
caggcagugucccaggaagcca

SEQ ID NO: 999051 - RNA, 22 nt, Human
ucaguauagcuucuaaacuaac

SEQ ID NO: 999052 - RNA, 22 nt, Human
aacaguaucuacgggaacuauu

SEQ ID NO: 999053 - RNA, 22 nt, Human
ugucuguauugaggugcauauu

SEQ ID NO: 999054 - RNA, 22 nt, Human
ugugcuauuuuugcauaugugu

SEQ ID NO: 999055 - RNA, 22 nt, Human
uuauuuucagcuaggaaagcca

SEQ ID NO: 999056 - RNA, 22 nt, Human
aggcuguguccucauuuuauau

SEQ ID NO: 999057 - RNA, 19 nt, Human
cuauacagccucugaggaa

SEQ ID NO: 999058 - RNA, 22 nt, Human
aguauguugaguuuugcuuuag

SEQ ID NO: 999059 - RNA, 17 nt, Human
uauggcuguguuugugc

SEQ ID NO: 999060 - RNA, 22 nt, Human
ccugugugucugucacugcaca

SEQ ID NO: 999061 - RNA, 22 nt, Human
uucucuuuuugcaucucaaccu

SEQ ID NO: 999062 - RNA, 22 nt, Human
aggcugugaggggcccgcaugc

SEQ ID NO: 999063 - RNA, 22 nt, Human
guuucucuguaccucuguccca

SEQ ID NO: 999064 - RNA, 22 nt, Human
ugugugcauucacaugcaugcc

SEQ ID NO: 999065 - RNA, 22 nt, Human
gauauauuuuccauggucugca

SEQ ID NO: 999066 - RNA, 20 nt, Human
acugugugaucuggaaagcu

SEQ ID NO: 999067 - RNA, 22 nt, Human
uauauuguaggugcuauuugaa

SEQ ID NO: 999068 - RNA, 22 nt, Human
ugugugccagccuacgaggagc

SEQ ID NO: 999069 - RNA, 22 nt, Human
ccugugugcugaugacgacaga

SEQ ID NO: 999070 - RNA, 22 nt, Human
uucucuuuauguauuuaguggg

SEQ ID NO: 999071 - RNA, 22 nt, Human
uauauucuuaccaguguaugua

SEQ ID NO: 999072 - RNA, 22 nt, Human
cuuuacagcuuagugguaugga

SEQ ID NO: 999073 - RNA, 22 nt, Human
ugugugugugcgcgcacgcaua

SEQ ID NO: 999074 - RNA, 22 nt, Human
ugugugggcgaagacagccuuu

SEQ ID NO: 999075 - RNA, 22 nt, Human
cuucacagucuuuauuuccucc

SEQ ID NO: 999076 - RNA, 22 nt, Human
caguauauucugcagagccuua

SEQ ID NO: 999077 - RNA, 22 nt, Human
uaaccuuuuuaucuuaccucca

SEQ ID NO: 999078 - RNA, 22 nt, Human
guauuuucaugauuucagacca

SEQ ID NO: 999079 - RNA, 22 nt, Human
guggcugcagcggcuguggaga

SEQ ID NO: 999080 - RNA, 23 nt, Human
uaucauuucagcucucugccugg

SEQ ID NO: 999081 - RNA, 22 nt, Human
ccugucuguccuuugcauucuu

SEQ ID NO: 999082 - RNA, 17 nt, Human
aucucucuaaggcaggc

SEQ ID NO: 999083 - RNA, 22 nt, Human
auuguucuaaggguuuaauuaa

SEQ ID NO: 999084 - RNA, 18 nt, Human
ucugucuguguugucuuu

SEQ ID NO: 999085 - RNA, 22 nt, Human
uguguguguuccuccucagcua

SEQ ID NO: 999086 - RNA, 22 nt, Human
uuucuaucuaggguuagaguga

SEQ ID NO: 999087 - RNA, 22 nt, Human
uaccaguaauguaacuuugcaa

SEQ ID NO: 999088 - RNA, 22 nt, Human
uguauguguauguacauaugca

SEQ ID NO: 999089 - RNA, 22 nt, Human
ucuacuuuauaaguauauaagu

SEQ ID NO: 999090 - RNA, 22 nt, Human
ugcagcugguaucccauggauu

SEQ ID NO: 999091 - RNA, 20 nt, Human
ccugugugguuugcacuaca

SEQ ID NO: 999092 - RNA, 22 nt, Human
aucuuuacaagaaauucuuuua

SEQ ID NO: 999093 - RNA, 22 nt, Human
gauuuucugagccuucaaauuu

SEQ ID NO: 999094 - RNA, 22 nt, Human
cuugacagaagguuuuauccua

SEQ ID NO: 999095 - RNA, 22 nt, Human
ucuguuugcuggugcauggguu

SEQ ID NO: 999096 - RNA, 22 nt, Human
cuuuuauuuugaauuaagggcu

SEQ ID NO: 999097 - RNA, 22 nt, Human
aucuguguaugaaaguauaacu

SEQ ID NO: 999098 - RNA, 22 nt, Human
cugucuuuucauacuuucccuc

SEQ ID NO: 999099 - RNA, 22 nt, Human
agggggugcauuugugaaugaa

SEQ ID NO: 999100 - RNA, 22 nt, Human
auguguauugagcaccuacugc

SEQ ID NO: 999101 - RNA, 22 nt, Human
guacaguaaauguaaauggauu

SEQ ID NO: 999102 - RNA, 22 nt, Human
gugugugugcauauaacauaua

SEQ ID NO: 999103 - RNA, 22 nt, Human
uguggcugcucaggugcagacc

SEQ ID NO: 999104 - RNA, 22 nt, Human
uucuaacuaaagucuuuguuuu

SEQ ID NO: 999105 - RNA, 22 nt, Human
cucugugugcuggugggguccu

SEQ ID NO: 999106 - RNA, 22 nt, Human
gugugucuuucauuucaugagg

SEQ ID NO: 999107 - RNA, 22 nt, Human
cuguguuugacaggcggucucc

SEQ ID NO: 999108 - RNA, 22 nt, Human
gcucucuuuccauguggaggau

SEQ ID NO: 999109 - RNA, 22 nt, Human
uauguguguuucaguggaaaug

SEQ ID NO: 999110 - RNA, 22 nt, Human
ugcggguugguggcauaugcag

SEQ ID NO: 999111 - RNA, 22 nt, Human
uggccugggugcugcugacauc

SEQ ID NO: 999112 - RNA, 23 nt, Human
uugacaguaggugguuuucauug

SEQ ID NO: 999113 - RNA, 22 nt, Human
uauguguguaugacagacagag

SEQ ID NO: 999114 - RNA, 22 nt, Human
uuugacagugaugauauauaca

SEQ ID NO: 999115 - RNA, 22 nt, Human
cauauuuuaguugcugaacagc

SEQ ID NO: 999116 - RNA, 22 nt, Human
uuuucuguauuauugugcuuca

SEQ ID NO: 999117 - RNA, 16 nt, Human
uuguggcuuuugcaca

SEQ ID NO: 999118 - RNA, 22 nt, Human
ccauggccucgcucuacguggg

SEQ ID NO: 999119 - RNA, 22 nt, Human
cuuauuuuaagucaguuugggu

SEQ ID NO: 999120 - RNA, 22 nt, Human
auuuacagaaacuuaaucauag

SEQ ID NO: 999121 - RNA, 22 nt, Human
caguauaaugcccccugugggg

SEQ ID NO: 999122 - RNA, 22 nt, Human
uucguguggagauguuucugca

SEQ ID NO: 999123 - RNA, 22 nt, Human
cagugugugacucuggggguac

SEQ ID NO: 999124 - RNA, 21 nt, Human
aguggcugucaagggggccuu

SEQ ID NO: 999125 - RNA, 22 nt, Human
ucuuuacaguccucugucaauc

SEQ ID NO: 999126 - RNA, 22 nt, Human
ggcugguguugagugccuguag

SEQ ID NO: 999127 - RNA, 22 nt, Human
guuuacaguacucacuugcauu

SEQ ID NO: 999128 - RNA, 22 nt, Human
uuuacaguuaagaaauguuacc

SEQ ID NO: 999129 - RNA, 22 nt, Human
ucuacagugucaaugugucuug

SEQ ID NO: 999130 - RNA, 22 nt, Human
uggcugugccucuuuccaggcc

SEQ ID NO: 999131 - RNA, 23 nt, Human
uggcugagguccagguaguuuca

SEQ ID NO: 999132 - RNA, 16 nt, Human
gggggugagagagagu

SEQ ID NO: 999133 - RNA, 22 nt, Human
uuuuuaucuuguaugugucucu

SEQ ID NO: 999134 - RNA, 22 nt, Human
agcuguguuauuagaaaccugc

SEQ ID NO: 999135 - RNA, 22 nt, Human
acucucugggcaugccccacca

SEQ ID NO: 999136 - RNA, 22 nt, Human
ugcuguggcaguuuauguauag

SEQ ID NO: 999137 - RNA, 22 nt, Human
gcuggaggauggacuggaagaa

SEQ ID NO: 999138 - RNA, 22 nt, Human
uauguguaaccuugugauuuau

SEQ ID NO: 999139 - RNA, 22 nt, Human
gccgugggugucauggcccaua

SEQ ID NO: 999140 - RNA, 22 nt, Human
ugguggccgaagcccucucuca

SEQ ID NO: 999141 - RNA, 22 nt, Human
gaguauauaauuaauuggucug

SEQ ID NO: 999142 - RNA, 22 nt, Human
ggacugugaggucugggugagg

SEQ ID NO: 999143 - RNA, 22 nt, Human
ucuuuaacaggaauuauuacag

SEQ ID NO: 999144 - RNA, 22 nt, Human
ucugucuuagcaucuuugcuca

SEQ ID NO: 999145 - RNA, 22 nt, Human
aggcugugcacagggcaccugc

SEQ ID NO: 999146 - RNA, 22 nt, Human
cacuauaucuguucuuguuuau

SEQ ID NO: 999147 - RNA, 22 nt, Human
uuucucucugacugggagcuga

SEQ ID NO: 999148 - RNA, 22 nt, Human
uuuacagaucuguugauuuguu

SEQ ID NO: 999149 - RNA, 22 nt, Human
uacaguauggaaaauguauagu

SEQ ID NO: 999150 - RNA, 21 nt, Human
ugugugcauaugcauguacau

SEQ ID NO: 999151 - RNA, 22 nt, Human
gauauuuuugcagacaccuggg

SEQ ID NO: 999152 - RNA, 22 nt, Human
uaggggugggauccaggaauua

SEQ ID NO: 999153 - RNA, 22 nt, Human
uuugcaguguucaucaguauuu

SEQ ID NO: 999154 - RNA, 22 nt, Human
ugcucuguccagugcaccauca

SEQ ID NO: 999155 - RNA, 22 nt, Human
gcugugugcugggcauggcacu

SEQ ID NO: 999156 - RNA, 22 nt, Human
aggcugugagagguggcuccca

SEQ ID NO: 999157 - RNA, 22 nt, Human
agcauauugucuuuggugucuc

SEQ ID NO: 999158 - RNA, 22 nt, Human
aaacuuuuucuuagguaugucu

SEQ ID NO: 999159 - RNA, 22 nt, Human
cuguguguuuauaucauuuccu

SEQ ID NO: 999160 - RNA, 21 nt, Human
ugcaccugugccccauccuuc

SEQ ID NO: 999161 - RNA, 22 nt, Human
uguauuuucagaguggcauuuc

SEQ ID NO: 999162 - RNA, 22 nt, Human
uguauuuuuaggaaugcgcuau

SEQ ID NO: 999163 - RNA, 22 nt, Human
uguguauagguugugcuaauag

SEQ ID NO: 999164 - RNA, 22 nt, Human
uucacagugagcuaugucuugu

SEQ ID NO: 999165 - RNA, 22 nt, Human
caggauauaucucuaguguugg

SEQ ID NO: 999166 - RNA, 22 nt, Human
ggcuguguccccaccugagcag

SEQ ID NO: 999167 - RNA, 22 nt, Human
gugggugugguucguuuaagac

SEQ ID NO: 999168 - RNA, 22 nt, Human
cugugcugggugugcuuaugau

SEQ ID NO: 999169 - RNA, 22 nt, Human
ugagggcagagcacuggggagc

SEQ ID NO: 999170 - RNA, 22 nt, Human
ggccuggaaggacagcgugaug

SEQ ID NO: 999171 - RNA, 22 nt, Human
cugcugccccugagcucagccu

SEQ ID NO: 999172 - RNA, 22 nt, Human
ggaagaaagguggacaacaggu

SEQ ID NO: 999173 - RNA, 22 nt, Human
ugugugaaggagccacuguuca

SEQ ID NO: 999174 - RNA, 22 nt, Human
cuuucucuggaggggagugguu

SEQ ID NO: 999175 - RNA, 22 nt, Human
auuacaguggacagcuaugcac

SEQ ID NO: 999176 - RNA, 22 nt, Human
uugacuuuacaguuuucuuagg

SEQ ID NO: 999177 - RNA, 22 nt, Human
ucucuacagaaucuuauuauug

SEQ ID NO: 999178 - RNA, 22 nt, Human
ucaucucucaggauaccagcag

SEQ ID NO: 999179 - RNA, 22 nt, Human
uucuacagaauaaauguuuaca

SEQ ID NO: 999180 - RNA, 22 nt, Human
uggcucugggcaccguguccac

SEQ ID NO: 999181 - RNA, 22 nt, Human
cucuucuugaaagaggaauuca

SEQ ID NO: 999182 - RNA, 22 nt, Human
uucucucuuuuggguaggaggu

SEQ ID NO: 999183 - RNA, 20 nt, Human
acuuucucgguuucucaccu

SEQ ID NO: 999184 - RNA, 22 nt, Human
uguggcugaucaaagcgcucag

SEQ ID NO: 999185 - RNA, 22 nt, Human
cugugugugagaagcagguuga

SEQ ID NO: 999186 - RNA, 22 nt, Human
cuuucucuguguuucacaugcu

SEQ ID NO: 999187 - RNA, 22 nt, Human
uuacacguguguguaucuguau

SEQ ID NO: 999188 - RNA, 22 nt, Human
ugugacuggcagaggugucugg

SEQ ID NO: 999189 - RNA, 18 nt, Human
cucucuuuccacucuuug

SEQ ID NO: 999190 - RNA, 22 nt, Human
guuuuauuggaacacagccaug

SEQ ID NO: 999191 - RNA, 22 nt, Human
cugugucucauccgccucuggc

SEQ ID NO: 999192 - RNA, 22 nt, Human
guaacuuuggauuuaggguacc

SEQ ID NO: 999193 - RNA, 22 nt, Human
aacuuuuguccgaucuccugga

SEQ ID NO: 999194 - RNA, 22 nt, Human
aucuuuacuuucagugcugagc

SEQ ID NO: 999195 - RNA, 22 nt, Human
uucuaacuccacuucccacucc

SEQ ID NO: 999196 - RNA, 22 nt, Human
cucucuuugauguauaaauaau

SEQ ID NO: 999197 - RNA, 22 nt, Human
uuuuucuggauaacuguaucuc

SEQ ID NO: 999198 - RNA, 19 nt, Human
aggcugugagggaggacuc

SEQ ID NO: 999199 - RNA, 22 nt, Human
uuuuacaggugugagccaccau

SEQ ID NO: 999200 - RNA, 22 nt, Human
gugugucugaaguugaguagac

SEQ ID NO: 999201 - RNA, 22 nt, Human
guggagggaaugaaucuucucu

SEQ ID NO: 999202 - RNA, 19 nt, Human
cucucagccugucuccuug

SEQ ID NO: 999203 - RNA, 22 nt, Human
auuuuuaugacaaaccauccuc

SEQ ID NO: 999204 - RNA, 22 nt, Human
cugcugcugcuaucuacccagg

SEQ ID NO: 999205 - RNA, 22 nt, Human
uucucuuuuagaggcuccauga

SEQ ID NO: 999206 - RNA, 22 nt, Human
cacaguaugaucuaaaguaagu

SEQ ID NO: 999207 - RNA, 22 nt, Human
acagauauguuggguucuuguu

SEQ ID NO: 999208 - RNA, 22 nt, Human
uuccucucucuugccagaaugu

SEQ ID NO: 999209 - RNA, 21 nt, Human
auuagaagguauuuagggccu

SEQ ID NO: 999210 - RNA, 22 nt, Human
ucuguggcgcauaguugucucu

SEQ ID NO: 999211 - RNA, 22 nt, Human
auguguauuuauuuggggcuua

SEQ ID NO: 999212 - RNA, 22 nt, Human
uucacaguggcccucucugagu

SEQ ID NO: 999213 - RNA, 17 nt, Human
ucugcucugccaaucca

SEQ ID NO: 999214 - RNA, 22 nt, Human
uucucucuuccaguucccacuu

SEQ ID NO: 999215 - RNA, 22 nt, Human
gcuguguucauuuugcauaugu

SEQ ID NO: 999216 - RNA, 21 nt, Human
ucucugugucuuuaagcugga

SEQ ID NO: 999217 - RNA, 23 nt, Human
uguguguguauucuacgcaaggu

SEQ ID NO: 999218 - RNA, 22 nt, Human
auucuucugccuacuuucaucc

SEQ ID NO: 999219 - RNA, 22 nt, Human
cuggagggacuuucucacggau

SEQ ID NO: 999220 - RNA, 22 nt, Human
acugugugcccugacgccaggg

SEQ ID NO: 999221 - RNA, 22 nt, Human
uuggcuguuuuauaggucaguu

SEQ ID NO: 999222 - RNA, 22 nt, Human
uacaguaggauuuucagggucu

SEQ ID NO: 999223 - RNA, 21 nt, Human
uguuacaguccaaauguuugu

SEQ ID NO: 999224 - RNA, 22 nt, Human
uguggcuggauugauuuuaccu

SEQ ID NO: 999225 - RNA, 22 nt, Human
aaacuuuuccugcucuuguccu

SEQ ID NO: 999226 - RNA, 22 nt, Human
auguggcuagggaauaaaauau

SEQ ID NO: 999227 - RNA, 23 nt, Human
uuguacagcccagauuccucuuc

SEQ ID NO: 999228 - RNA, 22 nt, Human
uuucucuuucaaucugcaguac

SEQ ID NO: 999229 - RNA, 21 nt, Human
aggcugugacuuacacuaucu

SEQ ID NO: 999230 - RNA, 22 nt, Human
cuuucacagccuucguucugaa

SEQ ID NO: 999231 - RNA, 22 nt, Human
augugugguuuaagaauugaau

SEQ ID NO: 999232 - RNA, 22 nt, Human
guuauauucaaaaugaggcugu

SEQ ID NO: 999233 - RNA, 22 nt, Human
guuaacuuuuuacagaaaugaa

SEQ ID NO: 999234 - RNA, 22 nt, Human
guguggcuaggauggcuuugcu

SEQ ID NO: 999235 - RNA, 23 nt, Human
ugucuggcucauggugggucuca

SEQ ID NO: 999236 - RNA, 22 nt, Human
aucauuuuauggcugagaggac

SEQ ID NO: 999237 - RNA, 22 nt, Human
uuuacauggaauauugucuugu

SEQ ID NO: 999238 - RNA, 22 nt, Human
ccaccaugggaagagagacuaa

SEQ ID NO: 999239 - RNA, 22 nt, Human
auguguaucuaagguguucuau

SEQ ID NO: 999240 - RNA, 22 nt, Human
uggcauguuuaauguacuguau

SEQ ID NO: 999241 - RNA, 22 nt, Human
ucuguggcuuucuuauguugua

SEQ ID NO: 999242 - RNA, 22 nt, Human
uuuauauugggagucguuuuga

SEQ ID NO: 999243 - RNA, 22 nt, Human
uuguaacuuugcauacuccugu

SEQ ID NO: 999244 - RNA, 22 nt, Human
acaguacauaauccugagucug

SEQ ID NO: 999245 - RNA, 22 nt, Human
gcuggagggguaauaggauggg

SEQ ID NO: 999246 - RNA, 22 nt, Human
auguggcuagugcagaugaaua

SEQ ID NO: 999247 - RNA, 22 nt, Human
ucugucuucuguagcuaauaau

SEQ ID NO: 999248 - RNA, 22 nt, Human
ucucuguguguuggcuguauau

SEQ ID NO: 999249 - RNA, 22 nt, Human
uuuaucuuuggaucuucagaaa

SEQ ID NO: 999250 - RNA, 19 nt, Human
uugugugucagucagaguu

SEQ ID NO: 999251 - RNA, 22 nt, Human
uguguguacucuccaguccuga

SEQ ID NO: 999252 - RNA, 22 nt, Human
gcaguauaaguggauuaugucc

SEQ ID NO: 999253 - RNA, 22 nt, Human
uucucuuuugugaugugagaug

SEQ ID NO: 999254 - RNA, 22 nt, Human
uacuuuuuagcacagugugugc

SEQ ID NO: 999255 - RNA, 22 nt, Human
aggggugugcauccuggaggau

SEQ ID NO: 999256 - RNA, 22 nt, Human
ugugugggagcacgggcuguug

SEQ ID NO: 999257 - RNA, 18 nt, Human
aacaguuuccagauucuc

SEQ ID NO: 999258 - RNA, 20 nt, Human
gaguauauuucuuccuuugc

SEQ ID NO: 999259 - RNA, 22 nt, Human
uguguguccuugaccucagugg

SEQ ID NO: 999260 - RNA, 22 nt, Human
uuucucacccaagaguuauuuu

SEQ ID NO: 999261 - RNA, 21 nt, Human
uaacuuuugugccuaucuugu

SEQ ID NO: 999262 - RNA, 22 nt, Human
uacaguauguucuugaauuugg

SEQ ID NO: 999263 - RNA, 21 nt, Human
ccugugugucugacugggcua

SEQ ID NO: 999264 - RNA, 22 nt, Human
uuuaguuugauguucuacuccu

SEQ ID NO: 999265 - RNA, 22 nt, Human
ugugugucauuuaggguggagc

SEQ ID NO: 999266 - RNA, 22 nt, Human
aggcuguguuuccccuggagcu

SEQ ID NO: 999267 - RNA, 21 nt, Human
ucuuugcaucaguuguuuucu

SEQ ID NO: 999268 - RNA, 22 nt, Human
ucugcuguacuuuuggucuguu

SEQ ID NO: 999269 - RNA, 22 nt, Human
ucuucacaucauguuuuuuaau

SEQ ID NO: 999270 - RNA, 22 nt, Human
cuuuuuuaagguagcuccuccu

SEQ ID NO: 999271 - RNA, 22 nt, Human
gucauauuauaaauguucuguu

SEQ ID NO: 999272 - RNA, 22 nt, Human
guguguggcaaacugggccugc

SEQ ID NO: 999273 - RNA, 22 nt, Human
gugcccaguaaaugaaagcuuu

SEQ ID NO: 999274 - RNA, 22 nt, Human
gcucucuggaggccauggacag

SEQ ID NO: 999275 - RNA, 22 nt, Human
acaguauuugcgauacugauga

SEQ ID NO: 999276 - RNA, 20 nt, Human
aguggcugauggaaagaagc

SEQ ID NO: 999277 - RNA, 22 nt, Human
uaacuuuucuaggugugauaau

SEQ ID NO: 999278 - RNA, 22 nt, Human
uucucuuuucaccaguugcuaa

SEQ ID NO: 999279 - RNA, 22 nt, Human
agccaguuuccagauauuaacu

SEQ ID NO: 999280 - RNA, 22 nt, Human
ccacugccagcuuuguccuccc

SEQ ID NO: 999281 - RNA, 23 nt, Human
guguguggaaagugcaugggccu

SEQ ID NO: 999282 - RNA, 22 nt, Human
ggugcugccuauagucugaaac

SEQ ID NO: 999283 - RNA, 22 nt, Human
cuuuacaggaaaagguggcugu

SEQ ID NO: 999284 - RNA, 22 nt, Human
ugucuuuaguuuuacugucugg

SEQ ID NO: 999285 - RNA, 22 nt, Human
uuuaacuuagaagagauauccu

SEQ ID NO: 999286 - RNA, 22 nt, Human
gaggggugggcuggaaguuaua

SEQ ID NO: 999287 - RNA, 22 nt, Human
agccccacacucucucugagaa

SEQ ID NO: 999288 - RNA, 22 nt, Human
cauuuacagugagaguuuuuac

SEQ ID NO: 999289 - RNA, 22 nt, Human
ucuguacaaaggcuauuuggag

SEQ ID NO: 999290 - RNA, 22 nt, Human
uguguuuguuagacuaauguua

SEQ ID NO: 999291 - RNA, 22 nt, Human
auuacaguaacagcuacaaugc

SEQ ID NO: 999292 - RNA, 22 nt, Human
uguguauaaacaagagucugug

SEQ ID NO: 999293 - RNA, 22 nt, Human
aggcugugggugauuuacugug

SEQ ID NO: 999294 - RNA, 22 nt, Human
uguguguauaugcauuuaucua

SEQ ID NO: 999295 - RNA, 22 nt, Human
gggcuguggagccgcgagggcu

SEQ ID NO: 999296 - RNA, 22 nt, Human
ugugugaccuggggugagauag

SEQ ID NO: 999297 - RNA, 22 nt, Human
gucugugugcacagagcuuugg

SEQ ID NO: 999298 - RNA, 22 nt, Human
gcaguauauacucuuugagggg

SEQ ID NO: 999299 - RNA, 22 nt, Human
acuguguggaccacucugaggc

SEQ ID NO: 999300 - RNA, 22 nt, Human
ucauuuacaugucuuucucuga

SEQ ID NO: 999301 - RNA, 22 nt, Human
ggcugaugggcaugagcuguca

SEQ ID NO: 999302 - RNA, 22 nt, Human
ucucuguggugggaggcugagu

SEQ ID NO: 999303 - RNA, 22 nt, Human
uuugugugguggauacugggua

SEQ ID NO: 999304 - RNA, 22 nt, Human
acucuuuagagguacaucucuu

SEQ ID NO: 999305 - RNA, 20 nt, Human
uaucaguaggauauucugcc

SEQ ID NO: 999306 - RNA, 22 nt, Human
uccugugugggcaggaugagaa

SEQ ID NO: 999307 - RNA, 22 nt, Human
uggcugagaaugggaugaugcc

SEQ ID NO: 999308 - RNA, 22 nt, Human
cuguggcuguauuuggccagag

SEQ ID NO: 999309 - RNA, 23 nt, Human
cugcugugaaacaugguuuuggu

SEQ ID NO: 999310 - RNA, 22 nt, Human
caagggugguauugggagcaua

SEQ ID NO: 999311 - RNA, 22 nt, Human
cuuucucugugugguaaagggc

SEQ ID NO: 999312 - RNA, 22 nt, Human
caguuuuauugguugaaaucug

SEQ ID NO: 999313 - RNA, 22 nt, Human
uguuuguaucucucucuguggc

SEQ ID NO: 999314 - RNA, 17 nt, Human
uauguguguguuuauac

SEQ ID NO: 999315 - RNA, 22 nt, Human
agcugcccugggcuggagaugg

SEQ ID NO: 999316 - RNA, 22 nt, Human
gagcugccggcccacaguacua

SEQ ID NO: 999317 - RNA, 22 nt, Human
uguggcugcaggcgauggagga

SEQ ID NO: 999318 - RNA, 22 nt, Human
auuuucaucgcuagguuggccu

SEQ ID NO: 999319 - RNA, 22 nt, Human
uauguuuccugagcuuacacca

SEQ ID NO: 999320 - RNA, 22 nt, Human
guuuuuauauccuguggagugu

SEQ ID NO: 999321 - RNA, 22 nt, Human
uuaguuuucucaucuaucucac

SEQ ID NO: 999322 - RNA, 22 nt, Human
uauuuugcaaaccugaguuuga

SEQ ID NO: 999323 - RNA, 22 nt, Human
gcuggcugaguucugucgucug

SEQ ID NO: 999324 - RNA, 22 nt, Human
uguguguucucaauuauugaug

SEQ ID NO: 999325 - RNA, 22 nt, Human
uuauuugccagaauuucucuug

SEQ ID NO: 999326 - RNA, 22 nt, Human
aggcggugcuguggacagugac

SEQ ID NO: 999327 - RNA, 23 nt, Human
uguaacuucuuaaauucuucacu

SEQ ID NO: 999328 - RNA, 22 nt, Human
uaguauuugcagauuuguguca

SEQ ID NO: 999329 - RNA, 22 nt, Human
uuguguguuuguagaaaaucca

SEQ ID NO: 999330 - RNA, 22 nt, Human
gaaggcagguuuuucaaaacug

SEQ ID NO: 999331 - RNA, 22 nt, Human
auucucuguucaaggaugguga

SEQ ID NO: 999332 - RNA, 22 nt, Human
acagaauauugguuacuguugc

SEQ ID NO: 999333 - RNA, 22 nt, Human
ccuguguggccaggcuggaguc

SEQ ID NO: 999334 - RNA, 22 nt, Human
ucucuccugcacugaauuaugu

SEQ ID NO: 999335 - RNA, 22 nt, Human
ugucucuugaguuuguuuuaau

SEQ ID NO: 999336 - RNA, 22 nt, Human
auacaguauuaccuguucagga

SEQ ID NO: 999337 - RNA, 22 nt, Human
aguggcuguacuauuuuuucau

SEQ ID NO: 999338 - RNA, 22 nt, Human
aggcugugagaaguccuucagu

SEQ ID NO: 999339 - RNA, 22 nt, Human
cauguauagcaaauauuuguuc

SEQ ID NO: 999340 - RNA, 22 nt, Human
uuuagaguugguccccugugag

SEQ ID NO: 999341 - RNA, 23 nt, Human
ccacgucugcacuguagcuguug

SEQ ID NO: 999342 - RNA, 22 nt, Human
aguguaugucaaguauauacac

SEQ ID NO: 999343 - RNA, 22 nt, Human
cucuguguuccggguugcugcu

SEQ ID NO: 999344 - RNA, 22 nt, Human
cuguguagccucaugugggcuu

SEQ ID NO: 999345 - RNA, 22 nt, Human
ugcagccaucgcagagucugua

SEQ ID NO: 999346 - RNA, 22 nt, Human
ugcaguguuuggaugcugaguc

SEQ ID NO: 999347 - RNA, 20 nt, Human
ugaguggccacugggucgca

SEQ ID NO: 999348 - RNA, 22 nt, Human
gacagcuggcaguggaaaggug

SEQ ID NO: 999349 - RNA, 22 nt, Human
gcccagcccugaggucacagcu

SEQ ID NO: 999350 - RNA, 22 nt, Human
gucuggcuuuugcccuguguuu

SEQ ID NO: 999351 - RNA, 22 nt, Human
uauuuucuguggaggaccagau

SEQ ID NO: 999352 - RNA, 22 nt, Human
acguauauugaaauaucaugag

SEQ ID NO: 999353 - RNA, 22 nt, Human
uguuugugcugccuggugggca

SEQ ID NO: 999354 - RNA, 22 nt, Human
ugugccuggucccugagucgag

SEQ ID NO: 999355 - RNA, 22 nt, Human
cugcugugcaggugccuaugau

SEQ ID NO: 999356 - RNA, 22 nt, Human
uuuaucugugggaguuguuugg

SEQ ID NO: 999357 - RNA, 22 nt, Human
cucucugggguuccagacgugg

SEQ ID NO: 999358 - RNA, 22 nt, Human
uuuacaguuccaugugauaggc

SEQ ID NO: 999359 - RNA, 22 nt, Human
auucuucuugagucuuggacuc

SEQ ID NO: 999360 - RNA, 22 nt, Human
uguucucucuggcugccaguac

SEQ ID NO: 999361 - RNA, 22 nt, Human
guuuuuauuguguaaauguggg

SEQ ID NO: 999362 - RNA, 22 nt, Human
aggcuguggaugcuuaacaaau

SEQ ID NO: 999363 - RNA, 22 nt, Human
ggggcagcucccgagggcagga

SEQ ID NO: 999364 - RNA, 22 nt, Human
cuauauuucuuggcuuuaaaca

SEQ ID NO: 999365 - RNA, 22 nt, Human
auuugucucucuggguuuacuu

SEQ ID NO: 999366 - RNA, 19 nt, Human
gucuguguauuuguugcug

SEQ ID NO: 999367 - RNA, 22 nt, Human
acugugugaaacaucaaugugu

SEQ ID NO: 999368 - RNA, 22 nt, Human
uuuucaguuacuguuuauguga

SEQ ID NO: 999369 - RNA, 22 nt, Human
auacaguauaacuaauaaaccc

SEQ ID NO: 999370 - RNA, 22 nt, Human
cagccacucggccauaaaggcu

SEQ ID NO: 999371 - RNA, 22 nt, Human
cuucuguguuaaaugagucuuu

SEQ ID NO: 999372 - RNA, 22 nt, Human
cuguguuuuuggucugaucuau

SEQ ID NO: 999373 - RNA, 22 nt, Human
acaguacugaguacugaguugg

SEQ ID NO: 999374 - RNA, 22 nt, Human
aaacuuuuuauucuaaugucua

SEQ ID NO: 999375 - RNA, 22 nt, Human
uucuauguagauaaggcugcuc

SEQ ID NO: 999376 - RNA, 19 nt, Human
ucugugcugggaggcagca

SEQ ID NO: 999377 - RNA, 22 nt, Human
auuugcucuagcugcagugaau

SEQ ID NO: 999378 - RNA, 22 nt, Human
ugcccagcugucaaaguagaua

SEQ ID NO: 999379 - RNA, 22 nt, Human
aguggcugcuggaguggagaug

SEQ ID NO: 999380 - RNA, 22 nt, Human
uguguuguuuuaagcugcugca

SEQ ID NO: 999381 - RNA, 22 nt, Human
cuguguaucucugugggacaga

SEQ ID NO: 999382 - RNA, 22 nt, Human
auggcugugagcaggcagcuuc

SEQ ID NO: 999383 - RNA, 22 nt, Human
uaaccuuugaccuugcuugugc

SEQ ID NO: 999384 - RNA, 22 nt, Human
aggagguggccugagcgugccc

SEQ ID NO: 999385 - RNA, 21 nt, Human
uuuuacagaugaggggaaggg

SEQ ID NO: 999386 - RNA, 22 nt, Human
ucuuuaagggauguucugcuuu

SEQ ID NO: 999387 - RNA, 22 nt, Human
ugucucuuggcucuaucacuua

SEQ ID NO: 999388 - RNA, 22 nt, Human
uaauauuucuacccugcugccu

SEQ ID NO: 999389 - RNA, 17 nt, Human
cguggcugagccauaga

SEQ ID NO: 999390 - RNA, 22 nt, Human
gcuuuacauguuucccuuuaag

SEQ ID NO: 999391 - RNA, 20 nt, Human
uuagcaguagagugugcuuc

SEQ ID NO: 999392 - RNA, 22 nt, Human
gaguauauuucucucucuuaag

SEQ ID NO: 999393 - RNA, 17 nt, Human
cuuuuaauuuacuuccc

SEQ ID NO: 999394 - RNA, 22 nt, Human
caguuuuaggacauguggaugu

SEQ ID NO: 999395 - RNA, 22 nt, Human
cuggagggaggaggcugcuauu

SEQ ID NO: 999396 - RNA, 22 nt, Human
cuauuuuccgcagcaggaagua

SEQ ID NO: 999397 - RNA, 22 nt, Human
auugucucugaauuuccagcug

SEQ ID NO: 999398 - RNA, 22 nt, Human
aguuuuaaaugauggugguggu

SEQ ID NO: 999399 - RNA, 20 nt, Human
cucuuuacaugucucuuccu

SEQ ID NO: 999400 - RNA, 22 nt, Human
gcugugugacugagagccuggc

SEQ ID NO: 999401 - RNA, 22 nt, Human
guuuucucaucuccucaauggu

SEQ ID NO: 999402 - RNA, 22 nt, Human
auguuucugaguguauauacau

SEQ ID NO: 999403 - RNA, 22 nt, Human
uggagguguccaacucgugggu

SEQ ID NO: 999404 - RNA, 22 nt, Human
uguauacauacauaugugugug

SEQ ID NO: 999405 - RNA, 22 nt, Human
uggccugguccuugucaaggca

SEQ ID NO: 999406 - RNA, 22 nt, Human
aguggcuguuuauaggugggua

SEQ ID NO: 999407 - RNA, 22 nt, Human
acugucugcuggccccugguua

SEQ ID NO: 999408 - RNA, 22 nt, Human
auguguauuuccaucgaucagc

SEQ ID NO: 999409 - RNA, 21 nt, Human
ccugugugugucccuuuaaga

SEQ ID NO: 999410 - RNA, 22 nt, Human
cuuuacagccuccagaaggaac

SEQ ID NO: 999411 - RNA, 22 nt, Human
auucucucuucugcugcccgug

SEQ ID NO: 999412 - RNA, 22 nt, Human
auuuucugaguccagaauuuac

SEQ ID NO: 999413 - RNA, 22 nt, Human
cuguguauugaaaaaggguuaa

SEQ ID NO: 999414 - RNA, 22 nt, Human
uuuaaccucuaauuuaguucuc

SEQ ID NO: 999415 - RNA, 22 nt, Human
gcugccacuuggucaugucaug

SEQ ID NO: 999416 - RNA, 22 nt, Human
uucucucuuacugccaugcugu

SEQ ID NO: 999417 - RNA, 17 nt, Human
uaucucuucaaguuuca

SEQ ID NO: 999418 - RNA, 22 nt, Human
uauauuuuagacacccucacgc

SEQ ID NO: 999419 - RNA, 22 nt, Human
uacaggauaucacuucauuucu

SEQ ID NO: 999420 - RNA, 22 nt, Human
guguguggaaugcucauuuauu

SEQ ID NO: 999421 - RNA, 22 nt, Human
aauauuuuugaggcccuguuau

SEQ ID NO: 999422 - RNA, 22 nt, Human
acagucugcuugucuccauggu

SEQ ID NO: 999423 - RNA, 22 nt, Human
ugucugugaccucuuuggagcc

SEQ ID NO: 999424 - RNA, 22 nt, Human
ucuuuaaggugauuucugcuac

SEQ ID NO: 999425 - RNA, 22 nt, Human
ugacaguauacuugugauggga

SEQ ID NO: 999426 - RNA, 22 nt, Human
aguggcugccaagauauaauuc

SEQ ID NO: 999427 - RNA, 22 nt, Human
cuuucucuugagcaagagcugu

SEQ ID NO: 999428 - RNA, 22 nt, Human
uggacucuaugaugcgccagca

SEQ ID NO: 999429 - RNA, 22 nt, Human
caguuuauauucuagugcuguu

SEQ ID NO: 999430 - RNA, 18 nt, Human
ucucucugauaacauuuu

SEQ ID NO: 999431 - RNA, 22 nt, Human
uggcauguauacuugaguagga

SEQ ID NO: 999432 - RNA, 22 nt, Human
ugugugcacguacauacuguau

SEQ ID NO: 999433 - RNA, 22 nt, Human
uccucuuucucaacauuaguua

SEQ ID NO: 999434 - RNA, 22 nt, Human
auguguauuaccucgauuguga

SEQ ID NO: 999435 - RNA, 22 nt, Human
auguggcuauuuuaauguuaau

SEQ ID NO: 999436 - RNA, 22 nt, Human
uguaugccuuuuucuguuguaa

SEQ ID NO: 999437 - RNA, 21 nt, Human
acuuuacaauuuacauaguga

SEQ ID NO: 999438 - RNA, 21 nt, Human
cuaacuuugaguccuggcccc

SEQ ID NO: 999439 - RNA, 22 nt, Human
ccuagccccagauaucucacac

SEQ ID NO: 999440 - RNA, 22 nt, Human
ccuuuuauacucuguccucugg

SEQ ID NO: 999441 - RNA, 20 nt, Human
ucucuuuuagcuuacagcug

SEQ ID NO: 999442 - RNA, 22 nt, Human
ucuuuacuuguguauuguauau

SEQ ID NO: 999443 - RNA, 22 nt, Human
ucuggcugaaaggggcugugcc

SEQ ID NO: 999444 - RNA, 22 nt, Human
uauuguucuucacuggucuuau

SEQ ID NO: 999445 - RNA, 22 nt, Human
uacaguauuugaagaauaugag

SEQ ID NO: 999446 - RNA, 22 nt, Human
cuguggcuggcucaucauaggu

SEQ ID NO: 999447 - RNA, 22 nt, Human
ucacucuuuaucuuuuaugucu

SEQ ID NO: 999448 - RNA, 22 nt, Human
gaagccuggagaccagauguug

SEQ ID NO: 999449 - RNA, 22 nt, Human
ucucuguucauggcacuauguc

SEQ ID NO: 999450 - RNA, 22 nt, Human
uacaguaucuucuggcaagcau

SEQ ID NO: 999451 - RNA, 22 nt, Human
gugcgugugccuaucaauaaag

SEQ ID NO: 999452 - RNA, 22 nt, Human
uguauaugugcacaugugcuuc

SEQ ID NO: 999453 - RNA, 22 nt, Human
uuagcuuuugagaaugauuucu

SEQ ID NO: 999454 - RNA, 22 nt, Human
uguguuugaggcauguugcaga

SEQ ID NO: 999455 - RNA, 22 nt, Human
uguggcugugccgucacacgug

SEQ ID NO: 999456 - RNA, 22 nt, Human
auauauuuugaauagccucugu

SEQ ID NO: 999457 - RNA, 22 nt, Human
ugugugugggcggaacggcccc

SEQ ID NO: 999458 - RNA, 22 nt, Human
ucuuuucuguaacucagugucu

SEQ ID NO: 999459 - RNA, 22 nt, Human
uuuuaucuucauuccuaucuac

SEQ ID NO: 999460 - RNA, 22 nt, Human
gaagccacagggaaggagaaca

SEQ ID NO: 999461 - RNA, 22 nt, Human
aagcugcccaagacugaagcau

SEQ ID NO: 999462 - RNA, 22 nt, Human
gcuguguuugacaguagcagac

SEQ ID NO: 999463 - RNA, 23 nt, Human
ucugagugauuagccucuggggu

SEQ ID NO: 999464 - RNA, 21 nt, Human
uguggcugccucuggcccugg

SEQ ID NO: 999465 - RNA, 20 nt, Human
aggcaguuagaaggagauga

SEQ ID NO: 999466 - RNA, 22 nt, Human
uuucucucuauuuagacaggua

SEQ ID NO: 999467 - RNA, 22 nt, Human
ucuuuccaaggacucuguagca

SEQ ID NO: 999468 - RNA, 22 nt, Human
uguucucuucucauugaacaug

SEQ ID NO: 999469 - RNA, 22 nt, Human
auuuucucacaaugcagaagga

SEQ ID NO: 999470 - RNA, 22 nt, Human
uguguguauccauuagaggcca

SEQ ID NO: 999471 - RNA, 22 nt, Human
uuaacuguaucauacuguuuca

SEQ ID NO: 999472 - RNA, 22 nt, Human
aggaagcuccuggagagccagu

SEQ ID NO: 999473 - RNA, 22 nt, Human
uguguguguuucugcucauaca

SEQ ID NO: 999474 - RNA, 22 nt, Human
aucuguguguugaguucucagc

SEQ ID NO: 999475 - RNA, 22 nt, Human
uuuagcagaucuauguauguga

SEQ ID NO: 999476 - RNA, 22 nt, Human
uuacaaguacugaauaugauuu

SEQ ID NO: 999477 - RNA, 21 nt, Human
auggagggaccagggaagcag

SEQ ID NO: 999478 - RNA, 22 nt, Human
aggacagcauaugggaaccagu

SEQ ID NO: 999479 - RNA, 22 nt, Human
uuacaguagauacaaugaguaa

SEQ ID NO: 999480 - RNA, 22 nt, Human
caguuuuaugaaugcuuauuag

SEQ ID NO: 999481 - RNA, 22 nt, Human
gcauguguggaggagaugugcu

SEQ ID NO: 999482 - RNA, 21 nt, Human
ggcugguguuuagcugugaua

SEQ ID NO: 999483 - RNA, 22 nt, Human
ugugugugcacgugcgcgcgag

SEQ ID NO: 999484 - RNA, 15 nt, Human
cuguggcuaaccuaa

SEQ ID NO: 999485 - RNA, 22 nt, Human
agcugugugccaggggagaugu

SEQ ID NO: 999486 - RNA, 18 nt, Human
gcugcgugggaugugacc

SEQ ID NO: 999487 - RNA, 22 nt, Human
uguuugugguuauaauaaguau

SEQ ID NO: 999488 - RNA, 22 nt, Human
aguggcugguaguuacugagca

SEQ ID NO: 999489 - RNA, 22 nt, Human
gcucugugggugaguagaaucu

SEQ ID NO: 999490 - RNA, 22 nt, Human
cuuuaucauggagguaaauaug

SEQ ID NO: 999491 - RNA, 22 nt, Human
guguauugcacauccuguagcc

SEQ ID NO: 999492 - RNA, 22 nt, Human
ucuacagucaaguuauauugcu

SEQ ID NO: 999493 - RNA, 22 nt, Human
aguuuucugaccccugcucuau

SEQ ID NO: 999494 - RNA, 22 nt, Human
aucucucugcccaggggcugug

SEQ ID NO: 999495 - RNA, 23 nt, Human
ugugucugaggauauaugugcau

SEQ ID NO: 999496 - RNA, 22 nt, Human
uugcugugucauuuguuuaauc

SEQ ID NO: 999497 - RNA, 23 nt, Human
auauuuccagguuagugagguaa

SEQ ID NO: 999498 - RNA, 22 nt, Human
uguguggcaagcuguaugcuag

SEQ ID NO: 999499 - RNA, 22 nt, Human
ucugugugggauaguuugagga

SEQ ID NO: 999500 - RNA, 22 nt, Human
acuuguuugaaucucucuagag

SEQ ID NO: 999501 - RNA, 21 nt, Human
auauuuuuguuuggacuguca

SEQ ID NO: 999502 - RNA, 22 nt, Human
uauaauuuuagaagagauggaa

SEQ ID NO: 999503 - RNA, 22 nt, Human
agcugcccuguggggaggguug

SEQ ID NO: 999504 - RNA, 22 nt, Human
aagccacucacaauaacugucc

SEQ ID NO: 999505 - RNA, 22 nt, Human
uuuaacauguaauugcugcuuu

SEQ ID NO: 999506 - RNA, 19 nt, Human
aauauuuuagccucuuccu

SEQ ID NO: 999507 - RNA, 22 nt, Human
uuggcugugagggguugcacag

SEQ ID NO: 999508 - RNA, 22 nt, Human
uacagguagggucuauguuaga

SEQ ID NO: 999509 - RNA, 22 nt, Human
aggcuguggcauuaaacguuug

SEQ ID NO: 999510 - RNA, 22 nt, Human
ucacuuuuugauaucauucugc

SEQ ID NO: 999511 - RNA, 22 nt, Human
ucugcuguuuacugugugauau

SEQ ID NO: 999512 - RNA, 22 nt, Human
auguggcuuggcagggaauaug

SEQ ID NO: 999513 - RNA, 17 nt, Human
uuuucucucuuggauuc

SEQ ID NO: 999514 - RNA, 22 nt, Human
guguauguucuacuuaauauua

SEQ ID NO: 999515 - RNA, 22 nt, Human
uguguagugauuuucuuccaac

SEQ ID NO: 999516 - RNA, 22 nt, Human
auguggcuguggacaccuuuca

SEQ ID NO: 999517 - RNA, 22 nt, Human
guggcuagaaaaauaugggugc

SEQ ID NO: 999518 - RNA, 22 nt, Human
uacaguuuguuacauuguuagu

SEQ ID NO: 999519 - RNA, 22 nt, Human
auuucucucauuguuagcuagg

SEQ ID NO: 999520 - RNA, 22 nt, Human
gcaguauauccauuacuucaua

SEQ ID NO: 999521 - RNA, 22 nt, Human
uuuaaauuauaguuaaugucug

SEQ ID NO: 999522 - RNA, 22 nt, Human
aggaaacagagugaagcuuggg

SEQ ID NO: 999523 - RNA, 22 nt, Human
uguggcugggcuaauaggcaaa

SEQ ID NO: 999524 - RNA, 18 nt, Human
gcagcugacacuggaguu

SEQ ID NO: 999525 - RNA, 22 nt, Human
uggccuggaaccuggcagggac

SEQ ID NO: 999526 - RNA, 22 nt, Human
aguggcuggagccccaggcugg

SEQ ID NO: 999527 - RNA, 23 nt, Human
ccccucugguggcucagcuccug

SEQ ID NO: 999528 - RNA, 22 nt, Human
uuuacuguguccaucugugacu

SEQ ID NO: 999529 - RNA, 22 nt, Human
uacuguguggugagcugucucc

SEQ ID NO: 999530 - RNA, 22 nt, Human
gacaguauccagguggugaaga

SEQ ID NO: 999531 - RNA, 22 nt, Human
uguaugcuuugguuguuucucu

SEQ ID NO: 999532 - RNA, 19 nt, Human
gcugggugaggucguugga

SEQ ID NO: 999533 - RNA, 22 nt, Human
aggcugugcauuuuggagggcc

SEQ ID NO: 999534 - RNA, 22 nt, Human
agcuguggaagacugucagggu

SEQ ID NO: 999535 - RNA, 22 nt, Human
uucuauguaccuagcguuguau

SEQ ID NO: 999536 - RNA, 22 nt, Human
gugugggcuaugugcgugggca

SEQ ID NO: 999537 - RNA, 22 nt, Human
uauguggccauucuguuugugu

SEQ ID NO: 999538 - RNA, 22 nt, Human
augcauguuuauagggugcuuc

SEQ ID NO: 999539 - RNA, 22 nt, Human
cugccuggaugaauggcgccuu

SEQ ID NO: 999540 - RNA, 22 nt, Human
uaauuucuaauucauuuucagu

SEQ ID NO: 999541 - RNA, 22 nt, Human
uacauuauccugucuuuguccu

SEQ ID NO: 999542 - RNA, 22 nt, Human
uuguaacuugugauuauaaucu

SEQ ID NO: 999543 - RNA, 20 nt, Human
agcugccccugggcacugcc

SEQ ID NO: 999544 - RNA, 22 nt, Human
uuauacagcauugcuagugaug

SEQ ID NO: 999545 - RNA, 22 nt, Human
cagauauaaauggaugugguag

SEQ ID NO: 999546 - RNA, 18 nt, Human
acugugugaauuagcucc

SEQ ID NO: 999547 - RNA, 22 nt, Human
cuggcugugugucuucauucag

SEQ ID NO: 999548 - RNA, 22 nt, Human
ucugugcugccauccuguggcc

SEQ ID NO: 999549 - RNA, 22 nt, Human
aucuggggucagacagcccugg

SEQ ID NO: 999550 - RNA, 22 nt, Human
auuaucucaagggauagcagau

SEQ ID NO: 999551 - RNA, 22 nt, Human
uaacuuugaagggaauuuuacu

SEQ ID NO: 999552 - RNA, 21 nt, Human
uguguuugagacuauguuucc

SEQ ID NO: 999553 - RNA, 22 nt, Human
uguguuuacuucuaugcaguuu

SEQ ID NO: 999554 - RNA, 22 nt, Human
uuauucuucuucucuugccagg

SEQ ID NO: 999555 - RNA, 22 nt, Human
cucuguguucagccuagcagaa

SEQ ID NO: 999556 - RNA, 22 nt, Human
uaaaguauccaguuauucuucu

SEQ ID NO: 999557 - RNA, 19 nt, Human
caauauauagugaguggau

SEQ ID NO: 999558 - RNA, 22 nt, Human
cuuugcagugauuguucuugga

SEQ ID NO: 999559 - RNA, 22 nt, Human
ugaugugugauucauucucaaa

SEQ ID NO: 999560 - RNA, 22 nt, Human
uuacagauuaaaaugcugaggu

SEQ ID NO: 999561 - RNA, 22 nt, Human
uucucacuauguauguagauug

SEQ ID NO: 999562 - RNA, 17 nt, Human
ugcagcugcucccaggc

SEQ ID NO: 999563 - RNA, 22 nt, Human
aguguaugcagguuuucaaugu

SEQ ID NO: 999564 - RNA, 22 nt, Human
aacaguuuaugagauaugcuau

SEQ ID NO: 999565 - RNA, 22 nt, Human
uuuuccuggggcuucuggacuc

SEQ ID NO: 999566 - RNA, 22 nt, Human
uguggguguucucacuuagaua

SEQ ID NO: 999567 - RNA, 22 nt, Human
ucucuucuauuugagacuauuu

SEQ ID NO: 999568 - RNA, 22 nt, Human
aacuuuuucugggauggagggu

SEQ ID NO: 999569 - RNA, 22 nt, Human
uaucuuuaacuugcaguauuua

SEQ ID NO: 999570 - RNA, 22 nt, Human
uguauguauacacugaucauca

SEQ ID NO: 999571 - RNA, 22 nt, Human
aggcuguguucugguucuuagc

SEQ ID NO: 999572 - RNA, 22 nt, Human
uuuaacuuaaucugcuugauga

SEQ ID NO: 999573 - RNA, 22 nt, Human
uauguucugucuguacagauuu

SEQ ID NO: 999574 - RNA, 22 nt, Human
uggccugucuuguugugcuaga

SEQ ID NO: 999575 - RNA, 18 nt, Human
gguguguaacguguuuuc

SEQ ID NO: 999576 - RNA, 22 nt, Human
cuuacaguguugagggaauuaa

SEQ ID NO: 999577 - RNA, 22 nt, Human
uuuaaccugucaauuugcaugc

SEQ ID NO: 999578 - RNA, 22 nt, Human
uguuacagucauuguuuucuga

SEQ ID NO: 999579 - RNA, 22 nt, Human
gaggaaaaugggacaggcugua

SEQ ID NO: 999580 - RNA, 22 nt, Human
auuuucucuuuguauaugcuag

SEQ ID NO: 999581 - RNA, 22 nt, Human
guaggggugcugagaucuggaa

SEQ ID NO: 999582 - RNA, 22 nt, Human
cuguggcuucugcuugggccuc

SEQ ID NO: 999583 - RNA, 22 nt, Human
gugcccagugcaggcccgcagg

SEQ ID NO: 999584 - RNA, 21 nt, Human
uguguguaugcacacacaugc

SEQ ID NO: 999585 - RNA, 20 nt, Human
uuugaacuuuguacucuguu

SEQ ID NO: 999586 - RNA, 22 nt, Human
gagaggauccacaaaccaggaa

SEQ ID NO: 999587 - RNA, 22 nt, Human
ucugugugauuucagggaaguc

SEQ ID NO: 999588 - RNA, 22 nt, Human
aguguguaaugccaggggcugc

SEQ ID NO: 999589 - RNA, 22 nt, Human
auggcuguccaguuucuagaga

SEQ ID NO: 999590 - RNA, 22 nt, Human
guacaguacuucagaaccagcc

SEQ ID NO: 999591 - RNA, 22 nt, Human
cuucucucugcauaggcauggg

SEQ ID NO: 999592 - RNA, 18 nt, Human
uguggcugguccacacug

SEQ ID NO: 999593 - RNA, 22 nt, Human
uguguugugucaccuaucaugc

SEQ ID NO: 999594 - RNA, 22 nt, Human
uauuugucaccuauggcugucc

SEQ ID NO: 999595 - RNA, 22 nt, Human
cugugucuuuccuacuuugugg

SEQ ID NO: 999596 - RNA, 23 nt, Human
uguaacuuugggcauguugcuuc

SEQ ID NO: 999597 - RNA, 22 nt, Human
aguggcugcuaugaucaggaca

SEQ ID NO: 999598 - RNA, 22 nt, Human
ugugccugauggucacguggcc

SEQ ID NO: 999599 - RNA, 19 nt, Human
ucucucuguacauuagaua

SEQ ID NO: 999600 - RNA, 22 nt, Human
cuggcugugucuuggaggagcu

SEQ ID NO: 999601 - RNA, 23 nt, Human
uggcugagauccuacuguuugcu

SEQ ID NO: 999602 - RNA, 22 nt, Human
cuauuacauuucuggacauuca

SEQ ID NO: 999603 - RNA, 22 nt, Human
uaguuucuaaagcuuccuaggu

SEQ ID NO: 999604 - RNA, 22 nt, Human
ucucacuuuccagacuuuucaa

SEQ ID NO: 999605 - RNA, 22 nt, Human
aucuguguaugugaccuuaucu

SEQ ID NO: 999606 - RNA, 20 nt, Human
gcuguguagcagugugcagu

SEQ ID NO: 999607 - RNA, 22 nt, Human
uucuuauuucccccuucaucau

SEQ ID NO: 999608 - RNA, 22 nt, Human
uuucuucuguuuguaguuacac

SEQ ID NO: 999609 - RNA, 21 nt, Human
caaguguggauguggaaggua

SEQ ID NO: 999610 - RNA, 23 nt, Human
acuuuucaauuagcuaugcuuaa

SEQ ID NO: 999611 - RNA, 21 nt, Human
gcauguguggugugcuccaca

SEQ ID NO: 999612 - RNA, 22 nt, Human
guacauuuuacuuuguuugaau

SEQ ID NO: 999613 - RNA, 22 nt, Human
ucuuuaagccaagauauauuua

SEQ ID NO: 999614 - RNA, 22 nt, Human
cauguguguccaugugacuaag

SEQ ID NO: 999615 - RNA, 22 nt, Human
aaaagcucuuucugcuguagau

SEQ ID NO: 999616 - RNA, 22 nt, Human
guggccuggaguuugauguagg

SEQ ID NO: 999617 - RNA, 22 nt, Human
ucuuuagacauccaguuucucu

SEQ ID NO: 999618 - RNA, 19 nt, Human
ggccuggcuaucccugcug

SEQ ID NO: 999619 - RNA, 22 nt, Human
agucauauauuuuguuugugca

SEQ ID NO: 999620 - RNA, 22 nt, Human
gugcccaguugaggccaggacu

SEQ ID NO: 999621 - RNA, 22 nt, Human
ucugucacccaggcuggagugc

SEQ ID NO: 999622 - RNA, 22 nt, Human
acagucuaggugugugauuuaa

SEQ ID NO: 999623 - RNA, 22 nt, Human
uuuacagucugucuagcaaugu

SEQ ID NO: 999624 - RNA, 19 nt, Human
cuuauacagauuuucucau

SEQ ID NO: 999625 - RNA, 22 nt, Human
uggcaguggcuuugcuggugga

SEQ ID NO: 999626 - RNA, 22 nt, Human
uauuuucuggacagucuugcuu

SEQ ID NO: 999627 - RNA, 22 nt, Human
aguggcuguaggcuaugagaga

SEQ ID NO: 999628 - RNA, 20 nt, Human
uggcugugggcaucuguuuc

SEQ ID NO: 999629 - RNA, 22 nt, Human
uugucucuacagagaguaguag

SEQ ID NO: 999630 - RNA, 22 nt, Human
uaaggaaggggaaagacauguc

SEQ ID NO: 999631 - RNA, 22 nt, Human
agcugugugugcuugggauuau

SEQ ID NO: 999632 - RNA, 22 nt, Human
guucucucaaacuuuguguuug

SEQ ID NO: 999633 - RNA, 22 nt, Human
uguauguauguauguauuuggg

SEQ ID NO: 999634 - RNA, 22 nt, Human
gcaguauauggauuuuaaacau

SEQ ID NO: 999635 - RNA, 22 nt, Human
aauuuucugaugaugaagcacg

SEQ ID NO: 999636 - RNA, 22 nt, Human
augugugguacagucccguuua

SEQ ID NO: 999637 - RNA, 22 nt, Human
uuuaucuguccuuugccaguga

SEQ ID NO: 999638 - RNA, 22 nt, Human
ugcaugcguuaguuggcguguu

SEQ ID NO: 999639 - RNA, 17 nt, Human
auguggcuaagcugcug

SEQ ID NO: 999640 - RNA, 22 nt, Human
ucgcugugguuucuguacaugg

SEQ ID NO: 999641 - RNA, 22 nt, Human
uacugugugacccuggguaggu

SEQ ID NO: 999642 - RNA, 22 nt, Human
uguguagcuuucuucugugggg

SEQ ID NO: 999643 - RNA, 22 nt, Human
gguggcugaaucaaaucaggcc

SEQ ID NO: 999644 - RNA, 22 nt, Human
ugugucuggauagguaauggau

SEQ ID NO: 999645 - RNA, 22 nt, Human
cuguggcucauucuugguggca

SEQ ID NO: 999646 - RNA, 22 nt, Human
acagucuaaucuuguguucugu

SEQ ID NO: 999647 - RNA, 22 nt, Human
ccucucuuggauguggaugggu

SEQ ID NO: 999648 - RNA, 22 nt, Human
cugugccuccaaguggucucug

SEQ ID NO: 999649 - RNA, 19 nt, Human
guguauguaaguugugagg

SEQ ID NO: 999650 - RNA, 22 nt, Human
auguaugcauagugaguaaaug

SEQ ID NO: 999651 - RNA, 22 nt, Human
cuguggcuucugggucaguuca

SEQ ID NO: 999652 - RNA, 22 nt, Human
gguguggcaguggaccugugaa

SEQ ID NO: 999653 - RNA, 22 nt, Human
uauguucuaggaaugguugaug

SEQ ID NO: 999654 - RNA, 22 nt, Human
cucugcuuggaacuggacagaa

SEQ ID NO: 999655 - RNA, 22 nt, Human
uuuaaacuguugauuuuaugaa

SEQ ID NO: 999656 - RNA, 22 nt, Human
cacuguguaagaagaugggcuu

SEQ ID NO: 999657 - RNA, 22 nt, Human
uuauuuacaacucuucucuucc

SEQ ID NO: 999658 - RNA, 22 nt, Human
auguggcucacauagcuggaaa

SEQ ID NO: 999659 - RNA, 20 nt, Human
ugugugcaucuguauguauu

SEQ ID NO: 999660 - RNA, 22 nt, Human
uggucucugcugcagcuucuca

SEQ ID NO: 999661 - RNA, 22 nt, Human
gcuguguguucaauaaugugau

SEQ ID NO: 999662 - RNA, 22 nt, Human
guuuucucugagaugccuuucu

SEQ ID NO: 999663 - RNA, 22 nt, Human
ucuggcuguguaauauguguag

SEQ ID NO: 999664 - RNA, 22 nt, Human
aguauauuuugauuguaugugu

SEQ ID NO: 999665 - RNA, 22 nt, Human
aauauuuuaggcuuuccaggcu

SEQ ID NO: 999666 - RNA, 22 nt, Human
auuguucuggauauuuacauug

SEQ ID NO: 999667 - RNA, 22 nt, Human
uauugucuaucgcugcuuucau

SEQ ID NO: 999668 - RNA, 22 nt, Human
gcugccaccguggagaugagug

SEQ ID NO: 999669 - RNA, 23 nt, Human
aucucucuuuauucuuggggaua

SEQ ID NO: 999670 - RNA, 22 nt, Human
cuggccccuguggcuaaaauca

SEQ ID NO: 999671 - RNA, 23 nt, Human
ccguguguauacucuguaauaga

SEQ ID NO: 999672 - RNA, 23 nt, Human
ucucucuuagcuaugcuuauggc

SEQ ID NO: 999673 - RNA, 20 nt, Human
uguguauaaauauauguuuc

SEQ ID NO: 999674 - RNA, 22 nt, Human
ucuguguauaggguugugcgcu

SEQ ID NO: 999675 - RNA, 22 nt, Human
uuucacagauauaagauuucac

SEQ ID NO: 999676 - RNA, 22 nt, Human
uguacaguauugguguuaguag

SEQ ID NO: 999677 - RNA, 22 nt, Human
uuucacaggaguccuuucuaua

SEQ ID NO: 999678 - RNA, 22 nt, Human
uuguaugcuguaggcaugcauu

SEQ ID NO: 999679 - RNA, 22 nt, Human
aggaagaaccuaagaaagucuc

SEQ ID NO: 999680 - RNA, 22 nt, Human
ucugcuuuagugcaaagucuua

SEQ ID NO: 999681 - RNA, 22 nt, Human
acuuuacacaucuuuucucauu

SEQ ID NO: 999682 - RNA, 22 nt, Human
auggcuguuccugggaguucua

SEQ ID NO: 999683 - RNA, 19 nt, Human
gguguuucuucauuuucca

SEQ ID NO: 999684 - RNA, 22 nt, Human
cuguggcuuugcagggcuuguu

SEQ ID NO: 999685 - RNA, 21 nt, Human
uacagucuccccuguugucca

SEQ ID NO: 999686 - RNA, 22 nt, Human
aguguaugugaaacuuuccaaa

SEQ ID NO: 999687 - RNA, 22 nt, Human
cuucugugagucaguguuucug

SEQ ID NO: 999688 - RNA, 22 nt, Human
uaugcgugccucugucugucug

SEQ ID NO: 999689 - RNA, 22 nt, Human
aguaaauuucugcauguguacu

SEQ ID NO: 999690 - RNA, 20 nt, Human
acuuuacagagaagacugac

SEQ ID NO: 999691 - RNA, 22 nt, Human
uuuucaguuccaucucugcucu

SEQ ID NO: 999692 - RNA, 22 nt, Human
uucucuuucuacagugugauug

SEQ ID NO: 999693 - RNA, 22 nt, Human
ugaguguguauuauguaucagg

SEQ ID NO: 999694 - RNA, 22 nt, Human
uccaguaugacugauguccuuc

SEQ ID NO: 999695 - RNA, 22 nt, Human
cuuaacagauacaucugugguu

SEQ ID NO: 999696 - RNA, 22 nt, Human
cucugugucugaguuauggucu

SEQ ID NO: 999697 - RNA, 22 nt, Human
uggcugugggaugagagccuca

SEQ ID NO: 999698 - RNA, 22 nt, Human
agcuguguuaggauguuaauaa

SEQ ID NO: 999699 - RNA, 20 nt, Human
ugugugcacacaugacauuc

SEQ ID NO: 999700 - RNA, 22 nt, Human
cucucuuucauuggucgccuug

SEQ ID NO: 999701 - RNA, 22 nt, Human
uuucacaguagaaaucauuaug

SEQ ID NO: 999702 - RNA, 22 nt, Human
uuugacuucugggcauuuuggu

SEQ ID NO: 999703 - RNA, 22 nt, Human
ucuugacauugcaaucuucaga

SEQ ID NO: 999704 - RNA, 22 nt, Human
cuaacuuuuugauucuugggga

SEQ ID NO: 999705 - RNA, 22 nt, Human
cucuuuacucuguguuauuguu

SEQ ID NO: 999706 - RNA, 22 nt, Human
gaggaaaaugcaacaggaaugc

SEQ ID NO: 999707 - RNA, 22 nt, Human
ugugcuauuugacuguuugcua

SEQ ID NO: 999708 - RNA, 22 nt, Human
gcuuuacaugauuucucacccu

SEQ ID NO: 999709 - RNA, 22 nt, Human
uguaguguggccuaucuuugcc

SEQ ID NO: 999710 - RNA, 22 nt, Human
gggcugugagaguggggcugcu

SEQ ID NO: 999711 - RNA, 22 nt, Human
ugcagcugaugauacccccaug

SEQ ID NO: 999712 - RNA, 18 nt, Human
gugcugugggcaguggcc

SEQ ID NO: 999713 - RNA, 22 nt, Human
ucucugugacugcagcuuugca

SEQ ID NO: 999714 - RNA, 22 nt, Human
gcaguauacacugauacaugag

SEQ ID NO: 999715 - RNA, 22 nt, Human
uauuugcugacagugcuggagc

SEQ ID NO: 999716 - RNA, 22 nt, Human
ugagcugucuaugguccugucu

SEQ ID NO: 999717 - RNA, 22 nt, Human
acaguguacuagguacauguuc

SEQ ID NO: 999718 - RNA, 19 nt, Human
uuagggguaugaaguggua

SEQ ID NO: 999719 - RNA, 22 nt, Human
acauguauacaauguguaauga

SEQ ID NO: 999720 - RNA, 22 nt, Human
ucuuuccacauucucuguuuag

SEQ ID NO: 999721 - RNA, 22 nt, Human
acgaguauguuuguauuuucuu

SEQ ID NO: 999722 - RNA, 22 nt, Human
uaaggcaggacuggauagcuau

SEQ ID NO: 999723 - RNA, 22 nt, Human
guuuacaguggcuucauuggau

SEQ ID NO: 999724 - RNA, 22 nt, Human
cuguggcuuuggggcggaggac

SEQ ID NO: 999725 - RNA, 22 nt, Human
agucauauggcuauuuaguggg

SEQ ID NO: 999726 - RNA, 22 nt, Human
uuuacagucaccaaacuuugcu

SEQ ID NO: 999727 - RNA, 22 nt, Human
uggcugugauuugcacgagaug

SEQ ID NO: 999728 - RNA, 21 nt, Human
uguggcaucauugaucuguga

SEQ ID NO: 999729 - RNA, 22 nt, Human
cuguauguuucuaugaauguga

SEQ ID NO: 999730 - RNA, 22 nt, Human
uaucucuugucuguuuugcaaa

SEQ ID NO: 999731 - RNA, 22 nt, Human
gacagcuguacacuccugguua

SEQ ID NO: 999732 - RNA, 22 nt, Human
uugucucuaagugugaucuuca

SEQ ID NO: 999733 - RNA, 22 nt, Human
guguggcugugggagauguuca

SEQ ID NO: 999734 - RNA, 22 nt, Human
ucuuacagccacucugugaagc

SEQ ID NO: 999735 - RNA, 22 nt, Human
auuucucuuccuccuaggguug

SEQ ID NO: 999736 - RNA, 22 nt, Human
guggcugcaguaguguaggguc

SEQ ID NO: 999737 - RNA, 22 nt, Human
uuaacaguaaagaauugugcaa

SEQ ID NO: 999738 - RNA, 22 nt, Human
gugccuguaaguuguaugggcu

SEQ ID NO: 999739 - RNA, 22 nt, Human
uuuacagcuucuauacuaugug

SEQ ID NO: 999740 - RNA, 22 nt, Human
ucucucuugucaccccaucugc

SEQ ID NO: 999741 - RNA, 22 nt, Human
guuucucuuaacacauaaagua

SEQ ID NO: 999742 - RNA, 22 nt, Human
uuacaguaacauuuucagucug

SEQ ID NO: 999743 - RNA, 22 nt, Human
gggcugugaggugagaacuuac

SEQ ID NO: 999744 - RNA, 22 nt, Human
guguguguauauauacacacac

SEQ ID NO: 999745 - RNA, 19 nt, Human
uacaaguaggcguuuucuc

SEQ ID NO: 999746 - RNA, 22 nt, Human
uuuaucagaggcuauguuucau

SEQ ID NO: 999747 - RNA, 22 nt, Human
uuugaacuucuaccugucauau

SEQ ID NO: 999748 - RNA, 22 nt, Human
acagcuccuacugaagccaugu

SEQ ID NO: 999749 - RNA, 22 nt, Human
ugugaugucagugguaucaaag

SEQ ID NO: 999750 - RNA, 22 nt, Human
auguguguaaacaaguauaauu

SEQ ID NO: 999751 - RNA, 22 nt, Human
cuuuuuaucucuuaaugauguu

SEQ ID NO: 999752 - RNA, 21 nt, Human
uuucucaccaugguauggaaa

SEQ ID NO: 999753 - RNA, 22 nt, Human
auacuuuuaauuccuucugagu

SEQ ID NO: 999754 - RNA, 22 nt, Human
guggccguguaacuugaguaca

SEQ ID NO: 999755 - RNA, 22 nt, Human
uuacgaguuugcaauuuuaaau

SEQ ID NO: 999756 - RNA, 20 nt, Human
uguguagcaggugcugugcc

SEQ ID NO: 999757 - RNA, 22 nt, Human
gucugugugcacagcgagugcc

SEQ ID NO: 999758 - RNA, 22 nt, Human
uguuaacuuccuccuccucugc

SEQ ID NO: 999759 - RNA, 23 nt, Human
aagcugccuucgcaguuggucug

SEQ ID NO: 999760 - RNA, 22 nt, Human
auacaguaagugucccugaaac

SEQ ID NO: 999761 - RNA, 22 nt, Human
cucucucuuuagaagcgucugg

SEQ ID NO: 999762 - RNA, 22 nt, Human
acagugaugagggaauuuugug

SEQ ID NO: 999763 - RNA, 22 nt, Human
auguguguguuuaauccucaaa

SEQ ID NO: 999764 - RNA, 21 nt, Human
ugugugugcaggcacacacac

SEQ ID NO: 999765 - RNA, 22 nt, Human
ccagcuccugggucuuagucag

SEQ ID NO: 999766 - RNA, 22 nt, Human
guggguguggaacugugagacc

SEQ ID NO: 999767 - RNA, 22 nt, Human
uuuuuuaucuaugguaguacca

SEQ ID NO: 999768 - RNA, 22 nt, Human
gccacagcuuagaucacagccu

SEQ ID NO: 999769 - RNA, 22 nt, Human
uucacagugugaucuaugggca

SEQ ID NO: 999770 - RNA, 22 nt, Human
aaaguuuggauuagcaguuaga

SEQ ID NO: 999771 - RNA, 22 nt, Human
guacaguagagccagguucagu

SEQ ID NO: 999772 - RNA, 22 nt, Human
uuuucuguuacaaaguacagcg

SEQ ID NO: 999773 - RNA, 22 nt, Human
auuacaguucugcagguaguuu

SEQ ID NO: 999774 - RNA, 22 nt, Human
uuuucucaggugcuuaucuaag

SEQ ID NO: 999775 - RNA, 22 nt, Human
uugacaguugaggguugucuaa

SEQ ID NO: 999776 - RNA, 18 nt, Human
gggcuguguucaugccca

SEQ ID NO: 999777 - RNA, 22 nt, Human
ucugcuguguccccugugcggg

SEQ ID NO: 999778 - RNA, 21 nt, Human
acaguauauuagauauuugaa

SEQ ID NO: 999779 - RNA, 22 nt, Human
gugccugugccaggggugugcu

SEQ ID NO: 999780 - RNA, 22 nt, Human
uuacaggaggugcuagguguuu

SEQ ID NO: 999781 - RNA, 19 nt, Human
cauuuucucauugugcccc

SEQ ID NO: 999782 - RNA, 22 nt, Human
uacuauuuauggagugguuauu

SEQ ID NO: 999783 - RNA, 22 nt, Human
gcuuuacacagcugguucuugu

SEQ ID NO: 999784 - RNA, 22 nt, Human
cuggcuguaugcuggccucaga

SEQ ID NO: 999785 - RNA, 22 nt, Human
uuuagcuugaaucuuguuuaaa

SEQ ID NO: 999786 - RNA, 22 nt, Human
auauuucuggggguguguuucu

SEQ ID NO: 999787 - RNA, 22 nt, Human
ugugugcuuauagucuaguagu

SEQ ID NO: 999788 - RNA, 22 nt, Human
ccuguguguaggccaggggagu

SEQ ID NO: 999789 - RNA, 22 nt, Human
aucuuucucugcacuauacaau

SEQ ID NO: 999790 - RNA, 22 nt, Human
cucucucuucuuuguaggggcc

SEQ ID NO: 999791 - RNA, 22 nt, Human
uguguuugggggagaugcauuu

SEQ ID NO: 999792 - RNA, 22 nt, Human
auauuuuuccaugugggacucu

SEQ ID NO: 999793 - RNA, 19 nt, Human
uuccugugcugcugugucc

SEQ ID NO: 999794 - RNA, 22 nt, Human
aacguuuuaucgugugcucuuc

SEQ ID NO: 999795 - RNA, 22 nt, Human
caggauauuaguuuucuuguua

SEQ ID NO: 999796 - RNA, 22 nt, Human
cuauuacaaucugcuacuauga

SEQ ID NO: 999797 - RNA, 17 nt, Human
uucucuuccuggauagu

SEQ ID NO: 999798 - RNA, 22 nt, Human
cuguggcuaauaauuaguauuu

SEQ ID NO: 999799 - RNA, 22 nt, Human
cuuguuaucuccguguccuugu

SEQ ID NO: 999800 - RNA, 22 nt, Human
uccuguguuacccuugcaguga

SEQ ID NO: 999801 - RNA, 22 nt, Human
uguguguuggcuggagagggcu

SEQ ID NO: 999802 - RNA, 20 nt, Human
augugucugccucuguguuc

SEQ ID NO: 999803 - RNA, 22 nt, Human
ccugaggagauuguggcugggg

SEQ ID NO: 999804 - RNA, 22 nt, Human
uacucucuggaaauuauaguga

SEQ ID NO: 999805 - RNA, 19 nt, Human
ucucugugucucuguuuau

SEQ ID NO: 999806 - RNA, 22 nt, Human
gcuguggcuuucuguuucuguu

SEQ ID NO: 999807 - RNA, 19 nt, Human
cuguggcugaccucuggcc

SEQ ID NO: 999808 - RNA, 22 nt, Human
uggcuguagaacaguggauauu

SEQ ID NO: 999809 - RNA, 22 nt, Human
acagugauuauuaguugguggu

SEQ ID NO: 999810 - RNA, 22 nt, Human
uacaguuaaaaaguucaauggu

SEQ ID NO: 999811 - RNA, 22 nt, Human
uacacuaugggcuuuguguaau

SEQ ID NO: 999812 - RNA, 22 nt, Human
gcauguguuauuucucuguggg

SEQ ID NO: 999813 - RNA, 22 nt, Human
aggggugaaggcccgauaggag

SEQ ID NO: 999814 - RNA, 22 nt, Human
aaacuuuuauaaagcugcagau

SEQ ID NO: 999815 - RNA, 22 nt, Human
uggcugaguaaguugugauaug

SEQ ID NO: 999816 - RNA, 18 nt, Human
auguggcuagugcuacug

SEQ ID NO: 999817 - RNA, 22 nt, Human
uuucucugugccauuuccauaa

SEQ ID NO: 999818 - RNA, 22 nt, Human
cuuucucuguggugaggagggu

SEQ ID NO: 999819 - RNA, 22 nt, Human
guucucucagccuuuguuauua

SEQ ID NO: 999820 - RNA, 23 nt, Human
auuacaguuaauuacaacaucuu

SEQ ID NO: 999821 - RNA, 22 nt, Human
uacaguaaccuuauuugucauu

SEQ ID NO: 999822 - RNA, 20 nt, Human
aguguauuuggguagagugu

SEQ ID NO: 999823 - RNA, 21 nt, Human
ugcaguauguauuuguaucca

SEQ ID NO: 999824 - RNA, 22 nt, Human
gcuguguaccuacuaacugcuu

SEQ ID NO: 999825 - RNA, 22 nt, Human
acuuuacaagcuuauagccuag

SEQ ID NO: 999826 - RNA, 22 nt, Human
uuucucugcuguguuggcagcu

SEQ ID NO: 999827 - RNA, 22 nt, Human
gugugauaacagggcaugacgg

SEQ ID NO: 999828 - RNA, 21 nt, Human
uuagcuuucuagaaucuuugu

SEQ ID NO: 999829 - RNA, 22 nt, Human
ggccugugagccuuaguuuaua

SEQ ID NO: 999830 - RNA, 22 nt, Human
cugcgugucucugucucauggc

SEQ ID NO: 999831 - RNA, 22 nt, Human
acuuuacauuugaucucucuaa

SEQ ID NO: 999832 - RNA, 22 nt, Human
acugugugcuggacaugauguu

SEQ ID NO: 999833 - RNA, 22 nt, Human
gcugugugcuaggauauguuuu

SEQ ID NO: 999834 - RNA, 22 nt, Human
uuuauguuugcauuuucaaaga

SEQ ID NO: 999835 - RNA, 22 nt, Human
cuaucuuuuguucauuuugagu

SEQ ID NO: 999836 - RNA, 22 nt, Human
auggcugugugacugaguucua

SEQ ID NO: 999837 - RNA, 22 nt, Human
gcucucuuuuuccagugguggu

SEQ ID NO: 999838 - RNA, 22 nt, Human
gcuggcugccuuacuuugugga

SEQ ID NO: 999839 - RNA, 22 nt, Human
uaguuucugaggauugaaagau

SEQ ID NO: 999840 - RNA, 22 nt, Human
ucuuuagccaguaucauaauga

SEQ ID NO: 999841 - RNA, 22 nt, Human
uauuucucagcauuuuacaucc

SEQ ID NO: 999842 - RNA, 22 nt, Human
acugugugccaggcgcuggucu

SEQ ID NO: 999843 - RNA, 22 nt, Human
uuugcaguagacaucuuauuuu

SEQ ID NO: 999844 - RNA, 22 nt, Human
uauauuuaauuaguugcuggau

SEQ ID NO: 999845 - RNA, 22 nt, Human
gguggcugaagcagucuucggg

SEQ ID NO: 999846 - RNA, 22 nt, Human
guaugcuuauuccuuguuguga

SEQ ID NO: 999847 - RNA, 22 nt, Human
ugugugugaguccuggcuuucc

SEQ ID NO: 999848 - RNA, 22 nt, Human
uauuugcugugcuuauuccauu

SEQ ID NO: 999849 - RNA, 22 nt, Human
ucuuugaccaaauuauccuguu

SEQ ID NO: 999850 - RNA, 22 nt, Human
uuugacaguccccugauguuug

SEQ ID NO: 999851 - RNA, 22 nt, Human
uuucucuccccaaguggaauug

SEQ ID NO: 999852 - RNA, 22 nt, Human
ccugucuggccuuccacggggg

SEQ ID NO: 999853 - RNA, 22 nt, Human
ccuuuuauauggcucaucacag

SEQ ID NO: 999854 - RNA, 22 nt, Human
auuugucuuugagugcccugcu

SEQ ID NO: 999855 - RNA, 22 nt, Human
auuugucuuuggaccugugaga

SEQ ID NO: 999856 - RNA, 21 nt, Human
ucugugcuuuuuuggcuccua

SEQ ID NO: 999857 - RNA, 22 nt, Human
aguguggcaggaaugacuagaa

SEQ ID NO: 999858 - RNA, 22 nt, Human
ucuguguguugucaggaggauu

SEQ ID NO: 999859 - RNA, 22 nt, Human
aguggcugugaaauacauggga

SEQ ID NO: 999860 - RNA, 22 nt, Human
auuauuuuaugugcggccugau

SEQ ID NO: 999861 - RNA, 22 nt, Human
uggcaguggcucagagugcaga

SEQ ID NO: 999862 - RNA, 20 nt, Human
uaugcaguauguguguauaa

SEQ ID NO: 999863 - RNA, 22 nt, Human
ugaggcagcauucuucaagaca

SEQ ID NO: 999864 - RNA, 20 nt, Human
ugcuguguggcccagcauga

SEQ ID NO: 999865 - RNA, 22 nt, Human
aguguauggaauuagcucccuu

SEQ ID NO: 999866 - RNA, 23 nt, Human
uuacagaaaguaugcuuuuguuu

SEQ ID NO: 999867 - RNA, 22 nt, Human
aagcugccuuccaugugaggaa

SEQ ID NO: 999868 - RNA, 22 nt, Human
uuucuuguaaaagcugugggaa

SEQ ID NO: 999869 - RNA, 22 nt, Human
acuuuugaggacuuuauuguau

SEQ ID NO: 999870 - RNA, 22 nt, Human
uaugccugauaacugugucucu

SEQ ID NO: 999871 - RNA, 22 nt, Human
cacaguaucccucuuucucccc

SEQ ID NO: 999872 - RNA, 22 nt, Human
ugugcugugggacucaggcucc

SEQ ID NO: 999873 - RNA, 20 nt, Human
uguguaugugcacaugcgaa

SEQ ID NO: 999874 - RNA, 22 nt, Human
ucuucugugaucuauguguuuu

SEQ ID NO: 999875 - RNA, 22 nt, Human
uuuuacaggucauagguauagu

SEQ ID NO: 999876 - RNA, 21 nt, Human
uagggcaggcauuggaagaga

SEQ ID NO: 999877 - RNA, 22 nt, Human
ucucugugcaggaugcugaguu

SEQ ID NO: 999878 - RNA, 17 nt, Human
gcaguuaaauuaagaug

SEQ ID NO: 999879 - RNA, 22 nt, Human
gccagccccuccauccuguuca

SEQ ID NO: 999880 - RNA, 22 nt, Human
aggcugugaguuuugucucaga

SEQ ID NO: 999881 - RNA, 22 nt, Human
aacaguaucuuuuaucagaaau

SEQ ID NO: 999882 - RNA, 23 nt, Human
cauguguaauuucugguugggug

SEQ ID NO: 999883 - RNA, 20 nt, Human
gcucugugguuugagucucc

SEQ ID NO: 999884 - RNA, 22 nt, Human
aaggcaguggcuggaaaaccug

SEQ ID NO: 999885 - RNA, 22 nt, Human
uucuaugucagugugcucugug

SEQ ID NO: 999886 - RNA, 18 nt, Human
guuggcugcuguggcugg

SEQ ID NO: 999887 - RNA, 22 nt, Human
uguuuacagggugauuuuaccu

SEQ ID NO: 999888 - RNA, 22 nt, Human
cuguggcucaaaaucccaugau

SEQ ID NO: 999889 - RNA, 22 nt, Human
uuuaacucugucauucucuuua

SEQ ID NO: 999890 - RNA, 22 nt, Human
aguguguguuugggcgguuuau

SEQ ID NO: 999891 - RNA, 22 nt, Human
uauucucugcagcugaauguuu

SEQ ID NO: 999892 - RNA, 22 nt, Human
gcuauguguguuuugcugcagc

SEQ ID NO: 999893 - RNA, 22 nt, Human
aggcuguguucugcccucuccc

SEQ ID NO: 999894 - RNA, 22 nt, Human
uuugacuuugggcucuaacuca

SEQ ID NO: 999895 - RNA, 22 nt, Human
uuugacagagcucuuagucucu

SEQ ID NO: 999896 - RNA, 17 nt, Human
ucuucucuuccagucuu

SEQ ID NO: 999897 - RNA, 22 nt, Human
uuacuguaugagugugguaguc

SEQ ID NO: 999898 - RNA, 22 nt, Human
cugugcugaggaugcaguuucu

SEQ ID NO: 999899 - RNA, 22 nt, Human
gcucucuugguggcuguccugg

SEQ ID NO: 999900 - RNA, 22 nt, Human
gucucucugcuaggccuccagu

SEQ ID NO: 999901 - RNA, 22 nt, Human
caguauauuuuagagaaguccc

SEQ ID NO: 999902 - RNA, 22 nt, Human
auuuacagccuugccaucuaua

SEQ ID NO: 999903 - RNA, 22 nt, Human
ggacaggaugcugaagaugaag

SEQ ID NO: 999904 - RNA, 22 nt, Human
uguguauguaagcaugugcaua

SEQ ID NO: 999905 - RNA, 22 nt, Human
cugcccugggaguaccuguccu

SEQ ID NO: 999906 - RNA, 22 nt, Human
acuguuuaggaggcuuauaugc

SEQ ID NO: 999907 - RNA, 22 nt, Human
uaguuucuaaacugaacuguca

SEQ ID NO: 999908 - RNA, 22 nt, Human
cuggcuguuucuccuuugucua

SEQ ID NO: 999909 - RNA, 22 nt, Human
uguauaugagucugaguguaca

SEQ ID NO: 999910 - RNA, 22 nt, Human
agcugugugacucuaagcaagu

SEQ ID NO: 999911 - RNA, 22 nt, Human
cucucuuuuucgugugccgaag

SEQ ID NO: 999912 - RNA, 18 nt, Human
agcugcccugggcuggag

SEQ ID NO: 999913 - RNA, 20 nt, Human
aguaugauccacucugcucu

SEQ ID NO: 999914 - RNA, 22 nt, Human
aguggcugagugacugugacuc

SEQ ID NO: 999915 - RNA, 22 nt, Human
ccuggcccuggaauagggcagg

SEQ ID NO: 999916 - RNA, 20 nt, Human
aaguauauguccguguacuu

SEQ ID NO: 999917 - RNA, 22 nt, Human
ucuuuccagaggaauuuuuaga

SEQ ID NO: 999918 - RNA, 22 nt, Human
aaguauauuuagcugagcuugu

SEQ ID NO: 999919 - RNA, 22 nt, Human
gugcaugcaguaaguguuuuaa

SEQ ID NO: 999920 - RNA, 22 nt, Human
cagggugcagagcuaggguagu

SEQ ID NO: 999921 - RNA, 22 nt, Human
uuccugugaagccgguggucuc

SEQ ID NO: 999922 - RNA, 22 nt, Human
ucucugugacagcuggguaugu

SEQ ID NO: 999923 - RNA, 22 nt, Human
guguguggaaaguuuuccaugg

SEQ ID NO: 999924 - RNA, 22 nt, Human
cagccacuguggaauagccccc

SEQ ID NO: 999925 - RNA, 22 nt, Human
auggcugucacgccacugugag

SEQ ID NO: 999926 - RNA, 22 nt, Human
ucugggugccacugucuguaca

SEQ ID NO: 999927 - RNA, 22 nt, Human
uguuugugagaugugagguacg

SEQ ID NO: 999928 - RNA, 22 nt, Human
auuugucucugcacuuuacuca

SEQ ID NO: 999929 - RNA, 18 nt, Human
gugggguguugugaggau

SEQ ID NO: 999930 - RNA, 22 nt, Human
uuuucagugguaucuuuguaaa

SEQ ID NO: 999931 - RNA, 22 nt, Human
cuuguacauugauuucugcauu

SEQ ID NO: 999932 - RNA, 22 nt, Human
aauuuucugccuagcaaaaacu

SEQ ID NO: 999933 - RNA, 21 nt, Human
ucugucugguuuuagaguggc

SEQ ID NO: 999934 - RNA, 22 nt, Human
guuacaguggguuuggggccca

SEQ ID NO: 999935 - RNA, 22 nt, Human
acuuauuagacaucuucauugu

SEQ ID NO: 999936 - RNA, 22 nt, Human
ucugucugagggagugacauuu

SEQ ID NO: 999937 - RNA, 22 nt, Human
cuaacuuugucaucuucccuuu

SEQ ID NO: 999938 - RNA, 22 nt, Human
uacaguuucuguccuuguggag

SEQ ID NO: 999939 - RNA, 22 nt, Human
uggcauguggcuuugagucauc

SEQ ID NO: 999940 - RNA, 22 nt, Human
ccugugugauuggaagcugaga

SEQ ID NO: 999941 - RNA, 22 nt, Human
uggcugugguuuaucccaguuc

SEQ ID NO: 999942 - RNA, 22 nt, Human
ucugcguggcugcugugagcgu

SEQ ID NO: 999943 - RNA, 22 nt, Human
gugugugucuccgcggccguag

SEQ ID NO: 999944 - RNA, 22 nt, Human
agcugccccucauuuucaccac

SEQ ID NO: 999945 - RNA, 22 nt, Human
ccugugugcacacgaggccaug

SEQ ID NO: 999946 - RNA, 22 nt, Human
agcugcccccagggcugugcuu

SEQ ID NO: 999947 - RNA, 22 nt, Human
ggcugaguucucuugcugaauc

SEQ ID NO: 999948 - RNA, 22 nt, Human
guuuucucuguguuuggaugau

SEQ ID NO: 999949 - RNA, 22 nt, Human
ucugugcuagaggaguuggcca

SEQ ID NO: 999950 - RNA, 22 nt, Human
aacaguauggaagccauuagga

SEQ ID NO: 999951 - RNA, 22 nt, Human
cuucuguguuuuacuauaugua

SEQ ID NO: 999952 - RNA, 22 nt, Human
uuaucucucacuuuuaaggaca

SEQ ID NO: 999953 - RNA, 22 nt, Human
cuguggcuaggaagcuguggga

SEQ ID NO: 999954 - RNA, 22 nt, Human
uagaguauagcuaacuguauua

SEQ ID NO: 999955 - RNA, 22 nt, Human
uguggcuguguccaccugcugc

SEQ ID NO: 999956 - RNA, 23 nt, Human
ucuuuacagcagcaggauuugga

SEQ ID NO: 999957 - RNA, 22 nt, Human
gacagcugugcaggagaagggg

SEQ ID NO: 999958 - RNA, 22 nt, Human
cuggagggacaagguaugcauu

SEQ ID NO: 999959 - RNA, 22 nt, Human
uacaguauuacuguguuguuuu

SEQ ID NO: 999960 - RNA, 22 nt, Human
ucaugugucugccaguguuuau

SEQ ID NO: 999961 - RNA, 22 nt, Human
uguauauugccugagucuuucc

SEQ ID NO: 999962 - RNA, 22 nt, Human
cuauacagcagcuuacuaguua

SEQ ID NO: 999963 - RNA, 22 nt, Human
ggcagugaacagaaaugcagaa

SEQ ID NO: 999964 - RNA, 22 nt, Human
ucugucacuauuggccagaaca

SEQ ID NO: 999965 - RNA, 22 nt, Human
uuauuuucuccucagaaagugg

SEQ ID NO: 999966 - RNA, 22 nt, Human
ucuuuaagaguaauuauuuugg

SEQ ID NO: 999967 - RNA, 22 nt, Human
uagcaguacugggcauguguuu

SEQ ID NO: 999968 - RNA, 20 nt, Human
ggaagcuguggguccccagg

SEQ ID NO: 999969 - RNA, 22 nt, Human
acuuuacaaacuccucacuguu

SEQ ID NO: 999970 - RNA, 19 nt, Human
uacuuuuucaggacagagu

SEQ ID NO: 999971 - RNA, 19 nt, Human
uguguguauuucaguucuu

SEQ ID NO: 999972 - RNA, 22 nt, Human
ucagugugacugauggcuuuau

SEQ ID NO: 999973 - RNA, 22 nt, Human
cuuuacaccaagcagaucuuuc

SEQ ID NO: 999974 - RNA, 22 nt, Human
uauuacaguucgaguuucuagg

SEQ ID NO: 999975 - RNA, 22 nt, Human
gggcugugccucaggugggguc

SEQ ID NO: 999976 - RNA, 22 nt, Human
ucuguguccugcuagcugucuu

SEQ ID NO: 999977 - RNA, 22 nt, Human
ugaguguauaugaagguuguaa

SEQ ID NO: 999978 - RNA, 22 nt, Human
ggaggggugcucagcugucacg

SEQ ID NO: 999979 - RNA, 22 nt, Human
uuucugcuuaggacucugugga

SEQ ID NO: 999980 - RNA, 18 nt, Human
uaucuuuuccagugguau

SEQ ID NO: 999981 - RNA, 22 nt, Human
acagucugcauaugaccuguag

SEQ ID NO: 999982 - RNA, 22 nt, Human
gugugugugccugcacacacac

SEQ ID NO: 999983 - RNA, 22 nt, Human
agcuguguuuccagaugguagc

SEQ ID NO: 999984 - RNA, 22 nt, Human
uaacuucuggaaaugcaucugc

SEQ ID NO: 999985 - RNA, 22 nt, Human
aucuggggagguaucuguaguc

SEQ ID NO: 999986 - RNA, 22 nt, Human
uuuucaguuugcacugcagugc

SEQ ID NO: 999987 - RNA, 22 nt, Human
cuuuacagugcugcuaauggcu

SEQ ID NO: 999988 - RNA, 22 nt, Human
uacaguaguaucuucauuuguu

SEQ ID NO: 999989 - RNA, 22 nt, Human
uucugucuggaaaaggacauag

SEQ ID NO: 999990 - RNA, 22 nt, Human
uuauuuugguaaauguuugccu

SEQ ID NO: 999991 - RNA, 22 nt, Human
auacaguagggaccaugucuga

SEQ ID NO: 999992 - RNA, 23 nt, Human
uuucucauccagagagucagucc

SEQ ID NO: 999993 - RNA, 22 nt, Human
cuacaguagagguugucaggga

SEQ ID NO: 999994 - RNA, 22 nt, Human
augugucuucuguggguuugaa

SEQ ID NO: 999995 - RNA, 22 nt, Human
ugggugugccauauuccauuuc

SEQ ID NO: 999996 - RNA, 22 nt, Human
uacacuuuauggauccuacuuu

SEQ ID NO: 999997 - RNA, 22 nt, Human
gguggcuggaggagcugaugga

SEQ ID NO: 999998 - RNA, 22 nt, Human
uucucccugguauuuacuuagu

SEQ ID NO: 999999 - RNA, 22 nt, Human
aggcuguguaaagugcuuuccc

SEQ ID NO: 1000000 - RNA, 22 nt, Human
aucaguauauuccuuggucuuu

SEQ ID NO: 1000001 - RNA, 22 nt, Human
gugugcacagagcuccaguguu

SEQ ID NO: 1000002 - RNA, 22 nt, Human
uuugugugcuugguauugaaga

SEQ ID NO: 1000003 - RNA, 22 nt, Human
aagcuuuucucuguauuaccug

SEQ ID NO: 1000004 - RNA, 22 nt, Human
uuuacaaggcaguuauuuuccu

SEQ ID NO: 1000005 - RNA, 22 nt, Human
uucuaacucaaagcuucuuuca

SEQ ID NO: 1000006 - RNA, 22 nt, Human
uucuucugacacugaugcugua

SEQ ID NO: 1000007 - RNA, 19 nt, Human
ggugugccaaaugggaaug

SEQ ID NO: 1000008 - RNA, 22 nt, Human
cuggcugugcuggaguugagga

SEQ ID NO: 1000009 - RNA, 22 nt, Human
aggagguggcugaacuugaggg

SEQ ID NO: 1000010 - RNA, 22 nt, Human
auuauucuugagguguuuauug

SEQ ID NO: 1000011 - RNA, 22 nt, Human
uguacagucaugcuuucuguuc

SEQ ID NO: 1000012 - RNA, 22 nt, Human
ugugccugacuaggugaaucaa

SEQ ID NO: 1000013 - RNA, 22 nt, Human
ugucuguauaucacuuuugucc

SEQ ID NO: 1000014 - RNA, 22 nt, Human
uaacuuuggggacacuucucuu

SEQ ID NO: 1000015 - RNA, 22 nt, Human
uauuaucuaguaacugauagug

SEQ ID NO: 1000016 - RNA, 22 nt, Human
ucuauuuuguuuccagcucuac

SEQ ID NO: 1000017 - RNA, 22 nt, Human
guguggcugccagccaagaggc

SEQ ID NO: 1000018 - RNA, 22 nt, Human
auggcuguguuguuccucugaa

SEQ ID NO: 1000019 - RNA, 22 nt, Human
cuuacagugaucaacacaaaga

SEQ ID NO: 1000020 - RNA, 22 nt, Human
cugcccugcuugaugacagcga

SEQ ID NO: 1000021 - RNA, 22 nt, Human
augcugugccuucucugugcca

SEQ ID NO: 1000022 - RNA, 22 nt, Human
cuucacaggcaagucuguuuuu

SEQ ID NO: 1000023 - RNA, 22 nt, Human
uuucuuguuucauggugucuca

SEQ ID NO: 1000024 - RNA, 22 nt, Human
ugugcucuugucugugacuaac

SEQ ID NO: 1000025 - RNA, 22 nt, Human
acaguauagggcuuauauugua

SEQ ID NO: 1000026 - RNA, 22 nt, Human
gauuaagagaaguuucuuaucg

SEQ ID NO: 1000027 - RNA, 22 nt, Human
uacuguaugaauuauguuauuu

SEQ ID NO: 1000028 - RNA, 22 nt, Human
uuuucuauucauugucuauggu

SEQ ID NO: 1000029 - RNA, 19 nt, Human
ucucuacacuacauuucua

SEQ ID NO: 1000030 - RNA, 19 nt, Human
auggcuguguuccaguaaa

SEQ ID NO: 1000031 - RNA, 22 nt, Human
uaacucuuccaacacuccuucc

SEQ ID NO: 1000032 - RNA, 22 nt, Human
cuguguggacugguugaggccc

SEQ ID NO: 1000033 - RNA, 22 nt, Human
uguggcugacuccuggucccca

SEQ ID NO: 1000034 - RNA, 22 nt, Human
uuuuaguuuggauuucuaaagc

SEQ ID NO: 1000035 - RNA, 22 nt, Human
ucuuuacacaagacaagaauaa

SEQ ID NO: 1000036 - RNA, 22 nt, Human
cucuucuugcuagacugagugc

SEQ ID NO: 1000037 - RNA, 19 nt, Human
ugugacugguugucucgcu

SEQ ID NO: 1000038 - RNA, 22 nt, Human
ucucucugugacagcuuugcug

SEQ ID NO: 1000039 - RNA, 22 nt, Human
gcugugugacccuagccaguag

SEQ ID NO: 1000040 - RNA, 22 nt, Human
aguguaugaguuucaguucuuc

SEQ ID NO: 1000041 - RNA, 22 nt, Human
aguguguaagggaucaaagagu

SEQ ID NO: 1000042 - RNA, 22 nt, Human
guguagcuuuggagugggaggc

SEQ ID NO: 1000043 - RNA, 22 nt, Human
uuucuuuaucauagcaucuuug

SEQ ID NO: 1000044 - RNA, 22 nt, Human
uaguggcugcagggcuguuuga

SEQ ID NO: 1000045 - RNA, 22 nt, Human
uaacuuugagaacuuucuggug

SEQ ID NO: 1000046 - RNA, 22 nt, Human
uauuuucuggggagagugaacc

SEQ ID NO: 1000047 - RNA, 23 nt, Human
aguguguauugcugagggcagcu

SEQ ID NO: 1000048 - RNA, 19 nt, Human
uguuuacauguuucuucag

SEQ ID NO: 1000049 - RNA, 22 nt, Human
cugugcugcagacgcaguagcu

SEQ ID NO: 1000050 - RNA, 22 nt, Human
uuacagaacugcccuaguuggc

SEQ ID NO: 1000051 - RNA, 22 nt, Human
aguaucuucaaguuucuucuag

SEQ ID NO: 1000052 - RNA, 22 nt, Human
gugacugugaacuguuucugau

SEQ ID NO: 1000053 - RNA, 22 nt, Human
uggagguggggcucaggaaucu

SEQ ID NO: 1000054 - RNA, 21 nt, Human
gugugcugauacauuggagaa

SEQ ID NO: 1000055 - RNA, 22 nt, Human
uacauguaguucacugguggca

SEQ ID NO: 1000056 - RNA, 21 nt, Human
ccagcccagcugugucccagc

SEQ ID NO: 1000057 - RNA, 21 nt, Human
augcauguuacaguauaugcc

SEQ ID NO: 1000058 - RNA, 22 nt, Human
uuuucagugggcaaugauguga

SEQ ID NO: 1000059 - RNA, 22 nt, Human
cugugugccuccugugaucagg

SEQ ID NO: 1000060 - RNA, 19 nt, Human
uuugcagugguuccuuugu

SEQ ID NO: 1000061 - RNA, 19 nt, Human
aggcugugaggggaaggaa

SEQ ID NO: 1000062 - RNA, 22 nt, Human
uuucaucuaacacuacauaggg

SEQ ID NO: 1000063 - RNA, 22 nt, Human
cuucuuauuaauccuucucugu

SEQ ID NO: 1000064 - RNA, 22 nt, Human
uggcugagagucauccugugug

SEQ ID NO: 1000065 - RNA, 22 nt, Human
auguguaugagugugcuucuuu

SEQ ID NO: 1000066 - RNA, 22 nt, Human
uuguguggauaauauuacuuga

SEQ ID NO: 1000067 - RNA, 22 nt, Human
ucuaacuuguauguauaguuuu

SEQ ID NO: 1000068 - RNA, 22 nt, Human
cuacaguagaguaggccucuga

SEQ ID NO: 1000069 - RNA, 22 nt, Human
uuucacagcagaauuucugagg

SEQ ID NO: 1000070 - RNA, 22 nt, Human
uuauguuuuauggcuauaucau

SEQ ID NO: 1000071 - RNA, 20 nt, Human
ucuguacacucaucuucugc

SEQ ID NO: 1000072 - RNA, 22 nt, Human
ugugugugacucauacuagaac

SEQ ID NO: 1000073 - RNA, 22 nt, Human
gcaguguggccccaguaucacg

SEQ ID NO: 1000074 - RNA, 22 nt, Human
acuucuuucacaauguuucuag

SEQ ID NO: 1000075 - RNA, 22 nt, Human
cuuucucuucagcacccagccc

SEQ ID NO: 1000076 - RNA, 22 nt, Human
cagccacugaacuccuggcuau

SEQ ID NO: 1000077 - RNA, 22 nt, Human
uucuuauuaugugcucugugaa

SEQ ID NO: 1000078 - RNA, 22 nt, Human
cugcccugagucaugccagaug

SEQ ID NO: 1000079 - RNA, 16 nt, Human
cuguggcucccagguu

SEQ ID NO: 1000080 - RNA, 22 nt, Human
cuggcccccacaccugucaggg

SEQ ID NO: 1000081 - RNA, 22 nt, Human
uaacuuuuacuuaccaucugag

SEQ ID NO: 1000082 - RNA, 22 nt, Human
cugugucuucaauguacuggga

SEQ ID NO: 1000083 - RNA, 22 nt, Human
uuauaguaugugcauaugugug

SEQ ID NO: 1000084 - RNA, 22 nt, Human
cuggcuguuucaggcagugucc

SEQ ID NO: 1000085 - RNA, 22 nt, Human
guguguguguaaaaauccagag

SEQ ID NO: 1000086 - RNA, 22 nt, Human
aucuguguguuauuguuuauca

SEQ ID NO: 1000087 - RNA, 22 nt, Human
uguguagcucauauuaguguua

SEQ ID NO: 1000088 - RNA, 22 nt, Human
guuacagugcauguggcuucug

SEQ ID NO: 1000089 - RNA, 22 nt, Human
cguggcuggggaggucagccag

SEQ ID NO: 1000090 - RNA, 22 nt, Human
uagggcagccacccaggcugcu

SEQ ID NO: 1000091 - RNA, 22 nt, Human
ucuucacaggagccugccugcc

SEQ ID NO: 1000092 - RNA, 22 nt, Human
ugugugccccagaugaguagcu

SEQ ID NO: 1000093 - RNA, 22 nt, Human
gcugugauguggagggugcuga

SEQ ID NO: 1000094 - RNA, 22 nt, Human
aguguggccaaugaggaugggc

SEQ ID NO: 1000095 - RNA, 21 nt, Human
agugugugauaggcaggaaga

SEQ ID NO: 1000096 - RNA, 22 nt, Human
cuucucucggugcaucccucac

SEQ ID NO: 1000097 - RNA, 22 nt, Human
augggcagacagggagcucacg

SEQ ID NO: 1000098 - RNA, 22 nt, Human
ccugcccaggagucucucugug

SEQ ID NO: 1000099 - RNA, 22 nt, Human
cuuguuuaagccgcuguuaagc

SEQ ID NO: 1000100 - RNA, 22 nt, Human
uggcuaugacuucguacugucu

SEQ ID NO: 1000101 - RNA, 22 nt, Human
uuguguauuuuuugauacuaac

SEQ ID NO: 1000102 - RNA, 22 nt, Human
guguuguggagcuugucagggg

SEQ ID NO: 1000103 - RNA, 22 nt, Human
uucuauguuaguaugggucucc

SEQ ID NO: 1000104 - RNA, 22 nt, Human
ugcuguguucuccugacucacc

SEQ ID NO: 1000105 - RNA, 22 nt, Human
guuugugucaaugacuucugca

SEQ ID NO: 1000106 - RNA, 22 nt, Human
acaguaguacacaucuaugucc

SEQ ID NO: 1000107 - RNA, 22 nt, Human
aggagguguagauuuccuguca

SEQ ID NO: 1000108 - RNA, 22 nt, Human
ggcugcugggucaugaugcaga

SEQ ID NO: 1000109 - RNA, 22 nt, Human
ugagcuguagcagaugcuguug

SEQ ID NO: 1000110 - RNA, 22 nt, Human
aggcuguggugcugaaggaggg

SEQ ID NO: 1000111 - RNA, 22 nt, Human
uauuuugcuuuagcugacuguu

SEQ ID NO: 1000112 - RNA, 23 nt, Human
augugugggaggucagagagcca

SEQ ID NO: 1000113 - RNA, 22 nt, Human
auguggcugucacagcauaaug

SEQ ID NO: 1000114 - RNA, 22 nt, Human
cugcagccucaaccuccugagc

SEQ ID NO: 1000115 - RNA, 19 nt, Human
acugugcucgggaaccacu

SEQ ID NO: 1000116 - RNA, 22 nt, Human
ucuuaacugacaguuuaauggg

SEQ ID NO: 1000117 - RNA, 22 nt, Human
gcuguaugaguucauguguaga

SEQ ID NO: 1000118 - RNA, 22 nt, Human
aguggcugauuacaaacugagu

SEQ ID NO: 1000119 - RNA, 22 nt, Human
auucucuggucauugagcauau

SEQ ID NO: 1000120 - RNA, 22 nt, Human
ugguguguacauuuuugcuucu

SEQ ID NO: 1000121 - RNA, 22 nt, Human
cguggcuggggcgacuccacgg

SEQ ID NO: 1000122 - RNA, 22 nt, Human
cugucguguucacuguggccua

SEQ ID NO: 1000123 - RNA, 22 nt, Human
uuguggcuucuacgcccacagg

SEQ ID NO: 1000124 - RNA, 22 nt, Human
cuguggcuccauagaaguugca

SEQ ID NO: 1000125 - RNA, 22 nt, Human
aguguauguccugaggggagaa

SEQ ID NO: 1000126 - RNA, 22 nt, Human
ugggugugaagucuguuggccu

SEQ ID NO: 1000127 - RNA, 22 nt, Human
cugugucugaauaacucugugu

SEQ ID NO: 1000128 - RNA, 22 nt, Human
agcuguguucugguugauucac

SEQ ID NO: 1000129 - RNA, 22 nt, Human
guaugcaugcauguguauguac

SEQ ID NO: 1000130 - RNA, 17 nt, Human
ugcaugcgucugugaua

SEQ ID NO: 1000131 - RNA, 22 nt, Human
cucugugugguaugauugucau

SEQ ID NO: 1000132 - RNA, 22 nt, Human
ucaguauagcuaaaaguuuguc

SEQ ID NO: 1000133 - RNA, 20 nt, Human
uguauauuuucugguguaaa

SEQ ID NO: 1000134 - RNA, 22 nt, Human
guguguggacgucugagcccag

SEQ ID NO: 1000135 - RNA, 22 nt, Human
acuguuuucuuagcucccugcu

SEQ ID NO: 1000136 - RNA, 22 nt, Human
uggcucugucacugugagcuau

SEQ ID NO: 1000137 - RNA, 19 nt, Human
uucucuauuaugucuucuc

SEQ ID NO: 1000138 - RNA, 21 nt, Human
uguuuucuaaagggcggauca

SEQ ID NO: 1000139 - RNA, 22 nt, Human
uucugcucuaauguacaccagc

SEQ ID NO: 1000140 - RNA, 22 nt, Human
ugugugcuaauguaugcucuaa

SEQ ID NO: 1000141 - RNA, 21 nt, Human
ucucuuugggaacauuaauca

SEQ ID NO: 1000142 - RNA, 22 nt, Human
acuuuugugcaggucucuccca

SEQ ID NO: 1000143 - RNA, 22 nt, Human
auuucucuuagcaagacauuac

SEQ ID NO: 1000144 - RNA, 22 nt, Human
uggcucuguuuuaugaguacca

SEQ ID NO: 1000145 - RNA, 22 nt, Human
caguaaauaguggagauguggg

SEQ ID NO: 1000146 - RNA, 22 nt, Human
guuauuuuaucucugagagguu

SEQ ID NO: 1000147 - RNA, 22 nt, Human
ucugcucugagagggccaucag

SEQ ID NO: 1000148 - RNA, 22 nt, Human
cuggcugugcugacugagaggg

SEQ ID NO: 1000149 - RNA, 22 nt, Human
uuacaguaaucgaguguugugg

SEQ ID NO: 1000150 - RNA, 22 nt, Human
guguguggggccuucggguccu

SEQ ID NO: 1000151 - RNA, 22 nt, Human
cuuuacagauggauaauuguuu

SEQ ID NO: 1000152 - RNA, 22 nt, Human
uuuacaguauaguaggacucau

SEQ ID NO: 1000153 - RNA, 22 nt, Human
ugccauggaaguggccagaccu

SEQ ID NO: 1000154 - RNA, 22 nt, Human
cucucuguauguguauauuuau

SEQ ID NO: 1000155 - RNA, 19 nt, Human
gcugugugaccuugggcaa

SEQ ID NO: 1000156 - RNA, 22 nt, Human
cugucccagauguucucagcac

SEQ ID NO: 1000157 - RNA, 22 nt, Human
ucugcgugaauuugcauugugg

SEQ ID NO: 1000158 - RNA, 22 nt, Human
ucuaugugcccuuugugugaug

SEQ ID NO: 1000159 - RNA, 22 nt, Human
cucugcucaccagccaugugau

SEQ ID NO: 1000160 - RNA, 17 nt, Human
ggcugcugugcuggugc

SEQ ID NO: 1000161 - RNA, 22 nt, Human
ugccugugucacagugauguuu

SEQ ID NO: 1000162 - RNA, 22 nt, Human
guuuuuaucuaauagcaguuau

SEQ ID NO: 1000163 - RNA, 22 nt, Human
ucuuugcauggacauguguuuu

SEQ ID NO: 1000164 - RNA, 22 nt, Human
aauuucucaauuguuacaggug

SEQ ID NO: 1000165 - RNA, 22 nt, Human
aguuucucuuaaucuaguaucu

SEQ ID NO: 1000166 - RNA, 22 nt, Human
aggcugugggaguugagagucu

SEQ ID NO: 1000167 - RNA, 23 nt, Human
acagcugcaccuggccgccuggc

SEQ ID NO: 1000168 - RNA, 18 nt, Human
uuaaguuuuacugcuuua

SEQ ID NO: 1000169 - RNA, 22 nt, Human
uucugugucuucuuguucugug

SEQ ID NO: 1000170 - RNA, 22 nt, Human
uguauauucugccuaaaagcuu

SEQ ID NO: 1000171 - RNA, 22 nt, Human
ucuucacauucacguaacauag

SEQ ID NO: 1000172 - RNA, 22 nt, Human
gaugugugcuuuucgcaguguc

SEQ ID NO: 1000173 - RNA, 22 nt, Human
gguguguagcauguuuaagacc

SEQ ID NO: 1000174 - RNA, 22 nt, Human
aaacuuuugguccucauggguu

SEQ ID NO: 1000175 - RNA, 22 nt, Human
ucuccucugugccacagcuugg

SEQ ID NO: 1000176 - RNA, 19 nt, Human
uaugugugcauuugugcau

SEQ ID NO: 1000177 - RNA, 22 nt, Human
ccucucuuuccuacaccuugga

SEQ ID NO: 1000178 - RNA, 22 nt, Human
ucuuugugccaugcagugaggc

SEQ ID NO: 1000179 - RNA, 22 nt, Human
aggcaguuguagagagggcucu

SEQ ID NO: 1000180 - RNA, 22 nt, Human
acuaguauucuuggucuuguau

SEQ ID NO: 1000181 - RNA, 22 nt, Human
gugcccaggggccagcugccgg

SEQ ID NO: 1000182 - RNA, 22 nt, Human
augugugugcauuucucucccu

SEQ ID NO: 1000183 - RNA, 22 nt, Human
aggcugugacagggucauggag

SEQ ID NO: 1000184 - RNA, 22 nt, Human
gcagcugcaagcacuucuggca

SEQ ID NO: 1000185 - RNA, 22 nt, Human
auguggcuuuucuaacccuucc

SEQ ID NO: 1000186 - RNA, 22 nt, Human
gcucugugaccuuaggcaaguu

SEQ ID NO: 1000187 - RNA, 22 nt, Human
uuuacgagugcuaaugauauug

SEQ ID NO: 1000188 - RNA, 22 nt, Human
uugacuuuaaagcuuugucucu

SEQ ID NO: 1000189 - RNA, 22 nt, Human
ucuuuucuggacucugcaugga

SEQ ID NO: 1000190 - RNA, 22 nt, Human
ucuuugcaggccaaauuguuaa

SEQ ID NO: 1000191 - RNA, 22 nt, Human
gcucuguguaaauguagggucc

SEQ ID NO: 1000192 - RNA, 22 nt, Human
gauauuuuuaggugaugcaggc

SEQ ID NO: 1000193 - RNA, 22 nt, Human
gcagcccaggucucucucacuc

SEQ ID NO: 1000194 - RNA, 22 nt, Human
cuguggcugaacucugaagagg

SEQ ID NO: 1000195 - RNA, 22 nt, Human
uacauauagacaguuacucuag

SEQ ID NO: 1000196 - RNA, 22 nt, Human
ccugaggacacacgcugcagga

SEQ ID NO: 1000197 - RNA, 22 nt, Human
ccucucuuggccgcagucuucu

SEQ ID NO: 1000198 - RNA, 18 nt, Human
gcugugugcaccugauaa

SEQ ID NO: 1000199 - RNA, 22 nt, Human
uacagcauugcauuuuccuuug

SEQ ID NO: 1000200 - RNA, 22 nt, Human
cugugugcauaguugugcucaa

SEQ ID NO: 1000201 - RNA, 22 nt, Human
uuuacagucuauguugaauuaa

SEQ ID NO: 1000202 - RNA, 22 nt, Human
uuaacugugacaguuucucaga

SEQ ID NO: 1000203 - RNA, 22 nt, Human
uuuacagucucuauagucaaaa

SEQ ID NO: 1000204 - RNA, 22 nt, Human
uaggaagcugagcagcauuccu

SEQ ID NO: 1000205 - RNA, 22 nt, Human
aggcuguguggucaugguggcu

SEQ ID NO: 1000206 - RNA, 22 nt, Human
uauguuucuuccuuuucauaca

SEQ ID NO: 1000207 - RNA, 22 nt, Human
ugguugugcugaguuuagugca

SEQ ID NO: 1000208 - RNA, 22 nt, Human
gcuguguaggauccuguuguau

SEQ ID NO: 1000209 - RNA, 22 nt, Human
uuucaucuuauuugucuacauc

SEQ ID NO: 1000210 - RNA, 22 nt, Human
acuuuuuaguuuccucaaacau

SEQ ID NO: 1000211 - RNA, 22 nt, Human
cuggcugugugcccccggcacc

SEQ ID NO: 1000212 - RNA, 22 nt, Human
aaacuuuucuuggggaccugcc

SEQ ID NO: 1000213 - RNA, 22 nt, Human
uuucacucagcucucauugucu

SEQ ID NO: 1000214 - RNA, 22 nt, Human
gaagggugugauuugccugaga

SEQ ID NO: 1000215 - RNA, 22 nt, Human
ccugucugcaugaucccugcca

SEQ ID NO: 1000216 - RNA, 20 nt, Human
ucuguagucuguggcaagac

SEQ ID NO: 1000217 - RNA, 20 nt, Human
uucuucucuaguuaucuuca

SEQ ID NO: 1000218 - RNA, 22 nt, Human
guguaugcagaaacaugcaaag

SEQ ID NO: 1000219 - RNA, 22 nt, Human
gugucaugcacacucaguguug

SEQ ID NO: 1000220 - RNA, 22 nt, Human
uauuuuacagacuacuuuagau

SEQ ID NO: 1000221 - RNA, 22 nt, Human
gcugugagcugccugugucaca

SEQ ID NO: 1000222 - RNA, 22 nt, Human
cucuuuaaaguaaaauuugucu

SEQ ID NO: 1000223 - RNA, 22 nt, Human
auauuuguaaaauucugugucu

SEQ ID NO: 1000224 - RNA, 22 nt, Human
uucugucucuguguuuacauua

SEQ ID NO: 1000225 - RNA, 21 nt, Human
caguuauucuugaugugugug

SEQ ID NO: 1000226 - RNA, 22 nt, Human
uuacagauggcaguuucuugag

SEQ ID NO: 1000227 - RNA, 22 nt, Human
auuguucuguagugacauguag

SEQ ID NO: 1000228 - RNA, 22 nt, Human
acauauaugugcacaugugcag

SEQ ID NO: 1000229 - RNA, 22 nt, Human
gcugauguuuaguugauguuac

SEQ ID NO: 1000230 - RNA, 22 nt, Human
ucucuuuagugcuuagacgucu

SEQ ID NO: 1000231 - RNA, 22 nt, Human
gcucucuugacagcuugcuguu

SEQ ID NO: 1000232 - RNA, 22 nt, Human
gucucucucccaagauuggcua

SEQ ID NO: 1000233 - RNA, 20 nt, Human
ucuuugugucagauggacag

SEQ ID NO: 1000234 - RNA, 22 nt, Human
uuauuuauucauucugucuguc

SEQ ID NO: 1000235 - RNA, 20 nt, Human
cuuucucuaauuuauaagua

SEQ ID NO: 1000236 - RNA, 19 nt, Human
aguguguacugaaagcacu

SEQ ID NO: 1000237 - RNA, 22 nt, Human
agucuauuuccccuucucuuga

SEQ ID NO: 1000238 - RNA, 19 nt, Human
aguguauuuuuuucuguag

SEQ ID NO: 1000239 - RNA, 22 nt, Human
guggccugggguuuguucugag

SEQ ID NO: 1000240 - RNA, 22 nt, Human
ucugagugaguguaggccugac

SEQ ID NO: 1000241 - RNA, 22 nt, Human
gggcugugugcaguacgggucc

SEQ ID NO: 1000242 - RNA, 22 nt, Human
uguguauaagugagaaugcugu

SEQ ID NO: 1000243 - RNA, 16 nt, Human
uggagguguuucuagu

SEQ ID NO: 1000244 - RNA, 22 nt, Human
cugguguggcggcgcccuguag

SEQ ID NO: 1000245 - RNA, 22 nt, Human
cagccacuggugccaggcuguu

SEQ ID NO: 1000246 - RNA, 22 nt, Human
guuuggcucugggugccugugc

SEQ ID NO: 1000247 - RNA, 22 nt, Human
uuuucuuggaguggcuguccuu

SEQ ID NO: 1000248 - RNA, 22 nt, Human
cacugugucuggagugagcugg

SEQ ID NO: 1000249 - RNA, 22 nt, Human
cuguggcucugcagucccaaca

SEQ ID NO: 1000250 - RNA, 22 nt, Human
cuucugugcaauuguggaggag

SEQ ID NO: 1000251 - RNA, 22 nt, Human
uguguggcguugcguggcuagg

SEQ ID NO: 1000252 - RNA, 16 nt, Human
caguuuuaaggcccaa

SEQ ID NO: 1000253 - RNA, 22 nt, Human
uuacaguuagaaucugaugaaa

SEQ ID NO: 1000254 - RNA, 22 nt, Human
agcuguguagggaaucagagaa

SEQ ID NO: 1000255 - RNA, 22 nt, Human
caguauuuuuaagcugcuuugu

SEQ ID NO: 1000256 - RNA, 22 nt, Human
cugugugucauuugucaauccu

SEQ ID NO: 1000257 - RNA, 22 nt, Human
auguggcuuuuccuggguuccu

SEQ ID NO: 1000258 - RNA, 22 nt, Human
uacuuucuuucugauccuuaug

SEQ ID NO: 1000259 - RNA, 22 nt, Human
uauacaguuaaguuucuucagu

SEQ ID NO: 1000260 - RNA, 22 nt, Human
cugugccugccuuguucacuga

SEQ ID NO: 1000261 - RNA, 21 nt, Human
uguggcugacacccuuuggga

SEQ ID NO: 1000262 - RNA, 22 nt, Human
ugugucugaacaugcuuuguaa

SEQ ID NO: 1000263 - RNA, 22 nt, Human
uuuagaguaaaaacugugaccu

SEQ ID NO: 1000264 - RNA, 22 nt, Human
uuuacaguaagguggaugguac

SEQ ID NO: 1000265 - RNA, 22 nt, Human
auuuacucgugucuccagugcu

SEQ ID NO: 1000266 - RNA, 22 nt, Human
accuuuuuguucuguucucagc

SEQ ID NO: 1000267 - RNA, 22 nt, Human
gugcucuccuggcugcccugac

SEQ ID NO: 1000268 - RNA, 22 nt, Human
uucucuccuacccaguauccau

SEQ ID NO: 1000269 - RNA, 22 nt, Human
cuguggcuucuagguccccgau

SEQ ID NO: 1000270 - RNA, 22 nt, Human
cuguggcucaauugccuacuga

SEQ ID NO: 1000271 - RNA, 22 nt, Human
cuuugcagcaauuucuguuaaa

SEQ ID NO: 1000272 - RNA, 22 nt, Human
uauguuucauucuuuucuggua

SEQ ID NO: 1000273 - RNA, 22 nt, Human
gugcugugcgcuuuuucuguau

SEQ ID NO: 1000274 - RNA, 22 nt, Human
uaugcuguauucuguauguuag

SEQ ID NO: 1000275 - RNA, 22 nt, Human
guauaguuugcgauuugugguu

SEQ ID NO: 1000276 - RNA, 19 nt, Human
cugugagucuuguggccuc

SEQ ID NO: 1000277 - RNA, 22 nt, Human
uucuacagacuauaacugugau

SEQ ID NO: 1000278 - RNA, 22 nt, Human
ccugugugguagccagcggugc

SEQ ID NO: 1000279 - RNA, 22 nt, Human
aguuuucuuucaucuaucagca

SEQ ID NO: 1000280 - RNA, 22 nt, Human
uuacaguccuuuguauuguuua

SEQ ID NO: 1000281 - RNA, 21 nt, Human
uucacaguggauaacuuucug

SEQ ID NO: 1000282 - RNA, 19 nt, Human
ugaguguguguuucucuaa

SEQ ID NO: 1000283 - RNA, 22 nt, Human
auuacaguaggauuggaaagga

SEQ ID NO: 1000284 - RNA, 22 nt, Human
uuugcagugucagcuucugugu

SEQ ID NO: 1000285 - RNA, 22 nt, Human
cagcucccaguggcagcuccuu

SEQ ID NO: 1000286 - RNA, 22 nt, Human
acugugugggccgcucacuggg

SEQ ID NO: 1000287 - RNA, 22 nt, Human
gcauguguugguuuaugcaugu

SEQ ID NO: 1000288 - RNA, 22 nt, Human
uacagucaacauugaugaugau

SEQ ID NO: 1000289 - RNA, 22 nt, Human
ugccuguggaaaggcuggugcu

SEQ ID NO: 1000290 - RNA, 22 nt, Human
uccucuuuaaaugcuuuuaucu

SEQ ID NO: 1000291 - RNA, 22 nt, Human
caguaauagauuugagaguggu

SEQ ID NO: 1000292 - RNA, 22 nt, Human
acuuguuucaacuguacucuca

SEQ ID NO: 1000293 - RNA, 22 nt, Human
guuuguguaacaugaugaugau

SEQ ID NO: 1000294 - RNA, 22 nt, Human
ggcugugauugguggaugugaa

SEQ ID NO: 1000295 - RNA, 22 nt, Human
ugugugcacaggaguguuugaa

SEQ ID NO: 1000296 - RNA, 23 nt, Human
uacagcugcagaaucaggcuaag

SEQ ID NO: 1000297 - RNA, 22 nt, Human
cuucucucccuggcacucagac

SEQ ID NO: 1000298 - RNA, 22 nt, Human
cauuauauuuuacugcauggga

SEQ ID NO: 1000299 - RNA, 18 nt, Human
gggcugugagaugggaag

SEQ ID NO: 1000300 - RNA, 21 nt, Human
gcccccuggacuccucaucca

SEQ ID NO: 1000301 - RNA, 22 nt, Human
acucuuuuauaaagcaucuuga

SEQ ID NO: 1000302 - RNA, 22 nt, Human
gcuguguaucagaugccacggg

SEQ ID NO: 1000303 - RNA, 22 nt, Human
uucaacuuuggagauuuaauaa

SEQ ID NO: 1000304 - RNA, 22 nt, Human
aacuguuucagaaauauuguug

SEQ ID NO: 1000305 - RNA, 22 nt, Human
acagaauaagguuuaucucucc

SEQ ID NO: 1000306 - RNA, 22 nt, Human
acuuucuuggucccauguuuga

SEQ ID NO: 1000307 - RNA, 22 nt, Human
uuuuuuauagcaaugaacccac

SEQ ID NO: 1000308 - RNA, 22 nt, Human
uuugcucuuaugaacaaggugg

SEQ ID NO: 1000309 - RNA, 22 nt, Human
uuuuauugggaguccucuacug

SEQ ID NO: 1000310 - RNA, 22 nt, Human
ucauuacagagauauaaucuac

SEQ ID NO: 1000311 - RNA, 22 nt, Human
uucucuacuugagauuuuaaug

SEQ ID NO: 1000312 - RNA, 22 nt, Human
uuguaacuguggguugauuaga

SEQ ID NO: 1000313 - RNA, 18 nt, Human
gguggcuggggacggaca

SEQ ID NO: 1000314 - RNA, 22 nt, Human
uuugucugccuugcuggacugu

SEQ ID NO: 1000315 - RNA, 22 nt, Human
uacagugacuggacuuugucau

SEQ ID NO: 1000316 - RNA, 22 nt, Human
uuucucugugggcuuuaugcau

SEQ ID NO: 1000317 - RNA, 22 nt, Human
cugcugugggcaggguagcugg

SEQ ID NO: 1000318 - RNA, 22 nt, Human
aacaguuuggguagguauguag

SEQ ID NO: 1000319 - RNA, 22 nt, Human
ucaguauaauugcuggcacuga

SEQ ID NO: 1000320 - RNA, 22 nt, Human
aagcugccugccacgcuagaua

SEQ ID NO: 1000321 - RNA, 22 nt, Human
uggcugcuuguuuuagugaggc

SEQ ID NO: 1000322 - RNA, 22 nt, Human
gcugugaguggaguucugugcu

SEQ ID NO: 1000323 - RNA, 22 nt, Human
uguguguagaaagggcccuggu

SEQ ID NO: 1000324 - RNA, 22 nt, Human
uacagugaaugaauggcugugc

SEQ ID NO: 1000325 - RNA, 22 nt, Human
auuuucaucauggguuuaacau

SEQ ID NO: 1000326 - RNA, 22 nt, Human
gugugagccaugauguguccag

SEQ ID NO: 1000327 - RNA, 17 nt, Human
uuccucucacauuuuuu

SEQ ID NO: 1000328 - RNA, 22 nt, Human
aguguguacauaauuguacgcc

SEQ ID NO: 1000329 - RNA, 22 nt, Human
ggcuguguuccaagugucagga

SEQ ID NO: 1000330 - RNA, 22 nt, Human
uucucuauguguguuguaguuu

SEQ ID NO: 1000331 - RNA, 22 nt, Human
cucuguuuuucaauaguucuug

SEQ ID NO: 1000332 - RNA, 22 nt, Human
uguauguguggauagauguaua

SEQ ID NO: 1000333 - RNA, 22 nt, Human
auuuacagguagaauuuuaagu

SEQ ID NO: 1000334 - RNA, 22 nt, Human
uuucucuguucucuaacuguaa

SEQ ID NO: 1000335 - RNA, 22 nt, Human
gcuguguggcaaagggauuaca

SEQ ID NO: 1000336 - RNA, 22 nt, Human
uaacaguagccuuauguggucu

SEQ ID NO: 1000337 - RNA, 22 nt, Human
ugcccagcacccagcaugaugc

SEQ ID NO: 1000338 - RNA, 22 nt, Human
auguggcuaguggacacaguau

SEQ ID NO: 1000339 - RNA, 21 nt, Human
uucaguaugcgucaugcuguu

SEQ ID NO: 1000340 - RNA, 20 nt, Human
cucucucuccauucccaggg

SEQ ID NO: 1000341 - RNA, 22 nt, Human
uggccuggaaaaaugcagaugg

SEQ ID NO: 1000342 - RNA, 22 nt, Human
cugggguggaggagcuccccug

SEQ ID NO: 1000343 - RNA, 18 nt, Human
guguggcugagaugaggc

SEQ ID NO: 1000344 - RNA, 22 nt, Human
uacuuuucaagcagcugguuau

SEQ ID NO: 1000345 - RNA, 22 nt, Human
cuguggcucucugcaggguccc

SEQ ID NO: 1000346 - RNA, 22 nt, Human
auguguguguauauacacacau

SEQ ID NO: 1000347 - RNA, 22 nt, Human
ucuuuagaaacuuuucuucaug

SEQ ID NO: 1000348 - RNA, 22 nt, Human
guguggguguacuguucuagau

SEQ ID NO: 1000349 - RNA, 23 nt, Human
cucucucuaccaugugaggacac

SEQ ID NO: 1000350 - RNA, 22 nt, Human
aaaguauauuuacuuacuguga

SEQ ID NO: 1000351 - RNA, 22 nt, Human
ggcagccaugugggcagcgagu

SEQ ID NO: 1000352 - RNA, 22 nt, Human
guuuucucaggaugguguguac

SEQ ID NO: 1000353 - RNA, 22 nt, Human
ccugcucugccaaguccucuuu

SEQ ID NO: 1000354 - RNA, 22 nt, Human
augugugguuuguaaaugauuu

SEQ ID NO: 1000355 - RNA, 22 nt, Human
cuggagggauguaggguguauu

SEQ ID NO: 1000356 - RNA, 19 nt, Human
uggcuguggggaaaugcuu

SEQ ID NO: 1000357 - RNA, 22 nt, Human
cuuuacaaagcaauuuugucuc

SEQ ID NO: 1000358 - RNA, 22 nt, Human
cuguggcuaggauuauuccuga

SEQ ID NO: 1000359 - RNA, 22 nt, Human
uggcucugcgucuguucguggg

SEQ ID NO: 1000360 - RNA, 22 nt, Human
uggccugggccugccggugcaa

SEQ ID NO: 1000361 - RNA, 20 nt, Human
uuauguguaccugugcuccc

SEQ ID NO: 1000362 - RNA, 22 nt, Human
uuacagcacagugcuuuuacug

SEQ ID NO: 1000363 - RNA, 22 nt, Human
caguuuuacccaagcuuauuuu

SEQ ID NO: 1000364 - RNA, 22 nt, Human
guauuuucaagagcaguaguau

SEQ ID NO: 1000365 - RNA, 22 nt, Human
uuacaguaccuguauggccacu

SEQ ID NO: 1000366 - RNA, 22 nt, Human
uugacaguugcaauggugaucu

SEQ ID NO: 1000367 - RNA, 22 nt, Human
caucugugccggguguuuguca

SEQ ID NO: 1000368 - RNA, 22 nt, Human
uuucacagcagugugcugcuuu

SEQ ID NO: 1000369 - RNA, 22 nt, Human
ucugcugucuuuucugggugag

SEQ ID NO: 1000370 - RNA, 22 nt, Human
cuggcugucuuggaggaaggag

SEQ ID NO: 1000371 - RNA, 22 nt, Human
uguauuuugaguccaaucuccu

SEQ ID NO: 1000372 - RNA, 22 nt, Human
cagggguguuuuuggccaggag

SEQ ID NO: 1000373 - RNA, 22 nt, Human
uacaaguagcucagguuuucug

SEQ ID NO: 1000374 - RNA, 22 nt, Human
uggcuguggacucagauggcuc

SEQ ID NO: 1000375 - RNA, 22 nt, Human
uacaguguauguauuuguaggu

SEQ ID NO: 1000376 - RNA, 22 nt, Human
uacugugucuuaggauguggaa

SEQ ID NO: 1000377 - RNA, 22 nt, Human
auucucuggucauugaguauaa

SEQ ID NO: 1000378 - RNA, 22 nt, Human
auauucucugcugcuuuugugu

SEQ ID NO: 1000379 - RNA, 20 nt, Human
auucucugcucaaguggcac

SEQ ID NO: 1000380 - RNA, 22 nt, Human
aguguggcugcguagggcucuc

SEQ ID NO: 1000381 - RNA, 22 nt, Human
cucucuguuaugcuuucaugaa

SEQ ID NO: 1000382 - RNA, 22 nt, Human
ucugccgugcgaggucccacca

SEQ ID NO: 1000383 - RNA, 22 nt, Human
uuucucaucuggaaacagugcu

SEQ ID NO: 1000384 - RNA, 20 nt, Human
gcuguggcaaagcuuugugu

SEQ ID NO: 1000385 - RNA, 22 nt, Human
gcugucugcugugcacugagca

SEQ ID NO: 1000386 - RNA, 22 nt, Human
auauuauucuagcucuugugug

SEQ ID NO: 1000387 - RNA, 22 nt, Human
uaguauauuuuguugcaauuca

SEQ ID NO: 1000388 - RNA, 22 nt, Human
guggaggguuugcaaugugcag

SEQ ID NO: 1000389 - RNA, 22 nt, Human
uauguguauugagcauuguuac

SEQ ID NO: 1000390 - RNA, 22 nt, Human
ugagcugucugaauggugagga

SEQ ID NO: 1000391 - RNA, 22 nt, Human
ggcuguagguuggugcuggaca

SEQ ID NO: 1000392 - RNA, 22 nt, Human
gaauauuuguaauuacuguuga

SEQ ID NO: 1000393 - RNA, 22 nt, Human
augugugugaugggcgccgcca

SEQ ID NO: 1000394 - RNA, 22 nt, Human
cucuuuucaaaauuucacugca

SEQ ID NO: 1000395 - RNA, 22 nt, Human
ucucaucucggaucagaaguga

SEQ ID NO: 1000396 - RNA, 22 nt, Human
cucuuugccuaacuguuuucaa

SEQ ID NO: 1000397 - RNA, 22 nt, Human
uacagugauuucuacugguguu

SEQ ID NO: 1000398 - RNA, 22 nt, Human
ugugugauuccacuuauauggg

SEQ ID NO: 1000399 - RNA, 22 nt, Human
uuuuauguaauaaacuguacac

SEQ ID NO: 1000400 - RNA, 22 nt, Human
gcuuuacagagaaaguuugccu

SEQ ID NO: 1000401 - RNA, 22 nt, Human
uaauuuuccacucuguuuaucu

SEQ ID NO: 1000402 - RNA, 22 nt, Human
ugcccagcaauaaaccagaaga

SEQ ID NO: 1000403 - RNA, 22 nt, Human
acaguaaagccuucugguugac

SEQ ID NO: 1000404 - RNA, 22 nt, Human
ucuguguuuaaaagauaugucc

SEQ ID NO: 1000405 - RNA, 22 nt, Human
uggcugugugccaggcugucug

SEQ ID NO: 1000406 - RNA, 22 nt, Human
uucugugugcugucuuggcuuu

SEQ ID NO: 1000407 - RNA, 22 nt, Human
uguguggguacagaugauuguu

SEQ ID NO: 1000408 - RNA, 22 nt, Human
uauuuccuguggauacuuuuag

SEQ ID NO: 1000409 - RNA, 22 nt, Human
auaucuucuuuauuuugugagg

SEQ ID NO: 1000410 - RNA, 22 nt, Human
guaguauuuucugugauguagg

SEQ ID NO: 1000411 - RNA, 22 nt, Human
acuuuucugcagaugaucucuu

SEQ ID NO: 1000412 - RNA, 22 nt, Human
uacuuucuuguuccuuucauaa

SEQ ID NO: 1000413 - RNA, 22 nt, Human
ucuuuacauaguguggacuacu

SEQ ID NO: 1000414 - RNA, 22 nt, Human
uaacguuugauaacuucuguuc

SEQ ID NO: 1000415 - RNA, 22 nt, Human
acaguauaaacuccuaaaagcc

SEQ ID NO: 1000416 - RNA, 22 nt, Human
uggcauguggcaauguugggau

SEQ ID NO: 1000417 - RNA, 22 nt, Human
acuuuucucccuccugccuuca

SEQ ID NO: 1000418 - RNA, 21 nt, Human
uggcugagccaggugugugga

SEQ ID NO: 1000419 - RNA, 22 nt, Human
aguggcuguaucagucaacccu

SEQ ID NO: 1000420 - RNA, 22 nt, Human
uguucucucuccuuuugaagug

SEQ ID NO: 1000421 - RNA, 22 nt, Human
cuguggcuggccugucugacau

SEQ ID NO: 1000422 - RNA, 22 nt, Human
ugacaggaugaugagcaggggg

SEQ ID NO: 1000423 - RNA, 22 nt, Human
gaguauaugacuuucuuuugca

SEQ ID NO: 1000424 - RNA, 22 nt, Human
uacagguagcaaaaccuuuccu

SEQ ID NO: 1000425 - RNA, 22 nt, Human
auuacaguagcaaaagaccgga

SEQ ID NO: 1000426 - RNA, 22 nt, Human
aguggcuggucuaaggucacag

SEQ ID NO: 1000427 - RNA, 22 nt, Human
uacuuuuugucucuuugaaugu

SEQ ID NO: 1000428 - RNA, 22 nt, Human
acagucauagcagccuuuguua

SEQ ID NO: 1000429 - RNA, 22 nt, Human
ucugugguggagugggcaugag

SEQ ID NO: 1000430 - RNA, 22 nt, Human
cuguggcuuugugucuauugua

SEQ ID NO: 1000431 - RNA, 22 nt, Human
gcugcccugcaucugugccuuc

SEQ ID NO: 1000432 - RNA, 22 nt, Human
gaagucugcugcucaggaguuu

SEQ ID NO: 1000433 - RNA, 22 nt, Human
cucuguuucucagccuauuucc

SEQ ID NO: 1000434 - RNA, 22 nt, Human
uacuuuucuguguggcagucac

SEQ ID NO: 1000435 - RNA, 22 nt, Human
cuuuuuacaaagccugucuucu

SEQ ID NO: 1000436 - RNA, 22 nt, Human
uuacagugacaguugcuaugau

SEQ ID NO: 1000437 - RNA, 22 nt, Human
auguuucuaaaacuugcauggc

SEQ ID NO: 1000438 - RNA, 22 nt, Human
ugcuguguuacugagauccggc

SEQ ID NO: 1000439 - RNA, 22 nt, Human
gagcugugccaaucugucuggg

SEQ ID NO: 1000440 - RNA, 22 nt, Human
ucuggcuggcagugauggugug

SEQ ID NO: 1000441 - RNA, 22 nt, Human
uggcucugcagcagugugcgug

SEQ ID NO: 1000442 - RNA, 22 nt, Human
gguggcugcuuccucaagagga

SEQ ID NO: 1000443 - RNA, 22 nt, Human
uguguggccuccauaggguacu

SEQ ID NO: 1000444 - RNA, 22 nt, Human
caugugugagugagcagucuuc

SEQ ID NO: 1000445 - RNA, 17 nt, Human
gugccuguuguccugga

SEQ ID NO: 1000446 - RNA, 22 nt, Human
auguguguacacacgugacucu

SEQ ID NO: 1000447 - RNA, 22 nt, Human
aacaguuugagcuuugaauuuc

SEQ ID NO: 1000448 - RNA, 22 nt, Human
ugugugagacaauuggcugugg

SEQ ID NO: 1000449 - RNA, 22 nt, Human
acuuuuugcuggucucuuccau

SEQ ID NO: 1000450 - RNA, 22 nt, Human
ccugcccagagccccuuucacu

SEQ ID NO: 1000451 - RNA, 22 nt, Human
auguuucuguccuacgagauaa

SEQ ID NO: 1000452 - RNA, 17 nt, Human
uuguguguaguucugau

SEQ ID NO: 1000453 - RNA, 22 nt, Human
ggcagugugcaucuguguggcc

SEQ ID NO: 1000454 - RNA, 22 nt, Human
ucugcuuuagaauccaguagcu

SEQ ID NO: 1000455 - RNA, 22 nt, Human
auauuuucuggaacuaugccug

SEQ ID NO: 1000456 - RNA, 22 nt, Human
guguaugcuuagccagagauuu

SEQ ID NO: 1000457 - RNA, 22 nt, Human
uuuucugccugcguguuuagga

SEQ ID NO: 1000458 - RNA, 22 nt, Human
aucuuuucuguuugcuaugucu

SEQ ID NO: 1000459 - RNA, 22 nt, Human
auguggcugguaguugacaacu

SEQ ID NO: 1000460 - RNA, 22 nt, Human
gaguguguucuuuaugcuguga

SEQ ID NO: 1000461 - RNA, 22 nt, Human
guaucuuugucuucauguugga

SEQ ID NO: 1000462 - RNA, 22 nt, Human
cucuguguuaaauuggguuuuu

SEQ ID NO: 1000463 - RNA, 19 nt, Human
uuuagcuuacguuucauug

SEQ ID NO: 1000464 - RNA, 22 nt, Human
uauguucuaaccuugucuuucc

SEQ ID NO: 1000465 - RNA, 22 nt, Human
gauauuuucagucuccuuucaa

SEQ ID NO: 1000466 - RNA, 22 nt, Human
ugccgcugucgccaccauggcu

SEQ ID NO: 1000467 - RNA, 22 nt, Human
acuuuacagaugguuuccugac

SEQ ID NO: 1000468 - RNA, 22 nt, Human
auguguauacuugugcuuacuc

SEQ ID NO: 1000469 - RNA, 22 nt, Human
aaguauauacuaaauguuaauc

SEQ ID NO: 1000470 - RNA, 18 nt, Human
ggccagccccaggccagc

SEQ ID NO: 1000471 - RNA, 20 nt, Human
uucuuuacgaccuuucugca

SEQ ID NO: 1000472 - RNA, 22 nt, Human
ugugugucagucuuguuuaggg

SEQ ID NO: 1000473 - RNA, 22 nt, Human
ugugucugcccuuaguacaucu

SEQ ID NO: 1000474 - RNA, 22 nt, Human
gugcuguaacaacagagugucu

SEQ ID NO: 1000475 - RNA, 22 nt, Human
auguggcucauuguuugcuuac

SEQ ID NO: 1000476 - RNA, 22 nt, Human
uuuauucuaacuugcugcucua

SEQ ID NO: 1000477 - RNA, 22 nt, Human
uuucuacuaagaaaguugauua

SEQ ID NO: 1000478 - RNA, 22 nt, Human
aacuguuuuucacgugucucau

SEQ ID NO: 1000479 - RNA, 22 nt, Human
gcuuuacagggcacaaagggag

SEQ ID NO: 1000480 - RNA, 22 nt, Human
cuggcucuuuccuagcuaggcu

SEQ ID NO: 1000481 - RNA, 22 nt, Human
auguguauuacccuuucauucc

SEQ ID NO: 1000482 - RNA, 22 nt, Human
uugacuuuauguguauguuuac

SEQ ID NO: 1000483 - RNA, 22 nt, Human
cuuucaguuaguaccuaguggc

SEQ ID NO: 1000484 - RNA, 22 nt, Human
uggccguguuagauguuuggcu

SEQ ID NO: 1000485 - RNA, 22 nt, Human
aguguguaauucagugcccagc

SEQ ID NO: 1000486 - RNA, 22 nt, Human
ucuaacuuagggaauacuuuag

SEQ ID NO: 1000487 - RNA, 22 nt, Human
ucuuugcaaauguuauuaucuu

SEQ ID NO: 1000488 - RNA, 18 nt, Human
auguuucucuuggcucug

SEQ ID NO: 1000489 - RNA, 22 nt, Human
auguguaugcaugcacuaagau

SEQ ID NO: 1000490 - RNA, 22 nt, Human
uauugucuucaacucuacuuuu

SEQ ID NO: 1000491 - RNA, 22 nt, Human
gcugaggauauagcaggaacaa

SEQ ID NO: 1000492 - RNA, 22 nt, Human
ucuacuuucacucauacuuauu

SEQ ID NO: 1000493 - RNA, 19 nt, Human
uguguggguuuagaguagu

SEQ ID NO: 1000494 - RNA, 22 nt, Human
uucucucauucaaauuaaagug

SEQ ID NO: 1000495 - RNA, 22 nt, Human
uuccucuccucccaccagguga

SEQ ID NO: 1000496 - RNA, 19 nt, Human
uaucuuuaugcaguggugg

SEQ ID NO: 1000497 - RNA, 22 nt, Human
guguggcugaaaucaaggcagg

SEQ ID NO: 1000498 - RNA, 22 nt, Human
cacaguaucuuuugaguaagca

SEQ ID NO: 1000499 - RNA, 22 nt, Human
ggagggguggucaccuggcagg

SEQ ID NO: 1000500 - RNA, 22 nt, Human
aaguauauuuuuugaagcauau

SEQ ID NO: 1000501 - RNA, 22 nt, Human
uuuaucugcuaucugcugugcu

SEQ ID NO: 1000502 - RNA, 22 nt, Human
auuacaguucuacacauccuuu

SEQ ID NO: 1000503 - RNA, 22 nt, Human
ggccuggagcagagacuaggga

SEQ ID NO: 1000504 - RNA, 22 nt, Human
uucugcugagugggcaggugca

SEQ ID NO: 1000505 - RNA, 22 nt, Human
ggugugccacuucacugagcag

SEQ ID NO: 1000506 - RNA, 23 nt, Human
ugugcgugaugcuuuguugaagg

SEQ ID NO: 1000507 - RNA, 22 nt, Human
ucuuuccaaguaauacuuccca

SEQ ID NO: 1000508 - RNA, 22 nt, Human
gcucucugaggugcuggcagag

SEQ ID NO: 1000509 - RNA, 22 nt, Human
uggcauguuugcuugugcauau

SEQ ID NO: 1000510 - RNA, 22 nt, Human
ucucucuucaacccuuaacuag

SEQ ID NO: 1000511 - RNA, 22 nt, Human
uuuauuguugggucuuaagcug

SEQ ID NO: 1000512 - RNA, 22 nt, Human
uuuucucuuguuaauguacuga

SEQ ID NO: 1000513 - RNA, 22 nt, Human
gcguguaugcaggucugugcag

SEQ ID NO: 1000514 - RNA, 22 nt, Human
acguguguuggucagggggccc

SEQ ID NO: 1000515 - RNA, 22 nt, Human
uguaugcagggcuuguaugcag

SEQ ID NO: 1000516 - RNA, 20 nt, Human
cagggacagcaguggguuuu

SEQ ID NO: 1000517 - RNA, 22 nt, Human
gaggaaaauaacaacuaagggc

SEQ ID NO: 1000518 - RNA, 22 nt, Human
aguauauugguguuauuccuca

SEQ ID NO: 1000519 - RNA, 22 nt, Human
uuucaucuauuugcuuugugaa

SEQ ID NO: 1000520 - RNA, 22 nt, Human
guguggcuugggugaggcgccu

SEQ ID NO: 1000521 - RNA, 22 nt, Human
ggccaggagcaagccaggcucu

SEQ ID NO: 1000522 - RNA, 22 nt, Human
gcugcuguuaugauguuacuuu

SEQ ID NO: 1000523 - RNA, 22 nt, Human
ugugccugaguuggcugaguac

SEQ ID NO: 1000524 - RNA, 22 nt, Human
aguggcuggacgacaaggguga

SEQ ID NO: 1000525 - RNA, 20 nt, Human
uuauuucucauucuccuacu

SEQ ID NO: 1000526 - RNA, 22 nt, Human
uauuuaucgagugucuacuaug

SEQ ID NO: 1000527 - RNA, 22 nt, Human
cuuuacagugaacuugcuuguc

SEQ ID NO: 1000528 - RNA, 21 nt, Human
uguauacacacauauauguac

SEQ ID NO: 1000529 - RNA, 22 nt, Human
aacuuuguuuuauucacugcug

SEQ ID NO: 1000530 - RNA, 19 nt, Human
ugugugcaugcgcacgugu

SEQ ID NO: 1000531 - RNA, 21 nt, Human
auuuucauuaauucagugugg

SEQ ID NO: 1000532 - RNA, 22 nt, Human
uaucucuuuauugacaauaaaa

SEQ ID NO: 1000533 - RNA, 20 nt, Human
cuguggcucaugcaucugcc

SEQ ID NO: 1000534 - RNA, 21 nt, Human
guuauuuuaagugagcuuugc

SEQ ID NO: 1000535 - RNA, 22 nt, Human
ggccuggacaccugaggucuua

SEQ ID NO: 1000536 - RNA, 22 nt, Human
uucucugccucuagcuauauuc

SEQ ID NO: 1000537 - RNA, 22 nt, Human
ucuucuuuggaugaaagaauau

SEQ ID NO: 1000538 - RNA, 22 nt, Human
acaguauacauugauuaggacc

SEQ ID NO: 1000539 - RNA, 18 nt, Human
ggcaugugagugcugagg

SEQ ID NO: 1000540 - RNA, 22 nt, Human
aggaggugcuguuuguccugga

SEQ ID NO: 1000541 - RNA, 22 nt, Human
ugugugacacauugauaugugc

SEQ ID NO: 1000542 - RNA, 22 nt, Human
aggcugugauggauguaaagga

SEQ ID NO: 1000543 - RNA, 22 nt, Human
auggcugugcagagauugggaa

SEQ ID NO: 1000544 - RNA, 22 nt, Human
uauguguggcagcugggagugu

SEQ ID NO: 1000545 - RNA, 22 nt, Human
ucuuuuuauauugacaaaaggu

SEQ ID NO: 1000546 - RNA, 22 nt, Human
uguuuacauggagguuuucagc

SEQ ID NO: 1000547 - RNA, 22 nt, Human
auuuacaggacagcuuggcauu

SEQ ID NO: 1000548 - RNA, 21 nt, Human
ucuuuccaauauucaugucuc

SEQ ID NO: 1000549 - RNA, 22 nt, Human
cuuaacuugaugucucucugcu

SEQ ID NO: 1000550 - RNA, 22 nt, Human
ucuuugcaugcauuuucccuua

SEQ ID NO: 1000551 - RNA, 22 nt, Human
aacaguuuaucaaguuuuuaca

SEQ ID NO: 1000552 - RNA, 22 nt, Human
caacuuuugacacgugugcuaa

SEQ ID NO: 1000553 - RNA, 22 nt, Human
ugucuguggcaauuguggguaa

SEQ ID NO: 1000554 - RNA, 22 nt, Human
auuuuuucccaguuagccagga

SEQ ID NO: 1000555 - RNA, 22 nt, Human
acaguagauugguaugauguca

SEQ ID NO: 1000556 - RNA, 22 nt, Human
cucucucuaugcguuguuccua

SEQ ID NO: 1000557 - RNA, 22 nt, Human
cuggcugugaaauggcaguguc

SEQ ID NO: 1000558 - RNA, 21 nt, Human
gugugucuaauguaguggaaa

SEQ ID NO: 1000559 - RNA, 22 nt, Human
uuucucugggcuguuggcagcc

SEQ ID NO: 1000560 - RNA, 22 nt, Human
gguggcugguuuuauaagaggu

SEQ ID NO: 1000561 - RNA, 18 nt, Human
uguuuauuuuucucuuac

SEQ ID NO: 1000562 - RNA, 22 nt, Human
caucucuugccaaaguuugacc

SEQ ID NO: 1000563 - RNA, 22 nt, Human
uucuguguggguagcuccuguu

SEQ ID NO: 1000564 - RNA, 19 nt, Human
agucauauuguucaucuug

SEQ ID NO: 1000565 - RNA, 22 nt, Human
ucauuuucaaguuugaacagga

SEQ ID NO: 1000566 - RNA, 22 nt, Human
ugauauuuuucacuggccucug

SEQ ID NO: 1000567 - RNA, 15 nt, Human
uguggcuggcuccug

SEQ ID NO: 1000568 - RNA, 22 nt, Human
uaggaagcuaugggagauguga

SEQ ID NO: 1000569 - RNA, 22 nt, Human
acuuguuugccuaaaauuuuga

SEQ ID NO: 1000570 - RNA, 21 nt, Human
uuucuuucuggcucucacagu

SEQ ID NO: 1000571 - RNA, 22 nt, Human
ugucuuuagccagcagucuucu

SEQ ID NO: 1000572 - RNA, 22 nt, Human
gcuggcccagugacccacagug

SEQ ID NO: 1000573 - RNA, 22 nt, Human
acuuuguucuaauaguaucucu

SEQ ID NO: 1000574 - RNA, 21 nt, Human
caguauuuuaagcagugaguu

SEQ ID NO: 1000575 - RNA, 22 nt, Human
cagccacucucagacaguccca

SEQ ID NO: 1000576 - RNA, 22 nt, Human
uucugugugcuuacugguguuc

SEQ ID NO: 1000577 - RNA, 22 nt, Human
uuucucucuacaguacuuucau

SEQ ID NO: 1000578 - RNA, 22 nt, Human
guacaguaaucccguucuucug

SEQ ID NO: 1000579 - RNA, 22 nt, Human
uuuuaugugucaaagcaguggu

SEQ ID NO: 1000580 - RNA, 19 nt, Human
ccugugugggguagagauc

SEQ ID NO: 1000581 - RNA, 18 nt, Human
auuguucugugacauguc

SEQ ID NO: 1000582 - RNA, 22 nt, Human
auauuuguauuucgugugugua

SEQ ID NO: 1000583 - RNA, 22 nt, Human
uguuuacaaggaguuuauauug

SEQ ID NO: 1000584 - RNA, 22 nt, Human
uuggcugugcagaucuugccua

SEQ ID NO: 1000585 - RNA, 22 nt, Human
gcugucgugugcaagugacaga

SEQ ID NO: 1000586 - RNA, 22 nt, Human
gcuuuacaugagaugaggacaa

SEQ ID NO: 1000587 - RNA, 22 nt, Human
uuuuuuauaucaacugaagucu

SEQ ID NO: 1000588 - RNA, 22 nt, Human
auguguauccaucugucuauuu

SEQ ID NO: 1000589 - RNA, 22 nt, Human
uuuuacagucagucaaacucag

SEQ ID NO: 1000590 - RNA, 22 nt, Human
uaugugugcuuuuuccaugcau

SEQ ID NO: 1000591 - RNA, 22 nt, Human
ugugccuguugguguagacaua

SEQ ID NO: 1000592 - RNA, 22 nt, Human
cuggcuguauuaguuugauccu

SEQ ID NO: 1000593 - RNA, 22 nt, Human
ggcugcuggauuguguaucugu

SEQ ID NO: 1000594 - RNA, 20 nt, Human
acguggccaccaguggcuua

SEQ ID NO: 1000595 - RNA, 21 nt, Human
uuagacuuggguuuuuccugg

SEQ ID NO: 1000596 - RNA, 22 nt, Human
gucaugugaauaaguguggggu

SEQ ID NO: 1000597 - RNA, 22 nt, Human
ucuccucuauuucuguauguau

SEQ ID NO: 1000598 - RNA, 19 nt, Human
ucauuuacgguuuugauga

SEQ ID NO: 1000599 - RNA, 22 nt, Human
gcuuuacauaaacauuuauuau

SEQ ID NO: 1000600 - RNA, 22 nt, Human
ucacaguacaugauucaguggu

SEQ ID NO: 1000601 - RNA, 22 nt, Human
ucugugcugagcucugagaugu

SEQ ID NO: 1000602 - RNA, 22 nt, Human
uguggguuuguaguuaaguucu

SEQ ID NO: 1000603 - RNA, 22 nt, Human
aggaagccaugguggacgucua

SEQ ID NO: 1000604 - RNA, 22 nt, Human
cucuuuaacucccauucugucc

SEQ ID NO: 1000605 - RNA, 22 nt, Human
auauuuucacugaaccaaagua

SEQ ID NO: 1000606 - RNA, 22 nt, Human
auguauguaugcugugcuugca

SEQ ID NO: 1000607 - RNA, 23 nt, Human
aguggcuggacagacuuuccugg

SEQ ID NO: 1000608 - RNA, 22 nt, Human
uuucccucucaucucuauuauu

SEQ ID NO: 1000609 - RNA, 22 nt, Human
uggcucuguugagguauggauu

SEQ ID NO: 1000610 - RNA, 22 nt, Human
uauguguauaucuguaugugca

SEQ ID NO: 1000611 - RNA, 22 nt, Human
augcauguaacaguguuaugaa

SEQ ID NO: 1000612 - RNA, 22 nt, Human
acaguagugcucaaucaguguu

SEQ ID NO: 1000613 - RNA, 22 nt, Human
gcauguguuauuuuauguauga

SEQ ID NO: 1000614 - RNA, 22 nt, Human
ugugugauugcaggagaugugg

SEQ ID NO: 1000615 - RNA, 22 nt, Human
uaauuucuucaucucugcagcu

SEQ ID NO: 1000616 - RNA, 23 nt, Human
cuuguuauaagaagacugucugg

SEQ ID NO: 1000617 - RNA, 23 nt, Human
aguguguaagguacuuugcugcu

SEQ ID NO: 1000618 - RNA, 21 nt, Human
uacuguauagauguguucuug

SEQ ID NO: 1000619 - RNA, 22 nt, Human
uucucugccucacaggucuaag

SEQ ID NO: 1000620 - RNA, 22 nt, Human
auacaguaaccacauucuauag

SEQ ID NO: 1000621 - RNA, 22 nt, Human
aguggcuguucauuuuacacaa

SEQ ID NO: 1000622 - RNA, 22 nt, Human
uuaucuguuuucugugcguuuc

SEQ ID NO: 1000623 - RNA, 22 nt, Human
uauauucugauuccaucugugu

SEQ ID NO: 1000624 - RNA, 23 nt, Human
uauguauguauguuuguauggaa

SEQ ID NO: 1000625 - RNA, 21 nt, Human
uuuuuucuugcgugaggccug

SEQ ID NO: 1000626 - RNA, 21 nt, Human
ccuuuacaauuuugcauuccu

SEQ ID NO: 1000627 - RNA, 22 nt, Human
guguguaaugcuuauugugcuu

SEQ ID NO: 1000628 - RNA, 22 nt, Human
ucuuucagaaacuuugucugcg

SEQ ID NO: 1000629 - RNA, 22 nt, Human
gcugcuguguuggccacugcuu

SEQ ID NO: 1000630 - RNA, 22 nt, Human
agguauauguucauguaugugu

SEQ ID NO: 1000631 - RNA, 20 nt, Human
uuugucuguuaaguguuucu

SEQ ID NO: 1000632 - RNA, 22 nt, Human
aagcugccagcugagcugaggc

SEQ ID NO: 1000633 - RNA, 22 nt, Human
ugugguggcuauucuggucuca

SEQ ID NO: 1000634 - RNA, 22 nt, Human
gugcucuccagccccacgugga

SEQ ID NO: 1000635 - RNA, 22 nt, Human
uguguaugucuguaugcacaca

SEQ ID NO: 1000636 - RNA, 22 nt, Human
uuuggcugagaaguugugcuuu

SEQ ID NO: 1000637 - RNA, 22 nt, Human
gaggaaaauauucagggagguu

SEQ ID NO: 1000638 - RNA, 22 nt, Human
cuguggcucauaucuguaaucu

SEQ ID NO: 1000639 - RNA, 22 nt, Human
uuuucucuauauugucugugaa

SEQ ID NO: 1000640 - RNA, 22 nt, Human
acaguaguccuuuauuuugguu

SEQ ID NO: 1000641 - RNA, 22 nt, Human
guggcaugaaagcaucugugau

SEQ ID NO: 1000642 - RNA, 22 nt, Human
cugugccuccagucucgcuucu

SEQ ID NO: 1000643 - RNA, 22 nt, Human
ggcugcuggcagauguaguuua

SEQ ID NO: 1000644 - RNA, 22 nt, Human
uacaauauguggccuuuuguga

SEQ ID NO: 1000645 - RNA, 22 nt, Human
gugggugucaguaucuuuaacg

SEQ ID NO: 1000646 - RNA, 22 nt, Human
ucuuauacagaagauguuuaau

SEQ ID NO: 1000647 - RNA, 22 nt, Human
gaagggugugugugagggacac

SEQ ID NO: 1000648 - RNA, 22 nt, Human
auguguauauuuggugucaaua

SEQ ID NO: 1000649 - RNA, 22 nt, Human
gccaccucucucuugacucgag

SEQ ID NO: 1000650 - RNA, 22 nt, Human
uaacuuuaugacaugucuugcu

SEQ ID NO: 1000651 - RNA, 22 nt, Human
gucuguggaguugcuugcugga

SEQ ID NO: 1000652 - RNA, 22 nt, Human
cggcugugucuucacaggagcc

SEQ ID NO: 1000653 - RNA, 22 nt, Human
ucuucucuccugcuuggcagaa

SEQ ID NO: 1000654 - RNA, 22 nt, Human
uuucacagcaacacugucugca

SEQ ID NO: 1000655 - RNA, 22 nt, Human
aguauaaugaaaugugucagua

SEQ ID NO: 1000656 - RNA, 22 nt, Human
gagcugcccugagcuuugcaug

SEQ ID NO: 1000657 - RNA, 22 nt, Human
aauuuucuaaggugaugaucug

SEQ ID NO: 1000658 - RNA, 22 nt, Human
ugugcguggauuccuguacuca

SEQ ID NO: 1000659 - RNA, 22 nt, Human
gaaaguuuucauauauaccaaa

SEQ ID NO: 1000660 - RNA, 21 nt, Human
ucuuuacauuugccucuugca

SEQ ID NO: 1000661 - RNA, 22 nt, Human
uacaauaugugaacuuuggugu

SEQ ID NO: 1000662 - RNA, 22 nt, Human
uuacagguacuugcugcugaaa

SEQ ID NO: 1000663 - RNA, 22 nt, Human
gcagugugucuggaguacaugg

SEQ ID NO: 1000664 - RNA, 22 nt, Human
ugugccugcuagaugguugucg

SEQ ID NO: 1000665 - RNA, 22 nt, Human
ucagugugucucugcauuuggg

SEQ ID NO: 1000666 - RNA, 22 nt, Human
ucucucuuuuuaaucauguaau

SEQ ID NO: 1000667 - RNA, 22 nt, Human
cuuuaacaaaugacucuugucu

SEQ ID NO: 1000668 - RNA, 22 nt, Human
cuuucacacacauacauuugga

SEQ ID NO: 1000669 - RNA, 22 nt, Human
ucuguguaagaccagugcuggg

SEQ ID NO: 1000670 - RNA, 22 nt, Human
ugucuguaagguguuuauguua

SEQ ID NO: 1000671 - RNA, 22 nt, Human
auguguaugucuuauucaaaga

SEQ ID NO: 1000672 - RNA, 20 nt, Human
uuuaucugugggaguggaga

SEQ ID NO: 1000673 - RNA, 22 nt, Human
acaguacaggacgaguuuuccu

SEQ ID NO: 1000674 - RNA, 22 nt, Human
guggccugccgugugguauggg

SEQ ID NO: 1000675 - RNA, 22 nt, Human
cugugugcaggugcuggguacc

SEQ ID NO: 1000676 - RNA, 22 nt, Human
gugucgugcuugccauggguac

SEQ ID NO: 1000677 - RNA, 22 nt, Human
auacaguaauugcccugcaaug

SEQ ID NO: 1000678 - RNA, 22 nt, Human
uuuuucauauuccccucucugg

SEQ ID NO: 1000679 - RNA, 22 nt, Human
cuuuacagauaggaacuacuca

SEQ ID NO: 1000680 - RNA, 22 nt, Human
uucuuuguggcagugagcuggg

SEQ ID NO: 1000681 - RNA, 22 nt, Human
uuauuuuuaaaaguucacacag

SEQ ID NO: 1000682 - RNA, 22 nt, Human
uuucucuggccucaguuuaaca

SEQ ID NO: 1000683 - RNA, 22 nt, Human
ucucauuugccucaucuauaaa

SEQ ID NO: 1000684 - RNA, 22 nt, Human
cuguguguccucggacgaguuu

SEQ ID NO: 1000685 - RNA, 22 nt, Human
caguuuauaguuguuaugugug

SEQ ID NO: 1000686 - RNA, 22 nt, Human
uuauacagggaguuucccugca

SEQ ID NO: 1000687 - RNA, 22 nt, Human
uaucucuuucauuuuagaguca

SEQ ID NO: 1000688 - RNA, 18 nt, Human
gucuguguggcuugggga

SEQ ID NO: 1000689 - RNA, 22 nt, Human
ggcuauguguguccaguguauu

SEQ ID NO: 1000690 - RNA, 22 nt, Human
uggcugugucaucauagcugug

SEQ ID NO: 1000691 - RNA, 22 nt, Human
ucauuacaguguuuauaugucu

SEQ ID NO: 1000692 - RNA, 22 nt, Human
gcuguggcuccaauggugagcc

SEQ ID NO: 1000693 - RNA, 22 nt, Human
ugugugcucuaaugccuaguac

SEQ ID NO: 1000694 - RNA, 22 nt, Human
uacaguuacugcauuucuaaua

SEQ ID NO: 1000695 - RNA, 22 nt, Human
ucuguguacgcaggcgugcgcg

SEQ ID NO: 1000696 - RNA, 22 nt, Human
aggcuguggcaucacaucagga

SEQ ID NO: 1000697 - RNA, 22 nt, Human
auuugucuaaugaguguguacu

SEQ ID NO: 1000698 - RNA, 22 nt, Human
acauauaugcugggacugugac

SEQ ID NO: 1000699 - RNA, 20 nt, Human
ugugugaauuagggcauguu

SEQ ID NO: 1000700 - RNA, 22 nt, Human
uuuaagcuguggcauuaauucu

SEQ ID NO: 1000701 - RNA, 22 nt, Human
agaggugacauaggagaggcuc

SEQ ID NO: 1000702 - RNA, 22 nt, Human
cucugugugguagauuccauua

SEQ ID NO: 1000703 - RNA, 22 nt, Human
ugcagucuuccagcugcacaaa

SEQ ID NO: 1000704 - RNA, 22 nt, Human
aguauauaguggcgcuguaugc

SEQ ID NO: 1000705 - RNA, 20 nt, Human
aggggugaucgggugacacu

SEQ ID NO: 1000706 - RNA, 23 nt, Human
ugaguguguucccugugagauuu

SEQ ID NO: 1000707 - RNA, 22 nt, Human
gcagcugcaauaggcaucaagc

SEQ ID NO: 1000708 - RNA, 23 nt, Human
caugugugacaguaucacuguuu

SEQ ID NO: 1000709 - RNA, 22 nt, Human
uacaguagucgucuuauuuuga

SEQ ID NO: 1000710 - RNA, 22 nt, Human
uguguguaaggaagcuuuaugg

SEQ ID NO: 1000711 - RNA, 22 nt, Human
guucucucagcgauagugaugg

SEQ ID NO: 1000712 - RNA, 22 nt, Human
cuucuuuaccaagagauagagu

SEQ ID NO: 1000713 - RNA, 22 nt, Human
ggaagcugugcucucaggccuc

SEQ ID NO: 1000714 - RNA, 22 nt, Human
uuuacagggaauauuuuggcuu

SEQ ID NO: 1000715 - RNA, 19 nt, Human
ugggugugaccaucucugc

SEQ ID NO: 1000716 - RNA, 22 nt, Human
uuuguguguauauccuuccaga

SEQ ID NO: 1000717 - RNA, 22 nt, Human
ggagguggcagagggacauucu

SEQ ID NO: 1000718 - RNA, 22 nt, Human
acaguguauauuguuuaucugg

SEQ ID NO: 1000719 - RNA, 22 nt, Human
acaguagagcauuuguuuugau

SEQ ID NO: 1000720 - RNA, 22 nt, Human
gguggcugggauuaguagccca

SEQ ID NO: 1000721 - RNA, 22 nt, Human
uucauuuuauaaacccugcuga

SEQ ID NO: 1000722 - RNA, 22 nt, Human
uguggcugucuguucuccuagg

SEQ ID NO: 1000723 - RNA, 22 nt, Human
ccuuuacaguaugguuguauca

SEQ ID NO: 1000724 - RNA, 22 nt, Human
auucucucauuuaucuguccua

SEQ ID NO: 1000725 - RNA, 22 nt, Human
aucaguauccugcaguuucuau

SEQ ID NO: 1000726 - RNA, 22 nt, Human
ugugacuguggacuuuuguggg

SEQ ID NO: 1000727 - RNA, 19 nt, Human
uauauauuuugggguugug

SEQ ID NO: 1000728 - RNA, 22 nt, Human
ucagcugcucaaauuuauguca

SEQ ID NO: 1000729 - RNA, 22 nt, Human
uguggcauacacaugagguggu

SEQ ID NO: 1000730 - RNA, 22 nt, Human
cugugucuaaucuuauacauca

SEQ ID NO: 1000731 - RNA, 22 nt, Human
uucuuuaccacuacucuuccaa

SEQ ID NO: 1000732 - RNA, 22 nt, Human
uaggagggcccugaaaauggca

SEQ ID NO: 1000733 - RNA, 22 nt, Human
cuggcugugcagucuuccagaa

SEQ ID NO: 1000734 - RNA, 22 nt, Human
uguauguggcuacuuuucuugc

SEQ ID NO: 1000735 - RNA, 23 nt, Human
ugaguguggggacagugguuugc

SEQ ID NO: 1000736 - RNA, 22 nt, Human
acagaauagucagcuguaggcc

SEQ ID NO: 1000737 - RNA, 22 nt, Human
cuucucuugguaguucuuguug

SEQ ID NO: 1000738 - RNA, 22 nt, Human
ucucucauaagaugaguacuua

SEQ ID NO: 1000739 - RNA, 22 nt, Human
uaucuuuauuaugucuaucugc

SEQ ID NO: 1000740 - RNA, 22 nt, Human
uauuugcuccuuaggcauauuu

SEQ ID NO: 1000741 - RNA, 22 nt, Human
uauguucuuagaagaggcagca

SEQ ID NO: 1000742 - RNA, 20 nt, Human
uuauuugcucuuuaucugca

SEQ ID NO: 1000743 - RNA, 22 nt, Human
uacuuuuuaugauaagaacuga

SEQ ID NO: 1000744 - RNA, 22 nt, Human
uguggcucggccagcugcugaa

SEQ ID NO: 1000745 - RNA, 23 nt, Human
uucugucuugcugucagcuuucu

SEQ ID NO: 1000746 - RNA, 22 nt, Human
caggcauuucgcaaaggcugag

SEQ ID NO: 1000747 - RNA, 22 nt, Human
cugcugugacagcugccguguu

SEQ ID NO: 1000748 - RNA, 22 nt, Human
ucuggcugcugcgugagugcuu

SEQ ID NO: 1000749 - RNA, 20 nt, Human
uguguguguacuucuaaaua

SEQ ID NO: 1000750 - RNA, 22 nt, Human
uuuccucuuuguaccuugacua

SEQ ID NO: 1000751 - RNA, 20 nt, Human
guggccuguccuguuguggg

SEQ ID NO: 1000752 - RNA, 22 nt, Human
cuguggcugcgccaucgaaaac

SEQ ID NO: 1000753 - RNA, 22 nt, Human
ucuuuuauagugaauuuucuug

SEQ ID NO: 1000754 - RNA, 22 nt, Human
auuucucugccucagcuucugc

SEQ ID NO: 1000755 - RNA, 22 nt, Human
aggaagcugggaaacugacauu

SEQ ID NO: 1000756 - RNA, 17 nt, Human
aguguguaacuugugua

SEQ ID NO: 1000757 - RNA, 22 nt, Human
uggagguguauaagguagcuuc

SEQ ID NO: 1000758 - RNA, 22 nt, Human
aguggcugaauauauuuuacua

SEQ ID NO: 1000759 - RNA, 22 nt, Human
gccagccccagacauccuaucg

SEQ ID NO: 1000760 - RNA, 22 nt, Human
uuuuucauugcagccucucucc

SEQ ID NO: 1000761 - RNA, 22 nt, Human
uuuccuguucuaguuguugcca

SEQ ID NO: 1000762 - RNA, 23 nt, Human
uuugacagcgugguuucuguggg

SEQ ID NO: 1000763 - RNA, 22 nt, Human
auuuuaucugcuuacuuucagg

SEQ ID NO: 1000764 - RNA, 22 nt, Human
uaacuuuuacauuuggcucacu

SEQ ID NO: 1000765 - RNA, 22 nt, Human
uuguguauuuccugaagguaag

SEQ ID NO: 1000766 - RNA, 18 nt, Human
uuuuacucauagcaggcc

SEQ ID NO: 1000767 - RNA, 22 nt, Human
cuguggcucuccaauggaggga

SEQ ID NO: 1000768 - RNA, 18 nt, Human
guggaggguucucagaau

SEQ ID NO: 1000769 - RNA, 22 nt, Human
uuguauuuuguuaugcuacugc

SEQ ID NO: 1000770 - RNA, 22 nt, Human
ucugugauagguggcauaguga

SEQ ID NO: 1000771 - RNA, 22 nt, Human
cagauauaguggcuugccuggg

SEQ ID NO: 1000772 - RNA, 22 nt, Human
gugugcgcgcucauaggugugu

SEQ ID NO: 1000773 - RNA, 22 nt, Human
ugucucuucugccuccagcugu

SEQ ID NO: 1000774 - RNA, 22 nt, Human
uguguguuaacuuauuuaaugu

SEQ ID NO: 1000775 - RNA, 22 nt, Human
cuggcugugcugcaggcuuugg

SEQ ID NO: 1000776 - RNA, 22 nt, Human
cauguguguggacgagcguggc

SEQ ID NO: 1000777 - RNA, 22 nt, Human
gugugggugggacaucaucuuu

SEQ ID NO: 1000778 - RNA, 22 nt, Human
auacaguaauuuguaacucauc

SEQ ID NO: 1000779 - RNA, 22 nt, Human
guuacagugcuuggcaauaagu

SEQ ID NO: 1000780 - RNA, 22 nt, Human
ugugucugaacuaguugcucuc

SEQ ID NO: 1000781 - RNA, 23 nt, Human
caguauaauguauggauggggca

SEQ ID NO: 1000782 - RNA, 22 nt, Human
aggcuguggugaugauuggguc

SEQ ID NO: 1000783 - RNA, 22 nt, Human
uuguauuucuccacuuucuguu

SEQ ID NO: 1000784 - RNA, 22 nt, Human
gcucucugggugugucuagaua

SEQ ID NO: 1000785 - RNA, 22 nt, Human
agagggguuaagugcuaguccg

SEQ ID NO: 1000786 - RNA, 22 nt, Human
uuucucucuggcccugauuguc

SEQ ID NO: 1000787 - RNA, 22 nt, Human
aguauauugcucuuaaucauag

SEQ ID NO: 1000788 - RNA, 22 nt, Human
ucuuuacaaucuaagcauaguu

SEQ ID NO: 1000789 - RNA, 22 nt, Human
gcuuuacaacaaauugaauaug

SEQ ID NO: 1000790 - RNA, 19 nt, Human
uauauuugagugugcaugc

SEQ ID NO: 1000791 - RNA, 22 nt, Human
ucugcugugucccuggucuccu

SEQ ID NO: 1000792 - RNA, 22 nt, Human
auuucucuaagcauccguuugc

SEQ ID NO: 1000793 - RNA, 22 nt, Human
ucagugugaggggcuggguccu

SEQ ID NO: 1000794 - RNA, 20 nt, Human
ugauauuucuggaaguggag

SEQ ID NO: 1000795 - RNA, 22 nt, Human
cacaguauucacugggcagauu

SEQ ID NO: 1000796 - RNA, 22 nt, Human
gugcaccagucacaugggcaga

SEQ ID NO: 1000797 - RNA, 22 nt, Human
ugucuguacaaauuuucugugu

SEQ ID NO: 1000798 - RNA, 21 nt, Human
uuagcaguuguugauuuccag

SEQ ID NO: 1000799 - RNA, 22 nt, Human
aaguuuuucacauugcuguugu

SEQ ID NO: 1000800 - RNA, 19 nt, Human
ucagugugugggagguggu

SEQ ID NO: 1000801 - RNA, 22 nt, Human
caguauguccuuccucguuggc

SEQ ID NO: 1000802 - RNA, 21 nt, Human
acaguacuugagaucuuuuga

SEQ ID NO: 1000803 - RNA, 22 nt, Human
gcucucuuuaaacugcauggcu

SEQ ID NO: 1000804 - RNA, 22 nt, Human
ccuuuacaaaguucuucauggg

SEQ ID NO: 1000805 - RNA, 22 nt, Human
gcugauguuucaaguauagcuu

SEQ ID NO: 1000806 - RNA, 22 nt, Human
uuaacuucaacacucucuugua

SEQ ID NO: 1000807 - RNA, 22 nt, Human
agcuguguguuugucaugggcg

SEQ ID NO: 1000808 - RNA, 22 nt, Human
auauauuuacucuccuguugca

SEQ ID NO: 1000809 - RNA, 22 nt, Human
uuauuauugugguugcauuauc

SEQ ID NO: 1000810 - RNA, 22 nt, Human
ugcugugucuuucugugaaaag

SEQ ID NO: 1000811 - RNA, 22 nt, Human
uuuccugucuuuugugaaggau

SEQ ID NO: 1000812 - RNA, 22 nt, Human
aauuuucugguguguaaugaag

SEQ ID NO: 1000813 - RNA, 22 nt, Human
uggcugugaacaaagagaauaa

SEQ ID NO: 1000814 - RNA, 22 nt, Human
acaguagucuuaauuucaugua

SEQ ID NO: 1000815 - RNA, 22 nt, Human
gcugugugaaaacugggccugg

SEQ ID NO: 1000816 - RNA, 22 nt, Human
uauuuuguuaauaauccagucc

SEQ ID NO: 1000817 - RNA, 22 nt, Human
guuagguagaaguuuacuuuga

SEQ ID NO: 1000818 - RNA, 21 nt, Human
gugugaguagcaugugucuca

SEQ ID NO: 1000819 - RNA, 22 nt, Human
uuuuucucuaugccaggggccu

SEQ ID NO: 1000820 - RNA, 22 nt, Human
gugaaugcaaacuguuucugau

SEQ ID NO: 1000821 - RNA, 22 nt, Human
uucuuuauugagacuucauugu

SEQ ID NO: 1000822 - RNA, 22 nt, Human
ugugugugcaggagagcaggug

SEQ ID NO: 1000823 - RNA, 22 nt, Human
uuauguucagcaucugcuuuau

SEQ ID NO: 1000824 - RNA, 22 nt, Human
ucucucucagccauuacagaac

SEQ ID NO: 1000825 - RNA, 23 nt, Human
ucuuuuuaagagaucuagugacg

SEQ ID NO: 1000826 - RNA, 22 nt, Human
gauauuuuuaguauuucugccu

SEQ ID NO: 1000827 - RNA, 22 nt, Human
gcucucuuugugccacuuaagg

SEQ ID NO: 1000828 - RNA, 22 nt, Human
uuauuguuuacuaguuugcaga

SEQ ID NO: 1000829 - RNA, 22 nt, Human
acuguguggaaauuugugaggg

SEQ ID NO: 1000830 - RNA, 22 nt, Human
uucuaacucuguuauguguuuc

SEQ ID NO: 1000831 - RNA, 22 nt, Human
aguuuucugcuaaaccagcuaa

SEQ ID NO: 1000832 - RNA, 21 nt, Human
cucuguguugaggguguugag

SEQ ID NO: 1000833 - RNA, 22 nt, Human
ccuacucugagcgccuccgcau

SEQ ID NO: 1000834 - RNA, 22 nt, Human
uguguguguaaaagcauuuaua

SEQ ID NO: 1000835 - RNA, 20 nt, Human
uuucuugucggcuguugcug

SEQ ID NO: 1000836 - RNA, 22 nt, Human
acuuguuucaacuguacucucc

SEQ ID NO: 1000837 - RNA, 22 nt, Human
ucauuuucccacugaagcuguc

SEQ ID NO: 1000838 - RNA, 22 nt, Human
cagggauucagcugaaggaggc

SEQ ID NO: 1000839 - RNA, 22 nt, Human
uuuaaucucccacucucagccu

SEQ ID NO: 1000840 - RNA, 22 nt, Human
uagggcaggggaggaaucugaa

SEQ ID NO: 1000841 - RNA, 22 nt, Human
uucuguguucugugcaaugagc

SEQ ID NO: 1000842 - RNA, 22 nt, Human
uucugugugucucagcaagcug

SEQ ID NO: 1000843 - RNA, 22 nt, Human
auguggcuaguccaauuaauga

SEQ ID NO: 1000844 - RNA, 22 nt, Human
uguguuggcuugccuguuaggc

SEQ ID NO: 1000845 - RNA, 22 nt, Human
auucucuguggugaugcuggug

SEQ ID NO: 1000846 - RNA, 22 nt, Human
uucuucucggcugucagauagu

SEQ ID NO: 1000847 - RNA, 22 nt, Human
gugguuguuuaggucguggauc

SEQ ID NO: 1000848 - RNA, 22 nt, Human
cagccacugacaggaauggucc

SEQ ID NO: 1000849 - RNA, 22 nt, Human
caacuuuucugugaauuuaagu

SEQ ID NO: 1000850 - RNA, 22 nt, Human
gguguguguggauuagcaugcc

SEQ ID NO: 1000851 - RNA, 22 nt, Human
uggcuaugguauugauggguuu

SEQ ID NO: 1000852 - RNA, 22 nt, Human
uaguuucuagucaaucuucuuu

SEQ ID NO: 1000853 - RNA, 22 nt, Human
cuguggcuuucucugccuccuu

SEQ ID NO: 1000854 - RNA, 22 nt, Human
aggcugugcucagccaauggga

SEQ ID NO: 1000855 - RNA, 22 nt, Human
uuuuauguuccucuuuaugcga

SEQ ID NO: 1000856 - RNA, 22 nt, Human
uaguuucuggguuggcuucuac

SEQ ID NO: 1000857 - RNA, 22 nt, Human
aggcugugaucucaugauuugu

SEQ ID NO: 1000858 - RNA, 22 nt, Human
auggcugugugcuucuccccau

SEQ ID NO: 1000859 - RNA, 21 nt, Human
uggcucugaaagagugcugca

SEQ ID NO: 1000860 - RNA, 22 nt, Human
cuacaguaugaaaccuuuacuc

SEQ ID NO: 1000861 - RNA, 22 nt, Human
auguggcuaguccucugcggca

SEQ ID NO: 1000862 - RNA, 22 nt, Human
uuuccagugaauuagucuguuu

SEQ ID NO: 1000863 - RNA, 22 nt, Human
uguguauguuuugagguugcua

SEQ ID NO: 1000864 - RNA, 22 nt, Human
gcugucuguucgagcguguguu

SEQ ID NO: 1000865 - RNA, 20 nt, Human
ucuguagucuaugaggcuua

SEQ ID NO: 1000866 - RNA, 22 nt, Human
gcagcugcagacccucagugcu

SEQ ID NO: 1000867 - RNA, 19 nt, Human
ucaguauauaauuacacca

SEQ ID NO: 1000868 - RNA, 22 nt, Human
uacaguauauacuguguguaga

SEQ ID NO: 1000869 - RNA, 22 nt, Human
uuagcaguucauugauuaucgu

SEQ ID NO: 1000870 - RNA, 22 nt, Human
auucgcgggccuggaggguggg

SEQ ID NO: 1000871 - RNA, 22 nt, Human
uuuaucaguagcaaaguuuuaa

SEQ ID NO: 1000872 - RNA, 22 nt, Human
ucucugugggcuuuggacuuga

SEQ ID NO: 1000873 - RNA, 22 nt, Human
agaauauugaaaguucuugaca

SEQ ID NO: 1000874 - RNA, 20 nt, Human
auguggcuuuuugaccugcu

SEQ ID NO: 1000875 - RNA, 22 nt, Human
uauuacagcuuugauuaucugg

SEQ ID NO: 1000876 - RNA, 22 nt, Human
uuauauuucugguagccuucag

SEQ ID NO: 1000877 - RNA, 22 nt, Human
aagccacuuucagcugucucag

SEQ ID NO: 1000878 - RNA, 22 nt, Human
ccugugugaagguuaggcaggu

SEQ ID NO: 1000879 - RNA, 22 nt, Human
uuuauaguagcaugauuuauaa

SEQ ID NO: 1000880 - RNA, 23 nt, Human
ucucuuaccugagacauuuccua

SEQ ID NO: 1000881 - RNA, 22 nt, Human
agugugugcuguuccccggagg

SEQ ID NO: 1000882 - RNA, 21 nt, Human
auuuucugugauagcugucuc

SEQ ID NO: 1000883 - RNA, 22 nt, Human
uauuugcuuugcuuuauagaga

SEQ ID NO: 1000884 - RNA, 22 nt, Human
ugccgcagugcggggagggccc

SEQ ID NO: 1000885 - RNA, 22 nt, Human
cuggagggugagccucaucucu

SEQ ID NO: 1000886 - RNA, 22 nt, Human
aguauguugacuuauucuugga

SEQ ID NO: 1000887 - RNA, 20 nt, Human
uuacagaaaugauguuauuu

SEQ ID NO: 1000888 - RNA, 22 nt, Human
cugucgccugguccucucugga

SEQ ID NO: 1000889 - RNA, 22 nt, Human
uuuacauuucccucugucaguu

SEQ ID NO: 1000890 - RNA, 22 nt, Human
cuguauguuccguuuugucacu

SEQ ID NO: 1000891 - RNA, 20 nt, Human
ucuguguuucagcugcuuga

SEQ ID NO: 1000892 - RNA, 22 nt, Human
cagcccuccuuucacucccagg

SEQ ID NO: 1000893 - RNA, 22 nt, Human
augcauguauucaugugugaca

SEQ ID NO: 1000894 - RNA, 22 nt, Human
ugcuguguggaugugaagaauc

SEQ ID NO: 1000895 - RNA, 22 nt, Human
uuuucuccagggaacaagguga

SEQ ID NO: 1000896 - RNA, 22 nt, Human
caguuuuaaauuuugaaugucu

SEQ ID NO: 1000897 - RNA, 19 nt, Human
auuuuucuuccucugugca

SEQ ID NO: 1000898 - RNA, 22 nt, Human
agcugugugcccaugguggagg

SEQ ID NO: 1000899 - RNA, 22 nt, Human
aguuucucuagagucuuugaaa

SEQ ID NO: 1000900 - RNA, 22 nt, Human
guguggcuuucuggguuuaauu

SEQ ID NO: 1000901 - RNA, 22 nt, Human
uuacaguauuggucacguuugu

SEQ ID NO: 1000902 - RNA, 22 nt, Human
cuaacuuuagcuuagauuauca

SEQ ID NO: 1000903 - RNA, 22 nt, Human
ucagcugcugugguauguacau

SEQ ID NO: 1000904 - RNA, 19 nt, Human
ggugugugcuggggccugu

SEQ ID NO: 1000905 - RNA, 22 nt, Human
gcucucuuucacagagguagga

SEQ ID NO: 1000906 - RNA, 22 nt, Human
acucucugguguagaaagaccu

SEQ ID NO: 1000907 - RNA, 22 nt, Human
aguuauauaacuaucuagaugc

SEQ ID NO: 1000908 - RNA, 22 nt, Human
uuuacaauugguuuucucuaau

SEQ ID NO: 1000909 - RNA, 19 nt, Human
acuguguggaagugugauu

SEQ ID NO: 1000910 - RNA, 22 nt, Human
cuuuuuacucuguugucucagc

SEQ ID NO: 1000911 - RNA, 22 nt, Human
ucucucuaggcaucuauuuuca

SEQ ID NO: 1000912 - RNA, 22 nt, Human
ucucugugucucauguuccuau

SEQ ID NO: 1000913 - RNA, 22 nt, Human
aguuuucuucauuuuguggcca

SEQ ID NO: 1000914 - RNA, 22 nt, Human
auguaugcaugcuacaguuuuc

SEQ ID NO: 1000915 - RNA, 22 nt, Human
uuucacaggaugcuguuuuaua

SEQ ID NO: 1000916 - RNA, 22 nt, Human
aguguguacauuuggugcaguu

SEQ ID NO: 1000917 - RNA, 22 nt, Human
cagauauauuuuauuuggucaa

SEQ ID NO: 1000918 - RNA, 22 nt, Human
ucugagugucuuaauaggcucu

SEQ ID NO: 1000919 - RNA, 22 nt, Human
acaguaaauaaugcauguugau

SEQ ID NO: 1000920 - RNA, 17 nt, Human
agucauauugugcaguu

SEQ ID NO: 1000921 - RNA, 22 nt, Human
auguggcucagcaggcucccgu

SEQ ID NO: 1000922 - RNA, 22 nt, Human
uuucugcuaaucuuuuacugag

SEQ ID NO: 1000923 - RNA, 22 nt, Human
uuucacagcgucuuucucuugc

SEQ ID NO: 1000924 - RNA, 22 nt, Human
ggugugugguuuugauacaguc

SEQ ID NO: 1000925 - RNA, 22 nt, Human
cuguggcuccagugaaccaaug

SEQ ID NO: 1000926 - RNA, 22 nt, Human
cccuggccccucacuccgaggc

SEQ ID NO: 1000927 - RNA, 22 nt, Human
agucauauguggcauuuucuaa

SEQ ID NO: 1000928 - RNA, 22 nt, Human
gugugugcaagagguuuauuga

SEQ ID NO: 1000929 - RNA, 22 nt, Human
cuuacaguacuucuaauaugau

SEQ ID NO: 1000930 - RNA, 22 nt, Human
uacuuucuguccuucuguuaaa

SEQ ID NO: 1000931 - RNA, 22 nt, Human
uguaggcugaagaugaagugga

SEQ ID NO: 1000932 - RNA, 22 nt, Human
uguguguuaucuuaguucaucu

SEQ ID NO: 1000933 - RNA, 21 nt, Human
ucuuuucucagcuuugugguu

SEQ ID NO: 1000934 - RNA, 22 nt, Human
acaguauauaugguuaucugau

SEQ ID NO: 1000935 - RNA, 22 nt, Human
cuuucuuucgaagacgugauua

SEQ ID NO: 1000936 - RNA, 22 nt, Human
gucucucugacugguccacacc

SEQ ID NO: 1000937 - RNA, 23 nt, Human
uguguauguaucuaugcauaggu

SEQ ID NO: 1000938 - RNA, 22 nt, Human
cuuuacauuaauuucuacugau

SEQ ID NO: 1000939 - RNA, 22 nt, Human
ugugugaacucucugauguaca

SEQ ID NO: 1000940 - RNA, 22 nt, Human
aagcuuuuuggauuugcuucag

SEQ ID NO: 1000941 - RNA, 22 nt, Human
aauuucucauggauucaguuau

SEQ ID NO: 1000942 - RNA, 22 nt, Human
uggcauguaguaggugcuauaa

SEQ ID NO: 1000943 - RNA, 22 nt, Human
uugugugucuucuucacugccc

SEQ ID NO: 1000944 - RNA, 22 nt, Human
cuuuucucugcaccauguguga

SEQ ID NO: 1000945 - RNA, 22 nt, Human
gugcuguacuucuguguugaag

SEQ ID NO: 1000946 - RNA, 20 nt, Human
acagaauaugcugguugugg

SEQ ID NO: 1000947 - RNA, 20 nt, Human
uaacuuucuaugcuuucagc

SEQ ID NO: 1000948 - RNA, 22 nt, Human
uccuuacaacuuguuauuuuuc

SEQ ID NO: 1000949 - RNA, 22 nt, Human
cugugugcaacuugcaguuuug

SEQ ID NO: 1000950 - RNA, 22 nt, Human
cuguggcucaggccuguaagcc

SEQ ID NO: 1000951 - RNA, 22 nt, Human
ucaucucuccccagugucuuua

SEQ ID NO: 1000952 - RNA, 22 nt, Human
cugugcuggauucugaggcuac

SEQ ID NO: 1000953 - RNA, 22 nt, Human
uggcucugucgccguuuggaau

SEQ ID NO: 1000954 - RNA, 22 nt, Human
caguuuuagcuagagcaaacca

SEQ ID NO: 1000955 - RNA, 22 nt, Human
cugugugugucugcagcauacu

SEQ ID NO: 1000956 - RNA, 19 nt, Human
uggcagugugggguaugaa

SEQ ID NO: 1000957 - RNA, 23 nt, Human
agcuguguggccuugggcaaguu

SEQ ID NO: 1000958 - RNA, 22 nt, Human
auucuucuaauaugaucguguu

SEQ ID NO: 1000959 - RNA, 22 nt, Human
ggcuguguuucuguuugacauu

SEQ ID NO: 1000960 - RNA, 22 nt, Human
caguuuuaugucgaauguauac

SEQ ID NO: 1000961 - RNA, 22 nt, Human
cuuuuaaugagcauugcugucu

SEQ ID NO: 1000962 - RNA, 22 nt, Human
aucucucuaugcacugaggacu

SEQ ID NO: 1000963 - RNA, 22 nt, Human
cucuauuuauggcaucuuuaug

SEQ ID NO: 1000964 - RNA, 22 nt, Human
cuucacagucacccugcugugu

SEQ ID NO: 1000965 - RNA, 23 nt, Human
gcagugugaauccaguguuucag

SEQ ID NO: 1000966 - RNA, 22 nt, Human
gcguggcuuagagugggguacc

SEQ ID NO: 1000967 - RNA, 22 nt, Human
auacaguaauugcauaggcuuc

SEQ ID NO: 1000968 - RNA, 22 nt, Human
agguggaguuaagugugaacug

SEQ ID NO: 1000969 - RNA, 22 nt, Human
uggcuguggguggaaggaaacc

SEQ ID NO: 1000970 - RNA, 22 nt, Human
uaacaguauccccauuugcaag

SEQ ID NO: 1000971 - RNA, 22 nt, Human
uuguaugcugaugacaccaccu

SEQ ID NO: 1000972 - RNA, 22 nt, Human
cuguggcugccucaccuacagg

SEQ ID NO: 1000973 - RNA, 22 nt, Human
cuguggcugcguaggucuggca

SEQ ID NO: 1000974 - RNA, 22 nt, Human
cugugugugaacacagcccagc

SEQ ID NO: 1000975 - RNA, 22 nt, Human
uuucuuugagucucaguuugcu

SEQ ID NO: 1000976 - RNA, 22 nt, Human
gucuguguuuucaggccuuugu

SEQ ID NO: 1000977 - RNA, 22 nt, Human
gccagcccauuaaccccugucc

SEQ ID NO: 1000978 - RNA, 22 nt, Human
cuggcuguggucacagguaacu

SEQ ID NO: 1000979 - RNA, 22 nt, Human
uacuguauaugcuuguaucuga

SEQ ID NO: 1000980 - RNA, 22 nt, Human
auaguuuuauagauauugugua

SEQ ID NO: 1000981 - RNA, 22 nt, Human
ugcguggcgcagcgugugggau

SEQ ID NO: 1000982 - RNA, 22 nt, Human
aguuuauuguauaugguaguuu

SEQ ID NO: 1000983 - RNA, 19 nt, Human
auucucugguuugcuggcu

SEQ ID NO: 1000984 - RNA, 22 nt, Human
cgcuguguuuacaucauugcug

SEQ ID NO: 1000985 - RNA, 22 nt, Human
caggacagguguucuagaucag

SEQ ID NO: 1000986 - RNA, 22 nt, Human
uggcugugcggccucgggcaga

SEQ ID NO: 1000987 - RNA, 22 nt, Human
auggcugugaaaugguaggugg

SEQ ID NO: 1000988 - RNA, 22 nt, Human
ccugugugccuggccgcgggag

SEQ ID NO: 1000989 - RNA, 22 nt, Human
uguguauauguaaauauaguug

SEQ ID NO: 1000990 - RNA, 22 nt, Human
ccugaggauuguuggugcuucc

SEQ ID NO: 1000991 - RNA, 22 nt, Human
guguguauuuaaaggauaguug

SEQ ID NO: 1000992 - RNA, 22 nt, Human
auuuucuauucugcugguuuag

SEQ ID NO: 1000993 - RNA, 22 nt, Human
acagucuacaaagugaugugug

SEQ ID NO: 1000994 - RNA, 20 nt, Human
uuucugugcccaggucuguu

SEQ ID NO: 1000995 - RNA, 22 nt, Human
uuacaguuacugguacuguuaa

SEQ ID NO: 1000996 - RNA, 22 nt, Human
caugugugaaucuugugaucau

SEQ ID NO: 1000997 - RNA, 22 nt, Human
caguaauagaggcuuugagucu

SEQ ID NO: 1000998 - RNA, 22 nt, Human
uuugugugaaaauauuuaaguu

SEQ ID NO: 1000999 - RNA, 23 nt, Human
ucuuuacauacugaugaguucuc

SEQ ID NO: 1001000 - RNA, 22 nt, Human
uuuagagucauuuuauauugac

SEQ ID NO: 1001001 - RNA, 22 nt, Human
uuauuauugauucgcucucaaa

SEQ ID NO: 1001002 - RNA, 22 nt, Human
ugugugaauagcaguggcuggu

SEQ ID NO: 1001003 - RNA, 22 nt, Human
uucuucugugaggugugugccu

SEQ ID NO: 1001004 - RNA, 22 nt, Human
ugcuguguuaaauacaagcaug

SEQ ID NO: 1001005 - RNA, 22 nt, Human
cuguaugugaaaaugucaagug

SEQ ID NO: 1001006 - RNA, 22 nt, Human
ugugaauguauaguuuguauau

SEQ ID NO: 1001007 - RNA, 22 nt, Human
uuugugugcgucuggccugggg

SEQ ID NO: 1001008 - RNA, 22 nt, Human
auuuugcuacaguugguggaaa

SEQ ID NO: 1001009 - RNA, 22 nt, Human
uuugugugcaacgcauggaguc

SEQ ID NO: 1001010 - RNA, 22 nt, Human
uuaaguauauccauuugacugg

SEQ ID NO: 1001011 - RNA, 22 nt, Human
auguggcuuucaugauuaagca

SEQ ID NO: 1001012 - RNA, 22 nt, Human
auuuacagccuugaaaacagca

SEQ ID NO: 1001013 - RNA, 22 nt, Human
ccugaggaccagcacccaucug

SEQ ID NO: 1001014 - RNA, 22 nt, Human
uuuucuguggucagagcuugag

SEQ ID NO: 1001015 - RNA, 22 nt, Human
acagugauuucauccuucuggg

SEQ ID NO: 1001016 - RNA, 22 nt, Human
ugugugcacugccuuuugugga

SEQ ID NO: 1001017 - RNA, 20 nt, Human
uucucuuuggguccagagaa

SEQ ID NO: 1001018 - RNA, 22 nt, Human
uucccucuuuuccaacaguugu

SEQ ID NO: 1001019 - RNA, 22 nt, Human
aggcugugaaauguggcaagga

SEQ ID NO: 1001020 - RNA, 22 nt, Human
ucugugugaccauaagccagcu

SEQ ID NO: 1001021 - RNA, 22 nt, Human
uggcugagcucccuguguguug

SEQ ID NO: 1001022 - RNA, 22 nt, Human
gggggugaggacaggagcacug

SEQ ID NO: 1001023 - RNA, 22 nt, Human
guauuauuggguaguaugguaa

SEQ ID NO: 1001024 - RNA, 22 nt, Human
ucugugugcccuaaagccugcu

SEQ ID NO: 1001025 - RNA, 22 nt, Human
aaugcaguuucauuuguagaau

SEQ ID NO: 1001026 - RNA, 22 nt, Human
uuucucugcugccugugucgau

SEQ ID NO: 1001027 - RNA, 22 nt, Human
cugcuguguugccagugucacc

SEQ ID NO: 1001028 - RNA, 22 nt, Human
aguauauuuguuaagauuauuc

SEQ ID NO: 1001029 - RNA, 22 nt, Human
aaguuuuauuggcuauagcacu

SEQ ID NO: 1001030 - RNA, 21 nt, Human
cuuuuacauucagucaugaug

SEQ ID NO: 1001031 - RNA, 22 nt, Human
cugcccuggccacugugcccag

SEQ ID NO: 1001032 - RNA, 22 nt, Human
uuuacaaggcagaacugauuaa

SEQ ID NO: 1001033 - RNA, 22 nt, Human
guuuacagagacagaaaguagu

SEQ ID NO: 1001034 - RNA, 22 nt, Human
cuauauuuggugagggaugucu

SEQ ID NO: 1001035 - RNA, 22 nt, Human
uacaguaacuggaauucuucuu

SEQ ID NO: 1001036 - RNA, 18 nt, Human
cugucuuuuuucucucca

SEQ ID NO: 1001037 - RNA, 17 nt, Human
uuccugugguuugaucu

SEQ ID NO: 1001038 - RNA, 22 nt, Human
uucugcuguaguugcaucuguu

SEQ ID NO: 1001039 - RNA, 20 nt, Human
agcugcccuuuucacauguu

SEQ ID NO: 1001040 - RNA, 22 nt, Human
uauauauucuuaaguaguguag

SEQ ID NO: 1001041 - RNA, 21 nt, Human
ggcuguguucagggcaugcgg

SEQ ID NO: 1001042 - RNA, 22 nt, Human
auggcuguugugaggaucaaau

SEQ ID NO: 1001043 - RNA, 17 nt, Human
ugcgaugucuguguuug

SEQ ID NO: 1001044 - RNA, 22 nt, Human
cuguggcugcagccuugguccu

SEQ ID NO: 1001045 - RNA, 22 nt, Human
gggcuguguaucaguuaucuau

SEQ ID NO: 1001046 - RNA, 22 nt, Human
uguauguaaaggucuucauguu

SEQ ID NO: 1001047 - RNA, 22 nt, Human
ucuuuacaagucacauuuucug

SEQ ID NO: 1001048 - RNA, 22 nt, Human
aagcuuuucucaguguccuugg

SEQ ID NO: 1001049 - RNA, 22 nt, Human
uaggggugaggccaggcaucag

SEQ ID NO: 1001050 - RNA, 22 nt, Human
cuggguguucaggagcugggcu

SEQ ID NO: 1001051 - RNA, 17 nt, Human
cauguguaugugggagu

SEQ ID NO: 1001052 - RNA, 22 nt, Human
ucucucuucaugcuuuuagaau

SEQ ID NO: 1001053 - RNA, 20 nt, Human
ucucuauucccacgaggaaa

SEQ ID NO: 1001054 - RNA, 22 nt, Human
gcucugugaaggguguugcuca

SEQ ID NO: 1001055 - RNA, 22 nt, Human
acuguguguuugucuagcacag

SEQ ID NO: 1001056 - RNA, 22 nt, Human
uuacauguacugguuugacuua

SEQ ID NO: 1001057 - RNA, 22 nt, Human
ugggacaggaggccucuggaga

SEQ ID NO: 1001058 - RNA, 22 nt, Human
auuuucucucaaaccuuaaaau

SEQ ID NO: 1001059 - RNA, 20 nt, Human
ucuuuagauuuaucuuaugu

SEQ ID NO: 1001060 - RNA, 22 nt, Human
ucauuuacuugguuuuaaucuu

SEQ ID NO: 1001061 - RNA, 22 nt, Human
aucuuucuccauauacaucuuu

SEQ ID NO: 1001062 - RNA, 22 nt, Human
uacauguaggugacauuuuaau

SEQ ID NO: 1001063 - RNA, 22 nt, Human
ucugugugcccaccugacaccu

SEQ ID NO: 1001064 - RNA, 23 nt, Human
cuguggcugaguccuguuggagu

SEQ ID NO: 1001065 - RNA, 22 nt, Human
guguaugcaauugagucauaga

SEQ ID NO: 1001066 - RNA, 22 nt, Human
ucucaucuccauuauagcauca

SEQ ID NO: 1001067 - RNA, 22 nt, Human
gcugugcuugcaugagugucug

SEQ ID NO: 1001068 - RNA, 19 nt, Human
caguuuaugcuuuggggac

SEQ ID NO: 1001069 - RNA, 22 nt, Human
uuuucuguaagaggacuuuaau

SEQ ID NO: 1001070 - RNA, 22 nt, Human
ucaguguguacacugagcauuu

SEQ ID NO: 1001071 - RNA, 22 nt, Human
ucuuuaucaagucuguucuuug

SEQ ID NO: 1001072 - RNA, 22 nt, Human
acugugugaggcugggugaguc

SEQ ID NO: 1001073 - RNA, 22 nt, Human
cuguggcucuuuaguugagcac

SEQ ID NO: 1001074 - RNA, 22 nt, Human
uuucuucuaugugugauauuuu

SEQ ID NO: 1001075 - RNA, 22 nt, Human
gugugccucccauuagggugua

SEQ ID NO: 1001076 - RNA, 21 nt, Human
auuaacuuguuaaccuaaagu

SEQ ID NO: 1001077 - RNA, 18 nt, Human
gaacuuuuggcuuugugu

SEQ ID NO: 1001078 - RNA, 19 nt, Human
cucugcuugguccauaugc

SEQ ID NO: 1001079 - RNA, 22 nt, Human
gcugugugccaggggaaggcug

SEQ ID NO: 1001080 - RNA, 22 nt, Human
uuuuaucugcuucauuaguuga

SEQ ID NO: 1001081 - RNA, 22 nt, Human
cuucacagaauaaacucauuau

SEQ ID NO: 1001082 - RNA, 22 nt, Human
cucuccuuucacuaaauauucu

SEQ ID NO: 1001083 - RNA, 22 nt, Human
acagugauugggguaucugcag

SEQ ID NO: 1001084 - RNA, 22 nt, Human
cuccucuucugaguaccaggga

SEQ ID NO: 1001085 - RNA, 22 nt, Human
uagggguggagcuaagaguccc

SEQ ID NO: 1001086 - RNA, 22 nt, Human
cgcccagcugaaaucuccaggc

SEQ ID NO: 1001087 - RNA, 22 nt, Human
cuggcuguuuucaauguugaug

SEQ ID NO: 1001088 - RNA, 22 nt, Human
gcugugagcacugcugggugga

SEQ ID NO: 1001089 - RNA, 22 nt, Human
uuacagcuuacauuuuaccuug

SEQ ID NO: 1001090 - RNA, 22 nt, Human
cucuuuucaaaccuguuuaugg

SEQ ID NO: 1001091 - RNA, 22 nt, Human
cuguggcuggaauaauaaaugu

SEQ ID NO: 1001092 - RNA, 19 nt, Human
uguggcugagcacuccuua

SEQ ID NO: 1001093 - RNA, 22 nt, Human
uuuaucugggauuuugcagucu

SEQ ID NO: 1001094 - RNA, 22 nt, Human
uguuacagaaauauugcuucuu

SEQ ID NO: 1001095 - RNA, 22 nt, Human
uuuagcagagcauaugauaucc

SEQ ID NO: 1001096 - RNA, 22 nt, Human
auuugucugcuugcugccuucc

SEQ ID NO: 1001097 - RNA, 22 nt, Human
acuguauaguauuuauucuuag

SEQ ID NO: 1001098 - RNA, 19 nt, Human
ucuauguggcagugauggc

SEQ ID NO: 1001099 - RNA, 22 nt, Human
uacaguuacuguuauaugugcu

SEQ ID NO: 1001100 - RNA, 22 nt, Human
aggcugugcgaggucucagagu

SEQ ID NO: 1001101 - RNA, 22 nt, Human
uguguguguccucauuugcaga

SEQ ID NO: 1001102 - RNA, 23 nt, Human
ucugcucugaaguucggcugagc

SEQ ID NO: 1001103 - RNA, 22 nt, Human
cuuugcagauuuguuuagugcu

SEQ ID NO: 1001104 - RNA, 22 nt, Human
gcuguguccaggugggggugac

SEQ ID NO: 1001105 - RNA, 22 nt, Human
uuuuaucuaccuaugcucauuu

SEQ ID NO: 1001106 - RNA, 22 nt, Human
uuugcagucuggccugcuuugg

SEQ ID NO: 1001107 - RNA, 22 nt, Human
uuuguuuucaaugugucauuca

SEQ ID NO: 1001108 - RNA, 23 nt, Human
uuucacagcuuuuauucugcauc

SEQ ID NO: 1001109 - RNA, 22 nt, Human
cacaguauuuguuuuucugagu

SEQ ID NO: 1001110 - RNA, 22 nt, Human
caguauaugcucuuucaucaaa

SEQ ID NO: 1001111 - RNA, 22 nt, Human
uguggcuggucuccgagcgucg

SEQ ID NO: 1001112 - RNA, 22 nt, Human
cuggcuguguccacagaguaag

SEQ ID NO: 1001113 - RNA, 19 nt, Human
cauauuuuugggcuggcau

SEQ ID NO: 1001114 - RNA, 22 nt, Human
uaguauauuaauucucacgguu

SEQ ID NO: 1001115 - RNA, 22 nt, Human
auauuuuggcaaaugucuagau

SEQ ID NO: 1001116 - RNA, 22 nt, Human
caugugugacaaacugccugca

SEQ ID NO: 1001117 - RNA, 22 nt, Human
uuacagauucaagcucuuugaa

SEQ ID NO: 1001118 - RNA, 22 nt, Human
aacaguauugguugaacucaag

SEQ ID NO: 1001119 - RNA, 22 nt, Human
uuuaacuccuaguguguauuag

SEQ ID NO: 1001120 - RNA, 22 nt, Human
uuacagauacauuucuuuuguu

SEQ ID NO: 1001121 - RNA, 22 nt, Human
uuuacagaaugucaauuucuau

SEQ ID NO: 1001122 - RNA, 20 nt, Human
agccccacccuuguccuggc

SEQ ID NO: 1001123 - RNA, 22 nt, Human
uuuuucucuucuguaaaguggu

SEQ ID NO: 1001124 - RNA, 22 nt, Human
aagcuggauguaggaucccccu

SEQ ID NO: 1001125 - RNA, 16 nt, Human
ccucucuuauuccucc

SEQ ID NO: 1001126 - RNA, 22 nt, Human
ggccuguggcaaggugagaaug

SEQ ID NO: 1001127 - RNA, 22 nt, Human
aaacuuuuuuagguucauaggc

SEQ ID NO: 1001128 - RNA, 22 nt, Human
gcugugugaccugggcaagucu

SEQ ID NO: 1001129 - RNA, 20 nt, Human
aacuuguuuuguuuucuaau

SEQ ID NO: 1001130 - RNA, 23 nt, Human
uuacagcuaacugcuguuauuag

SEQ ID NO: 1001131 - RNA, 22 nt, Human
uucucucuguuauggauuuuac

SEQ ID NO: 1001132 - RNA, 23 nt, Human
uuacaaguucugaaauuuccuuc

SEQ ID NO: 1001133 - RNA, 22 nt, Human
uguggccugggaaaugaguguu

SEQ ID NO: 1001134 - RNA, 22 nt, Human
uuguaugcugaucaaaagcuuc

SEQ ID NO: 1001135 - RNA, 22 nt, Human
aguuauuuggcuauagauggua

SEQ ID NO: 1001136 - RNA, 22 nt, Human
aagccacugagauuucacugca

SEQ ID NO: 1001137 - RNA, 22 nt, Human
auuuucucacaauccuaugggg

SEQ ID NO: 1001138 - RNA, 22 nt, Human
uuccugugaagaucugggugcu

SEQ ID NO: 1001139 - RNA, 22 nt, Human
uaacuuguguuacauuacucuu

SEQ ID NO: 1001140 - RNA, 22 nt, Human
ucugugucacugaggccugugu

SEQ ID NO: 1001141 - RNA, 23 nt, Human
uuuauauuccuaaugucuugagc

SEQ ID NO: 1001142 - RNA, 22 nt, Human
cucuguguauccaaguucaggu

SEQ ID NO: 1001143 - RNA, 22 nt, Human
cucucuauggaugcaguuuuuc

SEQ ID NO: 1001144 - RNA, 22 nt, Human
uguaugugcaauguuuauaugu

SEQ ID NO: 1001145 - RNA, 22 nt, Human
uacaaguauauucuagugauau

SEQ ID NO: 1001146 - RNA, 22 nt, Human
ucacaguaucagguggagugga

SEQ ID NO: 1001147 - RNA, 22 nt, Human
cuggaggggccauccacagucu

SEQ ID NO: 1001148 - RNA, 22 nt, Human
uaguuucugguucuugcucugg

SEQ ID NO: 1001149 - RNA, 22 nt, Human
ucugcguggcgugguucugugc

SEQ ID NO: 1001150 - RNA, 22 nt, Human
gucuggcuguuccugccuguga

SEQ ID NO: 1001151 - RNA, 21 nt, Human
uauuugcugccaucuuugagg

SEQ ID NO: 1001152 - RNA, 22 nt, Human
ugucuguguccaaauuuccucu

SEQ ID NO: 1001153 - RNA, 22 nt, Human
caucucuucauuagcauuauug

SEQ ID NO: 1001154 - RNA, 22 nt, Human
uaacauuugcugucuccuaugu

SEQ ID NO: 1001155 - RNA, 23 nt, Human
aucuguguguggguagggaugau

SEQ ID NO: 1001156 - RNA, 22 nt, Human
uggcagugaagcugucuuuagg

SEQ ID NO: 1001157 - RNA, 22 nt, Human
uccucugcucagcauuccucac

SEQ ID NO: 1001158 - RNA, 22 nt, Human
uauaauuuuucuguggccaguu

SEQ ID NO: 1001159 - RNA, 19 nt, Human
uauuuucguggaggccuau

SEQ ID NO: 1001160 - RNA, 22 nt, Human
cuuuguaucuaaauaucuugaa

SEQ ID NO: 1001161 - RNA, 22 nt, Human
uccaguaucaaaguccuagucc

SEQ ID NO: 1001162 - RNA, 22 nt, Human
uuuagaguugaguauucauugg

SEQ ID NO: 1001163 - RNA, 22 nt, Human
cugcucuagguuccugcauaug

SEQ ID NO: 1001164 - RNA, 22 nt, Human
gcucucuggcuaguccaucggg

SEQ ID NO: 1001165 - RNA, 22 nt, Human
acaguacugcuguucuuguccu

SEQ ID NO: 1001166 - RNA, 22 nt, Human
uguguauagaugcaugcauaua

SEQ ID NO: 1001167 - RNA, 18 nt, Human
auuucucuggggugauuc

SEQ ID NO: 1001168 - RNA, 22 nt, Human
uucuuuucuuggcaggaguaga

SEQ ID NO: 1001169 - RNA, 22 nt, Human
auuuucugagcacgugacagca

SEQ ID NO: 1001170 - RNA, 22 nt, Human
ugagugugcuaggugucucggu

SEQ ID NO: 1001171 - RNA, 22 nt, Human
uuuucaguugugcucucuaguu

SEQ ID NO: 1001172 - RNA, 22 nt, Human
uuuacacugccauucugaauac

SEQ ID NO: 1001173 - RNA, 22 nt, Human
uugucucugggacaugguauua

SEQ ID NO: 1001174 - RNA, 22 nt, Human
uguguaugcauacacacauaga

SEQ ID NO: 1001175 - RNA, 22 nt, Human
uugugugugagccuucaccaca

SEQ ID NO: 1001176 - RNA, 22 nt, Human
uuuaucagagauauguguggac

SEQ ID NO: 1001177 - RNA, 20 nt, Human
auguauauuacuggcuguga

SEQ ID NO: 1001178 - RNA, 22 nt, Human
uuuuguaugagaagugcuuuac

SEQ ID NO: 1001179 - RNA, 22 nt, Human
auguguaugauaccuuugcuga

SEQ ID NO: 1001180 - RNA, 22 nt, Human
ugugugggcaugcuuuuaauuu

SEQ ID NO: 1001181 - RNA, 22 nt, Human
gugugugugcaucucuuuuauu

SEQ ID NO: 1001182 - RNA, 20 nt, Human
gggcugugccuccucguggu

SEQ ID NO: 1001183 - RNA, 22 nt, Human
uagcugccagaccauucuuacu

SEQ ID NO: 1001184 - RNA, 22 nt, Human
auuacaguuaauuuaccuucuu

SEQ ID NO: 1001185 - RNA, 22 nt, Human
uuuccagugauugcugcucuca

SEQ ID NO: 1001186 - RNA, 22 nt, Human
aguagauucucauugaucuggu

SEQ ID NO: 1001187 - RNA, 22 nt, Human
cuuguacacucaguacuucuag

SEQ ID NO: 1001188 - RNA, 22 nt, Human
gguggcugcaauggcuaacuuc

SEQ ID NO: 1001189 - RNA, 22 nt, Human
uuucucuccuccaaaccaaaga

SEQ ID NO: 1001190 - RNA, 22 nt, Human
gcugcuguugauuuaguccaau

SEQ ID NO: 1001191 - RNA, 20 nt, Human
uggagguggucugcuguccu

SEQ ID NO: 1001192 - RNA, 22 nt, Human
auguguguaugugccuauaucu

SEQ ID NO: 1001193 - RNA, 22 nt, Human
cuguggcuaugguguacauacu

SEQ ID NO: 1001194 - RNA, 22 nt, Human
ggcagccagagggcagcuggau

SEQ ID NO: 1001195 - RNA, 22 nt, Human
aggcgguggccaaggagcggga

SEQ ID NO: 1001196 - RNA, 22 nt, Human
cauuuucucaaugaacccucuu

SEQ ID NO: 1001197 - RNA, 22 nt, Human
gcugcuguacuuggggggugcu

SEQ ID NO: 1001198 - RNA, 22 nt, Human
uacagguagagucucuaguuua

SEQ ID NO: 1001199 - RNA, 22 nt, Human
uuaggaggucuauggacauccu

SEQ ID NO: 1001200 - RNA, 22 nt, Human
cugugccugcaggccacaucaa

SEQ ID NO: 1001201 - RNA, 22 nt, Human
uguaugcuugaguguguauacu

SEQ ID NO: 1001202 - RNA, 22 nt, Human
uagacuuuccagccugcugcuu

SEQ ID NO: 1001203 - RNA, 22 nt, Human
caguaguaguuaaacuguguau

SEQ ID NO: 1001204 - RNA, 22 nt, Human
auauauuugagaauauucauga

SEQ ID NO: 1001205 - RNA, 22 nt, Human
ugcuugugacagaacugugucc

SEQ ID NO: 1001206 - RNA, 22 nt, Human
uuuucugugcccugcuagcugg

SEQ ID NO: 1001207 - RNA, 22 nt, Human
uguacaguggaaaauggauucg

SEQ ID NO: 1001208 - RNA, 22 nt, Human
uguggcugcuccugggugguca

SEQ ID NO: 1001209 - RNA, 22 nt, Human
gcugucugagaacaugguggaa

SEQ ID NO: 1001210 - RNA, 22 nt, Human
cuagugugucuaugucuguucc

SEQ ID NO: 1001211 - RNA, 22 nt, Human
agcuggccuucggugucacugg

SEQ ID NO: 1001212 - RNA, 22 nt, Human
cugucuuuuacuaucauuuacu

SEQ ID NO: 1001213 - RNA, 22 nt, Human
cuggcuguggauuaucacaggc

SEQ ID NO: 1001214 - RNA, 22 nt, Human
acucucugucuaaaugcaguuu

SEQ ID NO: 1001215 - RNA, 22 nt, Human
gggcugugcugaguaggaggug

SEQ ID NO: 1001216 - RNA, 22 nt, Human
uaacauuuaaauuuuucacaua

SEQ ID NO: 1001217 - RNA, 22 nt, Human
uccucacauggugagccacaca

SEQ ID NO: 1001218 - RNA, 18 nt, Human
uauauucugugcccuggu

SEQ ID NO: 1001219 - RNA, 22 nt, Human
uggcugugggauaugugacuga

SEQ ID NO: 1001220 - RNA, 22 nt, Human
uucaguaugcugaaugauuuuu

SEQ ID NO: 1001221 - RNA, 22 nt, Human
uucucuuugacauuauucaggu

SEQ ID NO: 1001222 - RNA, 22 nt, Human
aguggcuggaauugcaggugcg

SEQ ID NO: 1001223 - RNA, 22 nt, Human
uguauauuguucugucucuuca

SEQ ID NO: 1001224 - RNA, 22 nt, Human
aggcugugggacaguuaggaga

SEQ ID NO: 1001225 - RNA, 22 nt, Human
uuucuauuggcgucacuguugu

SEQ ID NO: 1001226 - RNA, 22 nt, Human
gcaggauugggcugaaggagug

SEQ ID NO: 1001227 - RNA, 22 nt, Human
gugugucagguacugugcuagg

SEQ ID NO: 1001228 - RNA, 22 nt, Human
ucauguguguuucauguaugga

SEQ ID NO: 1001229 - RNA, 22 nt, Human
uguguguaauguuucucucuuc

SEQ ID NO: 1001230 - RNA, 22 nt, Human
gugggugucucaagaauggggg

SEQ ID NO: 1001231 - RNA, 22 nt, Human
auuucucugcaguguucggaau

SEQ ID NO: 1001232 - RNA, 22 nt, Human
uuguggcucgugagauguuagg

SEQ ID NO: 1001233 - RNA, 22 nt, Human
ucugcuguucucaugcugauuu

SEQ ID NO: 1001234 - RNA, 22 nt, Human
ugugugauugcacuuauaugag

SEQ ID NO: 1001235 - RNA, 22 nt, Human
ggguggcugacuguuuugugga

SEQ ID NO: 1001236 - RNA, 22 nt, Human
auauuugugguuuuuggcuccu

SEQ ID NO: 1001237 - RNA, 22 nt, Human
guaguguguaggcacugugcuc

SEQ ID NO: 1001238 - RNA, 22 nt, Human
cuguggcugugaaacuucucag

SEQ ID NO: 1001239 - RNA, 22 nt, Human
caguaaauuuuauuugugggug

SEQ ID NO: 1001240 - RNA, 22 nt, Human
cagguauaacgugcauguugua

SEQ ID NO: 1001241 - RNA, 22 nt, Human
auguguauauuuauuguaguuu

SEQ ID NO: 1001242 - RNA, 22 nt, Human
cacugugucagaguaugaugau

SEQ ID NO: 1001243 - RNA, 22 nt, Human
auaacuuucuucacccuugcug

SEQ ID NO: 1001244 - RNA, 22 nt, Human
uuuuucucuaaguagucccaaa

SEQ ID NO: 1001245 - RNA, 22 nt, Human
gauuaagauuacauauuuaagu

SEQ ID NO: 1001246 - RNA, 22 nt, Human
acucuuuaacagacuuugaucu

SEQ ID NO: 1001247 - RNA, 22 nt, Human
caggauuaaggugaggggagua

SEQ ID NO: 1001248 - RNA, 22 nt, Human
gugauauuucaagaguggggca

SEQ ID NO: 1001249 - RNA, 22 nt, Human
auggcuguuggcaggaggccuc

SEQ ID NO: 1001250 - RNA, 22 nt, Human
agucuauuuuugguucuucggg

SEQ ID NO: 1001251 - RNA, 22 nt, Human
cuguggcuggccuuauugcugc

SEQ ID NO: 1001252 - RNA, 22 nt, Human
uauguguauguucauucaugca

SEQ ID NO: 1001253 - RNA, 22 nt, Human
cucugcaggcacccaggguggg

SEQ ID NO: 1001254 - RNA, 22 nt, Human
ugucuauguauacauguguaua

SEQ ID NO: 1001255 - RNA, 22 nt, Human
uuggcugucacugucaguucag

SEQ ID NO: 1001256 - RNA, 16 nt, Human
guucucucacuguacc

SEQ ID NO: 1001257 - RNA, 22 nt, Human
gcugugcuauaucucugagugu

SEQ ID NO: 1001258 - RNA, 22 nt, Human
ugcuguguucaccaauaugugu

SEQ ID NO: 1001259 - RNA, 22 nt, Human
uuuacuguuuuauauuguccag

SEQ ID NO: 1001260 - RNA, 22 nt, Human
cuguggcugaguuccuuauguu

SEQ ID NO: 1001261 - RNA, 22 nt, Human
gcugugugcucacguaguggaa

SEQ ID NO: 1001262 - RNA, 18 nt, Human
auguguggcuuggggucc

SEQ ID NO: 1001263 - RNA, 23 nt, Human
gccauggcugccccacaggccuc

SEQ ID NO: 1001264 - RNA, 21 nt, Human
agcugcccagaguagggaagg

SEQ ID NO: 1001265 - RNA, 22 nt, Human
acuuuuaaaugaguuucaguug

SEQ ID NO: 1001266 - RNA, 22 nt, Human
ccuuuacaguagcccuuuugaa

SEQ ID NO: 1001267 - RNA, 22 nt, Human
acuuuauuuccuauugcaucca

SEQ ID NO: 1001268 - RNA, 22 nt, Human
uauguucuuuacaucugugcaa

SEQ ID NO: 1001269 - RNA, 22 nt, Human
aggcuguguggaugagucuuac

SEQ ID NO: 1001270 - RNA, 22 nt, Human
uuacaguuagguguguaguggu

SEQ ID NO: 1001271 - RNA, 22 nt, Human
uuuccucugucaugacagcuga

SEQ ID NO: 1001272 - RNA, 22 nt, Human
cuuuacuguucuucugugggaa

SEQ ID NO: 1001273 - RNA, 22 nt, Human
uuacagcuagccaauuauuuag

SEQ ID NO: 1001274 - RNA, 22 nt, Human
cuaacuuuuacagucauguugc

SEQ ID NO: 1001275 - RNA, 22 nt, Human
cugugucuaaucaggucaguca

SEQ ID NO: 1001276 - RNA, 22 nt, Human
uuucucauggaacaucguuuag

SEQ ID NO: 1001277 - RNA, 22 nt, Human
auguguauuaguuaguuuaaug

SEQ ID NO: 1001278 - RNA, 22 nt, Human
uguguguggggaggcagcagau

SEQ ID NO: 1001279 - RNA, 22 nt, Human
agguauaugcuauuacuucugc

SEQ ID NO: 1001280 - RNA, 22 nt, Human
uucugucuucucgguuguuuac

SEQ ID NO: 1001281 - RNA, 22 nt, Human
uuuuacaggugaaaaaugaaga

SEQ ID NO: 1001282 - RNA, 19 nt, Human
gagcugccuuuugaagacc

SEQ ID NO: 1001283 - RNA, 22 nt, Human
uucuuuaccagugaaauguuau

SEQ ID NO: 1001284 - RNA, 23 nt, Human
ccucucuuuuuaggugguguuug

SEQ ID NO: 1001285 - RNA, 22 nt, Human
acauuauagcuuugaguuugga

SEQ ID NO: 1001286 - RNA, 20 nt, Human
cguguguggcuauuuugggu

SEQ ID NO: 1001287 - RNA, 22 nt, Human
uuucucccuccacuacaggcuc

SEQ ID NO: 1001288 - RNA, 22 nt, Human
uuucuucuugauuuaaacaggg

SEQ ID NO: 1001289 - RNA, 22 nt, Human
ugcuguguuccucaguuucaug

SEQ ID NO: 1001290 - RNA, 18 nt, Human
uacaguauuuucucgccu

SEQ ID NO: 1001291 - RNA, 19 nt, Human
uauguguguguauuuacau

SEQ ID NO: 1001292 - RNA, 22 nt, Human
ucuguguauuugugaccuguau

SEQ ID NO: 1001293 - RNA, 22 nt, Human
uguauauucacugagcaagggg

SEQ ID NO: 1001294 - RNA, 22 nt, Human
auguguauuuuguacuauuggg

SEQ ID NO: 1001295 - RNA, 22 nt, Human
uucuucuuuccaauuacauggu

SEQ ID NO: 1001296 - RNA, 22 nt, Human
gcugauguauauagugauugag

SEQ ID NO: 1001297 - RNA, 22 nt, Human
ugugugucugcacauguauaau

SEQ ID NO: 1001298 - RNA, 22 nt, Human
gccuggccgcuccgagcuccgc

SEQ ID NO: 1001299 - RNA, 22 nt, Human
uacagauagaauuagugaguua

SEQ ID NO: 1001300 - RNA, 22 nt, Human
guuaacuuccccaugucugcau

SEQ ID NO: 1001301 - RNA, 22 nt, Human
ucucucauagagaaaaauauau

SEQ ID NO: 1001302 - RNA, 22 nt, Human
ucucuuuaaaaauagugaaaua

SEQ ID NO: 1001303 - RNA, 22 nt, Human
uugugugguagcuucauugaac

SEQ ID NO: 1001304 - RNA, 22 nt, Human
uuucucauggcccuuggcuuuu

SEQ ID NO: 1001305 - RNA, 22 nt, Human
uucucugugagggugcuggauu

SEQ ID NO: 1001306 - RNA, 22 nt, Human
uguauacaugucugugugcaca

SEQ ID NO: 1001307 - RNA, 18 nt, Human
ccugucugggguccccac

SEQ ID NO: 1001308 - RNA, 22 nt, Human
guuauuuucauuggcucagacu

SEQ ID NO: 1001309 - RNA, 22 nt, Human
gcucugugccacaugcaguguu

SEQ ID NO: 1001310 - RNA, 22 nt, Human
gugacugugagucgcugugaca

SEQ ID NO: 1001311 - RNA, 22 nt, Human
guguugcucuguuuggggguug

SEQ ID NO: 1001312 - RNA, 22 nt, Human
gucuggggguccgggugccugc

SEQ ID NO: 1001313 - RNA, 22 nt, Human
uguguuugaguccucacagugc

SEQ ID NO: 1001314 - RNA, 22 nt, Human
uuaaaguaaucugugugaauuu

SEQ ID NO: 1001315 - RNA, 22 nt, Human
uuacaguacagaaaauaacaga

SEQ ID NO: 1001316 - RNA, 22 nt, Human
guguaucaguaacuguggacag

SEQ ID NO: 1001317 - RNA, 23 nt, Human
auuuacagguuaaaugaaaucag

SEQ ID NO: 1001318 - RNA, 22 nt, Human
auuuucaugacuaccuuaaaua

SEQ ID NO: 1001319 - RNA, 22 nt, Human
acaguuuaugguguuuuauaua

SEQ ID NO: 1001320 - RNA, 22 nt, Human
auguggcuuucugcguuuucuc

SEQ ID NO: 1001321 - RNA, 22 nt, Human
ugugucuaggcucaugcuugcu

SEQ ID NO: 1001322 - RNA, 22 nt, Human
ucaguguguaauucuuuguuuc

SEQ ID NO: 1001323 - RNA, 22 nt, Human
uguacaguacauguguagugau

SEQ ID NO: 1001324 - RNA, 22 nt, Human
uuacaguauuguuaaacucuuu

SEQ ID NO: 1001325 - RNA, 22 nt, Human
uuugaacugauaaucuucuguu

SEQ ID NO: 1001326 - RNA, 22 nt, Human
uucucucuguggucccauuuug

SEQ ID NO: 1001327 - RNA, 17 nt, Human
aguguggcccugguuaa

SEQ ID NO: 1001328 - RNA, 22 nt, Human
ucacaguauagaguuauuuugg

SEQ ID NO: 1001329 - RNA, 22 nt, Human
agcugugugguuugggcaaauu

SEQ ID NO: 1001330 - RNA, 22 nt, Human
cuuuccagcauuuccuugugaa

SEQ ID NO: 1001331 - RNA, 22 nt, Human
cucugugugguccucuguauug

SEQ ID NO: 1001332 - RNA, 22 nt, Human
guguggcugauugacaugguca

SEQ ID NO: 1001333 - RNA, 22 nt, Human
uuuauuauucuguucucucuac

SEQ ID NO: 1001334 - RNA, 22 nt, Human
acuuuucuaagcaauggucuug

SEQ ID NO: 1001335 - RNA, 22 nt, Human
ucuugacauucaaucauguaua

SEQ ID NO: 1001336 - RNA, 22 nt, Human
aggcugugaacucuaugcugaa

SEQ ID NO: 1001337 - RNA, 22 nt, Human
auuuacucgugcuucauugaau

SEQ ID NO: 1001338 - RNA, 22 nt, Human
agcuauauagaugguguguuug

SEQ ID NO: 1001339 - RNA, 22 nt, Human
uuucucuggcauuagguauaaa

SEQ ID NO: 1001340 - RNA, 22 nt, Human
auuuucugugugcagauaaaua

SEQ ID NO: 1001341 - RNA, 22 nt, Human
ucucugugucuuagugaaggga

SEQ ID NO: 1001342 - RNA, 22 nt, Human
uuguggcucaucuucagcuccc

SEQ ID NO: 1001343 - RNA, 22 nt, Human
uuguggcucuugaggcucucgu

SEQ ID NO: 1001344 - RNA, 22 nt, Human
uguggcuguugaggaccccaag

SEQ ID NO: 1001345 - RNA, 22 nt, Human
uuuuuauaccaccucucacuua

SEQ ID NO: 1001346 - RNA, 22 nt, Human
auguggcugccaccugccugaa

SEQ ID NO: 1001347 - RNA, 22 nt, Human
uuacaaguucagauuuucucau

SEQ ID NO: 1001348 - RNA, 22 nt, Human
cuuuucucugcgggucuuucau

SEQ ID NO: 1001349 - RNA, 22 nt, Human
cugugagucuucagcaaguguu

SEQ ID NO: 1001350 - RNA, 22 nt, Human
gcaggauugggcagagggugaa

SEQ ID NO: 1001351 - RNA, 21 nt, Human
ggaagcuguguccaugcuccu

SEQ ID NO: 1001352 - RNA, 22 nt, Human
aacuuuuacaaauugucaucau

SEQ ID NO: 1001353 - RNA, 22 nt, Human
gcugugugcucuggucuuucuu

SEQ ID NO: 1001354 - RNA, 22 nt, Human
guucucucucuugccugggugg

SEQ ID NO: 1001355 - RNA, 22 nt, Human
uuagcuuucagccuuucucacc

SEQ ID NO: 1001356 - RNA, 23 nt, Human
cugcuguguuggucucgauggga

SEQ ID NO: 1001357 - RNA, 22 nt, Human
auuugucuagugguauucacgu

SEQ ID NO: 1001358 - RNA, 22 nt, Human
cugugucuucacauuugugugc

SEQ ID NO: 1001359 - RNA, 22 nt, Human
uacauguauguguuaauaucug

SEQ ID NO: 1001360 - RNA, 22 nt, Human
aguggcuguccuggcucuaacu

SEQ ID NO: 1001361 - RNA, 22 nt, Human
auguggcuggugacugccguac

SEQ ID NO: 1001362 - RNA, 22 nt, Human
uuuucucagcugcacuguauua

SEQ ID NO: 1001363 - RNA, 22 nt, Human
acucucuugggggagagcagag

SEQ ID NO: 1001364 - RNA, 22 nt, Human
cuuuacacaaugauuuucuuua

SEQ ID NO: 1001365 - RNA, 22 nt, Human
uuacuuuccagcucuagcuuca

SEQ ID NO: 1001366 - RNA, 22 nt, Human
acuuuguuuccauauuuguagc

SEQ ID NO: 1001367 - RNA, 22 nt, Human
uaacuuuugugaucugucgauu

SEQ ID NO: 1001368 - RNA, 22 nt, Human
guguguuuagcauuagcagggg

SEQ ID NO: 1001369 - RNA, 22 nt, Human
uucucuguggauugggugagag

SEQ ID NO: 1001370 - RNA, 22 nt, Human
cuggagggaguuaggacccgga

SEQ ID NO: 1001371 - RNA, 18 nt, Human
ugugccucugcaggacgu

SEQ ID NO: 1001372 - RNA, 22 nt, Human
agugugugccuuuggauaccug

SEQ ID NO: 1001373 - RNA, 22 nt, Human
ugucucuccacacagccagugc

SEQ ID NO: 1001374 - RNA, 22 nt, Human
aguggcugcuucugguugcucc

SEQ ID NO: 1001375 - RNA, 22 nt, Human
ucucugugacauuucugagccu

SEQ ID NO: 1001376 - RNA, 22 nt, Human
cguggcugguggaccugagggc

SEQ ID NO: 1001377 - RNA, 22 nt, Human
cuccucuuuggggauuuacaca

SEQ ID NO: 1001378 - RNA, 22 nt, Human
aggcuguguuucuugcguuuuc

SEQ ID NO: 1001379 - RNA, 18 nt, Human
uguguaugucucagggaa

SEQ ID NO: 1001380 - RNA, 22 nt, Human
guuuaugcacuugguuuguguc

SEQ ID NO: 1001381 - RNA, 18 nt, Human
gacagcuguccugagccc

SEQ ID NO: 1001382 - RNA, 22 nt, Human
auguuucugaaguuuacagaua

SEQ ID NO: 1001383 - RNA, 22 nt, Human
uuuucuuuaaucugguggggug

SEQ ID NO: 1001384 - RNA, 22 nt, Human
acuguuuaaaggcuuccuuucu

SEQ ID NO: 1001385 - RNA, 22 nt, Human
uucuaguguccuuggacuugcu

SEQ ID NO: 1001386 - RNA, 22 nt, Human
cucuggggaagcagccagcugg

SEQ ID NO: 1001387 - RNA, 22 nt, Human
uguuaggacuccccagaagcug

SEQ ID NO: 1001388 - RNA, 22 nt, Human
agugugugaccuuuuaauuuaa

SEQ ID NO: 1001389 - RNA, 22 nt, Human
auguguauguguauacacacag

SEQ ID NO: 1001390 - RNA, 22 nt, Human
uuucuauuguaagucuccuaua

SEQ ID NO: 1001391 - RNA, 22 nt, Human
ucuuuauuuuaugcuugugcaa

SEQ ID NO: 1001392 - RNA, 22 nt, Human
cugugugcugaaaugcagugag

SEQ ID NO: 1001393 - RNA, 19 nt, Human
uuugucucugaauaauauu

SEQ ID NO: 1001394 - RNA, 22 nt, Human
cuguguggccucaagccagccu

SEQ ID NO: 1001395 - RNA, 22 nt, Human
uguauuuuuagaccuuuagacc

SEQ ID NO: 1001396 - RNA, 22 nt, Human
cugugauguuagcucuguguua

SEQ ID NO: 1001397 - RNA, 22 nt, Human
ugugccuggaucucugugacaa

SEQ ID NO: 1001398 - RNA, 22 nt, Human
caguuuuagggcaaugugaaga

SEQ ID NO: 1001399 - RNA, 22 nt, Human
acagcuaucugacuuugacuca

SEQ ID NO: 1001400 - RNA, 22 nt, Human
acucuuuuaugcauuccuucag

SEQ ID NO: 1001401 - RNA, 22 nt, Human
aacaguauaugaaauguuagga

SEQ ID NO: 1001402 - RNA, 22 nt, Human
ucguaugcucucuguguccugu

SEQ ID NO: 1001403 - RNA, 22 nt, Human
ucauauuucaaaauggcuggag

SEQ ID NO: 1001404 - RNA, 22 nt, Human
uguuuucugauucucguguggu

SEQ ID NO: 1001405 - RNA, 22 nt, Human
uuucuugucuuuaguaucuggc

SEQ ID NO: 1001406 - RNA, 17 nt, Human
gaacuuuuauuaaauuc

SEQ ID NO: 1001407 - RNA, 22 nt, Human
uuuacagugucuuguugacugu

SEQ ID NO: 1001408 - RNA, 20 nt, Human
uuucacagucccuguuuccu

SEQ ID NO: 1001409 - RNA, 23 nt, Human
uuucaacuccugccauuauuucu

SEQ ID NO: 1001410 - RNA, 23 nt, Human
uacuguauauuacuguguuauac

SEQ ID NO: 1001411 - RNA, 22 nt, Human
guggcuguucuugccccaugcu

SEQ ID NO: 1001412 - RNA, 22 nt, Human
gggcugugggacccggcacuuu

SEQ ID NO: 1001413 - RNA, 22 nt, Human
cuuucucuuacccaaggaucug

SEQ ID NO: 1001414 - RNA, 22 nt, Human
uauacaguuugaguucuugcau

SEQ ID NO: 1001415 - RNA, 22 nt, Human
gugugcugagugacugucauca

SEQ ID NO: 1001416 - RNA, 21 nt, Human
aggauauuaggugauuugggu

SEQ ID NO: 1001417 - RNA, 22 nt, Human
aguguguagcacaugguaagca

SEQ ID NO: 1001418 - RNA, 22 nt, Human
aguuuucugccucuggaugcgu

SEQ ID NO: 1001419 - RNA, 22 nt, Human
gugcugccggcauagcagugaa

SEQ ID NO: 1001420 - RNA, 22 nt, Human
cuuuucucuuacauuccacugg

SEQ ID NO: 1001421 - RNA, 22 nt, Human
uucugucucccugauguagagc

SEQ ID NO: 1001422 - RNA, 22 nt, Human
augugugugugcgcgcgcagga

SEQ ID NO: 1001423 - RNA, 17 nt, Human
augugucugaguguccu

SEQ ID NO: 1001424 - RNA, 22 nt, Human
uuaaucuucagggacucuugcu

SEQ ID NO: 1001425 - RNA, 22 nt, Human
cuguggcucucagaggcugcug

SEQ ID NO: 1001426 - RNA, 22 nt, Human
ucugggugcccuuugcucuguu

SEQ ID NO: 1001427 - RNA, 22 nt, Human
cugagagaaacaugacucagga

SEQ ID NO: 1001428 - RNA, 22 nt, Human
ucucuugugguuuuguaguuga

SEQ ID NO: 1001429 - RNA, 22 nt, Human
uuuuuaucuacagauucucagc

SEQ ID NO: 1001430 - RNA, 22 nt, Human
ucagugugauuaggcuaucuga

SEQ ID NO: 1001431 - RNA, 22 nt, Human
uaacuguugugcgggucucugg

SEQ ID NO: 1001432 - RNA, 22 nt, Human
aacuguuuggaacucuuccaca

SEQ ID NO: 1001433 - RNA, 22 nt, Human
uacuguaugauuucauguauau

SEQ ID NO: 1001434 - RNA, 22 nt, Human
gcagcugcuggaaguuccugcc

SEQ ID NO: 1001435 - RNA, 22 nt, Human
uucacaguauagguuuccagcg

SEQ ID NO: 1001436 - RNA, 17 nt, Human
gguguauggggagggaa

SEQ ID NO: 1001437 - RNA, 22 nt, Human
ggcuguauauacuguauacagu

SEQ ID NO: 1001438 - RNA, 22 nt, Human
aggcuguguuuaagugguaaug

SEQ ID NO: 1001439 - RNA, 22 nt, Human
cuuuccaggcugaguuugcuug

SEQ ID NO: 1001440 - RNA, 22 nt, Human
uggucuguucaagguggcugau

SEQ ID NO: 1001441 - RNA, 20 nt, Human
uggauucuggagcugcccuc

SEQ ID NO: 1001442 - RNA, 22 nt, Human
cucugugucugaagcccuauuu

SEQ ID NO: 1001443 - RNA, 19 nt, Human
ccuggcccugcugcgcggg

SEQ ID NO: 1001444 - RNA, 21 nt, Human
uuguaugcauacauacacaca

SEQ ID NO: 1001445 - RNA, 22 nt, Human
gaguauauauagacaugucaca

SEQ ID NO: 1001446 - RNA, 22 nt, Human
gcucuaacuauuaagaggucau

SEQ ID NO: 1001447 - RNA, 22 nt, Human
cuucugugguaaacuuuguugu

SEQ ID NO: 1001448 - RNA, 22 nt, Human
aggcugugaguaguucuuguug

SEQ ID NO: 1001449 - RNA, 22 nt, Human
ugugugugcacaugcauauaca

SEQ ID NO: 1001450 - RNA, 22 nt, Human
aguggcugauguaggcaguggg

SEQ ID NO: 1001451 - RNA, 22 nt, Human
acuuuugaacaaacuccucugu

SEQ ID NO: 1001452 - RNA, 22 nt, Human
aucuguguccuuauaagagaca

SEQ ID NO: 1001453 - RNA, 22 nt, Human
guuuuauuuccaugagagaccg

SEQ ID NO: 1001454 - RNA, 22 nt, Human
cuuuuuauaccgugccaguuga

SEQ ID NO: 1001455 - RNA, 22 nt, Human
ggcuggguacagggcagugugc

SEQ ID NO: 1001456 - RNA, 22 nt, Human
ucuauuacuuaccacuaauuca

SEQ ID NO: 1001457 - RNA, 21 nt, Human
aguguguguggaaugagaaua

SEQ ID NO: 1001458 - RNA, 22 nt, Human
acuuucuuauccaugaucucac

SEQ ID NO: 1001459 - RNA, 22 nt, Human
uuucuaucugagaagauaucua

SEQ ID NO: 1001460 - RNA, 22 nt, Human
uuucucugccaguuauuuuccu

SEQ ID NO: 1001461 - RNA, 22 nt, Human
uuccuguguguugguggcagaa

SEQ ID NO: 1001462 - RNA, 22 nt, Human
guguguggcauguccuauuuug

SEQ ID NO: 1001463 - RNA, 22 nt, Human
ggcuguaguuaccugaugaaau

SEQ ID NO: 1001464 - RNA, 22 nt, Human
gcugucuggcauggcguggcug

SEQ ID NO: 1001465 - RNA, 22 nt, Human
acugugugacuguuauuacugu

SEQ ID NO: 1001466 - RNA, 22 nt, Human
cuggccugugggcugucuccgg

SEQ ID NO: 1001467 - RNA, 20 nt, Human
aacuuguucuaccuguuuca

SEQ ID NO: 1001468 - RNA, 21 nt, Human
auguggcucccuuccucagga

SEQ ID NO: 1001469 - RNA, 22 nt, Human
cuuuacagccccacuuccgggc

SEQ ID NO: 1001470 - RNA, 22 nt, Human
uucugcucuuggcuuugcuggu

SEQ ID NO: 1001471 - RNA, 22 nt, Human
guguguauguagaacuauguau

SEQ ID NO: 1001472 - RNA, 22 nt, Human
ucugugugugccuguuaauauu

SEQ ID NO: 1001473 - RNA, 22 nt, Human
cuucuguggauguuggaugcau

SEQ ID NO: 1001474 - RNA, 23 nt, Human
aguacauucgaaaaauucuguga

SEQ ID NO: 1001475 - RNA, 22 nt, Human
uauuugucuaagaggcugacag

SEQ ID NO: 1001476 - RNA, 22 nt, Human
gcugcccucucuggccccacac

SEQ ID NO: 1001477 - RNA, 22 nt, Human
aggcugugacuacgcagggaag

SEQ ID NO: 1001478 - RNA, 22 nt, Human
auuuacaguuuagcauuucaag

SEQ ID NO: 1001479 - RNA, 22 nt, Human
guguguguacucuguauauaaa

SEQ ID NO: 1001480 - RNA, 22 nt, Human
ccuuuacacauggaaugggucu

SEQ ID NO: 1001481 - RNA, 22 nt, Human
aggcugugggaauggcugcuug

SEQ ID NO: 1001482 - RNA, 22 nt, Human
agcugcccaauccugcagggcg

SEQ ID NO: 1001483 - RNA, 22 nt, Human
uuuacauugcauuagguauuau

SEQ ID NO: 1001484 - RNA, 22 nt, Human
uaucuucuugccaggcuggugu

SEQ ID NO: 1001485 - RNA, 22 nt, Human
uauguucuagacuuuugcugug

SEQ ID NO: 1001486 - RNA, 22 nt, Human
uucucuucccacuuucuguauu

SEQ ID NO: 1001487 - RNA, 22 nt, Human
uacaguauagaauguguauuaa

SEQ ID NO: 1001488 - RNA, 23 nt, Human
uuacaguaggaguuggaaaacca

SEQ ID NO: 1001489 - RNA, 22 nt, Human
cagcuauauuguuuucuacugu

SEQ ID NO: 1001490 - RNA, 23 nt, Human
acuccccagucucuucuugccaa

SEQ ID NO: 1001491 - RNA, 22 nt, Human
gucacaggccuggaugaggggc

SEQ ID NO: 1001492 - RNA, 22 nt, Human
cucucuccuuagcugcagacca

SEQ ID NO: 1001493 - RNA, 22 nt, Human
uggcaucuccgacagucuugau

SEQ ID NO: 1001494 - RNA, 23 nt, Human
aguguugguugggaagccaagca

SEQ ID NO: 1001495 - RNA, 22 nt, Human
ccuggcagacugugagggcagg

SEQ ID NO: 1001496 - RNA, 22 nt, Human
uccacccugcuuuugucuuuga

SEQ ID NO: 1001497 - RNA, 22 nt, Human
uuccuggccccaccccuggaga

SEQ ID NO: 1001498 - RNA, 22 nt, Human
gagaaagauguaggcugggagg

SEQ ID NO: 1001499 - RNA, 22 nt, Human
ggagccugaaaagucugcauuu

SEQ ID NO: 1001500 - RNA, 22 nt, Human
cggcuggugucgggcacagcaa

SEQ ID NO: 1001501 - RNA, 23 nt, Human
uuggagagggugaguagugucag

SEQ ID NO: 1001502 - RNA, 22 nt, Human
cugccugccuuggccuccagga

SEQ ID NO: 1001503 - RNA, 22 nt, Human
ucuggcagcuauccucuggcca

SEQ ID NO: 1001504 - RNA, 22 nt, Human
ccuggcagcgccgaagcuggcc

SEQ ID NO: 1001505 - RNA, 22 nt, Human
cuggcaguuugccaggagcucg

SEQ ID NO: 1001506 - RNA, 22 nt, Human
gaggagcucugcuccauccuuc

SEQ ID NO: 1001507 - RNA, 22 nt, Human
uguggggaagaguaugacuugg

SEQ ID NO: 1001508 - RNA, 20 nt, Human
gcuccaggucagagaggacg

SEQ ID NO: 1001509 - RNA, 21 nt, Human
ccuagccucuuacccagcuuu

SEQ ID NO: 1001510 - RNA, 22 nt, Human
ucuggcaggaccaugaagcgua

SEQ ID NO: 1001511 - RNA, 22 nt, Human
gccuccuguuaugccaugugcc

SEQ ID NO: 1001512 - RNA, 22 nt, Human
cuccugaggaaaagcuugguca

SEQ ID NO: 1001513 - RNA, 22 nt, Human
cuggcaguuggcauuggcaucu

SEQ ID NO: 1001514 - RNA, 22 nt, Human
ccuggcagcuccguggccuucc

SEQ ID NO: 1001515 - RNA, 22 nt, Human
cuggcaguauuaagagaaguga

SEQ ID NO: 1001516 - RNA, 22 nt, Human
cccugagcucaggcccuugggg

SEQ ID NO: 1001517 - RNA, 22 nt, Human
cccagccugugacagccguccu

SEQ ID NO: 1001518 - RNA, 22 nt, Human
gcagggacagggcagggccuuu

SEQ ID NO: 1001519 - RNA, 22 nt, Human
ucccaccccggucaagggcuga

SEQ ID NO: 1001520 - RNA, 21 nt, Human
ucuggcaggaagacggauggg

SEQ ID NO: 1001521 - RNA, 22 nt, Human
gcuggcaggagaaacggggugc

SEQ ID NO: 1001522 - RNA, 22 nt, Human
accugccucagugcagcuggau

SEQ ID NO: 1001523 - RNA, 22 nt, Human
ggugccaggcuguagucagggu

SEQ ID NO: 1001524 - RNA, 22 nt, Human
gcuccaggaggaugaccuuccu

SEQ ID NO: 1001525 - RNA, 22 nt, Human
agcacaggaacauggagauggg

SEQ ID NO: 1001526 - RNA, 22 nt, Human
cuccuggcuuucccagaccagg

SEQ ID NO: 1001527 - RNA, 22 nt, Human
gccuggcacaggaauuaggagg

SEQ ID NO: 1001528 - RNA, 22 nt, Human
guggcagugaaggucauagcau

SEQ ID NO: 1001529 - RNA, 17 nt, Human
uugggagagaaagguau

SEQ ID NO: 1001530 - RNA, 22 nt, Human
gagccugaugaaacaggcagac

SEQ ID NO: 1001531 - RNA, 22 nt, Human
ccugaccuauuuuucucagcug

SEQ ID NO: 1001532 - RNA, 22 nt, Human
gacaaaaguguuuugaacaagg

SEQ ID NO: 1001533 - RNA, 22 nt, Human
guccuggcccacuggcaggcug

SEQ ID NO: 1001534 - RNA, 22 nt, Human
ccuggcagcuaagugcuuugag

SEQ ID NO: 1001535 - RNA, 22 nt, Human
ggccucucagggcagagacccu

SEQ ID NO: 1001536 - RNA, 22 nt, Human
ccuggcaguggugaagaagagg

SEQ ID NO: 1001537 - RNA, 19 nt, Human
uggcagguagugagcaguc

SEQ ID NO: 1001538 - RNA, 20 nt, Human
agggcugagaagggacuagc

SEQ ID NO: 1001539 - RNA, 22 nt, Human
uccaggcuuuuucaugcugucu

SEQ ID NO: 1001540 - RNA, 20 nt, Human
aaaagagugcuucaacugcu

SEQ ID NO: 1001541 - RNA, 22 nt, Human
cugccucuauaggaguccacca

SEQ ID NO: 1001542 - RNA, 22 nt, Human
caggaguggugugagggacucc

SEQ ID NO: 1001543 - RNA, 22 nt, Human
uccaggccauugacugcauccu

SEQ ID NO: 1001544 - RNA, 22 nt, Human
cccagccuacucugccauagca

SEQ ID NO: 1001545 - RNA, 22 nt, Human
ccuggcagacagcacugaagcu

SEQ ID NO: 1001546 - RNA, 22 nt, Human
cugccugcaggacaccucgcua

SEQ ID NO: 1001547 - RNA, 22 nt, Human
gccuggcauauaguaguugugc

SEQ ID NO: 1001548 - RNA, 22 nt, Human
aggaggcugggcacaguggccu

SEQ ID NO: 1001549 - RNA, 23 nt, Human
uugggaaauaguuaagacaugag

SEQ ID NO: 1001550 - RNA, 22 nt, Human
gaaagacuuccuuugagaguac

SEQ ID NO: 1001551 - RNA, 22 nt, Human
guggcagugggaugcuaucagg

SEQ ID NO: 1001552 - RNA, 22 nt, Human
ucccagccuuccagucugguuu

SEQ ID NO: 1001553 - RNA, 21 nt, Human
ucuggcagcaguuuguugagu

SEQ ID NO: 1001554 - RNA, 22 nt, Human
uggccucugugggagcugagca

SEQ ID NO: 1001555 - RNA, 19 nt, Human
acuggcagggcugcggugg

SEQ ID NO: 1001556 - RNA, 22 nt, Human
uccuggcaaagauguugguguu

SEQ ID NO: 1001557 - RNA, 22 nt, Human
gucaggacucugacccgucccg

SEQ ID NO: 1001558 - RNA, 22 nt, Human
ucuggcagggucagggcccagg

SEQ ID NO: 1001559 - RNA, 22 nt, Human
uccugagcuacaguaguaugau

SEQ ID NO: 1001560 - RNA, 22 nt, Human
ugccagccagggaagcucaccc

SEQ ID NO: 1001561 - RNA, 22 nt, Human
ggagagaauuccauggacaugu

SEQ ID NO: 1001562 - RNA, 22 nt, Human
uggcagggugccaguugcgagu

SEQ ID NO: 1001563 - RNA, 20 nt, Human
acuggcagccugccugcugu

SEQ ID NO: 1001564 - RNA, 22 nt, Human
ucuggcagagugauaggauaag

SEQ ID NO: 1001565 - RNA, 22 nt, Human
gccuggcaggccuguuggggcu

SEQ ID NO: 1001566 - RNA, 22 nt, Human
ggcacagggggcugaggacuag

SEQ ID NO: 1001567 - RNA, 22 nt, Human
aggaaagauggaaggaggauaa

SEQ ID NO: 1001568 - RNA, 22 nt, Human
cagguugguauucaucuccaca

SEQ ID NO: 1001569 - RNA, 22 nt, Human
aacaaaagccgaaguagguguc

SEQ ID NO: 1001570 - RNA, 22 nt, Human
acuggcagaggauagcacuaau

SEQ ID NO: 1001571 - RNA, 21 nt, Human
ucacguggucacaugagcuuu

SEQ ID NO: 1001572 - RNA, 23 nt, Human
ugagggacaugguggcuucugag

SEQ ID NO: 1001573 - RNA, 22 nt, Human
gguguugggcucacugguccuu

SEQ ID NO: 1001574 - RNA, 22 nt, Human
ccuggcagaauauuaaagugca

SEQ ID NO: 1001575 - RNA, 22 nt, Human
gccuccggagucacagugucuu

SEQ ID NO: 1001576 - RNA, 22 nt, Human
cccagccuuccacccuggacua

SEQ ID NO: 1001577 - RNA, 21 nt, Human
gggagggauggaaaugauguu

SEQ ID NO: 1001578 - RNA, 22 nt, Human
ccuggcagguagcauugaggag

SEQ ID NO: 1001579 - RNA, 22 nt, Human
uggccuccccuaacagccucuu

SEQ ID NO: 1001580 - RNA, 22 nt, Human
aaagaucacgucccaggacucg

SEQ ID NO: 1001581 - RNA, 22 nt, Human
guccacagagggcugggcaggc

SEQ ID NO: 1001582 - RNA, 22 nt, Human
ccuggcagccucagccaauucu

SEQ ID NO: 1001583 - RNA, 22 nt, Human
cuggccucuguguucaccauag

SEQ ID NO: 1001584 - RNA, 22 nt, Human
gcuggcagguaaagccccgggg

SEQ ID NO: 1001585 - RNA, 22 nt, Human
gaugccuggcacccagcaagga

SEQ ID NO: 1001586 - RNA, 22 nt, Human
gacucugggcugagccagggcc

SEQ ID NO: 1001587 - RNA, 18 nt, Human
cuccuggcugauggugag

SEQ ID NO: 1001588 - RNA, 22 nt, Human
cccugagcgugaggaggaagua

SEQ ID NO: 1001589 - RNA, 22 nt, Human
ucuggcagggguucugcacuug

SEQ ID NO: 1001590 - RNA, 22 nt, Human
ucccuccccacuucugagcuuu

SEQ ID NO: 1001591 - RNA, 22 nt, Human
agguagggaagaaggcaugaaa

SEQ ID NO: 1001592 - RNA, 22 nt, Human
caggucccugcgccccggccuc

SEQ ID NO: 1001593 - RNA, 22 nt, Human
aggaggcugaacuagggucugg

SEQ ID NO: 1001594 - RNA, 22 nt, Human
aagucguggcaggcuugcacga

SEQ ID NO: 1001595 - RNA, 22 nt, Human
ucuggcaguuugagaaaggcua

SEQ ID NO: 1001596 - RNA, 22 nt, Human
uuccaggcucccuuggaggugu

SEQ ID NO: 1001597 - RNA, 22 nt, Human
uggcaguagauccagucucucu

SEQ ID NO: 1001598 - RNA, 22 nt, Human
cuccuggcaggcugagugaaau

SEQ ID NO: 1001599 - RNA, 22 nt, Human
ucccagccacaguuuccaccug

SEQ ID NO: 1001600 - RNA, 22 nt, Human
ccuggcaggacuguuguaagaa

SEQ ID NO: 1001601 - RNA, 18 nt, Human
gccugcucugcucucccc

SEQ ID NO: 1001602 - RNA, 22 nt, Human
ugcuccagugccugccccacag

SEQ ID NO: 1001603 - RNA, 22 nt, Human
guugggaaggcaagaaguagaa

SEQ ID NO: 1001604 - RNA, 22 nt, Human
ucuggcagaagugcugucagua

SEQ ID NO: 1001605 - RNA, 22 nt, Human
aggccuccagccacaugccagu

SEQ ID NO: 1001606 - RNA, 22 nt, Human
acccacccuacuagcagugucc

SEQ ID NO: 1001607 - RNA, 22 nt, Human
ucuggcagcgaagcguguacuu

SEQ ID NO: 1001608 - RNA, 22 nt, Human
gggccccuuguaucucuggcuc

SEQ ID NO: 1001609 - RNA, 22 nt, Human
aaagagucuggcacuguaccag

SEQ ID NO: 1001610 - RNA, 22 nt, Human
gguggcagaggugcaucagccc

SEQ ID NO: 1001611 - RNA, 22 nt, Human
agggccccauagucacugcccg

SEQ ID NO: 1001612 - RNA, 22 nt, Human
aggaggcugcaacccugaggcc

SEQ ID NO: 1001613 - RNA, 19 nt, Human
gcuggcagauguggccgug

SEQ ID NO: 1001614 - RNA, 22 nt, Human
cccaggccuggucugggccagu

SEQ ID NO: 1001615 - RNA, 22 nt, Human
gcuccaggcagcauaguggaug

SEQ ID NO: 1001616 - RNA, 22 nt, Human
ucuggcagagucagugcacaca

SEQ ID NO: 1001617 - RNA, 22 nt, Human
gaggcugcuuugaugacaggag

SEQ ID NO: 1001618 - RNA, 22 nt, Human
uccaggcuaauuuugcauuguu

SEQ ID NO: 1001619 - RNA, 22 nt, Human
ccuggcagggcugcaguaaugg

SEQ ID NO: 1001620 - RNA, 22 nt, Human
gacuguggggggcggacacaag

SEQ ID NO: 1001621 - RNA, 22 nt, Human
cuccaggccauggcugcggagg

SEQ ID NO: 1001622 - RNA, 22 nt, Human
aggaagaacagauaauggacgc

SEQ ID NO: 1001623 - RNA, 22 nt, Human
ucuggcaguaauaggggagaga

SEQ ID NO: 1001624 - RNA, 22 nt, Human
gaggacucugggcguguauggg

SEQ ID NO: 1001625 - RNA, 22 nt, Human
gcugcgccggaucccacguucc

SEQ ID NO: 1001626 - RNA, 22 nt, Human
acaagagcauugcagguguguu

SEQ ID NO: 1001627 - RNA, 22 nt, Human
uccugagcugccgcaucagcag

SEQ ID NO: 1001628 - RNA, 22 nt, Human
ccuggcagcagcacaugccuuc

SEQ ID NO: 1001629 - RNA, 19 nt, Human
ugccuggcaccagcuccac

SEQ ID NO: 1001630 - RNA, 22 nt, Human
ccuccccaugacccggugcugg

SEQ ID NO: 1001631 - RNA, 22 nt, Human
ggugccagaguggcccaggggc

SEQ ID NO: 1001632 - RNA, 22 nt, Human
gccucaggccgcccugcugcuc

SEQ ID NO: 1001633 - RNA, 22 nt, Human
ccuggcagguggcgcccucggc

SEQ ID NO: 1001634 - RNA, 22 nt, Human
acuggcagccacaacuggcagg

SEQ ID NO: 1001635 - RNA, 22 nt, Human
ucuggcaguggaugagggcagc

SEQ ID NO: 1001636 - RNA, 19 nt, Human
guccuggcgccgccacacc

SEQ ID NO: 1001637 - RNA, 19 nt, Human
acuggcagcuguagucugu

SEQ ID NO: 1001638 - RNA, 22 nt, Human
caccagggccccaggcugugcc

SEQ ID NO: 1001639 - RNA, 22 nt, Human
gagacacacauucuggagagaa

SEQ ID NO: 1001640 - RNA, 19 nt, Human
gcuggcagaauuuugaacc

SEQ ID NO: 1001641 - RNA, 22 nt, Human
ccucuccuugcacccgucccgc

SEQ ID NO: 1001642 - RNA, 20 nt, Human
aagagucuuuacugagcuaa

SEQ ID NO: 1001643 - RNA, 22 nt, Human
uggccugccacugccacgccac

SEQ ID NO: 1001644 - RNA, 22 nt, Human
gcuggcaguguauuguuagcug

SEQ ID NO: 1001645 - RNA, 18 nt, Human
ggcagggaaaagauaggg

SEQ ID NO: 1001646 - RNA, 22 nt, Human
uccuggcacccuuggguuggag

SEQ ID NO: 1001647 - RNA, 22 nt, Human
gcuggcaggguucucacugaaa

SEQ ID NO: 1001648 - RNA, 22 nt, Human
cuccaggccccuggccuucugc

SEQ ID NO: 1001649 - RNA, 22 nt, Human
caggagggcccgagacucuucc

SEQ ID NO: 1001650 - RNA, 22 nt, Human
gcuggcagaagagcugguucaa

SEQ ID NO: 1001651 - RNA, 22 nt, Human
uuccaggcugaugggccacagg

SEQ ID NO: 1001652 - RNA, 22 nt, Human
acuggcagguccaucgcccuuu

SEQ ID NO: 1001653 - RNA, 22 nt, Human
ucuggcagcaagucuguuucuc

SEQ ID NO: 1001654 - RNA, 17 nt, Human
ugcuggcaacauacaaa

SEQ ID NO: 1001655 - RNA, 22 nt, Human
gccccaccuugagagcagaaac

SEQ ID NO: 1001656 - RNA, 22 nt, Human
ccagccucacuggcaucaccua

SEQ ID NO: 1001657 - RNA, 22 nt, Human
gccuggcaaggcccuguugacu

SEQ ID NO: 1001658 - RNA, 22 nt, Human
ccuggcagcauugguagagauu

SEQ ID NO: 1001659 - RNA, 19 nt, Human
gggagcugaggucuuuggu

SEQ ID NO: 1001660 - RNA, 22 nt, Human
cugccugccacguucagcugua

SEQ ID NO: 1001661 - RNA, 21 nt, Human
agugccaguagguauggagga

SEQ ID NO: 1001662 - RNA, 22 nt, Human
acuggcaguuugagaaugcauu

SEQ ID NO: 1001663 - RNA, 21 nt, Human
ucuggcaggcacgggcccagc

SEQ ID NO: 1001664 - RNA, 22 nt, Human
cagguggguguaugaaugcaaa

SEQ ID NO: 1001665 - RNA, 22 nt, Human
uccacccugcuuucuuaucucc

SEQ ID NO: 1001666 - RNA, 22 nt, Human
ccuggcagcaggugggcccgug

SEQ ID NO: 1001667 - RNA, 22 nt, Human
gcuggcagugugaaugacaagc

SEQ ID NO: 1001668 - RNA, 22 nt, Human
uuccaggcuucucuggggcguc

SEQ ID NO: 1001669 - RNA, 22 nt, Human
agaggccuccgaaaggugggcu

SEQ ID NO: 1001670 - RNA, 17 nt, Human
gccuucucugcccucac

SEQ ID NO: 1001671 - RNA, 22 nt, Human
cuuggcaguuucggaaggauga

SEQ ID NO: 1001672 - RNA, 22 nt, Human
ccagguccuguuuucaccacag

SEQ ID NO: 1001673 - RNA, 19 nt, Human
ucuggcagguaauuaggga

SEQ ID NO: 1001674 - RNA, 22 nt, Human
ggcagagguagcuggaaccagg

SEQ ID NO: 1001675 - RNA, 22 nt, Human
ugaccaggauacugcagggaug

SEQ ID NO: 1001676 - RNA, 22 nt, Human
ucaggcccuucucccaggacuc

SEQ ID NO: 1001677 - RNA, 22 nt, Human
uccaggcaaaaaccaacuacag

SEQ ID NO: 1001678 - RNA, 22 nt, Human
gcacucuccuggcugccacagu

SEQ ID NO: 1001679 - RNA, 22 nt, Human
uccugugccaucucuagagacu

SEQ ID NO: 1001680 - RNA, 22 nt, Human
uccugagcccuguaggacccug

SEQ ID NO: 1001681 - RNA, 21 nt, Human
cccuugccugcacuccucggc

SEQ ID NO: 1001682 - RNA, 22 nt, Human
uugggaagaauggaggugguua

SEQ ID NO: 1001683 - RNA, 20 nt, Human
aaagagcccuuggagcaggc

SEQ ID NO: 1001684 - RNA, 22 nt, Human
caggauggucucgaucuccuga

SEQ ID NO: 1001685 - RNA, 22 nt, Human
uccugagccugacaaucaccau

SEQ ID NO: 1001686 - RNA, 19 nt, Human
guccucucaacaacccggg

SEQ ID NO: 1001687 - RNA, 18 nt, Human
acucugcggaggccccag

SEQ ID NO: 1001688 - RNA, 17 nt, Human
gcccacccuuaggagcu

SEQ ID NO: 1001689 - RNA, 22 nt, Human
gaagagaaaggcaaggaguuuu

SEQ ID NO: 1001690 - RNA, 22 nt, Human
ugcuggcacguggaccaggaga

SEQ ID NO: 1001691 - RNA, 22 nt, Human
gguuccuucugaggucccugua

SEQ ID NO: 1001692 - RNA, 22 nt, Human
gcuggcagucccaucagcuggg

SEQ ID NO: 1001693 - RNA, 22 nt, Human
agacaagaaacugggagucucu

SEQ ID NO: 1001694 - RNA, 18 nt, Human
gacaaaaguacagacaga

SEQ ID NO: 1001695 - RNA, 22 nt, Human
ucuggcaggucaaucauucuuu

SEQ ID NO: 1001696 - RNA, 22 nt, Human
aggccacaguacuuugcagacc

SEQ ID NO: 1001697 - RNA, 22 nt, Human
aggaagaaccuaagaaagucuc

SEQ ID NO: 1001698 - RNA, 22 nt, Human
uccugagcaacacagcuaagug

SEQ ID NO: 1001699 - RNA, 22 nt, Human
aggcacaggaggugguaagaag

SEQ ID NO: 1001700 - RNA, 22 nt, Human
cccuuccuugauuuuaacugga

SEQ ID NO: 1001701 - RNA, 22 nt, Human
uucuuucaauagcuggcauaug

SEQ ID NO: 1001702 - RNA, 22 nt, Human
cugccugcuuaccaugcaucag

SEQ ID NO: 1001703 - RNA, 17 nt, Human
uuaagguggaucagcac

SEQ ID NO: 1001704 - RNA, 22 nt, Human
uccugagcacagagacaaggaa

SEQ ID NO: 1001705 - RNA, 22 nt, Human
cuccuggcucgcccccagcuga

SEQ ID NO: 1001706 - RNA, 22 nt, Human
acagguggcuuauuggcugauu

SEQ ID NO: 1001707 - RNA, 22 nt, Human
uuccuggcucacagcagugggg

SEQ ID NO: 1001708 - RNA, 22 nt, Human
cccagccucuguuugcuccucu

SEQ ID NO: 1001709 - RNA, 22 nt, Human
aaaagagugacugauaaguaua

SEQ ID NO: 1001710 - RNA, 22 nt, Human
ggccucagagaaggcugugcgg

SEQ ID NO: 1001711 - RNA, 22 nt, Human
ggagaagaggagcuggaagccu

SEQ ID NO: 1001712 - RNA, 22 nt, Human
guggcagucgcugacagauaca

SEQ ID NO: 1001713 - RNA, 22 nt, Human
ccugccucccagagguccucua

SEQ ID NO: 1001714 - RNA, 22 nt, Human
uggcaguggcucagagugcaga

SEQ ID NO: 1001715 - RNA, 22 nt, Human
aggacaagcuaaaggacuuccu

SEQ ID NO: 1001716 - RNA, 22 nt, Human
uggaaagagguagaggaucugg

SEQ ID NO: 1001717 - RNA, 22 nt, Human
gccacagguacuaugggagaga

SEQ ID NO: 1001718 - RNA, 22 nt, Human
ggcaaggggucaggcugagaca

SEQ ID NO: 1001719 - RNA, 18 nt, Human
cuccuccacagccccugc

SEQ ID NO: 1001720 - RNA, 22 nt, Human
ucuuuuucugcacacguguccc

SEQ ID NO: 1001721 - RNA, 22 nt, Human
aagagccagcuagugaagaggc

SEQ ID NO: 1001722 - RNA, 22 nt, Human
ccuggcagguggagguugcagu

SEQ ID NO: 1001723 - RNA, 22 nt, Human
gcccucucuucugcagccucca

SEQ ID NO: 1001724 - RNA, 21 nt, Human
agaugcugaugcugcaggucc

SEQ ID NO: 1001725 - RNA, 22 nt, Human
cccacccugggaagcuaggcag

SEQ ID NO: 1001726 - RNA, 22 nt, Human
cccuuccuugugacuggugggg

SEQ ID NO: 1001727 - RNA, 22 nt, Human
uggaaagaggaagugcccagca

SEQ ID NO: 1001728 - RNA, 22 nt, Human
acuggcaggcugcuggccggcg

SEQ ID NO: 1001729 - RNA, 22 nt, Human
gccuggcacucaaucaucugcu

SEQ ID NO: 1001730 - RNA, 22 nt, Human
cccacccucaagggugucuaua

SEQ ID NO: 1001731 - RNA, 22 nt, Human
aggcuggauuuauggggacuuc

SEQ ID NO: 1001732 - RNA, 22 nt, Human
agcacaggcuuuggugugaggg

SEQ ID NO: 1001733 - RNA, 22 nt, Human
aaagaaucagaagucucaaaca

SEQ ID NO: 1001734 - RNA, 22 nt, Human
cccuuccucccaggcuucugug

SEQ ID NO: 1001735 - RNA, 22 nt, Human
ggagucugcucccagacaugau

SEQ ID NO: 1001736 - RNA, 22 nt, Human
uuggagagauuuaggucucagu

SEQ ID NO: 1001737 - RNA, 22 nt, Human
caggacaaagcccuuugagaaa

SEQ ID NO: 1001738 - RNA, 22 nt, Human
aagagcacuaacagagcugaua

SEQ ID NO: 1001739 - RNA, 22 nt, Human
aggaggcuuuugcaggugccac

SEQ ID NO: 1001740 - RNA, 22 nt, Human
augacugcucugggcucccaug

SEQ ID NO: 1001741 - RNA, 22 nt, Human
uggcagugguaccggcucucag

SEQ ID NO: 1001742 - RNA, 22 nt, Human
ggagacucggguucuagccuug

SEQ ID NO: 1001743 - RNA, 22 nt, Human
acuggcagagguuggacaccau

SEQ ID NO: 1001744 - RNA, 22 nt, Human
ucuggcagugaagucaugaggu

SEQ ID NO: 1001745 - RNA, 22 nt, Human
gaccugccugagcugccucugc

SEQ ID NO: 1001746 - RNA, 22 nt, Human
gcuggcagacugggggcagaac

SEQ ID NO: 1001747 - RNA, 22 nt, Human
acuggcagcuguaggaugcaug

SEQ ID NO: 1001748 - RNA, 22 nt, Human
ccaggcccaggguacugaccaa

SEQ ID NO: 1001749 - RNA, 22 nt, Human
uccuggcagagggcggccucga

SEQ ID NO: 1001750 - RNA, 22 nt, Human
gcagccucaaacuccccagcuc

SEQ ID NO: 1001751 - RNA, 22 nt, Human
acaggugguaaaauggacuguc

SEQ ID NO: 1001752 - RNA, 22 nt, Human
uuccugccccugagagcuccca

SEQ ID NO: 1001753 - RNA, 22 nt, Human
acuggcagaacuggugauuguc

SEQ ID NO: 1001754 - RNA, 22 nt, Human
auggccugcagugcugccacag

SEQ ID NO: 1001755 - RNA, 22 nt, Human
ugguaagaacccaucagagaag

SEQ ID NO: 1001756 - RNA, 22 nt, Human
acagguggccccgagggagugg

SEQ ID NO: 1001757 - RNA, 22 nt, Human
ggcaagagggcagauggagugc

SEQ ID NO: 1001758 - RNA, 22 nt, Human
ucuggcagcaagauaacaaugg

SEQ ID NO: 1001759 - RNA, 22 nt, Human
ccugccuucagcccugaagucu

SEQ ID NO: 1001760 - RNA, 22 nt, Human
aaaaagucugcaaaggagguug

SEQ ID NO: 1001761 - RNA, 22 nt, Human
gauggccuggguccccuuccgg

SEQ ID NO: 1001762 - RNA, 22 nt, Human
uccaggcaagggaggagcaugg

SEQ ID NO: 1001763 - RNA, 22 nt, Human
ccucccuucaguagagcccaau

SEQ ID NO: 1001764 - RNA, 22 nt, Human
cagccaggauggagaacuguug

SEQ ID NO: 1001765 - RNA, 22 nt, Human
ggggcugagucagugggaagag

SEQ ID NO: 1001766 - RNA, 22 nt, Human
cccaggccagaacuugguugcu

SEQ ID NO: 1001767 - RNA, 22 nt, Human
gcuggcaggagccuuucccuuu

SEQ ID NO: 1001768 - RNA, 22 nt, Human
ccagcccuugcugaaggguggc

SEQ ID NO: 1001769 - RNA, 22 nt, Human
acagguggggcacuuggagccu

SEQ ID NO: 1001770 - RNA, 22 nt, Human
aaagagucguguuccagguuug

SEQ ID NO: 1001771 - RNA, 22 nt, Human
gaggagcucaugaaagcggugu

SEQ ID NO: 1001772 - RNA, 22 nt, Human
ucuggcaggcaaucggcucugg

SEQ ID NO: 1001773 - RNA, 22 nt, Human
gcuggcaguaaaggguuuggca

SEQ ID NO: 1001774 - RNA, 23 nt, Human
uccaggagcaugcuggcuggcga

SEQ ID NO: 1001775 - RNA, 22 nt, Human
aaaagagucuuaggcagucaua

SEQ ID NO: 1001776 - RNA, 22 nt, Human
cccuuccugggugucccggagu

SEQ ID NO: 1001777 - RNA, 22 nt, Human
aggcaggggagcuggaagggua

SEQ ID NO: 1001778 - RNA, 22 nt, Human
cccugccucugaagcugcucag

SEQ ID NO: 1001779 - RNA, 22 nt, Human
cugagccagggccacacaugga

SEQ ID NO: 1001780 - RNA, 22 nt, Human
acuggcaguagagggagcgcau

SEQ ID NO: 1001781 - RNA, 22 nt, Human
gccuggcacaguagggacccaa

SEQ ID NO: 1001782 - RNA, 18 nt, Human
uccuggcagucagagagg

SEQ ID NO: 1001783 - RNA, 22 nt, Human
ccagcccugccagagagagcug

SEQ ID NO: 1001784 - RNA, 22 nt, Human
ccaggcugggcggggaaccugg

SEQ ID NO: 1001785 - RNA, 22 nt, Human
uccaggcucccucaggaugcac

SEQ ID NO: 1001786 - RNA, 22 nt, Human
ucccacccccuccaaggaggaa

SEQ ID NO: 1001787 - RNA, 20 nt, Human
ccuggcaggcggguuacuua

SEQ ID NO: 1001788 - RNA, 22 nt, Human
cuggcagucugguggaaggccu

SEQ ID NO: 1001789 - RNA, 22 nt, Human
accugccuucucaaggacauga

SEQ ID NO: 1001790 - RNA, 22 nt, Human
uugggaucucaaauccagcuau

SEQ ID NO: 1001791 - RNA, 22 nt, Human
aagugccaucauagcauggcug

SEQ ID NO: 1001792 - RNA, 22 nt, Human
cuguccagcuuggcuccugggg

SEQ ID NO: 1001793 - RNA, 22 nt, Human
uuccaggcuauccggugaaggg

SEQ ID NO: 1001794 - RNA, 19 nt, Human
agaggccucagcagcuggc

SEQ ID NO: 1001795 - RNA, 22 nt, Human
cuuacaaauacacuuaggagag

SEQ ID NO: 1001796 - RNA, 22 nt, Human
uguuggaauuaggauacagagg

SEQ ID NO: 1001797 - RNA, 22 nt, Human
ccucagcugcuucccuggagcc

SEQ ID NO: 1001798 - RNA, 22 nt, Human
uuccuggccuaagguaggugac

SEQ ID NO: 1001799 - RNA, 22 nt, Human
ugccucucuaacccaugcccaa

SEQ ID NO: 1001800 - RNA, 22 nt, Human
gcuggcagggugguugagagag

SEQ ID NO: 1001801 - RNA, 22 nt, Human
uucaguuccauuucaggugggu

SEQ ID NO: 1001802 - RNA, 22 nt, Human
ccuggcagcccagagcgccgcu

SEQ ID NO: 1001803 - RNA, 22 nt, Human
acuggcagcagcagcccuuggg

SEQ ID NO: 1001804 - RNA, 22 nt, Human
uccuggcagcccgcaggugcug

SEQ ID NO: 1001805 - RNA, 22 nt, Human
aguguggcaggaaugacuagaa

SEQ ID NO: 1001806 - RNA, 22 nt, Human
gcacaggaugauggguugaggg

SEQ ID NO: 1001807 - RNA, 18 nt, Human
acaggcugugggaauggu

SEQ ID NO: 1001808 - RNA, 22 nt, Human
agcacagggacaaugccaggug

SEQ ID NO: 1001809 - RNA, 22 nt, Human
ucccugccugacagcacccacc

SEQ ID NO: 1001810 - RNA, 18 nt, Human
ccuggcagccaugcgcgc

SEQ ID NO: 1001811 - RNA, 22 nt, Human
cucucugggcccaguuggcacc

SEQ ID NO: 1001812 - RNA, 22 nt, Human
cagaaagaccugggcucaagag

SEQ ID NO: 1001813 - RNA, 22 nt, Human
ucuggcagaggaaggaggccug

SEQ ID NO: 1001814 - RNA, 22 nt, Human
uauuacagaaucaggcauaacu

SEQ ID NO: 1001815 - RNA, 22 nt, Human
auccuggcccagguguggaggg

SEQ ID NO: 1001816 - RNA, 22 nt, Human
agggcugacagugaggagucaa

SEQ ID NO: 1001817 - RNA, 22 nt, Human
gcuggcaguuuccucaccgagg

SEQ ID NO: 1001818 - RNA, 22 nt, Human
ccagcccugucaccaacuggag

SEQ ID NO: 1001819 - RNA, 22 nt, Human
gaggcuguuaggagggacucug

SEQ ID NO: 1001820 - RNA, 22 nt, Human
ucccugccuccuggcagugcca

SEQ ID NO: 1001821 - RNA, 22 nt, Human
uuggaaaguuuuuacugaagac

SEQ ID NO: 1001822 - RNA, 22 nt, Human
cacaaaaguaggaggcaggcgg

SEQ ID NO: 1001823 - RNA, 22 nt, Human
aguugggaguuauagacucuau

SEQ ID NO: 1001824 - RNA, 22 nt, Human
ugggagaaacugucucucccac

SEQ ID NO: 1001825 - RNA, 22 nt, Human
auccaggcgaaugcagaaggcc

SEQ ID NO: 1001826 - RNA, 17 nt, Human
ugccagccugucccagg

SEQ ID NO: 1001827 - RNA, 22 nt, Human
ggagcugaguucuucagccggg

SEQ ID NO: 1001828 - RNA, 22 nt, Human
ggagcugaaccccaucgugcug

SEQ ID NO: 1001829 - RNA, 22 nt, Human
ggagcugaaggggugggcucag

SEQ ID NO: 1001830 - RNA, 22 nt, Human
ggcugaguugagaggauuacuu

SEQ ID NO: 1001831 - RNA, 22 nt, Human
aggccccaaagcagugcaagua

SEQ ID NO: 1001832 - RNA, 22 nt, Human
agacacagucugucuggaggag

SEQ ID NO: 1001833 - RNA, 22 nt, Human
ccuggcagcgugccgagcugcg

SEQ ID NO: 1001834 - RNA, 22 nt, Human
acaggugguagaguggaaagag

SEQ ID NO: 1001835 - RNA, 22 nt, Human
cuggcaugaaauggcaucucau

SEQ ID NO: 1001836 - RNA, 22 nt, Human
ccuggcugguggcagcgacaag

SEQ ID NO: 1001837 - RNA, 22 nt, Human
gagagaaaagggggaauugauu

SEQ ID NO: 1001838 - RNA, 22 nt, Human
ucaggcccagagucacggaucc

SEQ ID NO: 1001839 - RNA, 22 nt, Human
gguucccggaucuccgaguccc

SEQ ID NO: 1001840 - RNA, 22 nt, Human
ugggacucacucuuuuggccag

SEQ ID NO: 1001841 - RNA, 22 nt, Human
guugggaaggugaacaugaugc

SEQ ID NO: 1001842 - RNA, 22 nt, Human
ucccuccuggccgucaccgcug

SEQ ID NO: 1001843 - RNA, 22 nt, Human
agagcacagaagaauaggugcu

SEQ ID NO: 1001844 - RNA, 22 nt, Human
agugccccaugggugccugggg

SEQ ID NO: 1001845 - RNA, 21 nt, Human
uccacccucucugcucccagu

SEQ ID NO: 1001846 - RNA, 22 nt, Human
gcuccaggagagggaagcagau

SEQ ID NO: 1001847 - RNA, 22 nt, Human
gcuggcagggacagcugcgugu

SEQ ID NO: 1001848 - RNA, 22 nt, Human
ccuggcagucaggggaguccuu

SEQ ID NO: 1001849 - RNA, 22 nt, Human
cucuccagaauaugccgccgug

SEQ ID NO: 1001850 - RNA, 22 nt, Human
agaggccugugugcuccagugg

SEQ ID NO: 1001851 - RNA, 20 nt, Human
ugccuggccuuucucugccc

SEQ ID NO: 1001852 - RNA, 19 nt, Human
uccuggcauuuguaggaaa

SEQ ID NO: 1001853 - RNA, 22 nt, Human
agucuagggugggguccacagg

SEQ ID NO: 1001854 - RNA, 22 nt, Human
cagugggggggccaugcugcag

SEQ ID NO: 1001855 - RNA, 22 nt, Human
gagauggccagugccaggacaa

SEQ ID NO: 1001856 - RNA, 22 nt, Human
ccagcccuuagauaaaccuggc

SEQ ID NO: 1001857 - RNA, 22 nt, Human
agcacaggaccaaggaagcugu

SEQ ID NO: 1001858 - RNA, 23 nt, Human
uccuuccuuugagaggcuccauc

SEQ ID NO: 1001859 - RNA, 22 nt, Human
gaggagcugggacccugucauc

SEQ ID NO: 1001860 - RNA, 22 nt, Human
cagguuggucggcaaguacaca

SEQ ID NO: 1001861 - RNA, 22 nt, Human
ucuggcaggauaucgaagugaa

SEQ ID NO: 1001862 - RNA, 22 nt, Human
ccuggcaggcuggggacagugc

SEQ ID NO: 1001863 - RNA, 22 nt, Human
uuccuggcgccacggagccggu

SEQ ID NO: 1001864 - RNA, 22 nt, Human
uggcagugucuuaucaggagug

SEQ ID NO: 1001865 - RNA, 22 nt, Human
agggcugaagggaggugcucau

SEQ ID NO: 1001866 - RNA, 22 nt, Human
ucuggcagaaggcagaaauuca

SEQ ID NO: 1001867 - RNA, 22 nt, Human
uuggaacaugccgggguccagg

SEQ ID NO: 1001868 - RNA, 22 nt, Human
uggcacucacucucagagucug

SEQ ID NO: 1001869 - RNA, 22 nt, Human
ucuggcagagauauccauccca

SEQ ID NO: 1001870 - RNA, 20 nt, Human
gagucacagaagaagcugaa

SEQ ID NO: 1001871 - RNA, 22 nt, Human
uccuggcauccgugggucugug

SEQ ID NO: 1001872 - RNA, 22 nt, Human
aaagagucaaaggcaugucucu

SEQ ID NO: 1001873 - RNA, 22 nt, Human
ccagugcccagcugcccaggca

SEQ ID NO: 1001874 - RNA, 22 nt, Human
cucuccagccuuuagcccacgc

SEQ ID NO: 1001875 - RNA, 22 nt, Human
uggucucugcaggccaggcuca

SEQ ID NO: 1001876 - RNA, 22 nt, Human
gccuccggaguugcagugucuu

SEQ ID NO: 1001877 - RNA, 22 nt, Human
ccuggcagaaagaguuacaccu

SEQ ID NO: 1001878 - RNA, 22 nt, Human
uccaggcuugagaccaggcucu

SEQ ID NO: 1001879 - RNA, 22 nt, Human
ccauucauacaauuuuguucua

SEQ ID NO: 1001880 - RNA, 22 nt, Human
gagaaagauuguccuucagggg

SEQ ID NO: 1001881 - RNA, 22 nt, Human
ccucucccgggugccgcugggc

SEQ ID NO: 1001882 - RNA, 22 nt, Human
gaggcacauauauacagagccc

SEQ ID NO: 1001883 - RNA, 22 nt, Human
gaggagcugcagggggagucua

SEQ ID NO: 1001884 - RNA, 22 nt, Human
gugggagaaauuagcucuaguu

SEQ ID NO: 1001885 - RNA, 22 nt, Human
gcuggcagagcucugggcuggg

SEQ ID NO: 1001886 - RNA, 22 nt, Human
gccgggaccaaggccacggagc

SEQ ID NO: 1001887 - RNA, 22 nt, Human
uccuggcacuuugggggcucgc

SEQ ID NO: 1001888 - RNA, 22 nt, Human
uggcaguggauaggggagcggu

SEQ ID NO: 1001889 - RNA, 22 nt, Human
acuggcagugucguuuacauga

SEQ ID NO: 1001890 - RNA, 22 nt, Human
ccuggcagcuccuccccggcgg

SEQ ID NO: 1001891 - RNA, 22 nt, Human
gcuggcagaauuucuucuugcu

SEQ ID NO: 1001892 - RNA, 22 nt, Human
ccacaaaacugugugucaaaga

SEQ ID NO: 1001893 - RNA, 20 nt, Human
uggccucugagaugccacgg

SEQ ID NO: 1001894 - RNA, 22 nt, Human
ucaggagcucuucccuggugug

SEQ ID NO: 1001895 - RNA, 22 nt, Human
gaggcacagucccgaggcaagg

SEQ ID NO: 1001896 - RNA, 22 nt, Human
acuggcagaacgugaugcgggu

SEQ ID NO: 1001897 - RNA, 22 nt, Human
uuccuggccaagcagaguggaa

SEQ ID NO: 1001898 - RNA, 22 nt, Human
cuugccucccucagcucacagc

SEQ ID NO: 1001899 - RNA, 22 nt, Human
cuggcacgcccacguaggcacu

SEQ ID NO: 1001900 - RNA, 22 nt, Human
uacaaaaggaagagggaucuua

SEQ ID NO: 1001901 - RNA, 22 nt, Human
cugccugcugcccuccagagcc

SEQ ID NO: 1001902 - RNA, 22 nt, Human
ccucucagcgauuccucuugga

SEQ ID NO: 1001903 - RNA, 22 nt, Human
cccugccuugggguccacaccg

SEQ ID NO: 1001904 - RNA, 22 nt, Human
ccaggcccugcuccucacacca

SEQ ID NO: 1001905 - RNA, 22 nt, Human
ugacaggaggcuugaggccagg

SEQ ID NO: 1001906 - RNA, 22 nt, Human
uuccuggcagaggccccgacag

SEQ ID NO: 1001907 - RNA, 22 nt, Human
cuggcaggagcauucacagagg

SEQ ID NO: 1001908 - RNA, 22 nt, Human
auggccuggggauuccugagca

SEQ ID NO: 1001909 - RNA, 22 nt, Human
aaagaucaauagauaaagcuac

SEQ ID NO: 1001910 - RNA, 20 nt, Human
cccagccccuaccuguugcc

SEQ ID NO: 1001911 - RNA, 22 nt, Human
aguguugggucuuuagaauuua

SEQ ID NO: 1001912 - RNA, 22 nt, Human
aggaggcuguggagcacuccau

SEQ ID NO: 1001913 - RNA, 22 nt, Human
cuccaggcucguccaagaucga

SEQ ID NO: 1001914 - RNA, 22 nt, Human
accugccuaucagcugccugcu

SEQ ID NO: 1001915 - RNA, 21 nt, Human
aggcugcuggcucaggguccu

SEQ ID NO: 1001916 - RNA, 22 nt, Human
gccuccuggaagucacauguuu

SEQ ID NO: 1001917 - RNA, 22 nt, Human
cuuggcaggguggaggaugcag

SEQ ID NO: 1001918 - RNA, 22 nt, Human
auggccugaugcaccuguccca

SEQ ID NO: 1001919 - RNA, 22 nt, Human
uccaggaggaggaaggcugcca

SEQ ID NO: 1001920 - RNA, 22 nt, Human
gaaagaagcuuuagauggcuau

SEQ ID NO: 1001921 - RNA, 22 nt, Human
agggagacacaugaggaaguca

SEQ ID NO: 1001922 - RNA, 21 nt, Human
agagucugagugugcaagggc

SEQ ID NO: 1001923 - RNA, 22 nt, Human
gaggcugcggggaggagccugc

SEQ ID NO: 1001924 - RNA, 22 nt, Human
uucauugcaguucuucagguua

SEQ ID NO: 1001925 - RNA, 22 nt, Human
acuggcagaauugaauaguugu

SEQ ID NO: 1001926 - RNA, 22 nt, Human
agacacagcugcaggagguggg

SEQ ID NO: 1001927 - RNA, 22 nt, Human
cagguuggggacuuaggaugac

SEQ ID NO: 1001928 - RNA, 22 nt, Human
gugugggaaggcuaggaugcug

SEQ ID NO: 1001929 - RNA, 22 nt, Human
uccuggcagaaauggggcugug

SEQ ID NO: 1001930 - RNA, 22 nt, Human
ucccaccccuugacucuuuaag

SEQ ID NO: 1001931 - RNA, 22 nt, Human
ugcacaggaggcuguggagaag

SEQ ID NO: 1001932 - RNA, 22 nt, Human
caggcuggagugcaauggcaca

SEQ ID NO: 1001933 - RNA, 22 nt, Human
gcuggcaggauaacuucuaagc

SEQ ID NO: 1001934 - RNA, 22 nt, Human
gguggcauaagaacacuaaaga

SEQ ID NO: 1001935 - RNA, 22 nt, Human
guccuggcaccucacuggcuac

SEQ ID NO: 1001936 - RNA, 22 nt, Human
cugcaggagcaaagccucugcu

SEQ ID NO: 1001937 - RNA, 19 nt, Human
acuggcaguuucugcaugg

SEQ ID NO: 1001938 - RNA, 22 nt, Human
ugccugccucuggcagcccugc

SEQ ID NO: 1001939 - RNA, 22 nt, Human
cugagcagugguucuugagcgc

SEQ ID NO: 1001940 - RNA, 17 nt, Human
agccugccccaugcugc

SEQ ID NO: 1001941 - RNA, 22 nt, Human
ccucugccaccucccacgaggc

SEQ ID NO: 1001942 - RNA, 22 nt, Human
acuggcagagggaaaaccauuc

SEQ ID NO: 1001943 - RNA, 18 nt, Human
uccugccugugccccagg

SEQ ID NO: 1001944 - RNA, 22 nt, Human
aaagaucaaguaggcauggccu

SEQ ID NO: 1001945 - RNA, 22 nt, Human
cucaccccacuaccccuuggug

SEQ ID NO: 1001946 - RNA, 22 nt, Human
uacaaaaguaauuacgguuuuu

SEQ ID NO: 1001947 - RNA, 22 nt, Human
gcuggcagcuggaaguugggcu

SEQ ID NO: 1001948 - RNA, 22 nt, Human
ucuggcaguugccgcuucaguc

SEQ ID NO: 1001949 - RNA, 22 nt, Human
gcaguguuuguguucucacaug

SEQ ID NO: 1001950 - RNA, 20 nt, Human
ucuggcaggugaacgagcug

SEQ ID NO: 1001951 - RNA, 22 nt, Human
aagaggucauaccagauaaggg

SEQ ID NO: 1001952 - RNA, 22 nt, Human
cuugggaaugcuaacagaugac

SEQ ID NO: 1001953 - RNA, 22 nt, Human
ugccugccaugcagaaagcuga

SEQ ID NO: 1001954 - RNA, 22 nt, Human
gccuggcaggggccugggagug

SEQ ID NO: 1001955 - RNA, 23 nt, Human
ccuggcagcaaacgaggagguua

SEQ ID NO: 1001956 - RNA, 22 nt, Human
gaaaagaguccugugugaggag

SEQ ID NO: 1001957 - RNA, 22 nt, Human
ccuggcaguucaucaaauggca

SEQ ID NO: 1001958 - RNA, 22 nt, Human
ggccucucugagagcagacguu

SEQ ID NO: 1001959 - RNA, 22 nt, Human
ucuggcagcucaguucaggucu

SEQ ID NO: 1001960 - RNA, 22 nt, Human
gcuggcagagagcuggugagga

SEQ ID NO: 1001961 - RNA, 22 nt, Human
gcuggcagcauuagacccuggg

SEQ ID NO: 1001962 - RNA, 22 nt, Human
guuaggaacacuggagccuaaa

SEQ ID NO: 1001963 - RNA, 22 nt, Human
ucuggcagguucccauguuaug

SEQ ID NO: 1001964 - RNA, 22 nt, Human
ccaggccucuggcugcuuaguc

SEQ ID NO: 1001965 - RNA, 22 nt, Human
ccacccuaacaauccuuacugu

SEQ ID NO: 1001966 - RNA, 22 nt, Human
gucuggaaggaggagauggagc

SEQ ID NO: 1001967 - RNA, 22 nt, Human
agagggugcuggagagacauug

SEQ ID NO: 1001968 - RNA, 20 nt, Human
agaggcuuccuugggaggag

SEQ ID NO: 1001969 - RNA, 22 nt, Human
guccuggcccaggaguacacau

SEQ ID NO: 1001970 - RNA, 22 nt, Human
gggccccuugcugcucugcugg

SEQ ID NO: 1001971 - RNA, 22 nt, Human
ccuggcaguuuugcccaggauu

SEQ ID NO: 1001972 - RNA, 23 nt, Human
cauccaggagcugagucugacug

SEQ ID NO: 1001973 - RNA, 18 nt, Human
aggaaagaaaggcaggug

SEQ ID NO: 1001974 - RNA, 22 nt, Human
cagggacaauggcagagccuga

SEQ ID NO: 1001975 - RNA, 22 nt, Human
aggagcugcagauucugccuug

SEQ ID NO: 1001976 - RNA, 19 nt, Human
ccagucccauacaggagau

SEQ ID NO: 1001977 - RNA, 22 nt, Human
ccugccuguacuagagacccag

SEQ ID NO: 1001978 - RNA, 19 nt, Human
cagcccucuuaccacugug

SEQ ID NO: 1001979 - RNA, 22 nt, Human
agaaagaggaugcagaucucau

SEQ ID NO: 1001980 - RNA, 19 nt, Human
ccuugccugucccugcagc

SEQ ID NO: 1001981 - RNA, 22 nt, Human
guccuggcugguucuguggggc

SEQ ID NO: 1001982 - RNA, 22 nt, Human
acuccugggugcugaccagcgu

SEQ ID NO: 1001983 - RNA, 22 nt, Human
uccaggcuagguuuacaggaca

SEQ ID NO: 1001984 - RNA, 22 nt, Human
cccagcccaucucaaaggucua

SEQ ID NO: 1001985 - RNA, 22 nt, Human
ggaggacacuggcucugccuuc

SEQ ID NO: 1001986 - RNA, 22 nt, Human
uuccaggcaugucagacauagg

SEQ ID NO: 1001987 - RNA, 20 nt, Human
ucccucccuccagcucuggg

SEQ ID NO: 1001988 - RNA, 22 nt, Human
aggcaguggagcuggaauaggc

SEQ ID NO: 1001989 - RNA, 17 nt, Human
cccaggccgccgggagc

SEQ ID NO: 1001990 - RNA, 22 nt, Human
acuggcagagacccugauggcc

SEQ ID NO: 1001991 - RNA, 22 nt, Human
cugccugcucaccagggcucug

SEQ ID NO: 1001992 - RNA, 22 nt, Human
gcuugggaagggcccuguguac

SEQ ID NO: 1001993 - RNA, 22 nt, Human
cugccugcucuauccaggccug

SEQ ID NO: 1001994 - RNA, 22 nt, Human
cuuggcagagggcugggcucag

SEQ ID NO: 1001995 - RNA, 22 nt, Human
uugggaagaaacauguccauca

SEQ ID NO: 1001996 - RNA, 22 nt, Human
aggcaguguguagcuggaagag

SEQ ID NO: 1001997 - RNA, 21 nt, Human
uccugccuuaguccagagcag

SEQ ID NO: 1001998 - RNA, 22 nt, Human
gcuccaggugucccagguaaaa

SEQ ID NO: 1001999 - RNA, 22 nt, Human
ucuggcagcagcaucaguggcu

SEQ ID NO: 1002000 - RNA, 22 nt, Human
ggugccagugggucucaggaua

SEQ ID NO: 1002001 - RNA, 22 nt, Human
gcuggcaggauagaagucuaau

SEQ ID NO: 1002002 - RNA, 22 nt, Human
ggccucucaugcccagagccaa

SEQ ID NO: 1002003 - RNA, 22 nt, Human
cugcaggacgaccgccucaucu

SEQ ID NO: 1002004 - RNA, 22 nt, Human
ggaggacaggggcugcagcaca

SEQ ID NO: 1002005 - RNA, 20 nt, Human
acaaagacuggaaaagcaag

SEQ ID NO: 1002006 - RNA, 22 nt, Human
uggccucugggaaagcagauuc

SEQ ID NO: 1002007 - RNA, 22 nt, Human
caugagauaauuuuucuccagu

SEQ ID NO: 1002008 - RNA, 22 nt, Human
acagaguccuagcugcaaagaa

SEQ ID NO: 1002009 - RNA, 22 nt, Human
cccuggcagagggggcaggugc

SEQ ID NO: 1002010 - RNA, 22 nt, Human
gccuggcaauggccucaggaag

SEQ ID NO: 1002011 - RNA, 22 nt, Human
cuccugaggacuucuauugggu

SEQ ID NO: 1002012 - RNA, 22 nt, Human
accugccuauggagccacaugg

SEQ ID NO: 1002013 - RNA, 22 nt, Human
uccuggcauugugcagggugug

SEQ ID NO: 1002014 - RNA, 22 nt, Human
agggacucccugggccgacacg

SEQ ID NO: 1002015 - RNA, 22 nt, Human
ucuggcagugagcaacuugaca

SEQ ID NO: 1002016 - RNA, 22 nt, Human
acagguggaggcuuuaggaggu

SEQ ID NO: 1002017 - RNA, 22 nt, Human
ugcacaggugagacucaggaag

SEQ ID NO: 1002018 - RNA, 22 nt, Human
uccaaggcuccggcccuggcgu

SEQ ID NO: 1002019 - RNA, 17 nt, Human
uccaggcagcaacugag

SEQ ID NO: 1002020 - RNA, 22 nt, Human
ucuggcagcucuccucggcgga

SEQ ID NO: 1002021 - RNA, 22 nt, Human
uccuggcaguaauuugauguug

SEQ ID NO: 1002022 - RNA, 22 nt, Human
gcuggcaggagaccauacccua

SEQ ID NO: 1002023 - RNA, 22 nt, Human
uggcagugggaauggacaaaca

SEQ ID NO: 1002024 - RNA, 22 nt, Human
uccaggcuccccugcgugcucc

SEQ ID NO: 1002025 - RNA, 22 nt, Human
ggagcugaggcugaggccucac

SEQ ID NO: 1002026 - RNA, 22 nt, Human
agggaagaagcugguaguaggu

SEQ ID NO: 1002027 - RNA, 22 nt, Human
gaggggcuggguagggcaaccc

SEQ ID NO: 1002028 - RNA, 22 nt, Human
ucccagccuuucuuuucugcug

SEQ ID NO: 1002029 - RNA, 22 nt, Human
gcuggcagguccaagauagagc

SEQ ID NO: 1002030 - RNA, 22 nt, Human
gagaggcuggcagugccagguu

SEQ ID NO: 1002031 - RNA, 23 nt, Human
uuccaggcagagcagggauuaga

SEQ ID NO: 1002032 - RNA, 22 nt, Human
gaggagcuguucccucaccucu

SEQ ID NO: 1002033 - RNA, 22 nt, Human
ucaggauggagggaagcacaga

SEQ ID NO: 1002034 - RNA, 22 nt, Human
agucacaguuucccugagagag

SEQ ID NO: 1002035 - RNA, 22 nt, Human
uugggaaguuuaaugacagacu

SEQ ID NO: 1002036 - RNA, 20 nt, Human
cugcuccacccggcucucag

SEQ ID NO: 1002037 - RNA, 22 nt, Human
ccccacccaccuaagagaaacu

SEQ ID NO: 1002038 - RNA, 22 nt, Human
ugagggacucccggcccugcca

SEQ ID NO: 1002039 - RNA, 22 nt, Human
uccugcagccacugcaggcaga

SEQ ID NO: 1002040 - RNA, 22 nt, Human
ccuggcagguuacaaccaguua

SEQ ID NO: 1002041 - RNA, 22 nt, Human
ucuggcaggacaugcugaccau

SEQ ID NO: 1002042 - RNA, 22 nt, Human
agaggcuuggaggugcaagguu

SEQ ID NO: 1002043 - RNA, 22 nt, Human
ccuggcaggccccuccuggauu

SEQ ID NO: 1002044 - RNA, 22 nt, Human
ugccugacugcugccaccacua

SEQ ID NO: 1002045 - RNA, 20 nt, Human
gcuggcagaugucuugagau

SEQ ID NO: 1002046 - RNA, 22 nt, Human
agccagggucucucgcucuguu

SEQ ID NO: 1002047 - RNA, 22 nt, Human
ccuccuggcuuuucccauugaa

SEQ ID NO: 1002048 - RNA, 22 nt, Human
gaggagcuggcagcgucuccgc

SEQ ID NO: 1002049 - RNA, 23 nt, Human
gcccacccucagcguccucacgg

SEQ ID NO: 1002050 - RNA, 22 nt, Human
guugggaagcagauggaugagc

SEQ ID NO: 1002051 - RNA, 22 nt, Human
aggguagggcccggagacagac

SEQ ID NO: 1002052 - RNA, 22 nt, Human
ccccacccucgcuccauuucgg

SEQ ID NO: 1002053 - RNA, 22 nt, Human
uuccuggcauagagagggcaca

SEQ ID NO: 1002054 - RNA, 22 nt, Human
aggcugcuucagcugcagggag

SEQ ID NO: 1002055 - RNA, 22 nt, Human
acuggcaguggcagcagaaaga

SEQ ID NO: 1002056 - RNA, 22 nt, Human
ucuggcaggccuugucaaucug

SEQ ID NO: 1002057 - RNA, 22 nt, Human
auccaggccccaagaccccgac

SEQ ID NO: 1002058 - RNA, 22 nt, Human
cccgagugucuacucacuccca

SEQ ID NO: 1002059 - RNA, 22 nt, Human
gcuggcagagacaagaagacua

SEQ ID NO: 1002060 - RNA, 21 nt, Human
ccuggcagaagccugauaugc

SEQ ID NO: 1002061 - RNA, 22 nt, Human
cuggcagguuuggugucuggug

SEQ ID NO: 1002062 - RNA, 22 nt, Human
uccuggcagggucuaggucuag

SEQ ID NO: 1002063 - RNA, 22 nt, Human
gagaaagacguaggcugggagg

SEQ ID NO: 1002064 - RNA, 22 nt, Human
gccagguugcugacgacgaucu

SEQ ID NO: 1002065 - RNA, 22 nt, Human
ccaggcuguaagagugauguug

SEQ ID NO: 1002066 - RNA, 22 nt, Human
uccuggcagugcuuguuuugga

SEQ ID NO: 1002067 - RNA, 22 nt, Human
guggcaguuuugacaucacaaa

SEQ ID NO: 1002068 - RNA, 22 nt, Human
cccagccuuugcuuccugguuc

SEQ ID NO: 1002069 - RNA, 22 nt, Human
agaggcuucucggauggggcag

SEQ ID NO: 1002070 - RNA, 22 nt, Human
uccugccuguuuaccuguacuu

SEQ ID NO: 1002071 - RNA, 22 nt, Human
ccuccagcgcgauccacuccgg

SEQ ID NO: 1002072 - RNA, 19 nt, Human
uccuggcacaguggaacca

SEQ ID NO: 1002073 - RNA, 22 nt, Human
gcuggcagccaagugaagaggg

SEQ ID NO: 1002074 - RNA, 22 nt, Human
gucacaggcaguaacuaggacc

SEQ ID NO: 1002075 - RNA, 22 nt, Human
ccuggcaggcaagaggaaggga

SEQ ID NO: 1002076 - RNA, 19 nt, Human
ccuuccuccccagggccau

SEQ ID NO: 1002077 - RNA, 22 nt, Human
uccucuccaugucucacgccac

SEQ ID NO: 1002078 - RNA, 22 nt, Human
cuggccucauagccaagcugug

SEQ ID NO: 1002079 - RNA, 22 nt, Human
cuccuggcacugucuugaccca

SEQ ID NO: 1002080 - RNA, 22 nt, Human
acuggcagggggagccccgaga

SEQ ID NO: 1002081 - RNA, 22 nt, Human
ucuccugggaggacaaggaagg

SEQ ID NO: 1002082 - RNA, 21 nt, Human
ucuggcaguggucuuucaaau

SEQ ID NO: 1002083 - RNA, 21 nt, Human
aaagagcccgcugagagguuc

SEQ ID NO: 1002084 - RNA, 22 nt, Human
uccuucccaggugucgccgccu

SEQ ID NO: 1002085 - RNA, 22 nt, Human
ucuggcaggguguguauuuaca

SEQ ID NO: 1002086 - RNA, 22 nt, Human
uggcaggaaaguaacagagcac

SEQ ID NO: 1002087 - RNA, 22 nt, Human
cuccuggcaguuccccuuguca

SEQ ID NO: 1002088 - RNA, 22 nt, Human
agggcugacaaauggcagugac

SEQ ID NO: 1002089 - RNA, 22 nt, Human
ucuggcagaucuucccacguuu

SEQ ID NO: 1002090 - RNA, 22 nt, Human
ccuggcagcuguuuggcuuggc

SEQ ID NO: 1002091 - RNA, 22 nt, Human
ucuggcagugauuucugugauc

SEQ ID NO: 1002092 - RNA, 22 nt, Human
ccuucucucugaagaccccaaa

SEQ ID NO: 1002093 - RNA, 18 nt, Human
ccuagccuccaagcucau

SEQ ID NO: 1002094 - RNA, 22 nt, Human
aggggugugcauccuggaggau

SEQ ID NO: 1002095 - RNA, 22 nt, Human
cucugagcagaggccguggcua

SEQ ID NO: 1002096 - RNA, 22 nt, Human
agcagguugugauacacucaga

SEQ ID NO: 1002097 - RNA, 22 nt, Human
ucccugcccucagugcacccgg

SEQ ID NO: 1002098 - RNA, 22 nt, Human
ucccacccauccugcaucucuu

SEQ ID NO: 1002099 - RNA, 22 nt, Human
uccaggcucuaggcugcucucc

SEQ ID NO: 1002100 - RNA, 22 nt, Human
cccagcccacgguccugggugg

SEQ ID NO: 1002101 - RNA, 22 nt, Human
ucccagccaggcucuaccacuu

SEQ ID NO: 1002102 - RNA, 22 nt, Human
gaggagcugagccacguccugg

SEQ ID NO: 1002103 - RNA, 22 nt, Human
ucaggcccuuugcugcugcccc

SEQ ID NO: 1002104 - RNA, 22 nt, Human
ucuggcaguuccuuguugauau

SEQ ID NO: 1002105 - RNA, 22 nt, Human
gagaaagaugaagaguggcguu

SEQ ID NO: 1002106 - RNA, 22 nt, Human
ucuugggauagugucucauggc

SEQ ID NO: 1002107 - RNA, 22 nt, Human
uccccaccuaagauacccaucu

SEQ ID NO: 1002108 - RNA, 22 nt, Human
gacugccucaguuucccugcag

SEQ ID NO: 1002109 - RNA, 22 nt, Human
uuccaggccgggcaggaaacac

SEQ ID NO: 1002110 - RNA, 22 nt, Human
gagggugucugcguaacuggca

SEQ ID NO: 1002111 - RNA, 22 nt, Human
cuccuggcacucaguguggaag

SEQ ID NO: 1002112 - RNA, 22 nt, Human
gauggccuuguuuucucccuuc

SEQ ID NO: 1002113 - RNA, 22 nt, Human
acaucccacagaaacauacaua

SEQ ID NO: 1002114 - RNA, 22 nt, Human
ucagcuuucucaaagaagcugg

SEQ ID NO: 1002115 - RNA, 22 nt, Human
ggcuuuauuuugcaugaaugcu

SEQ ID NO: 1002116 - RNA, 22 nt, Human
cagggcucaccacugggauccu

SEQ ID NO: 1002117 - RNA, 22 nt, Human
gaggagcuggcagcgucuccgc

SEQ ID NO: 1002118 - RNA, 22 nt, Human
augaaaaguucgaucuagaagg

SEQ ID NO: 1002119 - RNA, 22 nt, Human
cuggaaaggguccucauucugu

SEQ ID NO: 1002120 - RNA, 22 nt, Human
ugcagagagauccucaggguuu

SEQ ID NO: 1002121 - RNA, 22 nt, Human
cucugcagauucaucccuucac

SEQ ID NO: 1002122 - RNA, 22 nt, Human
ucagagagugcaaaauauagcu

SEQ ID NO: 1002123 - RNA, 22 nt, Human
ucugggcuugguuagggcuguu

SEQ ID NO: 1002124 - RNA, 22 nt, Human
cugagcagugguucuugagcgc

SEQ ID NO: 1002125 - RNA, 22 nt, Human
uagauacaggcucucugagccu

SEQ ID NO: 1002126 - RNA, 22 nt, Human
aaacaccagucccaguauacac

SEQ ID NO: 1002127 - RNA, 22 nt, Human
acauuuagaguucuuuacucca

SEQ ID NO: 1002128 - RNA, 22 nt, Human
uucccaguuagucauuuuuaca

SEQ ID NO: 1002129 - RNA, 22 nt, Human
ugauucacagacuucacaaggc

SEQ ID NO: 1002130 - RNA, 22 nt, Human
caaauacuacgauucuugcagu

SEQ ID NO: 1002131 - RNA, 19 nt, Human
uuugugaagaaaaugaugc

SEQ ID NO: 1002132 - RNA, 22 nt, Human
caggagggcccgagacucuucc

SEQ ID NO: 1002133 - RNA, 22 nt, Human
ucuggcagagauauccauccca

SEQ ID NO: 1002134 - RNA, 22 nt, Human
cagcucagucuggagagaugca

SEQ ID NO: 1002135 - RNA, 21 nt, Human
caugaagccgguucccuguuu

SEQ ID NO: 1002136 - RNA, 23 nt, Human
uuggagagggugaguagugucag

SEQ ID NO: 1002137 - RNA, 22 nt, Human
gcacacaguauaugcucauuaa

SEQ ID NO: 1002138 - RNA, 22 nt, Human
ccaggcucacugacuaccacau

SEQ ID NO: 1002139 - RNA, 22 nt, Human
agagcaucuaacacauaagccu

SEQ ID NO: 1002140 - RNA, 22 nt, Human
uugauuucuuacucuuccaagg

SEQ ID NO: 1002141 - RNA, 22 nt, Human
cagggcucuucaucacacagua

SEQ ID NO: 1002142 - RNA, 22 nt, Human
acagagagaauuggguuuacag

SEQ ID NO: 1002143 - RNA, 22 nt, Human
cacacagaugguaagggaggga

SEQ ID NO: 1002144 - RNA, 22 nt, Human
aaaauccuuagccgagugaggu

SEQ ID NO: 1002145 - RNA, 22 nt, Human
cccacccucaagggugucuaua

SEQ ID NO: 1002146 - RNA, 22 nt, Human
ugaaaucaaugucuucugucuc

SEQ ID NO: 1002147 - RNA, 22 nt, Human
uugaaauacugcauuguucagu

SEQ ID NO: 1002148 - RNA, 22 nt, Human
gguguugggcucacugguccuu

SEQ ID NO: 1002149 - RNA, 22 nt, Human
cugggcugcggugguagguugu

SEQ ID NO: 1002150 - RNA, 22 nt, Human
cuugccucccucagcucacagc

SEQ ID NO: 1002151 - RNA, 22 nt, Human
cucugggcugccuuuuagcucu

SEQ ID NO: 1002152 - RNA, 22 nt, Human
augaacugcaguauaaacuugg

SEQ ID NO: 1002153 - RNA, 22 nt, Human
uccaggcaagggaggagcaugg

SEQ ID NO: 1002154 - RNA, 20 nt, Human
caccacagaauuggggacag

SEQ ID NO: 1002155 - RNA, 22 nt, Human
gcaggcucagagcagauuagca

SEQ ID NO: 1002156 - RNA, 22 nt, Human
cacacacaguuuuguauucugu

SEQ ID NO: 1002157 - RNA, 22 nt, Human
uggaagagaaaauccacccuua

SEQ ID NO: 1002158 - RNA, 22 nt, Human
ugggcuccaauuuguccuuuca

SEQ ID NO: 1002159 - RNA, 22 nt, Human
cuguggcucauucuugguggca

SEQ ID NO: 1002160 - RNA, 22 nt, Human
ccuggcagcauugguagagauu

SEQ ID NO: 1002161 - RNA, 22 nt, Human
acacacaugguauuguucagaa

SEQ ID NO: 1002162 - RNA, 22 nt, Human
auacaaauuuauagaugcauuu

SEQ ID NO: 1002163 - RNA, 22 nt, Human
acaggcucgugcgcgcacgugu

SEQ ID NO: 1002164 - RNA, 19 nt, Human
gggagcugaggucuuuggu

SEQ ID NO: 1002165 - RNA, 22 nt, Human
auuauuaggugcucucugacaa

SEQ ID NO: 1002166 - RNA, 22 nt, Human
uuuucauuuuuguagaugcaag

SEQ ID NO: 1002167 - RNA, 22 nt, Human
cagggcucaggaaaucagacgu

SEQ ID NO: 1002168 - RNA, 22 nt, Human
auacaugacucacacauucugc

SEQ ID NO: 1002169 - RNA, 22 nt, Human
cuggcagguuuggugucuggug

SEQ ID NO: 1002170 - RNA, 22 nt, Human
auuuucauuuugcagggugaga

SEQ ID NO: 1002171 - RNA, 22 nt, Human
aaaaguauuuauggcuauguaa

SEQ ID NO: 1002172 - RNA, 22 nt, Human
cuguuauuucugccaggugagu

SEQ ID NO: 1002173 - RNA, 22 nt, Human
ggcuccacccugcuuccagaag

SEQ ID NO: 1002174 - RNA, 22 nt, Human
gagcuuuaggagaaggagguca

SEQ ID NO: 1002175 - RNA, 22 nt, Human
cccaggcaucccauuaaggagc

SEQ ID NO: 1002176 - RNA, 22 nt, Human
uauucccagccucuuucuaucu

SEQ ID NO: 1002177 - RNA, 22 nt, Human
gcuucuggaggagcugggcuga

SEQ ID NO: 1002178 - RNA, 22 nt, Human
acauuuagcuguacaaucuaug

SEQ ID NO: 1002179 - RNA, 22 nt, Human
cuuucucaaugccggaaggcac

SEQ ID NO: 1002180 - RNA, 22 nt, Human
ugcuucugggccugguguuccc

SEQ ID NO: 1002181 - RNA, 22 nt, Human
uauuaggguuuugaagguuugu

SEQ ID NO: 1002182 - RNA, 22 nt, Human
gaaaagaguccugugugaggag

SEQ ID NO: 1002183 - RNA, 22 nt, Human
aaacacagggauauauauucca

SEQ ID NO: 1002184 - RNA, 22 nt, Human
cagaagucacccucagaauaac

SEQ ID NO: 1002185 - RNA, 22 nt, Human
uaggaagcugagcagcauuccu

SEQ ID NO: 1002186 - RNA, 22 nt, Human
accaagcuucguggaggaaguu

SEQ ID NO: 1002187 - RNA, 20 nt, Human
ucccucccuccagcucuggg

SEQ ID NO: 1002188 - RNA, 22 nt, Human
uggaaauauacaaugugucucu

SEQ ID NO: 1002189 - RNA, 21 nt, Human
ucuagaauccuguauaagacu

SEQ ID NO: 1002190 - RNA, 22 nt, Human
gguggccaggccagcucuggcc

SEQ ID NO: 1002191 - RNA, 18 nt, Human
uuucacagauucaugacu

SEQ ID NO: 1002192 - RNA, 22 nt, Human
uggcagugggaauggacaaaca

SEQ ID NO: 1002193 - RNA, 22 nt, Human
ccacccuaacaauccuuacugu

SEQ ID NO: 1002194 - RNA, 22 nt, Human
acuggcagaauugaauaguugu

SEQ ID NO: 1002195 - RNA, 22 nt, Human
ucagcucuguuuugaguggaac

SEQ ID NO: 1002196 - RNA, 22 nt, Human
cgcaggcucgguucacagagca

SEQ ID NO: 1002197 - RNA, 22 nt, Human
cccagccucuguuugcuccucu

SEQ ID NO: 1002198 - RNA, 22 nt, Human
ugcauacacaugugcacauacg

SEQ ID NO: 1002199 - RNA, 22 nt, Human
uugcaacaucugaacauuuauc

SEQ ID NO: 1002200 - RNA, 22 nt, Human
cauuuguaguuaaaaaugucuc

SEQ ID NO: 1002201 - RNA, 20 nt, Human
uuaucugucaaucugucuca

SEQ ID NO: 1002202 - RNA, 22 nt, Human
ccaccccaaaugaagaccucuc

SEQ ID NO: 1002203 - RNA, 22 nt, Human
ugcagggaaaacccaggaugcu

SEQ ID NO: 1002204 - RNA, 22 nt, Human
aauuugauuuucuuaaaccaua

SEQ ID NO: 1002205 - RNA, 22 nt, Human
ucuugggauagugucucauggc

SEQ ID NO: 1002206 - RNA, 22 nt, Human
cugccugcaggacaccucgcua

SEQ ID NO: 1002207 - RNA, 22 nt, Human
gcagggacgcagcacucuccgu

SEQ ID NO: 1002208 - RNA, 22 nt, Human
ucugugacugauggaggcuuuu

SEQ ID NO: 1002209 - RNA, 22 nt, Human
ccacaaaacugugugucaaaga

SEQ ID NO: 1002210 - RNA, 22 nt, Human
gcacccagagggcagggucucc

SEQ ID NO: 1002211 - RNA, 20 nt, Human
uggccucugagaugccacgg

SEQ ID NO: 1002212 - RNA, 22 nt, Human
gguggccugaauuagcucaggg

SEQ ID NO: 1002213 - RNA, 22 nt, Human
auaaaguuuaaaagucaauagu

SEQ ID NO: 1002214 - RNA, 22 nt, Human
cacaucagggcugcuugggggu

SEQ ID NO: 1002215 - RNA, 22 nt, Human
uagaauucauguuacuguuagc

SEQ ID NO: 1002216 - RNA, 22 nt, Human
cucugagcagaggccguggcua

SEQ ID NO: 1002217 - RNA, 23 nt, Human
aaauuauugcucuucaauugccu

SEQ ID NO: 1002218 - RNA, 22 nt, Human
uggaacacaucuaaggaagcag

SEQ ID NO: 1002219 - RNA, 22 nt, Human
aaggcuuuuaacuacuguuuua

SEQ ID NO: 1002220 - RNA, 22 nt, Human
agcauucauugcuagaauguaa

SEQ ID NO: 1002221 - RNA, 22 nt, Human
cagagcugcuucccaguuugug

SEQ ID NO: 1002222 - RNA, 22 nt, Human
cagugaggugcccagccugccc

SEQ ID NO: 1002223 - RNA, 22 nt, Human
gaaucauuuagcucugcaugga

SEQ ID NO: 1002224 - RNA, 22 nt, Human
cacaggcuuccaguccccagcu

SEQ ID NO: 1002225 - RNA, 22 nt, Human
uguacaaagguacuuugauguu

SEQ ID NO: 1002226 - RNA, 22 nt, Human
gagaaagaugaagaguggcguu

SEQ ID NO: 1002227 - RNA, 22 nt, Human
auaauucagguuuucuggcaca

SEQ ID NO: 1002228 - RNA, 22 nt, Human
cuuagggagaaugccucugcag

SEQ ID NO: 1002229 - RNA, 22 nt, Human
ugucuucaucuccaugcacaga

SEQ ID NO: 1002230 - RNA, 22 nt, Human
ccuggcagcuaagugcuuugag

SEQ ID NO: 1002231 - RNA, 22 nt, Human
acaggugguaaaauggacuguc

SEQ ID NO: 1002232 - RNA, 22 nt, Human
ccugaccuauuuuucucagcug

SEQ ID NO: 1002233 - RNA, 22 nt, Human
uuguauuucuccacuuucuguu

SEQ ID NO: 1002234 - RNA, 22 nt, Human
cuccugcaagccuccccaagca

SEQ ID NO: 1002235 - RNA, 22 nt, Human
agcuuuaugaggagaccuuagu

SEQ ID NO: 1002236 - RNA, 19 nt, Human
guccaguguuuuccaguca

SEQ ID NO: 1002237 - RNA, 17 nt, Human
gccugcaggcccgcaga

SEQ ID NO: 1002238 - RNA, 22 nt, Human
cuuccaagaugaacagcaagcg

SEQ ID NO: 1002239 - RNA, 20 nt, Human
ucccaaggaugccugggugu

SEQ ID NO: 1002240 - RNA, 22 nt, Human
gaagcacugcauuucaagauca

SEQ ID NO: 1002241 - RNA, 22 nt, Human
ucgggcucgcucuccuagcgga

SEQ ID NO: 1002242 - RNA, 22 nt, Human
agagugaaaagcuagagcagua

SEQ ID NO: 1002243 - RNA, 22 nt, Human
gcuccaggugucccagguaaaa

SEQ ID NO: 1002244 - RNA, 22 nt, Human
gaauacauuggaaaucagaaua

SEQ ID NO: 1002245 - RNA, 22 nt, Human
ucccucuaaacuguaagauucu

SEQ ID NO: 1002246 - RNA, 22 nt, Human
cugcaggguuuuucaaggacaa

SEQ ID NO: 1002247 - RNA, 22 nt, Human
guccucugggcagcugccccac

SEQ ID NO: 1002248 - RNA, 22 nt, Human
gaaacaauuuuuguugucuaag

SEQ ID NO: 1002249 - RNA, 22 nt, Human
ugcuucugauucaugguuauug

SEQ ID NO: 1002250 - RNA, 22 nt, Human
uucacaguggcugugccauuug

SEQ ID NO: 1002251 - RNA, 22 nt, Human
uacacacagaggccaugggauu

SEQ ID NO: 1002252 - RNA, 22 nt, Human
agcucccagcagagcuggccac

SEQ ID NO: 1002253 - RNA, 22 nt, Human
ucagcuuuuuggauugcccaag

SEQ ID NO: 1002254 - RNA, 22 nt, Human
guuagggaagcgcuguguucuu

SEQ ID NO: 1002255 - RNA, 22 nt, Human
ccacacuaaacugcucaaacca

SEQ ID NO: 1002256 - RNA, 22 nt, Human
acuggcagcagcagcccuuggg

SEQ ID NO: 1002257 - RNA, 20 nt, Human
gcuccaggucagagaggacg

SEQ ID NO: 1002258 - RNA, 22 nt, Human
cagggcucccaaauaucucuuc

SEQ ID NO: 1002259 - RNA, 22 nt, Human
gacaggcuuccuaagugccaga

SEQ ID NO: 1002260 - RNA, 22 nt, Human
acauaugugcuuauauccauga

SEQ ID NO: 1002261 - RNA, 18 nt, Human
cuccuccacagccccugc

SEQ ID NO: 1002262 - RNA, 22 nt, Human
uuuguacauccuaauucugagu

SEQ ID NO: 1002263 - RNA, 22 nt, Human
aacaguaaaaaucauuuaguug

SEQ ID NO: 1002264 - RNA, 22 nt, Human
uacccagcuucaagucaggacu

SEQ ID NO: 1002265 - RNA, 22 nt, Human
uuccaaguguugagauuagagg

SEQ ID NO: 1002266 - RNA, 21 nt, Human
uagggcucucugugucaggug

SEQ ID NO: 1002267 - RNA, 22 nt, Human
gguuucaacuaaaucaagaagg

SEQ ID NO: 1002268 - RNA, 22 nt, Human
acacacuguugcucauccaggc

SEQ ID NO: 1002269 - RNA, 22 nt, Human
ggcauccaguucugaucaacaa

SEQ ID NO: 1002270 - RNA, 22 nt, Human
agcagcuccugccaugagugcu

SEQ ID NO: 1002271 - RNA, 22 nt, Human
uaacuacauuucacugcaauua

SEQ ID NO: 1002272 - RNA, 17 nt, Human
gcuucuggagcuucugu

SEQ ID NO: 1002273 - RNA, 21 nt, Human
ugggaccuauuucaacuggau

SEQ ID NO: 1002274 - RNA, 22 nt, Human
gacccaggguggucaccugaaa

SEQ ID NO: 1002275 - RNA, 17 nt, Human
gccuucucugcccucac

SEQ ID NO: 1002276 - RNA, 22 nt, Human
cuuacaaaggagaggagauagg

SEQ ID NO: 1002277 - RNA, 21 nt, Human
uccugccuuaguccagagcag

SEQ ID NO: 1002278 - RNA, 22 nt, Human
caguguggugugcacagcuuag

SEQ ID NO: 1002279 - RNA, 23 nt, Human
uuuauuuauuuaggcugagggau

SEQ ID NO: 1002280 - RNA, 22 nt, Human
uccaagcuuuccaugcccucac

SEQ ID NO: 1002281 - RNA, 22 nt, Human
cagguuuagguggacgugcagg

SEQ ID NO: 1002282 - RNA, 22 nt, Human
ugaggccagugacauauauuaa

SEQ ID NO: 1002283 - RNA, 22 nt, Human
uagggcucuggugggcucuguu

SEQ ID NO: 1002284 - RNA, 22 nt, Human
uacacaucacuguaucuuucag

SEQ ID NO: 1002285 - RNA, 22 nt, Human
ucuggcaguaauaggggagaga

SEQ ID NO: 1002286 - RNA, 22 nt, Human
aaaguuguucaguaagaaacuc

SEQ ID NO: 1002287 - RNA, 22 nt, Human
cuucuggguauuccagauaccu

SEQ ID NO: 1002288 - RNA, 22 nt, Human
gauucacucauauuuuacguuu

SEQ ID NO: 1002289 - RNA, 21 nt, Human
auucugucaucccagcuacuu

SEQ ID NO: 1002290 - RNA, 22 nt, Human
acuguccauucacucauauuca

SEQ ID NO: 1002291 - RNA, 22 nt, Human
ugcacagcuggcucuccuuuuc

SEQ ID NO: 1002292 - RNA, 22 nt, Human
aggaccugaaauucuugcuuuu

SEQ ID NO: 1002293 - RNA, 22 nt, Human
ucuccaggaagcccucccugac

SEQ ID NO: 1002294 - RNA, 22 nt, Human
ugcuucugacauguucuugguu

SEQ ID NO: 1002295 - RNA, 22 nt, Human
cccccaaaguuugcacggauaa

SEQ ID NO: 1002296 - RNA, 22 nt, Human
aaagaauagccuuuguccaaau

SEQ ID NO: 1002297 - RNA, 22 nt, Human
uccaggaggugaggggaccaaa

SEQ ID NO: 1002298 - RNA, 20 nt, Human
ucacuguaauugccuacauu

SEQ ID NO: 1002299 - RNA, 22 nt, Human
ugcaggcugcuggcaguagcuu

SEQ ID NO: 1002300 - RNA, 22 nt, Human
uuaacacauauuuaucaauugc

SEQ ID NO: 1002301 - RNA, 22 nt, Human
aaagaucaauagauaaagcuac

SEQ ID NO: 1002302 - RNA, 23 nt, Human
aguguugguugggaagccaagca

SEQ ID NO: 1002303 - RNA, 22 nt, Human
cacccagcacagagggaggcga

SEQ ID NO: 1002304 - RNA, 22 nt, Human
guccucuguagggcugggccac

SEQ ID NO: 1002305 - RNA, 22 nt, Human
auguuagaaucucugaaugugg

SEQ ID NO: 1002306 - RNA, 18 nt, Human
ucuggaacaacuucaugu

SEQ ID NO: 1002307 - RNA, 22 nt, Human
caggcucuuuugguggcaagga

SEQ ID NO: 1002308 - RNA, 21 nt, Human
aggcugcuggcucaggguccu

SEQ ID NO: 1002309 - RNA, 22 nt, Human
aucagagaaauggagggcgcuu

SEQ ID NO: 1002310 - RNA, 22 nt, Human
cauaauauacuacauugaugaa

SEQ ID NO: 1002311 - RNA, 22 nt, Human
aggcugugggaguugagagucu

SEQ ID NO: 1002312 - RNA, 22 nt, Human
ugggcugaguggcagccagagu

SEQ ID NO: 1002313 - RNA, 22 nt, Human
agaggcuuggaggugcaagguu

SEQ ID NO: 1002314 - RNA, 22 nt, Human
aaggaccuauauugucagagga

SEQ ID NO: 1002315 - RNA, 17 nt, Human
accaggcaacacgccca

SEQ ID NO: 1002316 - RNA, 22 nt, Human
acagagcaugcucaguguguga

SEQ ID NO: 1002317 - RNA, 22 nt, Human
gggcugacuccuauuggaugaa

SEQ ID NO: 1002318 - RNA, 22 nt, Human
uccuaguucucugccagucgcu

SEQ ID NO: 1002319 - RNA, 22 nt, Human
uuuucuuauggugaagcacaaa

SEQ ID NO: 1002320 - RNA, 22 nt, Human
uucacacacagcuuccuauugu

SEQ ID NO: 1002321 - RNA, 22 nt, Human
aagagcauauuaauaguggaga

SEQ ID NO: 1002322 - RNA, 22 nt, Human
acugggcuuaugcuguggagua

SEQ ID NO: 1002323 - RNA, 22 nt, Human
acaaauuuauugaagggcauau

SEQ ID NO: 1002324 - RNA, 22 nt, Human
uccaugagacagauacuguaag

SEQ ID NO: 1002325 - RNA, 22 nt, Human
auguccagggcacacagcagug

SEQ ID NO: 1002326 - RNA, 16 nt, Human
uguaugaacgucucca

SEQ ID NO: 1002327 - RNA, 22 nt, Human
acagcuuuucaauucugcugag

SEQ ID NO: 1002328 - RNA, 22 nt, Human
agcucccaauugacuugaacua

SEQ ID NO: 1002329 - RNA, 21 nt, Human
uccugcaggaggccugagagg

SEQ ID NO: 1002330 - RNA, 22 nt, Human
ccacaucauggauacaguuaug

SEQ ID NO: 1002331 - RNA, 22 nt, Human
ccaggcucugagaggaauguga

SEQ ID NO: 1002332 - RNA, 22 nt, Human
gcugccacauuuucaggacuaa

SEQ ID NO: 1002333 - RNA, 22 nt, Human
gcccggcagucacacacccagg

SEQ ID NO: 1002334 - RNA, 22 nt, Human
acaugauucuugauaggcauug

SEQ ID NO: 1002335 - RNA, 22 nt, Human
ucaucacauguguagucauccc

SEQ ID NO: 1002336 - RNA, 22 nt, Human
uucacuuaacaucauaucauga

SEQ ID NO: 1002337 - RNA, 22 nt, Human
auuuggcaacauuaauugaauc

SEQ ID NO: 1002338 - RNA, 22 nt, Human
gcugcaggcggccgugguggcg

SEQ ID NO: 1002339 - RNA, 18 nt, Human
uaaauauauuucccccuu

SEQ ID NO: 1002340 - RNA, 22 nt, Human
aaacaucauaggcaugcaugau

SEQ ID NO: 1002341 - RNA, 22 nt, Human
aaguauuucuggccugugaaag

SEQ ID NO: 1002342 - RNA, 22 nt, Human
cccugccucugaagcugcucag

SEQ ID NO: 1002343 - RNA, 22 nt, Human
gccugcagauauauaggauggu

SEQ ID NO: 1002344 - RNA, 21 nt, Human
uccuguaagcuuggguggcuc

SEQ ID NO: 1002345 - RNA, 22 nt, Human
auacacacugcuauccuuuuuu

SEQ ID NO: 1002346 - RNA, 22 nt, Human
aagacauugucauuuuauaauu

SEQ ID NO: 1002347 - RNA, 22 nt, Human
agaggcuuggccucaguucugu

SEQ ID NO: 1002348 - RNA, 22 nt, Human
gacccagcuuaagucacauguu

SEQ ID NO: 1002349 - RNA, 22 nt, Human
cauauguauuucucauaauuag

SEQ ID NO: 1002350 - RNA, 19 nt, Human
aggcuuggcuagauuuacu

SEQ ID NO: 1002351 - RNA, 22 nt, Human
gcugggcuugguuucccugcuu

SEQ ID NO: 1002352 - RNA, 22 nt, Human
gccugcaguucugugcuaggca

SEQ ID NO: 1002353 - RNA, 21 nt, Human
acagauauuucauugaacauu

SEQ ID NO: 1002354 - RNA, 18 nt, Human
ccuggcagccaugcgcgc

SEQ ID NO: 1002355 - RNA, 22 nt, Human
ucucuuaauuuuggaauagugu

SEQ ID NO: 1002356 - RNA, 22 nt, Human
gagggcuccauuccccgugccc

SEQ ID NO: 1002357 - RNA, 22 nt, Human
gggcugaccccaccccucacuc

SEQ ID NO: 1002358 - RNA, 22 nt, Human
gccaggcagcugggagggugcc

SEQ ID NO: 1002359 - RNA, 22 nt, Human
uugugaaauguuucaaaauagu

SEQ ID NO: 1002360 - RNA, 22 nt, Human
gaggcacauauauacagagccc

SEQ ID NO: 1002361 - RNA, 22 nt, Human
cuuauuagugucugucugaguu

SEQ ID NO: 1002362 - RNA, 22 nt, Human
auauuagggucucuaaauucua

SEQ ID NO: 1002363 - RNA, 20 nt, Human
cucuuuugacucuuugcaag

SEQ ID NO: 1002364 - RNA, 22 nt, Human
cacauacugagaaucacaccca

SEQ ID NO: 1002365 - RNA, 22 nt, Human
agggggucguccggaagaccug

SEQ ID NO: 1002366 - RNA, 22 nt, Human
acccaggcugcuucucaguggc

SEQ ID NO: 1002367 - RNA, 23 nt, Human
uauuagggccaggacuggcaaau

SEQ ID NO: 1002368 - RNA, 20 nt, Human
uccaggcagacagcuauggg

SEQ ID NO: 1002369 - RNA, 22 nt, Human
cucugauuuccuuauucuguca

SEQ ID NO: 1002370 - RNA, 22 nt, Human
ccaguguucauaauuuuacacu

SEQ ID NO: 1002371 - RNA, 22 nt, Human
ucaaggagcccacagucuaaug

SEQ ID NO: 1002372 - RNA, 22 nt, Human
cacauaaucaccaaguccuuuc

SEQ ID NO: 1002373 - RNA, 22 nt, Human
gcucacagccggcuggcagggg

SEQ ID NO: 1002374 - RNA, 22 nt, Human
uaugucaaaguuaagaaauagg

SEQ ID NO: 1002375 - RNA, 22 nt, Human
uguacauagaucuugaaaauua

SEQ ID NO: 1002376 - RNA, 22 nt, Human
cagcauuuagaauuugaagugu

SEQ ID NO: 1002377 - RNA, 22 nt, Human
cugggaggcagucucucuagaa

SEQ ID NO: 1002378 - RNA, 22 nt, Human
auuuauuauugugguuacuucu

SEQ ID NO: 1002379 - RNA, 22 nt, Human
guagggacaugccauuaucuca

SEQ ID NO: 1002380 - RNA, 22 nt, Human
gugagagggcugggcucaugau

SEQ ID NO: 1002381 - RNA, 22 nt, Human
gcagggaccucacuacccccag

SEQ ID NO: 1002382 - RNA, 22 nt, Human
agugcuccuauggaucaguugu

SEQ ID NO: 1002383 - RNA, 22 nt, Human
acacaucuuagacugaaauaug

SEQ ID NO: 1002384 - RNA, 19 nt, Human
uucuggggccuggccuugg

SEQ ID NO: 1002385 - RNA, 22 nt, Human
ucuggggaauguucauuucuga

SEQ ID NO: 1002386 - RNA, 22 nt, Human
cugcucuaacugcauuaguuuu

SEQ ID NO: 1002387 - RNA, 22 nt, Human
uuccuggcgccacggagccggu

SEQ ID NO: 1002388 - RNA, 22 nt, Human
aauguauuccucaugcaagagu

SEQ ID NO: 1002389 - RNA, 22 nt, Human
ugcuagaaaucugaaacuagca

SEQ ID NO: 1002390 - RNA, 22 nt, Human
aggaagaacagauaauggacgc

SEQ ID NO: 1002391 - RNA, 22 nt, Human
uggaacacugaucauugccuuu

SEQ ID NO: 1002392 - RNA, 22 nt, Human
uagcuuuagaaauauucucaga

SEQ ID NO: 1002393 - RNA, 22 nt, Human
cuucugggauuuuugaagacuc

SEQ ID NO: 1002394 - RNA, 22 nt, Human
cagggcucugccuugagggaug

SEQ ID NO: 1002395 - RNA, 22 nt, Human
cuguggcuucugcuugggccuc

SEQ ID NO: 1002396 - RNA, 22 nt, Human
ugcaggcucaccugccagggcc

SEQ ID NO: 1002397 - RNA, 22 nt, Human
uccaggcauaagccuugagugu

SEQ ID NO: 1002398 - RNA, 22 nt, Human
aaccugcauguuucuaaaagca

SEQ ID NO: 1002399 - RNA, 22 nt, Human
aaaugcuagggagaaacucucc

SEQ ID NO: 1002400 - RNA, 22 nt, Human
uacauucagaagaauggacacg

SEQ ID NO: 1002401 - RNA, 22 nt, Human
gauauguauugaaugaucauuu

SEQ ID NO: 1002402 - RNA, 22 nt, Human
uccugcagcugcagaccugggg

SEQ ID NO: 1002403 - RNA, 22 nt, Human
gacccauauaggacccuccaaa

SEQ ID NO: 1002404 - RNA, 23 nt, Human
ugccaaaguuuaccuaacacugg

SEQ ID NO: 1002405 - RNA, 22 nt, Human
ggcucugcagugacuugagggg

SEQ ID NO: 1002406 - RNA, 22 nt, Human
auuauuagauucuuaauuguaa

SEQ ID NO: 1002407 - RNA, 22 nt, Human
gccaggcauuuguuaggugcug

SEQ ID NO: 1002408 - RNA, 22 nt, Human
ccagagagggcgccaccuggag

SEQ ID NO: 1002409 - RNA, 22 nt, Human
ccagagaguaaacauuuuccgg

SEQ ID NO: 1002410 - RNA, 22 nt, Human
agcaggcugggcaauaugggca

SEQ ID NO: 1002411 - RNA, 22 nt, Human
agcuuuaugcuuccuacaagcu

SEQ ID NO: 1002412 - RNA, 22 nt, Human
gagcauuugguuauaguaauuu

SEQ ID NO: 1002413 - RNA, 22 nt, Human
aggcuccauaccaucuccggag

SEQ ID NO: 1002414 - RNA, 22 nt, Human
uacaaaguagaaauucaguaaa

SEQ ID NO: 1002415 - RNA, 22 nt, Human
uuauuuaaaagugguaagauuc

SEQ ID NO: 1002416 - RNA, 22 nt, Human
uagaacauaagucauucauuug

SEQ ID NO: 1002417 - RNA, 22 nt, Human
gacccagaaggagugcccuaga

SEQ ID NO: 1002418 - RNA, 22 nt, Human
auaugauuccacuauuguaugg

SEQ ID NO: 1002419 - RNA, 23 nt, Human
gggcuccagucucugcucaguug

SEQ ID NO: 1002420 - RNA, 22 nt, Human
agcagguggacagaggaagaaa

SEQ ID NO: 1002421 - RNA, 22 nt, Human
ucccaccccuugacucuuuaag

SEQ ID NO: 1002422 - RNA, 22 nt, Human
gccuccggaguugcagugucuu

SEQ ID NO: 1002423 - RNA, 19 nt, Human
gcuggcagauguggccgug

SEQ ID NO: 1002424 - RNA, 22 nt, Human
cccaggcagucuggcucuaaag

SEQ ID NO: 1002425 - RNA, 22 nt, Human
ugcagggauuauguagggguug

SEQ ID NO: 1002426 - RNA, 22 nt, Human
gcuggggagggcgucaaggcca

SEQ ID NO: 1002427 - RNA, 22 nt, Human
gacccagccugguuuuuauagg

SEQ ID NO: 1002428 - RNA, 22 nt, Human
gcagggaccuugcccacccucc

SEQ ID NO: 1002429 - RNA, 22 nt, Human
auuaaauuuucacuaggcuccc

SEQ ID NO: 1002430 - RNA, 19 nt, Human
ccagucccauacaggagau

SEQ ID NO: 1002431 - RNA, 22 nt, Human
gcacccagggacuuggcuggcc

SEQ ID NO: 1002432 - RNA, 22 nt, Human
gaaagacuuccuuugagaguac

SEQ ID NO: 1002433 - RNA, 22 nt, Human
ugcagggaaugcuugcagcaug

SEQ ID NO: 1002434 - RNA, 22 nt, Human
ggcaggcugcuugggucauguc

SEQ ID NO: 1002435 - RNA, 22 nt, Human
cagauuuaccuaacuccaaguu

SEQ ID NO: 1002436 - RNA, 22 nt, Human
caguaaaagauggaaauagaau

SEQ ID NO: 1002437 - RNA, 22 nt, Human
aggaaacuguccccucauccua

SEQ ID NO: 1002438 - RNA, 22 nt, Human
cuuuucauuguuuguacaugca

SEQ ID NO: 1002439 - RNA, 22 nt, Human
cuggcagggugggcuuugcuuu

SEQ ID NO: 1002440 - RNA, 22 nt, Human
uuucuacauucaaaaacuacca

SEQ ID NO: 1002441 - RNA, 22 nt, Human
auuucacaaagaacagaugcag

SEQ ID NO: 1002442 - RNA, 18 nt, Human
uuucacaaccuccagagg

SEQ ID NO: 1002443 - RNA, 22 nt, Human
gccugcagugagugcagaaggu

SEQ ID NO: 1002444 - RNA, 22 nt, Human
agucuagggugggguccacagg

SEQ ID NO: 1002445 - RNA, 22 nt, Human
gccugcagggugaugggcugcc

SEQ ID NO: 1002446 - RNA, 17 nt, Human
gcauccaguaacaugcc

SEQ ID NO: 1002447 - RNA, 22 nt, Human
cagguuggggacuuaggaugac

SEQ ID NO: 1002448 - RNA, 22 nt, Human
aaacuucauggauaauauaaag

SEQ ID NO: 1002449 - RNA, 22 nt, Human
agagggcaugcuugguggccug

SEQ ID NO: 1002450 - RNA, 23 nt, Human
agcuuuggugaugugacagauaa

SEQ ID NO: 1002451 - RNA, 22 nt, Human
uuauuuuuaaaaguucacacag

SEQ ID NO: 1002452 - RNA, 22 nt, Human
aaugaagccagcugggaugcga

SEQ ID NO: 1002453 - RNA, 22 nt, Human
gccugcagccagggaguucucu

SEQ ID NO: 1002454 - RNA, 22 nt, Human
aaucuucauuuugacaagauuc

SEQ ID NO: 1002455 - RNA, 22 nt, Human
aucucccagccacagcauucuu

SEQ ID NO: 1002456 - RNA, 22 nt, Human
ucacauaaauuuaccagaugau

SEQ ID NO: 1002457 - RNA, 22 nt, Human
acacagccgugaaucugcuucu

SEQ ID NO: 1002458 - RNA, 22 nt, Human
acaccauacucauguugguucc

SEQ ID NO: 1002459 - RNA, 22 nt, Human
gcuucugggcaccugaacagga

SEQ ID NO: 1002460 - RNA, 22 nt, Human
cauucacaaagcugauugaugg

SEQ ID NO: 1002461 - RNA, 22 nt, Human
uguuuauugagugccuacuaua

SEQ ID NO: 1002462 - RNA, 21 nt, Human
auucagaaagggaauaaacuc

SEQ ID NO: 1002463 - RNA, 22 nt, Human
cuuacacagucuggcacuucuu

SEQ ID NO: 1002464 - RNA, 22 nt, Human
uuucagauuaucucaacuuugg

SEQ ID NO: 1002465 - RNA, 22 nt, Human
cuuggcaggguggaggaugcag

SEQ ID NO: 1002466 - RNA, 22 nt, Human
auguccagaguaaagcacauuc

SEQ ID NO: 1002467 - RNA, 22 nt, Human
aaauauacuagaugaugaccca

SEQ ID NO: 1002468 - RNA, 22 nt, Human
ugugaaaagcguguguucuagg

SEQ ID NO: 1002469 - RNA, 22 nt, Human
aaacaaacauagguuugaaagu

SEQ ID NO: 1002470 - RNA, 22 nt, Human
uacauugacuuggauuguuaga

SEQ ID NO: 1002471 - RNA, 22 nt, Human
uagacauuucugguuauugaca

SEQ ID NO: 1002472 - RNA, 22 nt, Human
cuagguauucauguuucguggc

SEQ ID NO: 1002473 - RNA, 22 nt, Human
ucauuuauaaggaugcaauuaa

SEQ ID NO: 1002474 - RNA, 22 nt, Human
ucuuuauuucugaaucccccau

SEQ ID NO: 1002475 - RNA, 22 nt, Human
gaaugaauucagcacauggaau

SEQ ID NO: 1002476 - RNA, 22 nt, Human
uauggaaacuaauucauuuuuc

SEQ ID NO: 1002477 - RNA, 22 nt, Human
uuaaauuagucaagcuucucug

SEQ ID NO: 1002478 - RNA, 20 nt, Human
acuccagguggcaugaggac

SEQ ID NO: 1002479 - RNA, 22 nt, Human
acagcucugcauggcaguuauu

SEQ ID NO: 1002480 - RNA, 22 nt, Human
augcuuuauuauuuugcaggga

SEQ ID NO: 1002481 - RNA, 23 nt, Human
uuccaggcagagcagggauuaga

SEQ ID NO: 1002482 - RNA, 22 nt, Human
acaagguauccacauuaaaugu

SEQ ID NO: 1002483 - RNA, 22 nt, Human
augaagcugaaaaaggcauaua

SEQ ID NO: 1002484 - RNA, 22 nt, Human
ucagcucuaaguuuuaugcaaa

SEQ ID NO: 1002485 - RNA, 22 nt, Human
augaaaauguacauguguauaa

SEQ ID NO: 1002486 - RNA, 22 nt, Human
ccccacacucuuuacauucaua

SEQ ID NO: 1002487 - RNA, 22 nt, Human
ccuggcaggccccuccuggauu

SEQ ID NO: 1002488 - RNA, 22 nt, Human
accaggcaaaaccacaggagca

SEQ ID NO: 1002489 - RNA, 22 nt, Human
aguaugaauugcuuugccugua

SEQ ID NO: 1002490 - RNA, 21 nt, Human
acagauuuuauaucucugcug

SEQ ID NO: 1002491 - RNA, 22 nt, Human
cauuagggacugaggaauaagg

SEQ ID NO: 1002492 - RNA, 22 nt, Human
cuggccuggggggacacauccc

SEQ ID NO: 1002493 - RNA, 22 nt, Human
ccagcccugucaccaacuggag

SEQ ID NO: 1002494 - RNA, 21 nt, Human
uggaccuguccuucucgcugu

SEQ ID NO: 1002495 - RNA, 22 nt, Human
ccaggcugggcggggaaccugg

SEQ ID NO: 1002496 - RNA, 22 nt, Human
ugaccugcguaggugguuucug

SEQ ID NO: 1002497 - RNA, 22 nt, Human
aacacaaagaagcugcaggauc

SEQ ID NO: 1002498 - RNA, 21 nt, Human
ucagcuuugcaacugcacauc

SEQ ID NO: 1002499 - RNA, 19 nt, Human
agugcagggagcacccuca

SEQ ID NO: 1002500 - RNA, 22 nt, Human
caggcccugggcaggcacagag

SEQ ID NO: 1002501 - RNA, 22 nt, Human
acacacuggcccccaguacuga

SEQ ID NO: 1002502 - RNA, 22 nt, Human
acacaucagaaauaugaaugag

SEQ ID NO: 1002503 - RNA, 22 nt, Human
gggcugacaccacccaggcgca

SEQ ID NO: 1002504 - RNA, 20 nt, Human
gauuacaaaaugaaaugcau

SEQ ID NO: 1002505 - RNA, 22 nt, Human
gugugaaaaugugcacaauaug

SEQ ID NO: 1002506 - RNA, 22 nt, Human
ggcaggcuagcacugauguccu

SEQ ID NO: 1002507 - RNA, 22 nt, Human
agggcuccaaggaaguguagcu

SEQ ID NO: 1002508 - RNA, 22 nt, Human
uuuguaaaggccugaauuucag

SEQ ID NO: 1002509 - RNA, 22 nt, Human
gcuuggccagcagccgggaugc

SEQ ID NO: 1002510 - RNA, 22 nt, Human
gucacaggccuggaugaggggc

SEQ ID NO: 1002511 - RNA, 22 nt, Human
auccugucaucauaguacuuga

SEQ ID NO: 1002512 - RNA, 22 nt, Human
cuguugcaucauggcucuuaau

SEQ ID NO: 1002513 - RNA, 22 nt, Human
ucugauuagagcauucuugagu

SEQ ID NO: 1002514 - RNA, 22 nt, Human
uuuauuagugcuuguaucacug

SEQ ID NO: 1002515 - RNA, 22 nt, Human
uggaccugagccuggcccugcc

SEQ ID NO: 1002516 - RNA, 17 nt, Human
aggccucccuccaggcc

SEQ ID NO: 1002517 - RNA, 22 nt, Human
cagcauuuucuuaauguaggug

SEQ ID NO: 1002518 - RNA, 22 nt, Human
gccaggcaggugucggagcccu

SEQ ID NO: 1002519 - RNA, 22 nt, Human
gagcuuuaagggcacuggucuu

SEQ ID NO: 1002520 - RNA, 22 nt, Human
cccaggcacauccacucuguga

SEQ ID NO: 1002521 - RNA, 22 nt, Human
guccagagauggacgagcagau

SEQ ID NO: 1002522 - RNA, 22 nt, Human
cuccucuggguccugguggcca

SEQ ID NO: 1002523 - RNA, 22 nt, Human
ucuuugaaguugaaguaguugg

SEQ ID NO: 1002524 - RNA, 22 nt, Human
gcccucucuucugcagccucca

SEQ ID NO: 1002525 - RNA, 22 nt, Human
caugaguucaucugcuucucuu

SEQ ID NO: 1002526 - RNA, 22 nt, Human
ggaccugaacauaaaacgaggc

SEQ ID NO: 1002527 - RNA, 19 nt, Human
guagggacagugguucuga

SEQ ID NO: 1002528 - RNA, 22 nt, Human
uuaguuuucccaucuuuauggu

SEQ ID NO: 1002529 - RNA, 22 nt, Human
gaauaguucuauggcugcaggg

SEQ ID NO: 1002530 - RNA, 22 nt, Human
ucauauaaguuuaaaacuaucu

SEQ ID NO: 1002531 - RNA, 23 nt, Human
agaccugcaucugauaggcccug

SEQ ID NO: 1002532 - RNA, 22 nt, Human
gaccaccagagguccgugggua

SEQ ID NO: 1002533 - RNA, 22 nt, Human
uagaauucaagauucaacaggc

SEQ ID NO: 1002534 - RNA, 22 nt, Human
uuccagagaaaagguuuauuuc

SEQ ID NO: 1002535 - RNA, 22 nt, Human
cauaauuugauaugcuugaugg

SEQ ID NO: 1002536 - RNA, 16 nt, Human
ugggaccuguggccaa

SEQ ID NO: 1002537 - RNA, 22 nt, Human
agcaggcuuguuaugucugaga

SEQ ID NO: 1002538 - RNA, 22 nt, Human
uuaacacaucccugcucuaccc

SEQ ID NO: 1002539 - RNA, 22 nt, Human
auggccuggggauuccugagca

SEQ ID NO: 1002540 - RNA, 22 nt, Human
uggggaccagauuagaccaugg

SEQ ID NO: 1002541 - RNA, 22 nt, Human
ugggcugaguguggaacuaguu

SEQ ID NO: 1002542 - RNA, 22 nt, Human
acauccagaucucagcauggcu

SEQ ID NO: 1002543 - RNA, 19 nt, Human
uggccagguacugucugcu

SEQ ID NO: 1002544 - RNA, 22 nt, Human
aaucacuuuucucuaauguagc

SEQ ID NO: 1002545 - RNA, 22 nt, Human
uuccaggccgggcaggaaacac

SEQ ID NO: 1002546 - RNA, 22 nt, Human
uccaggcagggcagccaucaag

SEQ ID NO: 1002547 - RNA, 22 nt, Human
agaauaugaucggaauacagau

SEQ ID NO: 1002548 - RNA, 22 nt, Human
uuuucauuagaaugacugagaa

SEQ ID NO: 1002549 - RNA, 22 nt, Human
cuucugggcauggcagagccug

SEQ ID NO: 1002550 - RNA, 22 nt, Human
auacuuuggucacuauuauugg

SEQ ID NO: 1002551 - RNA, 22 nt, Human
uggaccugggguggccuccucu

SEQ ID NO: 1002552 - RNA, 22 nt, Human
agggcugacaaauggcagugac

SEQ ID NO: 1002553 - RNA, 22 nt, Human
accaugaugggaagcucagggc

SEQ ID NO: 1002554 - RNA, 17 nt, Human
ugcuucuguauugcugg

SEQ ID NO: 1002555 - RNA, 22 nt, Human
cacuguccaugcuugcuaaccc

SEQ ID NO: 1002556 - RNA, 22 nt, Human
cccaggaguaagugacauuguu

SEQ ID NO: 1002557 - RNA, 22 nt, Human
auaaaauuugcuacuguuaaau

SEQ ID NO: 1002558 - RNA, 22 nt, Human
uccaggcagagcaacaaaauau

SEQ ID NO: 1002559 - RNA, 22 nt, Human
cgaggcucagagagggugacuu

SEQ ID NO: 1002560 - RNA, 22 nt, Human
uccuggcagggucuaggucuag

SEQ ID NO: 1002561 - RNA, 22 nt, Human
uccugcagaccucagucagguc

SEQ ID NO: 1002562 - RNA, 22 nt, Human
uucugucacuuuuuuggaaucu

SEQ ID NO: 1002563 - RNA, 22 nt, Human
gggacaauggaggccucucucc

SEQ ID NO: 1002564 - RNA, 22 nt, Human
ggggcugagaauucagucucgg

SEQ ID NO: 1002565 - RNA, 22 nt, Human
ugaccuuauuugaaaauagaga

SEQ ID NO: 1002566 - RNA, 22 nt, Human
gcuaggaaucggacccaggaag

SEQ ID NO: 1002567 - RNA, 22 nt, Human
ccugggcucaagugaugguccc

SEQ ID NO: 1002568 - RNA, 20 nt, Human
cccacacccuucccacuugg

SEQ ID NO: 1002569 - RNA, 22 nt, Human
gaacuguaguuaauacuacaca

SEQ ID NO: 1002570 - RNA, 20 nt, Human
ccuggcaggcggguuacuua

SEQ ID NO: 1002571 - RNA, 22 nt, Human
aaaagagugacugauaaguaua

SEQ ID NO: 1002572 - RNA, 22 nt, Human
ccagugcauaaucaauacagcc

SEQ ID NO: 1002573 - RNA, 22 nt, Human
gccaggcaggccacgcuguguu

SEQ ID NO: 1002574 - RNA, 17 nt, Human
aaguccagaguugagca

SEQ ID NO: 1002575 - RNA, 22 nt, Human
ccaggcucuguuccccgaggag

SEQ ID NO: 1002576 - RNA, 22 nt, Human
uccugggguuuuggccgcagcu

SEQ ID NO: 1002577 - RNA, 22 nt, Human
cccaguuucaacuuuccagugg

SEQ ID NO: 1002578 - RNA, 22 nt, Human
gcucugagaggaugcugagcag

SEQ ID NO: 1002579 - RNA, 22 nt, Human
uggcaguagauccagucucucu

SEQ ID NO: 1002580 - RNA, 22 nt, Human
uaaucuguauuccuacuuugca

SEQ ID NO: 1002581 - RNA, 22 nt, Human
augaacuuauuucugaacuuuu

SEQ ID NO: 1002582 - RNA, 15 nt, Human
ccaggcucugcacuc

SEQ ID NO: 1002583 - RNA, 22 nt, Human
gacccaggcccaaggcugccag

SEQ ID NO: 1002584 - RNA, 22 nt, Human
uacacaucucugucaguaguga

SEQ ID NO: 1002585 - RNA, 22 nt, Human
ugagagucuguuccucuugcag

SEQ ID NO: 1002586 - RNA, 22 nt, Human
ugccaggcacgugagaguggcc

SEQ ID NO: 1002587 - RNA, 22 nt, Human
uccugagcaacacagcuaagug

SEQ ID NO: 1002588 - RNA, 22 nt, Human
acccagcuguuucccgugucau

SEQ ID NO: 1002589 - RNA, 19 nt, Human
cagguggcgcucuacaggg

SEQ ID NO: 1002590 - RNA, 22 nt, Human
gagggcucacugagaaagcagu

SEQ ID NO: 1002591 - RNA, 22 nt, Human
gaaauauuacaguggaggggau

SEQ ID NO: 1002592 - RNA, 19 nt, Human
gcugggcuuggguuuguag

SEQ ID NO: 1002593 - RNA, 22 nt, Human
cuauuagguaugugguugcuau

SEQ ID NO: 1002594 - RNA, 22 nt, Human
uagaaacagaaaacuguaauag

SEQ ID NO: 1002595 - RNA, 22 nt, Human
cgaggcagggaagcugcaaaag

SEQ ID NO: 1002596 - RNA, 22 nt, Human
ugaguguauaucaggagagagc

SEQ ID NO: 1002597 - RNA, 22 nt, Human
uuuaccaguguuaaacaccagc

SEQ ID NO: 1002598 - RNA, 22 nt, Human
ccugggcugggcgucucauggg

SEQ ID NO: 1002599 - RNA, 22 nt, Human
gaggagcuguucccucaccucu

SEQ ID NO: 1002600 - RNA, 22 nt, Human
cacacagacagcucucugaaga

SEQ ID NO: 1002601 - RNA, 22 nt, Human
ggccucagagaaggcugugcgg

SEQ ID NO: 1002602 - RNA, 22 nt, Human
ggguaccaagcugcuugggggc

SEQ ID NO: 1002603 - RNA, 21 nt, Human
ucuggcaguggucuuucaaau

SEQ ID NO: 1002604 - RNA, 22 nt, Human
gagcuuuaagggauaaaaugau

SEQ ID NO: 1002605 - RNA, 22 nt, Human
ugccucucuaacccaugcccaa

SEQ ID NO: 1002606 - RNA, 22 nt, Human
auacuguacgucccagauagga

SEQ ID NO: 1002607 - RNA, 22 nt, Human
uccaggcuagguuuacaggaca

SEQ ID NO: 1002608 - RNA, 22 nt, Human
gaaauauugggacucagagcuu

SEQ ID NO: 1002609 - RNA, 22 nt, Human
cccugcagcauucucuaacugg

SEQ ID NO: 1002610 - RNA, 22 nt, Human
aggaccugacauuguguuuucu

SEQ ID NO: 1002611 - RNA, 22 nt, Human
augaaacagugaauuagucaag

SEQ ID NO: 1002612 - RNA, 22 nt, Human
uaaguuuuaagcaaucugauaa

SEQ ID NO: 1002613 - RNA, 22 nt, Human
uucugucaaauuugccauaugg

SEQ ID NO: 1002614 - RNA, 22 nt, Human
uggcaggcaaguucagcuccac

SEQ ID NO: 1002615 - RNA, 22 nt, Human
aauuagggagccaucauaaggu

SEQ ID NO: 1002616 - RNA, 19 nt, Human
auauauguauacaaugugg

SEQ ID NO: 1002617 - RNA, 22 nt, Human
caaaugcagauucaggaguucu

SEQ ID NO: 1002618 - RNA, 22 nt, Human
guuaauuuaguagaguccagau

SEQ ID NO: 1002619 - RNA, 22 nt, Human
agcagguugugauacacucaga

SEQ ID NO: 1002620 - RNA, 22 nt, Human
cccuuccugggugucccggagu

SEQ ID NO: 1002621 - RNA, 22 nt, Human
aaauauuugucugaggcgguug

SEQ ID NO: 1002622 - RNA, 22 nt, Human
ccaggcucugccaggcccuuga

SEQ ID NO: 1002623 - RNA, 22 nt, Human
agcaccaucacagcuguauguc

SEQ ID NO: 1002624 - RNA, 22 nt, Human
aaggccaucuacuuacggaauu

SEQ ID NO: 1002625 - RNA, 22 nt, Human
uuucaaauagaaucuuuccaaa

SEQ ID NO: 1002626 - RNA, 22 nt, Human
cagcacagugaccagacccacu

SEQ ID NO: 1002627 - RNA, 22 nt, Human
cccuuccuccucgccugucaga

SEQ ID NO: 1002628 - RNA, 22 nt, Human
ggauuucuuccuuccucagaag

SEQ ID NO: 1002629 - RNA, 22 nt, Human
cuguuuaucucuaaccuguuua

SEQ ID NO: 1002630 - RNA, 22 nt, Human
cagcuuuguggccuugaccucg

SEQ ID NO: 1002631 - RNA, 22 nt, Human
gagagaaaagggggaauugauu

SEQ ID NO: 1002632 - RNA, 22 nt, Human
cagcucugagacugaggcuaug

SEQ ID NO: 1002633 - RNA, 22 nt, Human
caaagucagccagcuaguaggu

SEQ ID NO: 1002634 - RNA, 22 nt, Human
cuucugggauuaauuuuuccug

SEQ ID NO: 1002635 - RNA, 17 nt, Human
uguuuucauucauugcu

SEQ ID NO: 1002636 - RNA, 22 nt, Human
aacacauauuuauauaugcaca

SEQ ID NO: 1002637 - RNA, 22 nt, Human
uccaggcacagaguuggucagu

SEQ ID NO: 1002638 - RNA, 22 nt, Human
ugaccaggauacugcagggaug

SEQ ID NO: 1002639 - RNA, 22 nt, Human
acaauacuauuuucaguauccu

SEQ ID NO: 1002640 - RNA, 18 nt, Human
ggccucagccuggccgga

SEQ ID NO: 1002641 - RNA, 22 nt, Human
ccagagagcuacaaggcauaaa

SEQ ID NO: 1002642 - RNA, 22 nt, Human
acugauuacacgaguucugacu

SEQ ID NO: 1002643 - RNA, 22 nt, Human
acagauauaaacuauaguagug

SEQ ID NO: 1002644 - RNA, 22 nt, Human
ccagcuuuagguugccugccag

SEQ ID NO: 1002645 - RNA, 22 nt, Human
acacauuucucuuuuuguaagu

SEQ ID NO: 1002646 - RNA, 22 nt, Human
ccaggcucugucuggucagaag

SEQ ID NO: 1002647 - RNA, 22 nt, Human
cuuucauaaaggaaaugaugag

SEQ ID NO: 1002648 - RNA, 21 nt, Human
ggcuuuaugcucacccagccu

SEQ ID NO: 1002649 - RNA, 22 nt, Human
uccaugagggacacuggaugcu

SEQ ID NO: 1002650 - RNA, 22 nt, Human
uccccaccuaagauacccaucu

SEQ ID NO: 1002651 - RNA, 22 nt, Human
ccagagcccagggucaugcagg

SEQ ID NO: 1002652 - RNA, 22 nt, Human
ucuaggagcuuaaaggaggcca

SEQ ID NO: 1002653 - RNA, 22 nt, Human
acugcuuacccggccugacuuc

SEQ ID NO: 1002654 - RNA, 22 nt, Human
caaaguuuuaguaaacauauau

SEQ ID NO: 1002655 - RNA, 22 nt, Human
gcugcgccggaucccacguucc

SEQ ID NO: 1002656 - RNA, 22 nt, Human
ugcaggcuccaggugcacauau

SEQ ID NO: 1002657 - RNA, 20 nt, Human
aacacagauaccaaagguug

SEQ ID NO: 1002658 - RNA, 19 nt, Human
ggcggguggacuggagccc

SEQ ID NO: 1002659 - RNA, 22 nt, Human
cacaaaaguaggaggcaggcgg

SEQ ID NO: 1002660 - RNA, 22 nt, Human
uacaaaaguaauuacgguuuuu

SEQ ID NO: 1002661 - RNA, 22 nt, Human
auggcuagcaccgcguugcugg

SEQ ID NO: 1002662 - RNA, 22 nt, Human
ugcaggcucugguuuauagugc

SEQ ID NO: 1002663 - RNA, 22 nt, Human
uaugacauugcuuuuuagaacu

SEQ ID NO: 1002664 - RNA, 22 nt, Human
uucugucaaacucacaggccga

SEQ ID NO: 1002665 - RNA, 22 nt, Human
agauuuauguggucacacucag

SEQ ID NO: 1002666 - RNA, 22 nt, Human
auuacaauaagguuuauuugua

SEQ ID NO: 1002667 - RNA, 22 nt, Human
gcugggcugcgucggggaagcc

SEQ ID NO: 1002668 - RNA, 18 nt, Human
cucagagaugcccuuauu

SEQ ID NO: 1002669 - RNA, 22 nt, Human
ucacacagcugacagagccuuu

SEQ ID NO: 1002670 - RNA, 22 nt, Human
acugggcuguaaagagaggcaa

SEQ ID NO: 1002671 - RNA, 18 nt, Human
agacccucuaagggcagu

SEQ ID NO: 1002672 - RNA, 22 nt, Human
uuuagggaaauugaggguuaag

SEQ ID NO: 1002673 - RNA, 22 nt, Human
uuucuuagcgaugcuugauaaa

SEQ ID NO: 1002674 - RNA, 22 nt, Human
uagcuuuaggcacguuugaauu

SEQ ID NO: 1002675 - RNA, 22 nt, Human
ugagaauuuucaguuucacuuu

SEQ ID NO: 1002676 - RNA, 22 nt, Human
uaguuaggaaaguccagggagc

SEQ ID NO: 1002677 - RNA, 22 nt, Human
gcagcucugacaaugccuggaa

SEQ ID NO: 1002678 - RNA, 22 nt, Human
ucuggggcaguuacuggggccu

SEQ ID NO: 1002679 - RNA, 22 nt, Human
ucucuuaaaggucuucagcuga

SEQ ID NO: 1002680 - RNA, 22 nt, Human
gccuggaagugugucgugggaa

SEQ ID NO: 1002681 - RNA, 22 nt, Human
guggcagguuccguagacagca

SEQ ID NO: 1002682 - RNA, 22 nt, Human
uggcagaaagaaccaugugcaa

SEQ ID NO: 1002683 - RNA, 22 nt, Human
ccagccuuacugcccuucagug

SEQ ID NO: 1002684 - RNA, 20 nt, Human
acaauauguagaugaauagc

SEQ ID NO: 1002685 - RNA, 22 nt, Human
ucagagaguuacacaaauuguu

SEQ ID NO: 1002686 - RNA, 22 nt, Human
aacccaggguggagguugcagu

SEQ ID NO: 1002687 - RNA, 23 nt, Human
gggaccugguaggaggugauugg

SEQ ID NO: 1002688 - RNA, 22 nt, Human
cugggcuucucccccuggcaga

SEQ ID NO: 1002689 - RNA, 22 nt, Human
agggccucuaccauccaagguu

SEQ ID NO: 1002690 - RNA, 22 nt, Human
aauaucuucuaaggauagaacu

SEQ ID NO: 1002691 - RNA, 22 nt, Human
accugccuauggagccacaugg

SEQ ID NO: 1002692 - RNA, 22 nt, Human
cagaggcagacccuccagggcg

SEQ ID NO: 1002693 - RNA, 17 nt, Human
aguguuuccuuaucauu

SEQ ID NO: 1002694 - RNA, 22 nt, Human
cuucaaaugugauuuuaauaac

SEQ ID NO: 1002695 - RNA, 22 nt, Human
uacagcauguccuuagcaaggc

SEQ ID NO: 1002696 - RNA, 22 nt, Human
ucagcuuucucuucuaucgaua

SEQ ID NO: 1002697 - RNA, 22 nt, Human
gaggagcugcagggggagucua

SEQ ID NO: 1002698 - RNA, 22 nt, Human
aauuucuccaagaaugcuuaga

SEQ ID NO: 1002699 - RNA, 22 nt, Human
ccagcuuucucagaggcuucua

SEQ ID NO: 1002700 - RNA, 19 nt, Human
agaaucaggucaggugaca

SEQ ID NO: 1002701 - RNA, 22 nt, Human
gcacccaguuugucucaggguu

SEQ ID NO: 1002702 - RNA, 22 nt, Human
acauuucacuguucacagcagg

SEQ ID NO: 1002703 - RNA, 22 nt, Human
ucuggcagaggaaggaggccug

SEQ ID NO: 1002704 - RNA, 22 nt, Human
acaaucauuccguucacaacag

SEQ ID NO: 1002705 - RNA, 22 nt, Human
agggcgacaauggagagcguuu

SEQ ID NO: 1002706 - RNA, 22 nt, Human
ggugccagaguggcccaggggc

SEQ ID NO: 1002707 - RNA, 22 nt, Human
ggcaggcuuugagaaagagcau

SEQ ID NO: 1002708 - RNA, 23 nt, Human
ucugcagacgcuguucuauuguc

SEQ ID NO: 1002709 - RNA, 22 nt, Human
cagagcauuuggaagccacgug

SEQ ID NO: 1002710 - RNA, 22 nt, Human
cacugucccuguuuccuggaaa

SEQ ID NO: 1002711 - RNA, 22 nt, Human
cauucccacguguucuuugcuu

SEQ ID NO: 1002712 - RNA, 22 nt, Human
ccugcagaggucaggccagaaa

SEQ ID NO: 1002713 - RNA, 22 nt, Human
aagggcuccauccuuauaaaug

SEQ ID NO: 1002714 - RNA, 22 nt, Human
cuccuggcuuucccagaccagg

SEQ ID NO: 1002715 - RNA, 22 nt, Human
uaauuuuaacugugcuguuugg

SEQ ID NO: 1002716 - RNA, 22 nt, Human
uccugcaguuacaucccagcca

SEQ ID NO: 1002717 - RNA, 22 nt, Human
acaguguuuuagaaaagcuuga

SEQ ID NO: 1002718 - RNA, 22 nt, Human
uggccucugugggagcugagca

SEQ ID NO: 1002719 - RNA, 22 nt, Human
uuuagggacaagggucuggggu

SEQ ID NO: 1002720 - RNA, 22 nt, Human
auggcagaccuccuggccacaa

SEQ ID NO: 1002721 - RNA, 22 nt, Human
guagggacuguucucaccugag

SEQ ID NO: 1002722 - RNA, 22 nt, Human
ggaaccacagcccccagcaggc

SEQ ID NO: 1002723 - RNA, 22 nt, Human
aauuagggaaaauuuacuugua

SEQ ID NO: 1002724 - RNA, 22 nt, Human
aaauuucuugaggcucucuagc

SEQ ID NO: 1002725 - RNA, 22 nt, Human
cuggcuuucauuucaagcacgu

SEQ ID NO: 1002726 - RNA, 16 nt, Human
uucugucacguacggc

SEQ ID NO: 1002727 - RNA, 22 nt, Human
uucuggggccaauugccacugc

SEQ ID NO: 1002728 - RNA, 22 nt, Human
uacuuuuagccuauuugauucu

SEQ ID NO: 1002729 - RNA, 22 nt, Human
ucacauuuuuuacuggacuuaa

SEQ ID NO: 1002730 - RNA, 22 nt, Human
gcacaggaugauggguugaggg

SEQ ID NO: 1002731 - RNA, 22 nt, Human
aggaccugccaggugcaaagca

SEQ ID NO: 1002732 - RNA, 22 nt, Human
uacauauguaaacauguauaaa

SEQ ID NO: 1002733 - RNA, 22 nt, Human
uuuaauuugaaaugaguaaccc

SEQ ID NO: 1002734 - RNA, 22 nt, Human
ugguuuaccccuguccuauauc

SEQ ID NO: 1002735 - RNA, 22 nt, Human
gccaagcucaccuucugaugga

SEQ ID NO: 1002736 - RNA, 22 nt, Human
aaaaauaggucaaccguguaug

SEQ ID NO: 1002737 - RNA, 22 nt, Human
aacuacauuguccuuucugaag

SEQ ID NO: 1002738 - RNA, 22 nt, Human
uccucuccaugucucacgccac

SEQ ID NO: 1002739 - RNA, 22 nt, Human
ugcagggaaucuguggcuggac

SEQ ID NO: 1002740 - RNA, 22 nt, Human
cauuuguacagaacagcuuuau

SEQ ID NO: 1002741 - RNA, 22 nt, Human
aaugaucuacucucauuaucuc

SEQ ID NO: 1002742 - RNA, 22 nt, Human
cagcacaggucaguuuuuuaag

SEQ ID NO: 1002743 - RNA, 22 nt, Human
uccaggcaugucugaguccuuc

SEQ ID NO: 1002744 - RNA, 22 nt, Human
cagacccugggccacagaggag

SEQ ID NO: 1002745 - RNA, 22 nt, Human
cagggcucagaagacagaccuc

SEQ ID NO: 1002746 - RNA, 22 nt, Human
ucaucacaauuuuaugacccuc

SEQ ID NO: 1002747 - RNA, 22 nt, Human
ugcucugcacaucccucacaaa

SEQ ID NO: 1002748 - RNA, 22 nt, Human
acaggcucuggggcaggauggc

SEQ ID NO: 1002749 - RNA, 22 nt, Human
caccuaggguuucgccuuucuu

SEQ ID NO: 1002750 - RNA, 22 nt, Human
uaauuucaauagcuugcauaau

SEQ ID NO: 1002751 - RNA, 22 nt, Human
uguggagacuauagccauaaca

SEQ ID NO: 1002752 - RNA, 22 nt, Human
gcagggcucaacaggacacccc

SEQ ID NO: 1002753 - RNA, 22 nt, Human
ucuccugucuucucagcacccc

SEQ ID NO: 1002754 - RNA, 22 nt, Human
aguaugaauggaaacuaccuau

SEQ ID NO: 1002755 - RNA, 22 nt, Human
uucugggguuaugggugauucu

SEQ ID NO: 1002756 - RNA, 22 nt, Human
cucuuaaagcuuccaguuucaa

SEQ ID NO: 1002757 - RNA, 22 nt, Human
uuucaaaccuacuuguauguuu

SEQ ID NO: 1002758 - RNA, 22 nt, Human
acuggggagagucaugccagca

SEQ ID NO: 1002759 - RNA, 22 nt, Human
uccuggcauccgugggucugug

SEQ ID NO: 1002760 - RNA, 22 nt, Human
uuuucucuuguuaauguacuga

SEQ ID NO: 1002761 - RNA, 22 nt, Human
ggcugcaggcagaggcugucug

SEQ ID NO: 1002762 - RNA, 21 nt, Human
cagaggcaggcucugugugug

SEQ ID NO: 1002763 - RNA, 22 nt, Human
uuucacauaucaacucuauccu

SEQ ID NO: 1002764 - RNA, 22 nt, Human
cuuccucccccacacacucacu

SEQ ID NO: 1002765 - RNA, 22 nt, Human
gccuggaaucaugcagggguua

SEQ ID NO: 1002766 - RNA, 22 nt, Human
caguguggugagauuccaggug

SEQ ID NO: 1002767 - RNA, 22 nt, Human
agcucccaggcagucaugagga

SEQ ID NO: 1002768 - RNA, 22 nt, Human
augugguugaagaauuacaucu

SEQ ID NO: 1002769 - RNA, 20 nt, Human
cauauauaccuagaagugga

SEQ ID NO: 1002770 - RNA, 22 nt, Human
cauaugaaauaugaguugaaca

SEQ ID NO: 1002771 - RNA, 17 nt, Human
uccaggcagcaacugag

SEQ ID NO: 1002772 - RNA, 22 nt, Human
gaaacuuacuuacucacauuuc

SEQ ID NO: 1002773 - RNA, 22 nt, Human
uagcaauagaaacauauaaagu

SEQ ID NO: 1002774 - RNA, 22 nt, Human
auguguuuguaccuuuaaauau

SEQ ID NO: 1002775 - RNA, 22 nt, Human
cugccugcucaccagggcucug

SEQ ID NO: 1002776 - RNA, 21 nt, Human
agcaacucugacuagaugagg

SEQ ID NO: 1002777 - RNA, 22 nt, Human
uuagacauguuugcuaaaauga

SEQ ID NO: 1002778 - RNA, 17 nt, Human
gcuaggagagggaggag

SEQ ID NO: 1002779 - RNA, 22 nt, Human
agcugccaaguuucucaguuua

SEQ ID NO: 1002780 - RNA, 22 nt, Human
aaucuucagugucuaaaaagca

SEQ ID NO: 1002781 - RNA, 22 nt, Human
gggcugaccaaugccuugcuuu

SEQ ID NO: 1002782 - RNA, 22 nt, Human
cagcuuuuuagaaucuagggca

SEQ ID NO: 1002783 - RNA, 22 nt, Human
uuguaaaugaccuuuucuaauu

SEQ ID NO: 1002784 - RNA, 22 nt, Human
agagggugcuggagagacauug

SEQ ID NO: 1002785 - RNA, 22 nt, Human
gcacccaggccggcgacugcag

SEQ ID NO: 1002786 - RNA, 22 nt, Human
uuuacacaaaagauagcacacc

SEQ ID NO: 1002787 - RNA, 22 nt, Human
aguauaaagugguuuucagcac

SEQ ID NO: 1002788 - RNA, 22 nt, Human
ccuggcaguucaucaaauggca

SEQ ID NO: 1002789 - RNA, 22 nt, Human
auuauuucucacucacauaaua

SEQ ID NO: 1002790 - RNA, 22 nt, Human
ccuucaaaacacuaguuuuuga

SEQ ID NO: 1002791 - RNA, 22 nt, Human
gccaaugacagucucaguucug

SEQ ID NO: 1002792 - RNA, 22 nt, Human
gaauauuuuuaaagggacuaau

SEQ ID NO: 1002793 - RNA, 22 nt, Human
uuauucugcacuuuuaaaauau

SEQ ID NO: 1002794 - RNA, 22 nt, Human
caguguuucugaguuccagcuc

SEQ ID NO: 1002795 - RNA, 22 nt, Human
gaggcuccccaugaggccccag

SEQ ID NO: 1002796 - RNA, 22 nt, Human
gcacucuccuggcugccacagu

SEQ ID NO: 1002797 - RNA, 22 nt, Human
aaagcagggaugaggcuagagg

SEQ ID NO: 1002798 - RNA, 22 nt, Human
ucuggcagcuauccucuggcca

SEQ ID NO: 1002799 - RNA, 22 nt, Human
uauucacaguugauuuacaguu

SEQ ID NO: 1002800 - RNA, 22 nt, Human
aaauacauacacuguacguggc

SEQ ID NO: 1002801 - RNA, 22 nt, Human
gcagggguagugucuuccugag

SEQ ID NO: 1002802 - RNA, 22 nt, Human
gacccagcuaaccaggugggga

SEQ ID NO: 1002803 - RNA, 22 nt, Human
gcuucuggcagugcagccacca

SEQ ID NO: 1002804 - RNA, 23 nt, Human
gagggcucugagugcuugggcca

SEQ ID NO: 1002805 - RNA, 22 nt, Human
gaaucauuggaaccacauccaa

SEQ ID NO: 1002806 - RNA, 20 nt, Human
guauuagguguuccucuuuc

SEQ ID NO: 1002807 - RNA, 22 nt, Human
cuugggaggagaacaaagcucc

SEQ ID NO: 1002808 - RNA, 21 nt, Human
auaaaguuuuacaggaaugca

SEQ ID NO: 1002809 - RNA, 22 nt, Human
gcagcuuugaagacuuauuugc

SEQ ID NO: 1002810 - RNA, 22 nt, Human
ucccaaggccaggcaucuagaa

SEQ ID NO: 1002811 - RNA, 22 nt, Human
auguuucaucaguaagguuuug

SEQ ID NO: 1002812 - RNA, 22 nt, Human
guggccaggccgacugccaggc

SEQ ID NO: 1002813 - RNA, 22 nt, Human
cugggcuuaggaccuggugcgg

SEQ ID NO: 1002814 - RNA, 22 nt, Human
uggcagagcccagacuccaguc

SEQ ID NO: 1002815 - RNA, 22 nt, Human
ccugggcucuauccugacccag

SEQ ID NO: 1002816 - RNA, 22 nt, Human
cagggcucccugcagccucugu

SEQ ID NO: 1002817 - RNA, 22 nt, Human
ucagagagaaauaguuuuugac

SEQ ID NO: 1002818 - RNA, 18 nt, Human
ggacaucaucaggugcuu

SEQ ID NO: 1002819 - RNA, 22 nt, Human
uaugaacuagcugauuuaguuu

SEQ ID NO: 1002820 - RNA, 22 nt, Human
ucaaucacguguuccauguucu

SEQ ID NO: 1002821 - RNA, 22 nt, Human
augugaaauagcuggauaugaa

SEQ ID NO: 1002822 - RNA, 22 nt, Human
gguaugaauucacuacuuccaa

SEQ ID NO: 1002823 - RNA, 22 nt, Human
uucaaaauuguucuaagcucug

SEQ ID NO: 1002824 - RNA, 22 nt, Human
aauacuauguugugacacauga

SEQ ID NO: 1002825 - RNA, 22 nt, Human
auuacaguaacagcuacaaugc

SEQ ID NO: 1002826 - RNA, 22 nt, Human
cuggccucuguguucaccauag

SEQ ID NO: 1002827 - RNA, 22 nt, Human
guccuggcaccucacuggcuac

SEQ ID NO: 1002828 - RNA, 22 nt, Human
aucugucagccugggauuaggg

SEQ ID NO: 1002829 - RNA, 23 nt, Human
ugaaacauuuaggguagaauuuc

SEQ ID NO: 1002830 - RNA, 22 nt, Human
cuagaaauauuuuacagucaag

SEQ ID NO: 1002831 - RNA, 22 nt, Human
uguccagguggccucugcugcu

SEQ ID NO: 1002832 - RNA, 22 nt, Human
cugggcugagccugggcugugu

SEQ ID NO: 1002833 - RNA, 22 nt, Human
gacacagauaucucugagauua

SEQ ID NO: 1002834 - RNA, 22 nt, Human
uccagacccaugacccugggga

SEQ ID NO: 1002835 - RNA, 18 nt, Human
gccaggcaggguggggaa

SEQ ID NO: 1002836 - RNA, 22 nt, Human
uuccagcccgcgacuuguucag

SEQ ID NO: 1002837 - RNA, 22 nt, Human
agcaggcuccuuccuucucugg

SEQ ID NO: 1002838 - RNA, 19 nt, Human
ggcauccacgaaugcagag

SEQ ID NO: 1002839 - RNA, 22 nt, Human
uuuaaauucugucugccgcuua

SEQ ID NO: 1002840 - RNA, 22 nt, Human
gugggcuucccuuaagccagag

SEQ ID NO: 1002841 - RNA, 22 nt, Human
acccagcaugacaccugcacau

SEQ ID NO: 1002842 - RNA, 18 nt, Human
gacacauccccaggccuc

SEQ ID NO: 1002843 - RNA, 22 nt, Human
auaaacaguaaaugugagcagu

SEQ ID NO: 1002844 - RNA, 22 nt, Human
cauaauuucuguaucagcacca

SEQ ID NO: 1002845 - RNA, 22 nt, Human
ucacacacauaaucuaagauua

SEQ ID NO: 1002846 - RNA, 21 nt, Human
ugcaggcuguuuaagaggcaa

SEQ ID NO: 1002847 - RNA, 22 nt, Human
acuagauaauuauaaaagguag

SEQ ID NO: 1002848 - RNA, 22 nt, Human
cagggggugcaggcccugugac

SEQ ID NO: 1002849 - RNA, 22 nt, Human
agagagcauggcacagaggggu

SEQ ID NO: 1002850 - RNA, 22 nt, Human
ggcuccaagucucagagugaag

SEQ ID NO: 1002851 - RNA, 22 nt, Human
cuucugggcauucagcugcaca

SEQ ID NO: 1002852 - RNA, 22 nt, Human
ucacauacacuaggauauuuuu

SEQ ID NO: 1002853 - RNA, 22 nt, Human
uuugaaauaugaggcauuauga

SEQ ID NO: 1002854 - RNA, 22 nt, Human
ucuggcagcgaagcguguacuu

SEQ ID NO: 1002855 - RNA, 22 nt, Human
auauuauucuagcucuugugug

SEQ ID NO: 1002856 - RNA, 22 nt, Human
gcuggggaccagcugucucuga

SEQ ID NO: 1002857 - RNA, 22 nt, Human
gcagagaggaaugaagccaucc

SEQ ID NO: 1002858 - RNA, 22 nt, Human
augcuuuuccaggagaaauaua

SEQ ID NO: 1002859 - RNA, 22 nt, Human
cucugagauaguuucuaucaau

SEQ ID NO: 1002860 - RNA, 22 nt, Human
acacagaguuugacacauggga

SEQ ID NO: 1002861 - RNA, 22 nt, Human
cuauugaauuaacuauuaaagu

SEQ ID NO: 1002862 - RNA, 22 nt, Human
cuuaaauucuuaaugcccucau

SEQ ID NO: 1002863 - RNA, 22 nt, Human
guccucugcuucaugcccugau

SEQ ID NO: 1002864 - RNA, 22 nt, Human
ccugggcucaagugauccuccu

SEQ ID NO: 1002865 - RNA, 22 nt, Human
cacaugaagagagucuaguaau

SEQ ID NO: 1002866 - RNA, 22 nt, Human
cugcucuaauaucagauagacu

SEQ ID NO: 1002867 - RNA, 22 nt, Human
aacuuaaacccacucauguaga

SEQ ID NO: 1002868 - RNA, 22 nt, Human
uccaggagguagugcuuaauuu

SEQ ID NO: 1002869 - RNA, 22 nt, Human
aagagcauggaauggagaucca

SEQ ID NO: 1002870 - RNA, 22 nt, Human
agggccucugacgcccccagcc

SEQ ID NO: 1002871 - RNA, 22 nt, Human
cugcagggcagaagggcauaga

SEQ ID NO: 1002872 - RNA, 22 nt, Human
gcagggaccagggccagaucca

SEQ ID NO: 1002873 - RNA, 22 nt, Human
cuguccuccagacgacaguccc

SEQ ID NO: 1002874 - RNA, 22 nt, Human
gccaagcuuauaugaugcuuga

SEQ ID NO: 1002875 - RNA, 22 nt, Human
ucccagccuggacccugccagu

SEQ ID NO: 1002876 - RNA, 22 nt, Human
ugcaggcucugugugugccugg

SEQ ID NO: 1002877 - RNA, 20 nt, Human
cccugcagccaugggagugg

SEQ ID NO: 1002878 - RNA, 22 nt, Human
acacauaagaaacuacaaagag

SEQ ID NO: 1002879 - RNA, 22 nt, Human
ggcaggcuuucagcaucaaguc

SEQ ID NO: 1002880 - RNA, 22 nt, Human
caagauaagaucauuuacacua

SEQ ID NO: 1002881 - RNA, 22 nt, Human
uaauuucuaauucauuuucagu

SEQ ID NO: 1002882 - RNA, 22 nt, Human
aagggcucuguugccauuucag

SEQ ID NO: 1002883 - RNA, 22 nt, Human
ccaggccuucugaggacacucu

SEQ ID NO: 1002884 - RNA, 23 nt, Human
acagugugguggacaaggagcag

SEQ ID NO: 1002885 - RNA, 17 nt, Human
gugaagagucauugaau

SEQ ID NO: 1002886 - RNA, 22 nt, Human
auuaauuuuaccuuuguaaaca

SEQ ID NO: 1002887 - RNA, 22 nt, Human
cugcagggugacguugcccacc

SEQ ID NO: 1002888 - RNA, 22 nt, Human
ugggcugaacuucaucugauga

SEQ ID NO: 1002889 - RNA, 22 nt, Human
augggcuguccuaguccagccc

SEQ ID NO: 1002890 - RNA, 22 nt, Human
ucuucaaagaauuuuaguaauu

SEQ ID NO: 1002891 - RNA, 22 nt, Human
aauguuguuuuucugcaugucu

SEQ ID NO: 1002892 - RNA, 23 nt, Human
uugggcuggcucucgaugccucu

SEQ ID NO: 1002893 - RNA, 22 nt, Human
aauauaauuuuauuccuagagu

SEQ ID NO: 1002894 - RNA, 22 nt, Human
cagagacuggagugcaguggcg

SEQ ID NO: 1002895 - RNA, 22 nt, Human
aaguccagcucuaaauaucuga

SEQ ID NO: 1002896 - RNA, 22 nt, Human
uaacacaugucugggaugugaa

SEQ ID NO: 1002897 - RNA, 22 nt, Human
gaggcucugugaugugccaggc

SEQ ID NO: 1002898 - RNA, 22 nt, Human
uagggcucagaguccaguuucu

SEQ ID NO: 1002899 - RNA, 22 nt, Human
cagagccuuccuagcagacucu

SEQ ID NO: 1002900 - RNA, 22 nt, Human
uaugagaaucugcaguaugcuu

SEQ ID NO: 1002901 - RNA, 22 nt, Human
ccugggcucugaggagggaguc

SEQ ID NO: 1002902 - RNA, 22 nt, Human
aggaggcugggcacaguggccu

SEQ ID NO: 1002903 - RNA, 20 nt, Human
ucagauuuuucuaacuuuga

SEQ ID NO: 1002904 - RNA, 20 nt, Human
cugaacacagaauaagcaca

SEQ ID NO: 1002905 - RNA, 19 nt, Human
ccaggccugcgggcguugg

SEQ ID NO: 1002906 - RNA, 22 nt, Human
ccagccacugggccacugccag

SEQ ID NO: 1002907 - RNA, 22 nt, Human
ucccacccccuccaaggaggaa

SEQ ID NO: 1002908 - RNA, 22 nt, Human
aauuugauucccugcaccuguu

SEQ ID NO: 1002909 - RNA, 22 nt, Human
aggcaccuugagagcaggagcu

SEQ ID NO: 1002910 - RNA, 20 nt, Human
ucccaggcuccacccuagac

SEQ ID NO: 1002911 - RNA, 22 nt, Human
caauuucucgaacucuaaucca

SEQ ID NO: 1002912 - RNA, 22 nt, Human
ucuggggaugagugaugucgua

SEQ ID NO: 1002913 - RNA, 22 nt, Human
ucugggcuggcuuuaugcugac

SEQ ID NO: 1002914 - RNA, 22 nt, Human
uucugucucuguguuuacauua

SEQ ID NO: 1002915 - RNA, 22 nt, Human
uaauaucuggcauucaaacaug

SEQ ID NO: 1002916 - RNA, 22 nt, Human
caaugauugcuauuuacauaaa

SEQ ID NO: 1002917 - RNA, 22 nt, Human
uggcaugggcaaaccagggaaa

SEQ ID NO: 1002918 - RNA, 17 nt, Human
uuaagguggaucagcac

SEQ ID NO: 1002919 - RNA, 22 nt, Human
uucuaccuacccucugcauaca

SEQ ID NO: 1002920 - RNA, 22 nt, Human
uacacagaaccugguguacagu

SEQ ID NO: 1002921 - RNA, 22 nt, Human
ccugcaggcugcaggccaguuc

SEQ ID NO: 1002922 - RNA, 22 nt, Human
guuaacacaggacucucugccu

SEQ ID NO: 1002923 - RNA, 20 nt, Human
gccucagccaacccaugggg

SEQ ID NO: 1002924 - RNA, 22 nt, Human
uuucacauuggcuucuauuucu

SEQ ID NO: 1002925 - RNA, 22 nt, Human
guccucuguuagaaaugugcuu

SEQ ID NO: 1002926 - RNA, 22 nt, Human
gccaagcuguuuuucagagacg

SEQ ID NO: 1002927 - RNA, 22 nt, Human
acaugacuuuucucuuccagag

SEQ ID NO: 1002928 - RNA, 22 nt, Human
cauuuguagcuauuuacuguau

SEQ ID NO: 1002929 - RNA, 22 nt, Human
uuggaaauggcuguaguuauga

SEQ ID NO: 1002930 - RNA, 22 nt, Human
uuucuauugaucuaauaaacau

SEQ ID NO: 1002931 - RNA, 22 nt, Human
ugggaccuguuacauugaguua

SEQ ID NO: 1002932 - RNA, 22 nt, Human
ccagagaguaucauggagagua

SEQ ID NO: 1002933 - RNA, 22 nt, Human
uggaaauacuugccauaaaacu

SEQ ID NO: 1002934 - RNA, 20 nt, Human
ggccucaguguccuuguuug

SEQ ID NO: 1002935 - RNA, 22 nt, Human
uagggcuccacucccagagauu

SEQ ID NO: 1002936 - RNA, 22 nt, Human
uaugaacuguaacccucaccgc

SEQ ID NO: 1002937 - RNA, 18 nt, Human
gaguguggcacugggccc

SEQ ID NO: 1002938 - RNA, 22 nt, Human
auguccaguuucuacacacaua

SEQ ID NO: 1002939 - RNA, 21 nt, Human
acauucacaggauauuaucau

SEQ ID NO: 1002940 - RNA, 22 nt, Human
acagaguccuagcugcaaagaa

SEQ ID NO: 1002941 - RNA, 22 nt, Human
ugggccaggucugugucagcug

SEQ ID NO: 1002942 - RNA, 22 nt, Human
cagcucaggcucuccaugcucc

SEQ ID NO: 1002943 - RNA, 22 nt, Human
ugucagagcaaugagguucagc

SEQ ID NO: 1002944 - RNA, 19 nt, Human
ccaaaagcaauuccaagua

SEQ ID NO: 1002945 - RNA, 22 nt, Human
uuguacaaguauuaugugaaca

SEQ ID NO: 1002946 - RNA, 21 nt, Human
ccuagccucuuacccagcuuu

SEQ ID NO: 1002947 - RNA, 15 nt, Human
uccaggcauucauuc

SEQ ID NO: 1002948 - RNA, 22 nt, Human
gccaggcagcagcgaggauggu

SEQ ID NO: 1002949 - RNA, 22 nt, Human
aauaguauuuauuuggaaaaag

SEQ ID NO: 1002950 - RNA, 22 nt, Human
gcugcuaagcguuucuguucca

SEQ ID NO: 1002951 - RNA, 22 nt, Human
gcuggcagggugguugagagag

SEQ ID NO: 1002952 - RNA, 22 nt, Human
uacuuacagaaggaagcaauug

SEQ ID NO: 1002953 - RNA, 21 nt, Human
ccagcuuucccaagucccuuu

SEQ ID NO: 1002954 - RNA, 22 nt, Human
gcagcuuucugcaaugucaucc

SEQ ID NO: 1002955 - RNA, 22 nt, Human
cuccuggcaguuccccuuguca

SEQ ID NO: 1002956 - RNA, 20 nt, Human
auuuggcaugaaguauugau

SEQ ID NO: 1002957 - RNA, 22 nt, Human
cuccucuguauugauugggacu

SEQ ID NO: 1002958 - RNA, 23 nt, Human
ugagggacaugguggcuucugag

SEQ ID NO: 1002959 - RNA, 22 nt, Human
auagggccuaaaaaguauugcu

SEQ ID NO: 1002960 - RNA, 22 nt, Human
aguggcugccaagagcaaugcu

SEQ ID NO: 1002961 - RNA, 22 nt, Human
acaaaguuugugguauuccaag

SEQ ID NO: 1002962 - RNA, 22 nt, Human
aguccggggucuggacaccugg

SEQ ID NO: 1002963 - RNA, 22 nt, Human
aaauuauuacaagcuaguuggc

SEQ ID NO: 1002964 - RNA, 22 nt, Human
uuuucguuuauuugacauguaa

SEQ ID NO: 1002965 - RNA, 22 nt, Human
cucucugggcccaguuggcacc

SEQ ID NO: 1002966 - RNA, 23 nt, Human
uccaggcacgcauuucuucuagc

SEQ ID NO: 1002967 - RNA, 21 nt, Human
uccaaaucccauucuguaguc

SEQ ID NO: 1002968 - RNA, 22 nt, Human
cacacagaaccgcucgccacuu

SEQ ID NO: 1002969 - RNA, 22 nt, Human
ggaagaaagcacacaaacuuga

SEQ ID NO: 1002970 - RNA, 22 nt, Human
gguuucaaugagaagugcuugu

SEQ ID NO: 1002971 - RNA, 22 nt, Human
accugcaguggccacuccuaau

SEQ ID NO: 1002972 - RNA, 22 nt, Human
aagggcucucugcauugaaauu

SEQ ID NO: 1002973 - RNA, 22 nt, Human
ucagagaguccuggucauuugc

SEQ ID NO: 1002974 - RNA, 20 nt, Human
cagcuuuagaucuuugauua

SEQ ID NO: 1002975 - RNA, 22 nt, Human
gccaggcauuuauugauugaau

SEQ ID NO: 1002976 - RNA, 23 nt, Human
caggcucccggaccaggauccgc

SEQ ID NO: 1002977 - RNA, 22 nt, Human
acuggggagugguuuugggaag

SEQ ID NO: 1002978 - RNA, 22 nt, Human
aaauuucuaagcagccacuucc

SEQ ID NO: 1002979 - RNA, 22 nt, Human
cagugagggcauucagugcugg

SEQ ID NO: 1002980 - RNA, 20 nt, Human
aauuuacucacagaaugaau

SEQ ID NO: 1002981 - RNA, 22 nt, Human
cucauaaugugacuguauuuga

SEQ ID NO: 1002982 - RNA, 22 nt, Human
aaaguuaguuucuuauaugucu

SEQ ID NO: 1002983 - RNA, 22 nt, Human
aaaguaguuagucaugugaaaa

SEQ ID NO: 1002984 - RNA, 22 nt, Human
uucugugcccauuuuaaaaugg

SEQ ID NO: 1002985 - RNA, 22 nt, Human
cagagcucagagcagggcacuc

SEQ ID NO: 1002986 - RNA, 22 nt, Human
aucaaguuuucuuaguugacug

SEQ ID NO: 1002987 - RNA, 22 nt, Human
ugcuucuguucuuucaccuacg

SEQ ID NO: 1002988 - RNA, 22 nt, Human
agguuuaugccuuggagcuggg

SEQ ID NO: 1002989 - RNA, 22 nt, Human
uccuucccaggugucgccgccu

SEQ ID NO: 1002990 - RNA, 22 nt, Human
aacaaacaaacauuuugucauc

SEQ ID NO: 1002991 - RNA, 22 nt, Human
gcaggggcuaaggacacagaga

SEQ ID NO: 1002992 - RNA, 22 nt, Human
ucaauauauuccauguuuucuc

SEQ ID NO: 1002993 - RNA, 22 nt, Human
ccaggcucugacauagauggga

SEQ ID NO: 1002994 - RNA, 23 nt, Human
gaggcagcuccugcagugcccug

SEQ ID NO: 1002995 - RNA, 22 nt, Human
acuggcuugaaguagauucaaa

SEQ ID NO: 1002996 - RNA, 22 nt, Human
uuucacauggaagcucucgaga

SEQ ID NO: 1002997 - RNA, 22 nt, Human
ccaggcucagcgcgcacgucug

SEQ ID NO: 1002998 - RNA, 22 nt, Human
cagggcuccaugcagggacucc

SEQ ID NO: 1002999 - RNA, 22 nt, Human
uuggcaggaauauugcagaggu

SEQ ID NO: 1003000 - RNA, 21 nt, Human
ucuggcaggaagacggauggg

SEQ ID NO: 1003001 - RNA, 22 nt, Human
gccucaggccgcccugcugcuc

SEQ ID NO: 1003002 - RNA, 22 nt, Human
aaagucuuuauuuuguaucuuu

SEQ ID NO: 1003003 - RNA, 22 nt, Human
ugguuccuucugcauuuucagc

SEQ ID NO: 1003004 - RNA, 22 nt, Human
caguuuauagcucuagcagcuu

SEQ ID NO: 1003005 - RNA, 18 nt, Human
ucuaggagaguaccuacc

SEQ ID NO: 1003006 - RNA, 22 nt, Human
gcacacaugcaugcacaggagu

SEQ ID NO: 1003007 - RNA, 22 nt, Human
uggaacacuguggaugagaaga

SEQ ID NO: 1003008 - RNA, 22 nt, Human
gugccaaaagcuauaauuuggu

SEQ ID NO: 1003009 - RNA, 22 nt, Human
acaguucccgucuugcacagcu

SEQ ID NO: 1003010 - RNA, 22 nt, Human
cccugcagaucuaggguccuuc

SEQ ID NO: 1003011 - RNA, 18 nt, Human
uccugccugugccccagg

SEQ ID NO: 1003012 - RNA, 22 nt, Human
ggcuccacugcugaccacucca

SEQ ID NO: 1003013 - RNA, 22 nt, Human
gcacauaacugaccacaucuaa

SEQ ID NO: 1003014 - RNA, 22 nt, Human
cuagaauugcauucuaugaaua

SEQ ID NO: 1003015 - RNA, 22 nt, Human
acccagcuggaugcauggaggc

SEQ ID NO: 1003016 - RNA, 22 nt, Human
ugggcuuuaucaugggucuggu

SEQ ID NO: 1003017 - RNA, 22 nt, Human
aaagcuuuucaguauguucaug

SEQ ID NO: 1003018 - RNA, 22 nt, Human
cagugagguggauggauggccu

SEQ ID NO: 1003019 - RNA, 22 nt, Human
uuugauuuacuggauauucuca

SEQ ID NO: 1003020 - RNA, 22 nt, Human
aagggcuccaagagguagcugg

SEQ ID NO: 1003021 - RNA, 22 nt, Human
cuguaugauauccaaauugaua

SEQ ID NO: 1003022 - RNA, 22 nt, Human
aguuagaaaguaaaucauuuga

SEQ ID NO: 1003023 - RNA, 22 nt, Human
augcuuuuaugucacaugguca

SEQ ID NO: 1003024 - RNA, 22 nt, Human
ccacacagauaaguguuuucua

SEQ ID NO: 1003025 - RNA, 22 nt, Human
acugagagucaagauagcaugg

SEQ ID NO: 1003026 - RNA, 22 nt, Human
auguccaggaucuauccccaga

SEQ ID NO: 1003027 - RNA, 22 nt, Human
agggacuugaugucagggagau

SEQ ID NO: 1003028 - RNA, 22 nt, Human
auaaacagaguaguugcuacug

SEQ ID NO: 1003029 - RNA, 22 nt, Human
ccccacccucgcuccauuucgg

SEQ ID NO: 1003030 - RNA, 22 nt, Human
gaggcagcgggucaggaccgug

SEQ ID NO: 1003031 - RNA, 22 nt, Human
acaggccugagauuuugcauuu

SEQ ID NO: 1003032 - RNA, 22 nt, Human
ugcauuuuuaacaaggcuaauu

SEQ ID NO: 1003033 - RNA, 22 nt, Human
auguagaagcugacagugcugu

SEQ ID NO: 1003034 - RNA, 22 nt, Human
cccugagcucaggcccuugggg

SEQ ID NO: 1003035 - RNA, 22 nt, Human
uaauuucaccguugcuagaaau

SEQ ID NO: 1003036 - RNA, 22 nt, Human
gggacccagguaauccugugcu

SEQ ID NO: 1003037 - RNA, 22 nt, Human
ugaaauuaugcauuguuguacc

SEQ ID NO: 1003038 - RNA, 22 nt, Human
auuagggcuggaugcaaggaaa

SEQ ID NO: 1003039 - RNA, 22 nt, Human
gcagagcacccugcagugguau

SEQ ID NO: 1003040 - RNA, 22 nt, Human
ucugugcauuguaacaacuaaa

SEQ ID NO: 1003041 - RNA, 22 nt, Human
aacauaauguggccaaagucac

SEQ ID NO: 1003042 - RNA, 22 nt, Human
ccuggggagagaaagcccagcc

SEQ ID NO: 1003043 - RNA, 22 nt, Human
guacacacuguuugaucauuuc

SEQ ID NO: 1003044 - RNA, 22 nt, Human
aucugcuuuugagaauuuacuu

SEQ ID NO: 1003045 - RNA, 22 nt, Human
caauuucuuguuaauucucagg

SEQ ID NO: 1003046 - RNA, 22 nt, Human
uacauguuuacuccaagucagg

SEQ ID NO: 1003047 - RNA, 22 nt, Human
uagggacccucccugcucuaac

SEQ ID NO: 1003048 - RNA, 22 nt, Human
aggaagcuuggggcagggcuac

SEQ ID NO: 1003049 - RNA, 22 nt, Human
gaaugaauagguguccagaugg

SEQ ID NO: 1003050 - RNA, 23 nt, Human
ugugaaauuugaggucagugcuu

SEQ ID NO: 1003051 - RNA, 20 nt, Human
ccuuuauuauuuguaugaug

SEQ ID NO: 1003052 - RNA, 22 nt, Human
uuccuggccaagcagaguggaa

SEQ ID NO: 1003053 - RNA, 22 nt, Human
cagcauuuggugaucaucuuaa

SEQ ID NO: 1003054 - RNA, 22 nt, Human
ggagcugaaccccaucgugcug

SEQ ID NO: 1003055 - RNA, 22 nt, Human
ggcuuuauuauguggccaugug

SEQ ID NO: 1003056 - RNA, 23 nt, Human
ccagcccuccaccagcucuaggc

SEQ ID NO: 1003057 - RNA, 22 nt, Human
aaugaagcaagcugcuguguuu

SEQ ID NO: 1003058 - RNA, 22 nt, Human
uuuaaaaucagaugggaguugg

SEQ ID NO: 1003059 - RNA, 22 nt, Human
ggcaggcuugguggcaccgguu

SEQ ID NO: 1003060 - RNA, 22 nt, Human
gccaggcagacaggucaucagg

SEQ ID NO: 1003061 - RNA, 23 nt, Human
uccugcugaaagcuccagcuggc

SEQ ID NO: 1003062 - RNA, 22 nt, Human
uucugucauccuuucuagaugu

SEQ ID NO: 1003063 - RNA, 22 nt, Human
uggccagguugggcuuugcagc

SEQ ID NO: 1003064 - RNA, 22 nt, Human
ccaggcccugcuccucacacca

SEQ ID NO: 1003065 - RNA, 21 nt, Human
guuuucaugauagagucugua

SEQ ID NO: 1003066 - RNA, 22 nt, Human
ccuucucucugaagaccccaaa

SEQ ID NO: 1003067 - RNA, 22 nt, Human
aucugucaggagcaaggacuac

SEQ ID NO: 1003068 - RNA, 22 nt, Human
ggggucccugcaccagcauguc

SEQ ID NO: 1003069 - RNA, 22 nt, Human
acauacacaugaauauauuuuu

SEQ ID NO: 1003070 - RNA, 22 nt, Human
accugcaggcacaggugugcgc

SEQ ID NO: 1003071 - RNA, 22 nt, Human
ugccugccucuggcagcccugc

SEQ ID NO: 1003072 - RNA, 22 nt, Human
ugcuucugggcaaaugugugug

SEQ ID NO: 1003073 - RNA, 22 nt, Human
agggcuccgggccaccggccug

SEQ ID NO: 1003074 - RNA, 22 nt, Human
uggcuagguagcuuucugcugu

SEQ ID NO: 1003075 - RNA, 22 nt, Human
cagagaaagaagcccauucauu

SEQ ID NO: 1003076 - RNA, 22 nt, Human
uuaaauuuuagaaacagacucu

SEQ ID NO: 1003077 - RNA, 22 nt, Human
cagagcaugaauaaaaguuaca

SEQ ID NO: 1003078 - RNA, 22 nt, Human
gggcaaaaccugggcaucauga

SEQ ID NO: 1003079 - RNA, 21 nt, Human
gccugcagaccccaccaggcu

SEQ ID NO: 1003080 - RNA, 22 nt, Human
aggaggcuuuugcaggugccac

SEQ ID NO: 1003081 - RNA, 22 nt, Human
gcagggacaucuucagaucacu

SEQ ID NO: 1003082 - RNA, 22 nt, Human
gagaccucuugguaucgcuagg

SEQ ID NO: 1003083 - RNA, 22 nt, Human
aggcagcaauugaaaucauugu

SEQ ID NO: 1003084 - RNA, 22 nt, Human
cagcucuuugaguauuccauuu

SEQ ID NO: 1003085 - RNA, 22 nt, Human
ucuccaagaaaagaucucagcu

SEQ ID NO: 1003086 - RNA, 22 nt, Human
aauauguugagucuaucuuuau

SEQ ID NO: 1003087 - RNA, 22 nt, Human
ugggacucacucuuuuggccag

SEQ ID NO: 1003088 - RNA, 22 nt, Human
gugugagggacagagaaagggg

SEQ ID NO: 1003089 - RNA, 22 nt, Human
caagcuuguuucuccugggggu

SEQ ID NO: 1003090 - RNA, 22 nt, Human
ucaugaacauggaauaucuuuu

SEQ ID NO: 1003091 - RNA, 22 nt, Human
ggcagggaagcuggcaucacgg

SEQ ID NO: 1003092 - RNA, 22 nt, Human
gcuucuggaagcauaugcaaga

SEQ ID NO: 1003093 - RNA, 22 nt, Human
auguuucaugacugagcaaaau

SEQ ID NO: 1003094 - RNA, 23 nt, Human
ucagagagcuguugagagcugcc

SEQ ID NO: 1003095 - RNA, 22 nt, Human
auuuagacuucccagcacugug

SEQ ID NO: 1003096 - RNA, 22 nt, Human
aauuaugauuggucuaaaccag

SEQ ID NO: 1003097 - RNA, 22 nt, Human
cagacagagucuucccaucagu

SEQ ID NO: 1003098 - RNA, 22 nt, Human
auccuggcccagguguggaggg

SEQ ID NO: 1003099 - RNA, 22 nt, Human
uuuucauuuacauuagggaaga

SEQ ID NO: 1003100 - RNA, 22 nt, Human
ucaggauggagggaagcacaga

SEQ ID NO: 1003101 - RNA, 22 nt, Human
gggggcucugacucccucagcu

SEQ ID NO: 1003102 - RNA, 22 nt, Human
uuccaggcugaugggccacagg

SEQ ID NO: 1003103 - RNA, 22 nt, Human
uaauuucuucaucucugcagcu

SEQ ID NO: 1003104 - RNA, 22 nt, Human
gugggcuuuggccucuuucucc

SEQ ID NO: 1003105 - RNA, 23 nt, Human
ucuguacaauugagaagagaaca

SEQ ID NO: 1003106 - RNA, 22 nt, Human
gaauauuuucaguacagauggu

SEQ ID NO: 1003107 - RNA, 21 nt, Human
aggcucccagaaaugggcauc

SEQ ID NO: 1003108 - RNA, 19 nt, Human
aaacacagauuucuuacca

SEQ ID NO: 1003109 - RNA, 21 nt, Human
ugggaccuagcuuugcacagg

SEQ ID NO: 1003110 - RNA, 22 nt, Human
ucuggucaguaauaagaagugg

SEQ ID NO: 1003111 - RNA, 22 nt, Human
uuuguucaugccuauauucuca

SEQ ID NO: 1003112 - RNA, 22 nt, Human
gagcuuuagcugagaccugcuu

SEQ ID NO: 1003113 - RNA, 22 nt, Human
ucagagagguuggugauaagaa

SEQ ID NO: 1003114 - RNA, 22 nt, Human
gcacacaguagggauucaauga

SEQ ID NO: 1003115 - RNA, 22 nt, Human
ucugaacauccagcaaugcaca

SEQ ID NO: 1003116 - RNA, 22 nt, Human
ccuccagcgcgauccacuccgg

SEQ ID NO: 1003117 - RNA, 22 nt, Human
uuucugaagggcagcagacucu

SEQ ID NO: 1003118 - RNA, 22 nt, Human
ucagcuuuggucacauugaguu

SEQ ID NO: 1003119 - RNA, 22 nt, Human
gaggagcucaugaaagcggugu

SEQ ID NO: 1003120 - RNA, 22 nt, Human
ggcaggcugggugucauggagu

SEQ ID NO: 1003121 - RNA, 22 nt, Human
ccaggcagagggaauagcaagu

SEQ ID NO: 1003122 - RNA, 22 nt, Human
ucuauuuuauacucaaaucuuc

SEQ ID NO: 1003123 - RNA, 22 nt, Human
uggcaggaaaguaacagagcac

SEQ ID NO: 1003124 - RNA, 22 nt, Human
uucuggggacauaacaguaagc

SEQ ID NO: 1003125 - RNA, 23 nt, Human
ccaggccucucagagggugugcc

SEQ ID NO: 1003126 - RNA, 22 nt, Human
accugcagcugagaaaaugacu

SEQ ID NO: 1003127 - RNA, 22 nt, Human
agcuagaaguacagccauauga

SEQ ID NO: 1003128 - RNA, 22 nt, Human
cacaucccuggaguuacccagu

SEQ ID NO: 1003129 - RNA, 22 nt, Human
uacaaaguaauguauaauaucg

SEQ ID NO: 1003130 - RNA, 21 nt, Human
acaggcucuggggaugcuggg

SEQ ID NO: 1003131 - RNA, 22 nt, Human
cagcuuuaguaacccacugcuc

SEQ ID NO: 1003132 - RNA, 17 nt, Human
cagugaggccuuuccuc

SEQ ID NO: 1003133 - RNA, 22 nt, Human
ggggcugacgggcauguggcuu

SEQ ID NO: 1003134 - RNA, 22 nt, Human
gagccucguggcggccacugcg

SEQ ID NO: 1003135 - RNA, 22 nt, Human
uucaugaaacuuaacuguuggg

SEQ ID NO: 1003136 - RNA, 22 nt, Human
auugaaaaauucacaauucugg

SEQ ID NO: 1003137 - RNA, 20 nt, Human
gaggccucagccucagcucc

SEQ ID NO: 1003138 - RNA, 22 nt, Human
caacuuuaugauugguuuguca

SEQ ID NO: 1003139 - RNA, 22 nt, Human
guuguuuuuguucucuauagcu

SEQ ID NO: 1003140 - RNA, 21 nt, Human
ggcuaggaugcugggguuucc

SEQ ID NO: 1003141 - RNA, 20 nt, Human
aguguacagacacuagaaau

SEQ ID NO: 1003142 - RNA, 22 nt, Human
auguuagaaggaauguuaaaag

SEQ ID NO: 1003143 - RNA, 22 nt, Human
cagugggggggccaugcugcag

SEQ ID NO: 1003144 - RNA, 22 nt, Human
gcuucugggguucuggcaugcu

SEQ ID NO: 1003145 - RNA, 22 nt, Human
cccagcccacgguccugggugg

SEQ ID NO: 1003146 - RNA, 22 nt, Human
aaaguuugcaauuuauguuaau

SEQ ID NO: 1003147 - RNA, 22 nt, Human
uucaguuccauuucaggugggu

SEQ ID NO: 1003148 - RNA, 22 nt, Human
uaugacaagguggaguaugagu

SEQ ID NO: 1003149 - RNA, 22 nt, Human
ucuuuauuuaagucuguuguaa

SEQ ID NO: 1003150 - RNA, 22 nt, Human
agguagggaagaaggcaugaaa

SEQ ID NO: 1003151 - RNA, 22 nt, Human
uccaggcaggguuaaggguccu

SEQ ID NO: 1003152 - RNA, 22 nt, Human
acaguuugcccugacauucucc

SEQ ID NO: 1003153 - RNA, 20 nt, Human
uauuuacaacuuagagccuc

SEQ ID NO: 1003154 - RNA, 22 nt, Human
ggcaggguuuacaauagcaaua

SEQ ID NO: 1003155 - RNA, 22 nt, Human
uggaacacuggcuuuccacugu

SEQ ID NO: 1003156 - RNA, 22 nt, Human
acuggcaguggcagcagaaaga

SEQ ID NO: 1003157 - RNA, 20 nt, Human
ucauuacagugcuaagaugu

SEQ ID NO: 1003158 - RNA, 18 nt, Human
cuguccaguagacucugc

SEQ ID NO: 1003159 - RNA, 22 nt, Human
uaaucuguguaccuucaucgga

SEQ ID NO: 1003160 - RNA, 20 nt, Human
uccugcagucgcuagcgccc

SEQ ID NO: 1003161 - RNA, 22 nt, Human
uuggagagauuuaggucucagu

SEQ ID NO: 1003162 - RNA, 18 nt, Human
ggccucuggacuggcagc

SEQ ID NO: 1003163 - RNA, 22 nt, Human
ccacuguagagauuugaaugcc

SEQ ID NO: 1003164 - RNA, 22 nt, Human
uaugaacuuuugaugugacaug

SEQ ID NO: 1003165 - RNA, 22 nt, Human
ugcuucugacuaagcugcauga

SEQ ID NO: 1003166 - RNA, 22 nt, Human
uccaagcuacugaagguuuggg

SEQ ID NO: 1003167 - RNA, 22 nt, Human
ucuccaggccuuucccaucuua

SEQ ID NO: 1003168 - RNA, 22 nt, Human
ccuggcagcuccguggccuucc

SEQ ID NO: 1003169 - RNA, 22 nt, Human
auguuauggcucaaacauuugg

SEQ ID NO: 1003170 - RNA, 22 nt, Human
aguaugaaccuggguucuggau

SEQ ID NO: 1003171 - RNA, 22 nt, Human
aaacauuguaauuuuagcaugg

SEQ ID NO: 1003172 - RNA, 22 nt, Human
uguggggaagaguaugacuugg

SEQ ID NO: 1003173 - RNA, 22 nt, Human
uagggacaaagagcugaggccu

SEQ ID NO: 1003174 - RNA, 22 nt, Human
cccuggcagagggggcaggugc

SEQ ID NO: 1003175 - RNA, 22 nt, Human
ucauuugugugagugauuugac

SEQ ID NO: 1003176 - RNA, 22 nt, Human
agcaggcuaagggaccuguuua

SEQ ID NO: 1003177 - RNA, 22 nt, Human
ucuggggauaagacccagguau

SEQ ID NO: 1003178 - RNA, 22 nt, Human
agcaggugggaucaagcuggca

SEQ ID NO: 1003179 - RNA, 22 nt, Human
acugggcugcuugagugccuuc

SEQ ID NO: 1003180 - RNA, 22 nt, Human
aaagagucguguuccagguuug

SEQ ID NO: 1003181 - RNA, 22 nt, Human
ugcuucugaaaugcaggucuuc

SEQ ID NO: 1003182 - RNA, 22 nt, Human
agagacaggguuuugucguguu

SEQ ID NO: 1003183 - RNA, 22 nt, Human
ucacaauacucacucaauggcu

SEQ ID NO: 1003184 - RNA, 22 nt, Human
cagcuuauucaguaagcacaua

SEQ ID NO: 1003185 - RNA, 22 nt, Human
uucuuaaaacuuauggacaggu

SEQ ID NO: 1003186 - RNA, 22 nt, Human
auuagggaaacugacuugucuc

SEQ ID NO: 1003187 - RNA, 22 nt, Human
ugcccccugguggccagagccg

SEQ ID NO: 1003188 - RNA, 22 nt, Human
gagggugucugcguaacuggca

SEQ ID NO: 1003189 - RNA, 22 nt, Human
gggcugacgaaggccaugugug

SEQ ID NO: 1003190 - RNA, 22 nt, Human
gaauuucuggacccuuugagaa

SEQ ID NO: 1003191 - RNA, 23 nt, Human
uagaaugucauucaaugauaugg

SEQ ID NO: 1003192 - RNA, 22 nt, Human
cuccaggccccuggccuucugc

SEQ ID NO: 1003193 - RNA, 20 nt, Human
uuuacauuuugaaacaguga

SEQ ID NO: 1003194 - RNA, 22 nt, Human
aacagccacugauacugaauag

SEQ ID NO: 1003195 - RNA, 22 nt, Human
uguugauuaguguuuagacuua

SEQ ID NO: 1003196 - RNA, 22 nt, Human
auguagaauggugauuggcagg

SEQ ID NO: 1003197 - RNA, 22 nt, Human
auuuauuaagcaucugcuaugu

SEQ ID NO: 1003198 - RNA, 22 nt, Human
cuguaugaggaucagacuggac

SEQ ID NO: 1003199 - RNA, 22 nt, Human
aauuaugagguagauaucacau

SEQ ID NO: 1003200 - RNA, 22 nt, Human
ugugcauguauugauuuguacc

SEQ ID NO: 1003201 - RNA, 22 nt, Human
ugcuucugcauucaauguugga

SEQ ID NO: 1003202 - RNA, 22 nt, Human
ugcuuuauuaagagagaaauuu

SEQ ID NO: 1003203 - RNA, 22 nt, Human
gcugggcuguaguuugcugacc

SEQ ID NO: 1003204 - RNA, 22 nt, Human
cacacaguaggcacucauuaau

SEQ ID NO: 1003205 - RNA, 22 nt, Human
cuuaauuuaagccuagaaugca

SEQ ID NO: 1003206 - RNA, 22 nt, Human
agacccucuccaugcccacugc

SEQ ID NO: 1003207 - RNA, 22 nt, Human
ugcaggcugaggcuggcucaac

SEQ ID NO: 1003208 - RNA, 22 nt, Human
ucuauaaauuaugcagucucag

SEQ ID NO: 1003209 - RNA, 22 nt, Human
aagggcucugugcuugucccau

SEQ ID NO: 1003210 - RNA, 22 nt, Human
cucugguuucgcaggaaauaga

SEQ ID NO: 1003211 - RNA, 22 nt, Human
ccugggcuuugagggcaggaug

SEQ ID NO: 1003212 - RNA, 22 nt, Human
ggcuuucuaugaacucaaaggc

SEQ ID NO: 1003213 - RNA, 22 nt, Human
gcuggggagcuagaccucagca

SEQ ID NO: 1003214 - RNA, 22 nt, Human
aguaugaagcugaaugauuuua

SEQ ID NO: 1003215 - RNA, 22 nt, Human
ucucugaaggggagcuguuuaa

SEQ ID NO: 1003216 - RNA, 21 nt, Human
ugcuuuaugggaaaaauguca

SEQ ID NO: 1003217 - RNA, 22 nt, Human
uuaguuagucccugguaccuuu

SEQ ID NO: 1003218 - RNA, 22 nt, Human
aggacuuagaacauuauguacu

SEQ ID NO: 1003219 - RNA, 22 nt, Human
aggcaguggagcuggaauaggc

SEQ ID NO: 1003220 - RNA, 22 nt, Human
uaguauuuaaucacuuuugucu

SEQ ID NO: 1003221 - RNA, 22 nt, Human
gcuuggaaguaggauugggaga

SEQ ID NO: 1003222 - RNA, 22 nt, Human
caguguuuaaucauugugaauu

SEQ ID NO: 1003223 - RNA, 22 nt, Human
ucuccugcucagaacagccuca

SEQ ID NO: 1003224 - RNA, 22 nt, Human
uccuuucccuuuccauccuggc

SEQ ID NO: 1003225 - RNA, 22 nt, Human
uggccuccccuaacagccucuu

SEQ ID NO: 1003226 - RNA, 22 nt, Human
ucuggggagucaaagagaccug

SEQ ID NO: 1003227 - RNA, 22 nt, Human
cauuuauucucagauccuuguc

SEQ ID NO: 1003228 - RNA, 22 nt, Human
caucacagguccugaugacauu

SEQ ID NO: 1003229 - RNA, 22 nt, Human
augcuacauuuugguuuauaaa

SEQ ID NO: 1003230 - RNA, 19 nt, Human
gacuccaacuuuaagcaug

SEQ ID NO: 1003231 - RNA, 18 nt, Human
ggcaggcucucuggguca

SEQ ID NO: 1003232 - RNA, 22 nt, Human
aagggcucugugugccucccca

SEQ ID NO: 1003233 - RNA, 22 nt, Human
aucugucaucagcaccacaggu

SEQ ID NO: 1003234 - RNA, 22 nt, Human
aaagaucacgucccaggacucg

SEQ ID NO: 1003235 - RNA, 22 nt, Human
caggcagcccugcaccaagugu

SEQ ID NO: 1003236 - RNA, 22 nt, Human
acagguccucaagucagcuggg

SEQ ID NO: 1003237 - RNA, 22 nt, Human
ucuggcagguucccauguuaug

SEQ ID NO: 1003238 - RNA, 21 nt, Human
ugcaggcugugcgcuccugcc

SEQ ID NO: 1003239 - RNA, 22 nt, Human
auuuguagugaagugaaaauaa

SEQ ID NO: 1003240 - RNA, 22 nt, Human
guuaggaacacuggagccuaaa

SEQ ID NO: 1003241 - RNA, 22 nt, Human
guaugcaucgacucaagucuga

SEQ ID NO: 1003242 - RNA, 22 nt, Human
agaauauugaaaguucuugaca

SEQ ID NO: 1003243 - RNA, 22 nt, Human
caggcccugccuugagggaccu

SEQ ID NO: 1003244 - RNA, 22 nt, Human
acauauuuugaaagcuuucuaa

SEQ ID NO: 1003245 - RNA, 22 nt, Human
aaauuagucgguuuaggaauuu

SEQ ID NO: 1003246 - RNA, 22 nt, Human
agaauaauacugaaaugcugaa

SEQ ID NO: 1003247 - RNA, 22 nt, Human
uuugucaucccuuuugaaacug

SEQ ID NO: 1003248 - RNA, 22 nt, Human
gcaggcuccaggccggccccuu

SEQ ID NO: 1003249 - RNA, 19 nt, Human
auguaugaggucuucugcu

SEQ ID NO: 1003250 - RNA, 22 nt, Human
acaggacauguaccaggugguc

SEQ ID NO: 1003251 - RNA, 22 nt, Human
aaauuaguacauugcaaagucc

SEQ ID NO: 1003252 - RNA, 22 nt, Human
gucaggacucugacccgucccg

SEQ ID NO: 1003253 - RNA, 22 nt, Human
caaugaaaauuuaaguugcagc

SEQ ID NO: 1003254 - RNA, 22 nt, Human
gcacauacugcaaagauuacua

SEQ ID NO: 1003255 - RNA, 22 nt, Human
gaugaagcuaaaucuaagguuu

SEQ ID NO: 1003256 - RNA, 22 nt, Human
cugggcuuugguacugugauua

SEQ ID NO: 1003257 - RNA, 22 nt, Human
cagcuugaaauauuaggagaug

SEQ ID NO: 1003258 - RNA, 22 nt, Human
uaugaagcugauaaucacugau

SEQ ID NO: 1003259 - RNA, 22 nt, Human
gccaggcauguccucugcagaa

SEQ ID NO: 1003260 - RNA, 22 nt, Human
gugggcuucuguuagggaggcu

SEQ ID NO: 1003261 - RNA, 23 nt, Human
uccuuuaaugcuggaauggcuag

SEQ ID NO: 1003262 - RNA, 22 nt, Human
ugcuucuguuucauugaucuua

SEQ ID NO: 1003263 - RNA, 22 nt, Human
ucuaggaguaaugagcuagcac

SEQ ID NO: 1003264 - RNA, 21 nt, Human
cagcccagcccauugacagug

SEQ ID NO: 1003265 - RNA, 22 nt, Human
acagauauuuggggaaagacgu

SEQ ID NO: 1003266 - RNA, 22 nt, Human
guguaugaggggagaauguuuu

SEQ ID NO: 1003267 - RNA, 22 nt, Human
uuaucacuuaugagcuuuuugc

SEQ ID NO: 1003268 - RNA, 22 nt, Human
auccucuguggauuacaccuag

SEQ ID NO: 1003269 - RNA, 22 nt, Human
guuuuauaugucucugcugaca

SEQ ID NO: 1003270 - RNA, 22 nt, Human
ccagggggcuuggugaggccau

SEQ ID NO: 1003271 - RNA, 22 nt, Human
uauuugauagagauaaaugaua

SEQ ID NO: 1003272 - RNA, 22 nt, Human
cucagagagggcaccagggcca

SEQ ID NO: 1003273 - RNA, 22 nt, Human
cuggcaguuugccaggagcucg

SEQ ID NO: 1003274 - RNA, 22 nt, Human
ugucuuuagccagcagucuucu

SEQ ID NO: 1003275 - RNA, 22 nt, Human
gugauaaaauucaaauagcucu

SEQ ID NO: 1003276 - RNA, 22 nt, Human
cagguggguguaugaaugcaaa

SEQ ID NO: 1003277 - RNA, 22 nt, Human
auuuucaugacuaccuuaaaua

SEQ ID NO: 1003278 - RNA, 22 nt, Human
ggcuucuguccucuggaucugu

SEQ ID NO: 1003279 - RNA, 22 nt, Human
gauuuuucaguauaaaauauau

SEQ ID NO: 1003280 - RNA, 22 nt, Human
acuuuacaagcuuauagccuag

SEQ ID NO: 1003281 - RNA, 22 nt, Human
agcucccagaagccagagucgg

SEQ ID NO: 1003282 - RNA, 22 nt, Human
augccaaauucucagccucuuu

SEQ ID NO: 1003283 - RNA, 22 nt, Human
accuggagaaagccucucccug

SEQ ID NO: 1003284 - RNA, 23 nt, Human
gagugcagaauagacaugcagug

SEQ ID NO: 1003285 - RNA, 22 nt, Human
ugaaguuguuaagguugccauu

SEQ ID NO: 1003286 - RNA, 22 nt, Human
uuucauaaccucaagcuacagu

SEQ ID NO: 1003287 - RNA, 22 nt, Human
agcaggcuccaggcuggccauc

SEQ ID NO: 1003288 - RNA, 22 nt, Human
uaucaauacauguuaucagugu

SEQ ID NO: 1003289 - RNA, 22 nt, Human
uucaagauggcaccagugagug

SEQ ID NO: 1003290 - RNA, 22 nt, Human
aggugaguugguaggaaguuug

SEQ ID NO: 1003291 - RNA, 22 nt, Human
agccuccaucucccaucuguga

SEQ ID NO: 1003292 - RNA, 22 nt, Human
gagggcucugaaaggaggucac

SEQ ID NO: 1003293 - RNA, 17 nt, Human
ucgguuugccaggcuuc

SEQ ID NO: 1003294 - RNA, 22 nt, Human
ccacccagaccagggaucuggg

SEQ ID NO: 1003295 - RNA, 22 nt, Human
acaagauagcuuagaagauuca

SEQ ID NO: 1003296 - RNA, 22 nt, Human
ggcugaguugagaggauuacuu

SEQ ID NO: 1003297 - RNA, 22 nt, Human
ucuggcagugagcaacuugaca

SEQ ID NO: 1003298 - RNA, 22 nt, Human
ugcuuaaacccugaucaugugu

SEQ ID NO: 1003299 - RNA, 22 nt, Human
cucugggcaaguuucuucauga

SEQ ID NO: 1003300 - RNA, 22 nt, Human
ugauugacuuuagaauagcacu

SEQ ID NO: 1003301 - RNA, 22 nt, Human
gaaacauaguugagacacugcu

SEQ ID NO: 1003302 - RNA, 22 nt, Human
ccucagcugcuucccuggagcc

SEQ ID NO: 1003303 - RNA, 22 nt, Human
uccugcagagucccacugauuu

SEQ ID NO: 1003304 - RNA, 22 nt, Human
ccagcccuugcugaaggguggc

SEQ ID NO: 1003305 - RNA, 22 nt, Human
aaaguucuggggguguuucugg

SEQ ID NO: 1003306 - RNA, 22 nt, Human
caccagggccccaggcugugcc

SEQ ID NO: 1003307 - RNA, 18 nt, Human
aguuccuuaaauuggugu

SEQ ID NO: 1003308 - RNA, 22 nt, Human
acacacagguaaaggagccugg

SEQ ID NO: 1003309 - RNA, 22 nt, Human
uuuccuaagguagugauaauuu

SEQ ID NO: 1003310 - RNA, 22 nt, Human
cauaauuuuuuuaagucagaac

SEQ ID NO: 1003311 - RNA, 22 nt, Human
cuggcaggagcauucacagagg

SEQ ID NO: 1003312 - RNA, 22 nt, Human
ugcuagaauuagguuaaacaaa

SEQ ID NO: 1003313 - RNA, 21 nt, Human
ugacugaggcuucuucacaca

SEQ ID NO: 1003314 - RNA, 22 nt, Human
ccaggcuccucaugaucuuguu

SEQ ID NO: 1003315 - RNA, 22 nt, Human
agacaaguucugugggucaccu

SEQ ID NO: 1003316 - RNA, 17 nt, Human
ugcuggcaacauacaaa

SEQ ID NO: 1003317 - RNA, 22 nt, Human
uuccugccccugagagcuccca

SEQ ID NO: 1003318 - RNA, 22 nt, Human
acagugugugcuuucccuuacg

SEQ ID NO: 1003319 - RNA, 22 nt, Human
gcagcuuucugggacagaaagg

SEQ ID NO: 1003320 - RNA, 22 nt, Human
aaauccuaaaaguuugacuuaa

SEQ ID NO: 1003321 - RNA, 22 nt, Human
uuacuucuuacaaaagaaauau

SEQ ID NO: 1003322 - RNA, 22 nt, Human
caugagauuugggaggggccag

SEQ ID NO: 1003323 - RNA, 22 nt, Human
ugcucuguauucuauggcaguu

SEQ ID NO: 1003324 - RNA, 22 nt, Human
gcuucuggaagcugcuucugcc

SEQ ID NO: 1003325 - RNA, 19 nt, Human
ugcuucuggaaugcaaggc

SEQ ID NO: 1003326 - RNA, 22 nt, Human
uuaggaaguguguccagaagcg

SEQ ID NO: 1003327 - RNA, 21 nt, Human
uaaaucucuguauucuucagu

SEQ ID NO: 1003328 - RNA, 22 nt, Human
gugggcuuguuuugaugagauc

SEQ ID NO: 1003329 - RNA, 22 nt, Human
ccugggcugcaugauggcauuu

SEQ ID NO: 1003330 - RNA, 17 nt, Human
ugccagccugucccagg

SEQ ID NO: 1003331 - RNA, 22 nt, Human
aaauccuaaugacaaguuuagu

SEQ ID NO: 1003332 - RNA, 22 nt, Human
caggccuccacuccacgcagac

SEQ ID NO: 1003333 - RNA, 22 nt, Human
guuaaauucgaugauggauaaa

SEQ ID NO: 1003334 - RNA, 22 nt, Human
acuggcagccacaacuggcagg

SEQ ID NO: 1003335 - RNA, 22 nt, Human
ccaggcucugcaaaaucaggcu

SEQ ID NO: 1003336 - RNA, 22 nt, Human
ugguuccucaagcgcuggcggc

SEQ ID NO: 1003337 - RNA, 22 nt, Human
ccacauacaaauggggugcugu

SEQ ID NO: 1003338 - RNA, 22 nt, Human
auacuucuuugauguucacagg

SEQ ID NO: 1003339 - RNA, 22 nt, Human
acauaugauauugaggaucuca

SEQ ID NO: 1003340 - RNA, 22 nt, Human
ggcuuuaugcagggauagaaau

SEQ ID NO: 1003341 - RNA, 22 nt, Human
cuuggcagagggcugggcucag

SEQ ID NO: 1003342 - RNA, 22 nt, Human
gguuuccugcauugggaaauuu

SEQ ID NO: 1003343 - RNA, 22 nt, Human
aagauaauauucauuaacuaga

SEQ ID NO: 1003344 - RNA, 20 nt, Human
ugcaggcuucgcucuaggag

SEQ ID NO: 1003345 - RNA, 22 nt, Human
agggcucccgugaggugacugc

SEQ ID NO: 1003346 - RNA, 23 nt, Human
ggccucagcgcacagaaacugcu

SEQ ID NO: 1003347 - RNA, 22 nt, Human
cugugggaacacugaggacuuc

SEQ ID NO: 1003348 - RNA, 21 nt, Human
cauuagggcagaagcaggaag

SEQ ID NO: 1003349 - RNA, 20 nt, Human
agcuuugguuaagccagugg

SEQ ID NO: 1003350 - RNA, 22 nt, Human
cccagccuacucugccauagca

SEQ ID NO: 1003351 - RNA, 22 nt, Human
cagcuugugcaaagguccuggg

SEQ ID NO: 1003352 - RNA, 22 nt, Human
agacaucaaugaucagagguag

SEQ ID NO: 1003353 - RNA, 22 nt, Human
acaggcacugucaagucaugaa

SEQ ID NO: 1003354 - RNA, 22 nt, Human
uugugcaauuuaaaaucuuccu

SEQ ID NO: 1003355 - RNA, 22 nt, Human
gcaggcucccuugcagagcagg

SEQ ID NO: 1003356 - RNA, 22 nt, Human
ggagcugaaggggugggcucag

SEQ ID NO: 1003357 - RNA, 20 nt, Human
cagcccuccaguggaggcag

SEQ ID NO: 1003358 - RNA, 22 nt, Human
gcccagcuuuucacuuccacac

SEQ ID NO: 1003359 - RNA, 22 nt, Human
ccaaggcaggggaucaaaguuu

SEQ ID NO: 1003360 - RNA, 22 nt, Human
gaaacauauuaauccagugaaa

SEQ ID NO: 1003361 - RNA, 22 nt, Human
accugccucagugcagcuggau

SEQ ID NO: 1003362 - RNA, 22 nt, Human
ucuaggagcaugaagggaaggc

SEQ ID NO: 1003363 - RNA, 22 nt, Human
agguauauauucugguccuuau

SEQ ID NO: 1003364 - RNA, 22 nt, Human
ggggcugauggaacucaggccu

SEQ ID NO: 1003365 - RNA, 22 nt, Human
acgugcaggaucugguuggcga

SEQ ID NO: 1003366 - RNA, 22 nt, Human
uccaguggcaccuuggcccuca

SEQ ID NO: 1003367 - RNA, 22 nt, Human
acagguggccccgagggagugg

SEQ ID NO: 1003368 - RNA, 22 nt, Human
ucuuugaaaagauauuccuccu

SEQ ID NO: 1003369 - RNA, 22 nt, Human
ucuggcaguuccuuguugauau

SEQ ID NO: 1003370 - RNA, 22 nt, Human
agaggcucugccgccucaggua

SEQ ID NO: 1003371 - RNA, 21 nt, Human
agaaaaacacgauauaagccc

SEQ ID NO: 1003372 - RNA, 22 nt, Human
uuagggacagcucuguagguga

SEQ ID NO: 1003373 - RNA, 22 nt, Human
aguaugaagaauacauagauga

SEQ ID NO: 1003374 - RNA, 22 nt, Human
gaugaagccccaguguaaguaa

SEQ ID NO: 1003375 - RNA, 22 nt, Human
cuggccucagagggucauggug

SEQ ID NO: 1003376 - RNA, 19 nt, Human
cgcaggcuucgggucgcuc

SEQ ID NO: 1003377 - RNA, 22 nt, Human
uauucccauuccacuuaucaag

SEQ ID NO: 1003378 - RNA, 22 nt, Human
acccagcuaacccuacccugga

SEQ ID NO: 1003379 - RNA, 22 nt, Human
ccuggcagcaggugggcccgug

SEQ ID NO: 1003380 - RNA, 22 nt, Human
ccugcagaaaggguccccagga

SEQ ID NO: 1003381 - RNA, 22 nt, Human
guacacacuauuuaaaguguuu

SEQ ID NO: 1003382 - RNA, 22 nt, Human
acaucacacgccuuccaggagg

SEQ ID NO: 1003383 - RNA, 21 nt, Human
ucacacacguuuccaagggca

SEQ ID NO: 1003384 - RNA, 22 nt, Human
gacccggcuccaggcccagcag

SEQ ID NO: 1003385 - RNA, 22 nt, Human
ucugggcugcugugcagugacc

SEQ ID NO: 1003386 - RNA, 22 nt, Human
uuaugacaggaaaaucacagaa

SEQ ID NO: 1003387 - RNA, 22 nt, Human
gauggccuuguuuucucccuuc

SEQ ID NO: 1003388 - RNA, 22 nt, Human
augauugcagcccuacagcugu

SEQ ID NO: 1003389 - RNA, 22 nt, Human
ccugggcucaggcuugggcagc

SEQ ID NO: 1003390 - RNA, 20 nt, Human
agggcugagaagggacuagc

SEQ ID NO: 1003391 - RNA, 22 nt, Human
uguaaacauaccagagccaagu

SEQ ID NO: 1003392 - RNA, 22 nt, Human
gucuucuguucugugaggcuuc

SEQ ID NO: 1003393 - RNA, 23 nt, Human
acauacauggagauaaagugaug

SEQ ID NO: 1003394 - RNA, 22 nt, Human
gucugucacucaggggcuggag

SEQ ID NO: 1003395 - RNA, 22 nt, Human
cagagagcuuagugugcugcau

SEQ ID NO: 1003396 - RNA, 22 nt, Human
ucagcuuucucucgccaucagg

SEQ ID NO: 1003397 - RNA, 22 nt, Human
uaaauucugaucaaguuccuuc

SEQ ID NO: 1003398 - RNA, 22 nt, Human
ucacauacugaaaguccaguga

SEQ ID NO: 1003399 - RNA, 22 nt, Human
uucugucaaaugccaguagaga

SEQ ID NO: 1003400 - RNA, 22 nt, Human
uguaugaauauguauuuucaua

SEQ ID NO: 1003401 - RNA, 22 nt, Human
uccaaguugauguuucuuaaau

SEQ ID NO: 1003402 - RNA, 22 nt, Human
gacacuucaccuuucccagccu

SEQ ID NO: 1003403 - RNA, 22 nt, Human
uacacagacucuucaauucaga

SEQ ID NO: 1003404 - RNA, 22 nt, Human
cuguccagcuuggcuccugggg

SEQ ID NO: 1003405 - RNA, 21 nt, Human
aauuacagauggaauuacaga

SEQ ID NO: 1003406 - RNA, 22 nt, Human
acuggcagagguuggacaccau

SEQ ID NO: 1003407 - RNA, 17 nt, Human
uuauuuuuugggcugag

SEQ ID NO: 1003408 - RNA, 22 nt, Human
cuucuuaaucccuuauauauuu

SEQ ID NO: 1003409 - RNA, 22 nt, Human
uugggaaguuuaaugacagacu

SEQ ID NO: 1003410 - RNA, 22 nt, Human
auaugagaauuggaaaauauca

SEQ ID NO: 1003411 - RNA, 22 nt, Human
gcagagaccccgcagugaggcc

SEQ ID NO: 1003412 - RNA, 22 nt, Human
gcuccaagguauccaccagggu

SEQ ID NO: 1003413 - RNA, 22 nt, Human
ggccucagaggaggugugaguc

SEQ ID NO: 1003414 - RNA, 22 nt, Human
ccucugugucuugguuucaaga

SEQ ID NO: 1003415 - RNA, 22 nt, Human
caaauauuccagguacaucccu

SEQ ID NO: 1003416 - RNA, 22 nt, Human
cauuuguaucugggcugcugug

SEQ ID NO: 1003417 - RNA, 22 nt, Human
ucacacacauggauaguauuuu

SEQ ID NO: 1003418 - RNA, 22 nt, Human
uacauugcuuucuaauacaucu

SEQ ID NO: 1003419 - RNA, 22 nt, Human
agucacaguuucccugagagag

SEQ ID NO: 1003420 - RNA, 22 nt, Human
gugcagggcuggcaccggaggc

SEQ ID NO: 1003421 - RNA, 22 nt, Human
aaauuacagaucaccaaugcau

SEQ ID NO: 1003422 - RNA, 22 nt, Human
ugcuuaaaauaguucauuuuug

SEQ ID NO: 1003423 - RNA, 22 nt, Human
auaugagaguaaaugccgaucu

SEQ ID NO: 1003424 - RNA, 22 nt, Human
gugcaggguagcgacggcagga

SEQ ID NO: 1003425 - RNA, 22 nt, Human
ucacuguauuuggaagggaugg

SEQ ID NO: 1003426 - RNA, 22 nt, Human
ugaaacuuauaagaauaugaau

SEQ ID NO: 1003427 - RNA, 22 nt, Human
uccccacagcagaagaucugag

SEQ ID NO: 1003428 - RNA, 22 nt, Human
agggcacccucucugcaguacc

SEQ ID NO: 1003429 - RNA, 22 nt, Human
uccgccaggacugagggcccau

SEQ ID NO: 1003430 - RNA, 22 nt, Human
ccugggcuuugcuggcaaggcc

SEQ ID NO: 1003431 - RNA, 22 nt, Human
ccuggcagaaagaguuacaccu

SEQ ID NO: 1003432 - RNA, 22 nt, Human
agcuuugggcagaagaggauuc

SEQ ID NO: 1003433 - RNA, 22 nt, Human
uggcacaguccugggugccugc

SEQ ID NO: 1003434 - RNA, 22 nt, Human
ucuucauauauaaaguggaaua

SEQ ID NO: 1003435 - RNA, 22 nt, Human
ugcaguggaaagacucagacuu

SEQ ID NO: 1003436 - RNA, 22 nt, Human
cuuguuaaaaugcagauuccaa

SEQ ID NO: 1003437 - RNA, 22 nt, Human
augcuucagugcuaccuucaaa

SEQ ID NO: 1003438 - RNA, 22 nt, Human
uguuagaauauuguaauauucg

SEQ ID NO: 1003439 - RNA, 22 nt, Human
caggccucuuccaugcagcagc

SEQ ID NO: 1003440 - RNA, 22 nt, Human
ugcuucuguauuuugggcuuga

SEQ ID NO: 1003441 - RNA, 22 nt, Human
gcacauacccacugucaagcac

SEQ ID NO: 1003442 - RNA, 23 nt, Human
ccucucucccuguuuggcaaaua

SEQ ID NO: 1003443 - RNA, 22 nt, Human
aagagcaucuauuucacagugg

SEQ ID NO: 1003444 - RNA, 20 nt, Human
gagucacagaagaagcugaa

SEQ ID NO: 1003445 - RNA, 22 nt, Human
aguguugggucuuuagaauuua

SEQ ID NO: 1003446 - RNA, 22 nt, Human
auguagaaauuaggaugauagu

SEQ ID NO: 1003447 - RNA, 22 nt, Human
uuccaggcuucucuggggcguc

SEQ ID NO: 1003448 - RNA, 22 nt, Human
ccucugcaaagaauuugucucc

SEQ ID NO: 1003449 - RNA, 20 nt, Human
auguccagugacuggaccau

SEQ ID NO: 1003450 - RNA, 22 nt, Human
aguuuucuguucuacaauuuga

SEQ ID NO: 1003451 - RNA, 23 nt, Human
cugggcugcuugagucccuggcu

SEQ ID NO: 1003452 - RNA, 22 nt, Human
gccaggcagcuagcaaccccug

SEQ ID NO: 1003453 - RNA, 22 nt, Human
uccuggcacccuuggguuggag

SEQ ID NO: 1003454 - RNA, 22 nt, Human
acacucuguaaugucacacucc

SEQ ID NO: 1003455 - RNA, 22 nt, Human
cacaccagagguuaccugcaaa

SEQ ID NO: 1003456 - RNA, 22 nt, Human
acugggcucaagugauuguccu

SEQ ID NO: 1003457 - RNA, 22 nt, Human
uugcagcuuagugauguuaucu

SEQ ID NO: 1003458 - RNA, 22 nt, Human
gcccaggcuggagugcaguagc

SEQ ID NO: 1003459 - RNA, 22 nt, Human
cugggagaggaaccucgagggu

SEQ ID NO: 1003460 - RNA, 22 nt, Human
gggaccugaggagggguuucag

SEQ ID NO: 1003461 - RNA, 21 nt, Human
caauaaacugcacauugagac

SEQ ID NO: 1003462 - RNA, 22 nt, Human
cucagagauauagucccugcuu

SEQ ID NO: 1003463 - RNA, 22 nt, Human
guguaugagccuccagcugggc

SEQ ID NO: 1003464 - RNA, 22 nt, Human
agcccaggucuggcccagccug

SEQ ID NO: 1003465 - RNA, 22 nt, Human
aagaugcagcuuuacaauaagg

SEQ ID NO: 1003466 - RNA, 22 nt, Human
ucccacauuacccugacugaca

SEQ ID NO: 1003467 - RNA, 22 nt, Human
cagaguuuuaucauacguggau

SEQ ID NO: 1003468 - RNA, 22 nt, Human
acuucacagauauuuauuuggu

SEQ ID NO: 1003469 - RNA, 22 nt, Human
cauguuuuguguacagaauauu

SEQ ID NO: 1003470 - RNA, 22 nt, Human
agggcccuaaggaaggcacaca

SEQ ID NO: 1003471 - RNA, 23 nt, Human
cccagagcacagccuccagaugc

SEQ ID NO: 1003472 - RNA, 19 nt, Human
acuggcagcuguagucugu

SEQ ID NO: 1003473 - RNA, 22 nt, Human
uagaaacauguucuguucuguu

SEQ ID NO: 1003474 - RNA, 22 nt, Human
ccagcucucagcgggagacuca

SEQ ID NO: 1003475 - RNA, 23 nt, Human
uguaaacaucacccccuggaguu

SEQ ID NO: 1003476 - RNA, 22 nt, Human
uaugaaaugguaguaggaaggg

SEQ ID NO: 1003477 - RNA, 22 nt, Human
agaggccuccgaaaggugggcu

SEQ ID NO: 1003478 - RNA, 23 nt, Human
ccuggcagcaaacgaggagguua

SEQ ID NO: 1003479 - RNA, 22 nt, Human
uuuagggaagaagcccauggcc

SEQ ID NO: 1003480 - RNA, 22 nt, Human
uuuuucauauuccccucucugg

SEQ ID NO: 1003481 - RNA, 22 nt, Human
ucuucacaugaccuucaugucu

SEQ ID NO: 1003482 - RNA, 23 nt, Human
gcccacccucagcguccucacgg

SEQ ID NO: 1003483 - RNA, 22 nt, Human
gccaggcaaauuaaggaaugca

SEQ ID NO: 1003484 - RNA, 22 nt, Human
ccugggcuuucggcggcuuccu

SEQ ID NO: 1003485 - RNA, 22 nt, Human
ggcuuuaugcacagcagauggu

SEQ ID NO: 1003486 - RNA, 22 nt, Human
gaggccagaaugagcugaaugc

SEQ ID NO: 1003487 - RNA, 22 nt, Human
uucuugaaucacuuuagagaua

SEQ ID NO: 1003488 - RNA, 22 nt, Human
cagcuuugccaaguaaggucuu

SEQ ID NO: 1003489 - RNA, 22 nt, Human
acaguguucacuuaacaaugga

SEQ ID NO: 1003490 - RNA, 22 nt, Human
gaacacauguccuccuuggauu

SEQ ID NO: 1003491 - RNA, 22 nt, Human
uuauuuucuccucagaaagugg

SEQ ID NO: 1003492 - RNA, 19 nt, Human
ugcuucuggggcuucucca

SEQ ID NO: 1003493 - RNA, 22 nt, Human
uaccugcagcgggaauccauua

SEQ ID NO: 1003494 - RNA, 22 nt, Human
aucaguuauuuuuaagcuauaa

SEQ ID NO: 1003495 - RNA, 22 nt, Human
ccaggccucaccugcccaccua

SEQ ID NO: 1003496 - RNA, 22 nt, Human
cauaauuuuccaugguuugcua

SEQ ID NO: 1003497 - RNA, 22 nt, Human
auaugaaguuacagguaagaaa

SEQ ID NO: 1003498 - RNA, 22 nt, Human
cccagcccaucucaaaggucua

SEQ ID NO: 1003499 - RNA, 22 nt, Human
uuagaauuauuguuuccuucua

SEQ ID NO: 1003500 - RNA, 18 nt, Human
uguuuauuuuucucuuac

SEQ ID NO: 1003501 - RNA, 22 nt, Human
uucagagaagcaaaggcagauu

SEQ ID NO: 1003502 - RNA, 22 nt, Human
ucuaggagaaccaucagggagg

SEQ ID NO: 1003503 - RNA, 22 nt, Human
aagggcucgguagcaguccuga

SEQ ID NO: 1003504 - RNA, 22 nt, Human
acacauuugcauaauaccucau

SEQ ID NO: 1003505 - RNA, 22 nt, Human
ucauggcacuuagcacaguccu

SEQ ID NO: 1003506 - RNA, 22 nt, Human
gaagcacugccauaauucagac

SEQ ID NO: 1003507 - RNA, 22 nt, Human
uuuuauuaucuuugaaugggac

SEQ ID NO: 1003508 - RNA, 22 nt, Human
ggaccaggccagccucccugcg

SEQ ID NO: 1003509 - RNA, 22 nt, Human
cuggaaagaccugcuugcuuuu

SEQ ID NO: 1003510 - RNA, 22 nt, Human
gcuggcaggagaccauacccua

SEQ ID NO: 1003511 - RNA, 22 nt, Human
gaagccucaacaucucugcguc

SEQ ID NO: 1003512 - RNA, 22 nt, Human
uagggcucugagaguucagccu

SEQ ID NO: 1003513 - RNA, 22 nt, Human
cagcuuuaggacucauaauaaa

SEQ ID NO: 1003514 - RNA, 22 nt, Human
cacagcuucccaaaguggaccu

SEQ ID NO: 1003515 - RNA, 22 nt, Human
gaaguucuuagucucauuugca

SEQ ID NO: 1003516 - RNA, 22 nt, Human
ccagcucugcauguuucccuug

SEQ ID NO: 1003517 - RNA, 22 nt, Human
guccuggcccacuggcaggcug

SEQ ID NO: 1003518 - RNA, 22 nt, Human
uaauaguuucauaaugugcuuc

SEQ ID NO: 1003519 - RNA, 22 nt, Human
agggccccauagucacugcccg

SEQ ID NO: 1003520 - RNA, 22 nt, Human
ccuagaugggauggcggccggg

SEQ ID NO: 1003521 - RNA, 22 nt, Human
gccugcaggcuguaguuuguga

SEQ ID NO: 1003522 - RNA, 22 nt, Human
aggugaguuacaggaggagguc

SEQ ID NO: 1003523 - RNA, 20 nt, Human
ucuguacacucaucuucugc

SEQ ID NO: 1003524 - RNA, 22 nt, Human
acagagagguaaaauauauagu

SEQ ID NO: 1003525 - RNA, 22 nt, Human
uuguaaacugcugcaggagugc

SEQ ID NO: 1003526 - RNA, 22 nt, Human
ugcuuuauagacaaggaaguag

SEQ ID NO: 1003527 - RNA, 22 nt, Human
gaacacaucacauuuuacagug

SEQ ID NO: 1003528 - RNA, 22 nt, Human
uuagaacuuaaacuucagaaag

SEQ ID NO: 1003529 - RNA, 22 nt, Human
cuucugggagagcuuuugcuuc

SEQ ID NO: 1003530 - RNA, 22 nt, Human
cccugcagaucagugagaacuu

SEQ ID NO: 1003531 - RNA, 22 nt, Human
agcuuuaucuucaccugggaau

SEQ ID NO: 1003532 - RNA, 22 nt, Human
caggucuguuuccaucagugcu

SEQ ID NO: 1003533 - RNA, 22 nt, Human
acuauaaaaggauaaaccagaa

SEQ ID NO: 1003534 - RNA, 22 nt, Human
guggagcaggacuagcugagaa

SEQ ID NO: 1003535 - RNA, 22 nt, Human
gaaagauauuuauuggcaacag

SEQ ID NO: 1003536 - RNA, 22 nt, Human
uucacauuucauaccacagcuu

SEQ ID NO: 1003537 - RNA, 22 nt, Human
aggcucccaagcacugacccca

SEQ ID NO: 1003538 - RNA, 22 nt, Human
uguuagaaauuauuaguaauau

SEQ ID NO: 1003539 - RNA, 22 nt, Human
gcuggcagccaagugaagaggg

SEQ ID NO: 1003540 - RNA, 22 nt, Human
aaagagucaaaggcaugucucu

SEQ ID NO: 1003541 - RNA, 22 nt, Human
uguaugaaguuacugagccucu

SEQ ID NO: 1003542 - RNA, 22 nt, Human
ucccagccuccugacaguuuug

SEQ ID NO: 1003543 - RNA, 22 nt, Human
uggccaggaggcugcuucugac

SEQ ID NO: 1003544 - RNA, 22 nt, Human
ugcuccagugccugccccacag

SEQ ID NO: 1003545 - RNA, 22 nt, Human
ccuggcagcagcacaugccuuc

SEQ ID NO: 1003546 - RNA, 22 nt, Human
ggcuuuauuaacucauccguaa

SEQ ID NO: 1003547 - RNA, 22 nt, Human
aaggccacacuugcuggccagc

SEQ ID NO: 1003548 - RNA, 22 nt, Human
gguuucaacuucaaccucucca

SEQ ID NO: 1003549 - RNA, 21 nt, Human
ucagagagucacagugaacug

SEQ ID NO: 1003550 - RNA, 22 nt, Human
cacaucagguagaccuacagag

SEQ ID NO: 1003551 - RNA, 22 nt, Human
uugugaaacauucauggauuug

SEQ ID NO: 1003552 - RNA, 22 nt, Human
ugcuuuauguggcugauacuca

SEQ ID NO: 1003553 - RNA, 22 nt, Human
uuacauuuugggguaaggauaa

SEQ ID NO: 1003554 - RNA, 22 nt, Human
aaaguugugaaaccgaacaugu

SEQ ID NO: 1003555 - RNA, 22 nt, Human
aauucugugcaggcagagcuau

SEQ ID NO: 1003556 - RNA, 22 nt, Human
cccugcagaaccacagacaaac

SEQ ID NO: 1003557 - RNA, 23 nt, Human
aaaguuugaagcaacaguaguug

SEQ ID NO: 1003558 - RNA, 22 nt, Human
augcauugucugguuucauuuu

SEQ ID NO: 1003559 - RNA, 20 nt, Human
cugcuccacccggcucucag

SEQ ID NO: 1003560 - RNA, 22 nt, Human
caggcugccuggaagaggacug

SEQ ID NO: 1003561 - RNA, 22 nt, Human
aagggcucccugccugaggugg

SEQ ID NO: 1003562 - RNA, 22 nt, Human
uacauaaugagcuaguuaaguu

SEQ ID NO: 1003563 - RNA, 22 nt, Human
cagagcagggguuucccagguu

SEQ ID NO: 1003564 - RNA, 22 nt, Human
acuuggcaaguaucuauaaagu

SEQ ID NO: 1003565 - RNA, 22 nt, Human
cuuucacagcacaagccugccu

SEQ ID NO: 1003566 - RNA, 22 nt, Human
cccugcagggaggauucugaag

SEQ ID NO: 1003567 - RNA, 22 nt, Human
ccuggcagacagcacugaagcu

SEQ ID NO: 1003568 - RNA, 22 nt, Human
ugauucuauggaaggcauaagg

SEQ ID NO: 1003569 - RNA, 22 nt, Human
ggccucagugggccgcugcagg

SEQ ID NO: 1003570 - RNA, 22 nt, Human
gguuccuucugaggucccugua

SEQ ID NO: 1003571 - RNA, 22 nt, Human
ugaaccacaugcaaagugaaua

SEQ ID NO: 1003572 - RNA, 22 nt, Human
gugggcuggauuugcuugcaga

SEQ ID NO: 1003573 - RNA, 22 nt, Human
ggccucucagggcagagacccu

SEQ ID NO: 1003574 - RNA, 22 nt, Human
augggcuggggaagcucacucc

SEQ ID NO: 1003575 - RNA, 22 nt, Human
augcauaauguauguauugacu

SEQ ID NO: 1003576 - RNA, 22 nt, Human
auucucaauggcuacuuucaua

SEQ ID NO: 1003577 - RNA, 22 nt, Human
aagcaacucccuccucauuuuu

SEQ ID NO: 1003578 - RNA, 22 nt, Human
uccugcagccuugggcuggagc

SEQ ID NO: 1003579 - RNA, 22 nt, Human
acaauguaggauauguacuugu

SEQ ID NO: 1003580 - RNA, 16 nt, Human
gcagggguggguggag

SEQ ID NO: 1003581 - RNA, 22 nt, Human
aaauaguucagccacggugacu

SEQ ID NO: 1003582 - RNA, 22 nt, Human
uggcuaggaauccaugacucuc

SEQ ID NO: 1003583 - RNA, 22 nt, Human
cccuuccuugugacuggugggg

SEQ ID NO: 1003584 - RNA, 22 nt, Human
accaggcagcugggggugaugu

SEQ ID NO: 1003585 - RNA, 22 nt, Human
aaggcucccucuucucgagugu

SEQ ID NO: 1003586 - RNA, 22 nt, Human
acacucacccucccacugccug

SEQ ID NO: 1003587 - RNA, 22 nt, Human
acugggcuccaaggaccuggag

SEQ ID NO: 1003588 - RNA, 22 nt, Human
gcagcuuugucacggagugucg

SEQ ID NO: 1003589 - RNA, 22 nt, Human
uuugugcagauguauauuugug

SEQ ID NO: 1003590 - RNA, 22 nt, Human
cuggauuuaauuaacuguugcu

SEQ ID NO: 1003591 - RNA, 22 nt, Human
guuaaccaaggcaccaagugua

SEQ ID NO: 1003592 - RNA, 22 nt, Human
ucccaggccauaaaacucagag

SEQ ID NO: 1003593 - RNA, 22 nt, Human
auauuaggcaaggagauuauuu

SEQ ID NO: 1003594 - RNA, 22 nt, Human
ugcuucugggucccagccuggc

SEQ ID NO: 1003595 - RNA, 22 nt, Human
cagguugguauucaucuccaca

SEQ ID NO: 1003596 - RNA, 22 nt, Human
gguggcauaagaacacuaaaga

SEQ ID NO: 1003597 - RNA, 22 nt, Human
ugucaacacaccuaucucaauu

SEQ ID NO: 1003598 - RNA, 22 nt, Human
acauuuuaauaugcuuagugug

SEQ ID NO: 1003599 - RNA, 22 nt, Human
gcaaggaccuuugagcgugcca

SEQ ID NO: 1003600 - RNA, 22 nt, Human
ugcuuuauuuauaaaauagcaa

SEQ ID NO: 1003601 - RNA, 22 nt, Human
ggcuuugggcccucaagucucc

SEQ ID NO: 1003602 - RNA, 22 nt, Human
uacagagaguacagcauccaca

SEQ ID NO: 1003603 - RNA, 22 nt, Human
auaaucuuucuuuuccagauag

SEQ ID NO: 1003604 - RNA, 22 nt, Human
gcagggacaacugugcaccuga

SEQ ID NO: 1003605 - RNA, 22 nt, Human
uauguaaaaauucaucaggcug

SEQ ID NO: 1003606 - RNA, 22 nt, Human
cugggcucaccuguggcuggca

SEQ ID NO: 1003607 - RNA, 22 nt, Human
gacauaauccuccucaccuacu

SEQ ID NO: 1003608 - RNA, 19 nt, Human
ccaggccuccugggagguc

SEQ ID NO: 1003609 - RNA, 22 nt, Human
accaggcacucuuguggcagug

SEQ ID NO: 1003610 - RNA, 22 nt, Human
uuaggaaaaucaugagagauga

SEQ ID NO: 1003611 - RNA, 22 nt, Human
acuggggaguugaagcacuuuc

SEQ ID NO: 1003612 - RNA, 22 nt, Human
cuguaugaaauuaaguaaacag

SEQ ID NO: 1003613 - RNA, 20 nt, Human
ccagagaguagguuagugau

SEQ ID NO: 1003614 - RNA, 22 nt, Human
ucauuuguugcuguuaccugag

SEQ ID NO: 1003615 - RNA, 22 nt, Human
cccaggacucuucacugcagcc

SEQ ID NO: 1003616 - RNA, 22 nt, Human
agauuucucuuucccuggcuga

SEQ ID NO: 1003617 - RNA, 22 nt, Human
ugggcugagcacugaggaagga

SEQ ID NO: 1003618 - RNA, 22 nt, Human
ucauuguuucugcuuuucauga

SEQ ID NO: 1003619 - RNA, 22 nt, Human
aguaugaaaguuaaucaauuua

SEQ ID NO: 1003620 - RNA, 22 nt, Human
aucagagauuguaguaugugca

SEQ ID NO: 1003621 - RNA, 20 nt, Human
cucuuaaauguaaaguaggc

SEQ ID NO: 1003622 - RNA, 22 nt, Human
uugauaaaaugauaucuucuuu

SEQ ID NO: 1003623 - RNA, 22 nt, Human
uauuuguauguguguacauaua

SEQ ID NO: 1003624 - RNA, 22 nt, Human
uucuuaaagaggcaaaacacag

SEQ ID NO: 1003625 - RNA, 22 nt, Human
cuuccuccgaagaaguugcugg

SEQ ID NO: 1003626 - RNA, 22 nt, Human
uuauuaggaaaaggucagaugu

SEQ ID NO: 1003627 - RNA, 22 nt, Human
uauucacaugaaaacaaauuuu

SEQ ID NO: 1003628 - RNA, 22 nt, Human
cacccagccuucacacaggagu

SEQ ID NO: 1003629 - RNA, 22 nt, Human
uguuugaaacuuugaucacuaa

SEQ ID NO: 1003630 - RNA, 22 nt, Human
acuaaauacacacauuuguuca

SEQ ID NO: 1003631 - RNA, 22 nt, Human
uuguaugaucccauuuagugaa

SEQ ID NO: 1003632 - RNA, 22 nt, Human
cuaggaaucaccaagauucuag

SEQ ID NO: 1003633 - RNA, 22 nt, Human
uccuggcagugcuuguuuugga

SEQ ID NO: 1003634 - RNA, 22 nt, Human
gcuggcaggagaaacggggugc

SEQ ID NO: 1003635 - RNA, 22 nt, Human
cuggggacugaaggauguugcu

SEQ ID NO: 1003636 - RNA, 22 nt, Human
ucagcauaucuugagcuucaug

SEQ ID NO: 1003637 - RNA, 22 nt, Human
auccaagucagggauaguuuga

SEQ ID NO: 1003638 - RNA, 22 nt, Human
cugggcugcaguuccugguccu

SEQ ID NO: 1003639 - RNA, 22 nt, Human
uacauuccuguuagcaucuaag

SEQ ID NO: 1003640 - RNA, 22 nt, Human
agcuuuauagaaaggaucagug

SEQ ID NO: 1003641 - RNA, 22 nt, Human
cuucauuaaugucuauaaguuu

SEQ ID NO: 1003642 - RNA, 22 nt, Human
uuguucaugguuguaaguuuga

SEQ ID NO: 1003643 - RNA, 22 nt, Human
ucuucaaauccuacagugucug

SEQ ID NO: 1003644 - RNA, 22 nt, Human
uuagaacuuaagaauacugucu

SEQ ID NO: 1003645 - RNA, 22 nt, Human
uuucauaaacaguagaagacua

SEQ ID NO: 1003646 - RNA, 22 nt, Human
cuuagggaaucuuagagcugga

SEQ ID NO: 1003647 - RNA, 22 nt, Human
gccuggcaaggcccuguugacu

SEQ ID NO: 1003648 - RNA, 22 nt, Human
cauuacaaccccaaauuacaaa

SEQ ID NO: 1003649 - RNA, 22 nt, Human
uuucugaagauacagcuuugcu

SEQ ID NO: 1003650 - RNA, 22 nt, Human
gugcaguggcagauccuagcuc

SEQ ID NO: 1003651 - RNA, 22 nt, Human
ucucacagugcaggucugucuc

SEQ ID NO: 1003652 - RNA, 22 nt, Human
uuuucauuguuccucgagcauu

SEQ ID NO: 1003653 - RNA, 21 nt, Human
ucauuugugaucugauuucca

SEQ ID NO: 1003654 - RNA, 22 nt, Human
uucugucacuugcaaucaagag

SEQ ID NO: 1003655 - RNA, 22 nt, Human
ugcuuuauuggaaccucauccu

SEQ ID NO: 1003656 - RNA, 22 nt, Human
acuggcagggggagccccgaga

SEQ ID NO: 1003657 - RNA, 22 nt, Human
aaaguucuuucucuuauuuggu

SEQ ID NO: 1003658 - RNA, 22 nt, Human
agaggcuucucggauggggcag

SEQ ID NO: 1003659 - RNA, 22 nt, Human
uuauuaggaacucaggauuuuu

SEQ ID NO: 1003660 - RNA, 19 nt, Human
gugggacagacauuacaua

SEQ ID NO: 1003661 - RNA, 22 nt, Human
uuguuaaagaugcagauuccau

SEQ ID NO: 1003662 - RNA, 22 nt, Human
uggcagagucaucacaucugga

SEQ ID NO: 1003663 - RNA, 22 nt, Human
cucagagaaaugucacaacaau

SEQ ID NO: 1003664 - RNA, 22 nt, Human
agggaccuugauggguuuggga

SEQ ID NO: 1003665 - RNA, 22 nt, Human
accugcagcuaaagauguaggg

SEQ ID NO: 1003666 - RNA, 22 nt, Human
acauaaugagcucuuuauaaau

SEQ ID NO: 1003667 - RNA, 22 nt, Human
ugcuagaauuugcagaagcaua

SEQ ID NO: 1003668 - RNA, 22 nt, Human
auuauaaaccuuugaggguggg

SEQ ID NO: 1003669 - RNA, 22 nt, Human
aaacuucagugaaugacuuaug

SEQ ID NO: 1003670 - RNA, 22 nt, Human
agcaggcuaggaaccucacugc

SEQ ID NO: 1003671 - RNA, 22 nt, Human
gguucccggaucuccgaguccc

SEQ ID NO: 1003672 - RNA, 22 nt, Human
uggucucugcaggccaggcuca

SEQ ID NO: 1003673 - RNA, 22 nt, Human
aggaggcugcaacccugaggcc

SEQ ID NO: 1003674 - RNA, 22 nt, Human
augacacuuggugauacuuugu

SEQ ID NO: 1003675 - RNA, 22 nt, Human
aacaguaacgagauguccuaac

SEQ ID NO: 1003676 - RNA, 21 nt, Human
gggcagaggggccuccugggu

SEQ ID NO: 1003677 - RNA, 22 nt, Human
ccacacagucaguuuccaagaa

SEQ ID NO: 1003678 - RNA, 22 nt, Human
cuguagaacgauccaggcauuu

SEQ ID NO: 1003679 - RNA, 22 nt, Human
uaauuuuacuuccugagcaccu

SEQ ID NO: 1003680 - RNA, 22 nt, Human
uucccacauucuuuacauucau

SEQ ID NO: 1003681 - RNA, 22 nt, Human
ucuggggagggagccacagguc

SEQ ID NO: 1003682 - RNA, 22 nt, Human
uacccagcuccucagaagacca

SEQ ID NO: 1003683 - RNA, 22 nt, Human
caggcagcugcgacaagagagc

SEQ ID NO: 1003684 - RNA, 22 nt, Human
accugcagguguuuccacacuu

SEQ ID NO: 1003685 - RNA, 22 nt, Human
gccacauagaggaggauauuaa

SEQ ID NO: 1003686 - RNA, 22 nt, Human
gaacacaugauuauaaaugcua

SEQ ID NO: 1003687 - RNA, 19 nt, Human
uggaccugugcccauggcu

SEQ ID NO: 1003688 - RNA, 22 nt, Human
ugcuuuauaacuuaguuuaugg

SEQ ID NO: 1003689 - RNA, 19 nt, Human
gcuggggaauggauauuga

SEQ ID NO: 1003690 - RNA, 22 nt, Human
aauuuagauugauaaacaugga

SEQ ID NO: 1003691 - RNA, 22 nt, Human
ccuugcucaagcuagugacggg

SEQ ID NO: 1003692 - RNA, 22 nt, Human
auuuaaaugcuuaagaggguuu

SEQ ID NO: 1003693 - RNA, 22 nt, Human
uagcuuuaccauagaagaguau

SEQ ID NO: 1003694 - RNA, 22 nt, Human
uuauuagguuuacauaaagguu

SEQ ID NO: 1003695 - RNA, 22 nt, Human
ugcaggcuguuugguggaucuc

SEQ ID NO: 1003696 - RNA, 22 nt, Human
cugcagggaccacaagcagguu

SEQ ID NO: 1003697 - RNA, 22 nt, Human
auguccagaguguccuggaaag

SEQ ID NO: 1003698 - RNA, 22 nt, Human
guccaagagucaagaagggggc

SEQ ID NO: 1003699 - RNA, 22 nt, Human
guaaacaugcuguguacucagc

SEQ ID NO: 1003700 - RNA, 22 nt, Human
uuccuugaaugagucauggaaa

SEQ ID NO: 1003701 - RNA, 22 nt, Human
cccaggcagagagcuggugagc

SEQ ID NO: 1003702 - RNA, 22 nt, Human
ggcucugcaugugagugggugg

SEQ ID NO: 1003703 - RNA, 22 nt, Human
cuguccagaaagggggcaacaa

SEQ ID NO: 1003704 - RNA, 22 nt, Human
cccaggcaggagugugguggcu

SEQ ID NO: 1003705 - RNA, 22 nt, Human
uuccuggccccaccccuggaga

SEQ ID NO: 1003706 - RNA, 22 nt, Human
uggcagggugccaguugcgagu

SEQ ID NO: 1003707 - RNA, 17 nt, Human
cucuggggacaguucua

SEQ ID NO: 1003708 - RNA, 22 nt, Human
uagaaacaaugacaugcuugua

SEQ ID NO: 1003709 - RNA, 22 nt, Human
ugucauaacuuagugacaaauc

SEQ ID NO: 1003710 - RNA, 22 nt, Human
uauuuaaaaagaggccagcugg

SEQ ID NO: 1003711 - RNA, 22 nt, Human
uagcauuaucugucuuaucauu

SEQ ID NO: 1003712 - RNA, 22 nt, Human
aaauaguucagcuuguaaaccc

SEQ ID NO: 1003713 - RNA, 16 nt, Human
ccugggcucuguugga

SEQ ID NO: 1003714 - RNA, 22 nt, Human
cagcucuguucauagauggugc

SEQ ID NO: 1003715 - RNA, 22 nt, Human
gcauacagagaggauguggcau

SEQ ID NO: 1003716 - RNA, 18 nt, Human
acucugcggaggccccag

SEQ ID NO: 1003717 - RNA, 22 nt, Human
acaauucugaugguuucccagu

SEQ ID NO: 1003718 - RNA, 22 nt, Human
acucugaaugugcauguaaauc

SEQ ID NO: 1003719 - RNA, 22 nt, Human
gaaagaagcuuuagauggcuau

SEQ ID NO: 1003720 - RNA, 22 nt, Human
uagggcucacugagaugaauau

SEQ ID NO: 1003721 - RNA, 22 nt, Human
cugggccugucagggcuuuuug

SEQ ID NO: 1003722 - RNA, 22 nt, Human
uuucugaauaacucuaugauau

SEQ ID NO: 1003723 - RNA, 22 nt, Human
uuaauuuuuauguauagugugu

SEQ ID NO: 1003724 - RNA, 22 nt, Human
ugagaauuuuuugucaugcauu

SEQ ID NO: 1003725 - RNA, 22 nt, Human
acacauaagccuaaucaucucc

SEQ ID NO: 1003726 - RNA, 22 nt, Human
ucacaggcuugugaacauugca

SEQ ID NO: 1003727 - RNA, 22 nt, Human
gaugaagccugacuucucggug

SEQ ID NO: 1003728 - RNA, 22 nt, Human
uuccugggugguccugguagag

SEQ ID NO: 1003729 - RNA, 22 nt, Human
cacacaucuuaucccaguuauu

SEQ ID NO: 1003730 - RNA, 21 nt, Human
uaacacauuuugguacuuugg

SEQ ID NO: 1003731 - RNA, 22 nt, Human
ugcuuaaacauacuauuuauau

SEQ ID NO: 1003732 - RNA, 22 nt, Human
gguuucaaaguggacaguuagu

SEQ ID NO: 1003733 - RNA, 18 nt, Human
ccuagccuccaagcucau

SEQ ID NO: 1003734 - RNA, 22 nt, Human
ucccagccacaguuuccaccug

SEQ ID NO: 1003735 - RNA, 22 nt, Human
gacaaaaguguuuugaacaagg

SEQ ID NO: 1003736 - RNA, 20 nt, Human
gcuccccuucucugggccuc

SEQ ID NO: 1003737 - RNA, 22 nt, Human
uggguaggggacguggaagaaa

SEQ ID NO: 1003738 - RNA, 22 nt, Human
ggcuccaaagggcagugugagg

SEQ ID NO: 1003739 - RNA, 23 nt, Human
uguaugaauaugccacaguuuaa

SEQ ID NO: 1003740 - RNA, 22 nt, Human
uuucuacagcuggugcaacuuu

SEQ ID NO: 1003741 - RNA, 22 nt, Human
gcuggcaguaaaggguuuggca

SEQ ID NO: 1003742 - RNA, 22 nt, Human
aggcacaggaggugguaagaag

SEQ ID NO: 1003743 - RNA, 22 nt, Human
acagauuuuauuauucagguau

SEQ ID NO: 1003744 - RNA, 22 nt, Human
guuaugaaauaaauauagauca

SEQ ID NO: 1003745 - RNA, 22 nt, Human
ggggcucaguucggacagccug

SEQ ID NO: 1003746 - RNA, 22 nt, Human
guccucugaaagaugaaccaug

SEQ ID NO: 1003747 - RNA, 22 nt, Human
gggcucucaugaguguguggua

SEQ ID NO: 1003748 - RNA, 22 nt, Human
ugaaugaugcaguauaaugaua

SEQ ID NO: 1003749 - RNA, 22 nt, Human
gacagccaucagcacacgcugc

SEQ ID NO: 1003750 - RNA, 22 nt, Human
cuguaugauuccauuucuauaa

SEQ ID NO: 1003751 - RNA, 22 nt, Human
ucuggcagugauuucugugauc

SEQ ID NO: 1003752 - RNA, 22 nt, Human
cauuuguaguaucuguuuauau

SEQ ID NO: 1003753 - RNA, 22 nt, Human
cuguacaaguccuucaucaggg

SEQ ID NO: 1003754 - RNA, 22 nt, Human
cuuagggaauugggaggaugcc

SEQ ID NO: 1003755 - RNA, 22 nt, Human
cuggcaugaaauggcaucucau

SEQ ID NO: 1003756 - RNA, 22 nt, Human
uaugaacugugagugugauggg

SEQ ID NO: 1003757 - RNA, 22 nt, Human
accaugaugcauccuuaaggaa

SEQ ID NO: 1003758 - RNA, 22 nt, Human
acagauuugacugguaccuggc

SEQ ID NO: 1003759 - RNA, 22 nt, Human
ccagcuuuggaguguuguugcu

SEQ ID NO: 1003760 - RNA, 22 nt, Human
gccuggcacaguagggacccaa

SEQ ID NO: 1003761 - RNA, 22 nt, Human
gagccugaugaaacaggcagac

SEQ ID NO: 1003762 - RNA, 22 nt, Human
gggcaaguccggugcccagagc

SEQ ID NO: 1003763 - RNA, 22 nt, Human
gcagggacagggcagggccuuu

SEQ ID NO: 1003764 - RNA, 22 nt, Human
ucuggcagggguucugcacuug

SEQ ID NO: 1003765 - RNA, 22 nt, Human
cccaggcacaccccgaacggaa

SEQ ID NO: 1003766 - RNA, 22 nt, Human
cuacauggagaagaaaauucuu

SEQ ID NO: 1003767 - RNA, 22 nt, Human
agagggcugcugcacagugcuc

SEQ ID NO: 1003768 - RNA, 22 nt, Human
cuuuucaugagucuguuauggg

SEQ ID NO: 1003769 - RNA, 22 nt, Human
gggcugacauauuuggugcucu

SEQ ID NO: 1003770 - RNA, 22 nt, Human
uuuaacaugugaauuuuggaag

SEQ ID NO: 1003771 - RNA, 22 nt, Human
ugaagccauaggacagaggaua

SEQ ID NO: 1003772 - RNA, 22 nt, Human
gcaguguuguuaaaagauuaga

SEQ ID NO: 1003773 - RNA, 22 nt, Human
caggcccucgcccgcagcgacc

SEQ ID NO: 1003774 - RNA, 22 nt, Human
aagugauuucugccugcauguu

SEQ ID NO: 1003775 - RNA, 22 nt, Human
cccagcuucugagggggccuug

SEQ ID NO: 1003776 - RNA, 22 nt, Human
caauuucugggccucacacaag

SEQ ID NO: 1003777 - RNA, 22 nt, Human
cagugagggcccccuuccaggu

SEQ ID NO: 1003778 - RNA, 22 nt, Human
uacagccacaggugacucucau

SEQ ID NO: 1003779 - RNA, 22 nt, Human
uggaaagaggaagugcccagca

SEQ ID NO: 1003780 - RNA, 22 nt, Human
aucccacaccccuacaacauau

SEQ ID NO: 1003781 - RNA, 18 nt, Human
cuccuggcugauggugag

SEQ ID NO: 1003782 - RNA, 22 nt, Human
ccucugccaccucccacgaggc

SEQ ID NO: 1003783 - RNA, 22 nt, Human
cucucuggaagggggagcugau

SEQ ID NO: 1003784 - RNA, 22 nt, Human
uuugacaaauccuucagcaaug

SEQ ID NO: 1003785 - RNA, 20 nt, Human
ggcaggcuuuauauggaggg

SEQ ID NO: 1003786 - RNA, 22 nt, Human
gcagcucuccucugugaggaac

SEQ ID NO: 1003787 - RNA, 22 nt, Human
aaagaaucagaagucucaaaca

SEQ ID NO: 1003788 - RNA, 22 nt, Human
ccaggcuccgcauagaccccac

SEQ ID NO: 1003789 - RNA, 22 nt, Human
caccugcagggggagucaagag

SEQ ID NO: 1003790 - RNA, 22 nt, Human
gcagcuuuguggagaggcccau

SEQ ID NO: 1003791 - RNA, 22 nt, Human
ugcuucuggcagauugagugag

SEQ ID NO: 1003792 - RNA, 23 nt, Human
ucagagaggcccccugcagagau

SEQ ID NO: 1003793 - RNA, 22 nt, Human
cuccagugagcgcggggcaugg

SEQ ID NO: 1003794 - RNA, 22 nt, Human
ccuggcagcccagagcgccgcu

SEQ ID NO: 1003795 - RNA, 22 nt, Human
uacauaugaacuuuauaacuug

SEQ ID NO: 1003796 - RNA, 22 nt, Human
acuggagcugagagcaugggua

SEQ ID NO: 1003797 - RNA, 22 nt, Human
uccaagcucucuaugccaugau

SEQ ID NO: 1003798 - RNA, 22 nt, Human
ccaggcucaggugcgagagaca

SEQ ID NO: 1003799 - RNA, 22 nt, Human
augggcugcuucuccagcaccu

SEQ ID NO: 1003800 - RNA, 22 nt, Human
gccccacagccugcggucucag

SEQ ID NO: 1003801 - RNA, 20 nt, Human
agggucugaugugguggccc

SEQ ID NO: 1003802 - RNA, 22 nt, Human
uauuacagaaucaggcauaacu

SEQ ID NO: 1003803 - RNA, 22 nt, Human
acaguaaaucaacagaauaucu

SEQ ID NO: 1003804 - RNA, 22 nt, Human
aguucacauaucuguuuuauuu

SEQ ID NO: 1003805 - RNA, 22 nt, Human
uauucacaggcacgaaauauug

SEQ ID NO: 1003806 - RNA, 22 nt, Human
acagcuuuucugauagauccug

SEQ ID NO: 1003807 - RNA, 22 nt, Human
aucagagacaaaaccagcacuu

SEQ ID NO: 1003808 - RNA, 22 nt, Human
aggcuggauuuauggggacuuc

SEQ ID NO: 1003809 - RNA, 22 nt, Human
aaaagguuuugaguacaaauau

SEQ ID NO: 1003810 - RNA, 21 nt, Human
aauguauguuuaucucacagu

SEQ ID NO: 1003811 - RNA, 22 nt, Human
cuuaggaacgcucugccuagug

SEQ ID NO: 1003812 - RNA, 22 nt, Human
cagggcucacucggcuggcguc

SEQ ID NO: 1003813 - RNA, 22 nt, Human
ugcagggaaaguguuggcagca

SEQ ID NO: 1003814 - RNA, 22 nt, Human
accaggcaugauguggagcaca

SEQ ID NO: 1003815 - RNA, 22 nt, Human
gcagcuuuaaacauuggaaaua

SEQ ID NO: 1003816 - RNA, 22 nt, Human
ggagucugcucccagacaugau

SEQ ID NO: 1003817 - RNA, 22 nt, Human
gugaaacagaagcuccuggaau

SEQ ID NO: 1003818 - RNA, 22 nt, Human
cagaguggcgacccccucagcu

SEQ ID NO: 1003819 - RNA, 22 nt, Human
uaugaccuuaggaagcaagaag

SEQ ID NO: 1003820 - RNA, 22 nt, Human
uauauguaaauaagucuaaugu

SEQ ID NO: 1003821 - RNA, 23 nt, Human
agggcuccuuguugauuagcauu

SEQ ID NO: 1003822 - RNA, 22 nt, Human
gaggcuguuaggagggacucug

SEQ ID NO: 1003823 - RNA, 22 nt, Human
accaggcagucaccguccagga

SEQ ID NO: 1003824 - RNA, 22 nt, Human
ucccugcccucagugcacccgg

SEQ ID NO: 1003825 - RNA, 22 nt, Human
cagccucugacaccacagucgu

SEQ ID NO: 1003826 - RNA, 22 nt, Human
agucccagcuucccccaugcag

SEQ ID NO: 1003827 - RNA, 22 nt, Human
gccaggcacaguucuaggugcu

SEQ ID NO: 1003828 - RNA, 22 nt, Human
gccccaccuugagagcagaaac

SEQ ID NO: 1003829 - RNA, 20 nt, Human
uccugcaguuccuaggaggg

SEQ ID NO: 1003830 - RNA, 22 nt, Human
aauguaugagcgugaaagcacu

SEQ ID NO: 1003831 - RNA, 22 nt, Human
ccugcagggugcugccacagau

SEQ ID NO: 1003832 - RNA, 22 nt, Human
uuuuccuucuagagcagauuuc

SEQ ID NO: 1003833 - RNA, 22 nt, Human
ccuggcaguggugaagaagagg

SEQ ID NO: 1003834 - RNA, 22 nt, Human
uggcagagaacacacaugauuc

SEQ ID NO: 1003835 - RNA, 22 nt, Human
gcagcuuuagaaacaagggcug

SEQ ID NO: 1003836 - RNA, 22 nt, Human
ugccugacugcugccaccacua

SEQ ID NO: 1003837 - RNA, 20 nt, Human
aggcucugccugcaggccca

SEQ ID NO: 1003838 - RNA, 22 nt, Human
uggaaagagguagaggaucugg

SEQ ID NO: 1003839 - RNA, 22 nt, Human
auuuucauggcuucugcucagu

SEQ ID NO: 1003840 - RNA, 22 nt, Human
ugauguucuguauaucauauag

SEQ ID NO: 1003841 - RNA, 22 nt, Human
accugccuaucagcugccugcu

SEQ ID NO: 1003842 - RNA, 22 nt, Human
agaccugcagggccaggccugc

SEQ ID NO: 1003843 - RNA, 22 nt, Human
gagacugcauagauggccacaa

SEQ ID NO: 1003844 - RNA, 22 nt, Human
aucuagcaguguuauaauugga

SEQ ID NO: 1003845 - RNA, 22 nt, Human
cuccaagucggcugcagcugga

SEQ ID NO: 1003846 - RNA, 20 nt, Human
ucuggggaugaggucuagga

SEQ ID NO: 1003847 - RNA, 22 nt, Human
ucugucaucucuaaaauagaaa

SEQ ID NO: 1003848 - RNA, 22 nt, Human
uuuaaauuuagaagaaacacug

SEQ ID NO: 1003849 - RNA, 22 nt, Human
ugcaggcuuggaucacaucucc

SEQ ID NO: 1003850 - RNA, 22 nt, Human
aaguccaguuucauuugagguc

SEQ ID NO: 1003851 - RNA, 22 nt, Human
aacaaccaaaaagaugaaugua

SEQ ID NO: 1003852 - RNA, 22 nt, Human
cccaggcagggacgugcucugg

SEQ ID NO: 1003853 - RNA, 22 nt, Human
auggccugcagugcugccacag

SEQ ID NO: 1003854 - RNA, 21 nt, Human
gcaaguacuaucaucauuauc

SEQ ID NO: 1003855 - RNA, 22 nt, Human
agguauaagaagauuauuuaua

SEQ ID NO: 1003856 - RNA, 17 nt, Human
ugaauucaaucugcacu

SEQ ID NO: 1003857 - RNA, 22 nt, Human
acuggcaguuugagaaugcauu

SEQ ID NO: 1003858 - RNA, 22 nt, Human
gcuggcaggagccuuucccuuu

SEQ ID NO: 1003859 - RNA, 22 nt, Human
ucugggcuuuuccaugccugug

SEQ ID NO: 1003860 - RNA, 22 nt, Human
cacccagcauuggcuaagagag

SEQ ID NO: 1003861 - RNA, 22 nt, Human
gcagcuuuguaaaguaugaagc

SEQ ID NO: 1003862 - RNA, 17 nt, Human
agguauaaaaugguagc

SEQ ID NO: 1003863 - RNA, 22 nt, Human
ccugggcuuucaaaaccagccu

SEQ ID NO: 1003864 - RNA, 22 nt, Human
cuccuggcucgcccccagcuga

SEQ ID NO: 1003865 - RNA, 22 nt, Human
uuuaauuuguauuucuagaggg

SEQ ID NO: 1003866 - RNA, 22 nt, Human
uucacuuauagggauguuauug

SEQ ID NO: 1003867 - RNA, 22 nt, Human
ucauuuguucucauucucuacu

SEQ ID NO: 1003868 - RNA, 22 nt, Human
ggagugugggauggagcucagg

SEQ ID NO: 1003869 - RNA, 22 nt, Human
gcacacaggggaguucucagaa

SEQ ID NO: 1003870 - RNA, 22 nt, Human
ugaagcacaggcauacacaacc

SEQ ID NO: 1003871 - RNA, 22 nt, Human
acuggcaggcugcuggccggcg

SEQ ID NO: 1003872 - RNA, 22 nt, Human
aacccagccguguagcugccgc

SEQ ID NO: 1003873 - RNA, 20 nt, Human
auacacauauucuugcaacu

SEQ ID NO: 1003874 - RNA, 22 nt, Human
gcaggcucaaaagcugguagga

SEQ ID NO: 1003875 - RNA, 22 nt, Human
ucauuuguugaacuuuagugcg

SEQ ID NO: 1003876 - RNA, 22 nt, Human
uaacacauuuuccucauacgga

SEQ ID NO: 1003877 - RNA, 18 nt, Human
cucugucauaagugucau

SEQ ID NO: 1003878 - RNA, 22 nt, Human
cccaggccagaacuugguugcu

SEQ ID NO: 1003879 - RNA, 22 nt, Human
aggcuuuggaaucagaguucug

SEQ ID NO: 1003880 - RNA, 22 nt, Human
cugcagagcagccaguccccca

SEQ ID NO: 1003881 - RNA, 22 nt, Human
cugggcuuucaggcccuaaggc

SEQ ID NO: 1003882 - RNA, 18 nt, Human
acauuucuccuucugacc

SEQ ID NO: 1003883 - RNA, 22 nt, Human
guucacaagaguuacagacaga

SEQ ID NO: 1003884 - RNA, 22 nt, Human
guugggaaggcaagaaguagaa

SEQ ID NO: 1003885 - RNA, 22 nt, Human
ggagcugaggcugaggccucac

SEQ ID NO: 1003886 - RNA, 22 nt, Human
ccaggccuuccaguacgcagaa

SEQ ID NO: 1003887 - RNA, 22 nt, Human
ccagcuuuuggggugacaauuu

SEQ ID NO: 1003888 - RNA, 22 nt, Human
ccucucccgggugccgcugggc

SEQ ID NO: 1003889 - RNA, 20 nt, Human
agccugccagcuggcccaga

SEQ ID NO: 1003890 - RNA, 22 nt, Human
uguguaaagcuuguuccagaaa

SEQ ID NO: 1003891 - RNA, 22 nt, Human
gaaauauuucucuugagccccu

SEQ ID NO: 1003892 - RNA, 22 nt, Human
ucccacacagcccgcucaccgg

SEQ ID NO: 1003893 - RNA, 22 nt, Human
uggccaggccucuuggugccca

SEQ ID NO: 1003894 - RNA, 22 nt, Human
gucugucauacggcuuauguaa

SEQ ID NO: 1003895 - RNA, 22 nt, Human
ugcuucuggggacaggcugccu

SEQ ID NO: 1003896 - RNA, 22 nt, Human
acaggcaggcuucggccagagc

SEQ ID NO: 1003897 - RNA, 22 nt, Human
uaaguuuucuggaauaacuugg

SEQ ID NO: 1003898 - RNA, 22 nt, Human
ggcugcagagcugggugggccu

SEQ ID NO: 1003899 - RNA, 18 nt, Human
acuggcuuuagcaucaga

SEQ ID NO: 1003900 - RNA, 22 nt, Human
acuuaaaaccagacagcgucau

SEQ ID NO: 1003901 - RNA, 22 nt, Human
uacacacuuacuggagaugaag

SEQ ID NO: 1003902 - RNA, 21 nt, Human
uuuagggaggauauuuaacuu

SEQ ID NO: 1003903 - RNA, 22 nt, Human
gagcacugauuuauuuuugucu

SEQ ID NO: 1003904 - RNA, 22 nt, Human
aaagauucgagcgauguauaaa

SEQ ID NO: 1003905 - RNA, 22 nt, Human
ccaggcaggcgauggugcagug

SEQ ID NO: 1003906 - RNA, 22 nt, Human
uuccaaguccagccaggccaaa

SEQ ID NO: 1003907 - RNA, 22 nt, Human
aaagaguucuaugaucuuucca

SEQ ID NO: 1003908 - RNA, 22 nt, Human
ucccugccugacagcacccacc

SEQ ID NO: 1003909 - RNA, 23 nt, Human
cucccuggcccuugggagaccug

SEQ ID NO: 1003910 - RNA, 22 nt, Human
uccaggaggaggaaggcugcca

SEQ ID NO: 1003911 - RNA, 22 nt, Human
aagggcucccaacucaucuuuu

SEQ ID NO: 1003912 - RNA, 22 nt, Human
uucucuuuucaccaguugcuaa

SEQ ID NO: 1003913 - RNA, 20 nt, Human
gauacacagcacagagggcc

SEQ ID NO: 1003914 - RNA, 22 nt, Human
gacuacucaaacuuucucuaua

SEQ ID NO: 1003915 - RNA, 22 nt, Human
auguuaaaugguuuauuauuaa

SEQ ID NO: 1003916 - RNA, 22 nt, Human
uguaggaauguuuuuaaguugg

SEQ ID NO: 1003917 - RNA, 22 nt, Human
uccaggcagucauuaaucucua

SEQ ID NO: 1003918 - RNA, 23 nt, Human
uaaauuaccuuuccagugcaggg

SEQ ID NO: 1003919 - RNA, 22 nt, Human
aucugcuugaguuugaagucag

SEQ ID NO: 1003920 - RNA, 22 nt, Human
ugacaaaacugcaauuacuuuu

SEQ ID NO: 1003921 - RNA, 22 nt, Human
cauuuacuuaaaucuuuacaag

SEQ ID NO: 1003922 - RNA, 22 nt, Human
augggcugggaauacacagggg

SEQ ID NO: 1003923 - RNA, 22 nt, Human
ugcagggaauccagucuagggu

SEQ ID NO: 1003924 - RNA, 22 nt, Human
ucagcuuugaucucaggcaauc

SEQ ID NO: 1003925 - RNA, 22 nt, Human
cuucuuaacuguauauacuaug

SEQ ID NO: 1003926 - RNA, 22 nt, Human
accaggcaacugugaaugggcu

SEQ ID NO: 1003927 - RNA, 22 nt, Human
acuggcagguccaucgcccuuu

SEQ ID NO: 1003928 - RNA, 22 nt, Human
uuggaagacagugaaacagcac

SEQ ID NO: 1003929 - RNA, 22 nt, Human
ucucuuaauuguaaugguuccu

SEQ ID NO: 1003930 - RNA, 19 nt, Human
cucagagaggggcagugcc

SEQ ID NO: 1003931 - RNA, 19 nt, Human
uuagggacaugaauucuag

SEQ ID NO: 1003932 - RNA, 20 nt, Human
gccugcagguuggaugggau

SEQ ID NO: 1003933 - RNA, 22 nt, Human
ucugugcaggaagucauuauga

SEQ ID NO: 1003934 - RNA, 22 nt, Human
uccaaggcuccggcccuggcgu

SEQ ID NO: 1003935 - RNA, 22 nt, Human
uacauucccccaauuaccaaug

SEQ ID NO: 1003936 - RNA, 22 nt, Human
cccaggcacacugaagugacau

SEQ ID NO: 1003937 - RNA, 22 nt, Human
uaucauuguguuauuucuucca

SEQ ID NO: 1003938 - RNA, 22 nt, Human
uccaagcuguauguuccuagag

SEQ ID NO: 1003939 - RNA, 22 nt, Human
ggagagaauuccauggacaugu

SEQ ID NO: 1003940 - RNA, 22 nt, Human
acacacuuuaaauuaaaccucu

SEQ ID NO: 1003941 - RNA, 22 nt, Human
cagccucuguggcugccacacc

SEQ ID NO: 1003942 - RNA, 22 nt, Human
uacacaucccagacucccagga

SEQ ID NO: 1003943 - RNA, 22 nt, Human
cuucauuaaccaaaaugcaaua

SEQ ID NO: 1003944 - RNA, 19 nt, Human
gccugcagaaaaggcaggg

SEQ ID NO: 1003945 - RNA, 22 nt, Human
aaggcuuuugggaauuuucaac

SEQ ID NO: 1003946 - RNA, 22 nt, Human
gggacccugggaggcuggcgca

SEQ ID NO: 1003947 - RNA, 22 nt, Human
ucauacaauucaaucucugauu

SEQ ID NO: 1003948 - RNA, 22 nt, Human
gagggguccaggaggcacuuac

SEQ ID NO: 1003949 - RNA, 22 nt, Human
ugggcuccguugccuggggcag

SEQ ID NO: 1003950 - RNA, 22 nt, Human
agguaugagauaaaucaaugaa

SEQ ID NO: 1003951 - RNA, 22 nt, Human
gcagcuuucuacuuccuacagc

SEQ ID NO: 1003952 - RNA, 22 nt, Human
cucuggggaagcagccagcugg

SEQ ID NO: 1003953 - RNA, 22 nt, Human
cucaucaccacauauaacaaag

SEQ ID NO: 1003954 - RNA, 22 nt, Human
guauuagguuggugcaaaauug

SEQ ID NO: 1003955 - RNA, 22 nt, Human
gacacagaaggucacauguuca

SEQ ID NO: 1003956 - RNA, 22 nt, Human
augugaaagagguguucagugg

SEQ ID NO: 1003957 - RNA, 22 nt, Human
cuccaaguccgagggcucucaa

SEQ ID NO: 1003958 - RNA, 22 nt, Human
uuaugaaggaucagguacuugg

SEQ ID NO: 1003959 - RNA, 22 nt, Human
ccagccacagcuuccagcuccu

SEQ ID NO: 1003960 - RNA, 21 nt, Human
caguguggugaccagggucuc

SEQ ID NO: 1003961 - RNA, 22 nt, Human
cgcaggcugcagccaagaagag

SEQ ID NO: 1003962 - RNA, 22 nt, Human
augauugaaaaugacauugcca

SEQ ID NO: 1003963 - RNA, 22 nt, Human
ccauaaucuggcuuugagagag

SEQ ID NO: 1003964 - RNA, 22 nt, Human
uucagagacagcaaccaggaca

SEQ ID NO: 1003965 - RNA, 22 nt, Human
ccaggccucuggcugcuuaguc

SEQ ID NO: 1003966 - RNA, 20 nt, Human
uauaaauucagagcuuuggu

SEQ ID NO: 1003967 - RNA, 22 nt, Human
uaugaaacauucauacaaauaa

SEQ ID NO: 1003968 - RNA, 22 nt, Human
ugaaacauugcacuguaugaau

SEQ ID NO: 1003969 - RNA, 22 nt, Human
ccugaggggcugcaggccagcu

SEQ ID NO: 1003970 - RNA, 22 nt, Human
uaacacauauuucaagaguagu

SEQ ID NO: 1003971 - RNA, 22 nt, Human
auuguugggucucacuccuaga

SEQ ID NO: 1003972 - RNA, 22 nt, Human
ugcuucuggaaacaguggcugu

SEQ ID NO: 1003973 - RNA, 19 nt, Human
agacaaguuuccagaagcc

SEQ ID NO: 1003974 - RNA, 22 nt, Human
uguuucuuuguagauauucuuu

SEQ ID NO: 1003975 - RNA, 22 nt, Human
cuuuauuccuacaagauuuucu

SEQ ID NO: 1003976 - RNA, 22 nt, Human
gccaggcagccacccucugcga

SEQ ID NO: 1003977 - RNA, 22 nt, Human
gagacagaguuucacucuuguu

SEQ ID NO: 1003978 - RNA, 22 nt, Human
uuuuccuguccaggcaauuauu

SEQ ID NO: 1003979 - RNA, 22 nt, Human
ugggcuccuugggagcaaguga

SEQ ID NO: 1003980 - RNA, 22 nt, Human
uccugcagguggaugauucucu

SEQ ID NO: 1003981 - RNA, 22 nt, Human
ucauuuguaccauuuuuuaaga

SEQ ID NO: 1003982 - RNA, 22 nt, Human
uucauacacgaaaaugcaugca

SEQ ID NO: 1003983 - RNA, 22 nt, Human
acuuuauuuccuauugcaucca

SEQ ID NO: 1003984 - RNA, 19 nt, Human
cccucuugcacaaagcaaa

SEQ ID NO: 1003985 - RNA, 19 nt, Human
ugcuagaaauucugugacu

SEQ ID NO: 1003986 - RNA, 22 nt, Human
gcacacacaugugaguacaugc

SEQ ID NO: 1003987 - RNA, 22 nt, Human
uucauacaaugggauauuauga

SEQ ID NO: 1003988 - RNA, 22 nt, Human
agcaggugggcaugaaagcuga

SEQ ID NO: 1003989 - RNA, 22 nt, Human
cagaugagaguggccaggguuc

SEQ ID NO: 1003990 - RNA, 20 nt, Human
uauuuguauuugggaaaguu

SEQ ID NO: 1003991 - RNA, 22 nt, Human
acaauauuguacccagaaguuu

SEQ ID NO: 1003992 - RNA, 22 nt, Human
uccaggcuuuuucaugcugucu

SEQ ID NO: 1003993 - RNA, 22 nt, Human
gggucaggcucagcagggcagc

SEQ ID NO: 1003994 - RNA, 22 nt, Human
aucugucaagauagacucugca

SEQ ID NO: 1003995 - RNA, 22 nt, Human
uaaacaucugucauguguuuau

SEQ ID NO: 1003996 - RNA, 22 nt, Human
ucagagaguuagugucuuagcu

SEQ ID NO: 1003997 - RNA, 22 nt, Human
augcuacagaguuugaauaugu

SEQ ID NO: 1003998 - RNA, 22 nt, Human
aucauuuuuaagagacucuucu

SEQ ID NO: 1003999 - RNA, 22 nt, Human
uuccaaguagaagcauuugcau

SEQ ID NO: 1004000 - RNA, 22 nt, Human
uccugagcacagagacaaggaa

SEQ ID NO: 1004001 - RNA, 19 nt, Human
agcaggcuaggcugccucu

SEQ ID NO: 1004002 - RNA, 22 nt, Human
gcagggguuuucugacuugagu

SEQ ID NO: 1004003 - RNA, 23 nt, Human
ugcaggcuaggaagagagccuuc

SEQ ID NO: 1004004 - RNA, 22 nt, Human
ugaagcuugagugucaguuccu

SEQ ID NO: 1004005 - RNA, 22 nt, Human
uguaaagguaggugcaaaauga

SEQ ID NO: 1004006 - RNA, 22 nt, Human
uucugucaaagacuuuuucagg

SEQ ID NO: 1004007 - RNA, 22 nt, Human
augggcugacccagucguggca

SEQ ID NO: 1004008 - RNA, 22 nt, Human
cagcuuguuuuauuuggggacc

SEQ ID NO: 1004009 - RNA, 20 nt, Human
ccugggcucaaagcauccuc

SEQ ID NO: 1004010 - RNA, 22 nt, Human
ugucagaugcgauaaacuagug

SEQ ID NO: 1004011 - RNA, 21 nt, Human
aacacauccagaguauuugac

SEQ ID NO: 1004012 - RNA, 22 nt, Human
ugcagggccuucuagaccaugg

SEQ ID NO: 1004013 - RNA, 22 nt, Human
gagcuuuacuucugacuggugc

SEQ ID NO: 1004014 - RNA, 22 nt, Human
acaggcucaguucacuggauuu

SEQ ID NO: 1004015 - RNA, 22 nt, Human
ugucuuuagagucacaaaacca

SEQ ID NO: 1004016 - RNA, 22 nt, Human
cccugcagccggccagcucauu

SEQ ID NO: 1004017 - RNA, 22 nt, Human
uguagaaccuguuuauuauaga

SEQ ID NO: 1004018 - RNA, 22 nt, Human
uaacacauaagcugagaccaug

SEQ ID NO: 1004019 - RNA, 22 nt, Human
ccaggcagggcucaaggaaccu

SEQ ID NO: 1004020 - RNA, 22 nt, Human
ggcaggcuccguguuccauucc

SEQ ID NO: 1004021 - RNA, 22 nt, Human
accaggcaguauggugcugcaa

SEQ ID NO: 1004022 - RNA, 22 nt, Human
acuggcagugucguuuacauga

SEQ ID NO: 1004023 - RNA, 22 nt, Human
uaggaaauggcucaguuacugc

SEQ ID NO: 1004024 - RNA, 19 nt, Human
ugcauaaauuauauacuuu

SEQ ID NO: 1004025 - RNA, 22 nt, Human
uuccaggcuauccggugaaggg

SEQ ID NO: 1004026 - RNA, 22 nt, Human
guuuuauaauugcuucauaaga

SEQ ID NO: 1004027 - RNA, 22 nt, Human
aggaccuggaucacagagaucu

SEQ ID NO: 1004028 - RNA, 22 nt, Human
auaucauucugauguauaucuu

SEQ ID NO: 1004029 - RNA, 22 nt, Human
uucagagauggaaggcagaaug

SEQ ID NO: 1004030 - RNA, 22 nt, Human
aauuagggagagguagcuaggu

SEQ ID NO: 1004031 - RNA, 22 nt, Human
acuggcagcuguaggaugcaug

SEQ ID NO: 1004032 - RNA, 21 nt, Human
ucuggcagcaguuuguugagu

SEQ ID NO: 1004033 - RNA, 22 nt, Human
agcaguccaacugagguggcau

SEQ ID NO: 1004034 - RNA, 22 nt, Human
uauuucccagggagcaacaagc

SEQ ID NO: 1004035 - RNA, 22 nt, Human
cacccacauggaaauucacagu

SEQ ID NO: 1004036 - RNA, 22 nt, Human
cagcauuuggaggagaggcuuu

SEQ ID NO: 1004037 - RNA, 23 nt, Human
auauuagggagauuagcccucua

SEQ ID NO: 1004038 - RNA, 19 nt, Human
ccuuccuccccagggccau

SEQ ID NO: 1004039 - RNA, 22 nt, Human
ccaggccuagccccugagggua

SEQ ID NO: 1004040 - RNA, 22 nt, Human
ucagagagccucaggcacugcc

SEQ ID NO: 1004041 - RNA, 22 nt, Human
gcauaugaucacgugugucggu

SEQ ID NO: 1004042 - RNA, 22 nt, Human
agggaccugucaaugacaguua

SEQ ID NO: 1004043 - RNA, 22 nt, Human
uuucauaauauccagagauuuu

SEQ ID NO: 1004044 - RNA, 22 nt, Human
ucaggcucuggguacaccugac

SEQ ID NO: 1004045 - RNA, 22 nt, Human
uguaugaauauguuggggaggu

SEQ ID NO: 1004046 - RNA, 22 nt, Human
ucuggcagcagcaucaguggcu

SEQ ID NO: 1004047 - RNA, 22 nt, Human
uuaauuuuaaccuguuuguguc

SEQ ID NO: 1004048 - RNA, 22 nt, Human
auauauuugagaauauucauga

SEQ ID NO: 1004049 - RNA, 22 nt, Human
ugcuucuggcacuugagggggu

SEQ ID NO: 1004050 - RNA, 22 nt, Human
gccuccuggccuuugcuccuca

SEQ ID NO: 1004051 - RNA, 22 nt, Human
auuuuccucaagccucuggaag

SEQ ID NO: 1004052 - RNA, 19 nt, Human
cuuauuagagugagagcuu

SEQ ID NO: 1004053 - RNA, 22 nt, Human
ugcauaaacagauacuucaugu

SEQ ID NO: 1004054 - RNA, 22 nt, Human
gacaggcuuugagucccagaac

SEQ ID NO: 1004055 - RNA, 22 nt, Human
ccagcuuuaucaagucugagcu

SEQ ID NO: 1004056 - RNA, 22 nt, Human
cagaggcugcucuggguggcau

SEQ ID NO: 1004057 - RNA, 22 nt, Human
auaguguuacccuucuuaaagu

SEQ ID NO: 1004058 - RNA, 22 nt, Human
ucaggcucaaagggccggauga

SEQ ID NO: 1004059 - RNA, 22 nt, Human
cauuuauuggcauguaguaggu

SEQ ID NO: 1004060 - RNA, 22 nt, Human
agagcagauggagcuggaagag

SEQ ID NO: 1004061 - RNA, 22 nt, Human
uuuguuagagugugggaggcug

SEQ ID NO: 1004062 - RNA, 22 nt, Human
acacacaugcaugcuugccauu

SEQ ID NO: 1004063 - RNA, 22 nt, Human
ucuccacacuuucucucccagg

SEQ ID NO: 1004064 - RNA, 22 nt, Human
uucucuuagcuguaaagucaau

SEQ ID NO: 1004065 - RNA, 22 nt, Human
uucugggggccaggacaguggu

SEQ ID NO: 1004066 - RNA, 22 nt, Human
uccaggcaguuuuccagguugu

SEQ ID NO: 1004067 - RNA, 23 nt, Human
uuuuccuguggagacaugacugg

SEQ ID NO: 1004068 - RNA, 22 nt, Human
ucacauuucugauuauaccaaa

SEQ ID NO: 1004069 - RNA, 22 nt, Human
cccagcuugcgggcggcaggag

SEQ ID NO: 1004070 - RNA, 22 nt, Human
uauuccuauuucuaaacauaug

SEQ ID NO: 1004071 - RNA, 22 nt, Human
gcugggcuucucaaugcugccu

SEQ ID NO: 1004072 - RNA, 22 nt, Human
uauguacaugauuucauuugcu

SEQ ID NO: 1004073 - RNA, 22 nt, Human
cuucuggggauggagcccagaa

SEQ ID NO: 1004074 - RNA, 22 nt, Human
uuaacauuguccuuagcagauu

SEQ ID NO: 1004075 - RNA, 22 nt, Human
agagaguugaggaagcaacacu

SEQ ID NO: 1004076 - RNA, 22 nt, Human
ggaggacaggggcugcagcaca

SEQ ID NO: 1004077 - RNA, 22 nt, Human
cacuguccaauagauacauaau

SEQ ID NO: 1004078 - RNA, 22 nt, Human
ugcuccagugagcuggccaucc

SEQ ID NO: 1004079 - RNA, 22 nt, Human
augggcuggcagccugaacagc

SEQ ID NO: 1004080 - RNA, 22 nt, Human
uuucauaauacuguacaugaaa

SEQ ID NO: 1004081 - RNA, 22 nt, Human
uuagggaaggcugcugucagcu

SEQ ID NO: 1004082 - RNA, 22 nt, Human
uaugacauuggccaaguucugu

SEQ ID NO: 1004083 - RNA, 22 nt, Human
cagcuuuaccuuuaggaguaac

SEQ ID NO: 1004084 - RNA, 22 nt, Human
aacacauaggcagagcaugaca

SEQ ID NO: 1004085 - RNA, 22 nt, Human
ccugcagagccacgugccagcg

SEQ ID NO: 1004086 - RNA, 20 nt, Human
uuccagagaucugcauuuua

SEQ ID NO: 1004087 - RNA, 22 nt, Human
ccaaugauggugcccacgauga

SEQ ID NO: 1004088 - RNA, 22 nt, Human
ucugggcuuuugcacuggccau

SEQ ID NO: 1004089 - RNA, 23 nt, Human
cuguaugauguuaaguggaaagc

SEQ ID NO: 1004090 - RNA, 22 nt, Human
ugggccagcaauugcugcucag

SEQ ID NO: 1004091 - RNA, 22 nt, Human
augcugucgaaaccaaacaucu

SEQ ID NO: 1004092 - RNA, 20 nt, Human
uuccacaucuuugcacaugc

SEQ ID NO: 1004093 - RNA, 21 nt, Human
uccagaccucccucuccuagc

SEQ ID NO: 1004094 - RNA, 22 nt, Human
uguagaaauuaguaagaucaac

SEQ ID NO: 1004095 - RNA, 22 nt, Human
cccaaguuaauuuguagcugaa

SEQ ID NO: 1004096 - RNA, 22 nt, Human
agaugguuuugucuuuaugauu

SEQ ID NO: 1004097 - RNA, 22 nt, Human
aaauaguuacuucugcugucuu

SEQ ID NO: 1004098 - RNA, 22 nt, Human
uuucuugacugcuuaggaaugc

SEQ ID NO: 1004099 - RNA, 22 nt, Human
cagugaggcucugcugagcggu

SEQ ID NO: 1004100 - RNA, 20 nt, Human
ucacacaugguaagcuauga

SEQ ID NO: 1004101 - RNA, 22 nt, Human
acacacacaagcagguugugga

SEQ ID NO: 1004102 - RNA, 22 nt, Human
agggcccaggacagcaucaggg

SEQ ID NO: 1004103 - RNA, 22 nt, Human
cccagcucugcagaccugcccu

SEQ ID NO: 1004104 - RNA, 22 nt, Human
aacuuucaggcaaugaauauuu

SEQ ID NO: 1004105 - RNA, 22 nt, Human
ugcaggcugcagucucaggugg

SEQ ID NO: 1004106 - RNA, 22 nt, Human
uauugaaauucuucauguccuc

SEQ ID NO: 1004107 - RNA, 22 nt, Human
aaugaagccagguagaagagaa

SEQ ID NO: 1004108 - RNA, 22 nt, Human
uaugaacucuggagucugagug

SEQ ID NO: 1004109 - RNA, 22 nt, Human
agcuuuaucacaauauuggcua

SEQ ID NO: 1004110 - RNA, 22 nt, Human
cccacacacauuuaugauagga

SEQ ID NO: 1004111 - RNA, 19 nt, Human
uucuaccuuacuguaggcu

SEQ ID NO: 1004112 - RNA, 22 nt, Human
cccaggcaguagaaagaagagg

SEQ ID NO: 1004113 - RNA, 22 nt, Human
gaugaagcuuugaagucuaauc

SEQ ID NO: 1004114 - RNA, 22 nt, Human
guuuucauuacugcugugauuu

SEQ ID NO: 1004115 - RNA, 22 nt, Human
caggcauggugagaacucagcc

SEQ ID NO: 1004116 - RNA, 19 nt, Human
cccagcuugaccaccugcu

SEQ ID NO: 1004117 - RNA, 22 nt, Human
cauuuguaucauauguaucuua

SEQ ID NO: 1004118 - RNA, 22 nt, Human
aucucuguaaaccauaaauuga

SEQ ID NO: 1004119 - RNA, 22 nt, Human
uacugacacaaagccaaucccu

SEQ ID NO: 1004120 - RNA, 22 nt, Human
uagggcucugcucaucaguugu

SEQ ID NO: 1004121 - RNA, 22 nt, Human
ucacuguagugagcagaauaua

SEQ ID NO: 1004122 - RNA, 22 nt, Human
uuuuggaaugaggaacauccag

SEQ ID NO: 1004123 - RNA, 18 nt, Human
ucagcuuuugaaaaccaa

SEQ ID NO: 1004124 - RNA, 22 nt, Human
gccuccuggguucaugccauuc

SEQ ID NO: 1004125 - RNA, 23 nt, Human
cuucacaaucaaaaucaguucug

SEQ ID NO: 1004126 - RNA, 22 nt, Human
ugugaagauuuggcaugcagaa

SEQ ID NO: 1004127 - RNA, 22 nt, Human
cuagggaccucagcuccuggag

SEQ ID NO: 1004128 - RNA, 22 nt, Human
ggcaggcuguucaccugcuuuu

SEQ ID NO: 1004129 - RNA, 22 nt, Human
auugacuuccauagcuaccugg

SEQ ID NO: 1004130 - RNA, 22 nt, Human
aaugauugcaaacauugagaac

SEQ ID NO: 1004131 - RNA, 22 nt, Human
uuuagacauggcuugcucacuu

SEQ ID NO: 1004132 - RNA, 22 nt, Human
acagauuuaggacuguagcgau

SEQ ID NO: 1004133 - RNA, 22 nt, Human
cucagccccaauucuccccauu

SEQ ID NO: 1004134 - RNA, 22 nt, Human
gucuggaaggaggagauggagc

SEQ ID NO: 1004135 - RNA, 22 nt, Human
uccugcagcauccgucgucugu

SEQ ID NO: 1004136 - RNA, 22 nt, Human
caguagacacauuaauauggaa

SEQ ID NO: 1004137 - RNA, 22 nt, Human
agcaggggcuccuccacagcca

SEQ ID NO: 1004138 - RNA, 22 nt, Human
acacacaugccuuuccuaagua

SEQ ID NO: 1004139 - RNA, 22 nt, Human
ccagagagguagcuuacccucu

SEQ ID NO: 1004140 - RNA, 22 nt, Human
acaggcaggcgggacagcccga

SEQ ID NO: 1004141 - RNA, 22 nt, Human
ggccucaguuucuccauggguu

SEQ ID NO: 1004142 - RNA, 22 nt, Human
uaacacaugguucugucaggaa

SEQ ID NO: 1004143 - RNA, 22 nt, Human
gccuggggaacuugauccuguc

SEQ ID NO: 1004144 - RNA, 22 nt, Human
guuuuuaucuaauagcaguuau

SEQ ID NO: 1004145 - RNA, 22 nt, Human
augucaaaucaguuuuaucaga

SEQ ID NO: 1004146 - RNA, 22 nt, Human
ccuccccaugacccggugcugg

SEQ ID NO: 1004147 - RNA, 22 nt, Human
ugaguagagaauucagcuaagg

SEQ ID NO: 1004148 - RNA, 21 nt, Human
ccacucaugacuccacucacc

SEQ ID NO: 1004149 - RNA, 22 nt, Human
cccugcagccuugcaugccuuc

SEQ ID NO: 1004150 - RNA, 20 nt, Human
cuguuaaaagguaugaauuc

SEQ ID NO: 1004151 - RNA, 22 nt, Human
cuggaaagugucuccauccugg

SEQ ID NO: 1004152 - RNA, 22 nt, Human
cagagcaucgcgcagagagccu

SEQ ID NO: 1004153 - RNA, 18 nt, Human
ugcuuuaugcuuauauaa

SEQ ID NO: 1004154 - RNA, 22 nt, Human
gccugcagaggugcugcuagcu

SEQ ID NO: 1004155 - RNA, 22 nt, Human
ccuggggaauagagucaagggg

SEQ ID NO: 1004156 - RNA, 22 nt, Human
agagucagcuuaugacacaguc

SEQ ID NO: 1004157 - RNA, 22 nt, Human
augggcugugggacccuggacc

SEQ ID NO: 1004158 - RNA, 22 nt, Human
aauguaugacaguucuaguggu

SEQ ID NO: 1004159 - RNA, 21 nt, Human
ccuuuacaauuuugcauuccu

SEQ ID NO: 1004160 - RNA, 22 nt, Human
uuauuagguuauucucuguacu

SEQ ID NO: 1004161 - RNA, 18 nt, Human
uuuuacucauagcaggcc

SEQ ID NO: 1004162 - RNA, 22 nt, Human
auguaugaagcuuuguuuggga

SEQ ID NO: 1004163 - RNA, 21 nt, Human
gaauaguucuguggcagcagu

SEQ ID NO: 1004164 - RNA, 22 nt, Human
accugcagccacuucucuccuu

SEQ ID NO: 1004165 - RNA, 22 nt, Human
uguagaaagcucuucugaaauc

SEQ ID NO: 1004166 - RNA, 22 nt, Human
gaauauuuguaauuacuguuga

SEQ ID NO: 1004167 - RNA, 22 nt, Human
auaacuuucuucacccuugcug

SEQ ID NO: 1004168 - RNA, 22 nt, Human
aaaguuuguugcuuacaaagaa

SEQ ID NO: 1004169 - RNA, 22 nt, Human
cccagggaagggcuaccugagg

SEQ ID NO: 1004170 - RNA, 22 nt, Human
uacauaauaaggggcauggugu

SEQ ID NO: 1004171 - RNA, 22 nt, Human
aaauccuaaggagaauaugauu

SEQ ID NO: 1004172 - RNA, 22 nt, Human
uuguaugaguaugguguauagg

SEQ ID NO: 1004173 - RNA, 22 nt, Human
acagcuuuaucucagggaucag

SEQ ID NO: 1004174 - RNA, 22 nt, Human
aagagagagugcgcucacagaa

SEQ ID NO: 1004175 - RNA, 22 nt, Human
gcccacacagcagauccuuugg

SEQ ID NO: 1004176 - RNA, 22 nt, Human
auuuagcaaaaaaugaugaagc

SEQ ID NO: 1004177 - RNA, 22 nt, Human
gcagcucucuggccugcccugg

SEQ ID NO: 1004178 - RNA, 22 nt, Human
ucccagccuuucuuuucugcug

SEQ ID NO: 1004179 - RNA, 22 nt, Human
auguggcugguaguugacaacu

SEQ ID NO: 1004180 - RNA, 22 nt, Human
acaugauuuuuaaagagauaau

SEQ ID NO: 1004181 - RNA, 22 nt, Human
uuggaaauugcaagugauuugc

SEQ ID NO: 1004182 - RNA, 18 nt, Human
acaaaugugucacaggaa

SEQ ID NO: 1004183 - RNA, 22 nt, Human
uguaugaagacuucuucugugu

SEQ ID NO: 1004184 - RNA, 20 nt, Human
cugcaggguuagaggcucca

SEQ ID NO: 1004185 - RNA, 22 nt, Human
caucacagaaauaaacauaccu

SEQ ID NO: 1004186 - RNA, 22 nt, Human
cuggggacuuugguucuccaug

SEQ ID NO: 1004187 - RNA, 22 nt, Human
gcagcuuucuaagcuuuauugc

SEQ ID NO: 1004188 - RNA, 22 nt, Human
aggcuguguggaugagucuuac

SEQ ID NO: 1004189 - RNA, 22 nt, Human
uucacauuugaaaggaaagaua

SEQ ID NO: 1004190 - RNA, 22 nt, Human
ucauuuugggguuugucaucuu

SEQ ID NO: 1004191 - RNA, 22 nt, Human
acacauauauacauauuugugc

SEQ ID NO: 1004192 - RNA, 22 nt, Human
ugcuucugcugauauuuuguga

SEQ ID NO: 1004193 - RNA, 21 nt, Human
aaagagcccgcugagagguuc

SEQ ID NO: 1004194 - RNA, 22 nt, Human
uuuguuuucaaugugucauuca

SEQ ID NO: 1004195 - RNA, 22 nt, Human
acccagccacagcauugaggga

SEQ ID NO: 1004196 - RNA, 22 nt, Human
ucagagaguuggaaagaauuaa

SEQ ID NO: 1004197 - RNA, 22 nt, Human
uaugcacauucacacaaaaaug

SEQ ID NO: 1004198 - RNA, 20 nt, Human
uuuuccuucugaguauguug

SEQ ID NO: 1004199 - RNA, 22 nt, Human
ccuggcagggcugcaguaaugg

SEQ ID NO: 1004200 - RNA, 22 nt, Human
cccaggcagugugugcaugcgu

SEQ ID NO: 1004201 - RNA, 22 nt, Human
ggaccugcucucccaguucucu

SEQ ID NO: 1004202 - RNA, 22 nt, Human
aaaccaucagauaauucauacu

SEQ ID NO: 1004203 - RNA, 21 nt, Human
ccaggcugggagggcaguucc

SEQ ID NO: 1004204 - RNA, 22 nt, Human
agagcauccaucggccaggacc

SEQ ID NO: 1004205 - RNA, 22 nt, Human
aauugucaaacacaaauaagag

SEQ ID NO: 1004206 - RNA, 22 nt, Human
uguaugaaccuuuaauauagug

SEQ ID NO: 1004207 - RNA, 22 nt, Human
aaauacagauuccagggucuua

SEQ ID NO: 1004208 - RNA, 22 nt, Human
ggcaaggggucaggcugagaca

SEQ ID NO: 1004209 - RNA, 22 nt, Human
acaggcucucuauugagugcag

SEQ ID NO: 1004210 - RNA, 19 nt, Human
aauuagggagucgguuaag

SEQ ID NO: 1004211 - RNA, 22 nt, Human
ucugggcugcuaugaggcagag

SEQ ID NO: 1004212 - RNA, 19 nt, Human
acauuuagaauguacuugc

SEQ ID NO: 1004213 - RNA, 22 nt, Human
caugaagcacagcucucuuuuu

SEQ ID NO: 1004214 - RNA, 22 nt, Human
ggcuuuauuugcagccauuguu

SEQ ID NO: 1004215 - RNA, 22 nt, Human
cagaagagaugaaauaguauua

SEQ ID NO: 1004216 - RNA, 21 nt, Human
uagcuuuaauauucccacauu

SEQ ID NO: 1004217 - RNA, 22 nt, Human
auguuauuaaaguacagauucu

SEQ ID NO: 1004218 - RNA, 22 nt, Human
cacauaauaaauguuccugaug

SEQ ID NO: 1004219 - RNA, 22 nt, Human
gacccugccaugagugacaggg

SEQ ID NO: 1004220 - RNA, 22 nt, Human
uuuaugaacuacagauauaacu

SEQ ID NO: 1004221 - RNA, 22 nt, Human
cacccagggcugugccugccca

SEQ ID NO: 1004222 - RNA, 22 nt, Human
cagggacccgcacagguagcau

SEQ ID NO: 1004223 - RNA, 22 nt, Human
acuggcagagggaaaaccauuc

SEQ ID NO: 1004224 - RNA, 22 nt, Human
auguuucaaauauauagaguug

SEQ ID NO: 1004225 - RNA, 22 nt, Human
uggcuggagcauuccuugucuu

SEQ ID NO: 1004226 - RNA, 22 nt, Human
agauauauuuaagguaauaagu

SEQ ID NO: 1004227 - RNA, 22 nt, Human
uuucaugauuaacuuagugaau

SEQ ID NO: 1004228 - RNA, 23 nt, Human
uccaggagcaugcuggcuggcga

SEQ ID NO: 1004229 - RNA, 22 nt, Human
agggaccucauguaaguggauu

SEQ ID NO: 1004230 - RNA, 22 nt, Human
uacauaauuaaucuuuaaguuc

SEQ ID NO: 1004231 - RNA, 22 nt, Human
auaacuuagaguaggcaaaagu

SEQ ID NO: 1004232 - RNA, 22 nt, Human
uccugcagacauuuacaccuuu

SEQ ID NO: 1004233 - RNA, 22 nt, Human
aggggugugcauccuggaggau

SEQ ID NO: 1004234 - RNA, 22 nt, Human
gaacugaguuuucugccuggac

SEQ ID NO: 1004235 - RNA, 22 nt, Human
auauuaggugcucaauacaugc

SEQ ID NO: 1004236 - RNA, 22 nt, Human
uaacacaugguuaguacacaau

SEQ ID NO: 1004237 - RNA, 22 nt, Human
cugcaggcccccuuccuggagu

SEQ ID NO: 1004238 - RNA, 22 nt, Human
agagccaggugcugcuguuuga

SEQ ID NO: 1004239 - RNA, 22 nt, Human
ccuggcagacugugagggcagg

SEQ ID NO: 1004240 - RNA, 22 nt, Human
agcuuuauggugccucacuuga

SEQ ID NO: 1004241 - RNA, 22 nt, Human
acagcuuuguguuaaugggaag

SEQ ID NO: 1004242 - RNA, 22 nt, Human
uagcuagaaugcuucgugauau

SEQ ID NO: 1004243 - RNA, 22 nt, Human
ggcugccacgucgaggguccaa

SEQ ID NO: 1004244 - RNA, 22 nt, Human
aguuagaauauaauuauguuaa

SEQ ID NO: 1004245 - RNA, 22 nt, Human
cugagccagggccacacaugga

SEQ ID NO: 1004246 - RNA, 22 nt, Human
ggcagagguagcuggaaccagg

SEQ ID NO: 1004247 - RNA, 22 nt, Human
ucaggagcucuucccuggugug

SEQ ID NO: 1004248 - RNA, 22 nt, Human
uuauuugcccauguuuagcaga

SEQ ID NO: 1004249 - RNA, 22 nt, Human
auacauucaaaggaaggauaga

SEQ ID NO: 1004250 - RNA, 18 nt, Human
acaggcugugggaauggu

SEQ ID NO: 1004251 - RNA, 22 nt, Human
ucccacacuugaaacaaggcug

SEQ ID NO: 1004252 - RNA, 22 nt, Human
cauuguuauagcauuacacacc

SEQ ID NO: 1004253 - RNA, 22 nt, Human
cccaggcagccugcagggaagg

SEQ ID NO: 1004254 - RNA, 22 nt, Human
cacauaagaaaugaauaugaga

SEQ ID NO: 1004255 - RNA, 22 nt, Human
gagggcucugucuggaagggaa

SEQ ID NO: 1004256 - RNA, 22 nt, Human
caaauaguaugagcaaugauuc

SEQ ID NO: 1004257 - RNA, 22 nt, Human
cugccuggccacaacccagggu

SEQ ID NO: 1004258 - RNA, 18 nt, Human
ugaggcagucagugaugg

SEQ ID NO: 1004259 - RNA, 22 nt, Human
ggcuuuauguuuuucauguggu

SEQ ID NO: 1004260 - RNA, 22 nt, Human
aagguuaaauagguauuuucca

SEQ ID NO: 1004261 - RNA, 22 nt, Human
agcucugcuucuugggaagaug

SEQ ID NO: 1004262 - RNA, 22 nt, Human
cugcaggggcuggaguuggcuu

SEQ ID NO: 1004263 - RNA, 22 nt, Human
ugcuuuauaaccauuucugugg

SEQ ID NO: 1004264 - RNA, 22 nt, Human
caguggugaagagcaggggcuc

SEQ ID NO: 1004265 - RNA, 22 nt, Human
aauguaugcugugguaucuucu

SEQ ID NO: 1004266 - RNA, 22 nt, Human
ugggaccugcucuuggaaugag

SEQ ID NO: 1004267 - RNA, 22 nt, Human
aguaugaacggaaggccuggga

SEQ ID NO: 1004268 - RNA, 22 nt, Human
uuaacacagggggagacaaagu

SEQ ID NO: 1004269 - RNA, 22 nt, Human
cagccucuuuccacaucaggca

SEQ ID NO: 1004270 - RNA, 22 nt, Human
ucacacagcuccuuuccuuagu

SEQ ID NO: 1004271 - RNA, 22 nt, Human
cagcuuuauuucacguguuugu

SEQ ID NO: 1004272 - RNA, 22 nt, Human
cgcaggcuggcgcggaguggca

SEQ ID NO: 1004273 - RNA, 22 nt, Human
acccagccuacaaagcucaccu

SEQ ID NO: 1004274 - RNA, 22 nt, Human
acuggaaaacacuacuacaugc

SEQ ID NO: 1004275 - RNA, 20 nt, Human
ucuggcaggugaacgagcug

SEQ ID NO: 1004276 - RNA, 22 nt, Human
accaggcagcaccaaagccggu

SEQ ID NO: 1004277 - RNA, 22 nt, Human
auaugugaaguggguuauuuug

SEQ ID NO: 1004278 - RNA, 22 nt, Human
guaguuuucugaaaauuacuuu

SEQ ID NO: 1004279 - RNA, 22 nt, Human
ugcuuuaucaaagcuauaguga

SEQ ID NO: 1004280 - RNA, 22 nt, Human
agcuuuaucccuugcccaucga

SEQ ID NO: 1004281 - RNA, 22 nt, Human
cccaggcagcggggucuccuug

SEQ ID NO: 1004282 - RNA, 22 nt, Human
aauaaucucccuuuuuguaugu

SEQ ID NO: 1004283 - RNA, 22 nt, Human
gagugaugucuguagugaagaa

SEQ ID NO: 1004284 - RNA, 22 nt, Human
ucagcuuugcaaguuagaaaau

SEQ ID NO: 1004285 - RNA, 22 nt, Human
gugggguagaucuuucucagga

SEQ ID NO: 1004286 - RNA, 22 nt, Human
agugugagccuacaggccaaag

SEQ ID NO: 1004287 - RNA, 22 nt, Human
ucccaggcugggggccugaagu

SEQ ID NO: 1004288 - RNA, 22 nt, Human
cacccaggacaggccagaugug

SEQ ID NO: 1004289 - RNA, 22 nt, Human
auccccacgauauagccaaagc

SEQ ID NO: 1004290 - RNA, 22 nt, Human
aagcuuuaugacuuggagacag

SEQ ID NO: 1004291 - RNA, 22 nt, Human
uucucuuuuagaggcuccauga

SEQ ID NO: 1004292 - RNA, 17 nt, Human
gggcugacaguggccuc

SEQ ID NO: 1004293 - RNA, 22 nt, Human
gccgggaccaaggccacggagc

SEQ ID NO: 1004294 - RNA, 22 nt, Human
ggcagugagaggucuccugguc

SEQ ID NO: 1004295 - RNA, 22 nt, Human
ugcaggcucucugcugccagau

SEQ ID NO: 1004296 - RNA, 22 nt, Human
cugguggagagugggcucugga

SEQ ID NO: 1004297 - RNA, 22 nt, Human
ccaucuccaaauaccaucacau

SEQ ID NO: 1004298 - RNA, 22 nt, Human
agcuuuauuaacucuccaggug

SEQ ID NO: 1004299 - RNA, 22 nt, Human
aggcuuuguaccuggggucuua

SEQ ID NO: 1004300 - RNA, 22 nt, Human
ggcaggcugggagucaucagag

SEQ ID NO: 1004301 - RNA, 20 nt, Human
uuucacaucugucccuuuaa

SEQ ID NO: 1004302 - RNA, 22 nt, Human
uuuagggaugucagaacaggga

SEQ ID NO: 1004303 - RNA, 20 nt, Human
auacacauucauagaaaaau

SEQ ID NO: 1004304 - RNA, 22 nt, Human
gacuguggggggcggacacaag

SEQ ID NO: 1004305 - RNA, 22 nt, Human
gagauggccagugccaggacaa

SEQ ID NO: 1004306 - RNA, 22 nt, Human
agggcucccgcgguguccggga

SEQ ID NO: 1004307 - RNA, 22 nt, Human
guacccaggcacgccuugcuga

SEQ ID NO: 1004308 - RNA, 22 nt, Human
ggcugcagggcagcuggugugg

SEQ ID NO: 1004309 - RNA, 22 nt, Human
uuugaaaauuagacacaggcua

SEQ ID NO: 1004310 - RNA, 22 nt, Human
aaauuucuggaagugucagagu

SEQ ID NO: 1004311 - RNA, 22 nt, Human
acauuucucuugaugucucuau

SEQ ID NO: 1004312 - RNA, 22 nt, Human
acagcuuuguuuucccugcuga

SEQ ID NO: 1004313 - RNA, 22 nt, Human
uucaaauuaccacauuugcuua

SEQ ID NO: 1004314 - RNA, 19 nt, Human
ccagagacauuggcaucuu

SEQ ID NO: 1004315 - RNA, 22 nt, Human
uguaugaaugggaaaaggaaac

SEQ ID NO: 1004316 - RNA, 22 nt, Human
gugugggaaggcuaggaugcug

SEQ ID NO: 1004317 - RNA, 22 nt, Human
ugggccagcugaagugccgccc

SEQ ID NO: 1004318 - RNA, 22 nt, Human
aaaaaucuaugacugcuucucc

SEQ ID NO: 1004319 - RNA, 21 nt, Human
gggagggauggaaaugauguu

SEQ ID NO: 1004320 - RNA, 22 nt, Human
cccagcaugcacgcugacacuc

SEQ ID NO: 1004321 - RNA, 22 nt, Human
gagacacacauucuggagagaa

SEQ ID NO: 1004322 - RNA, 22 nt, Human
cauuuguauagugcuuagacca

SEQ ID NO: 1004323 - RNA, 22 nt, Human
gcaaggacucccugggucauuc

SEQ ID NO: 1004324 - RNA, 22 nt, Human
ugcaggcucaucucaagaguag

SEQ ID NO: 1004325 - RNA, 22 nt, Human
ugacuagaccuauaucuuuuug

SEQ ID NO: 1004326 - RNA, 22 nt, Human
uuuaguagaaugauacagggca

SEQ ID NO: 1004327 - RNA, 22 nt, Human
accaggcagcacuuuccuugca

SEQ ID NO: 1004328 - RNA, 22 nt, Human
auugcuuaucuaucuuuaaguc

SEQ ID NO: 1004329 - RNA, 22 nt, Human
agaggccugugugcuccagugg

SEQ ID NO: 1004330 - RNA, 22 nt, Human
ugagcagagucgcuccagagug

SEQ ID NO: 1004331 - RNA, 22 nt, Human
aagggcuccacuugaaucacac

SEQ ID NO: 1004332 - RNA, 22 nt, Human
agggcuccuaugaugcucugcc

SEQ ID NO: 1004333 - RNA, 22 nt, Human
guccaagucuuccuucccaaac

SEQ ID NO: 1004334 - RNA, 23 nt, Human
uuucacaaugagcauuacagaau

SEQ ID NO: 1004335 - RNA, 22 nt, Human
ucaggcccuuugcugcugcccc

SEQ ID NO: 1004336 - RNA, 22 nt, Human
ugaaugauuugggugcauucag

SEQ ID NO: 1004337 - RNA, 22 nt, Human
acugggcugccugguucuucua

SEQ ID NO: 1004338 - RNA, 22 nt, Human
ccugggcucaccaugccuugga

SEQ ID NO: 1004339 - RNA, 19 nt, Human
gagggcucauuugaacaau

SEQ ID NO: 1004340 - RNA, 22 nt, Human
gggcucucgauuagacccuggg

SEQ ID NO: 1004341 - RNA, 22 nt, Human
gggcugacucugcacugagcca

SEQ ID NO: 1004342 - RNA, 22 nt, Human
uuacaagauaaccugaugcugu

SEQ ID NO: 1004343 - RNA, 22 nt, Human
cugagagaucaagccacaggau

SEQ ID NO: 1004344 - RNA, 22 nt, Human
gcaggcuccaaggccugggaga

SEQ ID NO: 1004345 - RNA, 22 nt, Human
ccugggcuucugucuagauguu

SEQ ID NO: 1004346 - RNA, 22 nt, Human
aucacagagcucccuuccacug

SEQ ID NO: 1004347 - RNA, 22 nt, Human
caguguuugcuuaaguuauaug

SEQ ID NO: 1004348 - RNA, 22 nt, Human
ucccugccuccuggcagugcca

SEQ ID NO: 1004349 - RNA, 22 nt, Human
caggacaaagcccuuugagaaa

SEQ ID NO: 1004350 - RNA, 22 nt, Human
ccaaguacucucaccaaagcuu

SEQ ID NO: 1004351 - RNA, 22 nt, Human
auuucccuccagggaaagcuua

SEQ ID NO: 1004352 - RNA, 22 nt, Human
cuuggcaguuucggaaggauga

SEQ ID NO: 1004353 - RNA, 22 nt, Human
acauacacaagcguacaugaac

SEQ ID NO: 1004354 - RNA, 22 nt, Human
uauuagggaacugcaagacuaa

SEQ ID NO: 1004355 - RNA, 22 nt, Human
gcuaggagauugagcucugaag

SEQ ID NO: 1004356 - RNA, 22 nt, Human
ucauuuguggaagugauugugg

SEQ ID NO: 1004357 - RNA, 22 nt, Human
ugaauaugugacuuugauuuca

SEQ ID NO: 1004358 - RNA, 22 nt, Human
ugcagggcuaagucagagccug

SEQ ID NO: 1004359 - RNA, 22 nt, Human
cccugcagaccaaugccauaga

SEQ ID NO: 1004360 - RNA, 22 nt, Human
uaucaauugggccaaaugguac

SEQ ID NO: 1004361 - RNA, 22 nt, Human
guccucugcccaggucaagguu

SEQ ID NO: 1004362 - RNA, 23 nt, Human
acucacaaagcaggaucauguug

SEQ ID NO: 1004363 - RNA, 19 nt, Human
gggaccugacuaauuggca

SEQ ID NO: 1004364 - RNA, 21 nt, Human
agugccaguagguauggagga

SEQ ID NO: 1004365 - RNA, 22 nt, Human
uacauucagcaaaagaaugguu

SEQ ID NO: 1004366 - RNA, 22 nt, Human
aggccucugcuggaaagaguug

SEQ ID NO: 1004367 - RNA, 22 nt, Human
gagccaccuucaacucaggaau

SEQ ID NO: 1004368 - RNA, 22 nt, Human
agauaugugcgucuuagauuga

SEQ ID NO: 1004369 - RNA, 22 nt, Human
cacccagcagcacuuaagacua

SEQ ID NO: 1004370 - RNA, 22 nt, Human
uugugcucuguguuauuuaagg

SEQ ID NO: 1004371 - RNA, 22 nt, Human
guauuagggccaaaggcaggaa

SEQ ID NO: 1004372 - RNA, 19 nt, Human
guuucauuaagauaggaaa

SEQ ID NO: 1004373 - RNA, 22 nt, Human
cugggcuuugaagccaggcugc

SEQ ID NO: 1004374 - RNA, 22 nt, Human
cacacacuggagcaaggagaug

SEQ ID NO: 1004375 - RNA, 22 nt, Human
cagguacauucguagacccauu

SEQ ID NO: 1004376 - RNA, 22 nt, Human
agucacccuccaacucuccacu

SEQ ID NO: 1004377 - RNA, 22 nt, Human
ugcugagcgcauccggcggccg

SEQ ID NO: 1004378 - RNA, 22 nt, Human
uauguacacacacaugcaugua

SEQ ID NO: 1004379 - RNA, 22 nt, Human
auaugcaagcacauagaauacu

SEQ ID NO: 1004380 - RNA, 22 nt, Human
cugccugccuuggccuccagga

SEQ ID NO: 1004381 - RNA, 22 nt, Human
cauuuauugaguggccacagug

SEQ ID NO: 1004382 - RNA, 22 nt, Human
aggugaguccugggcacaggua

SEQ ID NO: 1004383 - RNA, 22 nt, Human
ggcuucugagugcucugcuguu

SEQ ID NO: 1004384 - RNA, 22 nt, Human
gccaaaucuugcacacucuugu

SEQ ID NO: 1004385 - RNA, 22 nt, Human
gacacagagggcaccagauaug

SEQ ID NO: 1004386 - RNA, 16 nt, Human
cagcuuuaugucagug

SEQ ID NO: 1004387 - RNA, 22 nt, Human
guaugaaguaagauauuguuca

SEQ ID NO: 1004388 - RNA, 22 nt, Human
ugagugugcagggaaguggcgg

SEQ ID NO: 1004389 - RNA, 22 nt, Human
ggcacagagcuuugucccaguu

SEQ ID NO: 1004390 - RNA, 22 nt, Human
auguaugaugcuaggcucucag

SEQ ID NO: 1004391 - RNA, 22 nt, Human
gaggccugucgcuaggccucug

SEQ ID NO: 1004392 - RNA, 22 nt, Human
uuuuucaugagacuagaaguca

SEQ ID NO: 1004393 - RNA, 22 nt, Human
uuucacaagacagcuacuguug

SEQ ID NO: 1004394 - RNA, 22 nt, Human
guggcagugaaggucauagcau

SEQ ID NO: 1004395 - RNA, 22 nt, Human
aaaguuuguuauaugauaagga

SEQ ID NO: 1004396 - RNA, 20 nt, Human
ccagcuuucccugcagcauc

SEQ ID NO: 1004397 - RNA, 22 nt, Human
acuggcagaacgugaugcgggu

SEQ ID NO: 1004398 - RNA, 22 nt, Human
gcacacaggcaguuuccagcca

SEQ ID NO: 1004399 - RNA, 22 nt, Human
uguaacacucaaucuguuuaac

SEQ ID NO: 1004400 - RNA, 22 nt, Human
ggagcugaguucuucagccggg

SEQ ID NO: 1004401 - RNA, 22 nt, Human
uuccuggcagaggccccgacag

SEQ ID NO: 1004402 - RNA, 22 nt, Human
cagggacccuacuagcucacac

SEQ ID NO: 1004403 - RNA, 22 nt, Human
ucacuguaccuuccauuucauu

SEQ ID NO: 1004404 - RNA, 22 nt, Human
ccuggcaggcuggggacagugc

SEQ ID NO: 1004405 - RNA, 22 nt, Human
gauuuauuuuuaaucagcaggg

SEQ ID NO: 1004406 - RNA, 22 nt, Human
ucccagccuuccuuguggugaa

SEQ ID NO: 1004407 - RNA, 22 nt, Human
ccagagaggccuuggcaagaca

SEQ ID NO: 1004408 - RNA, 22 nt, Human
ugcuucuggaguaacaggguga

SEQ ID NO: 1004409 - RNA, 22 nt, Human
ugaaauaucauuuucaucuccc

SEQ ID NO: 1004410 - RNA, 22 nt, Human
ugcuuuaucugacuuggcgcug

SEQ ID NO: 1004411 - RNA, 22 nt, Human
ccuggcagguagcauugaggag

SEQ ID NO: 1004412 - RNA, 22 nt, Human
cugccugcucuauccaggccug

SEQ ID NO: 1004413 - RNA, 22 nt, Human
cccgagugucuacucacuccca

SEQ ID NO: 1004414 - RNA, 22 nt, Human
acuguccaagcaugccuggcuu

SEQ ID NO: 1004415 - RNA, 22 nt, Human
ucuaugaaaagucuauucauuc

SEQ ID NO: 1004416 - RNA, 22 nt, Human
cuuuggaauauuuuauugagaa

SEQ ID NO: 1004417 - RNA, 22 nt, Human
auaugaagaaucuaggauaggc

SEQ ID NO: 1004418 - RNA, 23 nt, Human
uccugcagauaagcugguugaca

SEQ ID NO: 1004419 - RNA, 22 nt, Human
augggcugaaagaguaagcugu

SEQ ID NO: 1004420 - RNA, 20 nt, Human
agcaggcugcagggugaaau

SEQ ID NO: 1004421 - RNA, 22 nt, Human
cugggcuguucugccccugggu

SEQ ID NO: 1004422 - RNA, 22 nt, Human
ucaaagagcuauucaguugugg

SEQ ID NO: 1004423 - RNA, 22 nt, Human
uagggacacugcucaugaguuc

SEQ ID NO: 1004424 - RNA, 22 nt, Human
uaacacauagauauuuuaacuu

SEQ ID NO: 1004425 - RNA, 22 nt, Human
agcuuuauuugucauucacggc

SEQ ID NO: 1004426 - RNA, 22 nt, Human
ugcagagaagaggacaguucua

SEQ ID NO: 1004427 - RNA, 18 nt, Human
auccuugaugagaggucu

SEQ ID NO: 1004428 - RNA, 22 nt, Human
uccaagaugguugguguggugg

SEQ ID NO: 1004429 - RNA, 22 nt, Human
ugcagccccugaaaauggcagc

SEQ ID NO: 1004430 - RNA, 22 nt, Human
acuuaaaaacagauccagcagg

SEQ ID NO: 1004431 - RNA, 22 nt, Human
uccagaccuagggcaccccagu

SEQ ID NO: 1004432 - RNA, 22 nt, Human
ucccacauaugcaauccugaau

SEQ ID NO: 1004433 - RNA, 22 nt, Human
ccugccugucuuuauccccugu

SEQ ID NO: 1004434 - RNA, 22 nt, Human
auggcagauggcuggagcaggu

SEQ ID NO: 1004435 - RNA, 22 nt, Human
uacaauauguggccuuuuguga

SEQ ID NO: 1004436 - RNA, 22 nt, Human
auauuucaugggguuccauacu

SEQ ID NO: 1004437 - RNA, 22 nt, Human
ccacuguaaguuugaaaauaac

SEQ ID NO: 1004438 - RNA, 23 nt, Human
caggacaugggaggaaguauggc

SEQ ID NO: 1004439 - RNA, 22 nt, Human
ucaagagauugaauaauaacug

SEQ ID NO: 1004440 - RNA, 21 nt, Human
uccacccucucugcucccagu

SEQ ID NO: 1004441 - RNA, 22 nt, Human
ccuggcagguggagguugcagu

SEQ ID NO: 1004442 - RNA, 20 nt, Human
uccaugaguuagagacuaua

SEQ ID NO: 1004443 - RNA, 22 nt, Human
cagcucuggguaggaggaaucu

SEQ ID NO: 1004444 - RNA, 22 nt, Human
agcaggcuaaauaauaauacau

SEQ ID NO: 1004445 - RNA, 22 nt, Human
cucccaagcugugcugaacugu

SEQ ID NO: 1004446 - RNA, 22 nt, Human
aagaacuuccuaauauauuuuc

SEQ ID NO: 1004447 - RNA, 22 nt, Human
ggcaggcuccaagcauccuaug

SEQ ID NO: 1004448 - RNA, 22 nt, Human
ucauaaaugcagugucauaaau

SEQ ID NO: 1004449 - RNA, 22 nt, Human
uuccaagugcugaggacaguag

SEQ ID NO: 1004450 - RNA, 22 nt, Human
uaauuuuaugacaguguauuuu

SEQ ID NO: 1004451 - RNA, 23 nt, Human
cauccaggagcugagucugacug

SEQ ID NO: 1004452 - RNA, 22 nt, Human
gggucuccauguuaacaucacu

SEQ ID NO: 1004453 - RNA, 22 nt, Human
gcugucugccgcaggcugccac

SEQ ID NO: 1004454 - RNA, 22 nt, Human
ccuccuggcuuuucccauugaa

SEQ ID NO: 1004455 - RNA, 22 nt, Human
aguaugaaucuuucagaccgua

SEQ ID NO: 1004456 - RNA, 22 nt, Human
ucuggcaggccuugucaaucug

SEQ ID NO: 1004457 - RNA, 22 nt, Human
uccugcagccauuagaggucaa

SEQ ID NO: 1004458 - RNA, 22 nt, Human
caagcucugggauagcagagag

SEQ ID NO: 1004459 - RNA, 22 nt, Human
uguaaacagccccauggagagc

SEQ ID NO: 1004460 - RNA, 22 nt, Human
uuuaugagcaaugcugagggga

SEQ ID NO: 1004461 - RNA, 22 nt, Human
gagggcuccucacauucucuau

SEQ ID NO: 1004462 - RNA, 22 nt, Human
ugugugaaggagccacuguuca

SEQ ID NO: 1004463 - RNA, 22 nt, Human
guggcagucgcugacagauaca

SEQ ID NO: 1004464 - RNA, 22 nt, Human
ccuggcagccucagccaauucu

SEQ ID NO: 1004465 - RNA, 22 nt, Human
uuagcauuucaguacacauguu

SEQ ID NO: 1004466 - RNA, 22 nt, Human
cucugucagaguguugucccca

SEQ ID NO: 1004467 - RNA, 22 nt, Human
guccucugggcuuugagcaguc

SEQ ID NO: 1004468 - RNA, 22 nt, Human
acaaauccagugaacuccagug

SEQ ID NO: 1004469 - RNA, 22 nt, Human
acacagaugcauuacacaucua

SEQ ID NO: 1004470 - RNA, 22 nt, Human
aaaaagucugcaaaggagguug

SEQ ID NO: 1004471 - RNA, 22 nt, Human
gaggcugcggggaggagccugc

SEQ ID NO: 1004472 - RNA, 22 nt, Human
uggcagugguaccggcucucag

SEQ ID NO: 1004473 - RNA, 22 nt, Human
uuaugaaguuccuguuacagug

SEQ ID NO: 1004474 - RNA, 22 nt, Human
uugguuccuucugaaaguauug

SEQ ID NO: 1004475 - RNA, 22 nt, Human
ucagagagcuggugggcagagg

SEQ ID NO: 1004476 - RNA, 22 nt, Human
augggcugugagguccggcagg

SEQ ID NO: 1004477 - RNA, 22 nt, Human
agcaggcugccuuccaaagccu

SEQ ID NO: 1004478 - RNA, 22 nt, Human
cacaauuuuaauacacagucaa

SEQ ID NO: 1004479 - RNA, 22 nt, Human
ucaggcucugagcugaugcuaa

SEQ ID NO: 1004480 - RNA, 22 nt, Human
uuagacauagaauauugucuag

SEQ ID NO: 1004481 - RNA, 22 nt, Human
acuuugcagggcuugauaucca

SEQ ID NO: 1004482 - RNA, 22 nt, Human
aaauggauggaauugacauuua

SEQ ID NO: 1004483 - RNA, 22 nt, Human
uccugcagaucaaagccuuuga

SEQ ID NO: 1004484 - RNA, 22 nt, Human
gccaggggugcccacccaagga

SEQ ID NO: 1004485 - RNA, 21 nt, Human
cccuugccugcacuccucggc

SEQ ID NO: 1004486 - RNA, 22 nt, Human
guuuauuauacaacaaaagcua

SEQ ID NO: 1004487 - RNA, 19 nt, Human
ccaggccucuggggccugu

SEQ ID NO: 1004488 - RNA, 23 nt, Human
aucuguucaucugacacagauuc

SEQ ID NO: 1004489 - RNA, 22 nt, Human
gcuggcagcauuagacccuggg

SEQ ID NO: 1004490 - RNA, 22 nt, Human
aaauuucaguuggaaugagcuc

SEQ ID NO: 1004491 - RNA, 22 nt, Human
uaacacauuuuaagccauuuua

SEQ ID NO: 1004492 - RNA, 17 nt, Human
ucugggcuucagugguc

SEQ ID NO: 1004493 - RNA, 22 nt, Human
gcuggcagaauuucuucuugcu

SEQ ID NO: 1004494 - RNA, 22 nt, Human
cauacauuuauacacaucuaug

SEQ ID NO: 1004495 - RNA, 22 nt, Human
uauaauuuggggaaaguggugu

SEQ ID NO: 1004496 - RNA, 22 nt, Human
ccugcaguuuguugugaccccg

SEQ ID NO: 1004497 - RNA, 22 nt, Human
accugccuucucaaggacauga

SEQ ID NO: 1004498 - RNA, 22 nt, Human
cagaggcauacucccagucuug

SEQ ID NO: 1004499 - RNA, 22 nt, Human
ccuggcagcgccgaagcuggcc

SEQ ID NO: 1004500 - RNA, 22 nt, Human
ccagagagaguacugggcucug

SEQ ID NO: 1004501 - RNA, 22 nt, Human
uauauauucuuaaguaguguag

SEQ ID NO: 1004502 - RNA, 22 nt, Human
auaugaagucagacaaacuggg

SEQ ID NO: 1004503 - RNA, 22 nt, Human
cuuaauuucaaacugcuaguga

SEQ ID NO: 1004504 - RNA, 22 nt, Human
uauuagguaaaggacuugcagg

SEQ ID NO: 1004505 - RNA, 21 nt, Human
agaugcugaugcugcaggucc

SEQ ID NO: 1004506 - RNA, 22 nt, Human
guggcagguggagccuccugca

SEQ ID NO: 1004507 - RNA, 22 nt, Human
cucugaaagaguuuaguauuau

SEQ ID NO: 1004508 - RNA, 22 nt, Human
cugggcugcuguccacuagggu

SEQ ID NO: 1004509 - RNA, 22 nt, Human
uacacagauuucaguaucauca

SEQ ID NO: 1004510 - RNA, 22 nt, Human
ucagccuccgaaagugcuggga

SEQ ID NO: 1004511 - RNA, 22 nt, Human
ucacuguaauagguuugaagau

SEQ ID NO: 1004512 - RNA, 22 nt, Human
gaccugccugagcugccucugc

SEQ ID NO: 1004513 - RNA, 22 nt, Human
ucauuucuguugugcaucacug

SEQ ID NO: 1004514 - RNA, 22 nt, Human
gccuccuggaagucacauguuu

SEQ ID NO: 1004515 - RNA, 22 nt, Human
aaucacaugugcucaauuuuaa

SEQ ID NO: 1004516 - RNA, 22 nt, Human
ucuggggaccauggcaucuaaa

SEQ ID NO: 1004517 - RNA, 22 nt, Human
aaguguuuggggaucauuuuaa

SEQ ID NO: 1004518 - RNA, 22 nt, Human
cccacacauuuuucacuuaccg

SEQ ID NO: 1004519 - RNA, 22 nt, Human
uuucagaugugugucucugaag

SEQ ID NO: 1004520 - RNA, 22 nt, Human
gucugucaucugagauggagug

SEQ ID NO: 1004521 - RNA, 22 nt, Human
uccagaccaugugagaggcgca

SEQ ID NO: 1004522 - RNA, 22 nt, Human
auaugcauuuaccuggcauaua

SEQ ID NO: 1004523 - RNA, 22 nt, Human
aaaauuuugcccuauccuucau

SEQ ID NO: 1004524 - RNA, 22 nt, Human
ucuggcaggguguguauuuaca

SEQ ID NO: 1004525 - RNA, 22 nt, Human
aaaguuguaauggaagaaaugc

SEQ ID NO: 1004526 - RNA, 22 nt, Human
gauaauauuagaagauacaaau

SEQ ID NO: 1004527 - RNA, 22 nt, Human
gagccagguuugaaucucaguc

SEQ ID NO: 1004528 - RNA, 21 nt, Human
uccaagcucaacucccuuccu

SEQ ID NO: 1004529 - RNA, 22 nt, Human
aggaaagauggaaggaggauaa

SEQ ID NO: 1004530 - RNA, 22 nt, Human
ccugggcucacagccaaggcuc

SEQ ID NO: 1004531 - RNA, 22 nt, Human
acaucacaguaguuaagccaga

SEQ ID NO: 1004532 - RNA, 20 nt, Human
uaguauuugcauaaggauag

SEQ ID NO: 1004533 - RNA, 22 nt, Human
ucuggggacggggcccagcaau

SEQ ID NO: 1004534 - RNA, 22 nt, Human
cagcucagucuugaagcacugg

SEQ ID NO: 1004535 - RNA, 22 nt, Human
uagcauuucccaaaugcauuug

SEQ ID NO: 1004536 - RNA, 22 nt, Human
acccacccuacuagcagugucc

SEQ ID NO: 1004537 - RNA, 20 nt, Human
agaaauauugaguucagagg

SEQ ID NO: 1004538 - RNA, 22 nt, Human
ucuggggaugagguccagugau

SEQ ID NO: 1004539 - RNA, 22 nt, Human
gggaccuggcaccuuugcucug

SEQ ID NO: 1004540 - RNA, 22 nt, Human
aauucuguaacuuuacugaauu

SEQ ID NO: 1004541 - RNA, 22 nt, Human
agggcuccugaggcccuucugg

SEQ ID NO: 1004542 - RNA, 22 nt, Human
agggcucugagcuggaccaccu

SEQ ID NO: 1004543 - RNA, 22 nt, Human
aggcuccugcaggugaggugcu

SEQ ID NO: 1004544 - RNA, 22 nt, Human
gcagccucaaacuccccagcuc

SEQ ID NO: 1004545 - RNA, 21 nt, Human
agagucugagugugcaagggc

SEQ ID NO: 1004546 - RNA, 22 nt, Human
agccauccuacuaccucagcau

SEQ ID NO: 1004547 - RNA, 22 nt, Human
cacacacugacaccuuaucuug

SEQ ID NO: 1004548 - RNA, 21 nt, Human
acugggcuagccugacuucug

SEQ ID NO: 1004549 - RNA, 22 nt, Human
ccugggcucugucagaauuggg

SEQ ID NO: 1004550 - RNA, 22 nt, Human
ugcuucugaguugcaggacuug

SEQ ID NO: 1004551 - RNA, 22 nt, Human
ucucuuucuauugcaccaugcu

SEQ ID NO: 1004552 - RNA, 22 nt, Human
uccacccugcuuucuuaucucc

SEQ ID NO: 1004553 - RNA, 22 nt, Human
ugcauacacaagcauacaugua

SEQ ID NO: 1004554 - RNA, 22 nt, Human
cccaggccuggucugggccagu

SEQ ID NO: 1004555 - RNA, 22 nt, Human
uuucaaauaccauaaaccuaau

SEQ ID NO: 1004556 - RNA, 22 nt, Human
uucugucagcugcuuugucuca

SEQ ID NO: 1004557 - RNA, 22 nt, Human
cagcuuugugcaaugcagucuc

SEQ ID NO: 1004558 - RNA, 22 nt, Human
uuucacauaugguuguugauug

SEQ ID NO: 1004559 - RNA, 22 nt, Human
caggacugauguuccuccagcc

SEQ ID NO: 1004560 - RNA, 23 nt, Human
gaauaguuuuagaaauuggagaa

SEQ ID NO: 1004561 - RNA, 22 nt, Human
gccaggcaauguguuagaagcg

SEQ ID NO: 1004562 - RNA, 22 nt, Human
gcacacauucggauucuuaacc

SEQ ID NO: 1004563 - RNA, 22 nt, Human
guggccagccccauggacaguu

SEQ ID NO: 1004564 - RNA, 22 nt, Human
ccacuguauuuuggaagcagau

SEQ ID NO: 1004565 - RNA, 22 nt, Human
aagugugggaaguugcuaaaau

SEQ ID NO: 1004566 - RNA, 23 nt, Human
cagugugacgaggugaggcaggc

SEQ ID NO: 1004567 - RNA, 22 nt, Human
guaaacaucgacccaacagggg

SEQ ID NO: 1004568 - RNA, 21 nt, Human
uggccaaaaccauauuauuaa

SEQ ID NO: 1004569 - RNA, 22 nt, Human
uauucauaguaaacaaaagugg

SEQ ID NO: 1004570 - RNA, 22 nt, Human
uucacaauaggagcaugcaaau

SEQ ID NO: 1004571 - RNA, 22 nt, Human
ugaacuuagugggaauaucucu

SEQ ID NO: 1004572 - RNA, 22 nt, Human
uccaggcaaaaggaacugcuug

SEQ ID NO: 1004573 - RNA, 22 nt, Human
agcucccagaaggcccugcgcc

SEQ ID NO: 1004574 - RNA, 22 nt, Human
gaugggcguggcgcguuuggug

SEQ ID NO: 1004575 - RNA, 22 nt, Human
cuuauaaaguccaucugaacaa

SEQ ID NO: 1004576 - RNA, 22 nt, Human
gcccagccuccaagcuccaagg

SEQ ID NO: 1004577 - RNA, 22 nt, Human
uaucuguuaugggcugaauugc

SEQ ID NO: 1004578 - RNA, 22 nt, Human
cacccaggcagguggcugagaa

SEQ ID NO: 1004579 - RNA, 19 nt, Human
acauauguggauauacaug

SEQ ID NO: 1004580 - RNA, 22 nt, Human
ugaguacucggagugcuuugga

SEQ ID NO: 1004581 - RNA, 22 nt, Human
auguagaagugggcauuauaga

SEQ ID NO: 1004582 - RNA, 22 nt, Human
cagcuucuucaguccuggagcu

SEQ ID NO: 1004583 - RNA, 22 nt, Human
aaggcucuggguuucauaggug

SEQ ID NO: 1004584 - RNA, 20 nt, Human
ugcuuuaugcuauacuuugu

SEQ ID NO: 1004585 - RNA, 21 nt, Human
uuuaauuugcauguaugacgc

SEQ ID NO: 1004586 - RNA, 22 nt, Human
cccugcaguccuuucuuggcuc

SEQ ID NO: 1004587 - RNA, 22 nt, Human
aagugccaucauagcauggcug

SEQ ID NO: 1004588 - RNA, 21 nt, Human
acaggcucacgauccauuucu

SEQ ID NO: 1004589 - RNA, 17 nt, Human
uugggagagaaagguau

SEQ ID NO: 1004590 - RNA, 22 nt, Human
gaagagaaaggcaaggaguuuu

SEQ ID NO: 1004591 - RNA, 22 nt, Human
aaaacaggugucagcaaacuau

SEQ ID NO: 1004592 - RNA, 22 nt, Human
ccuggcagaauauuaaagugca

SEQ ID NO: 1004593 - RNA, 22 nt, Human
gccuggcacaggaauuaggagg

SEQ ID NO: 1004594 - RNA, 22 nt, Human
caucacagggggcuagaagucu

SEQ ID NO: 1004595 - RNA, 22 nt, Human
ugcagggacaggcucuggggau

SEQ ID NO: 1004596 - RNA, 22 nt, Human
aaauccuaagcagaggaauuua

SEQ ID NO: 1004597 - RNA, 22 nt, Human
cccugcagagccagcccugacc

SEQ ID NO: 1004598 - RNA, 22 nt, Human
augaccagccgagauaaacaga

SEQ ID NO: 1004599 - RNA, 22 nt, Human
ugcaggcuuuagccccauggcu

SEQ ID NO: 1004600 - RNA, 22 nt, Human
gcaggcucguuggaaguccccu

SEQ ID NO: 1004601 - RNA, 22 nt, Human
ugugaaauauuuauauacucaa

SEQ ID NO: 1004602 - RNA, 22 nt, Human
cugggcugcaggaguggggcaa

SEQ ID NO: 1004603 - RNA, 22 nt, Human
aaauuugauaagccauuguuac

SEQ ID NO: 1004604 - RNA, 21 nt, Human
acagugugcuucucucccucc

SEQ ID NO: 1004605 - RNA, 22 nt, Human
aaauggaucuguggaauacauu

SEQ ID NO: 1004606 - RNA, 22 nt, Human
cuccaggccauggcugcggagg

SEQ ID NO: 1004607 - RNA, 22 nt, Human
ucccacaggaaaguagacauug

SEQ ID NO: 1004608 - RNA, 22 nt, Human
agcuuuauucaugauuucaggg

SEQ ID NO: 1004609 - RNA, 22 nt, Human
cuguaugaaauugucauuuuua

SEQ ID NO: 1004610 - RNA, 22 nt, Human
agggcuccuaugccccauggac

SEQ ID NO: 1004611 - RNA, 22 nt, Human
ggcaggcucagcagccaaggag

SEQ ID NO: 1004612 - RNA, 22 nt, Human
accugcaggggugcucucuggg

SEQ ID NO: 1004613 - RNA, 22 nt, Human
cauguuaauaugcauugaguac

SEQ ID NO: 1004614 - RNA, 23 nt, Human
acagaaaguucugcuggacagag

SEQ ID NO: 1004615 - RNA, 22 nt, Human
guccuggcccaggaguacacau

SEQ ID NO: 1004616 - RNA, 22 nt, Human
uccugcagcugauaaauacagu

SEQ ID NO: 1004617 - RNA, 23 nt, Human
ucacauaauccuucauccacagg

SEQ ID NO: 1004618 - RNA, 22 nt, Human
augggcugacaagacaugcaua

SEQ ID NO: 1004619 - RNA, 22 nt, Human
guuaauuugcagcuuucgagcu

SEQ ID NO: 1004620 - RNA, 20 nt, Human
agaggcuuccuugggaggag

SEQ ID NO: 1004621 - RNA, 22 nt, Human
uccuggcagcccgcaggugcug

SEQ ID NO: 1004622 - RNA, 22 nt, Human
uuggagagcaguaaaccacacu

SEQ ID NO: 1004623 - RNA, 22 nt, Human
guacacacaaucucuggucagu

SEQ ID NO: 1004624 - RNA, 22 nt, Human
cauuuguaauacugacuugcag

SEQ ID NO: 1004625 - RNA, 22 nt, Human
cugggcuugaguuccugcucgu

SEQ ID NO: 1004626 - RNA, 22 nt, Human
ucugaacagaaaagaugcacaa

SEQ ID NO: 1004627 - RNA, 22 nt, Human
aaugaucuggcucaggauauca

SEQ ID NO: 1004628 - RNA, 22 nt, Human
acuggcaguagagggagcgcau

SEQ ID NO: 1004629 - RNA, 22 nt, Human
uuggcaggaggcuucaguuccu

SEQ ID NO: 1004630 - RNA, 22 nt, Human
gcaaaucaccaccuagcuggau

SEQ ID NO: 1004631 - RNA, 22 nt, Human
guggccagcaagugcugccucu

SEQ ID NO: 1004632 - RNA, 22 nt, Human
cuuccucuagccuaguaaugcc

SEQ ID NO: 1004633 - RNA, 22 nt, Human
uuaaagaugcagcuuuagagaa

SEQ ID NO: 1004634 - RNA, 22 nt, Human
uuggaaaguuuuuacugaagac

SEQ ID NO: 1004635 - RNA, 22 nt, Human
agcuuuaccugccuuggggcac

SEQ ID NO: 1004636 - RNA, 22 nt, Human
cauuuauucaugaucuguagcu

SEQ ID NO: 1004637 - RNA, 22 nt, Human
ugcaggcuggcagauaucucau

SEQ ID NO: 1004638 - RNA, 21 nt, Human
acacagaggcaucaucacuuu

SEQ ID NO: 1004639 - RNA, 22 nt, Human
cuggggaccgagcaagcucugg

SEQ ID NO: 1004640 - RNA, 22 nt, Human
agaauccuguuuuacuucauca

SEQ ID NO: 1004641 - RNA, 22 nt, Human
ugcuuuauaucucucuucuuag

SEQ ID NO: 1004642 - RNA, 22 nt, Human
aggacaagcuaaaggacuuccu

SEQ ID NO: 1004643 - RNA, 22 nt, Human
auuucauugaaguuaauucuuc

SEQ ID NO: 1004644 - RNA, 22 nt, Human
ucaggagcuugguagugugauu

SEQ ID NO: 1004645 - RNA, 22 nt, Human
uggggacccggacuccuggguc

SEQ ID NO: 1004646 - RNA, 21 nt, Human
cuugggcuuguagauggugga

SEQ ID NO: 1004647 - RNA, 22 nt, Human
uuaguuaguggggcugucaguc

SEQ ID NO: 1004648 - RNA, 22 nt, Human
gccuggcaggggccugggagug

SEQ ID NO: 1004649 - RNA, 22 nt, Human
gcacacagcuagauuaccauuc

SEQ ID NO: 1004650 - RNA, 22 nt, Human
cuauuaggcuuccauuucaugc

SEQ ID NO: 1004651 - RNA, 22 nt, Human
guccucugggagccuugagccu

SEQ ID NO: 1004652 - RNA, 22 nt, Human
auaugcauguacgugugcacaa

SEQ ID NO: 1004653 - RNA, 22 nt, Human
uucucuuaucuggcauuauugg

SEQ ID NO: 1004654 - RNA, 22 nt, Human
gcugggcucaccaggccacuag

SEQ ID NO: 1004655 - RNA, 22 nt, Human
uggccugccacugccacgccac

SEQ ID NO: 1004656 - RNA, 22 nt, Human
auguaugauauuuccaguauca

SEQ ID NO: 1004657 - RNA, 22 nt, Human
cucuccagaauaugccgccgug

SEQ ID NO: 1004658 - RNA, 22 nt, Human
guccucugucccuggggcacgg

SEQ ID NO: 1004659 - RNA, 22 nt, Human
uggcuaggacucauccuguuuc

SEQ ID NO: 1004660 - RNA, 22 nt, Human
auuuauuaccucggaguuucug

SEQ ID NO: 1004661 - RNA, 22 nt, Human
agggcuccuccccggccuccac

SEQ ID NO: 1004662 - RNA, 22 nt, Human
cacaauguauauguauaucaaa

SEQ ID NO: 1004663 - RNA, 22 nt, Human
uuguuucaaauauuucagaaua

SEQ ID NO: 1004664 - RNA, 23 nt, Human
cccugcagucagggugagauggu

SEQ ID NO: 1004665 - RNA, 22 nt, Human
ucccaaggugcucggcaacagg

SEQ ID NO: 1004666 - RNA, 21 nt, Human
agaauaaugguaucauuugcu

SEQ ID NO: 1004667 - RNA, 22 nt, Human
aagcuuccugaaugcucauuua

SEQ ID NO: 1004668 - RNA, 22 nt, Human
auuaaauuggacgcugggggaa

SEQ ID NO: 1004669 - RNA, 19 nt, Human
aaaguuuuauucucauuug

SEQ ID NO: 1004670 - RNA, 22 nt, Human
agcacagggacaaugccaggug

SEQ ID NO: 1004671 - RNA, 22 nt, Human
uguaaacauauguauguaugua

SEQ ID NO: 1004672 - RNA, 22 nt, Human
ugcuuuaucugugagaaccuga

SEQ ID NO: 1004673 - RNA, 22 nt, Human
ugcuucugcaggagcuccugau

SEQ ID NO: 1004674 - RNA, 22 nt, Human
uacauguuauuucacuauuggu

SEQ ID NO: 1004675 - RNA, 22 nt, Human
aacaaaagccgaaguagguguc

SEQ ID NO: 1004676 - RNA, 22 nt, Human
uuaugcaacaggugagcagaca

SEQ ID NO: 1004677 - RNA, 22 nt, Human
ugcagggaaagggcacugggcu

SEQ ID NO: 1004678 - RNA, 23 nt, Human
ccuggggagcuguauccagagug

SEQ ID NO: 1004679 - RNA, 22 nt, Human
uaauacuguauacugcaaauuu

SEQ ID NO: 1004680 - RNA, 22 nt, Human
gaggugagaagggggucagaug

SEQ ID NO: 1004681 - RNA, 22 nt, Human
cgcauacauagaaacacacaga

SEQ ID NO: 1004682 - RNA, 22 nt, Human
auaauggccgggggcugaaugc

SEQ ID NO: 1004683 - RNA, 22 nt, Human
uuucacaaucaaauggugaaau

SEQ ID NO: 1004684 - RNA, 22 nt, Human
uacaaagucagaauaacaggug

SEQ ID NO: 1004685 - RNA, 22 nt, Human
uggcagugucuuaucaggagug

SEQ ID NO: 1004686 - RNA, 22 nt, Human
aaaguuugagugauuugacaca

SEQ ID NO: 1004687 - RNA, 22 nt, Human
acuggcagagacccugauggcc

SEQ ID NO: 1004688 - RNA, 22 nt, Human
agcaggcugaugggcaugcuug

SEQ ID NO: 1004689 - RNA, 22 nt, Human
auccacagucuuagccaucaaa

SEQ ID NO: 1004690 - RNA, 22 nt, Human
uuaauuuucucaucugugaaau

SEQ ID NO: 1004691 - RNA, 22 nt, Human
cauaauaucuccgauuacuugc

SEQ ID NO: 1004692 - RNA, 22 nt, Human
uccaaguccauuaugguggucu

SEQ ID NO: 1004693 - RNA, 22 nt, Human
auucugucuuuuuaaaauaaua

SEQ ID NO: 1004694 - RNA, 22 nt, Human
uggaccugcguaggugcugggc

SEQ ID NO: 1004695 - RNA, 22 nt, Human
acagagagcugugauugaguua

SEQ ID NO: 1004696 - RNA, 22 nt, Human
aguguuugucccguuagaaaug

SEQ ID NO: 1004697 - RNA, 22 nt, Human
uguuucaggaccuaucuuuuag

SEQ ID NO: 1004698 - RNA, 21 nt, Human
acacacucugagucuucuauu

SEQ ID NO: 1004699 - RNA, 22 nt, Human
ugcuucugcuuuacuugguuca

SEQ ID NO: 1004700 - RNA, 22 nt, Human
cugagggucaacuugauuguau

SEQ ID NO: 1004701 - RNA, 22 nt, Human
cccaggcacucuuggucauuuu

SEQ ID NO: 1004702 - RNA, 22 nt, Human
gcuucuggugaggccucaggaa

SEQ ID NO: 1004703 - RNA, 23 nt, Human
agcaggcugcuucuccacagcug

SEQ ID NO: 1004704 - RNA, 22 nt, Human
ggcuuuauaggguagaggauca

SEQ ID NO: 1004705 - RNA, 22 nt, Human
guugggaaggugaacaugaugc

SEQ ID NO: 1004706 - RNA, 22 nt, Human
aauuaguaaccuaauuccaucu

SEQ ID NO: 1004707 - RNA, 20 nt, Human
uuucacaaugaacaugucuc

SEQ ID NO: 1004708 - RNA, 22 nt, Human
cagagcauaauugacaugaggu

SEQ ID NO: 1004709 - RNA, 22 nt, Human
aaagaucaaguaggcauggccu

SEQ ID NO: 1004710 - RNA, 22 nt, Human
ugcaggcuauaucuuauuugac

SEQ ID NO: 1004711 - RNA, 19 nt, Human
acauucccaucagcaaugu

SEQ ID NO: 1004712 - RNA, 22 nt, Human
agacaagaaacugggagucucu

SEQ ID NO: 1004713 - RNA, 22 nt, Human
ucagccucagguguucagauuu

SEQ ID NO: 1004714 - RNA, 23 nt, Human
acugggcugaaauuuuucauggc

SEQ ID NO: 1004715 - RNA, 22 nt, Human
guaaaauucuagcaucugaaag

SEQ ID NO: 1004716 - RNA, 21 nt, Human
aguuugaugcaauuucugaga

SEQ ID NO: 1004717 - RNA, 22 nt, Human
ggcuuuggggugugcagagaug

SEQ ID NO: 1004718 - RNA, 20 nt, Human
cagggcucugggccuggccu

SEQ ID NO: 1004719 - RNA, 22 nt, Human
ucugaaauagaagugucuuucu

SEQ ID NO: 1004720 - RNA, 22 nt, Human
uccuccuccucacagucaccug

SEQ ID NO: 1004721 - RNA, 22 nt, Human
gggaccugggccagaggacagu

SEQ ID NO: 1004722 - RNA, 22 nt, Human
gguuucaacuuuugugaggaau

SEQ ID NO: 1004723 - RNA, 22 nt, Human
ccaggcuguaagagugauguug

SEQ ID NO: 1004724 - RNA, 22 nt, Human
uuaaaacugcaaauccuacuga

SEQ ID NO: 1004725 - RNA, 17 nt, Human
ugcaggcuguuauagcc

SEQ ID NO: 1004726 - RNA, 22 nt, Human
uuucucauagucaugccucuua

SEQ ID NO: 1004727 - RNA, 19 nt, Human
acacauuugcacaauccac

SEQ ID NO: 1004728 - RNA, 17 nt, Human
uauauguaugccucucc

SEQ ID NO: 1004729 - RNA, 22 nt, Human
uuucacaucagagguagauuag

SEQ ID NO: 1004730 - RNA, 22 nt, Human
ccagcuuuuagugggcuuauua

SEQ ID NO: 1004731 - RNA, 22 nt, Human
aacaaagucguugccuagaaga

SEQ ID NO: 1004732 - RNA, 16 nt, Human
gcacacacaucaauga

SEQ ID NO: 1004733 - RNA, 22 nt, Human
ugcaggcuccacguuguugucc

SEQ ID NO: 1004734 - RNA, 19 nt, Human
cucuuaaauugucucuugc

SEQ ID NO: 1004735 - RNA, 22 nt, Human
uagcuuuaauaagcugcugaau

SEQ ID NO: 1004736 - RNA, 22 nt, Human
ccuggggagccgccugagcccc

SEQ ID NO: 1004737 - RNA, 21 nt, Human
guagggacagagaguugguga

SEQ ID NO: 1004738 - RNA, 22 nt, Human
aacacagcuaauuucugucaau

SEQ ID NO: 1004739 - RNA, 22 nt, Human
ucagcuuucucagaggccuaac

SEQ ID NO: 1004740 - RNA, 18 nt, Human
ucagagagaauaguaauu

SEQ ID NO: 1004741 - RNA, 22 nt, Human
aagcuuuaugaucucucagcua

SEQ ID NO: 1004742 - RNA, 22 nt, Human
gcuugggaagggcccuguguac

SEQ ID NO: 1004743 - RNA, 22 nt, Human
ggcucccacccauagggcgagu

SEQ ID NO: 1004744 - RNA, 22 nt, Human
gccaggcacugcucuaagcccu

SEQ ID NO: 1004745 - RNA, 22 nt, Human
aaacacauuuuaggaaaaucua

SEQ ID NO: 1004746 - RNA, 18 nt, Human
gacccagcagaugggcuu

SEQ ID NO: 1004747 - RNA, 22 nt, Human
aggccacaguacuuugcagacc

SEQ ID NO: 1004748 - RNA, 22 nt, Human
gcuggcagagacaagaagacua

SEQ ID NO: 1004749 - RNA, 22 nt, Human
auguaaacaagguuauugucca

SEQ ID NO: 1004750 - RNA, 22 nt, Human
ugaacacauaaggcuuuccugu

SEQ ID NO: 1004751 - RNA, 22 nt, Human
cauaauuugugguaguggggga

SEQ ID NO: 1004752 - RNA, 22 nt, Human
cccagccuuccacccuggacua

SEQ ID NO: 1004753 - RNA, 22 nt, Human
cuuuucaugccagcccaucaca

SEQ ID NO: 1004754 - RNA, 22 nt, Human
cuucugggugccugugaguguu

SEQ ID NO: 1004755 - RNA, 22 nt, Human
uucauaguguuuccuuccagug

SEQ ID NO: 1004756 - RNA, 22 nt, Human
guuuauuagaguuuucugucug

SEQ ID NO: 1004757 - RNA, 22 nt, Human
cccaggcagaauuaguguuuca

SEQ ID NO: 1004758 - RNA, 22 nt, Human
agucagugaaaacuagaauguu

SEQ ID NO: 1004759 - RNA, 22 nt, Human
guggccagccagggugcugaug

SEQ ID NO: 1004760 - RNA, 22 nt, Human
ugcaggcugcaccccugcccug

SEQ ID NO: 1004761 - RNA, 22 nt, Human
cccugcagagagugcuuuugug

SEQ ID NO: 1004762 - RNA, 17 nt, Human
ugcaggcuccugucccu

SEQ ID NO: 1004763 - RNA, 22 nt, Human
ggcuucugaaccaggcccugga

SEQ ID NO: 1004764 - RNA, 22 nt, Human
augggcugggaucugaguguca

SEQ ID NO: 1004765 - RNA, 22 nt, Human
ggccucucaugcccagagccaa

SEQ ID NO: 1004766 - RNA, 22 nt, Human
cacauacauacguauguauaca

SEQ ID NO: 1004767 - RNA, 22 nt, Human
gccaaaguaccuagcccucugc

SEQ ID NO: 1004768 - RNA, 22 nt, Human
acagauuuguucuuuugggcua

SEQ ID NO: 1004769 - RNA, 22 nt, Human
ccaggcuccccaggaggcccuu

SEQ ID NO: 1004770 - RNA, 21 nt, Human
ugcaggcuacuucugacucua

SEQ ID NO: 1004771 - RNA, 22 nt, Human
cuggggcuggugaggcaggcuc

SEQ ID NO: 1004772 - RNA, 22 nt, Human
uaaaucuccuguuuuucaucua

SEQ ID NO: 1004773 - RNA, 22 nt, Human
cuggggacuugcagacacaauu

SEQ ID NO: 1004774 - RNA, 22 nt, Human
accauuugacucucuaaggaua

SEQ ID NO: 1004775 - RNA, 22 nt, Human
caggcccucaggcaagggcucu

SEQ ID NO: 1004776 - RNA, 22 nt, Human
cacccagcuuuugcauccuccg

SEQ ID NO: 1004777 - RNA, 22 nt, Human
acagagagaaacaaucagcagc

SEQ ID NO: 1004778 - RNA, 22 nt, Human
uacauguauguguacgugcaug

SEQ ID NO: 1004779 - RNA, 22 nt, Human
cgugagcaaaauggacacuccc

SEQ ID NO: 1004780 - RNA, 22 nt, Human
uuauuuugguaaauguuugccu

SEQ ID NO: 1004781 - RNA, 22 nt, Human
acuucacagaaauuuuaugagg

SEQ ID NO: 1004782 - RNA, 20 nt, Human
cuaggaacuauggucuggcu

SEQ ID NO: 1004783 - RNA, 20 nt, Human
ugcagggcugccucccagcu

SEQ ID NO: 1004784 - RNA, 22 nt, Human
caugaagcccucaucagucuga

SEQ ID NO: 1004785 - RNA, 22 nt, Human
ucagcuuuuuacaugugaaaua

SEQ ID NO: 1004786 - RNA, 22 nt, Human
uuguaugaggauagcaagaagc

SEQ ID NO: 1004787 - RNA, 22 nt, Human
guggcaggggcgggcuguuccg

SEQ ID NO: 1004788 - RNA, 22 nt, Human
ccagagagaaauggauuugagu

SEQ ID NO: 1004789 - RNA, 22 nt, Human
cauacuuuugcccugacauucu

SEQ ID NO: 1004790 - RNA, 22 nt, Human
ugggcugcuucuauuggugguc

SEQ ID NO: 1004791 - RNA, 22 nt, Human
gcagccuccgcacugcgagucc

SEQ ID NO: 1004792 - RNA, 22 nt, Human
cagaggcucagauggcccuggc

SEQ ID NO: 1004793 - RNA, 22 nt, Human
cagcuuguuaccgagggagggu

SEQ ID NO: 1004794 - RNA, 22 nt, Human
ucugggcuuggauuggcucugc

SEQ ID NO: 1004795 - RNA, 22 nt, Human
aguuauuucaguaacauaauag

SEQ ID NO: 1004796 - RNA, 22 nt, Human
uuuugcuuuuguaacacagugu

SEQ ID NO: 1004797 - RNA, 22 nt, Human
uccugcaggccagaggggugag

SEQ ID NO: 1004798 - RNA, 22 nt, Human
uugcagcuucuaccacuguuuc

SEQ ID NO: 1004799 - RNA, 21 nt, Human
agcaggcuuuggaguggggcu

SEQ ID NO: 1004800 - RNA, 22 nt, Human
auuauuagugauguuguuacug

SEQ ID NO: 1004801 - RNA, 22 nt, Human
uuacaauaccacaucaccucau

SEQ ID NO: 1004802 - RNA, 22 nt, Human
cauccagggcagccauggccug

SEQ ID NO: 1004803 - RNA, 22 nt, Human
cauccaggcaccacaaccagcu

SEQ ID NO: 1004804 - RNA, 22 nt, Human
uuccuggcauagagagggcaca

SEQ ID NO: 1004805 - RNA, 22 nt, Human
cugagggagcugcuggccuugg

SEQ ID NO: 1004806 - RNA, 22 nt, Human
cuuucuuauaccugucagggcc

SEQ ID NO: 1004807 - RNA, 22 nt, Human
gcuggcagguccaagauagagc

SEQ ID NO: 1004808 - RNA, 22 nt, Human
ugcuucuguuuguuucugucau

SEQ ID NO: 1004809 - RNA, 22 nt, Human
augugaaacugaagcauccaua

SEQ ID NO: 1004810 - RNA, 22 nt, Human
gcuggcaggauaacuucuaagc

SEQ ID NO: 1004811 - RNA, 22 nt, Human
uggcagggccuaccccaauauc

SEQ ID NO: 1004812 - RNA, 22 nt, Human
ucuggcagcucuccucggcgga

SEQ ID NO: 1004813 - RNA, 22 nt, Human
gcagcuuucuugcccuaaucuu

SEQ ID NO: 1004814 - RNA, 22 nt, Human
aaugauuuggcaaaggaaucca

SEQ ID NO: 1004815 - RNA, 22 nt, Human
gguaugaaaugauuccauguua

SEQ ID NO: 1004816 - RNA, 22 nt, Human
uuuuccuuucaucaggacaaag

SEQ ID NO: 1004817 - RNA, 22 nt, Human
uucacauugugcagauuauggu

SEQ ID NO: 1004818 - RNA, 22 nt, Human
agguauaagucucauuucuguu

SEQ ID NO: 1004819 - RNA, 20 nt, Human
aaaagagugcuucaacugcu

SEQ ID NO: 1004820 - RNA, 22 nt, Human
aguaaaauuucugcugaggaga

SEQ ID NO: 1004821 - RNA, 23 nt, Human
gccaggcacaugguggacacgca

SEQ ID NO: 1004822 - RNA, 22 nt, Human
uuccuggcucacagcagugggg

SEQ ID NO: 1004823 - RNA, 22 nt, Human
cuuuucacaggaggauaagccc

SEQ ID NO: 1004824 - RNA, 22 nt, Human
ucuucuuaugugccauuaucuc

SEQ ID NO: 1004825 - RNA, 20 nt, Human
aguuuauuccaggagaacug

SEQ ID NO: 1004826 - RNA, 22 nt, Human
uaagaacaguagaacaguaggu

SEQ ID NO: 1004827 - RNA, 22 nt, Human
cucuccagccuuuagcccacgc

SEQ ID NO: 1004828 - RNA, 22 nt, Human
gacugccucaguuucccugcag

SEQ ID NO: 1004829 - RNA, 22 nt, Human
cccagccugugacagccguccu

SEQ ID NO: 1004830 - RNA, 22 nt, Human
auagauauuugaguuguuucca

SEQ ID NO: 1004831 - RNA, 22 nt, Human
aggcaggggagcuggaagggua

SEQ ID NO: 1004832 - RNA, 22 nt, Human
ucaggcucucagaccaacagca

SEQ ID NO: 1004833 - RNA, 22 nt, Human
uuugacaaaggaaaaaugcaca

SEQ ID NO: 1004834 - RNA, 22 nt, Human
auuuucaucauggguuuaacau

SEQ ID NO: 1004835 - RNA, 22 nt, Human
acaaguaccaaaugcucaagua

SEQ ID NO: 1004836 - RNA, 22 nt, Human
gcccagcuggcuuccagcacau

SEQ ID NO: 1004837 - RNA, 22 nt, Human
aagauauagauaaaacuaugca

SEQ ID NO: 1004838 - RNA, 22 nt, Human
aauuugcaugaugagaacaaua

SEQ ID NO: 1004839 - RNA, 22 nt, Human
ucccuccccacuucugagcuuu

SEQ ID NO: 1004840 - RNA, 22 nt, Human
ccuucuucuguguggcccaaga

SEQ ID NO: 1004841 - RNA, 22 nt, Human
aagcuuuaaggaauuuuaugga

SEQ ID NO: 1004842 - RNA, 22 nt, Human
uggcacagggcuuggucgcuca

SEQ ID NO: 1004843 - RNA, 22 nt, Human
uccugcagagccgcccucaggu

SEQ ID NO: 1004844 - RNA, 22 nt, Human
ucuggggauggucuacuuucug

SEQ ID NO: 1004845 - RNA, 22 nt, Human
ggcuuugguagacacagauuga

SEQ ID NO: 1004846 - RNA, 22 nt, Human
uucccacagagauuacauugaa

SEQ ID NO: 1004847 - RNA, 22 nt, Human
cagucccaugagcccagaacau

SEQ ID NO: 1004848 - RNA, 22 nt, Human
cucuugcagauaccuugaagga

SEQ ID NO: 1004849 - RNA, 22 nt, Human
uuucacacugcagcaucagaga

SEQ ID NO: 1004850 - RNA, 22 nt, Human
agagggcuuugauucucaguuc

SEQ ID NO: 1004851 - RNA, 22 nt, Human
aaauaguuagcccugcauauau

SEQ ID NO: 1004852 - RNA, 23 nt, Human
auggaagucacuguuuucuuguc

SEQ ID NO: 1004853 - RNA, 22 nt, Human
ucauaaaucauacuccauuugc

SEQ ID NO: 1004854 - RNA, 22 nt, Human
gcaguguuaggaauaaaaauga

SEQ ID NO: 1004855 - RNA, 22 nt, Human
auauaauuguucugaaguguuu

SEQ ID NO: 1004856 - RNA, 22 nt, Human
agcagguguauauaaggcugag

SEQ ID NO: 1004857 - RNA, 22 nt, Human
aagaauacguaucaacaauggu

SEQ ID NO: 1004858 - RNA, 22 nt, Human
cagccucuugcacuuugaaggc

SEQ ID NO: 1004859 - RNA, 22 nt, Human
aauguaugggugagaaaguuga

SEQ ID NO: 1004860 - RNA, 21 nt, Human
aggucccagguuugggcagca

SEQ ID NO: 1004861 - RNA, 22 nt, Human
auggccugaugcaccuguccca

SEQ ID NO: 1004862 - RNA, 22 nt, Human
uccaagcuugcuuuagccacag

SEQ ID NO: 1004863 - RNA, 22 nt, Human
ugcuucugcaacuugaauguac

SEQ ID NO: 1004864 - RNA, 20 nt, Human
ucagagagagggugccacuu

SEQ ID NO: 1004865 - RNA, 22 nt, Human
ccagagagucgaugggggacac

SEQ ID NO: 1004866 - RNA, 20 nt, Human
guguuucaugugauacaaug

SEQ ID NO: 1004867 - RNA, 22 nt, Human
gggaccugccauugcucacagg

SEQ ID NO: 1004868 - RNA, 22 nt, Human
aaguuucaugauguaauuauug

SEQ ID NO: 1004869 - RNA, 22 nt, Human
aucuccagauugugaucaucag

SEQ ID NO: 1004870 - RNA, 22 nt, Human
cagcuuuccagagaccugcccc

SEQ ID NO: 1004871 - RNA, 22 nt, Human
cccaggcagugcugaucccuca

SEQ ID NO: 1004872 - RNA, 22 nt, Human
agacacagucugucuggaggag

SEQ ID NO: 1004873 - RNA, 22 nt, Human
aaguuuaacuugaauucuuucu

SEQ ID NO: 1004874 - RNA, 23 nt, Human
cuuucauugugguuucacagagc

SEQ ID NO: 1004875 - RNA, 22 nt, Human
ucuggcagcaagauaacaaugg

SEQ ID NO: 1004876 - RNA, 22 nt, Human
aggcuuuaaguggccuacagcu

SEQ ID NO: 1004877 - RNA, 22 nt, Human
cucuuaaauaacaucauugcuu

SEQ ID NO: 1004878 - RNA, 22 nt, Human
gcuggcaguuuccucaccgagg

SEQ ID NO: 1004879 - RNA, 22 nt, Human
cuguaugaacccauauacuuau

SEQ ID NO: 1004880 - RNA, 23 nt, Human
uggccaggguacuacacccaccc

SEQ ID NO: 1004881 - RNA, 22 nt, Human
cagucucuuuauccaccaagcc

SEQ ID NO: 1004882 - RNA, 22 nt, Human
ggcaggcuugauauggggggac

SEQ ID NO: 1004883 - RNA, 22 nt, Human
guccucugagggggcugcacgc

SEQ ID NO: 1004884 - RNA, 22 nt, Human
aucacagagauugcuuuuaaaa

SEQ ID NO: 1004885 - RNA, 20 nt, Human
cccagccccuaccuguugcc

SEQ ID NO: 1004886 - RNA, 22 nt, Human
ggcaggcuccagagcccucucc

SEQ ID NO: 1004887 - RNA, 22 nt, Human
ucaauaaaauuguuuuccuauc

SEQ ID NO: 1004888 - RNA, 22 nt, Human
gcuaggaguggugggucaagga

SEQ ID NO: 1004889 - RNA, 23 nt, Human
uugugggcagauuccauggggag

SEQ ID NO: 1004890 - RNA, 22 nt, Human
uguauaaacuuaagcaggaacc

SEQ ID NO: 1004891 - RNA, 22 nt, Human
cucugggcacuguauggguucu

SEQ ID NO: 1004892 - RNA, 22 nt, Human
acuaaagaagccaaaguuuucu

SEQ ID NO: 1004893 - RNA, 22 nt, Human
uuuauacuccacucugcaagcg

SEQ ID NO: 1004894 - RNA, 22 nt, Human
aggaccuguagggccugcaucc

SEQ ID NO: 1004895 - RNA, 20 nt, Human
uucuuaaagaccucacuuug

SEQ ID NO: 1004896 - RNA, 22 nt, Human
acacauacauggggaagaugag

SEQ ID NO: 1004897 - RNA, 22 nt, Human
ccugggcuuccacgagcagagg

SEQ ID NO: 1004898 - RNA, 22 nt, Human
accagugggaaguggaaaauga

SEQ ID NO: 1004899 - RNA, 22 nt, Human
aaugaaugaaccacauauaaca

SEQ ID NO: 1004900 - RNA, 19 nt, Human
ucuggcagguaauuaggga

SEQ ID NO: 1004901 - RNA, 22 nt, Human
auguuucagauacagaucaaau

SEQ ID NO: 1004902 - RNA, 22 nt, Human
augacugcucugggcucccaug

SEQ ID NO: 1004903 - RNA, 22 nt, Human
ugcuauaaguagacauucaaca

SEQ ID NO: 1004904 - RNA, 22 nt, Human
ugaccugcagucaagaggggaa

SEQ ID NO: 1004905 - RNA, 19 nt, Human
acuggcaguuucugcaugg

SEQ ID NO: 1004906 - RNA, 22 nt, Human
aaaaugacauuccagugauauu

SEQ ID NO: 1004907 - RNA, 22 nt, Human
gcauuauuaauagcugcaugag

SEQ ID NO: 1004908 - RNA, 18 nt, Human
ugagaggcuauuuuuugc

SEQ ID NO: 1004909 - RNA, 22 nt, Human
ccuggggagaagagcuuccccc

SEQ ID NO: 1004910 - RNA, 22 nt, Human
ccagcuuuccaggguugacugg

SEQ ID NO: 1004911 - RNA, 22 nt, Human
aggaggcugaacuagggucugg

SEQ ID NO: 1004912 - RNA, 22 nt, Human
ccuggggaccugccucagcccu

SEQ ID NO: 1004913 - RNA, 22 nt, Human
guuucuuagguaaauucuuuga

SEQ ID NO: 1004914 - RNA, 22 nt, Human
aaguaugaaucaaagacuaucu

SEQ ID NO: 1004915 - RNA, 22 nt, Human
aguccaguguguucuggcagca

SEQ ID NO: 1004916 - RNA, 22 nt, Human
cugcagggaugugaggcccguu

SEQ ID NO: 1004917 - RNA, 22 nt, Human
gacacagacaguuagagguaau

SEQ ID NO: 1004918 - RNA, 22 nt, Human
ugggaccugcccuggccccauc

SEQ ID NO: 1004919 - RNA, 22 nt, Human
ccagauagaaaagaaggcagga

SEQ ID NO: 1004920 - RNA, 22 nt, Human
aguccagugucaaggugccauu

SEQ ID NO: 1004921 - RNA, 22 nt, Human
ggccucagaccggagcuggcca

SEQ ID NO: 1004922 - RNA, 22 nt, Human
uuccaagugucagaucagauuu

SEQ ID NO: 1004923 - RNA, 22 nt, Human
aauguauggauucaugucugug

SEQ ID NO: 1004924 - RNA, 22 nt, Human
agagggcugccucagucagcua

SEQ ID NO: 1004925 - RNA, 22 nt, Human
ucaggcucccugcugggcucug

SEQ ID NO: 1004926 - RNA, 22 nt, Human
auuuguuccacacauauuuacu

SEQ ID NO: 1004927 - RNA, 20 nt, Human
ggcugcaggacucauuggcu

SEQ ID NO: 1004928 - RNA, 22 nt, Human
uuucauugucuacauaugacau

SEQ ID NO: 1004929 - RNA, 22 nt, Human
uuguaauuugcaaauguauugu

SEQ ID NO: 1004930 - RNA, 22 nt, Human
uuuauucugugcuacaugaaga

SEQ ID NO: 1004931 - RNA, 22 nt, Human
cugcagccacgagucacagccc

SEQ ID NO: 1004932 - RNA, 22 nt, Human
aguccagucucacucuuggcag

SEQ ID NO: 1004933 - RNA, 22 nt, Human
uguagaaacuacacaugcaaca

SEQ ID NO: 1004934 - RNA, 22 nt, Human
uacaaaaggaagagggaucuua

SEQ ID NO: 1004935 - RNA, 22 nt, Human
ugguauaaaacuuuuuauugaa

SEQ ID NO: 1004936 - RNA, 22 nt, Human
cagcccagccuugucucuuuau

SEQ ID NO: 1004937 - RNA, 22 nt, Human
uuaucauugucgcagucuaauu

SEQ ID NO: 1004938 - RNA, 22 nt, Human
aaucaagaaaaugaggauucuu

SEQ ID NO: 1004939 - RNA, 22 nt, Human
ucaguuaacaacuauuuauuga

SEQ ID NO: 1004940 - RNA, 22 nt, Human
cagaaagaccugggcucaagag

SEQ ID NO: 1004941 - RNA, 22 nt, Human
guauuaggaaauaugaagaaag

SEQ ID NO: 1004942 - RNA, 22 nt, Human
gcaggugaugugaugugagcau

SEQ ID NO: 1004943 - RNA, 22 nt, Human
ugagcaucuuuuuacagguuua

SEQ ID NO: 1004944 - RNA, 22 nt, Human
uccaggcauaaugcccaguggu

SEQ ID NO: 1004945 - RNA, 22 nt, Human
ccaggcaggcuagaauguaaau

SEQ ID NO: 1004946 - RNA, 22 nt, Human
ccaggccucccuuuuccagcca

SEQ ID NO: 1004947 - RNA, 22 nt, Human
aauacugccugugagguaacuc

SEQ ID NO: 1004948 - RNA, 22 nt, Human
cuauuagguaugcagccuauuu

SEQ ID NO: 1004949 - RNA, 22 nt, Human
ugugaaaagcaggcuacuuucu

SEQ ID NO: 1004950 - RNA, 22 nt, Human
augggcugaggugggauagaag

SEQ ID NO: 1004951 - RNA, 22 nt, Human
ucugucaaaaguuuucaauaaa

SEQ ID NO: 1004952 - RNA, 22 nt, Human
acaggcagagaacucagccaga

SEQ ID NO: 1004953 - RNA, 20 nt, Human
uagggcucauuaugaucucc

SEQ ID NO: 1004954 - RNA, 20 nt, Human
aagagucuuuacugagcuaa

SEQ ID NO: 1004955 - RNA, 22 nt, Human
gccaggcauuauuccgaucccu

SEQ ID NO: 1004956 - RNA, 22 nt, Human
agcaggcuaaucuugcugaaca

SEQ ID NO: 1004957 - RNA, 20 nt, Human
ucccaggcugggcuccagcu

SEQ ID NO: 1004958 - RNA, 22 nt, Human
uuucaaacuuuacucuugaauc

SEQ ID NO: 1004959 - RNA, 22 nt, Human
ugucaagucucugaaugaaaug

SEQ ID NO: 1004960 - RNA, 22 nt, Human
aaauaguuguuuggaucaauaa

SEQ ID NO: 1004961 - RNA, 19 nt, Human
ccacacagugugcaauuua

SEQ ID NO: 1004962 - RNA, 22 nt, Human
caauaguucgguccugaaggcc

SEQ ID NO: 1004963 - RNA, 22 nt, Human
uuuauuagauuaucaaagaggu

SEQ ID NO: 1004964 - RNA, 22 nt, Human
cccugccuugggguccacaccg

SEQ ID NO: 1004965 - RNA, 22 nt, Human
ucaggcccuucucccaggacuc

SEQ ID NO: 1004966 - RNA, 22 nt, Human
aggagcugcagauucugccuug

SEQ ID NO: 1004967 - RNA, 22 nt, Human
gggcugacucaaccuugcaaag

SEQ ID NO: 1004968 - RNA, 23 nt, Human
ugaaauauucuuuugcaugagcu

SEQ ID NO: 1004969 - RNA, 22 nt, Human
ugcuuuauucgacaucugguag

SEQ ID NO: 1004970 - RNA, 22 nt, Human
cugccugcugcccuccagagcc

SEQ ID NO: 1004971 - RNA, 22 nt, Human
ugaacacugccauauuuaagaa

SEQ ID NO: 1004972 - RNA, 22 nt, Human
aauauuucuguagcuauguucu

SEQ ID NO: 1004973 - RNA, 22 nt, Human
aggguagggcccggagacagac

SEQ ID NO: 1004974 - RNA, 22 nt, Human
aauaacuuuuaaaagacccugg

SEQ ID NO: 1004975 - RNA, 22 nt, Human
cagggcucaucugugugaccag

SEQ ID NO: 1004976 - RNA, 21 nt, Human
cuguccaguaauuccuggcac

SEQ ID NO: 1004977 - RNA, 22 nt, Human
agauacaaaagauaagauuuag

SEQ ID NO: 1004978 - RNA, 22 nt, Human
ccucucagcgauuccucuugga

SEQ ID NO: 1004979 - RNA, 18 nt, Human
agcagguggcgucugcag

SEQ ID NO: 1004980 - RNA, 22 nt, Human
gcaguccaaaguggcucucacc

SEQ ID NO: 1004981 - RNA, 22 nt, Human
agagggaucacccuguuucugg

SEQ ID NO: 1004982 - RNA, 22 nt, Human
uagcuuuacaaagugcugcacc

SEQ ID NO: 1004983 - RNA, 22 nt, Human
agccagggucucucgcucuguu

SEQ ID NO: 1004984 - RNA, 22 nt, Human
cugccugccacguucagcugua

SEQ ID NO: 1004985 - RNA, 22 nt, Human
ccugggcugaagucaagugugg

SEQ ID NO: 1004986 - RNA, 22 nt, Human
ugguccugccccgugcacagag

SEQ ID NO: 1004987 - RNA, 22 nt, Human
cuggggacgucgggcaguguuc

SEQ ID NO: 1004988 - RNA, 22 nt, Human
ugcuucuguuacauaccagaac

SEQ ID NO: 1004989 - RNA, 22 nt, Human
ccagcccugccagagagagcug

SEQ ID NO: 1004990 - RNA, 22 nt, Human
gggaccuggacaugugugugcu

SEQ ID NO: 1004991 - RNA, 22 nt, Human
uucacaauggcaaaccauuaaa

SEQ ID NO: 1004992 - RNA, 22 nt, Human
ucacauuuucuacuacuguacg

SEQ ID NO: 1004993 - RNA, 22 nt, Human
guuacucuuccccggggucugg

SEQ ID NO: 1004994 - RNA, 22 nt, Human
ccuaggaacccccaggcuucug

SEQ ID NO: 1004995 - RNA, 22 nt, Human
uuguaaauaguaguaagaugcc

SEQ ID NO: 1004996 - RNA, 22 nt, Human
agauuugcggcuuuacuuugca

SEQ ID NO: 1004997 - RNA, 22 nt, Human
agcaggcuacuccuguguucgu

SEQ ID NO: 1004998 - RNA, 22 nt, Human
uacacagauaugugaucaauca

SEQ ID NO: 1004999 - RNA, 22 nt, Human
uggccaggcuggucuggaacgc

SEQ ID NO: 1005000 - RNA, 22 nt, Human
uggcagagagagugcagucgac

SEQ ID NO: 1005001 - RNA, 22 nt, Human
ugucaaagccugaaucacauag

SEQ ID NO: 1005002 - RNA, 22 nt, Human
accaagcuagaacauuacaggc

SEQ ID NO: 1005003 - RNA, 22 nt, Human
caauuucuggaacuaauucuga

SEQ ID NO: 1005004 - RNA, 22 nt, Human
guauuaggagguggagccuuug

SEQ ID NO: 1005005 - RNA, 22 nt, Human
ccuggcagucaggggaguccuu

SEQ ID NO: 1005006 - RNA, 22 nt, Human
uuucaaaugcaugucuuuccuc

SEQ ID NO: 1005007 - RNA, 22 nt, Human
gcacccagaggucagcagugcu

SEQ ID NO: 1005008 - RNA, 22 nt, Human
aucagagaaguuucacuggcau

SEQ ID NO: 1005009 - RNA, 22 nt, Human
uaccugcaaaguuccuuuugcc

SEQ ID NO: 1005010 - RNA, 22 nt, Human
ugcuucugaaguggaugggugc

SEQ ID NO: 1005011 - RNA, 22 nt, Human
cuuugaaaggaagccacacagc

SEQ ID NO: 1005012 - RNA, 22 nt, Human
aacaugauuuaguauaaugcag

SEQ ID NO: 1005013 - RNA, 22 nt, Human
uauggaaagcucuuuuugauug

SEQ ID NO: 1005014 - RNA, 22 nt, Human
gcuuucuugguucugcaggggc

SEQ ID NO: 1005015 - RNA, 22 nt, Human
gcuucugguagaauucaauaga

SEQ ID NO: 1005016 - RNA, 22 nt, Human
cagcauuuaaugcagugcuucc

SEQ ID NO: 1005017 - RNA, 22 nt, Human
uuauuucauguaaaauuuaugu

SEQ ID NO: 1005018 - RNA, 22 nt, Human
gccuggcaauggccucaggaag

SEQ ID NO: 1005019 - RNA, 22 nt, Human
auuucauagauuguaaaucccu

SEQ ID NO: 1005020 - RNA, 22 nt, Human
ucagagagguuaaauaucuugu

SEQ ID NO: 1005021 - RNA, 22 nt, Human
uccuggcacuuugggggcucgc

SEQ ID NO: 1005022 - RNA, 22 nt, Human
acaguaaaaagccuuagaauuu

SEQ ID NO: 1005023 - RNA, 22 nt, Human
ggcccaaacggguccagugaaa

SEQ ID NO: 1005024 - RNA, 22 nt, Human
aaauauagcaauuaugccuacu

SEQ ID NO: 1005025 - RNA, 22 nt, Human
guccucugacucagccuuggga

SEQ ID NO: 1005026 - RNA, 22 nt, Human
uuuaaauuauaguuaaugucug

SEQ ID NO: 1005027 - RNA, 22 nt, Human
gggaccuggucuagcacugagc

SEQ ID NO: 1005028 - RNA, 22 nt, Human
agcuagaauauugaucugaaau

SEQ ID NO: 1005029 - RNA, 22 nt, Human
aauguaugugcaucauuuacau

SEQ ID NO: 1005030 - RNA, 22 nt, Human
uggacuggaaugcugauccucu

SEQ ID NO: 1005031 - RNA, 22 nt, Human
ccaggccuggccaggggaugcc

SEQ ID NO: 1005032 - RNA, 22 nt, Human
uagucaaaccucagaauacccc

SEQ ID NO: 1005033 - RNA, 22 nt, Human
caggcuggagugcaauggcaca

SEQ ID NO: 1005034 - RNA, 22 nt, Human
caggcugccgugaagcaggccu

SEQ ID NO: 1005035 - RNA, 22 nt, Human
agccagaguugaaugugagucu

SEQ ID NO: 1005036 - RNA, 22 nt, Human
cuaucauuuuacaugguuggug

SEQ ID NO: 1005037 - RNA, 22 nt, Human
guuuucaugucuauugggcaua

SEQ ID NO: 1005038 - RNA, 22 nt, Human
cagcccaggucucucuuccagu

SEQ ID NO: 1005039 - RNA, 22 nt, Human
ucaggcucaggaauguguuuau

SEQ ID NO: 1005040 - RNA, 22 nt, Human
aggacagugguguucuggagug

SEQ ID NO: 1005041 - RNA, 22 nt, Human
cccugcaggcucagacuggagu

SEQ ID NO: 1005042 - RNA, 22 nt, Human
agacaucagcuugugugcaggg

SEQ ID NO: 1005043 - RNA, 22 nt, Human
aagcacauuguacauuugugcu

SEQ ID NO: 1005044 - RNA, 22 nt, Human
uguuugaauuuugcuaacgugu

SEQ ID NO: 1005045 - RNA, 22 nt, Human
auuuauuaugggauuuggcaca

SEQ ID NO: 1005046 - RNA, 22 nt, Human
ucugucaauauaugugcugcag

SEQ ID NO: 1005047 - RNA, 22 nt, Human
cccagcccccgagugucuggaa

SEQ ID NO: 1005048 - RNA, 22 nt, Human
uuugucauaucacacaauuuug

SEQ ID NO: 1005049 - RNA, 22 nt, Human
aucugcuuccugggcuccauga

SEQ ID NO: 1005050 - RNA, 19 nt, Human
cuccaaguuaagagggagg

SEQ ID NO: 1005051 - RNA, 17 nt, Human
cagcuuuaugcuacugu

SEQ ID NO: 1005052 - RNA, 22 nt, Human
cuccaaguauguuaaaaucuaa

SEQ ID NO: 1005053 - RNA, 22 nt, Human
cccacacacuggcugcugccaa

SEQ ID NO: 1005054 - RNA, 22 nt, Human
uccauucuaugcuuacauuuau

SEQ ID NO: 1005055 - RNA, 22 nt, Human
aaacacagauuucuuuguccca

SEQ ID NO: 1005056 - RNA, 22 nt, Human
cccagcuugcaaauggguugcu

SEQ ID NO: 1005057 - RNA, 22 nt, Human
ggccucagaaauagaguaaaau

SEQ ID NO: 1005058 - RNA, 22 nt, Human
uagcuuuaagacauggugaaug

SEQ ID NO: 1005059 - RNA, 22 nt, Human
uugcagcugcaguaaauguuca

SEQ ID NO: 1005060 - RNA, 22 nt, Human
uuuccacaauguuuuugcagga

SEQ ID NO: 1005061 - RNA, 20 nt, Human
acccagcucugugcccuggg

SEQ ID NO: 1005062 - RNA, 22 nt, Human
acccacacaucucuaauucagu

SEQ ID NO: 1005063 - RNA, 22 nt, Human
uaacacaugaaagcaccuucuu

SEQ ID NO: 1005064 - RNA, 22 nt, Human
ucuuuauugcuacugguuuguc

SEQ ID NO: 1005065 - RNA, 22 nt, Human
ggggaccuuuccauuucugaga

SEQ ID NO: 1005066 - RNA, 22 nt, Human
cagggcuagugacaccccaguc

SEQ ID NO: 1005067 - RNA, 22 nt, Human
uccugcaggcuugaguccucag

SEQ ID NO: 1005068 - RNA, 22 nt, Human
agcaggcugagcacccaggggg

SEQ ID NO: 1005069 - RNA, 22 nt, Human
ccagcccugaacccugcugcau

SEQ ID NO: 1005070 - RNA, 22 nt, Human
guuauuaguaagacucgcacau

SEQ ID NO: 1005071 - RNA, 22 nt, Human
cccucucucaggcugacagccu

SEQ ID NO: 1005072 - RNA, 22 nt, Human
ugcagggagcucuggggugcag

SEQ ID NO: 1005073 - RNA, 22 nt, Human
ucccaccccggucaagggcuga

SEQ ID NO: 1005074 - RNA, 22 nt, Human
agucuacaaagaaaaguuauug

SEQ ID NO: 1005075 - RNA, 22 nt, Human
uuguaugaauguauccuaauuu

SEQ ID NO: 1005076 - RNA, 22 nt, Human
gagggcucuacucaccacccug

SEQ ID NO: 1005077 - RNA, 22 nt, Human
cuucugggccauggccuuccuc

SEQ ID NO: 1005078 - RNA, 22 nt, Human
gugggagaaauuagcucuaguu

SEQ ID NO: 1005079 - RNA, 22 nt, Human
aagucguggcaggcuugcacga

SEQ ID NO: 1005080 - RNA, 18 nt, Human
ucauuuguuuugcaugaa

SEQ ID NO: 1005081 - RNA, 22 nt, Human
ucaggcccagagucacggaucc

SEQ ID NO: 1005082 - RNA, 20 nt, Human
gcugggcuaccacuggcccu

SEQ ID NO: 1005083 - RNA, 22 nt, Human
cacagagacagaagcacuuaug

SEQ ID NO: 1005084 - RNA, 22 nt, Human
ucuuugaaaagggagauagaaa

SEQ ID NO: 1005085 - RNA, 21 nt, Human
aggcucucauccagggaccca

SEQ ID NO: 1005086 - RNA, 22 nt, Human
uccaggcauguugggaagauga

SEQ ID NO: 1005087 - RNA, 22 nt, Human
caggcuccuucccagggauggu

SEQ ID NO: 1005088 - RNA, 22 nt, Human
uccugccuguuuaccuguacuu

SEQ ID NO: 1005089 - RNA, 22 nt, Human
gaggguggggaauagacugcua

SEQ ID NO: 1005090 - RNA, 22 nt, Human
uuucacauuuguuuuaagaagu

SEQ ID NO: 1005091 - RNA, 17 nt, Human
cucugggcagccugggg

SEQ ID NO: 1005092 - RNA, 22 nt, Human
agcccggcuuccccgguugcua

SEQ ID NO: 1005093 - RNA, 22 nt, Human
cuucugggcagaaguuuugaga

SEQ ID NO: 1005094 - RNA, 22 nt, Human
ucuggcaguuugagaaaggcua

SEQ ID NO: 1005095 - RNA, 21 nt, Human
uucucuccauaugcccagccc

SEQ ID NO: 1005096 - RNA, 22 nt, Human
ugcuuuauucccuucugaugug

SEQ ID NO: 1005097 - RNA, 22 nt, Human
ggcacagggggcugaggacuag

SEQ ID NO: 1005098 - RNA, 22 nt, Human
ugaaacaaugugaaguugcuga

SEQ ID NO: 1005099 - RNA, 22 nt, Human
aagggacccuggaucaaaugga

SEQ ID NO: 1005100 - RNA, 22 nt, Human
gaaaacacuuugaucugaaagu

SEQ ID NO: 1005101 - RNA, 22 nt, Human
uguaugaaaaggaauagauuga

SEQ ID NO: 1005102 - RNA, 22 nt, Human
auauuaggaguuaaauguauua

SEQ ID NO: 1005103 - RNA, 22 nt, Human
guguaugaacgaaagaauggau

SEQ ID NO: 1005104 - RNA, 23 nt, Human
cgcccagccucagugaccugggc

SEQ ID NO: 1005105 - RNA, 22 nt, Human
gccuggcacucaaucaucugcu

SEQ ID NO: 1005106 - RNA, 22 nt, Human
uguccaggucagcagcagggac

SEQ ID NO: 1005107 - RNA, 22 nt, Human
gcccacacaccagcucaggagg

SEQ ID NO: 1005108 - RNA, 22 nt, Human
ggggaccuaggcucugucucuu

SEQ ID NO: 1005109 - RNA, 22 nt, Human
guagggacaauauguuauuaga

SEQ ID NO: 1005110 - RNA, 18 nt, Human
gcuuuauuucuuggggaa

SEQ ID NO: 1005111 - RNA, 22 nt, Human
gggcucucaaggcagggcccca

SEQ ID NO: 1005112 - RNA, 22 nt, Human
ggggaccuucccagagcaguug

SEQ ID NO: 1005113 - RNA, 22 nt, Human
gcuggcagagagcuggugagga

SEQ ID NO: 1005114 - RNA, 22 nt, Human
uucauugcaguucuucagguua

SEQ ID NO: 1005115 - RNA, 22 nt, Human
cacauugcagcuucuuuuggcu

SEQ ID NO: 1005116 - RNA, 22 nt, Human
cuucacauguuggaguccuuug

SEQ ID NO: 1005117 - RNA, 22 nt, Human
guacacacuauguauuguacac

SEQ ID NO: 1005118 - RNA, 22 nt, Human
ggcaggcucuuggccuuaugag

SEQ ID NO: 1005119 - RNA, 22 nt, Human
cuuucacacacauacauuugga

SEQ ID NO: 1005120 - RNA, 22 nt, Human
ucagggacgugagcucagaguc

SEQ ID NO: 1005121 - RNA, 22 nt, Human
aaugaagcaguuuucaucaagu

SEQ ID NO: 1005122 - RNA, 22 nt, Human
aucuguuccccuaugcucucua

SEQ ID NO: 1005123 - RNA, 22 nt, Human
ugcaggcuauccuuugcugcaa

SEQ ID NO: 1005124 - RNA, 22 nt, Human
guccacagagggcugggcaggc

SEQ ID NO: 1005125 - RNA, 22 nt, Human
ucucuuaaaagauuuuaaugac

SEQ ID NO: 1005126 - RNA, 22 nt, Human
agaaaauuagauuuuacugugu

SEQ ID NO: 1005127 - RNA, 22 nt, Human
uccaggcuugagaccaggcucu

SEQ ID NO: 1005128 - RNA, 22 nt, Human
ucuggcaguugccgcuucaguc

SEQ ID NO: 1005129 - RNA, 22 nt, Human
uccaggaggccucauuuccugu

SEQ ID NO: 1005130 - RNA, 22 nt, Human
ugagagcacacagaaauauuuu

SEQ ID NO: 1005131 - RNA, 22 nt, Human
uguaaaaccaaaucaaucuagu

SEQ ID NO: 1005132 - RNA, 22 nt, Human
guuucgucaggcuuauucuauc

SEQ ID NO: 1005133 - RNA, 22 nt, Human
ccaggcucagggcagacuuuca

SEQ ID NO: 1005134 - RNA, 22 nt, Human
ggcaggcuggcuuuguuccagg

SEQ ID NO: 1005135 - RNA, 22 nt, Human
auuaaauuggaucugcauaguu

SEQ ID NO: 1005136 - RNA, 22 nt, Human
aaauacugcugcuauuccuuuu

SEQ ID NO: 1005137 - RNA, 22 nt, Human
gccagguugcugacgacgaucu

SEQ ID NO: 1005138 - RNA, 22 nt, Human
acagcuuugggcaaugcuauga

SEQ ID NO: 1005139 - RNA, 22 nt, Human
cuacugaguccuucagcugcca

SEQ ID NO: 1005140 - RNA, 22 nt, Human
ccaggccugugcaaggagggag

SEQ ID NO: 1005141 - RNA, 22 nt, Human
gagaacucagacgcaggucaug

SEQ ID NO: 1005142 - RNA, 22 nt, Human
gggaccuggggacuccuuguuc

SEQ ID NO: 1005143 - RNA, 22 nt, Human
accaggcacuccugaggucuga

SEQ ID NO: 1005144 - RNA, 21 nt, Human
ccagagagagggaaguggguu

SEQ ID NO: 1005145 - RNA, 22 nt, Human
cugccugcuuaccaugcaucag

SEQ ID NO: 1005146 - RNA, 22 nt, Human
cugugggaugggaccucagcug

SEQ ID NO: 1005147 - RNA, 22 nt, Human
cuucuggguguggagugaggac

SEQ ID NO: 1005148 - RNA, 22 nt, Human
ucccacaugugaauccucaggu

SEQ ID NO: 1005149 - RNA, 22 nt, Human
guuagggagggugcauaugugu

SEQ ID NO: 1005150 - RNA, 22 nt, Human
auuucucacucacaguccaugu

SEQ ID NO: 1005151 - RNA, 22 nt, Human
auuucucaguuccuacuguuua

SEQ ID NO: 1005152 - RNA, 22 nt, Human
agaagaaaugaggccguucugc

SEQ ID NO: 1005153 - RNA, 22 nt, Human
agaaaauauucauugagaggcu

SEQ ID NO: 1005154 - RNA, 22 nt, Human
agggagacacaugaggaaguca

SEQ ID NO: 1005155 - RNA, 22 nt, Human
ugguaagaacccaucagagaag

SEQ ID NO: 1005156 - RNA, 22 nt, Human
gaacacauuagucugaguuggc

SEQ ID NO: 1005157 - RNA, 22 nt, Human
ugcagagaaaacuccuggguac

SEQ ID NO: 1005158 - RNA, 22 nt, Human
acaggcucucagccaguuggca

SEQ ID NO: 1005159 - RNA, 22 nt, Human
ugucagagagcaggcaguagaa

SEQ ID NO: 1005160 - RNA, 22 nt, Human
uaccugcacagccagccaugug

SEQ ID NO: 1005161 - RNA, 22 nt, Human
auucagugugagguuuucaagu

SEQ ID NO: 1005162 - RNA, 18 nt, Human
cuccagggaacucaguca

SEQ ID NO: 1005163 - RNA, 22 nt, Human
cugaaccaucucuguucuguau

SEQ ID NO: 1005164 - RNA, 22 nt, Human
acugggcuguuuuuugagugga

SEQ ID NO: 1005165 - RNA, 22 nt, Human
acugggcuagaguggaagcugg

SEQ ID NO: 1005166 - RNA, 21 nt, Human
cccugcaggccagggcugagc

SEQ ID NO: 1005167 - RNA, 22 nt, Human
cuguggcugcguaggucuggca

SEQ ID NO: 1005168 - RNA, 19 nt, Human
aggcugugagggaggacuc

SEQ ID NO: 1005169 - RNA, 22 nt, Human
cauuuguaggaugcuucuuguu

SEQ ID NO: 1005170 - RNA, 22 nt, Human
uccuggcauugugcagggugug

SEQ ID NO: 1005171 - RNA, 22 nt, Human
uagcauuucacugaucuucacu

SEQ ID NO: 1005172 - RNA, 22 nt, Human
aaaguguugauaugugacaucc

SEQ ID NO: 1005173 - RNA, 22 nt, Human
auguauuucuauguagugaaga

SEQ ID NO: 1005174 - RNA, 22 nt, Human
guccaaguacauguguguacau

SEQ ID NO: 1005175 - RNA, 22 nt, Human
ccaucacaguccccaucgugau

SEQ ID NO: 1005176 - RNA, 17 nt, Human
gagccacccugugcgag

SEQ ID NO: 1005177 - RNA, 23 nt, Human
ggacacauuuauuucagaauuca

SEQ ID NO: 1005178 - RNA, 22 nt, Human
gcugggcuggaaggccaaggca

SEQ ID NO: 1005179 - RNA, 22 nt, Human
ucaggcucagguuaggggccaa

SEQ ID NO: 1005180 - RNA, 22 nt, Human
guccucuggaagaugaguucuu

SEQ ID NO: 1005181 - RNA, 18 nt, Human
guuaauuuugaaguucau

SEQ ID NO: 1005182 - RNA, 22 nt, Human
uggcacucacucucagagucug

SEQ ID NO: 1005183 - RNA, 22 nt, Human
cagccaggauggagaacuguug

SEQ ID NO: 1005184 - RNA, 22 nt, Human
cacauuccuggugcucagcagc

SEQ ID NO: 1005185 - RNA, 19 nt, Human
accugcaguaauaauuccu

SEQ ID NO: 1005186 - RNA, 22 nt, Human
acccacaccuccguauaucacu

SEQ ID NO: 1005187 - RNA, 22 nt, Human
ugagagucucagaccuccuggu

SEQ ID NO: 1005188 - RNA, 22 nt, Human
gccaagcuggaugaagagguug

SEQ ID NO: 1005189 - RNA, 22 nt, Human
uggcaggcgggagccauagagg

SEQ ID NO: 1005190 - RNA, 22 nt, Human
uuuaucuuuaggacuuugcaga

SEQ ID NO: 1005191 - RNA, 19 nt, Human
uccugcagaccagaccugu

SEQ ID NO: 1005192 - RNA, 22 nt, Human
uuguaugaccacaaucugacgu

SEQ ID NO: 1005193 - RNA, 21 nt, Human
aauuagggugccucuuauaau

SEQ ID NO: 1005194 - RNA, 22 nt, Human
agugaaccaggcugcgucccug

SEQ ID NO: 1005195 - RNA, 22 nt, Human
uauacacaaggugugcauuugu

SEQ ID NO: 1005196 - RNA, 22 nt, Human
guuagggagucagguggcucuu

SEQ ID NO: 1005197 - RNA, 22 nt, Human
ugcagggagggcccagcaaucu

SEQ ID NO: 1005198 - RNA, 22 nt, Human
acagauuuauugaagcugcugc

SEQ ID NO: 1005199 - RNA, 22 nt, Human
uguaggcugaagaugaagugga

SEQ ID NO: 1005200 - RNA, 22 nt, Human
uaugcacacauguaugcaugug

SEQ ID NO: 1005201 - RNA, 22 nt, Human
cagcccucaucucagcuucuuu

SEQ ID NO: 1005202 - RNA, 19 nt, Human
guccucucaacaacccggg

SEQ ID NO: 1005203 - RNA, 22 nt, Human
acuccaggcaucugcuucugcu

SEQ ID NO: 1005204 - RNA, 22 nt, Human
cagguuggucggcaaguacaca

SEQ ID NO: 1005205 - RNA, 22 nt, Human
uucuuuuacauuaagauuucag

SEQ ID NO: 1005206 - RNA, 22 nt, Human
cagcauuuaucuuguagcagga

SEQ ID NO: 1005207 - RNA, 22 nt, Human
aauacauauggaauuccauguu

SEQ ID NO: 1005208 - RNA, 22 nt, Human
aauaacuuaagaaauuucccca

SEQ ID NO: 1005209 - RNA, 22 nt, Human
ggugccagugggucucaggaua

SEQ ID NO: 1005210 - RNA, 22 nt, Human
ccuacucugagcgccuccgcau

SEQ ID NO: 1005211 - RNA, 22 nt, Human
agagcaauggcauccagcugau

SEQ ID NO: 1005212 - RNA, 22 nt, Human
ucacuguauuugcugaugcaua

SEQ ID NO: 1005213 - RNA, 22 nt, Human
ccagcuuuuccucucauugcuu

SEQ ID NO: 1005214 - RNA, 22 nt, Human
auuucuacaguacacaugcauu

SEQ ID NO: 1005215 - RNA, 22 nt, Human
gagggcucuaccaaguaacucu

SEQ ID NO: 1005216 - RNA, 22 nt, Human
uuuacauugcauuagguauuau

SEQ ID NO: 1005217 - RNA, 19 nt, Human
uuaugaaggcuggggggag

SEQ ID NO: 1005218 - RNA, 22 nt, Human
uccccacaucucugcaucaggc

SEQ ID NO: 1005219 - RNA, 22 nt, Human
cccagccuuugcuuccugguuc

SEQ ID NO: 1005220 - RNA, 22 nt, Human
uuuaauauucugcauucuccuu

SEQ ID NO: 1005221 - RNA, 22 nt, Human
ucagaaagaacacaggcaguag

SEQ ID NO: 1005222 - RNA, 22 nt, Human
uccccacacuuucacuccuggc

SEQ ID NO: 1005223 - RNA, 22 nt, Human
uggaacacaagucauugagggg

SEQ ID NO: 1005224 - RNA, 20 nt, Human
cacaacuguccacaugcucc

SEQ ID NO: 1005225 - RNA, 22 nt, Human
agacacauaggaccacacugug

SEQ ID NO: 1005226 - RNA, 22 nt, Human
ccucccuucaguagagcccaau

SEQ ID NO: 1005227 - RNA, 20 nt, Human
gcaggcuccgggcuugggag

SEQ ID NO: 1005228 - RNA, 22 nt, Human
aacccaggagacagguugcagu

SEQ ID NO: 1005229 - RNA, 21 nt, Human
uccccacauuucuaaacagac

SEQ ID NO: 1005230 - RNA, 22 nt, Human
cccugcagacgucuugaugccu

SEQ ID NO: 1005231 - RNA, 22 nt, Human
ugggcugagcagugaagcucau

SEQ ID NO: 1005232 - RNA, 22 nt, Human
uccuggcagaaauggggcugug

SEQ ID NO: 1005233 - RNA, 22 nt, Human
ggagccugaaaagucugcauuu

SEQ ID NO: 1005234 - RNA, 22 nt, Human
uccaggcaugucccaagccgga

SEQ ID NO: 1005235 - RNA, 22 nt, Human
uucuacaauaugaauaaugaag

SEQ ID NO: 1005236 - RNA, 22 nt, Human
cagcaaucgggugauaugcaau

SEQ ID NO: 1005237 - RNA, 22 nt, Human
uguucauaucauuuugaaagcu

SEQ ID NO: 1005238 - RNA, 22 nt, Human
uccuggcaguaauuugauguug

SEQ ID NO: 1005239 - RNA, 22 nt, Human
ugggcuccagcaccugugcucu

SEQ ID NO: 1005240 - RNA, 22 nt, Human
ugggccaggcaugugaucagca

SEQ ID NO: 1005241 - RNA, 22 nt, Human
gaggagcugggacccugucauc

SEQ ID NO: 1005242 - RNA, 22 nt, Human
ucagcuuuccuugcuuuagauu

SEQ ID NO: 1005243 - RNA, 22 nt, Human
augggcugaggaagcuccugag

SEQ ID NO: 1005244 - RNA, 22 nt, Human
ggcaggcaggucuucauggccc

SEQ ID NO: 1005245 - RNA, 21 nt, Human
uccagcucuuauguucaugaa

SEQ ID NO: 1005246 - RNA, 20 nt, Human
augugaaagaucaguugucu

SEQ ID NO: 1005247 - RNA, 22 nt, Human
uuguuucauggggauguuuauu

SEQ ID NO: 1005248 - RNA, 22 nt, Human
guaugaaggcgagagcccacua

SEQ ID NO: 1005249 - RNA, 18 nt, Human
cccagcuuagcgccccuc

SEQ ID NO: 1005250 - RNA, 18 nt, Human
uccucucuuuccccaggg

SEQ ID NO: 1005251 - RNA, 22 nt, Human
cagaagaggacuggguagcuca

SEQ ID NO: 1005252 - RNA, 22 nt, Human
ccugccucccagagguccucua

SEQ ID NO: 1005253 - RNA, 22 nt, Human
uuucugaaaucucuuuugagga

SEQ ID NO: 1005254 - RNA, 22 nt, Human
ucaaaguuacuugugguuuucu

SEQ ID NO: 1005255 - RNA, 22 nt, Human
uagaauaugauuaauuuucuua

SEQ ID NO: 1005256 - RNA, 22 nt, Human
aggcaguguguagcuggaagag

SEQ ID NO: 1005257 - RNA, 22 nt, Human
uaaaauagcaugugcagugaaa

SEQ ID NO: 1005258 - RNA, 22 nt, Human
ucugggcuuuaguuuguuaucu

SEQ ID NO: 1005259 - RNA, 22 nt, Human
ccucuccuugcacccgucccgc

SEQ ID NO: 1005260 - RNA, 22 nt, Human
aaacacauuagcccuguggaaa

SEQ ID NO: 1005261 - RNA, 22 nt, Human
cccuuccuugauuuuaacugga

SEQ ID NO: 1005262 - RNA, 22 nt, Human
acuggaaaugagaugauaucag

SEQ ID NO: 1005263 - RNA, 20 nt, Human
ccaggccugggccugcucua

SEQ ID NO: 1005264 - RNA, 22 nt, Human
cauuuucagcacccaucugaaa

SEQ ID NO: 1005265 - RNA, 22 nt, Human
uauaauuuuagaagagauggaa

SEQ ID NO: 1005266 - RNA, 22 nt, Human
uuuaaaauuuagaccucuccac

SEQ ID NO: 1005267 - RNA, 22 nt, Human
gugcaggggccuccccuugcug

SEQ ID NO: 1005268 - RNA, 22 nt, Human
aaauccuaauaaugcacuagug

SEQ ID NO: 1005269 - RNA, 22 nt, Human
uucucauggugucuuuauacau

SEQ ID NO: 1005270 - RNA, 22 nt, Human
caguguuuguauagaauaugca

SEQ ID NO: 1005271 - RNA, 22 nt, Human
cugcaggggccucgagcacagg

SEQ ID NO: 1005272 - RNA, 22 nt, Human
uccaggcuccccugcgugcucc

SEQ ID NO: 1005273 - RNA, 22 nt, Human
gguggcagaggugcaucagccc

SEQ ID NO: 1005274 - RNA, 22 nt, Human
ucugcagaaggaaucagcugag

SEQ ID NO: 1005275 - RNA, 19 nt, Human
acuggcagggcugcggugg

SEQ ID NO: 1005276 - RNA, 22 nt, Human
uauaauuuaucaugucacaguu

SEQ ID NO: 1005277 - RNA, 22 nt, Human
cagcuucuggcguggagccuga

SEQ ID NO: 1005278 - RNA, 22 nt, Human
ggccucaggguugggcccauua

SEQ ID NO: 1005279 - RNA, 22 nt, Human
ccuacauucucugaguuuuccu

SEQ ID NO: 1005280 - RNA, 22 nt, Human
ugggcugagaguaccuuauaaa

SEQ ID NO: 1005281 - RNA, 22 nt, Human
gcacccagccagcaucucagag

SEQ ID NO: 1005282 - RNA, 22 nt, Human
ggguuucaugguucucacaaug

SEQ ID NO: 1005283 - RNA, 22 nt, Human
ucuacuauguuucuuaaauaga

SEQ ID NO: 1005284 - RNA, 22 nt, Human
gcaguguuuguguucucacaug

SEQ ID NO: 1005285 - RNA, 22 nt, Human
gcguccagggaaggcccagcug

SEQ ID NO: 1005286 - RNA, 22 nt, Human
gcuccugggcccugggcuaacu

SEQ ID NO: 1005287 - RNA, 22 nt, Human
gcuggcaggauagaagucuaau

SEQ ID NO: 1005288 - RNA, 22 nt, Human
ucccaggcaaaggcagcucauu

SEQ ID NO: 1005289 - RNA, 22 nt, Human
ccccacaccugccgggcagcag

SEQ ID NO: 1005290 - RNA, 22 nt, Human
ugcauaaacuucucugguguga

SEQ ID NO: 1005291 - RNA, 22 nt, Human
uuccagccaugguuucccuaug

SEQ ID NO: 1005292 - RNA, 22 nt, Human
ccaggcucugcgcuggacaugg

SEQ ID NO: 1005293 - RNA, 22 nt, Human
auucugucuuuuuauacaucua

SEQ ID NO: 1005294 - RNA, 23 nt, Human
uuaggcacuuaguagggccagag

SEQ ID NO: 1005295 - RNA, 22 nt, Human
ugaauccagagcuauuucgucc

SEQ ID NO: 1005296 - RNA, 22 nt, Human
gacacauaugcguauaguuuag

SEQ ID NO: 1005297 - RNA, 22 nt, Human
aauauuuguuaguguuuuaaug

SEQ ID NO: 1005298 - RNA, 22 nt, Human
uuuccuuugcccaauacauguc

SEQ ID NO: 1005299 - RNA, 22 nt, Human
ugcuuuauguuaucagaagggu

SEQ ID NO: 1005300 - RNA, 22 nt, Human
augaaugcugggacaaauauau

SEQ ID NO: 1005301 - RNA, 21 nt, Human
uggccaaacuggagcauuuga

SEQ ID NO: 1005302 - RNA, 22 nt, Human
agaaagaggaugcagaucucau

SEQ ID NO: 1005303 - RNA, 22 nt, Human
aaguaugacauuuaagacaauu

SEQ ID NO: 1005304 - RNA, 22 nt, Human
ugucagaggcucagggucucag

SEQ ID NO: 1005305 - RNA, 21 nt, Human
ucuggcaggcacgggcccagc

SEQ ID NO: 1005306 - RNA, 22 nt, Human
ucauuuaauugguuuugcucgu

SEQ ID NO: 1005307 - RNA, 22 nt, Human
ugauuucuuccuugucauuaga

SEQ ID NO: 1005308 - RNA, 22 nt, Human
gcuccaggcagcauaguggaug

SEQ ID NO: 1005309 - RNA, 22 nt, Human
uccaggcagcccuuccugacuc

SEQ ID NO: 1005310 - RNA, 22 nt, Human
ccaggcucagcuauuaagaaac

SEQ ID NO: 1005311 - RNA, 22 nt, Human
uauguacuacacuagaacauuu

SEQ ID NO: 1005312 - RNA, 22 nt, Human
ccuggcaggacuguuguaagaa

SEQ ID NO: 1005313 - RNA, 22 nt, Human
agaauaugaugguuggagaauu

SEQ ID NO: 1005314 - RNA, 21 nt, Human
uucaaaguuugccuaaagauu

SEQ ID NO: 1005315 - RNA, 22 nt, Human
ucagcuuuugucagaaauugua

SEQ ID NO: 1005316 - RNA, 22 nt, Human
gccaggcagagccccgugcagc

SEQ ID NO: 1005317 - RNA, 22 nt, Human
acaauacuuaccaauguuuuug

SEQ ID NO: 1005318 - RNA, 22 nt, Human
uggccucugggaaagcagauuc

SEQ ID NO: 1005319 - RNA, 22 nt, Human
uuagccauguugaagauuuaga

SEQ ID NO: 1005320 - RNA, 22 nt, Human
uucauaaugagguccuagaggc

SEQ ID NO: 1005321 - RNA, 21 nt, Human
augugaaauaucaucagagca

SEQ ID NO: 1005322 - RNA, 22 nt, Human
acacucucagcuuuucaacuua

SEQ ID NO: 1005323 - RNA, 22 nt, Human
auguccagagccggccugcuga

SEQ ID NO: 1005324 - RNA, 22 nt, Human
ccaggcucugagccucacucuu

SEQ ID NO: 1005325 - RNA, 22 nt, Human
cuauuacauuucuggacauuca

SEQ ID NO: 1005326 - RNA, 22 nt, Human
ucuguuuaggcaaaauagcuac

SEQ ID NO: 1005327 - RNA, 22 nt, Human
gccugcagccucaagggcugag

SEQ ID NO: 1005328 - RNA, 22 nt, Human
gauuuucugagccuucaaauuu

SEQ ID NO: 1005329 - RNA, 22 nt, Human
agggcuccgggcaggcgaugga

SEQ ID NO: 1005330 - RNA, 22 nt, Human
acuccugggugcugaccagcgu

SEQ ID NO: 1005331 - RNA, 20 nt, Human
augggcugguuaggaagugu

SEQ ID NO: 1005332 - RNA, 22 nt, Human
auuucucagugaaaugacaggc

SEQ ID NO: 1005333 - RNA, 22 nt, Human
uuuucauugagcaccugaguaa

SEQ ID NO: 1005334 - RNA, 22 nt, Human
gcuggcagugugaaugacaagc

SEQ ID NO: 1005335 - RNA, 22 nt, Human
uccaggcacuauauauacuuuu

SEQ ID NO: 1005336 - RNA, 22 nt, Human
ucuggcagagucagugcacaca

SEQ ID NO: 1005337 - RNA, 22 nt, Human
auuaaauuaaguggcuaauuua

SEQ ID NO: 1005338 - RNA, 19 nt, Human
ucugcagaaggcauacaug

SEQ ID NO: 1005339 - RNA, 22 nt, Human
cuccaggcucguccaagaucga

SEQ ID NO: 1005340 - RNA, 22 nt, Human
uuaauacaagcauaugcacaca

SEQ ID NO: 1005341 - RNA, 22 nt, Human
caggagcaaggagcagugggau

SEQ ID NO: 1005342 - RNA, 21 nt, Human
uugaccaagggugcgugcucc

SEQ ID NO: 1005343 - RNA, 22 nt, Human
caugaagcuugaagcaguccac

SEQ ID NO: 1005344 - RNA, 22 nt, Human
ccagagaggccaaggucguggu

SEQ ID NO: 1005345 - RNA, 21 nt, Human
ugcauaaagaaauacaaauac

SEQ ID NO: 1005346 - RNA, 22 nt, Human
aucacuguuaucuagaagcaca

SEQ ID NO: 1005347 - RNA, 22 nt, Human
cauguuaaaauauacauucuga

SEQ ID NO: 1005348 - RNA, 22 nt, Human
ucagcucuguguacaguuagca

SEQ ID NO: 1005349 - RNA, 21 nt, Human
aaauuucugcaagccucaacu

SEQ ID NO: 1005350 - RNA, 22 nt, Human
uucugucauuuagcauugucau

SEQ ID NO: 1005351 - RNA, 22 nt, Human
cauuugcagagggugacacucu

SEQ ID NO: 1005352 - RNA, 23 nt, Human
cuuuucauugccuuagcgcagag

SEQ ID NO: 1005353 - RNA, 22 nt, Human
uguuuucauuugauguaacaaa

SEQ ID NO: 1005354 - RNA, 22 nt, Human
augauuucuauauaaacuuaaa

SEQ ID NO: 1005355 - RNA, 22 nt, Human
guagggacuuguuuuacuagua

SEQ ID NO: 1005356 - RNA, 22 nt, Human
ucagggaccccucugaguggag

SEQ ID NO: 1005357 - RNA, 22 nt, Human
acagcuuuuuacuaauagauug

SEQ ID NO: 1005358 - RNA, 18 nt, Human
ggcagggaaaagauaggg

SEQ ID NO: 1005359 - RNA, 22 nt, Human
uguuaggguccugugcaggggc

SEQ ID NO: 1005360 - RNA, 22 nt, Human
uugcagcuucgagucuaucugu

SEQ ID NO: 1005361 - RNA, 22 nt, Human
cuggcacgcccacguaggcacu

SEQ ID NO: 1005362 - RNA, 22 nt, Human
uaaacauuuguuauucuuguuu

SEQ ID NO: 1005363 - RNA, 22 nt, Human
ccuggcuccugccucugcaggg

SEQ ID NO: 1005364 - RNA, 22 nt, Human
ccagagaggggaagggcuugcc

SEQ ID NO: 1005365 - RNA, 22 nt, Human
aagagagaacucccuucgccag

SEQ ID NO: 1005366 - RNA, 22 nt, Human
uuggguaggagaaagaacagau

SEQ ID NO: 1005367 - RNA, 20 nt, Human
guauuaggagguaaauguaa

SEQ ID NO: 1005368 - RNA, 22 nt, Human
ggaccugccagaacucaggcua

SEQ ID NO: 1005369 - RNA, 22 nt, Human
cccaaggccuucaagccagcuc

SEQ ID NO: 1005370 - RNA, 22 nt, Human
gagugcaggccugagcaccauc

SEQ ID NO: 1005371 - RNA, 22 nt, Human
aaugaagcaguccaucugcucu

SEQ ID NO: 1005372 - RNA, 22 nt, Human
agggacccugaugacugaggag

SEQ ID NO: 1005373 - RNA, 22 nt, Human
uucugucacuuaggaggucaua

SEQ ID NO: 1005374 - RNA, 20 nt, Human
uggaaguucuguugcauugg

SEQ ID NO: 1005375 - RNA, 22 nt, Human
ugugaaauucuugaaaugcaca

SEQ ID NO: 1005376 - RNA, 22 nt, Human
gucacacagggccuccaaauca

SEQ ID NO: 1005377 - RNA, 22 nt, Human
guccucuguuuccaucugacuu

SEQ ID NO: 1005378 - RNA, 22 nt, Human
gguuucaaauuaaagucuuaag

SEQ ID NO: 1005379 - RNA, 22 nt, Human
cguaugaaauuuuugacauuug

SEQ ID NO: 1005380 - RNA, 22 nt, Human
aaacagauaaugcuauaaaugg

SEQ ID NO: 1005381 - RNA, 22 nt, Human
guuucauuuacaucuguaggua

SEQ ID NO: 1005382 - RNA, 22 nt, Human
gcagcuuuaaaggaggcucuga

SEQ ID NO: 1005383 - RNA, 22 nt, Human
aggccuuaccauagcuguagca

SEQ ID NO: 1005384 - RNA, 22 nt, Human
augugaaaaauuucuuauuaca

SEQ ID NO: 1005385 - RNA, 22 nt, Human
ggcccagccucagacaugcccu

SEQ ID NO: 1005386 - RNA, 22 nt, Human
uaauaguuaugguugguucuca

SEQ ID NO: 1005387 - RNA, 22 nt, Human
uguguuuugaacucaucuacug

SEQ ID NO: 1005388 - RNA, 22 nt, Human
aaaauccugcugacucgagaug

SEQ ID NO: 1005389 - RNA, 22 nt, Human
ucacacaugcuaagccagagau

SEQ ID NO: 1005390 - RNA, 22 nt, Human
aaaguguggucguucauuuugu

SEQ ID NO: 1005391 - RNA, 22 nt, Human
ugcuuaaaaugaugauuauuuu

SEQ ID NO: 1005392 - RNA, 22 nt, Human
ccuggcugguggcagcgacaag

SEQ ID NO: 1005393 - RNA, 22 nt, Human
ccacccagcagaggaggcaaga

SEQ ID NO: 1005394 - RNA, 22 nt, Human
agggaccucuucuugcagcuga

SEQ ID NO: 1005395 - RNA, 22 nt, Human
uggguacuccuauuaguucagu

SEQ ID NO: 1005396 - RNA, 22 nt, Human
auuagggaaggauuuggccuga

SEQ ID NO: 1005397 - RNA, 22 nt, Human
uaugaagcucucacuguguguc

SEQ ID NO: 1005398 - RNA, 17 nt, Human
gaauuucuuggucaaaa

SEQ ID NO: 1005399 - RNA, 22 nt, Human
ucaagagaaggggaaauagacu

SEQ ID NO: 1005400 - RNA, 22 nt, Human
ugcaggcuccaugaggacaggc

SEQ ID NO: 1005401 - RNA, 22 nt, Human
gcuccaggaggaugaccuuccu

SEQ ID NO: 1005402 - RNA, 22 nt, Human
uuguaugaucaaaagaaaugua

SEQ ID NO: 1005403 - RNA, 22 nt, Human
cacauacaaggcacacuggagg

SEQ ID NO: 1005404 - RNA, 22 nt, Human
ucccaggcuaggccucugcguu

SEQ ID NO: 1005405 - RNA, 22 nt, Human
uuggaaauacagcaguuacuuu

SEQ ID NO: 1005406 - RNA, 22 nt, Human
ccugcagguugcagaggcggaa

SEQ ID NO: 1005407 - RNA, 22 nt, Human
ugcuucugucucuuaugccuug

SEQ ID NO: 1005408 - RNA, 22 nt, Human
uuagaacugaagaagauuaagg

SEQ ID NO: 1005409 - RNA, 22 nt, Human
aucagagaccggucaagucaug

SEQ ID NO: 1005410 - RNA, 22 nt, Human
uuucacauguggaaugccaggu

SEQ ID NO: 1005411 - RNA, 22 nt, Human
cuccagggaugagacagaguag

SEQ ID NO: 1005412 - RNA, 22 nt, Human
cugcagccuccuccagcuacgu

SEQ ID NO: 1005413 - RNA, 22 nt, Human
uccaggcucuaggcugcucucc

SEQ ID NO: 1005414 - RNA, 20 nt, Human
guggcaggcagugaaggagc

SEQ ID NO: 1005415 - RNA, 22 nt, Human
cacuuagucucaccaguucagu

SEQ ID NO: 1005416 - RNA, 22 nt, Human
auucugucauuucaagaaaaac

SEQ ID NO: 1005417 - RNA, 19 nt, Human
uggcagguagugagcaguc

SEQ ID NO: 1005418 - RNA, 22 nt, Human
agcccagcuuugaaccauauca

SEQ ID NO: 1005419 - RNA, 23 nt, Human
gcugacugugaaauucuggagcu

SEQ ID NO: 1005420 - RNA, 21 nt, Human
ucacguggucacaugagcuuu

SEQ ID NO: 1005421 - RNA, 17 nt, Human
uuuagaauacaauguuu

SEQ ID NO: 1005422 - RNA, 22 nt, Human
uguauacaggauuacucauagc

SEQ ID NO: 1005423 - RNA, 22 nt, Human
auguccagccaaccacuggauu

SEQ ID NO: 1005424 - RNA, 22 nt, Human
cucauuaaaggaaaucaccugc

SEQ ID NO: 1005425 - RNA, 22 nt, Human
uucugucagcgucagaaauucu

SEQ ID NO: 1005426 - RNA, 22 nt, Human
gcugggcugagcuagacuuggc

SEQ ID NO: 1005427 - RNA, 22 nt, Human
uaugaacauguucauugacuua

SEQ ID NO: 1005428 - RNA, 23 nt, Human
acugggcuuaugaggaggcuugu

SEQ ID NO: 1005429 - RNA, 22 nt, Human
auuucauacuaaggcucaaaaa

SEQ ID NO: 1005430 - RNA, 22 nt, Human
auccaggcgaaugcagaaggcc

SEQ ID NO: 1005431 - RNA, 22 nt, Human
cuggcaguauuaagagaaguga

SEQ ID NO: 1005432 - RNA, 22 nt, Human
ucaucaguguccuuaucacuua

SEQ ID NO: 1005433 - RNA, 22 nt, Human
augcuacagcaucucucaucag

SEQ ID NO: 1005434 - RNA, 22 nt, Human
gaggguggccuuuagagcccau

SEQ ID NO: 1005435 - RNA, 22 nt, Human
agcaggcuuaugguugaaggga

SEQ ID NO: 1005436 - RNA, 22 nt, Human
ccagcccuuagauaaaccuggc

SEQ ID NO: 1005437 - RNA, 22 nt, Human
ucaggcucugccaccuagauua

SEQ ID NO: 1005438 - RNA, 22 nt, Human
acccagcaaagauaaacuuaug

SEQ ID NO: 1005439 - RNA, 19 nt, Human
gcaucagagcagaaggggu

SEQ ID NO: 1005440 - RNA, 22 nt, Human
gcuuuauuuugugagggauuac

SEQ ID NO: 1005441 - RNA, 22 nt, Human
gucacaggcaguaacuaggacc

SEQ ID NO: 1005442 - RNA, 22 nt, Human
uguuagaaguuaaucacuaauu

SEQ ID NO: 1005443 - RNA, 21 nt, Human
ccaggcuccugaggcugguca

SEQ ID NO: 1005444 - RNA, 22 nt, Human
ucccacaccugucuauuccuag

SEQ ID NO: 1005445 - RNA, 22 nt, Human
uccacacacauuucuaugugca

SEQ ID NO: 1005446 - RNA, 22 nt, Human
guccucuggagguuuuuaggug

SEQ ID NO: 1005447 - RNA, 22 nt, Human
uagggcucgggcacaggacagg

SEQ ID NO: 1005448 - RNA, 22 nt, Human
cguguggucccggcaaggcaag

SEQ ID NO: 1005449 - RNA, 22 nt, Human
aaacacaccuuuggaacuguga

SEQ ID NO: 1005450 - RNA, 22 nt, Human
ccugccuguacuagagacccag

SEQ ID NO: 1005451 - RNA, 22 nt, Human
uagggcucagagaaguggggcc

SEQ ID NO: 1005452 - RNA, 22 nt, Human
aauguaugugauuauuccucua

SEQ ID NO: 1005453 - RNA, 22 nt, Human
acucacuuuccauucaagcacc

SEQ ID NO: 1005454 - RNA, 22 nt, Human
gggcuguaggagcuggaauggg

SEQ ID NO: 1005455 - RNA, 22 nt, Human
uguacuaaggcuguguagaugu

SEQ ID NO: 1005456 - RNA, 22 nt, Human
ccugggcuugguuguugagaac

SEQ ID NO: 1005457 - RNA, 22 nt, Human
augacucuuagcuaaagguaag

SEQ ID NO: 1005458 - RNA, 23 nt, Human
ucugggcugagacuuggaagguc

SEQ ID NO: 1005459 - RNA, 22 nt, Human
augcagcuucaggauuaugaug

SEQ ID NO: 1005460 - RNA, 23 nt, Human
gcugggcuuacucuuucagugag

SEQ ID NO: 1005461 - RNA, 22 nt, Human
ugucuuuaaaauuaaacacauc

SEQ ID NO: 1005462 - RNA, 22 nt, Human
uacacaacugacaaccauucug

SEQ ID NO: 1005463 - RNA, 22 nt, Human
uugggaagaauggaggugguua

SEQ ID NO: 1005464 - RNA, 22 nt, Human
uccugagcugccgcaucagcag

SEQ ID NO: 1005465 - RNA, 22 nt, Human
cucugucaggcugcagaugcuc

SEQ ID NO: 1005466 - RNA, 22 nt, Human
ugcagggaggccccgcagcccu

SEQ ID NO: 1005467 - RNA, 22 nt, Human
gucacuguauccagguuccagc

SEQ ID NO: 1005468 - RNA, 22 nt, Human
auugguggugaggacaugccag

SEQ ID NO: 1005469 - RNA, 23 nt, Human
guccucuggagagaaaggcagua

SEQ ID NO: 1005470 - RNA, 22 nt, Human
cagaagaguagcugaacaaguu

SEQ ID NO: 1005471 - RNA, 22 nt, Human
gcuaggagccgcugcacuaggu

SEQ ID NO: 1005472 - RNA, 22 nt, Human
guucuuaagaccacaauaaaaa

SEQ ID NO: 1005473 - RNA, 22 nt, Human
aauugcaacagguagacuuuuc

SEQ ID NO: 1005474 - RNA, 22 nt, Human
aauuagggaaguauuuaguagu

SEQ ID NO: 1005475 - RNA, 22 nt, Human
uggaaacaucucugccuuuauu

SEQ ID NO: 1005476 - RNA, 22 nt, Human
cauucacaucuuguuccaucac

SEQ ID NO: 1005477 - RNA, 22 nt, Human
cugaaccacuaauauuuugauu

SEQ ID NO: 1005478 - RNA, 22 nt, Human
uuccacauuccuuacauucaua

SEQ ID NO: 1005479 - RNA, 22 nt, Human
ucuucaaacugaaaauuuagaa

SEQ ID NO: 1005480 - RNA, 22 nt, Human
cuggggacucauucagagcaua

SEQ ID NO: 1005481 - RNA, 21 nt, Human
uauuugcugccaucuuugagg

SEQ ID NO: 1005482 - RNA, 22 nt, Human
aaucugucguaguaaaaagcag

SEQ ID NO: 1005483 - RNA, 22 nt, Human
cucuuaaagaauguuccagcug

SEQ ID NO: 1005484 - RNA, 22 nt, Human
cuuauuagaaagaaaagacaug

SEQ ID NO: 1005485 - RNA, 22 nt, Human
uccugcagcugaagcucaugug

SEQ ID NO: 1005486 - RNA, 22 nt, Human
ucucuuaauaaguaaauacuga

SEQ ID NO: 1005487 - RNA, 22 nt, Human
ggagacucggguucuagccuug

SEQ ID NO: 1005488 - RNA, 22 nt, Human
cuuauuagaguuguguucuguu

SEQ ID NO: 1005489 - RNA, 22 nt, Human
gguuuauuaaugugaacuguau

SEQ ID NO: 1005490 - RNA, 22 nt, Human
acaggugguagaguggaaagag

SEQ ID NO: 1005491 - RNA, 19 nt, Human
agcauuuggaauucuacac

SEQ ID NO: 1005492 - RNA, 22 nt, Human
guguauaaugcuguuuguacau

SEQ ID NO: 1005493 - RNA, 22 nt, Human
ugcuuuauaggggauugcaggc

SEQ ID NO: 1005494 - RNA, 21 nt, Human
gcccccuggacuccucaucca

SEQ ID NO: 1005495 - RNA, 22 nt, Human
aagggcucugggcuacgcacug

SEQ ID NO: 1005496 - RNA, 18 nt, Human
ucucugaauauuuuaugu

SEQ ID NO: 1005497 - RNA, 22 nt, Human
ggugccaggcuguagucagggu

SEQ ID NO: 1005498 - RNA, 22 nt, Human
agcaggcuuucaagagucuucu

SEQ ID NO: 1005499 - RNA, 22 nt, Human
ccugggcuugcaucugugcugg

SEQ ID NO: 1005500 - RNA, 22 nt, Human
cugccucuauaggaguccacca

SEQ ID NO: 1005501 - RNA, 22 nt, Human
cugguggaggugccaggauuug

SEQ ID NO: 1005502 - RNA, 22 nt, Human
acaggacaggcugggcuagacu

SEQ ID NO: 1005503 - RNA, 22 nt, Human
agcuuuauauuuaaugaauucu

SEQ ID NO: 1005504 - RNA, 22 nt, Human
uucugcaucugaauuuaaguac

SEQ ID NO: 1005505 - RNA, 16 nt, Human
uccaggcauaucugag

SEQ ID NO: 1005506 - RNA, 22 nt, Human
cagggccagagagggcuggcug

SEQ ID NO: 1005507 - RNA, 22 nt, Human
uacauuccuucguuuagagauu

SEQ ID NO: 1005508 - RNA, 22 nt, Human
uaugaacuguacuguacuaagc

SEQ ID NO: 1005509 - RNA, 22 nt, Human
gggcugacaguuuccccugaaa

SEQ ID NO: 1005510 - RNA, 22 nt, Human
cagggccagcgcccaggcccag

SEQ ID NO: 1005511 - RNA, 17 nt, Human
agccugccccaugcugc

SEQ ID NO: 1005512 - RNA, 22 nt, Human
uuccaggcaugucagacauagg

SEQ ID NO: 1005513 - RNA, 22 nt, Human
aguguggcaggaaugacuagaa

SEQ ID NO: 1005514 - RNA, 22 nt, Human
caguguggcugagacagaggcu

SEQ ID NO: 1005515 - RNA, 22 nt, Human
gacacagaauuuacucccgaua

SEQ ID NO: 1005516 - RNA, 22 nt, Human
cagcuuuauuaaugauugucuu

SEQ ID NO: 1005517 - RNA, 22 nt, Human
augcagcugugggcaagaaaug

SEQ ID NO: 1005518 - RNA, 22 nt, Human
ccugggcuguaccugugcgcgg

SEQ ID NO: 1005519 - RNA, 22 nt, Human
cugggcuggauaauucuuugcu

SEQ ID NO: 1005520 - RNA, 22 nt, Human
uuccaagucacccuuaggguca

SEQ ID NO: 1005521 - RNA, 22 nt, Human
uaugcauacaaugagauauucc

SEQ ID NO: 1005522 - RNA, 22 nt, Human
gacacauagaucuaucucacuc

SEQ ID NO: 1005523 - RNA, 17 nt, Human
uuucagauucacuuucu

SEQ ID NO: 1005524 - RNA, 22 nt, Human
cuggccagagguuccucugccc

SEQ ID NO: 1005525 - RNA, 22 nt, Human
caggucuuuucuacugguggag

SEQ ID NO: 1005526 - RNA, 22 nt, Human
ccagcuuucauaucaugaggua

SEQ ID NO: 1005527 - RNA, 22 nt, Human
ugaaugauacagaauuauguag

SEQ ID NO: 1005528 - RNA, 22 nt, Human
ugggcugaggggccuugaugac

SEQ ID NO: 1005529 - RNA, 22 nt, Human
ccagagaccagaacauggggau

SEQ ID NO: 1005530 - RNA, 17 nt, Human
uccaggcauaucuccua

SEQ ID NO: 1005531 - RNA, 22 nt, Human
cauuuauugguuaggccagcag

SEQ ID NO: 1005532 - RNA, 22 nt, Human
aauacugucuuucacagauauu

SEQ ID NO: 1005533 - RNA, 22 nt, Human
ccugggcuuuggaacaguacuu

SEQ ID NO: 1005534 - RNA, 22 nt, Human
accacccauucagaaacacuga

SEQ ID NO: 1005535 - RNA, 23 nt, Human
aauguauguuaguaucuuagaga

SEQ ID NO: 1005536 - RNA, 21 nt, Human
cagcuucuucugugaccuggu

SEQ ID NO: 1005537 - RNA, 22 nt, Human
gaaaacuauuggccuagaacaa

SEQ ID NO: 1005538 - RNA, 22 nt, Human
auguuugaaauuguaaguauau

SEQ ID NO: 1005539 - RNA, 22 nt, Human
cuagggacugggaccuuaguua

SEQ ID NO: 1005540 - RNA, 22 nt, Human
ucuggcaggaccaugaagcgua

SEQ ID NO: 1005541 - RNA, 22 nt, Human
caugaaauugcuccuuuggugc

SEQ ID NO: 1005542 - RNA, 22 nt, Human
guggggacgggauggcucacug

SEQ ID NO: 1005543 - RNA, 22 nt, Human
gcuucuauuauuuggagcugag

SEQ ID NO: 1005544 - RNA, 22 nt, Human
guaugaaguuggacuguauaaa

SEQ ID NO: 1005545 - RNA, 22 nt, Human
uccaggcauguggccaguacuc

SEQ ID NO: 1005546 - RNA, 22 nt, Human
uacauaauugucuuuguccuca

SEQ ID NO: 1005547 - RNA, 23 nt, Human
uggaccugaaccagugccucugu

SEQ ID NO: 1005548 - RNA, 22 nt, Human
aauggcagaggcaaagauggua

SEQ ID NO: 1005549 - RNA, 22 nt, Human
ccagguccuguuuucaccacag

SEQ ID NO: 1005550 - RNA, 22 nt, Human
uggaacacagugauugauagcg

SEQ ID NO: 1005551 - RNA, 22 nt, Human
gggcugacaaccaucugacaag

SEQ ID NO: 1005552 - RNA, 22 nt, Human
gggaccuggcgagggucacaca

SEQ ID NO: 1005553 - RNA, 22 nt, Human
aacaugauggggaagaacaaga

SEQ ID NO: 1005554 - RNA, 22 nt, Human
uuccaaguuaggcgagcuggug

SEQ ID NO: 1005555 - RNA, 22 nt, Human
cagugagggaagaucucagcac

SEQ ID NO: 1005556 - RNA, 22 nt, Human
aggcugugacagggucauggag

SEQ ID NO: 1005557 - RNA, 19 nt, Human
aggugagugugggaaaggg

SEQ ID NO: 1005558 - RNA, 22 nt, Human
ccacacagggggaugaguuauu

SEQ ID NO: 1005559 - RNA, 22 nt, Human
gagaggcuggcagugccagguu

SEQ ID NO: 1005560 - RNA, 22 nt, Human
ucuggcagaucuucccacguuu

SEQ ID NO: 1005561 - RNA, 22 nt, Human
ccugccuucagcccugaagucu

SEQ ID NO: 1005562 - RNA, 21 nt, Human
agaaaauggcguuuuagauuu

SEQ ID NO: 1005563 - RNA, 22 nt, Human
ugcagagagaccccugggccag

SEQ ID NO: 1005564 - RNA, 22 nt, Human
caaagagcuguucagugucgcu

SEQ ID NO: 1005565 - RNA, 22 nt, Human
auacacauauguguguauaugu

SEQ ID NO: 1005566 - RNA, 22 nt, Human
uuuauugacccaaagcgagagu

SEQ ID NO: 1005567 - RNA, 22 nt, Human
uuaaacauuuauggaggcagca

SEQ ID NO: 1005568 - RNA, 22 nt, Human
agcaaucaccaccucuauauuu

SEQ ID NO: 1005569 - RNA, 22 nt, Human
aggacacacagaauacaaaucc

SEQ ID NO: 1005570 - RNA, 22 nt, Human
cuuaaauuggaugaguuaaguu

SEQ ID NO: 1005571 - RNA, 22 nt, Human
ccagagagaaaauggagggcca

SEQ ID NO: 1005572 - RNA, 22 nt, Human
aaguuucaaauguugauuaugc

SEQ ID NO: 1005573 - RNA, 22 nt, Human
guugggaagcagauggaugagc

SEQ ID NO: 1005574 - RNA, 22 nt, Human
ucacaauauuuaucuuccaauu

SEQ ID NO: 1005575 - RNA, 22 nt, Human
caucuuuucagaagccauucug

SEQ ID NO: 1005576 - RNA, 17 nt, Human
ccagagaguaguuagga

SEQ ID NO: 1005577 - RNA, 22 nt, Human
ucaucacauaugucaugauuug

SEQ ID NO: 1005578 - RNA, 22 nt, Human
gcccacaccauuuauucuuugu

SEQ ID NO: 1005579 - RNA, 22 nt, Human
uuuaauuuucugggcccagcag

SEQ ID NO: 1005580 - RNA, 22 nt, Human
uccaggcaaggauaauaaacau

SEQ ID NO: 1005581 - RNA, 22 nt, Human
ucuggcagggucagggcccagg

SEQ ID NO: 1005582 - RNA, 22 nt, Human
gagacaucauaaugaaguuucc

SEQ ID NO: 1005583 - RNA, 22 nt, Human
ugcuucuguauugaaauuguua

SEQ ID NO: 1005584 - RNA, 22 nt, Human
cagaguuuugugaacaacuugg

SEQ ID NO: 1005585 - RNA, 22 nt, Human
acacacucaauugcauaagcac

SEQ ID NO: 1005586 - RNA, 22 nt, Human
agggacccauagagagaccagu

SEQ ID NO: 1005587 - RNA, 22 nt, Human
ugggcuucugauguugagugcu

SEQ ID NO: 1005588 - RNA, 22 nt, Human
cuugggcucagacuugaggaca

SEQ ID NO: 1005589 - RNA, 22 nt, Human
gccuggcaggccuguuggggcu

SEQ ID NO: 1005590 - RNA, 22 nt, Human
gugggcuuuugacagugccugg

SEQ ID NO: 1005591 - RNA, 22 nt, Human
auauuagguuggugcaaaagua

SEQ ID NO: 1005592 - RNA, 22 nt, Human
caugaaugcuggguucauguaa

SEQ ID NO: 1005593 - RNA, 22 nt, Human
uacccagcaaucccuagagguu

SEQ ID NO: 1005594 - RNA, 22 nt, Human
aauugcaauuuucuuaaggucu

SEQ ID NO: 1005595 - RNA, 22 nt, Human
ggggcuccagucuucacauuuu

SEQ ID NO: 1005596 - RNA, 22 nt, Human
ugccagccagggaagcucaccc

SEQ ID NO: 1005597 - RNA, 22 nt, Human
gcuggcagucccaucagcuggg

SEQ ID NO: 1005598 - RNA, 22 nt, Human
ucugauuagcaguuuagggaaa

SEQ ID NO: 1005599 - RNA, 22 nt, Human
guccucuguguaggcugcagac

SEQ ID NO: 1005600 - RNA, 18 nt, Human
ucaggcucucuggcuaga

SEQ ID NO: 1005601 - RNA, 22 nt, Human
gugcuaaaggguuaugaacaag

SEQ ID NO: 1005602 - RNA, 20 nt, Human
aaaggaauauaugaaguaua

SEQ ID NO: 1005603 - RNA, 22 nt, Human
acacacagcgccuaccaugugc

SEQ ID NO: 1005604 - RNA, 22 nt, Human
uuguaugagcuccaggaacuca

SEQ ID NO: 1005605 - RNA, 22 nt, Human
uagcuuuagugaaaaauaucag

SEQ ID NO: 1005606 - RNA, 22 nt, Human
agggcugaagggaggugcucau

SEQ ID NO: 1005607 - RNA, 22 nt, Human
uucagagagaaaccagugggaa

SEQ ID NO: 1005608 - RNA, 22 nt, Human
ugcaggcuggaggagggacuaa

SEQ ID NO: 1005609 - RNA, 22 nt, Human
ucccagccuuccagucugguuu

SEQ ID NO: 1005610 - RNA, 20 nt, Human
cuggggacagcaauggcugu

SEQ ID NO: 1005611 - RNA, 22 nt, Human
cccagcuugcccaggacugagg

SEQ ID NO: 1005612 - RNA, 22 nt, Human
gugugaaagcuuguccucugua

SEQ ID NO: 1005613 - RNA, 22 nt, Human
ggcuuuauuaagcaggguaagu

SEQ ID NO: 1005614 - RNA, 22 nt, Human
cagaugaggggcauauaacaau

SEQ ID NO: 1005615 - RNA, 22 nt, Human
ugagaaaugggucugcugaaga

SEQ ID NO: 1005616 - RNA, 22 nt, Human
cagccucugagccuuggcagau

SEQ ID NO: 1005617 - RNA, 22 nt, Human
uggcgucucucauaaguaugug

SEQ ID NO: 1005618 - RNA, 22 nt, Human
ccagccucacuggcaucaccua

SEQ ID NO: 1005619 - RNA, 22 nt, Human
uucugucacagugcugguauca

SEQ ID NO: 1005620 - RNA, 22 nt, Human
uguaggaaaaacaaugaucugc

SEQ ID NO: 1005621 - RNA, 22 nt, Human
uuucauaauagugcaguuuguu

SEQ ID NO: 1005622 - RNA, 22 nt, Human
uccccaccccagaacuacuagg

SEQ ID NO: 1005623 - RNA, 22 nt, Human
gugauaaagacgugucauaauu

SEQ ID NO: 1005624 - RNA, 22 nt, Human
uaacuuucacaucacacugacu

SEQ ID NO: 1005625 - RNA, 20 nt, Human
cugcagggugagugggcgau

SEQ ID NO: 1005626 - RNA, 22 nt, Human
gccuccuguuaugccaugugcc

SEQ ID NO: 1005627 - RNA, 22 nt, Human
guucugggaagguggaccuguu

SEQ ID NO: 1005628 - RNA, 22 nt, Human
uaggccauucuuggagcuuacu

SEQ ID NO: 1005629 - RNA, 22 nt, Human
cucccagguuccgacgccucuu

SEQ ID NO: 1005630 - RNA, 22 nt, Human
cuaggaaugguaccucuuacaa

SEQ ID NO: 1005631 - RNA, 22 nt, Human
ugcuuuauggauuuguguccug

SEQ ID NO: 1005632 - RNA, 22 nt, Human
ccuuuauucaauuaguccuaau

SEQ ID NO: 1005633 - RNA, 22 nt, Human
acagcuuuuaugggaccagcca

SEQ ID NO: 1005634 - RNA, 22 nt, Human
gcaaguacaaacgcaucggcug

SEQ ID NO: 1005635 - RNA, 22 nt, Human
ccugggcuggaguacagcagug

SEQ ID NO: 1005636 - RNA, 22 nt, Human
gccugcagaacugugaggcaau

SEQ ID NO: 1005637 - RNA, 19 nt, Human
uccaggcauccuucaggcu

SEQ ID NO: 1005638 - RNA, 22 nt, Human
agagugaaguucaucgugcagc

SEQ ID NO: 1005639 - RNA, 22 nt, Human
ucagggacugcagagggaagcu

SEQ ID NO: 1005640 - RNA, 22 nt, Human
ucuggcaggcaaucggcucugg

SEQ ID NO: 1005641 - RNA, 22 nt, Human
uauuaaauuauggauuuaggag

SEQ ID NO: 1005642 - RNA, 22 nt, Human
aggacaguccgggguccuccac

SEQ ID NO: 1005643 - RNA, 22 nt, Human
uauguaaaguagauggcaggua

SEQ ID NO: 1005644 - RNA, 22 nt, Human
acugccaaugguaguuugaugg

SEQ ID NO: 1005645 - RNA, 22 nt, Human
cacaggccugucucuuucuaac

SEQ ID NO: 1005646 - RNA, 22 nt, Human
auguaugagagauucuuuuauu

SEQ ID NO: 1005647 - RNA, 22 nt, Human
uuguuucaggaugguuuguuac

SEQ ID NO: 1005648 - RNA, 22 nt, Human
aucugggggagcugcucaugga

SEQ ID NO: 1005649 - RNA, 22 nt, Human
ucuuugaugugguuaauuauga

SEQ ID NO: 1005650 - RNA, 19 nt, Human
uccugcagguggcuugcag

SEQ ID NO: 1005651 - RNA, 22 nt, Human
gcacccaggcuugggcagcaac

SEQ ID NO: 1005652 - RNA, 22 nt, Human
ccugggcucaagcgaucuuguc

SEQ ID NO: 1005653 - RNA, 22 nt, Human
cucaaauauaagcuaaaugugg

SEQ ID NO: 1005654 - RNA, 22 nt, Human
ccugggcuccacuccaagagca

SEQ ID NO: 1005655 - RNA, 22 nt, Human
cacaugcaucugucauguuugg

SEQ ID NO: 1005656 - RNA, 22 nt, Human
aauuacuuaagagaaacuuuga

SEQ ID NO: 1005657 - RNA, 22 nt, Human
auuuauuaugggauuuggcuca

SEQ ID NO: 1005658 - RNA, 22 nt, Human
gccugcagccucagagaauuuu

SEQ ID NO: 1005659 - RNA, 22 nt, Human
gugaaacacccuccaaugcaca

SEQ ID NO: 1005660 - RNA, 22 nt, Human
uuccaagugcccauauuucauc

SEQ ID NO: 1005661 - RNA, 22 nt, Human
uccugagccugacaaucaccau

SEQ ID NO: 1005662 - RNA, 22 nt, Human
uuaaauuccagccucauaauag

SEQ ID NO: 1005663 - RNA, 22 nt, Human
ucugcucugggccagcuauuaa

SEQ ID NO: 1005664 - RNA, 22 nt, Human
cuuaauuuuuguaguagaugga

SEQ ID NO: 1005665 - RNA, 22 nt, Human
agcucugacugaagagaugcaa

SEQ ID NO: 1005666 - RNA, 22 nt, Human
ugucuucaguaaaauacacuau

SEQ ID NO: 1005667 - RNA, 22 nt, Human
auucacaugugcuucuuaucac

SEQ ID NO: 1005668 - RNA, 22 nt, Human
aaauuauuaugccccucuauaa

SEQ ID NO: 1005669 - RNA, 22 nt, Human
caggaguggugugagggacucc

SEQ ID NO: 1005670 - RNA, 17 nt, Human
ucugcagaggcaaaccu

SEQ ID NO: 1005671 - RNA, 22 nt, Human
aguuagaauagucagauuguag

SEQ ID NO: 1005672 - RNA, 22 nt, Human
cuucuggguaauucuucuucau

SEQ ID NO: 1005673 - RNA, 22 nt, Human
gcugggcucugucaugccuucc

SEQ ID NO: 1005674 - RNA, 22 nt, Human
cgggcuccgggucuuugcaguc

SEQ ID NO: 1005675 - RNA, 22 nt, Human
aaauccuaccaagaaauucccu

SEQ ID NO: 1005676 - RNA, 22 nt, Human
uacuuacacagcuguagaaggu

SEQ ID NO: 1005677 - RNA, 22 nt, Human
uuuacucuugcuacacaacugu

SEQ ID NO: 1005678 - RNA, 22 nt, Human
guguuuuaucagacaaaguaua

SEQ ID NO: 1005679 - RNA, 22 nt, Human
ccaggaccuggagcucuaugaa

SEQ ID NO: 1005680 - RNA, 22 nt, Human
ggcucccaggagggccuggagg

SEQ ID NO: 1005681 - RNA, 22 nt, Human
guccucuggugaaagcauuccc

SEQ ID NO: 1005682 - RNA, 22 nt, Human
gacacagagcucacagucuccu

SEQ ID NO: 1005683 - RNA, 21 nt, Human
uaaauaauaaguugcugagau

SEQ ID NO: 1005684 - RNA, 20 nt, Human
aaagagcccuuggagcaggc

SEQ ID NO: 1005685 - RNA, 22 nt, Human
auucucaguucacuaguuucuu

SEQ ID NO: 1005686 - RNA, 22 nt, Human
gccaaaucuggauuuagcaaga

SEQ ID NO: 1005687 - RNA, 22 nt, Human
ucuuaaaccacaaaauucagag

SEQ ID NO: 1005688 - RNA, 22 nt, Human
ugcuucuggcuuaucucgugcc

SEQ ID NO: 1005689 - RNA, 20 nt, Human
cccaggcagagcuagcggca

SEQ ID NO: 1005690 - RNA, 22 nt, Human
aaguguuuauuuauaacgaucu

SEQ ID NO: 1005691 - RNA, 22 nt, Human
aaaguucuaaaacucuuuguga

SEQ ID NO: 1005692 - RNA, 22 nt, Human
uacaaagucacauugaaaugaa

SEQ ID NO: 1005693 - RNA, 22 nt, Human
ucaggguugcugugaucagucc

SEQ ID NO: 1005694 - RNA, 22 nt, Human
caugaaaucugaguauguuucc

SEQ ID NO: 1005695 - RNA, 22 nt, Human
agccauccucccaccucagccu

SEQ ID NO: 1005696 - RNA, 22 nt, Human
aggacaguguggaagagggugc

SEQ ID NO: 1005697 - RNA, 22 nt, Human
aauagauacuacuuagauguag

SEQ ID NO: 1005698 - RNA, 22 nt, Human
gaaacaugucugacaauuuacc

SEQ ID NO: 1005699 - RNA, 22 nt, Human
acagacuggccugucucgcacc

SEQ ID NO: 1005700 - RNA, 22 nt, Human
gagggcucaacuacuacuaggc

SEQ ID NO: 1005701 - RNA, 22 nt, Human
cagagaaagggugaauuccuuc

SEQ ID NO: 1005702 - RNA, 23 nt, Human
cacacccaucacuaagagcuccu

SEQ ID NO: 1005703 - RNA, 22 nt, Human
acagcucuguugccagaucugc

SEQ ID NO: 1005704 - RNA, 19 nt, Human
ccugccugagcugucccuc

SEQ ID NO: 1005705 - RNA, 22 nt, Human
cuacccagcaccuaggcugccu

SEQ ID NO: 1005706 - RNA, 22 nt, Human
cagcuuuggcccagucgggagg

SEQ ID NO: 1005707 - RNA, 22 nt, Human
uuauucagucugucuagggagu

SEQ ID NO: 1005708 - RNA, 22 nt, Human
cuccugaggacuucuauugggu

SEQ ID NO: 1005709 - RNA, 22 nt, Human
guaaaauugcaauuacuuuugc

SEQ ID NO: 1005710 - RNA, 22 nt, Human
cucuccaggacuuuggcccaau

SEQ ID NO: 1005711 - RNA, 22 nt, Human
gggguggccaaggacucugacc

SEQ ID NO: 1005712 - RNA, 22 nt, Human
gauggccuggguccccuuccgg

SEQ ID NO: 1005713 - RNA, 22 nt, Human
gaaauauucuugucuuguuuuc

SEQ ID NO: 1005714 - RNA, 22 nt, Human
ccccuguguuguucaaggguca

SEQ ID NO: 1005715 - RNA, 22 nt, Human
cuuucauuugauaagaaugcca

SEQ ID NO: 1005716 - RNA, 22 nt, Human
agcuuuauauaaaagaguacau

SEQ ID NO: 1005717 - RNA, 22 nt, Human
uaaaguuuggcagacaauaaca

SEQ ID NO: 1005718 - RNA, 22 nt, Human
caggauggucucgaucuccuga

SEQ ID NO: 1005719 - RNA, 22 nt, Human
uauacaaugaguacauucuggg

SEQ ID NO: 1005720 - RNA, 22 nt, Human
uacccagcccaugccuaccuca

SEQ ID NO: 1005721 - RNA, 22 nt, Human
auuauuagacuuauaugguagu

SEQ ID NO: 1005722 - RNA, 22 nt, Human
gcucucagaugcuccagcagcc

SEQ ID NO: 1005723 - RNA, 22 nt, Human
uuuucauuguaaaucaggaaac

SEQ ID NO: 1005724 - RNA, 22 nt, Human
cugcagggagaggggacagccu

SEQ ID NO: 1005725 - RNA, 22 nt, Human
accaugaucugcucugguguuu

SEQ ID NO: 1005726 - RNA, 22 nt, Human
ugucuuuagaaagaagcagaca

SEQ ID NO: 1005727 - RNA, 22 nt, Human
cgcugauaaacgucacguuccc

SEQ ID NO: 1005728 - RNA, 22 nt, Human
cuccagugagugagcaggcgac

SEQ ID NO: 1005729 - RNA, 22 nt, Human
gaggagggagcuggaagcucuu

SEQ ID NO: 1005730 - RNA, 22 nt, Human
uccaggcaaagugcugggcugc

SEQ ID NO: 1005731 - RNA, 22 nt, Human
auauauuuacucuccuguugca

SEQ ID NO: 1005732 - RNA, 22 nt, Human
uuccaagugaaaguagcuuugu

SEQ ID NO: 1005733 - RNA, 19 nt, Human
ccuugccugucccugcagc

SEQ ID NO: 1005734 - RNA, 22 nt, Human
uaacacauaucuacaacaugug

SEQ ID NO: 1005735 - RNA, 22 nt, Human
uuucuuauacuauauugucauc

SEQ ID NO: 1005736 - RNA, 22 nt, Human
aggccccaaagcagugcaagua

SEQ ID NO: 1005737 - RNA, 22 nt, Human
ucccaggcuggcaggcagcagu

SEQ ID NO: 1005738 - RNA, 22 nt, Human
acagguggaggcuuuaggaggu

SEQ ID NO: 1005739 - RNA, 22 nt, Human
ucacuguaaaguaauacuguca

SEQ ID NO: 1005740 - RNA, 21 nt, Human
cagacccucuagaggccaccu

SEQ ID NO: 1005741 - RNA, 22 nt, Human
uucaagauggccccagugagcc

SEQ ID NO: 1005742 - RNA, 22 nt, Human
uucuggggccccaguguccucg

SEQ ID NO: 1005743 - RNA, 22 nt, Human
ugcauguuaagaaaauauugag

SEQ ID NO: 1005744 - RNA, 22 nt, Human
uguuccaauaaggaguugaaau

SEQ ID NO: 1005745 - RNA, 22 nt, Human
uuggcuucuugugaaaucugag

SEQ ID NO: 1005746 - RNA, 22 nt, Human
ucccugugagaaaugaagcagg

SEQ ID NO: 1005747 - RNA, 22 nt, Human
aaguuucauuguucauguaaca

SEQ ID NO: 1005748 - RNA, 22 nt, Human
cagcccaggccgacaguuccuc

SEQ ID NO: 1005749 - RNA, 22 nt, Human
uucuuugcccuuaaugaaauaa

SEQ ID NO: 1005750 - RNA, 22 nt, Human
ggggaccuggccacccauccuu

SEQ ID NO: 1005751 - RNA, 22 nt, Human
uccaggcaaaaaccaacuacag

SEQ ID NO: 1005752 - RNA, 22 nt, Human
uccaggcauuggagagauaaug

SEQ ID NO: 1005753 - RNA, 19 nt, Human
uuuacucuccaaggugagu

SEQ ID NO: 1005754 - RNA, 22 nt, Human
cucugaauggacacuccagugu

SEQ ID NO: 1005755 - RNA, 22 nt, Human
uccugcagccacugcaggcaga

SEQ ID NO: 1005756 - RNA, 21 nt, Human
acacacugaguuuuccacugu

SEQ ID NO: 1005757 - RNA, 22 nt, Human
ccagcucucaaggcucccuggg

SEQ ID NO: 1005758 - RNA, 23 nt, Human
aaacaugcagcacaugaaugcua

SEQ ID NO: 1005759 - RNA, 22 nt, Human
ucccuccuggccgucaccgcug

SEQ ID NO: 1005760 - RNA, 22 nt, Human
guggcagggcuuugcuguucuu

SEQ ID NO: 1005761 - RNA, 19 nt, Human
cacacccaugcuugccaag

SEQ ID NO: 1005762 - RNA, 22 nt, Human
ugggcuccucgucacucgcugu

SEQ ID NO: 1005763 - RNA, 22 nt, Human
agauauguuuguauauauuugu

SEQ ID NO: 1005764 - RNA, 22 nt, Human
auucacaguuuccucauauucu

SEQ ID NO: 1005765 - RNA, 22 nt, Human
ccuggggauucugacacggagu

SEQ ID NO: 1005766 - RNA, 22 nt, Human
uuccaagucuaaguuauaaauc

SEQ ID NO: 1005767 - RNA, 22 nt, Human
uagauauguguuuauuaugcug

SEQ ID NO: 1005768 - RNA, 22 nt, Human
accaggcagagcugggccuuaa

SEQ ID NO: 1005769 - RNA, 22 nt, Human
acagagagaggcccgaggcugc

SEQ ID NO: 1005770 - RNA, 22 nt, Human
acugggcuuauuucuugugaac

SEQ ID NO: 1005771 - RNA, 22 nt, Human
uuuuucuuaaauguggguuggc

SEQ ID NO: 1005772 - RNA, 22 nt, Human
caggcagcugacugucagauau

SEQ ID NO: 1005773 - RNA, 18 nt, Human
cccucuugcacaaagcaa

SEQ ID NO: 1005774 - RNA, 22 nt, Human
uugucaaguaaggcugacauuu

SEQ ID NO: 1005775 - RNA, 22 nt, Human
uccaggagaggccugaccaggu

SEQ ID NO: 1005776 - RNA, 22 nt, Human
ucagcuuugggggucucaggag

SEQ ID NO: 1005777 - RNA, 20 nt, Human
cccagagccauagccagaca

SEQ ID NO: 1005778 - RNA, 22 nt, Human
aaguaugugauacauguuaauu

SEQ ID NO: 1005779 - RNA, 18 nt, Human
cuacauucauaggaaagg

SEQ ID NO: 1005780 - RNA, 22 nt, Human
agacuucuuugugagcauuuuc

SEQ ID NO: 1005781 - RNA, 22 nt, Human
uuaaauauuuucagcaggguca

SEQ ID NO: 1005782 - RNA, 22 nt, Human
uuucacauaaauauuaugccua

SEQ ID NO: 1005783 - RNA, 22 nt, Human
acccaggguagaaccucagagc

SEQ ID NO: 1005784 - RNA, 21 nt, Human
guacacacagguggaugggcu

SEQ ID NO: 1005785 - RNA, 22 nt, Human
aaauuucuguuguuuugagcca

SEQ ID NO: 1005786 - RNA, 22 nt, Human
gggcuaggcuuggccagcacug

SEQ ID NO: 1005787 - RNA, 22 nt, Human
ugggcagggagcuggaaccaca

SEQ ID NO: 1005788 - RNA, 23 nt, Human
acaggcucuuaaucagugcuccu

SEQ ID NO: 1005789 - RNA, 22 nt, Human
ugcaggcuggcagugcugaaau

SEQ ID NO: 1005790 - RNA, 20 nt, Human
agcauuugaaauaugacuau

SEQ ID NO: 1005791 - RNA, 22 nt, Human
aaguauuucguucugaaaaagu

SEQ ID NO: 1005792 - RNA, 22 nt, Human
uuugcuuguucaagauuucugu

SEQ ID NO: 1005793 - RNA, 20 nt, Human
auacacaugcagacagaugc

SEQ ID NO: 1005794 - RNA, 22 nt, Human
ucugggcugaaaugaaggccuu

SEQ ID NO: 1005795 - RNA, 22 nt, Human
uagcuuuaaugaguugguaaga

SEQ ID NO: 1005796 - RNA, 22 nt, Human
cccugcagugugaccucaccua

SEQ ID NO: 1005797 - RNA, 22 nt, Human
ucugcagauuuaucagcagcug

SEQ ID NO: 1005798 - RNA, 22 nt, Human
gaggagcucugcuccauccuuc

SEQ ID NO: 1005799 - RNA, 22 nt, Human
ccugggcugcucauggggauga

SEQ ID NO: 1005800 - RNA, 22 nt, Human
cagagggcucggcggccgcucc

SEQ ID NO: 1005801 - RNA, 17 nt, Human
gcaucacagauaacacg

SEQ ID NO: 1005802 - RNA, 19 nt, Human
cagcccucuuaccacugug

SEQ ID NO: 1005803 - RNA, 22 nt, Human
cuguaaauaugaagaauauaug

SEQ ID NO: 1005804 - RNA, 20 nt, Human
gccugcagagaaggucagag

SEQ ID NO: 1005805 - RNA, 22 nt, Human
gcacccagcccagggcgugaug

SEQ ID NO: 1005806 - RNA, 22 nt, Human
auggcagacgaggcagcagggg

SEQ ID NO: 1005807 - RNA, 22 nt, Human
gggccccuuguaucucuggcuc

SEQ ID NO: 1005808 - RNA, 22 nt, Human
augggcugagaaucaagaauau

SEQ ID NO: 1005809 - RNA, 22 nt, Human
uuaggaauauuuucugaguagu

SEQ ID NO: 1005810 - RNA, 18 nt, Human
uccuggcagucagagagg

SEQ ID NO: 1005811 - RNA, 23 nt, Human
ugcagggcaaguuagagacccca

SEQ ID NO: 1005812 - RNA, 22 nt, Human
acacacagaaggaagccccacu

SEQ ID NO: 1005813 - RNA, 22 nt, Human
cagauuuagaguggggcuugga

SEQ ID NO: 1005814 - RNA, 22 nt, Human
cuccaggguuccccgauccacu

SEQ ID NO: 1005815 - RNA, 22 nt, Human
ugcuuuauugcaucaguguggg

SEQ ID NO: 1005816 - RNA, 22 nt, Human
aaaguuugucacuuggcuagaa

SEQ ID NO: 1005817 - RNA, 22 nt, Human
ccaggcccaggguacugaccaa

SEQ ID NO: 1005818 - RNA, 22 nt, Human
ugcuuuauucagucucugccau

SEQ ID NO: 1005819 - RNA, 22 nt, Human
ccuggcaguuuugcccaggauu

SEQ ID NO: 1005820 - RNA, 22 nt, Human
uauauguaagcuauguaagagu

SEQ ID NO: 1005821 - RNA, 22 nt, Human
ugugaaaagggcuuuguacaaa

SEQ ID NO: 1005822 - RNA, 22 nt, Human
cacauacuuguguguacauaug

SEQ ID NO: 1005823 - RNA, 22 nt, Human
auuaagggccaauccuccagcc

SEQ ID NO: 1005824 - RNA, 21 nt, Human
ugucagagcuuguaggacauu

SEQ ID NO: 1005825 - RNA, 22 nt, Human
acagcuuuaguguggguggugc

SEQ ID NO: 1005826 - RNA, 22 nt, Human
cauaauuucccaagagauugaa

SEQ ID NO: 1005827 - RNA, 22 nt, Human
cagggcuccccgcaccgcagcc

SEQ ID NO: 1005828 - RNA, 22 nt, Human
ccccacccaccuaagagaaacu

SEQ ID NO: 1005829 - RNA, 21 nt, Human
uccugcagaaugccuuccuac

SEQ ID NO: 1005830 - RNA, 22 nt, Human
cucagagaaaaggagcaagggu

SEQ ID NO: 1005831 - RNA, 22 nt, Human
acauacuuaugcuaaaaauaua

SEQ ID NO: 1005832 - RNA, 22 nt, Human
cagagcauuaaaaccagcucug

SEQ ID NO: 1005833 - RNA, 22 nt, Human
cuggcagucugguggaaggccu

SEQ ID NO: 1005834 - RNA, 22 nt, Human
uacauguuugguaaaugauggc

SEQ ID NO: 1005835 - RNA, 22 nt, Human
uuuaauuuuccugguaggccug

SEQ ID NO: 1005836 - RNA, 22 nt, Human
ucagagaguuuucacuagggug

SEQ ID NO: 1005837 - RNA, 22 nt, Human
gagaggcugaaaucacaggagc

SEQ ID NO: 1005838 - RNA, 22 nt, Human
caguguggagggagagagccug

SEQ ID NO: 1005839 - RNA, 22 nt, Human
ugcaggcuguaaucugaggcua

SEQ ID NO: 1005840 - RNA, 22 nt, Human
ugcaaaauaaugaacgauuuuu

SEQ ID NO: 1005841 - RNA, 22 nt, Human
ugggaccucucuugagagagca

SEQ ID NO: 1005842 - RNA, 22 nt, Human
caguuuauuuccaagaugacaa

SEQ ID NO: 1005843 - RNA, 17 nt, Human
cccaggccgccgggagc

SEQ ID NO: 1005844 - RNA, 22 nt, Human
augacaugaccugguagagaca

SEQ ID NO: 1005845 - RNA, 22 nt, Human
cccagcuugucugauucagccu

SEQ ID NO: 1005846 - RNA, 22 nt, Human
guuucauuaccugacccaugag

SEQ ID NO: 1005847 - RNA, 22 nt, Human
uacccagggcuuuucugaugca

SEQ ID NO: 1005848 - RNA, 22 nt, Human
aaacaucaccauuuuaccuaau

SEQ ID NO: 1005849 - RNA, 22 nt, Human
ucuccgaucacagguuuucaau

SEQ ID NO: 1005850 - RNA, 22 nt, Human
cggcuggugucgggcacagcaa

SEQ ID NO: 1005851 - RNA, 22 nt, Human
uauaauuuuaagugguaaauua

SEQ ID NO: 1005852 - RNA, 22 nt, Human
uugaaaaaauugguagaggaug

SEQ ID NO: 1005853 - RNA, 22 nt, Human
ucccacccauccugcaucucuu

SEQ ID NO: 1005854 - RNA, 22 nt, Human
aacagcaugcuggguaacauug

SEQ ID NO: 1005855 - RNA, 20 nt, Human
ccugggcuccaggagccccg

SEQ ID NO: 1005856 - RNA, 22 nt, Human
auguagaaaguucauagaugcg

SEQ ID NO: 1005857 - RNA, 22 nt, Human
acugggcugguuaguuuuacua

SEQ ID NO: 1005858 - RNA, 22 nt, Human
ucuuuuucugcacacguguccc

SEQ ID NO: 1005859 - RNA, 22 nt, Human
ucaucccuaaggacagcucugc

SEQ ID NO: 1005860 - RNA, 22 nt, Human
aggcugcuucagcugcagggag

SEQ ID NO: 1005861 - RNA, 22 nt, Human
ucagcuuucuauguugcuaaac

SEQ ID NO: 1005862 - RNA, 22 nt, Human
uguaugaagguuuaccugcugu

SEQ ID NO: 1005863 - RNA, 22 nt, Human
auauuugucaauucacuguuca

SEQ ID NO: 1005864 - RNA, 22 nt, Human
acaucacagagcccagauaaag

SEQ ID NO: 1005865 - RNA, 22 nt, Human
aggcuuuaauuaucuacaggag

SEQ ID NO: 1005866 - RNA, 22 nt, Human
aacaggcaggagaauucugccu

SEQ ID NO: 1005867 - RNA, 22 nt, Human
auguaauuugcccucaaguuaa

SEQ ID NO: 1005868 - RNA, 22 nt, Human
gaggcugcuuugaugacaggag

SEQ ID NO: 1005869 - RNA, 22 nt, Human
ucugcagaauucgaggaagaaa

SEQ ID NO: 1005870 - RNA, 22 nt, Human
cagggcucccucuggcucccag

SEQ ID NO: 1005871 - RNA, 22 nt, Human
cucuuaaaaacuugauauauuu

SEQ ID NO: 1005872 - RNA, 22 nt, Human
cccacccugggcuacacaucca

SEQ ID NO: 1005873 - RNA, 22 nt, Human
gggcugcaaugcuucaguuguu

SEQ ID NO: 1005874 - RNA, 22 nt, Human
acaugauauuaaugucuuauuu

SEQ ID NO: 1005875 - RNA, 22 nt, Human
gcauguuuugcaacaagugacc

SEQ ID NO: 1005876 - RNA, 22 nt, Human
gguggcagagaggagguaguuu

SEQ ID NO: 1005877 - RNA, 22 nt, Human
uaacacauuaguucuccuagau

SEQ ID NO: 1005878 - RNA, 22 nt, Human
cauguuaaugaauuuuugcagu

SEQ ID NO: 1005879 - RNA, 22 nt, Human
cugcucuagagagcauuaguca

SEQ ID NO: 1005880 - RNA, 22 nt, Human
auauacuuggagacuaucauug

SEQ ID NO: 1005881 - RNA, 20 nt, Human
ccccacacuauugagcacuu

SEQ ID NO: 1005882 - RNA, 22 nt, Human
uacagagacuuuauggcacaaa

SEQ ID NO: 1005883 - RNA, 22 nt, Human
cgacccuacagacagugcugag

SEQ ID NO: 1005884 - RNA, 22 nt, Human
ggaaucagaauuaggauuugaa

SEQ ID NO: 1005885 - RNA, 22 nt, Human
ggcauccaaauaccaagaugua

SEQ ID NO: 1005886 - RNA, 22 nt, Human
ccuggggaagucacuucucuuu

SEQ ID NO: 1005887 - RNA, 22 nt, Human
ucuggcaggacaugcugaccau

SEQ ID NO: 1005888 - RNA, 22 nt, Human
auccaggccccaagaccccgac

SEQ ID NO: 1005889 - RNA, 22 nt, Human
ggcucccugccuguccucaguc

SEQ ID NO: 1005890 - RNA, 22 nt, Human
aagagcaucaaugacucgcagu

SEQ ID NO: 1005891 - RNA, 22 nt, Human
ucucugaagauauuuauuauua

SEQ ID NO: 1005892 - RNA, 22 nt, Human
guuuauuauucaacuucauguu

SEQ ID NO: 1005893 - RNA, 22 nt, Human
cagagcauugagggucugccaa

SEQ ID NO: 1005894 - RNA, 22 nt, Human
auuucucagcacuuccuaucuc

SEQ ID NO: 1005895 - RNA, 22 nt, Human
ggguuccuccaguuccuagagc

SEQ ID NO: 1005896 - RNA, 22 nt, Human
cacaggcugcccgcagcuggga

SEQ ID NO: 1005897 - RNA, 22 nt, Human
ucuggcaguggaugagggcagc

SEQ ID NO: 1005898 - RNA, 22 nt, Human
aaccugcaguuuuuauucugag

SEQ ID NO: 1005899 - RNA, 22 nt, Human
auugaaaaaugacuauugcuua

SEQ ID NO: 1005900 - RNA, 22 nt, Human
agagcacagaagaauaggugcu

SEQ ID NO: 1005901 - RNA, 22 nt, Human
ccuggcagguuacaaccaguua

SEQ ID NO: 1005902 - RNA, 23 nt, Human
uccaggcaugagcucuggaugga

SEQ ID NO: 1005903 - RNA, 22 nt, Human
agggcccuagggaaugagacau

SEQ ID NO: 1005904 - RNA, 22 nt, Human
ccccaggcagggccuaacagag

SEQ ID NO: 1005905 - RNA, 20 nt, Human
uccaggcagcucagaguguc

SEQ ID NO: 1005906 - RNA, 22 nt, Human
gccaggcagcaggaagccagug

SEQ ID NO: 1005907 - RNA, 17 nt, Human
uauacacagacagacug

SEQ ID NO: 1005908 - RNA, 21 nt, Human
ccacuguagacucauucugag

SEQ ID NO: 1005909 - RNA, 22 nt, Human
aauuauguagccauaugaaaca

SEQ ID NO: 1005910 - RNA, 22 nt, Human
ugcccccuuuucuuguuacacu

SEQ ID NO: 1005911 - RNA, 19 nt, Human
ugcuucuggaaccaugauc

SEQ ID NO: 1005912 - RNA, 22 nt, Human
aaccccgcucaggcugggugag

SEQ ID NO: 1005913 - RNA, 22 nt, Human
uccaggcauagaaggcacgcac

SEQ ID NO: 1005914 - RNA, 22 nt, Human
gcagcuuucuuuuugcaugucu

SEQ ID NO: 1005915 - RNA, 22 nt, Human
acacacagaguuuauacaggca

SEQ ID NO: 1005916 - RNA, 19 nt, Human
ccagagagcuagguacaga

SEQ ID NO: 1005917 - RNA, 22 nt, Human
aauauaaugcuguuuuaugcca

SEQ ID NO: 1005918 - RNA, 22 nt, Human
acagugugguuugagcacuggg

SEQ ID NO: 1005919 - RNA, 22 nt, Human
ccagcuuuucuuaucauuauaa

SEQ ID NO: 1005920 - RNA, 22 nt, Human
augggcugcuuggcuuccaccc

SEQ ID NO: 1005921 - RNA, 22 nt, Human
ugccugccaugcagaaagcuga

SEQ ID NO: 1005922 - RNA, 22 nt, Human
cuaggaauccuuuuagaguugg

SEQ ID NO: 1005923 - RNA, 22 nt, Human
gccaagcuuugcaggaguguug

SEQ ID NO: 1005924 - RNA, 22 nt, Human
aagagccagcuagugaagaggc

SEQ ID NO: 1005925 - RNA, 22 nt, Human
aagggcucuucuauuuauggcc

SEQ ID NO: 1005926 - RNA, 22 nt, Human
cuccagggggcauccacacagc

SEQ ID NO: 1005927 - RNA, 22 nt, Human
gcuggggacuccccaccauagc

SEQ ID NO: 1005928 - RNA, 22 nt, Human
uaacacauauuugcaguaagca

SEQ ID NO: 1005929 - RNA, 19 nt, Human
uugaaauuguuugauaugg

SEQ ID NO: 1005930 - RNA, 18 nt, Human
cauaauuuucuuucuuua

SEQ ID NO: 1005931 - RNA, 22 nt, Human
ugaaacuucuaauaugaauagu

SEQ ID NO: 1005932 - RNA, 18 nt, Human
gccugcucugcucucccc

SEQ ID NO: 1005933 - RNA, 22 nt, Human
agguauuauuagcaucucuauu

SEQ ID NO: 1005934 - RNA, 18 nt, Human
ugaccugcgcuucacggu

SEQ ID NO: 1005935 - RNA, 22 nt, Human
ccaggcucaccuggagccccug

SEQ ID NO: 1005936 - RNA, 22 nt, Human
auuguuaugaaaauaagauguu

SEQ ID NO: 1005937 - RNA, 22 nt, Human
gcuggggagcaagaguagugag

SEQ ID NO: 1005938 - RNA, 22 nt, Human
gcaaauacauguugagcaccua

SEQ ID NO: 1005939 - RNA, 22 nt, Human
cauuagggucucucagcugaau

SEQ ID NO: 1005940 - RNA, 19 nt, Human
agcaacaccguuuauuucc

SEQ ID NO: 1005941 - RNA, 22 nt, Human
uguaugaaagaacaagggcuua

SEQ ID NO: 1005942 - RNA, 22 nt, Human
gacccaggguauccagagcugc

SEQ ID NO: 1005943 - RNA, 22 nt, Human
uucugucagaagcuagcuccug

SEQ ID NO: 1005944 - RNA, 22 nt, Human
gcaggcucuucuuucugcccag

SEQ ID NO: 1005945 - RNA, 22 nt, Human
ugggcuuaggucggaggcggcc

SEQ ID NO: 1005946 - RNA, 20 nt, Human
gcugggcuuugacugacaca

SEQ ID NO: 1005947 - RNA, 22 nt, Human
gccaggcaguucaaguacacca

SEQ ID NO: 1005948 - RNA, 22 nt, Human
guggcagugggaugcuaucagg

SEQ ID NO: 1005949 - RNA, 22 nt, Human
cagcuuugcaggcuggucagug

SEQ ID NO: 1005950 - RNA, 22 nt, Human
uauaaaguuucgaaagauguau

SEQ ID NO: 1005951 - RNA, 22 nt, Human
cacucuccagcacaccccauuu

SEQ ID NO: 1005952 - RNA, 22 nt, Human
ggaccugcauuuuaacaagauc

SEQ ID NO: 1005953 - RNA, 22 nt, Human
uaauuucuagggacuaaggugc

SEQ ID NO: 1005954 - RNA, 22 nt, Human
auuuaugauuagccuauuguug

SEQ ID NO: 1005955 - RNA, 22 nt, Human
gccugcagacguguuuuccuca

SEQ ID NO: 1005956 - RNA, 22 nt, Human
cccacacaaaucauggggagaa

SEQ ID NO: 1005957 - RNA, 22 nt, Human
uccugcagagacagaggccuca

SEQ ID NO: 1005958 - RNA, 22 nt, Human
ugcuggcacguggaccaggaga

SEQ ID NO: 1005959 - RNA, 18 nt, Human
gggcucacacaggucauc

SEQ ID NO: 1005960 - RNA, 22 nt, Human
aaaauauuuuagggccaggaga

SEQ ID NO: 1005961 - RNA, 22 nt, Human
ccaggcucaggccugcucguug

SEQ ID NO: 1005962 - RNA, 22 nt, Human
ucuggcaggucaaucauucuuu

SEQ ID NO: 1005963 - RNA, 22 nt, Human
aggaccauccuaagguaggcaa

SEQ ID NO: 1005964 - RNA, 22 nt, Human
caacacauugaagcuaugauga

SEQ ID NO: 1005965 - RNA, 22 nt, Human
aaagacuuggcuuaugauuugc

SEQ ID NO: 1005966 - RNA, 22 nt, Human
aauaacuucauguaacauuuaa

SEQ ID NO: 1005967 - RNA, 22 nt, Human
auuccacagcuacaucaaucua

SEQ ID NO: 1005968 - RNA, 22 nt, Human
uugaagcagagaaauacuugaa

SEQ ID NO: 1005969 - RNA, 22 nt, Human
uccugaggcacaauccuagaau

SEQ ID NO: 1005970 - RNA, 22 nt, Human
uugggaagaaacauguccauca

SEQ ID NO: 1005971 - RNA, 20 nt, Human
ugccuggccuuucucugccc

SEQ ID NO: 1005972 - RNA, 22 nt, Human
guauuaggaggaacacaggccu

SEQ ID NO: 1005973 - RNA, 22 nt, Human
ucuggcaggauaucgaagugaa

SEQ ID NO: 1005974 - RNA, 22 nt, Human
uuauucagauuggcuacaggau

SEQ ID NO: 1005975 - RNA, 20 nt, Human
gagggcucguggauggauaa

SEQ ID NO: 1005976 - RNA, 22 nt, Human
ucugggcugggagcguguggac

SEQ ID NO: 1005977 - RNA, 22 nt, Human
ggaccugcccuggcucagaugc

SEQ ID NO: 1005978 - RNA, 22 nt, Human
uccaggccauugacugcauccu

SEQ ID NO: 1005979 - RNA, 22 nt, Human
acaugauuuuaguaucauaaua

SEQ ID NO: 1005980 - RNA, 22 nt, Human
guuuuacacaccuaugaaagac

SEQ ID NO: 1005981 - RNA, 22 nt, Human
auuaauuuccaggcacugugcu

SEQ ID NO: 1005982 - RNA, 22 nt, Human
aaggcuuuuguuccuauuuagu

SEQ ID NO: 1005983 - RNA, 22 nt, Human
ccagcuuuauagcuucaaagga

SEQ ID NO: 1005984 - RNA, 22 nt, Human
aacacagaucaaaauauuuccu

SEQ ID NO: 1005985 - RNA, 22 nt, Human
uaacuuucuucauaugugaacc

SEQ ID NO: 1005986 - RNA, 22 nt, Human
uuauauaucuugauuuguucca

SEQ ID NO: 1005987 - RNA, 22 nt, Human
aaugucauugguaaagauuagg

SEQ ID NO: 1005988 - RNA, 22 nt, Human
uuuagggaauagaagaucugaa

SEQ ID NO: 1005989 - RNA, 22 nt, Human
agggcuacugccugccuucagg

SEQ ID NO: 1005990 - RNA, 20 nt, Human
acaaagacuggaaaagcaag

SEQ ID NO: 1005991 - RNA, 22 nt, Human
gcagcuuuaaucugaauaagua

SEQ ID NO: 1005992 - RNA, 23 nt, Human
uuccaagugcuuuacuuaauccu

SEQ ID NO: 1005993 - RNA, 22 nt, Human
aaauauguaagauuagcacuag

SEQ ID NO: 1005994 - RNA, 22 nt, Human
ccuuuaaagacugcauaacuuc

SEQ ID NO: 1005995 - RNA, 22 nt, Human
cucccaagauaaauaaggcagu

SEQ ID NO: 1005996 - RNA, 19 nt, Human
ggcaggcuggauagagagg

SEQ ID NO: 1005997 - RNA, 22 nt, Human
uucagugucaauuuuuaaauau

SEQ ID NO: 1005998 - RNA, 22 nt, Human
acaugauuaaaagauuuuaaag

SEQ ID NO: 1005999 - RNA, 22 nt, Human
ucauauaacuggauauuuucaa

SEQ ID NO: 1006000 - RNA, 21 nt, Human
uccugcagggcagcagagugg

SEQ ID NO: 1006001 - RNA, 22 nt, Human
ugcaggcugugucauuuaguga

SEQ ID NO: 1006002 - RNA, 22 nt, Human
uaugaagcuuugaaaagcuuac

SEQ ID NO: 1006003 - RNA, 18 nt, Human
uagggcucuagggaguga

SEQ ID NO: 1006004 - RNA, 22 nt, Human
ugaagccaaucugccaggcaga

SEQ ID NO: 1006005 - RNA, 22 nt, Human
ggcuuuauauuguuugagcaga

SEQ ID NO: 1006006 - RNA, 18 nt, Human
ugcaggcugggguuccuc

SEQ ID NO: 1006007 - RNA, 22 nt, Human
agggacuauuuacccaucucac

SEQ ID NO: 1006008 - RNA, 22 nt, Human
aaugaagccacugaagacaauc

SEQ ID NO: 1006009 - RNA, 22 nt, Human
ggcagaccucuccagccccaca

SEQ ID NO: 1006010 - RNA, 22 nt, Human
acuggcagaacuggugauuguc

SEQ ID NO: 1006011 - RNA, 22 nt, Human
gguuucaacucagcuaguaagg

SEQ ID NO: 1006012 - RNA, 22 nt, Human
ggaggugggcuaaggacucucu

SEQ ID NO: 1006013 - RNA, 22 nt, Human
gaggagcugagccacguccugg

SEQ ID NO: 1006014 - RNA, 22 nt, Human
guauuaggugguggaauuguag

SEQ ID NO: 1006015 - RNA, 22 nt, Human
caauacugaguuuacauucauc

SEQ ID NO: 1006016 - RNA, 22 nt, Human
uccuggcagagggcggccucga

SEQ ID NO: 1006017 - RNA, 22 nt, Human
gaaaacuaacggaaaaguuagg

SEQ ID NO: 1006018 - RNA, 19 nt, Human
ccagcccacagugacuuuc

SEQ ID NO: 1006019 - RNA, 22 nt, Human
ucuggggaugaggaccuagaug

SEQ ID NO: 1006020 - RNA, 22 nt, Human
agacacagcugcaggagguggg

SEQ ID NO: 1006021 - RNA, 22 nt, Human
cuuaaauuuucaucuacaagaa

SEQ ID NO: 1006022 - RNA, 20 nt, Human
ucaggcuccgcauuaacuua

SEQ ID NO: 1006023 - RNA, 22 nt, Human
gcuggcagacugggggcagaac

SEQ ID NO: 1006024 - RNA, 22 nt, Human
ggccucagggucacucuguaga

SEQ ID NO: 1006025 - RNA, 22 nt, Human
ucaugaacaucucaaauaacca

SEQ ID NO: 1006026 - RNA, 22 nt, Human
uguacauacauagauauacaca

SEQ ID NO: 1006027 - RNA, 22 nt, Human
aaaguuagacagcaucauuucu

SEQ ID NO: 1006028 - RNA, 22 nt, Human
cuacauaaucuggauuugucug

SEQ ID NO: 1006029 - RNA, 22 nt, Human
gggguggcccuacccucuggaa

SEQ ID NO: 1006030 - RNA, 22 nt, Human
aacagcauaaguauuuauuuca

SEQ ID NO: 1006031 - RNA, 22 nt, Human
ucuggcagaaggcagaaauuca

SEQ ID NO: 1006032 - RNA, 22 nt, Human
ucuggcagagugauaggauaag

SEQ ID NO: 1006033 - RNA, 22 nt, Human
auucugucuaagcuggcuacgu

SEQ ID NO: 1006034 - RNA, 22 nt, Human
gagcuuuaccuuagguucuguu

SEQ ID NO: 1006035 - RNA, 22 nt, Human
ugcaggcugcucaagacuuagu

SEQ ID NO: 1006036 - RNA, 22 nt, Human
uuucugaacaaagccauuauca

SEQ ID NO: 1006037 - RNA, 22 nt, Human
cuggggaccagugucuguuugu

SEQ ID NO: 1006038 - RNA, 22 nt, Human
cuggccucauagccaagcugug

SEQ ID NO: 1006039 - RNA, 22 nt, Human
guacccagaggcaugaucccag

SEQ ID NO: 1006040 - RNA, 22 nt, Human
ucuccugggaggacaaggaagg

SEQ ID NO: 1006041 - RNA, 20 nt, Human
uucugucagauuauauggga

SEQ ID NO: 1006042 - RNA, 22 nt, Human
uguaaaauaauucuccauguuu

SEQ ID NO: 1006043 - RNA, 22 nt, Human
caauuucucuuuauaucucaca

SEQ ID NO: 1006044 - RNA, 22 nt, Human
guggcuuggaccagucacagug

SEQ ID NO: 1006045 - RNA, 22 nt, Human
augggcugacuaaugguaaacu

SEQ ID NO: 1006046 - RNA, 22 nt, Human
aauacuuuccuauauaaggugc

SEQ ID NO: 1006047 - RNA, 22 nt, Human
aagcuuuagagaugaguuccuu

SEQ ID NO: 1006048 - RNA, 22 nt, Human
ccccuuccuuccucagacagcc

SEQ ID NO: 1006049 - RNA, 22 nt, Human
uaugacauuauaaaggauuauu

SEQ ID NO: 1006050 - RNA, 22 nt, Human
uccccacacagauacagaguag

SEQ ID NO: 1006051 - RNA, 22 nt, Human
ugcuuuauggagcccaucucau

SEQ ID NO: 1006052 - RNA, 22 nt, Human
uucugggggaauacagcuauga

SEQ ID NO: 1006053 - RNA, 22 nt, Human
augggcuggccuuucccgcucu

SEQ ID NO: 1006054 - RNA, 22 nt, Human
ccagcuuuccugcgaguugauu

SEQ ID NO: 1006055 - RNA, 22 nt, Human
ccacaggcugcugcaggucccg

SEQ ID NO: 1006056 - RNA, 22 nt, Human
gcuuuuaauuaguugcuuccau

SEQ ID NO: 1006057 - RNA, 22 nt, Human
ucuggggagugccuaaguggaa

SEQ ID NO: 1006058 - RNA, 22 nt, Human
cacacacuguuaauguaggagu

SEQ ID NO: 1006059 - RNA, 22 nt, Human
uuccaaguugagcgauuuuccu

SEQ ID NO: 1006060 - RNA, 22 nt, Human
cgcaggcuuuagaaucugcuac

SEQ ID NO: 1006061 - RNA, 22 nt, Human
agaggccggccgagcccauggg

SEQ ID NO: 1006062 - RNA, 23 nt, Human
ccaggcucuuucaccugcuauuc

SEQ ID NO: 1006063 - RNA, 22 nt, Human
ucuccaagcagggcugcaaggc

SEQ ID NO: 1006064 - RNA, 22 nt, Human
ugaaagauugugauucaauaug

SEQ ID NO: 1006065 - RNA, 22 nt, Human
uucacauaaugauacaaagcuu

SEQ ID NO: 1006066 - RNA, 22 nt, Human
uugggcucaggaguuugagacc

SEQ ID NO: 1006067 - RNA, 19 nt, Human
uccuggcauuuguaggaaa

SEQ ID NO: 1006068 - RNA, 22 nt, Human
accaagcuguauauuauugguu

SEQ ID NO: 1006069 - RNA, 22 nt, Human
acagcuuuugaaaaauuacugg

SEQ ID NO: 1006070 - RNA, 22 nt, Human
uagaacacuugaccacugcucc

SEQ ID NO: 1006071 - RNA, 22 nt, Human
cagagagcaugggaggcccgag

SEQ ID NO: 1006072 - RNA, 22 nt, Human
cacacaucaaccuagacauugu

SEQ ID NO: 1006073 - RNA, 22 nt, Human
agguuuauguuuggugcaggag

SEQ ID NO: 1006074 - RNA, 22 nt, Human
uauacaauggcugaaucaucca

SEQ ID NO: 1006075 - RNA, 22 nt, Human
aauacuauguagccaaaauaau

SEQ ID NO: 1006076 - RNA, 22 nt, Human
acaucugaggagaccagccucu

SEQ ID NO: 1006077 - RNA, 22 nt, Human
uguuugaacugaauaacauagu

SEQ ID NO: 1006078 - RNA, 23 nt, Human
acuccccagucucuucuugccaa

SEQ ID NO: 1006079 - RNA, 22 nt, Human
agcucccauuaucuucugaaac

SEQ ID NO: 1006080 - RNA, 20 nt, Human
uggaccugucucuuuaggga

SEQ ID NO: 1006081 - RNA, 21 nt, Human
agccugcaauguagguaccgg

SEQ ID NO: 1006082 - RNA, 22 nt, Human
cccaggcagccccagaagcuug

SEQ ID NO: 1006083 - RNA, 22 nt, Human
ucauguuauugacucauaauau

SEQ ID NO: 1006084 - RNA, 22 nt, Human
uggaacacuuuguugaaaugca

SEQ ID NO: 1006085 - RNA, 22 nt, Human
ucauuuguucaucugcucuucu

SEQ ID NO: 1006086 - RNA, 22 nt, Human
gcaggcuccaacuggaggaguu

SEQ ID NO: 1006087 - RNA, 22 nt, Human
agcacaggaccaaggaagcugu

SEQ ID NO: 1006088 - RNA, 22 nt, Human
gcuaggaggaagaaugugaauu

SEQ ID NO: 1006089 - RNA, 22 nt, Human
uauuaggguaaauuugacaugc

SEQ ID NO: 1006090 - RNA, 22 nt, Human
cuuaauuuaaaauaguucaggc

SEQ ID NO: 1006091 - RNA, 22 nt, Human
ccacagaccuuggcuuccaccu

SEQ ID NO: 1006092 - RNA, 22 nt, Human
cgcaggcuccggggugcccugg

SEQ ID NO: 1006093 - RNA, 22 nt, Human
uauguacuaacuuucauucuag

SEQ ID NO: 1006094 - RNA, 22 nt, Human
ccaggcucacagcaucccagga

SEQ ID NO: 1006095 - RNA, 22 nt, Human
ugcuucugaacucagcaugugg

SEQ ID NO: 1006096 - RNA, 22 nt, Human
aguaugaauacagauuuucucu

SEQ ID NO: 1006097 - RNA, 22 nt, Human
auggcagagggauugaacagcu

SEQ ID NO: 1006098 - RNA, 22 nt, Human
gggaccugcgccacucacuguc

SEQ ID NO: 1006099 - RNA, 22 nt, Human
aaacagcaggaacaucuugcca

SEQ ID NO: 1006100 - RNA, 22 nt, Human
uuauuuaggagaaggaacccug

SEQ ID NO: 1006101 - RNA, 22 nt, Human
agcucugacauugauucucagc

SEQ ID NO: 1006102 - RNA, 17 nt, Human
ggagaucuggcagaggg

SEQ ID NO: 1006103 - RNA, 22 nt, Human
guuuuccugaaacugauggugu

SEQ ID NO: 1006104 - RNA, 22 nt, Human
uagggaccuuagaauuguaugu

SEQ ID NO: 1006105 - RNA, 22 nt, Human
uuuaauuuuccucuuccuggag

SEQ ID NO: 1006106 - RNA, 22 nt, Human
cugggcugaaaguguuccuuga

SEQ ID NO: 1006107 - RNA, 22 nt, Human
aucacaauguacguuaaaaugu

SEQ ID NO: 1006108 - RNA, 22 nt, Human
uugggaucucaaauccagcuau

SEQ ID NO: 1006109 - RNA, 22 nt, Human
ugggagaaacugucucucccac

SEQ ID NO: 1006110 - RNA, 22 nt, Human
caugaagcucuugcaccucuag

SEQ ID NO: 1006111 - RNA, 22 nt, Human
ggcccagcgaggccaccuacag

SEQ ID NO: 1006112 - RNA, 22 nt, Human
ccuggggaaucuugcaggggaa

SEQ ID NO: 1006113 - RNA, 22 nt, Human
uuuuacuuaauucuuggucaug

SEQ ID NO: 1006114 - RNA, 22 nt, Human
cccugagcgugaggaggaagua

SEQ ID NO: 1006115 - RNA, 19 nt, Human
cacaucagcagggcugugg

SEQ ID NO: 1006116 - RNA, 22 nt, Human
ccuggcagguggcgcccucggc

SEQ ID NO: 1006117 - RNA, 22 nt, Human
uguaugaagccagaaucuguuu

SEQ ID NO: 1006118 - RNA, 22 nt, Human
ggacuccucuagaaguugaggc

SEQ ID NO: 1006119 - RNA, 22 nt, Human
uccaggcaucuguauuuuuuaa

SEQ ID NO: 1006120 - RNA, 22 nt, Human
ggcagggaguggagacucccua

SEQ ID NO: 1006121 - RNA, 22 nt, Human
cuccaguggcaaguccgggcgg

SEQ ID NO: 1006122 - RNA, 22 nt, Human
uguaaagaaagacgcagaguua

SEQ ID NO: 1006123 - RNA, 22 nt, Human
uuucucuugcgauaugcuacac

SEQ ID NO: 1006124 - RNA, 22 nt, Human
cugcagggaacugaggcccaga

SEQ ID NO: 1006125 - RNA, 22 nt, Human
ccagagaguaggaggcauuauu

SEQ ID NO: 1006126 - RNA, 22 nt, Human
uuugauaagagcugcugaaacu

SEQ ID NO: 1006127 - RNA, 22 nt, Human
aaauacauaaagguuguaccag

SEQ ID NO: 1006128 - RNA, 22 nt, Human
gagaaagacguaggcugggagg

SEQ ID NO: 1006129 - RNA, 22 nt, Human
uucaauaucauuguuuagucuc

SEQ ID NO: 1006130 - RNA, 22 nt, Human
agugccccaugggugccugggg

SEQ ID NO: 1006131 - RNA, 23 nt, Human
ugggaccuguuugcccacagaug

SEQ ID NO: 1006132 - RNA, 22 nt, Human
uccaggcaaagccuuguagacg

SEQ ID NO: 1006133 - RNA, 22 nt, Human
acaagagcauugcagguguguu

SEQ ID NO: 1006134 - RNA, 22 nt, Human
ccuggcaggcaagaggaaggga

SEQ ID NO: 1006135 - RNA, 22 nt, Human
gcuucuggagucuucagaggaa

SEQ ID NO: 1006136 - RNA, 22 nt, Human
gccaagcucuuuaaaggccaaa

SEQ ID NO: 1006137 - RNA, 22 nt, Human
uaugacuuauuucaucaguucu

SEQ ID NO: 1006138 - RNA, 23 nt, Human
aacagccaacuuuagcggguggc

SEQ ID NO: 1006139 - RNA, 22 nt, Human
cugcuuuagacaacugcuggga

SEQ ID NO: 1006140 - RNA, 22 nt, Human
aauaauuauuugagagcagacc

SEQ ID NO: 1006141 - RNA, 22 nt, Human
guuagguagaaguuuacuuuga

SEQ ID NO: 1006142 - RNA, 22 nt, Human
auucaagagcccauguuuccug

SEQ ID NO: 1006143 - RNA, 22 nt, Human
aagagcacuaacagagcugaua

SEQ ID NO: 1006144 - RNA, 22 nt, Human
auguagaauuccuucuacuuug

SEQ ID NO: 1006145 - RNA, 22 nt, Human
uugaauuagacuuugcuacagg

SEQ ID NO: 1006146 - RNA, 22 nt, Human
aauauguuccacuuaaagcugg

SEQ ID NO: 1006147 - RNA, 22 nt, Human
acagagagggagugauaaaucc

SEQ ID NO: 1006148 - RNA, 22 nt, Human
caugaagcauguuuugucauga

SEQ ID NO: 1006149 - RNA, 22 nt, Human
cagggcacggagaagucacccc

SEQ ID NO: 1006150 - RNA, 22 nt, Human
aauuaggggaggacguaucaua

SEQ ID NO: 1006151 - RNA, 22 nt, Human
ucuggcagcaagucuguuucuc

SEQ ID NO: 1006152 - RNA, 22 nt, Human
uugauacaggccuucuagauga

SEQ ID NO: 1006153 - RNA, 22 nt, Human
ucagagagcagaacuuuuuuac

SEQ ID NO: 1006154 - RNA, 22 nt, Human
ccaggcucugugugggcuagag

SEQ ID NO: 1006155 - RNA, 22 nt, Human
cucaccccacuaccccuuggug

SEQ ID NO: 1006156 - RNA, 22 nt, Human
gcuccuggguguggcugccccu

SEQ ID NO: 1006157 - RNA, 22 nt, Human
agagucccagggacacuccaga

SEQ ID NO: 1006158 - RNA, 22 nt, Human
acagauuuuaaaugacacuccc

SEQ ID NO: 1006159 - RNA, 20 nt, Human
gccaggcacuguucucaaua

SEQ ID NO: 1006160 - RNA, 22 nt, Human
uuucuugaccacuauguugaua

SEQ ID NO: 1006161 - RNA, 22 nt, Human
ccuggcagcuguuuggcuuggc

SEQ ID NO: 1006162 - RNA, 22 nt, Human
uucacaauagcuggcaucaucu

SEQ ID NO: 1006163 - RNA, 22 nt, Human
auuacaaucgagagaaacaaau

SEQ ID NO: 1006164 - RNA, 22 nt, Human
acacaucucaggggacacucuc

SEQ ID NO: 1006165 - RNA, 22 nt, Human
cuccagugcacccagaggauuu

SEQ ID NO: 1006166 - RNA, 22 nt, Human
cagcuuuagagaaaacauauuu

SEQ ID NO: 1006167 - RNA, 19 nt, Human
uuuuccuucuauauguuuc

SEQ ID NO: 1006168 - RNA, 22 nt, Human
cagucacauagguauacacaua

SEQ ID NO: 1006169 - RNA, 22 nt, Human
uagcuuuaagaugagaugugga

SEQ ID NO: 1006170 - RNA, 22 nt, Human
ccagagacgucggucagggcgc

SEQ ID NO: 1006171 - RNA, 22 nt, Human
ggccagggggcuucagacucca

SEQ ID NO: 1006172 - RNA, 22 nt, Human
ucaaauauuggcuauuucacau

SEQ ID NO: 1006173 - RNA, 22 nt, Human
gcuggggagaauuggguuaucu

SEQ ID NO: 1006174 - RNA, 22 nt, Human
ugcuucugacugggucaguuga

SEQ ID NO: 1006175 - RNA, 22 nt, Human
ccagcuuucugggugguuucug

SEQ ID NO: 1006176 - RNA, 22 nt, Human
ccccuuccacagugcuuccuaa

SEQ ID NO: 1006177 - RNA, 22 nt, Human
augugcaaauccaaugugaaug

SEQ ID NO: 1006178 - RNA, 22 nt, Human
cccaggcacagauuaucccaau

SEQ ID NO: 1006179 - RNA, 22 nt, Human
uagggcucagcucuagcuccug

SEQ ID NO: 1006180 - RNA, 23 nt, Human
uggccagguagaggagguaguga

SEQ ID NO: 1006181 - RNA, 22 nt, Human
uuccuggccuaagguaggugac

SEQ ID NO: 1006182 - RNA, 22 nt, Human
gccagggaaacugcagaccagc

SEQ ID NO: 1006183 - RNA, 22 nt, Human
gccugcagcugcuuccacacac

SEQ ID NO: 1006184 - RNA, 22 nt, Human
ugggggcugugcacaggcucac

SEQ ID NO: 1006185 - RNA, 22 nt, Human
cuccuggcaggcugagugaaau

SEQ ID NO: 1006186 - RNA, 22 nt, Human
uuuguacauauauaaaaucugu

SEQ ID NO: 1006187 - RNA, 22 nt, Human
cuacaaugacagaauugaguag

SEQ ID NO: 1006188 - RNA, 22 nt, Human
auuuucaucgcuagguuggccu

SEQ ID NO: 1006189 - RNA, 22 nt, Human
ucuagaauuuugccauauagcu

SEQ ID NO: 1006190 - RNA, 22 nt, Human
aguaugaagauuauaauuuuuc

SEQ ID NO: 1006191 - RNA, 22 nt, Human
auuauuaggacuacugggguug

SEQ ID NO: 1006192 - RNA, 22 nt, Human
uccugcagugugucuccugcac

SEQ ID NO: 1006193 - RNA, 22 nt, Human
ucagcuuuccugcagcuaaggg

SEQ ID NO: 1006194 - RNA, 22 nt, Human
uuuaaaaaacuagucugagucu

SEQ ID NO: 1006195 - RNA, 22 nt, Human
cccaggcagcccuucugacgca

SEQ ID NO: 1006196 - RNA, 22 nt, Human
gcacacacuguuuuccucacau

SEQ ID NO: 1006197 - RNA, 21 nt, Human
ccagcccagcugugucccagc

SEQ ID NO: 1006198 - RNA, 22 nt, Human
agcaggcuuuccacagaaggag

SEQ ID NO: 1006199 - RNA, 22 nt, Human
uggcagagaacacggcugaucu

SEQ ID NO: 1006200 - RNA, 22 nt, Human
uccaggcaaagggacuagcagg

SEQ ID NO: 1006201 - RNA, 23 nt, Human
cugcagagaacugagggacagcc

SEQ ID NO: 1006202 - RNA, 22 nt, Human
cagugaggaguccagggcagag

SEQ ID NO: 1006203 - RNA, 22 nt, Human
ugggaccugaagcagguuggca

SEQ ID NO: 1006204 - RNA, 22 nt, Human
gccacagguacuaugggagaga

SEQ ID NO: 1006205 - RNA, 22 nt, Human
uuggcagggccaggcucucucu

SEQ ID NO: 1006206 - RNA, 22 nt, Human
ccuggcagcuccuccccggcgg

SEQ ID NO: 1006207 - RNA, 22 nt, Human
uuauucuucuucucuugccagg

SEQ ID NO: 1006208 - RNA, 22 nt, Human
gcuggcagagcucugggcuggg

SEQ ID NO: 1006209 - RNA, 22 nt, Human
uuggaaagauuauuauuaugaa

SEQ ID NO: 1006210 - RNA, 22 nt, Human
aaggcuuuaugugaccaaaaga

SEQ ID NO: 1006211 - RNA, 22 nt, Human
aaaauccucuaauucuagaaua

SEQ ID NO: 1006212 - RNA, 22 nt, Human
uucuaucauacuugaauacauu

SEQ ID NO: 1006213 - RNA, 22 nt, Human
ugggcucucaaagugcggcuug

SEQ ID NO: 1006214 - RNA, 22 nt, Human
gagggcuccacacgggcccagc

SEQ ID NO: 1006215 - RNA, 22 nt, Human
aggaggcuguggagcacuccau

SEQ ID NO: 1006216 - RNA, 22 nt, Human
aaacucuguagcuaaacauaau

SEQ ID NO: 1006217 - RNA, 22 nt, Human
augcaacaaaugcuacgaaucg

SEQ ID NO: 1006218 - RNA, 22 nt, Human
aaucuuagguuuggcuucaucu

SEQ ID NO: 1006219 - RNA, 22 nt, Human
aaucuuucccuauuaaaugugg

SEQ ID NO: 1006220 - RNA, 22 nt, Human
acacacaauuaguuuuaugcuu

SEQ ID NO: 1006221 - RNA, 22 nt, Human
caggucccugcgccccggccuc

SEQ ID NO: 1006222 - RNA, 22 nt, Human
ugggcuucauaauugguccuag

SEQ ID NO: 1006223 - RNA, 22 nt, Human
ucagagaggcaauacuguuuaa

SEQ ID NO: 1006224 - RNA, 22 nt, Human
ccagcucucuuugaagcauaaa

SEQ ID NO: 1006225 - RNA, 22 nt, Human
gaacaucagucauaauuuaacg

SEQ ID NO: 1006226 - RNA, 19 nt, Human
gucuucugaauguggcugc

SEQ ID NO: 1006227 - RNA, 22 nt, Human
cugcaggacgaccgccucaucu

SEQ ID NO: 1006228 - RNA, 22 nt, Human
cagggagcuggugccagccgac

SEQ ID NO: 1006229 - RNA, 22 nt, Human
gagggaccccaggcuggcccuu

SEQ ID NO: 1006230 - RNA, 22 nt, Human
ccaaguacagauuccuccacug

SEQ ID NO: 1006231 - RNA, 22 nt, Human
ucuggcagaagugcugucagua

SEQ ID NO: 1006232 - RNA, 22 nt, Human
augugagggaaaucagucagaa

SEQ ID NO: 1006233 - RNA, 22 nt, Human
uacccaggggcugagcagaggu

SEQ ID NO: 1006234 - RNA, 20 nt, Human
acuggcagccugccugcugu

SEQ ID NO: 1006235 - RNA, 21 nt, Human
cagugagguccccagccuagg

SEQ ID NO: 1006236 - RNA, 22 nt, Human
uucugucaugcucauguaauug

SEQ ID NO: 1006237 - RNA, 22 nt, Human
auuucacaucuaucucagauuu

SEQ ID NO: 1006238 - RNA, 22 nt, Human
gccagccuucuguggccugcaa

SEQ ID NO: 1006239 - RNA, 18 nt, Human
ugucauaauauaucaccu

SEQ ID NO: 1006240 - RNA, 22 nt, Human
gcagagaguugggcugcgccag

SEQ ID NO: 1006241 - RNA, 22 nt, Human
aggaccugcuaaugugccaagu

SEQ ID NO: 1006242 - RNA, 22 nt, Human
agggaagaagcugguaguaggu

SEQ ID NO: 1006243 - RNA, 22 nt, Human
gccugcagcaugcuaggucuug

SEQ ID NO: 1006244 - RNA, 22 nt, Human
gagguggcuccuucagggaaua

SEQ ID NO: 1006245 - RNA, 22 nt, Human
guccuggcugguucuguggggc

SEQ ID NO: 1006246 - RNA, 22 nt, Human
ggaggacacuggcucugccuuc

SEQ ID NO: 1006247 - RNA, 22 nt, Human
agcaggcugcuggcguugaagu

SEQ ID NO: 1006248 - RNA, 22 nt, Human
cagggcucagggacugcagaaa

SEQ ID NO: 1006249 - RNA, 22 nt, Human
agguggcucugacagcucuggu

SEQ ID NO: 1006250 - RNA, 22 nt, Human
aacaaucaaguuucuaaaugac

SEQ ID NO: 1006251 - RNA, 21 nt, Human
uuucugaaggcaacaucuauc

SEQ ID NO: 1006252 - RNA, 22 nt, Human
caauguaucaaccagaaaguuc

SEQ ID NO: 1006253 - RNA, 22 nt, Human
cuaauguaucauggcucucagc

SEQ ID NO: 1006254 - RNA, 22 nt, Human
gcauagucaguaggauucucaa

SEQ ID NO: 1006255 - RNA, 21 nt, Human
ccugggcugugguuuggagac

SEQ ID NO: 1006256 - RNA, 22 nt, Human
cauuuacacuucuaaccacaag

SEQ ID NO: 1006257 - RNA, 22 nt, Human
auucauuuagguauucacuuac

SEQ ID NO: 1006258 - RNA, 18 nt, Human
ucagagagcagcuuuauu

SEQ ID NO: 1006259 - RNA, 22 nt, Human
gcacauaaagggcaugggaggu

SEQ ID NO: 1006260 - RNA, 22 nt, Human
ucaggcucuacacuugacacac

SEQ ID NO: 1006261 - RNA, 22 nt, Human
agcacaggaacauggagauggg

SEQ ID NO: 1006262 - RNA, 22 nt, Human
aguguggcugcguagggcucuc

SEQ ID NO: 1006263 - RNA, 20 nt, Human
uuaagaaaagcacauccugc

SEQ ID NO: 1006264 - RNA, 22 nt, Human
uuuauuuggcauccagggagaa

SEQ ID NO: 1006265 - RNA, 22 nt, Human
ucauuacaguguuuauaugucu

SEQ ID NO: 1006266 - RNA, 22 nt, Human
uucaaauacauucuuugccacu

SEQ ID NO: 1006267 - RNA, 22 nt, Human
agggaccugcucacugccuggc

SEQ ID NO: 1006268 - RNA, 22 nt, Human
auguuggagucguaaggcaugg

SEQ ID NO: 1006269 - RNA, 22 nt, Human
aaaagagucuuaggcagucaua

SEQ ID NO: 1006270 - RNA, 22 nt, Human
agggcugacagugaggagucaa

SEQ ID NO: 1006271 - RNA, 22 nt, Human
uuuuucaucugauugauaacuc

SEQ ID NO: 1006272 - RNA, 22 nt, Human
cagcuauuuucucauuaaggau

SEQ ID NO: 1006273 - RNA, 22 nt, Human
uuuuaccugaaccacacaguau

SEQ ID NO: 1006274 - RNA, 22 nt, Human
uacacacaugcauuugccuuau

SEQ ID NO: 1006275 - RNA, 22 nt, Human
aaaguuugaaugauauauuagu

SEQ ID NO: 1006276 - RNA, 22 nt, Human
ggcuuuauuucacuguaccaua

SEQ ID NO: 1006277 - RNA, 22 nt, Human
uauugacaauuugugaaacuau

SEQ ID NO: 1006278 - RNA, 22 nt, Human
cuagggacagaaagaggguaga

SEQ ID NO: 1006279 - RNA, 22 nt, Human
acaggcucacagucauuucauu

SEQ ID NO: 1006280 - RNA, 22 nt, Human
guggcagggugcucaucaugca

SEQ ID NO: 1006281 - RNA, 19 nt, Human
cugagagaugcuucacaca

SEQ ID NO: 1006282 - RNA, 22 nt, Human
ucacacacauuugcugucugau

SEQ ID NO: 1006283 - RNA, 22 nt, Human
caggaguccagagugucauuuu

SEQ ID NO: 1006284 - RNA, 22 nt, Human
uaguuaggguucugcagagaca

SEQ ID NO: 1006285 - RNA, 22 nt, Human
ccaggcucuaucccuccuucuu

SEQ ID NO: 1006286 - RNA, 22 nt, Human
guccaguguguuuaucuuggau

SEQ ID NO: 1006287 - RNA, 22 nt, Human
uucuggggcuaauacagagguc

SEQ ID NO: 1006288 - RNA, 22 nt, Human
uacaacauguaaagugguuuaa

SEQ ID NO: 1006289 - RNA, 22 nt, Human
guauuagguuggugcaaaagua

SEQ ID NO: 1006290 - RNA, 22 nt, Human
auuccacacaguaauacucaau

SEQ ID NO: 1006291 - RNA, 22 nt, Human
ucaccagggcuccagccagccu

SEQ ID NO: 1006292 - RNA, 21 nt, Human
guccagagagccggcuccuga

SEQ ID NO: 1006293 - RNA, 22 nt, Human
cagggagcuuucccaggacccu

SEQ ID NO: 1006294 - RNA, 22 nt, Human
cacacugucagguaaauaacac

SEQ ID NO: 1006295 - RNA, 22 nt, Human
ccaggccugcaucugcugcgca

SEQ ID NO: 1006296 - RNA, 22 nt, Human
caguauagaaaguuuuaaauug

SEQ ID NO: 1006297 - RNA, 22 nt, Human
aggaccuguaccucagcaucua

SEQ ID NO: 1006298 - RNA, 22 nt, Human
uuauuagcugggcuucagggug

SEQ ID NO: 1006299 - RNA, 22 nt, Human
cucagagaaccuaagcggagga

SEQ ID NO: 1006300 - RNA, 22 nt, Human
uuccaagugggggaagcugagu

SEQ ID NO: 1006301 - RNA, 22 nt, Human
gagcucagccugaggccuggcu

SEQ ID NO: 1006302 - RNA, 22 nt, Human
acugggcucccaggcuugucau

SEQ ID NO: 1006303 - RNA, 22 nt, Human
caguauuuauggcuugaguauu

SEQ ID NO: 1006304 - RNA, 22 nt, Human
uccaggcuaauuuugcauuguu

SEQ ID NO: 1006305 - RNA, 22 nt, Human
uccaggcaucccccaggacaga

SEQ ID NO: 1006306 - RNA, 18 nt, Human
cccacacagcaguagcuc

SEQ ID NO: 1006307 - RNA, 22 nt, Human
cuuccucccggcccaugcucug

SEQ ID NO: 1006308 - RNA, 22 nt, Human
agccuauuccaggaugagcuca

SEQ ID NO: 1006309 - RNA, 22 nt, Human
cagcucugcugggaggaugcag

SEQ ID NO: 1006310 - RNA, 22 nt, Human
gaaacauacgauuuaggagaaa

SEQ ID NO: 1006311 - RNA, 22 nt, Human
ucuggcagugaagucaugaggu

SEQ ID NO: 1006312 - RNA, 22 nt, Human
gaugccuggcacccagcaagga

SEQ ID NO: 1006313 - RNA, 22 nt, Human
ucacauuuuauaucucugguuu

SEQ ID NO: 1006314 - RNA, 22 nt, Human
aaccucaggcucucuggacaau

SEQ ID NO: 1006315 - RNA, 22 nt, Human
auuucucaucaagugccaacuc

SEQ ID NO: 1006316 - RNA, 23 nt, Human
agagcaucaugaugcuaagucug

SEQ ID NO: 1006317 - RNA, 22 nt, Human
ucccacacuacacgguuguugg

SEQ ID NO: 1006318 - RNA, 20 nt, Human
uuucuggguacucucccucu

SEQ ID NO: 1006319 - RNA, 22 nt, Human
aucuacauaaaacgaauacaua

SEQ ID NO: 1006320 - RNA, 22 nt, Human
ccuggcagcgugccgagcugcg

SEQ ID NO: 1006321 - RNA, 22 nt, Human
gcuggcagggacagcugcgugu

SEQ ID NO: 1006322 - RNA, 22 nt, Human
cccaggcauuuucaacuuuagu

SEQ ID NO: 1006323 - RNA, 17 nt, Human
acaggccugcuugcacu

SEQ ID NO: 1006324 - RNA, 22 nt, Human
cccugcaggggaccugcagccu

SEQ ID NO: 1006325 - RNA, 22 nt, Human
uuccagcuaacucacaucccuu

SEQ ID NO: 1006326 - RNA, 22 nt, Human
ccugcagggaaucgaggcagaa

SEQ ID NO: 1006327 - RNA, 22 nt, Human
uuuguaaauagcaguacucaug

SEQ ID NO: 1006328 - RNA, 22 nt, Human
uccugcagccaagggucaucga

SEQ ID NO: 1006329 - RNA, 22 nt, Human
aagcgccaugguuccugcgcag

SEQ ID NO: 1006330 - RNA, 22 nt, Human
uaauuucacugauaugaaguca

SEQ ID NO: 1006331 - RNA, 19 nt, Human
guccuggcgccgccacacc

SEQ ID NO: 1006332 - RNA, 22 nt, Human
uuucacauucagauauagacuu

SEQ ID NO: 1006333 - RNA, 22 nt, Human
cacaacuuuaggaaccacauuc

SEQ ID NO: 1006334 - RNA, 22 nt, Human
uucauauaaauggaaucagaau

SEQ ID NO: 1006335 - RNA, 22 nt, Human
auuauucuuaugucaucauggc

SEQ ID NO: 1006336 - RNA, 22 nt, Human
gaaauauuguacuggagauguu

SEQ ID NO: 1006337 - RNA, 22 nt, Human
aucuguaaaugcaaauguagcu

SEQ ID NO: 1006338 - RNA, 22 nt, Human
uuucagauggagguuuaggaca

SEQ ID NO: 1006339 - RNA, 20 nt, Human
gcuggcagaugucuugagau

SEQ ID NO: 1006340 - RNA, 22 nt, Human
ggggccuuuucugaauguggaa

SEQ ID NO: 1006341 - RNA, 22 nt, Human
guuuuauaggcuguugcuauau

SEQ ID NO: 1006342 - RNA, 22 nt, Human
agcaggcuuacuuucugauuag

SEQ ID NO: 1006343 - RNA, 22 nt, Human
uauaauguuuuccauggacuga

SEQ ID NO: 1006344 - RNA, 22 nt, Human
agggcugaaguuauggcugagc

SEQ ID NO: 1006345 - RNA, 22 nt, Human
uacccaggaggaaacugaggcu

SEQ ID NO: 1006346 - RNA, 21 nt, Human
ucuggggaagacaucuaggau

SEQ ID NO: 1006347 - RNA, 22 nt, Human
gcuaggagugggauggaagucg

SEQ ID NO: 1006348 - RNA, 22 nt, Human
uaaaggguagguuuuacuguaa

SEQ ID NO: 1006349 - RNA, 22 nt, Human
acagguggggcacuuggagccu

SEQ ID NO: 1006350 - RNA, 22 nt, Human
gaccucagugaauggucaugua

SEQ ID NO: 1006351 - RNA, 22 nt, Human
aguaugaaucucuuuauucugc

SEQ ID NO: 1006352 - RNA, 23 nt, Human
acacugucucauggauagacugc

SEQ ID NO: 1006353 - RNA, 22 nt, Human
agacaggcuuugcuguauauca

SEQ ID NO: 1006354 - RNA, 22 nt, Human
auaaagauuucuuuuucucuac

SEQ ID NO: 1006355 - RNA, 22 nt, Human
gagcucagcaaaggucugugug

SEQ ID NO: 1006356 - RNA, 22 nt, Human
ugaaaaaccucaguccgcuuua

SEQ ID NO: 1006357 - RNA, 22 nt, Human
agcacaggcuuuggugugaggg

SEQ ID NO: 1006358 - RNA, 23 nt, Human
cagcuuucagggcuuuagggaag

SEQ ID NO: 1006359 - RNA, 22 nt, Human
aggcccaaaagaaaccacuggg

SEQ ID NO: 1006360 - RNA, 22 nt, Human
agugauuugggugucagaaagu

SEQ ID NO: 1006361 - RNA, 19 nt, Human
gcagagugggguggagggu

SEQ ID NO: 1006362 - RNA, 22 nt, Human
uguaugaaucucauuuguuuaa

SEQ ID NO: 1006363 - RNA, 22 nt, Human
cacauacauucauguuacucua

SEQ ID NO: 1006364 - RNA, 18 nt, Human
uguagagccagguuugcc

SEQ ID NO: 1006365 - RNA, 22 nt, Human
ccacacugucuaacaaggcaua

SEQ ID NO: 1006366 - RNA, 22 nt, Human
cuauuagguuggugcaaaagua

SEQ ID NO: 1006367 - RNA, 22 nt, Human
auaugugaaugauaucacuuug

SEQ ID NO: 1006368 - RNA, 22 nt, Human
augucaaacacaacaccagugg

SEQ ID NO: 1006369 - RNA, 22 nt, Human
cacucugaugguuucuguucaa

SEQ ID NO: 1006370 - RNA, 22 nt, Human
uccugcagcucugagaagcauc

SEQ ID NO: 1006371 - RNA, 22 nt, Human
gagcucagacucgggccugggg

SEQ ID NO: 1006372 - RNA, 23 nt, Human
uccuuccuuugagaggcuccauc

SEQ ID NO: 1006373 - RNA, 22 nt, Human
ucccagccaggcucuaccacuu

SEQ ID NO: 1006374 - RNA, 22 nt, Human
gagaagcaaucaguggccaccc

SEQ ID NO: 1006375 - RNA, 22 nt, Human
gucaaaaaguagucauuucugu

SEQ ID NO: 1006376 - RNA, 22 nt, Human
cagcuuuauugagguauaauug

SEQ ID NO: 1006377 - RNA, 22 nt, Human
acagaccaaguuuccagcaggu

SEQ ID NO: 1006378 - RNA, 22 nt, Human
cuacauaaauauuuaugugucu

SEQ ID NO: 1006379 - RNA, 23 nt, Human
acuuuauugaccccaggucaguu

SEQ ID NO: 1006380 - RNA, 22 nt, Human
gccugcagggcccuuguggguc

SEQ ID NO: 1006381 - RNA, 22 nt, Human
gaauuugaaaagugaugggaau

SEQ ID NO: 1006382 - RNA, 23 nt, Human
ugagcaucacaggagaaccaggc

SEQ ID NO: 1006383 - RNA, 22 nt, Human
gccaagcuuggaaggaucaugg

SEQ ID NO: 1006384 - RNA, 22 nt, Human
uaauauuucuacccugcugccu

SEQ ID NO: 1006385 - RNA, 22 nt, Human
cuaugagaagaaaacaagauua

SEQ ID NO: 1006386 - RNA, 22 nt, Human
uggcaucuccgacagucuugau

SEQ ID NO: 1006387 - RNA, 22 nt, Human
uguuggaauuaggauacagagg

SEQ ID NO: 1006388 - RNA, 22 nt, Human
uguuuauuacaguucuuggaau

SEQ ID NO: 1006389 - RNA, 22 nt, Human
gggagcuguaagggacagguag

SEQ ID NO: 1006390 - RNA, 22 nt, Human
gccaggcaugggcuucugggcg

SEQ ID NO: 1006391 - RNA, 22 nt, Human
agcacugugauuuauaacauuu

SEQ ID NO: 1006392 - RNA, 22 nt, Human
cagcccaaagccccaggcuaga

SEQ ID NO: 1006393 - RNA, 22 nt, Human
aaucuuuuaggggauccugagg

SEQ ID NO: 1006394 - RNA, 22 nt, Human
agaauccucuucaguaaauucu

SEQ ID NO: 1006395 - RNA, 18 nt, Human
ccaaggccccugcugggg

SEQ ID NO: 1006396 - RNA, 21 nt, Human
auuuucauuuccaggggagga

SEQ ID NO: 1006397 - RNA, 22 nt, Human
ucuggggagcagcccuggugag

SEQ ID NO: 1006398 - RNA, 22 nt, Human
ugcaggcugccuucacagagcc

SEQ ID NO: 1006399 - RNA, 22 nt, Human
caggggccaaggguccagaccu

SEQ ID NO: 1006400 - RNA, 22 nt, Human
auaauauaauccuacuucccau

SEQ ID NO: 1006401 - RNA, 22 nt, Human
ucacacauuucucaaguguagg

SEQ ID NO: 1006402 - RNA, 22 nt, Human
acccaggccugagagacaggag

SEQ ID NO: 1006403 - RNA, 22 nt, Human
ugggcuccggcggccucaggcu

SEQ ID NO: 1006404 - RNA, 22 nt, Human
gagcacccuuugcacaucaguc

SEQ ID NO: 1006405 - RNA, 22 nt, Human
uuucacauuuaggcgugaauug

SEQ ID NO: 1006406 - RNA, 23 nt, Human
auguaucucauccaaggaagcuc

SEQ ID NO: 1006407 - RNA, 22 nt, Human
ugcaggcuggggaggcagacuu

SEQ ID NO: 1006408 - RNA, 22 nt, Human
ugcuuuauucaggguuuacccc

SEQ ID NO: 1006409 - RNA, 22 nt, Human
guccucugauuucuagguauau

SEQ ID NO: 1006410 - RNA, 18 nt, Human
gaugaagcugcuggggau

SEQ ID NO: 1006411 - RNA, 23 nt, Human
agcuuugugaaagcagacauggg

SEQ ID NO: 1006412 - RNA, 22 nt, Human
uguauaaaccauggacagcuuu

SEQ ID NO: 1006413 - RNA, 23 nt, Human
ucuuuucaaugguucuuuaugug

SEQ ID NO: 1006414 - RNA, 20 nt, Human
cugaaccaaggcuuucucag

SEQ ID NO: 1006415 - RNA, 22 nt, Human
aggccuccuggcuccaggccuu

SEQ ID NO: 1006416 - RNA, 22 nt, Human
acuggggauuagggacucagug

SEQ ID NO: 1006417 - RNA, 22 nt, Human
ucacacaugaguaaauacaggg

SEQ ID NO: 1006418 - RNA, 22 nt, Human
aucacauugccagugauuaccc

SEQ ID NO: 1006419 - RNA, 22 nt, Human
ucuguggaaauuuccugaggca

SEQ ID NO: 1006420 - RNA, 22 nt, Human
uuuuucuugugcuggaucuaau

SEQ ID NO: 1006421 - RNA, 21 nt, Human
acagagcauaaugguguggca

SEQ ID NO: 1006422 - RNA, 22 nt, Human
uucacaaaacacuauuuucugg

SEQ ID NO: 1006423 - RNA, 22 nt, Human
gauggcagguaguggucucauc

SEQ ID NO: 1006424 - RNA, 20 nt, Human
gcucugaccauaucaagaca

SEQ ID NO: 1006425 - RNA, 19 nt, Human
gcuggcagaauuuugaacc

SEQ ID NO: 1006426 - RNA, 22 nt, Human
ugggcuuccuggagccugugcu

SEQ ID NO: 1006427 - RNA, 22 nt, Human
cagggcucgcucgcucgcucgc

SEQ ID NO: 1006428 - RNA, 22 nt, Human
cucugucacuucuccagcugag

SEQ ID NO: 1006429 - RNA, 22 nt, Human
cugggcuguuuguucuggucuc

SEQ ID NO: 1006430 - RNA, 22 nt, Human
gccugcagggccugggccuacc

SEQ ID NO: 1006431 - RNA, 22 nt, Human
gugggcuuugcuggauccuucc

SEQ ID NO: 1006432 - RNA, 22 nt, Human
ucuccaggagcaagucacccag

SEQ ID NO: 1006433 - RNA, 22 nt, Human
aagaggucauaccagauaaggg

SEQ ID NO: 1006434 - RNA, 20 nt, Human
auaaaauaacugccacaaga

SEQ ID NO: 1006435 - RNA, 19 nt, Human
agaggccucagcagcuggc

SEQ ID NO: 1006436 - RNA, 22 nt, Human
ugguccuggaagguccugaggg

SEQ ID NO: 1006437 - RNA, 22 nt, Human
gguauaaaugaucagaucgcug

SEQ ID NO: 1006438 - RNA, 20 nt, Human
uucaugggagcaaagaggcc

SEQ ID NO: 1006439 - RNA, 22 nt, Human
gcuggcaguguauuguuagcug

SEQ ID NO: 1006440 - RNA, 22 nt, Human
gccaggcagauaugugagcuua

SEQ ID NO: 1006441 - RNA, 19 nt, Human
cuuuucaucaacagccaau

SEQ ID NO: 1006442 - RNA, 22 nt, Human
caucaaauaggaauauuuggca

SEQ ID NO: 1006443 - RNA, 22 nt, Human
uucccacaguguugaauccucu

SEQ ID NO: 1006444 - RNA, 22 nt, Human
aaacaugagcauuucuguuuaa

SEQ ID NO: 1006445 - RNA, 22 nt, Human
gcagagaggauauuauugucca

SEQ ID NO: 1006446 - RNA, 22 nt, Human
ugcuucugaugugagcagcccc

SEQ ID NO: 1006447 - RNA, 22 nt, Human
ugccaaauugcccuauaaauga

SEQ ID NO: 1006448 - RNA, 22 nt, Human
uaaauuguuuucuagaaguugu

SEQ ID NO: 1006449 - RNA, 22 nt, Human
uccuggcaaagauguugguguu

SEQ ID NO: 1006450 - RNA, 22 nt, Human
agccagagcagggaauuggaca

SEQ ID NO: 1006451 - RNA, 22 nt, Human
gaggcacagucccgaggcaagg

SEQ ID NO: 1006452 - RNA, 22 nt, Human
gacauaauaaucugaccuagau

SEQ ID NO: 1006453 - RNA, 22 nt, Human
ugaauaaucuuggguauuaaua

SEQ ID NO: 1006454 - RNA, 20 nt, Human
ugggcugaggaucaggugcc

SEQ ID NO: 1006455 - RNA, 22 nt, Human
ugagcagaacacgggauccaug

SEQ ID NO: 1006456 - RNA, 22 nt, Human
aaagagucuggcacuguaccag

SEQ ID NO: 1006457 - RNA, 22 nt, Human
ucuagggaacaugggucaagcu

SEQ ID NO: 1006458 - RNA, 18 nt, Human
uccugcagcuucuaugua

SEQ ID NO: 1006459 - RNA, 22 nt, Human
gagcauuuuugucugcauuuua

SEQ ID NO: 1006460 - RNA, 22 nt, Human
guccaggucuggacccugagcc

SEQ ID NO: 1006461 - RNA, 22 nt, Human
cauuagggccaccauaacaaaa

SEQ ID NO: 1006462 - RNA, 22 nt, Human
gccuccggagucacagugucuu

SEQ ID NO: 1006463 - RNA, 18 nt, Human
ugcaggcuguugaaacug

SEQ ID NO: 1006464 - RNA, 22 nt, Human
uuaugggagcaauuggggaggu

SEQ ID NO: 1006465 - RNA, 22 nt, Human
cuugggcucugugggccuuagu

SEQ ID NO: 1006466 - RNA, 22 nt, Human
cuuacaaauacacuuaggagag

SEQ ID NO: 1006467 - RNA, 22 nt, Human
ccacuguaguuaugaugaaguu

SEQ ID NO: 1006468 - RNA, 22 nt, Human
uguauaaauuuaaauuccugcu

SEQ ID NO: 1006469 - RNA, 22 nt, Human
acuuaaaaagaaucuuuucacg

SEQ ID NO: 1006470 - RNA, 22 nt, Human
auguuugacugaguuuggcaga

SEQ ID NO: 1006471 - RNA, 22 nt, Human
cauguacaaaaggcaaaugccu

SEQ ID NO: 1006472 - RNA, 22 nt, Human
aauguaugaagguuccaguuuc

SEQ ID NO: 1006473 - RNA, 22 nt, Human
cuucuuaaauuggauugcuauu

SEQ ID NO: 1006474 - RNA, 22 nt, Human
auucagcaaugagcuuggauuu

SEQ ID NO: 1006475 - RNA, 22 nt, Human
aggaccuguguuuuccuugaau

SEQ ID NO: 1006476 - RNA, 22 nt, Human
ugugucaauuuucauuccuacu

SEQ ID NO: 1006477 - RNA, 22 nt, Human
uggcaguggauaggggagcggu

SEQ ID NO: 1006478 - RNA, 22 nt, Human
aucugucuugccuugcauauuu

SEQ ID NO: 1006479 - RNA, 22 nt, Human
gaugaagcuauuugguuggcac

SEQ ID NO: 1006480 - RNA, 22 nt, Human
uuggaacaugccgggguccagg

SEQ ID NO: 1006481 - RNA, 22 nt, Human
gccuggcauauaguaguugugc

SEQ ID NO: 1006482 - RNA, 23 nt, Human
uugggaaauaguuaagacaugag

SEQ ID NO: 1006483 - RNA, 22 nt, Human
uuucuuuguuguuaucacauca

SEQ ID NO: 1006484 - RNA, 22 nt, Human
auuacucugucugccucugacc

SEQ ID NO: 1006485 - RNA, 22 nt, Human
cugggcugucaguuuuguuuua

SEQ ID NO: 1006486 - RNA, 22 nt, Human
ugcaggcuggauuugcuuuugu

SEQ ID NO: 1006487 - RNA, 22 nt, Human
cacagucacauaucuaugugug

SEQ ID NO: 1006488 - RNA, 22 nt, Human
ugagggacucccggcccugcca

SEQ ID NO: 1006489 - RNA, 16 nt, Human
cuacccagugagaagg

SEQ ID NO: 1006490 - RNA, 22 nt, Human
cacacacucuuccuggcaccua

SEQ ID NO: 1006491 - RNA, 22 nt, Human
ggccucaguuucuucaacugua

SEQ ID NO: 1006492 - RNA, 22 nt, Human
gagggaccuuuacacagacauu

SEQ ID NO: 1006493 - RNA, 22 nt, Human
acagugugaugggccugccuga

SEQ ID NO: 1006494 - RNA, 22 nt, Human
auuucucaguguacauuauguu

SEQ ID NO: 1006495 - RNA, 22 nt, Human
ggcggguguaaguaggacagcg

SEQ ID NO: 1006496 - RNA, 22 nt, Human
uuggaaaaacacgauagugguu

SEQ ID NO: 1006497 - RNA, 21 nt, Human
ggccucagccaccuggcucug

SEQ ID NO: 1006498 - RNA, 22 nt, Human
ugcuagaagauagcuagaagau

SEQ ID NO: 1006499 - RNA, 22 nt, Human
ucucaaaucaaacuuugagcuu

SEQ ID NO: 1006500 - RNA, 22 nt, Human
cuggcaguuggcauuggcaucu

SEQ ID NO: 1006501 - RNA, 22 nt, Human
uccaggcacgaggcccugugca

SEQ ID NO: 1006502 - RNA, 22 nt, Human
guuuauuaacugucaagugauu

SEQ ID NO: 1006503 - RNA, 18 nt, Human
acacugcagcagucugcu

SEQ ID NO: 1006504 - RNA, 22 nt, Human
aggaagaaccuaagaaagucuc

SEQ ID NO: 1006505 - RNA, 22 nt, Human
uccugcaggggcugaggaacca

SEQ ID NO: 1006506 - RNA, 22 nt, Human
cuuaaaaucuggcaguuagcua

SEQ ID NO: 1006507 - RNA, 22 nt, Human
ugcaggcucacccuggagcuga

SEQ ID NO: 1006508 - RNA, 22 nt, Human
agggcuccaggggaccaucagu

SEQ ID NO: 1006509 - RNA, 22 nt, Human
auuuugcuggucugaauuacuu

SEQ ID NO: 1006510 - RNA, 22 nt, Human
auaugaagaauuccaauuugga

SEQ ID NO: 1006511 - RNA, 22 nt, Human
gggcuccaccuagggacacugg

SEQ ID NO: 1006512 - RNA, 22 nt, Human
gacuuuggcaucuagacauugu

SEQ ID NO: 1006513 - RNA, 22 nt, Human
uccacccugcuuuugucuuuga

SEQ ID NO: 1006514 - RNA, 16 nt, Human
ucacauacuuccuugc

SEQ ID NO: 1006515 - RNA, 22 nt, Human
gccugcagccccucugcaguag

SEQ ID NO: 1006516 - RNA, 22 nt, Human
aaugauuggcacuagauacaca

SEQ ID NO: 1006517 - RNA, 22 nt, Human
cagguggcuucucccuaggcca

SEQ ID NO: 1006518 - RNA, 23 nt, Human
uuuuaauuuggacauaagaagau

SEQ ID NO: 1006519 - RNA, 22 nt, Human
aauuagggaggacaaagguaca

SEQ ID NO: 1006520 - RNA, 19 nt, Human
cauuuagaaguacauauua

SEQ ID NO: 1006521 - RNA, 21 nt, Human
auuuucauuaauucagugugg

SEQ ID NO: 1006522 - RNA, 22 nt, Human
ucugucaaaugagcaaguaacu

SEQ ID NO: 1006523 - RNA, 22 nt, Human
gggaccugccaaggccacccag

SEQ ID NO: 1006524 - RNA, 22 nt, Human
agacaucauguuacagauuaag

SEQ ID NO: 1006525 - RNA, 20 nt, Human
ugccaggcacggagugcaug

SEQ ID NO: 1006526 - RNA, 22 nt, Human
cuucccacuaguaucacagagc

SEQ ID NO: 1006527 - RNA, 22 nt, Human
ucaucaguuuagaaaaaauaug

SEQ ID NO: 1006528 - RNA, 22 nt, Human
ugcaggcugggaagagggacaa

SEQ ID NO: 1006529 - RNA, 22 nt, Human
uuuaaagugcugcuccuauccu

SEQ ID NO: 1006530 - RNA, 22 nt, Human
cacauaauacauguuccacuua

SEQ ID NO: 1006531 - RNA, 20 nt, Human
agacccucuggacugggccc

SEQ ID NO: 1006532 - RNA, 19 nt, Human
cugcagggaugugcagagu

SEQ ID NO: 1006533 - RNA, 19 nt, Human
ucuuuucacgcauuuugaa

SEQ ID NO: 1006534 - RNA, 22 nt, Human
gugcauuugugcaugcacaugu

SEQ ID NO: 1006535 - RNA, 22 nt, Human
ugcacaggaggcuguggagaag

SEQ ID NO: 1006536 - RNA, 22 nt, Human
auccugugcaaugacugcaucu

SEQ ID NO: 1006537 - RNA, 21 nt, Human
gaugaagcaaucuuucuguug

SEQ ID NO: 1006538 - RNA, 22 nt, Human
uccugcagucugcacucugccu

SEQ ID NO: 1006539 - RNA, 20 nt, Human
gcauccagacacccagcugc

SEQ ID NO: 1006540 - RNA, 22 nt, Human
cuguaaaacacuguaguaucug

SEQ ID NO: 1006541 - RNA, 23 nt, Human
aguaugaauucauuguuuuaguu

SEQ ID NO: 1006542 - RNA, 22 nt, Human
ccagugcccagcugcccaggca

SEQ ID NO: 1006543 - RNA, 22 nt, Human
caccugcaaggagcuuucauuu

SEQ ID NO: 1006544 - RNA, 22 nt, Human
cuucuggguugcaggucuuggc

SEQ ID NO: 1006545 - RNA, 22 nt, Human
aaguguuuacuuaaagucaugg

SEQ ID NO: 1006546 - RNA, 19 nt, Human
uccuggcacaguggaacca

SEQ ID NO: 1006547 - RNA, 22 nt, Human
aucuuuuacauuacugcccaga

SEQ ID NO: 1006548 - RNA, 22 nt, Human
uacaaaugaguuguaugaacca

SEQ ID NO: 1006549 - RNA, 22 nt, Human
gcccaggccggagagcagugcu

SEQ ID NO: 1006550 - RNA, 22 nt, Human
auuauaaagaacaugugugugg

SEQ ID NO: 1006551 - RNA, 22 nt, Human
augugaaaauccaauggcagca

SEQ ID NO: 1006552 - RNA, 22 nt, Human
uacauugcuagaaauguauuuu

SEQ ID NO: 1006553 - RNA, 22 nt, Human
uacagcauauacagaaugaaca

SEQ ID NO: 1006554 - RNA, 22 nt, Human
uuauuauagauuaugcaagauu

SEQ ID NO: 1006555 - RNA, 22 nt, Human
uggcagagagacucuccuugau

SEQ ID NO: 1006556 - RNA, 22 nt, Human
aggaccugacuggcuccugcuu

SEQ ID NO: 1006557 - RNA, 22 nt, Human
ggagaagaggagcuggaagccu

SEQ ID NO: 1006558 - RNA, 22 nt, Human
ugaaugauguauaauauugaga

SEQ ID NO: 1006559 - RNA, 22 nt, Human
cauuuguauguuccuccuuagg

SEQ ID NO: 1006560 - RNA, 22 nt, Human
augcuauacauaugacaucaca

SEQ ID NO: 1006561 - RNA, 22 nt, Human
cauaauuucacugucguauggc

SEQ ID NO: 1006562 - RNA, 22 nt, Human
uuugaaaagaaccaucgccuua

SEQ ID NO: 1006563 - RNA, 22 nt, Human
cagggcucaggcucugggauuc

SEQ ID NO: 1006564 - RNA, 23 nt, Human
uguggcugagaaauugacaacuu

SEQ ID NO: 1006565 - RNA, 22 nt, Human
cuguaugaguugggaauagaau

SEQ ID NO: 1006566 - RNA, 21 nt, Human
gaaaagcaagggaguagaaca

SEQ ID NO: 1006567 - RNA, 22 nt, Human
cuuucauucuuagauauuagug

SEQ ID NO: 1006568 - RNA, 22 nt, Human
uagauauggccgucuguuuuaa

SEQ ID NO: 1006569 - RNA, 22 nt, Human
ucuggcagcucaguucaggucu

SEQ ID NO: 1006570 - RNA, 22 nt, Human
caguuuauaugucagagcugua

SEQ ID NO: 1006571 - RNA, 22 nt, Human
caguauuuguucccuaucaaug

SEQ ID NO: 1006572 - RNA, 22 nt, Human
acacuaauuaagcugcuuuacu

SEQ ID NO: 1006573 - RNA, 22 nt, Human
aaacacaucauucaugucguca

SEQ ID NO: 1006574 - RNA, 21 nt, Human
aaaaagcuggggcaugcaugc

SEQ ID NO: 1006575 - RNA, 22 nt, Human
gggcugacagcacgccuucugu

SEQ ID NO: 1006576 - RNA, 22 nt, Human
accauugccuagaaaaauuccu

SEQ ID NO: 1006577 - RNA, 22 nt, Human
guccucuggccuuucccaggac

SEQ ID NO: 1006578 - RNA, 22 nt, Human
cauacaagcguucaauagaugu

SEQ ID NO: 1006579 - RNA, 22 nt, Human
gaauccaggguuguuugagcua

SEQ ID NO: 1006580 - RNA, 22 nt, Human
ccagcuuuugcacuggacuggg

SEQ ID NO: 1006581 - RNA, 22 nt, Human
gagcucagauucuggugucaga

SEQ ID NO: 1006582 - RNA, 22 nt, Human
gacugccagaaugugaggccug

SEQ ID NO: 1006583 - RNA, 22 nt, Human
gaggggucacaugggcuggcuu

SEQ ID NO: 1006584 - RNA, 22 nt, Human
ggggcugaaccuggaggugguc

SEQ ID NO: 1006585 - RNA, 22 nt, Human
ucacauaaauuauacaauuuca

SEQ ID NO: 1006586 - RNA, 22 nt, Human
uggaccugcuggaugggcaggu

SEQ ID NO: 1006587 - RNA, 22 nt, Human
aacauucaaaacccaguucagu

SEQ ID NO: 1006588 - RNA, 22 nt, Human
aggcaauccccugaggauacuu

SEQ ID NO: 1006589 - RNA, 22 nt, Human
uacauugaauuuuuuagcaugu

SEQ ID NO: 1006590 - RNA, 22 nt, Human
aagcuuuaagugucagucagcc

SEQ ID NO: 1006591 - RNA, 21 nt, Human
uagggcucuauuuuuauuuca

SEQ ID NO: 1006592 - RNA, 22 nt, Human
agucacaguuccuacccaguaa

SEQ ID NO: 1006593 - RNA, 17 nt, Human
agcaggcugcagaggcc

SEQ ID NO: 1006594 - RNA, 22 nt, Human
cuaaaauuaucaagauaauucc

SEQ ID NO: 1006595 - RNA, 22 nt, Human
gagccuccuccuggugugccga

SEQ ID NO: 1006596 - RNA, 18 nt, Human
cucucuuuccacucuuug

SEQ ID NO: 1006597 - RNA, 22 nt, Human
acagcucuguguauugucaucu

SEQ ID NO: 1006598 - RNA, 22 nt, Human
agcuuuaugggagcuuagauaa

SEQ ID NO: 1006599 - RNA, 22 nt, Human
uaggaaaugcuccauugcauaa

SEQ ID NO: 1006600 - RNA, 22 nt, Human
aaacaucaauugcaucucccaa

SEQ ID NO: 1006601 - RNA, 22 nt, Human
uuauuagggugguuuauguucu

SEQ ID NO: 1006602 - RNA, 22 nt, Human
ggcuucugcucagccugcacgc

SEQ ID NO: 1006603 - RNA, 22 nt, Human
cccugcagagggaugggggcag

SEQ ID NO: 1006604 - RNA, 22 nt, Human
uuuuauuaguggcuagaugggg

SEQ ID NO: 1006605 - RNA, 22 nt, Human
uaauaguugugacuuuguaaag

SEQ ID NO: 1006606 - RNA, 22 nt, Human
cugggcuuagcagcuccugguc

SEQ ID NO: 1006607 - RNA, 22 nt, Human
cacaugaugguggaagccauag

SEQ ID NO: 1006608 - RNA, 23 nt, Human
auguuauuauuagcagucuugcc

SEQ ID NO: 1006609 - RNA, 21 nt, Human
uaugaacaugaccaauagucc

SEQ ID NO: 1006610 - RNA, 22 nt, Human
gccagaagggguggauccaggc

SEQ ID NO: 1006611 - RNA, 22 nt, Human
guccucugaaguugugcaaugc

SEQ ID NO: 1006612 - RNA, 22 nt, Human
uuuugagauggagucuugcucu

SEQ ID NO: 1006613 - RNA, 22 nt, Human
cugguggagggacaggcuuagc

SEQ ID NO: 1006614 - RNA, 22 nt, Human
aaacaugcauucaagaaaaucu

SEQ ID NO: 1006615 - RNA, 19 nt, Human
ugccuggcaccagcuccac

SEQ ID NO: 1006616 - RNA, 22 nt, Human
gacucugggcugagccagggcc

SEQ ID NO: 1006617 - RNA, 22 nt, Human
ugacaggaggcuugaggccagg

SEQ ID NO: 1006618 - RNA, 22 nt, Human
agaaaguuuugugcuauauaug

SEQ ID NO: 1006619 - RNA, 22 nt, Human
uagcuuuaggaugguucucuug

SEQ ID NO: 1006620 - RNA, 22 nt, Human
uguuuuucaaauauugcucugu

SEQ ID NO: 1006621 - RNA, 22 nt, Human
auaucauuauguuaugagcaca

SEQ ID NO: 1006622 - RNA, 22 nt, Human
ugggcugaaaugcuguggacua

SEQ ID NO: 1006623 - RNA, 22 nt, Human
auuaauuuuucugacagccaca

SEQ ID NO: 1006624 - RNA, 22 nt, Human
ucugggcugguugugcuugcuu

SEQ ID NO: 1006625 - RNA, 22 nt, Human
aaggcuuucagcuaacuugauu

SEQ ID NO: 1006626 - RNA, 18 nt, Human
gccugcaggcacgggggu

SEQ ID NO: 1006627 - RNA, 22 nt, Human
cuaaaauuaccuaccaguuuag

SEQ ID NO: 1006628 - RNA, 22 nt, Human
uaguuaggaauagcagcgacuc

SEQ ID NO: 1006629 - RNA, 22 nt, Human
uuugcaaauauguguuucuauu

SEQ ID NO: 1006630 - RNA, 22 nt, Human
agcuuuaucagaggagucucua

SEQ ID NO: 1006631 - RNA, 23 nt, Human
accaugaugggagugcaaauaag

SEQ ID NO: 1006632 - RNA, 22 nt, Human
gcuggcagcuggaaguugggcu

SEQ ID NO: 1006633 - RNA, 22 nt, Human
ccauacacacaccaaauuugua

SEQ ID NO: 1006634 - RNA, 22 nt, Human
ucugggcuuuguaaugggaggu

SEQ ID NO: 1006635 - RNA, 22 nt, Human
gaggacucugggcguguauggg

SEQ ID NO: 1006636 - RNA, 22 nt, Human
ugucagagcaaggccaggccag

SEQ ID NO: 1006637 - RNA, 22 nt, Human
acaguguguucugggaccucca

SEQ ID NO: 1006638 - RNA, 22 nt, Human
gcauccaaaccauucaucagcc

SEQ ID NO: 1006639 - RNA, 22 nt, Human
aggccuccagccacaugccagu

SEQ ID NO: 1006640 - RNA, 22 nt, Human
agggacucccugggccgacacg

SEQ ID NO: 1006641 - RNA, 22 nt, Human
agccaccuucuccaaggccuag

SEQ ID NO: 1006642 - RNA, 22 nt, Human
cugggagggguagccaauccua

SEQ ID NO: 1006643 - RNA, 22 nt, Human
caggacauugauccauuggcac

SEQ ID NO: 1006644 - RNA, 22 nt, Human
ugcauaaagugccauaguauua

SEQ ID NO: 1006645 - RNA, 22 nt, Human
aggcuuuggggcauucuguguu

SEQ ID NO: 1006646 - RNA, 22 nt, Human
gauucuuacuucuaagcaagcu

SEQ ID NO: 1006647 - RNA, 22 nt, Human
ugcacaggugagacucaggaag

SEQ ID NO: 1006648 - RNA, 22 nt, Human
ugggaccugcuccuggaaugag

SEQ ID NO: 1006649 - RNA, 22 nt, Human
gcagcuuuggagguggaacucu

SEQ ID NO: 1006650 - RNA, 22 nt, Human
aagagcaucgguggagccccca

SEQ ID NO: 1006651 - RNA, 22 nt, Human
aaauauguauggaguucaugaa

SEQ ID NO: 1006652 - RNA, 22 nt, Human
auuuaaauuuucugauggagag

SEQ ID NO: 1006653 - RNA, 19 nt, Human
uccaggaggcugccauuga

SEQ ID NO: 1006654 - RNA, 22 nt, Human
uuacaguuuaguccaagccaga

SEQ ID NO: 1006655 - RNA, 22 nt, Human
ugcuucugcucagcuuccuacu

SEQ ID NO: 1006656 - RNA, 22 nt, Human
ucugcucuguggcuucagcuaa

SEQ ID NO: 1006657 - RNA, 22 nt, Human
uccaggaggguuuucugccuuc

SEQ ID NO: 1006658 - RNA, 22 nt, Human
cauuaggguaauugaacacuua

SEQ ID NO: 1006659 - RNA, 21 nt, Human
uuacaaagcaagugcuguguc

SEQ ID NO: 1006660 - RNA, 22 nt, Human
agcuugauuucucugcagugug

SEQ ID NO: 1006661 - RNA, 22 nt, Human
cacccacauuccaucacucugc

SEQ ID NO: 1006662 - RNA, 22 nt, Human
ugcagggauuguuggcauccau

SEQ ID NO: 1006663 - RNA, 22 nt, Human
gccuggaaugcaaugugacgaa

SEQ ID NO: 1006664 - RNA, 22 nt, Human
ugugugaaggaauauauacuca

SEQ ID NO: 1006665 - RNA, 22 nt, Human
uccugugccaucucuagagacu

SEQ ID NO: 1006666 - RNA, 22 nt, Human
cgcuaggauuaggauuaauccu

SEQ ID NO: 1006667 - RNA, 22 nt, Human
auuaaaauuccaagguaugcca

SEQ ID NO: 1006668 - RNA, 22 nt, Human
gagaaagauguaggcugggagg

SEQ ID NO: 1006669 - RNA, 22 nt, Human
gcuggcagaagagcugguucaa

SEQ ID NO: 1006670 - RNA, 22 nt, Human
aguugggaguuauagacucuau

SEQ ID NO: 1006671 - RNA, 22 nt, Human
uuccaggcucccuuggaggugu

SEQ ID NO: 1006672 - RNA, 20 nt, Human
cagagaccaggccagguguc

SEQ ID NO: 1006673 - RNA, 22 nt, Human
aauucuguuacuaaugugaugu

SEQ ID NO: 1006674 - RNA, 22 nt, Human
ucaggagcugcacugggcccac

SEQ ID NO: 1006675 - RNA, 22 nt, Human
cccacccugggaagcuaggcag

SEQ ID NO: 1006676 - RNA, 22 nt, Human
auuaaauuagcaaacugugaaa

SEQ ID NO: 1006677 - RNA, 15 nt, Human
cacacagacagcuug

SEQ ID NO: 1006678 - RNA, 23 nt, Human
acaagauagggauaaaaagauaa

SEQ ID NO: 1006679 - RNA, 22 nt, Human
auguagaacagguuaaugacag

SEQ ID NO: 1006680 - RNA, 22 nt, Human
acaggccuuggcaggcauguga

SEQ ID NO: 1006681 - RNA, 22 nt, Human
gcuggcagguaaagccccgggg

SEQ ID NO: 1006682 - RNA, 22 nt, Human
uccugagcccuguaggacccug

SEQ ID NO: 1006683 - RNA, 22 nt, Human
gggaccugaggcccugcuccac

SEQ ID NO: 1006684 - RNA, 22 nt, Human
uaauuucuggagggagaaagag

SEQ ID NO: 1006685 - RNA, 22 nt, Human
aggaccugagaguuggaaaucc

SEQ ID NO: 1006686 - RNA, 22 nt, Human
cuuuauuagauguagacuuucu

SEQ ID NO: 1006687 - RNA, 22 nt, Human
guccagugacaaguagcuggcc

SEQ ID NO: 1006688 - RNA, 22 nt, Human
gccaaaucacagggccaaaagc

SEQ ID NO: 1006689 - RNA, 22 nt, Human
ccugggcucgcgcacuucaccc

SEQ ID NO: 1006690 - RNA, 22 nt, Human
guggcaguuuugacaucacaaa

SEQ ID NO: 1006691 - RNA, 17 nt, Human
ccauacugacauauuga

SEQ ID NO: 1006692 - RNA, 22 nt, Human
uggaccugaagaauaggaagua

SEQ ID NO: 1006693 - RNA, 22 nt, Human
ugucuuuauauauuuggaaaau

SEQ ID NO: 1006694 - RNA, 22 nt, Human
uuuucauuguuacuaugagcua

SEQ ID NO: 1006695 - RNA, 22 nt, Human
aucucauaacucauuugaagac

SEQ ID NO: 1006696 - RNA, 22 nt, Human
acauuuuuauucaucaaagcag

SEQ ID NO: 1006697 - RNA, 22 nt, Human
cagggcuccccagagagccucu

SEQ ID NO: 1006698 - RNA, 22 nt, Human
gcaguguuuacauauuagaaac

SEQ ID NO: 1006699 - RNA, 22 nt, Human
cagucuggaggucagcuggcuu

SEQ ID NO: 1006700 - RNA, 22 nt, Human
ucagcuuuuaaaaacaagaagu

SEQ ID NO: 1006701 - RNA, 22 nt, Human
uuuaaauuuguguuuagagggu

SEQ ID NO: 1006702 - RNA, 22 nt, Human
uccaggcucccucaggaugcac

SEQ ID NO: 1006703 - RNA, 22 nt, Human
accaagcucucuucccggcucu

SEQ ID NO: 1006704 - RNA, 22 nt, Human
ugcuacaauucacaucuggaua

SEQ ID NO: 1006705 - RNA, 22 nt, Human
uggguaggaccagaaaugcacu

SEQ ID NO: 1006706 - RNA, 22 nt, Human
ucagcuuugccaccagcuguaa

SEQ ID NO: 1006707 - RNA, 22 nt, Human
ccacccagccagaugcaggaag

SEQ ID NO: 1006708 - RNA, 22 nt, Human
auuugcuuuuacuauguuaaaa

SEQ ID NO: 1006709 - RNA, 21 nt, Human
aaaugaaugugguagugcaag

SEQ ID NO: 1006710 - RNA, 22 nt, Human
acacacuguaaggacuaucacu

SEQ ID NO: 1006711 - RNA, 22 nt, Human
gaacacauuucucugacuguag

SEQ ID NO: 1006712 - RNA, 22 nt, Human
auucacagaauaguuuuaccag

SEQ ID NO: 1006713 - RNA, 22 nt, Human
gaggggcuggguagggcaaccc

SEQ ID NO: 1006714 - RNA, 22 nt, Human
acaggcagguccugucccagcu

SEQ ID NO: 1006715 - RNA, 22 nt, Human
uggcaguggcucagagugcaga

SEQ ID NO: 1006716 - RNA, 22 nt, Human
cugccugcaugcugccauagcu

SEQ ID NO: 1006717 - RNA, 22 nt, Human
cccuuccucccaggcuucugug

SEQ ID NO: 1006718 - RNA, 23 nt, Human
agcuucauugaccuccgcagggg

SEQ ID NO: 1006719 - RNA, 22 nt, Human
ucuuuauuuuaugcuugugcaa

SEQ ID NO: 1006720 - RNA, 22 nt, Human
ugcagugguugagagcccagac

SEQ ID NO: 1006721 - RNA, 22 nt, Human
cacauaauugaacgugaugagu

SEQ ID NO: 1006722 - RNA, 22 nt, Human
uuguacaaaggauuuggaagag

SEQ ID NO: 1006723 - RNA, 22 nt, Human
guuuagaacacggaaauacuga

SEQ ID NO: 1006724 - RNA, 22 nt, Human
ggggaccugggcuucaaggguu

SEQ ID NO: 1006725 - RNA, 22 nt, Human
cacacauuucagaugcuacaau

SEQ ID NO: 1006726 - RNA, 22 nt, Human
gcuucuaucccuccacugcacu

SEQ ID NO: 1006727 - RNA, 20 nt, Human
aucugcuugccuguccucgg

SEQ ID NO: 1006728 - RNA, 22 nt, Human
agucccuucucaaagugugcgg

SEQ ID NO: 1006729 - RNA, 22 nt, Human
uuauuacacugaaagaauugcg

SEQ ID NO: 1006730 - RNA, 22 nt, Human
cagcuuuaccaauauuuggaaa

SEQ ID NO: 1006731 - RNA, 22 nt, Human
ccagagagagaggucaauggca

SEQ ID NO: 1006732 - RNA, 17 nt, Human
acaggcagaucaccuga

SEQ ID NO: 1006733 - RNA, 22 nt, Human
uccaggcaugguguaauuuugc

SEQ ID NO: 1006734 - RNA, 22 nt, Human
cagggcucuuccggagcaggga

SEQ ID NO: 1006735 - RNA, 22 nt, Human
acaguguguuggaggagacugu

SEQ ID NO: 1006736 - RNA, 22 nt, Human
aagucuguuugagugucacacu

SEQ ID NO: 1006737 - RNA, 22 nt, Human
aaguccuuggagaauagaaagg

SEQ ID NO: 1006738 - RNA, 22 nt, Human
ccuggggaaaagcaggcauuua

SEQ ID NO: 1006739 - RNA, 22 nt, Human
cccugcagcuuuugcauaguca

SEQ ID NO: 1006740 - RNA, 17 nt, Human
aggcauggucuggggug

SEQ ID NO: 1006741 - RNA, 22 nt, Human
uagacacaucuucauccacaau

SEQ ID NO: 1006742 - RNA, 22 nt, Human
acuggcagaggauagcacuaau

SEQ ID NO: 1006743 - RNA, 21 nt, Human
gccugcaguuuugaagcccuu

SEQ ID NO: 1006744 - RNA, 22 nt, Human
aauaacuucaguucuuacauua

SEQ ID NO: 1006745 - RNA, 22 nt, Human
ucagggacagggugcugcugcg

SEQ ID NO: 1006746 - RNA, 21 nt, Human
acauacauaccuuaccaccuu

SEQ ID NO: 1006747 - RNA, 22 nt, Human
uuuuucauugcagccucucucc

SEQ ID NO: 1006748 - RNA, 22 nt, Human
ggcuuuaucaaaugagacccug

SEQ ID NO: 1006749 - RNA, 20 nt, Human
ucugugcaccugcuacaagg

SEQ ID NO: 1006750 - RNA, 22 nt, Human
cucugaccauucccuugauuuu

SEQ ID NO: 1006751 - RNA, 19 nt, Human
gggguggcuggggcuccag

SEQ ID NO: 1006752 - RNA, 22 nt, Human
auuagagguacaaaccuucacu

SEQ ID NO: 1006753 - RNA, 22 nt, Human
cuugggaaugcuaacagaugac

SEQ ID NO: 1006754 - RNA, 22 nt, Human
gcccaagcuggacugcaguggc

SEQ ID NO: 1006755 - RNA, 17 nt, Human
ccaggcuccaucacugu

SEQ ID NO: 1006756 - RNA, 22 nt, Human
uacacauccauguuuugacuuu

SEQ ID NO: 1006757 - RNA, 22 nt, Human
uuucuuucaauucuccuaaugc

SEQ ID NO: 1006758 - RNA, 22 nt, Human
aaagcagguugcaauuacagug

SEQ ID NO: 1006759 - RNA, 22 nt, Human
ugccuacauuccuugcuuaugg

SEQ ID NO: 1006760 - RNA, 22 nt, Human
ccagacccugcucuggggcucu

SEQ ID NO: 1006761 - RNA, 22 nt, Human
cuguccagucuuuagcaagcug

SEQ ID NO: 1006762 - RNA, 19 nt, Human
ccaggccuggcgucuccgc

SEQ ID NO: 1006763 - RNA, 21 nt, Human
cacacagugaucuauccacau

SEQ ID NO: 1006764 - RNA, 22 nt, Human
aauguauguguauaucaaauca

SEQ ID NO: 1006765 - RNA, 22 nt, Human
ccugggcuguugcaucauccuu

SEQ ID NO: 1006766 - RNA, 21 nt, Human
augugaaaccuuccacgcuga

SEQ ID NO: 1006767 - RNA, 22 nt, Human
uacaaguaaauuguagauacca

SEQ ID NO: 1006768 - RNA, 22 nt, Human
agcuuuggagacugacuccauc

SEQ ID NO: 1006769 - RNA, 22 nt, Human
cagggcucgcucuugcccuucg

SEQ ID NO: 1006770 - RNA, 22 nt, Human
cagccaagaaccacagacccag

SEQ ID NO: 1006771 - RNA, 22 nt, Human
uguuuauucauggcuaaugaaa

SEQ ID NO: 1006772 - RNA, 22 nt, Human
caggcagcugcuggguucagcc

SEQ ID NO: 1006773 - RNA, 22 nt, Human
gcuggcaggguucucacugaaa

SEQ ID NO: 1006774 - RNA, 22 nt, Human
agucuacaaucuuaaaugaacu

SEQ ID NO: 1006775 - RNA, 22 nt, Human
aucagagauggcuccagugcuc

SEQ ID NO: 1006776 - RNA, 22 nt, Human
acagguggcuuauuggcugauu

SEQ ID NO: 1006777 - RNA, 22 nt, Human
aagggcucugcugucucucccc

SEQ ID NO: 1006778 - RNA, 22 nt, Human
cagagccucagaauccugugga

SEQ ID NO: 1006779 - RNA, 22 nt, Human
uucucagugaaguuuagaacau

SEQ ID NO: 1006780 - RNA, 23 nt, Human
aaauaugucugagggcaaagaau

SEQ ID NO: 1006781 - RNA, 22 nt, Human
cuccugaggaaaagcuugguca

SEQ ID NO: 1006782 - RNA, 20 nt, Human
agguuccuuuguggagaauu

SEQ ID NO: 1006783 - RNA, 22 nt, Human
agggcuccaggggcugggugac

SEQ ID NO: 1006784 - RNA, 18 nt, Human
acacacacaccuguguau

SEQ ID NO: 1006785 - RNA, 22 nt, Human
ggcaagagggcagauggagugc

SEQ ID NO: 1006786 - RNA, 22 nt, Human
ugcuuuauuuuaaauaugccau

SEQ ID NO: 1006787 - RNA, 22 nt, Human
aacagcauaccaauguacauau

SEQ ID NO: 1006788 - RNA, 21 nt, Human
uucauaaaccauucucaugca

SEQ ID NO: 1006789 - RNA, 22 nt, Human
aauaauuuuagcucagaguugu

SEQ ID NO: 1006790 - RNA, 22 nt, Human
cugaaaauguuacacaggaaga

SEQ ID NO: 1006791 - RNA, 22 nt, Human
ccagagagauugcuucuaaaga

SEQ ID NO: 1006792 - RNA, 22 nt, Human
gagaaagauuguccuucagggg

SEQ ID NO: 1006793 - RNA, 22 nt, Human
ugcuucuggguaggccucagga

SEQ ID NO: 1006794 - RNA, 22 nt, Human
uuucacaugguacugccuguuu

SEQ ID NO: 1006795 - RNA, 22 nt, Human
gggccccuugcugcucugcugg

SEQ ID NO: 1006796 - RNA, 22 nt, Human
ugcagggauuagaggccgggga

SEQ ID NO: 1006797 - RNA, 18 nt, Human
aggaaagaaaggcaggug

SEQ ID NO: 1006798 - RNA, 21 nt, Human
uuuagggaccaggucauaggc

SEQ ID NO: 1006799 - RNA, 22 nt, Human
ggcuucuggugggagcaugacu

SEQ ID NO: 1006800 - RNA, 22 nt, Human
cauuuauucauuugcuagggcu

SEQ ID NO: 1006801 - RNA, 22 nt, Human
gugcuaggauuacaggcauggg

SEQ ID NO: 1006802 - RNA, 22 nt, Human
cagggcucgcugccagcuucag

SEQ ID NO: 1006803 - RNA, 19 nt, Human
ggcauccagaacuaccagu

SEQ ID NO: 1006804 - RNA, 22 nt, Human
ccagagaggcaaaacuccuucc

SEQ ID NO: 1006805 - RNA, 22 nt, Human
cagggcucccuugcaaggaggg

SEQ ID NO: 1006806 - RNA, 22 nt, Human
uuucaaacauagaucugaauau

SEQ ID NO: 1006807 - RNA, 22 nt, Human
agcaggcuugguccccagccuc

SEQ ID NO: 1006808 - RNA, 22 nt, Human
cauuguuaccaucuuuuaccua

SEQ ID NO: 1006809 - RNA, 18 nt, Human
gcagcuuuugauucaccc

SEQ ID NO: 1006810 - RNA, 22 nt, Human
acacccaggcuggcgugcagug

SEQ ID NO: 1006811 - RNA, 22 nt, Human
auugaaaauauaauucuaggag

SEQ ID NO: 1006812 - RNA, 20 nt, Human
gcaaaauaggcucuguuggu

SEQ ID NO: 1006813 - RNA, 19 nt, Human
caggucuucuuggaggacu

SEQ ID NO: 1006814 - RNA, 22 nt, Human
cagggacaauggcagagccuga

SEQ ID NO: 1006815 - RNA, 19 nt, Human
cuccaagugccaaggacag

SEQ ID NO: 1006816 - RNA, 22 nt, Human
ugaagccacuuuccagaaucac

SEQ ID NO: 1006817 - RNA, 22 nt, Human
uagcuuuaaaaaucaucaaagc

SEQ ID NO: 1006818 - RNA, 22 nt, Human
uuaugcaaaggggccucuuccu

SEQ ID NO: 1006819 - RNA, 22 nt, Human
gggcugacaaucucuuuacuua

SEQ ID NO: 1006820 - RNA, 22 nt, Human
uuucauugaugggugauagaaa

SEQ ID NO: 1006821 - RNA, 22 nt, Human
ugcagggaagcaaggguggcuc

SEQ ID NO: 1006822 - RNA, 22 nt, Human
ggggcugagucagugggaagag

SEQ ID NO: 1006823 - RNA, 22 nt, Human
caugagauaauuuuucuccagu

SEQ ID NO: 1006824 - RNA, 22 nt, Human
ccauucauacaauuuuguucua

SEQ ID NO: 1006825 - RNA, 22 nt, Human
ccugggcuuacgaccucugacu

SEQ ID NO: 1006826 - RNA, 22 nt, Human
gcagcuuuuuggaugucaguua

SEQ ID NO: 1006827 - RNA, 22 nt, Human
aaaguucuggcauuuucugucu

SEQ ID NO: 1006828 - RNA, 22 nt, Human
cuccuggcacucaguguggaag

SEQ ID NO: 1006829 - RNA, 22 nt, Human
guguaugauuucaaauggcuag

SEQ ID NO: 1006830 - RNA, 22 nt, Human
ggccucucugagagcagacguu

SEQ ID NO: 1006831 - RNA, 20 nt, Human
uaacuuucuaugcuuucagc

SEQ ID NO: 1006832 - RNA, 22 nt, Human
guuauuagaagugaaggauugu

SEQ ID NO: 1006833 - RNA, 22 nt, Human
ugggcucagucugcuugguccu

SEQ ID NO: 1006834 - RNA, 22 nt, Human
cucagcucugacaggaggcauc

SEQ ID NO: 1006835 - RNA, 22 nt, Human
uuuuccuucugauacuccauuu

SEQ ID NO: 1006836 - RNA, 23 nt, Human
cuggggcuuucaaaucugggcag

SEQ ID NO: 1006837 - RNA, 22 nt, Human
gccaggcauucuagaaguagug

SEQ ID NO: 1006838 - RNA, 22 nt, Human
cccacacucugagaaaugcuga

SEQ ID NO: 1006839 - RNA, 22 nt, Human
acacaucaugccaaguuucacc

SEQ ID NO: 1006840 - RNA, 22 nt, Human
gcuggggaggcagcagagaaca

SEQ ID NO: 1006841 - RNA, 22 nt, Human
uccagaccauggauggcugcaa

SEQ ID NO: 1006842 - RNA, 22 nt, Human
uugaauuauaagugugucuacu

SEQ ID NO: 1006843 - RNA, 22 nt, Human
uucagagagaccaaguggcgug

SEQ ID NO: 1006844 - RNA, 22 nt, Human
uuuugagauggugucucgcucc

SEQ ID NO: 1006845 - RNA, 22 nt, Human
gcagcucuuuucuuaaagagau

SEQ ID NO: 1006846 - RNA, 22 nt, Human
cagaggcugccagccaugugca

SEQ ID NO: 1006847 - RNA, 22 nt, Human
ugggcuucuggaguggggcaga

SEQ ID NO: 1006848 - RNA, 22 nt, Human
agcuuuguggcuuugcaagacu

SEQ ID NO: 1006849 - RNA, 22 nt, Human
gcucugagacaguagagauggc

SEQ ID NO: 1006850 - RNA, 22 nt, Human
aucaaauauaauaauuuucgcu

SEQ ID NO: 1006851 - RNA, 22 nt, Human
aagggcucacccaacucacuuc

SEQ ID NO: 1006852 - RNA, 22 nt, Human
gauuuauugucccuguccugcu

SEQ ID NO: 1006853 - RNA, 22 nt, Human
agaaucucuacucaaguacuug

SEQ ID NO: 1006854 - RNA, 22 nt, Human
ccaggccuggaccaugccaggg

SEQ ID NO: 1006855 - RNA, 22 nt, Human
agucucuuuaaucacagugucu

SEQ ID NO: 1006856 - RNA, 22 nt, Human
gcuccaggagagggaagcagau

SEQ ID NO: 1006857 - RNA, 22 nt, Human
gcaggcucacucuguuuggcuc

SEQ ID NO: 1006858 - RNA, 17 nt, Human
gcccacccuuaggagcu

SEQ ID NO: 1006859 - RNA, 22 nt, Human
cucucuccuuagcugcagacca

SEQ ID NO: 1006860 - RNA, 22 nt, Human
acuggggaauggaacugggaau

SEQ ID NO: 1006861 - RNA, 22 nt, Human
uucuuucaauagcuggcauaug

SEQ ID NO: 1006862 - RNA, 20 nt, Human
accccacagaguccauugca

SEQ ID NO: 1006863 - RNA, 22 nt, Human
uagcauuuauuccagauuugga

SEQ ID NO: 1006864 - RNA, 23 nt, Human
ucagggacaugaugugucauauc

SEQ ID NO: 1006865 - RNA, 22 nt, Human
aaauaguuuagcucucauuuca

SEQ ID NO: 1006866 - RNA, 22 nt, Human
agcuuuauauguuguuucucca

SEQ ID NO: 1006867 - RNA, 23 nt, Human
aaacuacauuuauaguuuuucuc

SEQ ID NO: 1006868 - RNA, 22 nt, Human
guaugaaaauuguaaaguucuu

SEQ ID NO: 1006869 - RNA, 22 nt, Human
guuagggaucaggaacaagagc

SEQ ID NO: 1006870 - RNA, 22 nt, Human
guagggacccacagucuauauu

SEQ ID NO: 1006871 - RNA, 22 nt, Human
aguaugaagaugaugaaaaaua

SEQ ID NO: 1006872 - RNA, 22 nt, Human
ucccagggcacucacccucccu

SEQ ID NO: 1006873 - RNA, 18 nt, Human
gacaaaaguacagacaga

SEQ ID NO: 1006874 - RNA, 22 nt, Human
guuucauucggcagcucauaag

SEQ ID NO: 1006875 - RNA, 22 nt, Human
cacacucauuagucauuucucu

SEQ ID NO: 1006876 - RNA, 22 nt, Human
uucugucuguaaacuucucaau

SEQ ID NO: 1006877 - RNA, 22 nt, Human
ccagcuuuucagaaucugccug

SEQ ID NO: 1006878 - RNA, 22 nt, Human
uccugcaggccuguucccagua

SEQ ID NO: 1006879 - RNA, 22 nt, Human
uuauuuacaacucuucucuucc

SEQ ID NO: 1006880 - RNA, 22 nt, Human
aauuagggaaaacauuugcuuu

SEQ ID NO: 1006881 - RNA, 22 nt, Human
uuagggacaaauuugcagaacc

SEQ ID NO: 1006882 - RNA, 22 nt, Human
uauugaggaucuccugcuaauu

SEQ ID NO: 1006883 - RNA, 22 nt, Human
cugcaggagcaaagccucugcu

SEQ ID NO: 1006884 - RNA, 22 nt, Human
auauucuuccaaaacaucauuu

SEQ ID NO: 1006885 - RNA, 22 nt, Human
uccaggcauuccagccauucca

SEQ ID NO: 1006886 - RNA, 22 nt, Human
uccugagcuacaguaguaugau

SEQ ID NO: 1006887 - RNA, 21 nt, Human
ccuggcagaagccugauaugc

SEQ ID NO: 1006888 - RNA, 22 nt, Human
cccugcagagaccacugaccuu

SEQ ID NO: 1006889 - RNA, 22 nt, Human
cagguggccaguacucaaggau

SEQ ID NO: 1006890 - RNA, 22 nt, Human
ucagagaggauuuuaauaagug

SEQ ID NO: 1006891 - RNA, 22 nt, Human
cuccuggcacugucuugaccca

SEQ ID NO: 1006892 - RNA, 22 nt, Human
ucauuguuucugcuuuucauga

SEQ ID NO: 1006893 - RNA, 22 nt, Human
auguuugaaauuguaaguauau

SEQ ID NO: 1006894 - RNA, 22 nt, Human
aauaaguacuuggggauaacuu

SEQ ID NO: 1006895 - RNA, 22 nt, Human
ugauuugaaaccuuuggcaaga

SEQ ID NO: 1006896 - RNA, 22 nt, Human
cuucauuucaggcugaagaaua

SEQ ID NO: 1006897 - RNA, 18 nt, Human
ucagggaaucuuggccuu

SEQ ID NO: 1006898 - RNA, 22 nt, Human
uugacuauacucuggcggaaaa

SEQ ID NO: 1006899 - RNA, 22 nt, Human
uuuuguguugccauguuaagca

SEQ ID NO: 1006900 - RNA, 22 nt, Human
cucuaaauguggucugcagaua

SEQ ID NO: 1006901 - RNA, 22 nt, Human
ugaaagaagccucccuuuggag

SEQ ID NO: 1006902 - RNA, 22 nt, Human
uacaaagugauuuuggaauuga

SEQ ID NO: 1006903 - RNA, 22 nt, Human
uguguuuuggaaggaacaugca

SEQ ID NO: 1006904 - RNA, 22 nt, Human
agugaaaaccuaaucaugcagu

SEQ ID NO: 1006905 - RNA, 21 nt, Human
uaagaacauuaucuucuuccu

SEQ ID NO: 1006906 - RNA, 22 nt, Human
cuauuuucccauaugguugaca

SEQ ID NO: 1006907 - RNA, 22 nt, Human
gaaaccuuugccgauggggucc

SEQ ID NO: 1006908 - RNA, 22 nt, Human
uuggaggaagcucaugggggau

SEQ ID NO: 1006909 - RNA, 22 nt, Human
auuuacagacguggauuagugc

SEQ ID NO: 1006910 - RNA, 22 nt, Human
uccugaaaauaauuucacaaga

SEQ ID NO: 1006911 - RNA, 23 nt, Human
acacauguuuaugcuugggggca

SEQ ID NO: 1006912 - RNA, 22 nt, Human
ucuuccagauacuuccugacuu

SEQ ID NO: 1006913 - RNA, 22 nt, Human
agagcaauuagcuuagguaaaa

SEQ ID NO: 1006914 - RNA, 22 nt, Human
gaauaauugugaugcuugaagu

SEQ ID NO: 1006915 - RNA, 20 nt, Human
uuugauugccccucugacuu

SEQ ID NO: 1006916 - RNA, 22 nt, Human
uuuucaguuccaucucugcucu

SEQ ID NO: 1006917 - RNA, 22 nt, Human
acaaucagcacugaguuuaucu

SEQ ID NO: 1006918 - RNA, 22 nt, Human
uguguggcaagcuguaugcuag

SEQ ID NO: 1006919 - RNA, 22 nt, Human
ugaauaaucuuggguauuaaua

SEQ ID NO: 1006920 - RNA, 22 nt, Human
cacauuuaaagguugaagcuga

SEQ ID NO: 1006921 - RNA, 23 nt, Human
uuaagacuggcugaacuuaguag

SEQ ID NO: 1006922 - RNA, 22 nt, Human
aauucaaggaucuguuaaaucu

SEQ ID NO: 1006923 - RNA, 22 nt, Human
uuuuccuucugauacuccauuu

SEQ ID NO: 1006924 - RNA, 22 nt, Human
augauugaaaaugacauugcca

SEQ ID NO: 1006925 - RNA, 22 nt, Human
acugauuucagggaugagaaga

SEQ ID NO: 1006926 - RNA, 22 nt, Human
guuuuguucaugaacauugggu

SEQ ID NO: 1006927 - RNA, 22 nt, Human
acuuccagaaaugauuuaauuu

SEQ ID NO: 1006928 - RNA, 22 nt, Human
aauuauguuugcuuuagaugga

SEQ ID NO: 1006929 - RNA, 22 nt, Human
guauuaugaaugccgaggcggc

SEQ ID NO: 1006930 - RNA, 22 nt, Human
uuuggauugcuuggaugcuucg

SEQ ID NO: 1006931 - RNA, 22 nt, Human
auguuguugaacucuuugcaug

SEQ ID NO: 1006932 - RNA, 21 nt, Human
uucugagacucauuugaacuc

SEQ ID NO: 1006933 - RNA, 22 nt, Human
aaagaugucauacacauuaaga

SEQ ID NO: 1006934 - RNA, 22 nt, Human
cauaaauuguacccauuccaac

SEQ ID NO: 1006935 - RNA, 22 nt, Human
cugcaucaguggauaugauggu

SEQ ID NO: 1006936 - RNA, 22 nt, Human
uaugaaggauacaccucugauu

SEQ ID NO: 1006937 - RNA, 22 nt, Human
augcaauaguaauucuagucug

SEQ ID NO: 1006938 - RNA, 22 nt, Human
gauacuuuguggaauccuggau

SEQ ID NO: 1006939 - RNA, 22 nt, Human
gucuguggaguugcuugcugga

SEQ ID NO: 1006940 - RNA, 22 nt, Human
uccuuucugucuuuacucugga

SEQ ID NO: 1006941 - RNA, 22 nt, Human
aaucaggagugugcacuuugau

SEQ ID NO: 1006942 - RNA, 22 nt, Human
uuuuccuuaacagagggagaaa

SEQ ID NO: 1006943 - RNA, 22 nt, Human
uagcauuucacugaucuucacu

SEQ ID NO: 1006944 - RNA, 22 nt, Human
auuauugcaagcagugaaggga

SEQ ID NO: 1006945 - RNA, 22 nt, Human
ucuguucagaagaggugaaagu

SEQ ID NO: 1006946 - RNA, 22 nt, Human
uuguaagacuguagaaugcaaa

SEQ ID NO: 1006947 - RNA, 22 nt, Human
guuguuuuugaacggugguggc

SEQ ID NO: 1006948 - RNA, 22 nt, Human
gauucugaaauuaacagacugg

SEQ ID NO: 1006949 - RNA, 22 nt, Human
aaauugaauuugggaaacauug

SEQ ID NO: 1006950 - RNA, 22 nt, Human
uugcuauuuugagagucauagu

SEQ ID NO: 1006951 - RNA, 21 nt, Human
caaaagagacugauucuugga

SEQ ID NO: 1006952 - RNA, 22 nt, Human
uucacagcucauacuguucuca

SEQ ID NO: 1006953 - RNA, 22 nt, Human
aucaucaucuaaauugugucgc

SEQ ID NO: 1006954 - RNA, 22 nt, Human
uggcccgggaguuuugaagagu

SEQ ID NO: 1006955 - RNA, 22 nt, Human
ucugugggcauuuauaaucugg

SEQ ID NO: 1006956 - RNA, 22 nt, Human
uugaagcauuugcuauagcauu

SEQ ID NO: 1006957 - RNA, 22 nt, Human
augcuuucucuuaguucauuga

SEQ ID NO: 1006958 - RNA, 22 nt, Human
caagcagauauuuuagucaaga

SEQ ID NO: 1006959 - RNA, 22 nt, Human
ugcaucauuaagguacaguugg

SEQ ID NO: 1006960 - RNA, 22 nt, Human
auauuuguuuggcagaguucag

SEQ ID NO: 1006961 - RNA, 22 nt, Human
cucucuguuaugcuuucaugaa

SEQ ID NO: 1006962 - RNA, 23 nt, Human
cauuugauccucacaauaaaugg

SEQ ID NO: 1006963 - RNA, 22 nt, Human
aacagauuguaaccugauagcc

SEQ ID NO: 1006964 - RNA, 22 nt, Human
augcuugcccauguuucugaag

SEQ ID NO: 1006965 - RNA, 22 nt, Human
uugcucuauguuuguaaacaga

SEQ ID NO: 1006966 - RNA, 22 nt, Human
auuuggucuacauuuuccaaau

SEQ ID NO: 1006967 - RNA, 22 nt, Human
aaaugcacaauaaaguaaaggc

SEQ ID NO: 1006968 - RNA, 22 nt, Human
ugcucuguucaguguaucuugu

SEQ ID NO: 1006969 - RNA, 22 nt, Human
uuguuuguaaggcucuuagaau

SEQ ID NO: 1006970 - RNA, 18 nt, Human
uggggggcuugucugaag

SEQ ID NO: 1006971 - RNA, 22 nt, Human
gucuccuuguggaucucaagga

SEQ ID NO: 1006972 - RNA, 22 nt, Human
cucacucaguuuuuaguucauc

SEQ ID NO: 1006973 - RNA, 22 nt, Human
uacuuugagaugaugcugaucg

SEQ ID NO: 1006974 - RNA, 20 nt, Human
caacacugcccauuguuugc

SEQ ID NO: 1006975 - RNA, 22 nt, Human
auacuucuuuagcauauugaac

SEQ ID NO: 1006976 - RNA, 22 nt, Human
uguuaguauuggcaaauuuguu

SEQ ID NO: 1006977 - RNA, 22 nt, Human
augcauaucuccuaucuccuca

SEQ ID NO: 1006978 - RNA, 22 nt, Human
gcuagaaacuguuuaaucucuu

SEQ ID NO: 1006979 - RNA, 22 nt, Human
ucuaauuuuggcauuuuaaccu

SEQ ID NO: 1006980 - RNA, 22 nt, Human
cagcuuguuuacaugcuuauuc

SEQ ID NO: 1006981 - RNA, 22 nt, Human
cuccagagagaaaggaggccgc

SEQ ID NO: 1006982 - RNA, 23 nt, Human
uuguucuuggaucuuccugaagc

SEQ ID NO: 1006983 - RNA, 22 nt, Human
gaacaguuucccuguagaaaau

SEQ ID NO: 1006984 - RNA, 22 nt, Human
uuccuggugguggugacagcac

SEQ ID NO: 1006985 - RNA, 21 nt, Human
ugagcaccagcugcaugcccc

SEQ ID NO: 1006986 - RNA, 22 nt, Human
aagugcuuccauguuugagugu

SEQ ID NO: 1006987 - RNA, 19 nt, Human
uuugauagggcauaauaua

SEQ ID NO: 1006988 - RNA, 22 nt, Human
uuuugaauaauucagaaacagc

SEQ ID NO: 1006989 - RNA, 22 nt, Human
guguaucaaagcacagacuuca

SEQ ID NO: 1006990 - RNA, 22 nt, Human
aaguuugucucauuugaucuuc

SEQ ID NO: 1006991 - RNA, 20 nt, Human
aaagauacuuuuuguaaugg

SEQ ID NO: 1006992 - RNA, 22 nt, Human
gguguuguacauucuguggauu

SEQ ID NO: 1006993 - RNA, 22 nt, Human
cauuguguauuucuguaguacu

SEQ ID NO: 1006994 - RNA, 22 nt, Human
cacugguugccucuuucuguuc

SEQ ID NO: 1006995 - RNA, 22 nt, Human
uuauuuaaaagugguaagauuc

SEQ ID NO: 1006996 - RNA, 22 nt, Human
augaauaaaacauuuuaaucag

SEQ ID NO: 1006997 - RNA, 22 nt, Human
ucuuggcaguucuugugcuuuu

SEQ ID NO: 1006998 - RNA, 22 nt, Human
uauuuggugaaucuauggucag

SEQ ID NO: 1006999 - RNA, 22 nt, Human
ucaagaaagggcuucaccagga

SEQ ID NO: 1007000 - RNA, 22 nt, Human
ugguggcacugacaucagacac

SEQ ID NO: 1007001 - RNA, 22 nt, Human
aaaacauuuuacugccaucuca

SEQ ID NO: 1007002 - RNA, 22 nt, Human
cagcuauuguucuguauaauga

SEQ ID NO: 1007003 - RNA, 22 nt, Human
uuguccuuaccucaaucuggaa

SEQ ID NO: 1007004 - RNA, 22 nt, Human
caguuaaacagauugaguguua

SEQ ID NO: 1007005 - RNA, 22 nt, Human
augcaucaccgaguugcccacc

SEQ ID NO: 1007006 - RNA, 22 nt, Human
aagaugauuauguagauuggga

SEQ ID NO: 1007007 - RNA, 22 nt, Human
uuuucuaacaucuaguaauuug

SEQ ID NO: 1007008 - RNA, 22 nt, Human
ccugaaaugaguucugcucacu

SEQ ID NO: 1007009 - RNA, 22 nt, Human
acuagaaacuaauggauuauua

SEQ ID NO: 1007010 - RNA, 22 nt, Human
aacaugaugacauuguaagcuu

SEQ ID NO: 1007011 - RNA, 23 nt, Human
cuguuauauggguguuaugugcu

SEQ ID NO: 1007012 - RNA, 22 nt, Human
uuccaaguuaggcgagcuggug

SEQ ID NO: 1007013 - RNA, 18 nt, Human
ucugaaggaaugauucca

SEQ ID NO: 1007014 - RNA, 22 nt, Human
auuaaauuggacgcugggggaa

SEQ ID NO: 1007015 - RNA, 22 nt, Human
uccacagugguggaauuguuca

SEQ ID NO: 1007016 - RNA, 22 nt, Human
uuuccaaggaugugucucucua

SEQ ID NO: 1007017 - RNA, 20 nt, Human
acuagaaagucacugggggg

SEQ ID NO: 1007018 - RNA, 22 nt, Human
agcuggugugccaguuccaguu

SEQ ID NO: 1007019 - RNA, 22 nt, Human
acaauuucuaauauagaucuua

SEQ ID NO: 1007020 - RNA, 22 nt, Human
acugguuuuggaaaucaguaca

SEQ ID NO: 1007021 - RNA, 22 nt, Human
cauuuuccucugcugguguuca

SEQ ID NO: 1007022 - RNA, 22 nt, Human
cauaacauccuugcuacuuuga

SEQ ID NO: 1007023 - RNA, 20 nt, Human
auacuuguuuucaggcuuuu

SEQ ID NO: 1007024 - RNA, 22 nt, Human
cuacuucuguggcucuaagaga

SEQ ID NO: 1007025 - RNA, 22 nt, Human
aaaucaugguggaagaaacaga

SEQ ID NO: 1007026 - RNA, 22 nt, Human
guaauucugugugaaucuauua

SEQ ID NO: 1007027 - RNA, 22 nt, Human
uucuucauucccuuacuuccga

SEQ ID NO: 1007028 - RNA, 22 nt, Human
gugguuguuuccagguuugaaa

SEQ ID NO: 1007029 - RNA, 22 nt, Human
aaggauuuuuggaaugagaugg

SEQ ID NO: 1007030 - RNA, 22 nt, Human
aggggaauggguagacuguuga

SEQ ID NO: 1007031 - RNA, 22 nt, Human
guuuccuuuuggaauuagagcu

SEQ ID NO: 1007032 - RNA, 22 nt, Human
ugcuugcugaaaggcauuuaga

SEQ ID NO: 1007033 - RNA, 22 nt, Human
uuaguguccagaguuuuuauua

SEQ ID NO: 1007034 - RNA, 22 nt, Human
aguaacagguguacagacuauc

SEQ ID NO: 1007035 - RNA, 22 nt, Human
uagcauuuagaacaccuugaga

SEQ ID NO: 1007036 - RNA, 22 nt, Human
aagaauaagaggauuuagaaca

SEQ ID NO: 1007037 - RNA, 22 nt, Human
aaaugcaugugcuauagaugug

SEQ ID NO: 1007038 - RNA, 22 nt, Human
auacaacagaaaaugauuauuc

SEQ ID NO: 1007039 - RNA, 22 nt, Human
guuauucuauuaaugugauugu

SEQ ID NO: 1007040 - RNA, 22 nt, Human
ucagcacaggucuugcaaaaca

SEQ ID NO: 1007041 - RNA, 22 nt, Human
gaaacauuuguugaguacuugc

SEQ ID NO: 1007042 - RNA, 22 nt, Human
gaucuguccuggcaguuaacac

SEQ ID NO: 1007043 - RNA, 22 nt, Human
agaauaagccugacgaaaccua

SEQ ID NO: 1007044 - RNA, 22 nt, Human
uucacagugguagugcauuuag

SEQ ID NO: 1007045 - RNA, 23 nt, Human
augccaggcugccuggccagccu

SEQ ID NO: 1007046 - RNA, 22 nt, Human
gucuugcacuuaccuaagaacu

SEQ ID NO: 1007047 - RNA, 22 nt, Human
cauucauaggaggagaugauua

SEQ ID NO: 1007048 - RNA, 22 nt, Human
gggaggaaggcuugggugagua

SEQ ID NO: 1007049 - RNA, 22 nt, Human
ugguggggccagacuucagcuc

SEQ ID NO: 1007050 - RNA, 22 nt, Human
aaauucuguccugaaugccauu

SEQ ID NO: 1007051 - RNA, 22 nt, Human
ucugaauucuuagaauuaaagg

SEQ ID NO: 1007052 - RNA, 19 nt, Human
uaugacaaguacuaguucu

SEQ ID NO: 1007053 - RNA, 22 nt, Human
cuugugaaaugccagauaaucu

SEQ ID NO: 1007054 - RNA, 22 nt, Human
uuguguacucaccagcacauac

SEQ ID NO: 1007055 - RNA, 21 nt, Human
cuagaaagaauguugucgucu

SEQ ID NO: 1007056 - RNA, 22 nt, Human
aaacaucuucucuugauucuuu

SEQ ID NO: 1007057 - RNA, 22 nt, Human
uuccuucuucauuguguuacag

SEQ ID NO: 1007058 - RNA, 18 nt, Human
gcugaaauucuaaacaaa

SEQ ID NO: 1007059 - RNA, 22 nt, Human
augauuuguuaacagacuuaau

SEQ ID NO: 1007060 - RNA, 22 nt, Human
aaauugcaaaaguacuuuuagg

SEQ ID NO: 1007061 - RNA, 22 nt, Human
uuuugucagugagaacagaguu

SEQ ID NO: 1007062 - RNA, 22 nt, Human
guucuucaaagugacaacuaaa

SEQ ID NO: 1007063 - RNA, 22 nt, Human
aaugcuuuuugcgaaaugugca

SEQ ID NO: 1007064 - RNA, 22 nt, Human
uuccaauaaaauguuauuugca

SEQ ID NO: 1007065 - RNA, 22 nt, Human
uuuaauuauaucugggcaguua

SEQ ID NO: 1007066 - RNA, 22 nt, Human
gggagaguagcuggaagguucu

SEQ ID NO: 1007067 - RNA, 22 nt, Human
uuuccuguccugguacuuggca

SEQ ID NO: 1007068 - RNA, 22 nt, Human
uuccuuaguuauuugguccccu

SEQ ID NO: 1007069 - RNA, 22 nt, Human
aggcaguggcuuuuguuguguu

SEQ ID NO: 1007070 - RNA, 22 nt, Human
uuuaauuuucugggcccagcag

SEQ ID NO: 1007071 - RNA, 22 nt, Human
guuucuuauuucaacuggaaca

SEQ ID NO: 1007072 - RNA, 22 nt, Human
ugugcuugucguggagccaggc

SEQ ID NO: 1007073 - RNA, 23 nt, Human
cagcugguugugggaguggcugc

SEQ ID NO: 1007074 - RNA, 22 nt, Human
ugccugugggugaugauuugau

SEQ ID NO: 1007075 - RNA, 22 nt, Human
gagaacuugaacuuuuccucug

SEQ ID NO: 1007076 - RNA, 21 nt, Human
gacauugagcgugucgcagug

SEQ ID NO: 1007077 - RNA, 22 nt, Human
cauuguuggcagagggacagag

SEQ ID NO: 1007078 - RNA, 22 nt, Human
uuugagaaacagacgaaagaca

SEQ ID NO: 1007079 - RNA, 22 nt, Human
uggaauuaucugaagugauuug

SEQ ID NO: 1007080 - RNA, 22 nt, Human
augaucaagaauuuuguauucc

SEQ ID NO: 1007081 - RNA, 22 nt, Human
uguguacauguaucaacuaucg

SEQ ID NO: 1007082 - RNA, 20 nt, Human
caauaauuuacuucccuauu

SEQ ID NO: 1007083 - RNA, 22 nt, Human
uucaacaacuugguucaaaugg

SEQ ID NO: 1007084 - RNA, 22 nt, Human
ugaauaugugacuuugauuuca

SEQ ID NO: 1007085 - RNA, 22 nt, Human
guucuucaggcugugcucuaga

SEQ ID NO: 1007086 - RNA, 22 nt, Human
uaucuuaaaaaucgaagcagau

SEQ ID NO: 1007087 - RNA, 22 nt, Human
aaugaguuuguucuauuauuug

SEQ ID NO: 1007088 - RNA, 23 nt, Human
cguuuuuuccucagauguucugg

SEQ ID NO: 1007089 - RNA, 22 nt, Human
uguucaguuugcuaucauaauc

SEQ ID NO: 1007090 - RNA, 22 nt, Human
augcuacauuuugguuuauaaa

SEQ ID NO: 1007091 - RNA, 22 nt, Human
agugaauuagccuauuuguaaa

SEQ ID NO: 1007092 - RNA, 19 nt, Human
agcagccaucgaccaugga

SEQ ID NO: 1007093 - RNA, 22 nt, Human
ggcuuccuccuuccugcuguca

SEQ ID NO: 1007094 - RNA, 22 nt, Human
cuucauguacaguuauuggaga

SEQ ID NO: 1007095 - RNA, 22 nt, Human
aucuaaagugucauaaguagcu

SEQ ID NO: 1007096 - RNA, 22 nt, Human
uaauucuagauugacauuuuga

SEQ ID NO: 1007097 - RNA, 22 nt, Human
cugaaagcaaaguaauucuuaa

SEQ ID NO: 1007098 - RNA, 22 nt, Human
uuuccaguuguucuagaaagcu

SEQ ID NO: 1007099 - RNA, 22 nt, Human
uuauuuaaaauguagguuggga

SEQ ID NO: 1007100 - RNA, 22 nt, Human
uuucauguuggauacuguuuca

SEQ ID NO: 1007101 - RNA, 22 nt, Human
uuuguguuguacuucugugcau

SEQ ID NO: 1007102 - RNA, 22 nt, Human
guaguucuuucucaauguucaa

SEQ ID NO: 1007103 - RNA, 22 nt, Human
uagauuaucccugauuugucca

SEQ ID NO: 1007104 - RNA, 22 nt, Human
uaggauaugcauuuuuauacau

SEQ ID NO: 1007105 - RNA, 22 nt, Human
auuguugacuugauuacucaac

SEQ ID NO: 1007106 - RNA, 18 nt, Human
gaacagcaauuucauguu

SEQ ID NO: 1007107 - RNA, 22 nt, Human
uaaucuuagacauguauuuuuc

SEQ ID NO: 1007108 - RNA, 22 nt, Human
cuuguauuaggaagaaugcuuu

SEQ ID NO: 1007109 - RNA, 22 nt, Human
guucucucagcgauagugaugg

SEQ ID NO: 1007110 - RNA, 22 nt, Human
aauuagaagcuguuagcaaaau

SEQ ID NO: 1007111 - RNA, 22 nt, Human
auucuugauauagauaguuaau

SEQ ID NO: 1007112 - RNA, 19 nt, Human
gcuuccagcacugcaggag

SEQ ID NO: 1007113 - RNA, 22 nt, Human
ugaaucaaugaauugcacuuca

SEQ ID NO: 1007114 - RNA, 22 nt, Human
ccuuccaguucuugguuguaau

SEQ ID NO: 1007115 - RNA, 22 nt, Human
uuuccagucucugccuccaagg

SEQ ID NO: 1007116 - RNA, 20 nt, Human
aaaaacaguaaugcugaaga

SEQ ID NO: 1007117 - RNA, 22 nt, Human
uaucuguuuuuacagugucuuu

SEQ ID NO: 1007118 - RNA, 23 nt, Human
aguguucagcauguaguaaauac

SEQ ID NO: 1007119 - RNA, 22 nt, Human
aagucaauuaguaaacuuggaa

SEQ ID NO: 1007120 - RNA, 21 nt, Human
aucuuaaaaggucuuaacuuu

SEQ ID NO: 1007121 - RNA, 22 nt, Human
aaauugcuugagauuagucucc

SEQ ID NO: 1007122 - RNA, 22 nt, Human
ucucaagaucucaagauggccc

SEQ ID NO: 1007123 - RNA, 22 nt, Human
uuacaauuacuugaucucagcu

SEQ ID NO: 1007124 - RNA, 21 nt, Human
acuguauuguuuucaaggauc

SEQ ID NO: 1007125 - RNA, 20 nt, Human
acagagauccucucuuuauc

SEQ ID NO: 1007126 - RNA, 22 nt, Human
cauugcugugggcauuugcugc

SEQ ID NO: 1007127 - RNA, 22 nt, Human
auucagaaauagaaaauuugau

SEQ ID NO: 1007128 - RNA, 22 nt, Human
cgauuuccgcuugaucugaucu

SEQ ID NO: 1007129 - RNA, 21 nt, Human
uggagagugauuucagugugg

SEQ ID NO: 1007130 - RNA, 22 nt, Human
auucccuuugacgaucccuagg

SEQ ID NO: 1007131 - RNA, 22 nt, Human
cugcaucacagcaggaggcaca

SEQ ID NO: 1007132 - RNA, 22 nt, Human
uugauguaauacuuugcaacca

SEQ ID NO: 1007133 - RNA, 22 nt, Human
acaugacagugacuuuauaaga

SEQ ID NO: 1007134 - RNA, 22 nt, Human
ucuucaugucaugguauauuga

SEQ ID NO: 1007135 - RNA, 21 nt, Human
uuuguucaggggcaaaguuaa

SEQ ID NO: 1007136 - RNA, 22 nt, Human
auuuugacauugcggcauugcu

SEQ ID NO: 1007137 - RNA, 22 nt, Human
uuugaaaggagcuuuauccaga

SEQ ID NO: 1007138 - RNA, 22 nt, Human
ugaacagugugagggugugacc

SEQ ID NO: 1007139 - RNA, 21 nt, Human
uuucaagggacccuggggauc

SEQ ID NO: 1007140 - RNA, 22 nt, Human
cuccagaggcgacuugcaucac

SEQ ID NO: 1007141 - RNA, 22 nt, Human
uuugacaugugcuuauaacuuu

SEQ ID NO: 1007142 - RNA, 22 nt, Human
gagaauguuaauguugaaguau

SEQ ID NO: 1007143 - RNA, 22 nt, Human
caugugaauuccaaagcuaggu

SEQ ID NO: 1007144 - RNA, 22 nt, Human
aguguuugaguuugcggcauug

SEQ ID NO: 1007145 - RNA, 22 nt, Human
uuugaacuucuaccugucauau

SEQ ID NO: 1007146 - RNA, 22 nt, Human
auugaagacuugguauccgugg

SEQ ID NO: 1007147 - RNA, 22 nt, Human
aagcauuuuagauaaagcauca

SEQ ID NO: 1007148 - RNA, 22 nt, Human
caauaauugcuuuccagaguua

SEQ ID NO: 1007149 - RNA, 22 nt, Human
auacaugugugugcauacaugu

SEQ ID NO: 1007150 - RNA, 22 nt, Human
aaggaucauguauauguuuaag

SEQ ID NO: 1007151 - RNA, 22 nt, Human
uaaagugaaguucagaauggcu

SEQ ID NO: 1007152 - RNA, 22 nt, Human
uaauccaaaacugaaucugugg

SEQ ID NO: 1007153 - RNA, 22 nt, Human
aaugagaauguaagugaagaga

SEQ ID NO: 1007154 - RNA, 22 nt, Human
cagagcugagucuucaagguug

SEQ ID NO: 1007155 - RNA, 22 nt, Human
gucauuuuugacuuugaaguga

SEQ ID NO: 1007156 - RNA, 22 nt, Human
uugcugugucauuuguuuaauc

SEQ ID NO: 1007157 - RNA, 22 nt, Human
guucuuaaagauucaucaagca

SEQ ID NO: 1007158 - RNA, 22 nt, Human
ugaguguuguaaccauaugauu

SEQ ID NO: 1007159 - RNA, 22 nt, Human
ugccuguguccccuucuuggca

SEQ ID NO: 1007160 - RNA, 22 nt, Human
aaucuguugucaggaauccaca

SEQ ID NO: 1007161 - RNA, 22 nt, Human
uuucauuauaaaaaguuggcuu

SEQ ID NO: 1007162 - RNA, 19 nt, Human
uuuaaugugugcugcaauc

SEQ ID NO: 1007163 - RNA, 22 nt, Human
guaaaucagugucauuuuagaa

SEQ ID NO: 1007164 - RNA, 22 nt, Human
cuucuuaaaguugucacagcug

SEQ ID NO: 1007165 - RNA, 22 nt, Human
ucuucaugaaauugauugcuua

SEQ ID NO: 1007166 - RNA, 20 nt, Human
uaugauaauuacaaaauagu

SEQ ID NO: 1007167 - RNA, 22 nt, Human
aggauaauaauaaucucguuua

SEQ ID NO: 1007168 - RNA, 22 nt, Human
auagucuuagaaucuugagugu

SEQ ID NO: 1007169 - RNA, 22 nt, Human
acaaguuucauuguuuagaacc

SEQ ID NO: 1007170 - RNA, 22 nt, Human
auuguauacaagcuuaauuguu

SEQ ID NO: 1007171 - RNA, 22 nt, Human
uuugaauauacuucaaacaaag

SEQ ID NO: 1007172 - RNA, 22 nt, Human
uuuuuaagagucuggaaauagu

SEQ ID NO: 1007173 - RNA, 22 nt, Human
cauugcuuugugcauauuuaaa

SEQ ID NO: 1007174 - RNA, 22 nt, Human
gucccucugccugugguucucu

SEQ ID NO: 1007175 - RNA, 22 nt, Human
ugucuucuaccuugacagcauu

SEQ ID NO: 1007176 - RNA, 22 nt, Human
augcacaagguagauuauuauu

SEQ ID NO: 1007177 - RNA, 19 nt, Human
caggucuucuuggaggacu

SEQ ID NO: 1007178 - RNA, 20 nt, Human
uuucacaaugaacaugucuc

SEQ ID NO: 1007179 - RNA, 22 nt, Human
cauuguccucugaugccuuccc

SEQ ID NO: 1007180 - RNA, 22 nt, Human
ugugugaacucucugauguaca

SEQ ID NO: 1007181 - RNA, 22 nt, Human
guucuucagauuccauuucagu

SEQ ID NO: 1007182 - RNA, 22 nt, Human
uugcaucagcaggcauaauugg

SEQ ID NO: 1007183 - RNA, 22 nt, Human
aucauugaguaaaaugaauaca

SEQ ID NO: 1007184 - RNA, 22 nt, Human
acauuguugagccucuuguuca

SEQ ID NO: 1007185 - RNA, 22 nt, Human
uggaaaauauuuaggugaauga

SEQ ID NO: 1007186 - RNA, 22 nt, Human
ucacaugcucaccuaagccaca

SEQ ID NO: 1007187 - RNA, 22 nt, Human
gcagucauggguagaacucaag

SEQ ID NO: 1007188 - RNA, 22 nt, Human
cagcuuuugcagacuucuugcc

SEQ ID NO: 1007189 - RNA, 22 nt, Human
uuucaugauuaacuuagugaau

SEQ ID NO: 1007190 - RNA, 22 nt, Human
cuuccagugcauagguagauca

SEQ ID NO: 1007191 - RNA, 22 nt, Human
uuaaggaacuugucuuucucuu

SEQ ID NO: 1007192 - RNA, 22 nt, Human
agguuuggguucauugcuggcu

SEQ ID NO: 1007193 - RNA, 22 nt, Human
uaaguauguuagaaaaucaagu

SEQ ID NO: 1007194 - RNA, 22 nt, Human
cuguuccuccaccucaacaaac

SEQ ID NO: 1007195 - RNA, 22 nt, Human
ucaguaaaugagcaaaaauuuc

SEQ ID NO: 1007196 - RNA, 22 nt, Human
gaggcaaagcauguggcucagg

SEQ ID NO: 1007197 - RNA, 22 nt, Human
ugcuuuggcccaacauugaugc

SEQ ID NO: 1007198 - RNA, 22 nt, Human
uaguauuuccuguaagcuauag

SEQ ID NO: 1007199 - RNA, 22 nt, Human
agaugguucagaauuauaaaga

SEQ ID NO: 1007200 - RNA, 22 nt, Human
aauugcuuuacaagccguuuaa

SEQ ID NO: 1007201 - RNA, 22 nt, Human
gaguggggcccacugcugggug

SEQ ID NO: 1007202 - RNA, 21 nt, Human
gcucuguguuacaaguugggg

SEQ ID NO: 1007203 - RNA, 22 nt, Human
ugucuucauuccccaugaaguc

SEQ ID NO: 1007204 - RNA, 22 nt, Human
ucugaaauuuuaguuauagaaa

SEQ ID NO: 1007205 - RNA, 22 nt, Human
gagccacaguggauugauucca

SEQ ID NO: 1007206 - RNA, 22 nt, Human
gucuuuuuuacaccuuacauca

SEQ ID NO: 1007207 - RNA, 22 nt, Human
aaucuguuuuaaaguuugugcc

SEQ ID NO: 1007208 - RNA, 22 nt, Human
uuagcacugucugguuaucuug

SEQ ID NO: 1007209 - RNA, 22 nt, Human
caguuuuucaaaauuacaugau

SEQ ID NO: 1007210 - RNA, 22 nt, Human
aauacagauggcaugugaagau

SEQ ID NO: 1007211 - RNA, 22 nt, Human
cuggagggcugcagcgaggcug

SEQ ID NO: 1007212 - RNA, 22 nt, Human
uucugauuguuggaggaugcuu

SEQ ID NO: 1007213 - RNA, 22 nt, Human
ugcauguuucuguauguuaaug

SEQ ID NO: 1007214 - RNA, 22 nt, Human
uaacauuucggugacaguggga

SEQ ID NO: 1007215 - RNA, 22 nt, Human
gauuuucauuauagcuaguuuc

SEQ ID NO: 1007216 - RNA, 22 nt, Human
uggauguuugaaguugcaugug

SEQ ID NO: 1007217 - RNA, 22 nt, Human
uuugggcuguacaauuucugua

SEQ ID NO: 1007218 - RNA, 22 nt, Human
uaaaaucaugacagauugacau

SEQ ID NO: 1007219 - RNA, 22 nt, Human
uucucucaguuaaacuuuguga

SEQ ID NO: 1007220 - RNA, 22 nt, Human
cuuauuggucccaggaggagaa

SEQ ID NO: 1007221 - RNA, 22 nt, Human
aauucauacucuauauugcuuu

SEQ ID NO: 1007222 - RNA, 22 nt, Human
aacaguaugugagauuuacaca

SEQ ID NO: 1007223 - RNA, 22 nt, Human
cuagagaaaaagcuuagguacg

SEQ ID NO: 1007224 - RNA, 22 nt, Human
uaaguugauuauaaccacugga

SEQ ID NO: 1007225 - RNA, 22 nt, Human
gugauuucagguuuuucauacu

SEQ ID NO: 1007226 - RNA, 22 nt, Human
cuuucugaggagacgggcuuug

SEQ ID NO: 1007227 - RNA, 22 nt, Human
guuuccaagucucucaacaccc

SEQ ID NO: 1007228 - RNA, 22 nt, Human
aauugguuugaauaaauaaaga

SEQ ID NO: 1007229 - RNA, 22 nt, Human
agucaacauuugagaugcaaug

SEQ ID NO: 1007230 - RNA, 22 nt, Human
uuucucuuucaaucugcaguac

SEQ ID NO: 1007231 - RNA, 23 nt, Human
cuuuccuuucuuugacacccagc

SEQ ID NO: 1007232 - RNA, 21 nt, Human
agauuguauggaggugagagg

SEQ ID NO: 1007233 - RNA, 21 nt, Human
guucaauagcucuuugaaugc

SEQ ID NO: 1007234 - RNA, 22 nt, Human
ucccaaguagaugggaauacag

SEQ ID NO: 1007235 - RNA, 22 nt, Human
aguguugucaaacggcucagca

SEQ ID NO: 1007236 - RNA, 22 nt, Human
caagauauguccuguuacuaag

SEQ ID NO: 1007237 - RNA, 22 nt, Human
caaucaaugcugcuaguuccuu

SEQ ID NO: 1007238 - RNA, 22 nt, Human
ggacauggaaguauggagugga

SEQ ID NO: 1007239 - RNA, 22 nt, Human
uguucuuagguauuugacaguc

SEQ ID NO: 1007240 - RNA, 22 nt, Human
acucauuugcaugaugugcuau

SEQ ID NO: 1007241 - RNA, 22 nt, Human
guugcaaaugggaagaugguua

SEQ ID NO: 1007242 - RNA, 22 nt, Human
acauauuuugaaagcuuucuaa

SEQ ID NO: 1007243 - RNA, 22 nt, Human
uuugaaauguaucaguauaggu

SEQ ID NO: 1007244 - RNA, 22 nt, Human
gcuguggcuccaauggugagcc

SEQ ID NO: 1007245 - RNA, 22 nt, Human
uaauuuugucacagugacaugc

SEQ ID NO: 1007246 - RNA, 22 nt, Human
uaaguauuggccuauagcuaga

SEQ ID NO: 1007247 - RNA, 22 nt, Human
ugucuuaugcugcauagacuau

SEQ ID NO: 1007248 - RNA, 22 nt, Human
uuacacaacaucuguauuauua

SEQ ID NO: 1007249 - RNA, 20 nt, Human
caucaacaccuugucagccu

SEQ ID NO: 1007250 - RNA, 22 nt, Human
auuugugggacuauaaugcagg

SEQ ID NO: 1007251 - RNA, 22 nt, Human
uugaugcugucuuucagaauca

SEQ ID NO: 1007252 - RNA, 22 nt, Human
ggcagccagagggcagcuggau

SEQ ID NO: 1007253 - RNA, 22 nt, Human
ucuuuuaucuguuguguaacaa

SEQ ID NO: 1007254 - RNA, 22 nt, Human
augaauuguccgauguugugca

SEQ ID NO: 1007255 - RNA, 22 nt, Marburg virus
ugaagagcaccgaagcauccag

SEQ ID NO: 1007256 - RNA, 22 nt, Marburg virus
ggagcacauguuugauucuucg

SEQ ID NO: 1007257 - RNA, 22 nt, Marburg virus
ugaagagcaccgaagcauccag

SEQ ID NO: 1007258 - RNA, 22 nt, Marburg virus
ucaucaucauuguuugggucug

SEQ ID NO: 1007259 - RNA, 22 nt, Marburg virus
ggagcacauguuugauucuucg

SEQ ID NO: 1007260 - RNA, 22 nt, Marburg virus
gacccugaaccggauguuauga

SEQ ID NO: 1007261 - RNA, 22 nt, Human
acuuugugcccaacagaaagaa

SEQ ID NO: 1007262 - RNA, 22 nt, Human
gauucugagcugguguuuuacg

SEQ ID NO: 1007263 - RNA, 22 nt, Human
uuccauaauaaccugagagaaa

SEQ ID NO: 1007264 - RNA, 19 nt, Human
gcugugccucucuccugcu

SEQ ID NO: 1007265 - RNA, 23 nt, Human
gggaccugguaggaggugauugg

SEQ ID NO: 1007266 - RNA, 18 nt, Human
aagaggaggagcagguug

SEQ ID NO: 1007267 - RNA, 22 nt, Human
cacaugcauaaggauaauuacu

SEQ ID NO: 1007268 - RNA, 22 nt, Human
ucauuacagagauauaaucuac

SEQ ID NO: 1007269 - RNA, 22 nt, Human
gcucugagucucagcuaccaca

SEQ ID NO: 1007270 - RNA, 21 nt, Human
aaggaaaagcuuggucucuga

SEQ ID NO: 1007271 - RNA, 21 nt, Human
aucagcaaaugccugucuccc

SEQ ID NO: 1007272 - RNA, 22 nt, Human
uuuucucuacaaaauaaccagc

SEQ ID NO: 1007273 - RNA, 22 nt, Human
ucugggagacguguguugucag

SEQ ID NO: 1007274 - RNA, 22 nt, Human
ggccagaggccauccuccugcu

SEQ ID NO: 1007275 - RNA, 22 nt, Human
agguggguccuggcucugccau

SEQ ID NO: 1007276 - RNA, 22 nt, Human
uguauuagaucugagaacuucu

SEQ ID NO: 1007277 - RNA, 22 nt, Human
cugggaguugacgaggcuugua

SEQ ID NO: 1007278 - RNA, 22 nt, Human
cccaggagagaggccaguuggc

SEQ ID NO: 1007279 - RNA, 22 nt, Human
agaagcugacagaugcagcagg

SEQ ID NO: 1007280 - RNA, 22 nt, Human
augaaacagugaauuagucaag

SEQ ID NO: 1007281 - RNA, 22 nt, Human
aggacuucuccgauaagucaga

SEQ ID NO: 1007282 - RNA, 22 nt, Human
ccagcccugaacccugcugcau

SEQ ID NO: 1007283 - RNA, 22 nt, Human
uguccacaucacucacuuguca

SEQ ID NO: 1007284 - RNA, 22 nt, Human
cuacauaaucuggauuugucug

SEQ ID NO: 1007285 - RNA, 19 nt, Human
auagaaaggguuaaagaca

SEQ ID NO: 1007286 - RNA, 22 nt, Human
cccuggaggucagaggccuggg

SEQ ID NO: 1007287 - RNA, 22 nt, Human
caagcccaggauuccccaguua

SEQ ID NO: 1007288 - RNA, 22 nt, Human
uggggccugagguggagcugca

SEQ ID NO: 1007289 - RNA, 22 nt, Human
cccucugccucugaguaggaca

SEQ ID NO: 1007290 - RNA, 22 nt, Human
ccuuggagcggucagcacuggu

SEQ ID NO: 1007291 - RNA, 22 nt, Human
uuugcauuaguuuagauuucaa

SEQ ID NO: 1007292 - RNA, 22 nt, Human
cucauaaugugacuguauuuga

SEQ ID NO: 1007293 - RNA, 22 nt, Human
ccuugggauuucucaugccaau

SEQ ID NO: 1007294 - RNA, 22 nt, Human
ggccucacccaucggugccuuu

SEQ ID NO: 1007295 - RNA, 22 nt, Human
gagcacagccaaaguaagaagg

SEQ ID NO: 1007296 - RNA, 22 nt, Human
agagucagcuuaugacacaguc

SEQ ID NO: 1007297 - RNA, 20 nt, Human
uguuaaaggacacuugcuuu

SEQ ID NO: 1007298 - RNA, 18 nt, Human
gguggccuugacuucucu

SEQ ID NO: 1007299 - RNA, 22 nt, Human
gcucugcuugcaucaugacugc

SEQ ID NO: 1007300 - RNA, 22 nt, Human
gucccugcccuccugggacuca

SEQ ID NO: 1007301 - RNA, 22 nt, Human
cauuagaagaacaguuauauua

SEQ ID NO: 1007302 - RNA, 22 nt, Human
uaggaaaaauacagaauuauau

SEQ ID NO: 1007303 - RNA, 22 nt, Human
aucauguuccagaaacagugau

SEQ ID NO: 1007304 - RNA, 22 nt, Human
uucacaaaacacuauuuucugg

SEQ ID NO: 1007305 - RNA, 22 nt, Human
agguuauaugucauacugaagu

SEQ ID NO: 1007306 - RNA, 18 nt, Human
ggaaaaggagugucuagc

SEQ ID NO: 1007307 - RNA, 22 nt, Human
agaacuuaggaacaacagcuua

SEQ ID NO: 1007308 - RNA, 22 nt, Human
caagggcuucaaguggccaaga

SEQ ID NO: 1007309 - RNA, 22 nt, Human
uggagccaaggccaguucucag

SEQ ID NO: 1007310 - RNA, 22 nt, Human
agagcugauuugauuacagugc

SEQ ID NO: 1007311 - RNA, 22 nt, Human
gguguccuacagggccgcaggc

SEQ ID NO: 1007312 - RNA, 22 nt, Human
ucugucuccugccagugccucu

SEQ ID NO: 1007313 - RNA, 22 nt, Human
ugaaaugaaacagaacauauca

SEQ ID NO: 1007314 - RNA, 21 nt, Human
agcuuccugcagugggagguc

SEQ ID NO: 1007315 - RNA, 19 nt, Human
uuuggcacucugaaguguu

SEQ ID NO: 1007316 - RNA, 23 nt, Human
gggcugcuccaggccaaggcugg

SEQ ID NO: 1007317 - RNA, 22 nt, Human
agaaaugaauauguagugguua

SEQ ID NO: 1007318 - RNA, 22 nt, Human
ccugagacaugaaccaggcucc

SEQ ID NO: 1007319 - RNA, 22 nt, Human
agccuguccagaggacagggcu

SEQ ID NO: 1007320 - RNA, 20 nt, Human
cagaaggucuaagcuuuaga

SEQ ID NO: 1007321 - RNA, 19 nt, Human
cagaguacaccagauagga

SEQ ID NO: 1007322 - RNA, 22 nt, Human
agggagccagaguugggagcuc

SEQ ID NO: 1007323 - RNA, 22 nt, Human
ugcaggugcguuuucaagccuc

SEQ ID NO: 1007324 - RNA, 22 nt, Human
uugcauuucccauugaguaaug

SEQ ID NO: 1007325 - RNA, 22 nt, Human
gggaguggauuauguggaccca

SEQ ID NO: 1007326 - RNA, 22 nt, Human
acagagcuuaggaugacuccca

SEQ ID NO: 1007327 - RNA, 18 nt, Human
auccuugaugagaggucu

SEQ ID NO: 1007328 - RNA, 22 nt, Human
acacaaugcauauuuuuccaga

SEQ ID NO: 1007329 - RNA, 22 nt, Human
uagcacauacauaauagauaga

SEQ ID NO: 1007330 - RNA, 22 nt, Human
ucaggcugcccguucagggcuc

SEQ ID NO: 1007331 - RNA, 22 nt, Human
ucagagucauugcaaguagaag

SEQ ID NO: 1007332 - RNA, 22 nt, Human
ggaggcucccacgcagcucaca

SEQ ID NO: 1007333 - RNA, 22 nt, Human
gcauagucaguaggauucucaa

SEQ ID NO: 1007334 - RNA, 22 nt, Human
ucucugguuauuaacuaacucc

SEQ ID NO: 1007335 - RNA, 22 nt, Human
uguggcuguguccaccugcugc

SEQ ID NO: 1007336 - RNA, 22 nt, Human
ccuguguggaaaccgcaugacg

SEQ ID NO: 1007337 - RNA, 22 nt, Human
ugcaguggaaucuggagagcag

SEQ ID NO: 1007338 - RNA, 22 nt, Human
caagauggaguccgggaaugug

SEQ ID NO: 1007339 - RNA, 22 nt, Human
auucuucaucacuaccuuguga

SEQ ID NO: 1007340 - RNA, 18 nt, Human
uggguggcuagggaguuu

SEQ ID NO: 1007341 - RNA, 22 nt, Human
ugggccuggcccuguggaggag

SEQ ID NO: 1007342 - RNA, 22 nt, Human
ggucccugguucccucugagcu

SEQ ID NO: 1007343 - RNA, 22 nt, Human
ugcagcuucuccaucuccuugu

SEQ ID NO: 1007344 - RNA, 17 nt, Human
gccucugcuugugucau

SEQ ID NO: 1007345 - RNA, 22 nt, Human
uccucagaaaccccugugaggu

SEQ ID NO: 1007346 - RNA, 20 nt, Human
gcugccuuguccugcuuggu

SEQ ID NO: 1007347 - RNA, 22 nt, Human
uuuauuauguacaggcacuaua

SEQ ID NO: 1007348 - RNA, 22 nt, Human
ccucuggguaucuguggaagua

SEQ ID NO: 1007349 - RNA, 22 nt, Human
agcugccacauggugucacugu

SEQ ID NO: 1007350 - RNA, 22 nt, Human
ugcugccaugcagagcaacaga

SEQ ID NO: 1007351 - RNA, 22 nt, Human
ucauugcagugauguuguaugu

SEQ ID NO: 1007352 - RNA, 22 nt, Human
uugaauuagacuuugcuacagg

SEQ ID NO: 1007353 - RNA, 22 nt, Human
ugggccuguugggguugaguua

SEQ ID NO: 1007354 - RNA, 22 nt, Human
uugugucccccuuugagagcca

SEQ ID NO: 1007355 - RNA, 22 nt, Human
cccaggagguggagguugcagu

SEQ ID NO: 1007356 - RNA, 22 nt, Human
aaauguguuuagaugguuuauu

SEQ ID NO: 1007357 - RNA, 22 nt, Human
ggccucucuggcauggcugccc

SEQ ID NO: 1007358 - RNA, 22 nt, Human
gaggccugaaaggggaccuaug

SEQ ID NO: 1007359 - RNA, 18 nt, Human
acauuucuaggugaaagc

SEQ ID NO: 1007360 - RNA, 22 nt, Human
gcacugaaugccaaaguguagg

SEQ ID NO: 1007361 - RNA, 22 nt, Human
cagcucccagagugaccagcag

SEQ ID NO: 1007362 - RNA, 22 nt, Human
gauauguauugaaugaucauuu

SEQ ID NO: 1007363 - RNA, 22 nt, Human
cugugcugauucagcacaggcc

SEQ ID NO: 1007364 - RNA, 22 nt, Human
cacauuucucuaccucacacaa

SEQ ID NO: 1007365 - RNA, 22 nt, Human
cuggccuuggaagggagcccgu

SEQ ID NO: 1007366 - RNA, 20 nt, Human
cuaucuccuggcgugccuuc

SEQ ID NO: 1007367 - RNA, 19 nt, Human
ccuggaggugaagguucuc

SEQ ID NO: 1007368 - RNA, 22 nt, Human
ugagccagccucagaagucacg

SEQ ID NO: 1007369 - RNA, 22 nt, Human
agagcuuagaauuucagaugau

SEQ ID NO: 1007370 - RNA, 22 nt, Human
cugccacuuucacccagugcuc

SEQ ID NO: 1007371 - RNA, 22 nt, Human
caggcagcugggucaccguccc

SEQ ID NO: 1007372 - RNA, 19 nt, Human
ccuguucaugacucugucc

SEQ ID NO: 1007373 - RNA, 22 nt, Human
gcugcccaguucugcugcugcc

SEQ ID NO: 1007374 - RNA, 22 nt, Human
uuuguuaauucuuauguuagag

SEQ ID NO: 1007375 - RNA, 22 nt, Human
gggacaggcugagacuugagcu

SEQ ID NO: 1007376 - RNA, 16 nt, Human
agcagccagcacugga

SEQ ID NO: 1007377 - RNA, 22 nt, Human
ugccuguguccccuucuuggca

SEQ ID NO: 1007378 - RNA, 22 nt, Human
uuagagucaagcugcauguucu

SEQ ID NO: 1007379 - RNA, 20 nt, Human
gcccacucuaauccacuguc

SEQ ID NO: 1007380 - RNA, 22 nt, Human
agucuccuuggccucaaugccu

SEQ ID NO: 1007381 - RNA, 22 nt, Human
ccaaaguccuuucuccaccugc

SEQ ID NO: 1007382 - RNA, 22 nt, Human
aguuagaauagucagauuguag

SEQ ID NO: 1007383 - RNA, 22 nt, Human
gccagugugcaagaggccacca

SEQ ID NO: 1007384 - RNA, 22 nt, Human
acugcuuuuagaaaucuauaga

SEQ ID NO: 1007385 - RNA, 20 nt, Human
gucucagaauggauuugcau

SEQ ID NO: 1007386 - RNA, 22 nt, Human
ccugcuguucuguuuagugaac

SEQ ID NO: 1007387 - RNA, 22 nt, Human
ggcuccuguccuccuggagcuc

SEQ ID NO: 1007388 - RNA, 22 nt, Human
uaaaugcaguuaguacuugcca

SEQ ID NO: 1007389 - RNA, 22 nt, Human
uagcccagagucccaauuccag

SEQ ID NO: 1007390 - RNA, 22 nt, Human
agcccaagcauaggagggaggc

SEQ ID NO: 1007391 - RNA, 22 nt, Human
uauguaaaaauucaucaggcug

SEQ ID NO: 1007392 - RNA, 21 nt, Human
gcaggcuggucaaaccucagu

SEQ ID NO: 1007393 - RNA, 22 nt, Human
acagagagguaaaauauauagu

SEQ ID NO: 1007394 - RNA, 22 nt, Human
uccaggucuggccugcuaggca

SEQ ID NO: 1007395 - RNA, 22 nt, Human
guagggacuuguuuuacuagua

SEQ ID NO: 1007396 - RNA, 22 nt, Human
acugaaggaagcgggcaggggu

SEQ ID NO: 1007397 - RNA, 22 nt, Human
gaugagcauuguuucauguguu

SEQ ID NO: 1007398 - RNA, 22 nt, Human
aaacacagauuucuuuguccca

SEQ ID NO: 1007399 - RNA, 22 nt, Human
aaaguguagagacuuuggaacc

SEQ ID NO: 1007400 - RNA, 22 nt, Human
agccuucaguaaauccacugug

SEQ ID NO: 1007401 - RNA, 22 nt, Human
acacauauucauauguacuuac

SEQ ID NO: 1007402 - RNA, 22 nt, Human
cauugaaauauggaaacugaug

SEQ ID NO: 1007403 - RNA, 22 nt, Human
uugaaaggcacaggcaccuggg

SEQ ID NO: 1007404 - RNA, 20 nt, Human
gugaccagaagacagugggu

SEQ ID NO: 1007405 - RNA, 23 nt, Human
aaaguuugaagcaacaguaguug

SEQ ID NO: 1007406 - RNA, 22 nt, Human
uccuucagauuccugcuucugg

SEQ ID NO: 1007407 - RNA, 22 nt, Human
auacaucuugucagauucaugu

SEQ ID NO: 1007408 - RNA, 22 nt, Human
gcagcacauauaaacaaagaga

SEQ ID NO: 1007409 - RNA, 22 nt, Human
auguuacagaaagcaaagauga

SEQ ID NO: 1007410 - RNA, 22 nt, Human
auguaacuucugugaaucugac

SEQ ID NO: 1007411 - RNA, 22 nt, Human
acauuucuuccacaugcugcug

SEQ ID NO: 1007412 - RNA, 22 nt, Human
ggcuucucgugccgaagcaaga

SEQ ID NO: 1007413 - RNA, 22 nt, Human
ucacugcugcugccaugaugga

SEQ ID NO: 1007414 - RNA, 22 nt, Human
ugaugaauaaacuugagaguca

SEQ ID NO: 1007415 - RNA, 22 nt, Human
ugggcagaguagcucagaagaa

SEQ ID NO: 1007416 - RNA, 20 nt, Human
uaaggcuguuuuguauuccu

SEQ ID NO: 1007417 - RNA, 22 nt, Human
ugugcaguuucuauguugucca

SEQ ID NO: 1007418 - RNA, 22 nt, Human
ggccagagaagucagacccuug

SEQ ID NO: 1007419 - RNA, 22 nt, Human
cugcuaaaccucucugagagcu

SEQ ID NO: 1007420 - RNA, 22 nt, Human
guuuuaguggguggccacugau

SEQ ID NO: 1007421 - RNA, 22 nt, Human
uguagaaacuacacaugcaaca

SEQ ID NO: 1007422 - RNA, 22 nt, Human
uggagacucugcaucugugaca

SEQ ID NO: 1007423 - RNA, 22 nt, Human
uucuaugccauguucagcuacu

SEQ ID NO: 1007424 - RNA, 22 nt, Human
aagcugccuagaguugaauguc

SEQ ID NO: 1007425 - RNA, 22 nt, Human
gcagugccuugcuucucugucu

SEQ ID NO: 1007426 - RNA, 22 nt, Human
ccugggaggcugugggucugcu

SEQ ID NO: 1007427 - RNA, 22 nt, Human
ccaggaaugaaauguagauaaa

SEQ ID NO: 1007428 - RNA, 22 nt, Human
guggaggagaggcgccuugcgg

SEQ ID NO: 1007429 - RNA, 22 nt, Human
aucacaaaggcugcuucaugau

SEQ ID NO: 1007430 - RNA, 22 nt, Human
gccuggcccagggcuccgcagg

SEQ ID NO: 1007431 - RNA, 22 nt, Human
uggaguucucaggugagggcuu

SEQ ID NO: 1007432 - RNA, 22 nt, Human
gugacagaguuuuagaucucau

SEQ ID NO: 1007433 - RNA, 22 nt, Human
acccagcuaacccuacccugga

SEQ ID NO: 1007434 - RNA, 23 nt, Human
ugucacauuuaguuggcauuguu

SEQ ID NO: 1007435 - RNA, 22 nt, Human
gguuucaaaguggacaguuagu

SEQ ID NO: 1007436 - RNA, 22 nt, Human
uagccggguguugugucaugca

SEQ ID NO: 1007437 - RNA, 22 nt, Human
cauggccugccuccuccuggug

SEQ ID NO: 1007438 - RNA, 22 nt, Human
gcucugagauugagccuuuggu

SEQ ID NO: 1007439 - RNA, 22 nt, Human
aggccugacuugaauuuagggc

SEQ ID NO: 1007440 - RNA, 22 nt, Human
aauggccagcaacaggagugaa

SEQ ID NO: 1007441 - RNA, 22 nt, Human
cagaaguaagauuacugugagu

SEQ ID NO: 1007442 - RNA, 22 nt, Human
aaggguggauuucugagcucua

SEQ ID NO: 1007443 - RNA, 22 nt, Human
acucaggaaaaauguagugaua

SEQ ID NO: 1007444 - RNA, 22 nt, Human
uguguguauaugcauuuaucua

SEQ ID NO: 1007445 - RNA, 22 nt, Human
gugauuucagguuuuucauacu

SEQ ID NO: 1007446 - RNA, 21 nt, Human
ggcuuuaugcucacccagccu

SEQ ID NO: 1007447 - RNA, 22 nt, Human
acuggcugaaguuuacuuuuug

SEQ ID NO: 1007448 - RNA, 22 nt, Human
gggaagagaccguacccuggcc

SEQ ID NO: 1007449 - RNA, 19 nt, Human
cagagcagugguuccugaa

SEQ ID NO: 1007450 - RNA, 22 nt, Human
ucugggcccuaaaccagcucua

SEQ ID NO: 1007451 - RNA, 22 nt, Human
uuguuucaugaguguaaaggga

SEQ ID NO: 1007452 - RNA, 22 nt, Human
cagcagcugauggggaagugau

SEQ ID NO: 1007453 - RNA, 19 nt, Human
agggaguuuauauuugcac

SEQ ID NO: 1007454 - RNA, 22 nt, Human
auagugguuggauaugucagag

SEQ ID NO: 1007455 - RNA, 22 nt, Human
gccuggcuccuaaggacuggcu

SEQ ID NO: 1007456 - RNA, 21 nt, Human
ucucuacacuuucacuaggcu

SEQ ID NO: 1007457 - RNA, 22 nt, Human
ccagaccacccuggccaugcac

SEQ ID NO: 1007458 - RNA, 22 nt, Human
ucaaaagucugcauucuucaca

SEQ ID NO: 1007459 - RNA, 23 nt, Human
ugcuguccaacagacuggccaug

SEQ ID NO: 1007460 - RNA, 22 nt, Human
aaggaggaauuucagggugaau

SEQ ID NO: 1007461 - RNA, 22 nt, Human
gguacaaggagugaagguuugg

SEQ ID NO: 1007462 - RNA, 22 nt, Human
uggcagggaguugcaggauuuc

SEQ ID NO: 1007463 - RNA, 22 nt, Human
uaugucaaaguuaagaaauagg

SEQ ID NO: 1007464 - RNA, 22 nt, Human
ccuggcagcuguuuggcuuggc

SEQ ID NO: 1007465 - RNA, 22 nt, Human
ugcagcugcuggcccaggugcu

SEQ ID NO: 1007466 - RNA, 20 nt, Human
ugcuugucaugcacucaggc

SEQ ID NO: 1007467 - RNA, 22 nt, Human
uucaaagugcauguuccucaga

SEQ ID NO: 1007468 - RNA, 22 nt, Human
agggcucccgugaggugacugc

SEQ ID NO: 1007469 - RNA, 18 nt, Human
ggagagugacagagucgu

SEQ ID NO: 1007470 - RNA, 22 nt, Human
cucccaggcacagggaggagcc

SEQ ID NO: 1007471 - RNA, 22 nt, Human
aaacaucauaggcaugcaugau

SEQ ID NO: 1007472 - RNA, 22 nt, Human
gcaugcugcaccagagccucuc

SEQ ID NO: 1007473 - RNA, 22 nt, Human
ugagcaguaggucugaauagug

SEQ ID NO: 1007474 - RNA, 22 nt, Human
uccaagaucuacagcaguuuag

SEQ ID NO: 1007475 - RNA, 22 nt, Human
ucagcagggaggcucugugccc

SEQ ID NO: 1007476 - RNA, 22 nt, Human
guuuucaugucuauugggcaua

SEQ ID NO: 1007477 - RNA, 22 nt, Human
cuccagggagcuuggaaagacc

SEQ ID NO: 1007478 - RNA, 22 nt, Human
cagucccagcugcucagaaggc

SEQ ID NO: 1007479 - RNA, 22 nt, Human
agagccugugauugucaucacc

SEQ ID NO: 1007480 - RNA, 22 nt, Human
uuccucucaacaugccugccgg

SEQ ID NO: 1007481 - RNA, 22 nt, Human
aaagcuuuucaguauguucaug

SEQ ID NO: 1007482 - RNA, 22 nt, Human
acaaagguggaccauguggcuu

SEQ ID NO: 1007483 - RNA, 22 nt, Human
gccaccaggagcccaguccaaa

SEQ ID NO: 1007484 - RNA, 22 nt, Human
cagagccaggugguguuggggc

SEQ ID NO: 1007485 - RNA, 22 nt, Human
uugucccaggacuugcauagau

SEQ ID NO: 1007486 - RNA, 22 nt, Human
cucucuguuaugcuuucaugaa

SEQ ID NO: 1007487 - RNA, 22 nt, Human
cucaggauuaaggaaucuaaau

SEQ ID NO: 1007488 - RNA, 21 nt, Human
ugcugccauagaccugaggga

SEQ ID NO: 1007489 - RNA, 19 nt, Human
gcccugcaggagguggggc

SEQ ID NO: 1007490 - RNA, 22 nt, Human
uggagggcaugcuguccauggg

SEQ ID NO: 1007491 - RNA, 22 nt, Human
ucuguucagacacuuuacaugu

SEQ ID NO: 1007492 - RNA, 22 nt, Human
aaaccaucagauaauucauacu

SEQ ID NO: 1007493 - RNA, 22 nt, Human
ggugaggcuaagugacacaggg

SEQ ID NO: 1007494 - RNA, 22 nt, Human
ugacccauggucugaucauagg

SEQ ID NO: 1007495 - RNA, 22 nt, Human
agugucugaaccaccggggcau

SEQ ID NO: 1007496 - RNA, 22 nt, Human
uaacacaugaaagcaccuucuu

SEQ ID NO: 1007497 - RNA, 22 nt, Human
uucuucaaaacaacacuggccu

SEQ ID NO: 1007498 - RNA, 22 nt, Human
ucauuuguucucauucucuacu

SEQ ID NO: 1007499 - RNA, 22 nt, Human
gaaacuguauguaguuuuuggg

SEQ ID NO: 1007500 - RNA, 22 nt, Human
auguuauggcucaaacauuugg

SEQ ID NO: 1007501 - RNA, 22 nt, Human
ccaggaggcagaaguugcagug

SEQ ID NO: 1007502 - RNA, 22 nt, Human
cgugagcaaaauggacacuccc

SEQ ID NO: 1007503 - RNA, 22 nt, Human
cuguuuaucuaggaguugcagg

SEQ ID NO: 1007504 - RNA, 19 nt, Human
gggaaauucacuugcuucc

SEQ ID NO: 1007505 - RNA, 22 nt, Human
acagcuggaggccccauugucc

SEQ ID NO: 1007506 - RNA, 22 nt, Human
cugguacaaaaugcugauauca

SEQ ID NO: 1007507 - RNA, 22 nt, Human
acaucucaugaaugauaaauca

SEQ ID NO: 1007508 - RNA, 17 nt, Human
cagcuuuaugcuacugu

SEQ ID NO: 1007509 - RNA, 21 nt, Human
gggccacaccuucugcagacc

SEQ ID NO: 1007510 - RNA, 21 nt, Human
acuguucauuugaugaacugg

SEQ ID NO: 1007511 - RNA, 22 nt, Human
ucugucacugagcucaggauuc

SEQ ID NO: 1007512 - RNA, 22 nt, Human
uuauuuaggagaaggaacccug

SEQ ID NO: 1007513 - RNA, 22 nt, Human
cccugccugugggcaucaacau

SEQ ID NO: 1007514 - RNA, 22 nt, Human
ugggggugaaagucuggacagu

SEQ ID NO: 1007515 - RNA, 22 nt, Human
cagauggccagaggcagcugca

SEQ ID NO: 1007516 - RNA, 22 nt, Human
aucaggauagucuguaaauugu

SEQ ID NO: 1007517 - RNA, 22 nt, Human
aauuaguaaccuaauuccaucu

SEQ ID NO: 1007518 - RNA, 22 nt, Human
aguguggguuuuauggagcccu

SEQ ID NO: 1007519 - RNA, 22 nt, Human
caucagcaggcaacacucuugg

SEQ ID NO: 1007520 - RNA, 22 nt, Human
gggaggcuggcucuggccacag

SEQ ID NO: 1007521 - RNA, 22 nt, Human
ugucaccaugccagcuucugcc

SEQ ID NO: 1007522 - RNA, 22 nt, Human
guggccugucagaagccguggg

SEQ ID NO: 1007523 - RNA, 22 nt, Human
gcaggaaagguugagacuuugc

SEQ ID NO: 1007524 - RNA, 22 nt, Human
gcaagcaguuguggcuucugag

SEQ ID NO: 1007525 - RNA, 22 nt, Human
ugucuuuagccagcagucuucu

SEQ ID NO: 1007526 - RNA, 22 nt, Human
ccagcucuggcuucuugcuggg

SEQ ID NO: 1007527 - RNA, 22 nt, Human
ucuggcucauaggaaggccauu

SEQ ID NO: 1007528 - RNA, 22 nt, Human
cugcucugcagcuuggacuccc

SEQ ID NO: 1007529 - RNA, 22 nt, Human
acauauauuacuaguaaagaca

SEQ ID NO: 1007530 - RNA, 22 nt, Human
acacaugagaaacaucaguugu

SEQ ID NO: 1007531 - RNA, 22 nt, Human
aguuauauuccauagauucaga

SEQ ID NO: 1007532 - RNA, 22 nt, Human
gcaaagucugcaucuggaucag

SEQ ID NO: 1007533 - RNA, 22 nt, Human
cauagagugauguaagguaugu

SEQ ID NO: 1007534 - RNA, 22 nt, Human
cugagagugcucuuugauguca

SEQ ID NO: 1007535 - RNA, 22 nt, Human
ugggcugcacccucagccucug

SEQ ID NO: 1007536 - RNA, 22 nt, Human
ugcauuguugaugaguugaaua

SEQ ID NO: 1007537 - RNA, 22 nt, Human
aaguucaaucagaugaaaaagc

SEQ ID NO: 1007538 - RNA, 22 nt, Human
gagcugucucuauaugaaugcu

SEQ ID NO: 1007539 - RNA, 22 nt, Human
ccaggccaaauucagucagcag

SEQ ID NO: 1007540 - RNA, 22 nt, Human
gggugggaacaggaugccagga

SEQ ID NO: 1007541 - RNA, 22 nt, Human
uuacaagauaaccugaugcugu

SEQ ID NO: 1007542 - RNA, 22 nt, Human
ggaaagaccugagauaggaaua

SEQ ID NO: 1007543 - RNA, 22 nt, Human
uagcagcuuccagagagggcag

SEQ ID NO: 1007544 - RNA, 23 nt, Human
acagcaagaggaccagaugugag

SEQ ID NO: 1007545 - RNA, 22 nt, Human
caggaugggauguagugggccc

SEQ ID NO: 1007546 - RNA, 22 nt, Human
uuuggaauuggcauucuauucu

SEQ ID NO: 1007547 - RNA, 22 nt, Human
uacaaagccugguagauaucug

SEQ ID NO: 1007548 - RNA, 23 nt, Human
uccuuccuuugagaggcuccauc

SEQ ID NO: 1007549 - RNA, 18 nt, Human
uacaugcauaaaugaagc

SEQ ID NO: 1007550 - RNA, 22 nt, Human
cccugggcagucugcacuucag

SEQ ID NO: 1007551 - RNA, 22 nt, Human
uggcagagguauauugggagga

SEQ ID NO: 1007552 - RNA, 22 nt, Human
cauugaaaaacguugacugagu

SEQ ID NO: 1007553 - RNA, 22 nt, Human
agugugcugcuuaaacaguugu

SEQ ID NO: 1007554 - RNA, 22 nt, Human
cugccacuagcuuucacaucuu

SEQ ID NO: 1007555 - RNA, 22 nt, Human
uggcaguguauagguggcuccu

SEQ ID NO: 1007556 - RNA, 20 nt, Human
aaguuuucuccaaauacagu

SEQ ID NO: 1007557 - RNA, 19 nt, Human
uguuggugcggauguggag

SEQ ID NO: 1007558 - RNA, 22 nt, Human
auguacacaugcaugcaugugc

SEQ ID NO: 1007559 - RNA, 22 nt, Human
uucacaggcuuggagguggggg

SEQ ID NO: 1007560 - RNA, 22 nt, Human
gcugggagcccuggucugcucc

SEQ ID NO: 1007561 - RNA, 22 nt, Human
agggcagagcacugaauuggga

SEQ ID NO: 1007562 - RNA, 21 nt, Human
uggagcugaauuuuuggcauc

SEQ ID NO: 1007563 - RNA, 22 nt, Human
acagaguaggugcugucgacug

SEQ ID NO: 1007564 - RNA, 22 nt, Human
uuauuuauuguguaccuacugu

SEQ ID NO: 1007565 - RNA, 22 nt, Human
aaaugugugcacaaagacagcu

SEQ ID NO: 1007566 - RNA, 22 nt, Human
aaguuacuggcaagggcugcag

SEQ ID NO: 1007567 - RNA, 22 nt, Human
agugaaauggaugcugcuacug

SEQ ID NO: 1007568 - RNA, 22 nt, Human
uuuguaugugauaagacuauuc

SEQ ID NO: 1007569 - RNA, 21 nt, Human
ugcccacagcaaaugcagagg

SEQ ID NO: 1007570 - RNA, 22 nt, Human
agggcugcugaggaagccuugc

SEQ ID NO: 1007571 - RNA, 19 nt, Human
acccucucagugccugagg

SEQ ID NO: 1007572 - RNA, 22 nt, Human
ugaaggaaaugacggcagaaga

SEQ ID NO: 1007573 - RNA, 22 nt, Human
cucuggcuuugcucaugcaucc

SEQ ID NO: 1007574 - RNA, 22 nt, Human
ggccucucauguccugggcuuc

SEQ ID NO: 1007575 - RNA, 22 nt, Human
ugggagagcacugcagccccgg

SEQ ID NO: 1007576 - RNA, 22 nt, Human
cuguccccgcgaguccagagcu

SEQ ID NO: 1007577 - RNA, 22 nt, Human
aggccuggccugggcggcauug

SEQ ID NO: 1007578 - RNA, 22 nt, Human
cugggagucaccaggagcaagg

SEQ ID NO: 1007579 - RNA, 22 nt, Human
aaacuucagugaaugacuuaug

SEQ ID NO: 1007580 - RNA, 22 nt, Human
agcaggaaagaaaaaucugugu

SEQ ID NO: 1007581 - RNA, 22 nt, Human
aacacagcuaauuucugucaau

SEQ ID NO: 1007582 - RNA, 22 nt, Human
cucuuucaguucugauagucuc

SEQ ID NO: 1007583 - RNA, 22 nt, Human
uucacaggaggguggaugcaug

SEQ ID NO: 1007584 - RNA, 22 nt, Human
agucucugugagcucccaaugg

SEQ ID NO: 1007585 - RNA, 22 nt, Human
ucuggcuccaccuccuuuacua

SEQ ID NO: 1007586 - RNA, 20 nt, Human
agccugccagcuggcccaga

SEQ ID NO: 1007587 - RNA, 22 nt, Human
agaaaguucugugaguuguuca

SEQ ID NO: 1007588 - RNA, 22 nt, Human
gaaacugugaucguguucuggg

SEQ ID NO: 1007589 - RNA, 22 nt, Human
uaacagaaguuguucauugugg

SEQ ID NO: 1007590 - RNA, 22 nt, Human
aguuuuuccguggcuacgauaa

SEQ ID NO: 1007591 - RNA, 22 nt, Human
gggagccaugcuggucuucuuu

SEQ ID NO: 1007592 - RNA, 22 nt, Human
ugcagcaggagccaggccuggu

SEQ ID NO: 1007593 - RNA, 22 nt, Human
gagaggaguaggcugauggugc

SEQ ID NO: 1007594 - RNA, 22 nt, Human
cugcugggucuaugcaagugga

SEQ ID NO: 1007595 - RNA, 22 nt, Human
cagcaauaagccagguuagaca

SEQ ID NO: 1007596 - RNA, 22 nt, Human
uuauuugcccauguuuagcaga

SEQ ID NO: 1007597 - RNA, 22 nt, Human
ccugggagugugccaucucugu

SEQ ID NO: 1007598 - RNA, 22 nt, Human
uauucacauguacauaugcuca

SEQ ID NO: 1007599 - RNA, 22 nt, Human
gcucugcucuugacuuaccagg

SEQ ID NO: 1007600 - RNA, 22 nt, Human
gagagucuaggaaccucauaua

SEQ ID NO: 1007601 - RNA, 22 nt, Human
cugaggcugcccagggccaggu

SEQ ID NO: 1007602 - RNA, 22 nt, Human
gacaugcaacaauuuggcauuu

SEQ ID NO: 1007603 - RNA, 22 nt, Human
auugcuguaaauuaucuuauua

SEQ ID NO: 1007604 - RNA, 22 nt, Human
agggcugccauuucuggcccaa

SEQ ID NO: 1007605 - RNA, 22 nt, Human
gugcaggggccuccccuugcug

SEQ ID NO: 1007606 - RNA, 22 nt, Human
agaugcugugaggaagcuagga

SEQ ID NO: 1007607 - RNA, 22 nt, Human
gcaaagguagccaaggagcuca

SEQ ID NO: 1007608 - RNA, 21 nt, Human
uccagaccucccucuccuagc

SEQ ID NO: 1007609 - RNA, 22 nt, Human
ugcauuuuuaacaaggcuaauu

SEQ ID NO: 1007610 - RNA, 22 nt, Human
cucacagaugcugugggucagg

SEQ ID NO: 1007611 - RNA, 22 nt, Human
gcugcccaggguggagccggcu

SEQ ID NO: 1007612 - RNA, 22 nt, Human
gggcucugcgcucagcuccagc

SEQ ID NO: 1007613 - RNA, 22 nt, Human
ugcuggcuacugauggcaggcc

SEQ ID NO: 1007614 - RNA, 22 nt, Human
aaaauccucuaauucuagaaua

SEQ ID NO: 1007615 - RNA, 22 nt, Human
caaauacuggguaaguuaauuu

SEQ ID NO: 1007616 - RNA, 22 nt, Human
gggcuugcugauuugggcagga

SEQ ID NO: 1007617 - RNA, 22 nt, Human
agugugcuauugcaccaucaua

SEQ ID NO: 1007618 - RNA, 22 nt, Human
uuugacagcuuguuacaaaguu

SEQ ID NO: 1007619 - RNA, 22 nt, Human
uggccugaggcucggcaugggu

SEQ ID NO: 1007620 - RNA, 22 nt, Human
ugcagaggagucagccugggca

SEQ ID NO: 1007621 - RNA, 22 nt, Human
cccagcccaucucaaaggucua

SEQ ID NO: 1007622 - RNA, 22 nt, Human
gcugccugccuugccuggagga

SEQ ID NO: 1007623 - RNA, 22 nt, Human
aggaccuguagggccugcaucc

SEQ ID NO: 1007624 - RNA, 22 nt, Human
acaggcuuuuuuagaaugacau

SEQ ID NO: 1007625 - RNA, 22 nt, Human
gaggucaggggagaggcugaug

SEQ ID NO: 1007626 - RNA, 22 nt, Human
acaggcagggaccuuggcuaag

SEQ ID NO: 1007627 - RNA, 22 nt, Human
ccucccacuucuugcugagguc

SEQ ID NO: 1007628 - RNA, 22 nt, Human
cuggcugcuuguagacucgacu

SEQ ID NO: 1007629 - RNA, 22 nt, Human
ucccuggagauaacuucuggga

SEQ ID NO: 1007630 - RNA, 22 nt, Human
acauacauauguuuaaaugcau

SEQ ID NO: 1007631 - RNA, 22 nt, Human
acuguucauuuggauuucucug

SEQ ID NO: 1007632 - RNA, 22 nt, Human
caguccuggggaccaggcugag

SEQ ID NO: 1007633 - RNA, 22 nt, Human
caucaucaaaagugacagagaa

SEQ ID NO: 1007634 - RNA, 22 nt, Human
cugaggugcuagggucccugcu

SEQ ID NO: 1007635 - RNA, 22 nt, Human
uucuucucucauagauuaaggu

SEQ ID NO: 1007636 - RNA, 22 nt, Human
ggcagccaugucccagggcuuc

SEQ ID NO: 1007637 - RNA, 22 nt, Human
caggaaggcccaccuguccugu

SEQ ID NO: 1007638 - RNA, 22 nt, Human
auuucauagauuguaaaucccu

SEQ ID NO: 1007639 - RNA, 22 nt, Human
ucugucaaaugagcaaguaacu

SEQ ID NO: 1007640 - RNA, 21 nt, Human
auacuuugaauuacagccuug

SEQ ID NO: 1007641 - RNA, 22 nt, Human
cccugcaggggaccugcagccu

SEQ ID NO: 1007642 - RNA, 22 nt, Human
ggcagccagagggcagcuggau

SEQ ID NO: 1007643 - RNA, 22 nt, Human
guccucuggugaaagcauuccc

SEQ ID NO: 1007644 - RNA, 22 nt, Human
ggccucucuccuuggcuugcag

SEQ ID NO: 1007645 - RNA, 22 nt, Human
aaggugucacugggacaggaaa

SEQ ID NO: 1007646 - RNA, 22 nt, Human
ugaaggcccuaucuccauauac

SEQ ID NO: 1007647 - RNA, 22 nt, Human
gcaggagcccuggcauguucuu

SEQ ID NO: 1007648 - RNA, 22 nt, Human
cuccagaagacccauccucaug

SEQ ID NO: 1007649 - RNA, 21 nt, Human
uccauuguuuucccaggguuu

SEQ ID NO: 1007650 - RNA, 20 nt, Human
uccagcugggaacagcugau

SEQ ID NO: 1007651 - RNA, 19 nt, Human
cccuggcaggcaagccugg

SEQ ID NO: 1007652 - RNA, 22 nt, Human
cuugccuucuuuuccuauagaa

SEQ ID NO: 1007653 - RNA, 22 nt, Human
guucuucaggcugugcucuaga

SEQ ID NO: 1007654 - RNA, 22 nt, Human
acuugggagggugugggcagcu

SEQ ID NO: 1007655 - RNA, 22 nt, Human
auguccuucuccucuuaccugc

SEQ ID NO: 1007656 - RNA, 22 nt, Human
aaggcacucauucaaggagaua

SEQ ID NO: 1007657 - RNA, 22 nt, Human
cucuccuggggagcacacacac

SEQ ID NO: 1007658 - RNA, 22 nt, Human
cuggccuggagccucugggugg

SEQ ID NO: 1007659 - RNA, 22 nt, Human
agaaguaggcagggcuguauca

SEQ ID NO: 1007660 - RNA, 22 nt, Human
aggcugcaggucugggucaugu

SEQ ID NO: 1007661 - RNA, 22 nt, Human
gcuguggguccggaccccacgg

SEQ ID NO: 1007662 - RNA, 22 nt, Human
gagcucagauucuggugucaga

SEQ ID NO: 1007663 - RNA, 22 nt, Human
augaaaaguucgaucuagaagg

SEQ ID NO: 1007664 - RNA, 22 nt, Human
cccaggaugucgaggcugcagu

SEQ ID NO: 1007665 - RNA, 22 nt, Human
uccauguggccagacacuggca

SEQ ID NO: 1007666 - RNA, 22 nt, Human
gaaggaaaacagaucugccuga

SEQ ID NO: 1007667 - RNA, 22 nt, Human
cucacuguccaacaggcuuuac

SEQ ID NO: 1007668 - RNA, 22 nt, Human
uucaacuagauuuauacaauuc

SEQ ID NO: 1007669 - RNA, 22 nt, Human
ucuugccucuuccccuuuccau

SEQ ID NO: 1007670 - RNA, 22 nt, Human
gcagaagcccggucagcgcacg

SEQ ID NO: 1007671 - RNA, 22 nt, Human
aauuuggcagugucuugaagua

SEQ ID NO: 1007672 - RNA, 19 nt, Human
cugaggcccauguaccaug

SEQ ID NO: 1007673 - RNA, 22 nt, Human
cuucauuaaugucuauaaguuu

SEQ ID NO: 1007674 - RNA, 22 nt, Human
uguaggaaaaacaaugaucugc

SEQ ID NO: 1007675 - RNA, 17 nt, Human
ccuguguuugcuccuuc

SEQ ID NO: 1007676 - RNA, 22 nt, Human
gugguaauuuaauccuacacug

SEQ ID NO: 1007677 - RNA, 22 nt, Human
aggcugucaucuuugcaggcag

SEQ ID NO: 1007678 - RNA, 22 nt, Human
auugaaagauuuugggcucaug

SEQ ID NO: 1007679 - RNA, 22 nt, Human
cacagguguaugaauaugucca

SEQ ID NO: 1007680 - RNA, 22 nt, Human
gagaaguuucugguuugcauag

SEQ ID NO: 1007681 - RNA, 18 nt, Human
uuaagagcugaaagggga

SEQ ID NO: 1007682 - RNA, 22 nt, Human
gaaaucugaacaacagcuguca

SEQ ID NO: 1007683 - RNA, 22 nt, Human
ccuucugcucccuggccagggc

SEQ ID NO: 1007684 - RNA, 22 nt, Human
ugaagcaggcauugacugauga

SEQ ID NO: 1007685 - RNA, 22 nt, Human
cacugcagaucagaggcugaga

SEQ ID NO: 1007686 - RNA, 22 nt, Human
uggcagcuccggguaggggcug

SEQ ID NO: 1007687 - RNA, 22 nt, Human
guauuaggaaauaugaagaaag

SEQ ID NO: 1007688 - RNA, 22 nt, Human
ucuuagcacagcuauauaaguu

SEQ ID NO: 1007689 - RNA, 22 nt, Human
caggaaaaaugccaggagucag

SEQ ID NO: 1007690 - RNA, 22 nt, Human
ccagcuggucugugcucauguu

SEQ ID NO: 1007691 - RNA, 22 nt, Human
ccucagagccuccagaaggaau

SEQ ID NO: 1007692 - RNA, 22 nt, Human
cagccuguagaauacaguaaau

SEQ ID NO: 1007693 - RNA, 22 nt, Human
uccuucagaaaaccucagucuu

SEQ ID NO: 1007694 - RNA, 22 nt, Human
ugucucugugagaucugacgau

SEQ ID NO: 1007695 - RNA, 22 nt, Human
gagggcugauaaaugcgcaugg

SEQ ID NO: 1007696 - RNA, 22 nt, Human
caggaaagggaugggcugccac

SEQ ID NO: 1007697 - RNA, 22 nt, Human
gagcuucccucugcagucccug

SEQ ID NO: 1007698 - RNA, 22 nt, Human
ucucagagggaaaggccaauuu

SEQ ID NO: 1007699 - RNA, 22 nt, Human
agaaugcauuuuguguagcuau

SEQ ID NO: 1007700 - RNA, 20 nt, Human
cugagagucugugcuuaguc

SEQ ID NO: 1007701 - RNA, 22 nt, Human
uucacaauagcuggcaucaucu

SEQ ID NO: 1007702 - RNA, 22 nt, Human
cugcugcugcuaucuacccagg

SEQ ID NO: 1007703 - RNA, 19 nt, Human
acacugaauguagaauugg

SEQ ID NO: 1007704 - RNA, 22 nt, Human
aguggcagccgagcaggagaug

SEQ ID NO: 1007705 - RNA, 22 nt, Human
gcagggcucugcuguaguccua

SEQ ID NO: 1007706 - RNA, 22 nt, Human
aaucaguucuacaucuuaucca

SEQ ID NO: 1007707 - RNA, 22 nt, Human
uggccugguuguugcugccguu

SEQ ID NO: 1007708 - RNA, 22 nt, Human
aaagaacaucggagugggcggg

SEQ ID NO: 1007709 - RNA, 22 nt, Human
agggagaaugaccaagguauau

SEQ ID NO: 1007710 - RNA, 22 nt, Human
uggcucagugcauucacaguaa

SEQ ID NO: 1007711 - RNA, 22 nt, Human
ucagaguguuuuacuaaacaag

SEQ ID NO: 1007712 - RNA, 22 nt, Human
uaaacauuuguuauucuuguuu

SEQ ID NO: 1007713 - RNA, 22 nt, Human
cccauucauccucgcuuccuuc

SEQ ID NO: 1007714 - RNA, 22 nt, Human
cugccuggcauggagaagagaa

SEQ ID NO: 1007715 - RNA, 22 nt, Human
uacuacauuaauaaaacauuca

SEQ ID NO: 1007716 - RNA, 22 nt, Human
acauucaugucccacuucuagc

SEQ ID NO: 1007717 - RNA, 22 nt, Human
ugaaggaaugagggaguggguc

SEQ ID NO: 1007718 - RNA, 22 nt, Human
aucuaggauuugaaugcacagu

SEQ ID NO: 1007719 - RNA, 22 nt, Human
cugugauuguuaguuccuauac

SEQ ID NO: 1007720 - RNA, 22 nt, Human
uuucagaaagcugaacauauga

SEQ ID NO: 1007721 - RNA, 18 nt, Human
gggcucacacaggucauc

SEQ ID NO: 1007722 - RNA, 22 nt, Human
caggcacuggccagucagcaca

SEQ ID NO: 1007723 - RNA, 22 nt, Human
cuuguccccagcagguugguuu

SEQ ID NO: 1007724 - RNA, 22 nt, Human
ugaaaggugacauuucuuggau

SEQ ID NO: 1007725 - RNA, 21 nt, Human
guggcccugccgcagugucca

SEQ ID NO: 1007726 - RNA, 22 nt, Human
ucugcuggccuuagcaggucua

SEQ ID NO: 1007727 - RNA, 22 nt, Human
cuggacagaaagggcugcugug

SEQ ID NO: 1007728 - RNA, 22 nt, Human
aggccagacagcuagaaacagg

SEQ ID NO: 1007729 - RNA, 22 nt, Human
ugcaauaaggaguaauaguaaa

SEQ ID NO: 1007730 - RNA, 22 nt, Human
ccuugcaggggaacaggcagug

SEQ ID NO: 1007731 - RNA, 22 nt, Human
uggagcucaaaggccuguggga

SEQ ID NO: 1007732 - RNA, 22 nt, Human
caggcagcaggagcccugcucg

SEQ ID NO: 1007733 - RNA, 22 nt, Human
gccugcagauauauaggauggu

SEQ ID NO: 1007734 - RNA, 22 nt, Human
gaggcugcaggcaaugcugccc

SEQ ID NO: 1007735 - RNA, 22 nt, Human
aaacaucaauugcaucucccaa

SEQ ID NO: 1007736 - RNA, 21 nt, Human
aaauuucugcaagccucaacu

SEQ ID NO: 1007737 - RNA, 22 nt, Human
gaccagagaaaggcacuggaag

SEQ ID NO: 1007738 - RNA, 22 nt, Human
acguuuucuagagaauaugcag

SEQ ID NO: 1007739 - RNA, 22 nt, Human
ucacaaauauuuuaacaguagg

SEQ ID NO: 1007740 - RNA, 22 nt, Human
uuuccuucaucaucugagagcu

SEQ ID NO: 1007741 - RNA, 22 nt, Human
agggccagcacuccuggcagga

SEQ ID NO: 1007742 - RNA, 21 nt, Human
augucaaaugcuuuauuuuau

SEQ ID NO: 1007743 - RNA, 22 nt, Human
auaauuuacuaagcucuaccuu

SEQ ID NO: 1007744 - RNA, 22 nt, Human
augcacagacccaaaggccauc

SEQ ID NO: 1007745 - RNA, 22 nt, Human
aagggcagcuauuaucgucauc

SEQ ID NO: 1007746 - RNA, 22 nt, Human
caaauauuccagguacaucccu

SEQ ID NO: 1007747 - RNA, 22 nt, Human
uggcacugaccccaggccugug

SEQ ID NO: 1007748 - RNA, 19 nt, Human
ucccaggaagcaaauguca

SEQ ID NO: 1007749 - RNA, 22 nt, Human
cagcugcccauccugggaaaug

SEQ ID NO: 1007750 - RNA, 22 nt, Human
cagaggcugccagccaugugca

SEQ ID NO: 1007751 - RNA, 22 nt, Human
auugcacaaacacagucagacu

SEQ ID NO: 1007752 - RNA, 22 nt, Human
ugccagaagugcuuuauaagug

SEQ ID NO: 1007753 - RNA, 22 nt, Human
gugccaggugcuaagcugugcu

SEQ ID NO: 1007754 - RNA, 22 nt, Human
uaaaucccuacaucuguguuuu

SEQ ID NO: 1007755 - RNA, 22 nt, Human
gagcugccggcccacaguacua

SEQ ID NO: 1007756 - RNA, 22 nt, Human
agccuggcacugaggcagggcg

SEQ ID NO: 1007757 - RNA, 22 nt, Human
gccuggcaggaaucucagugcu

SEQ ID NO: 1007758 - RNA, 22 nt, Human
acucccacuccagaguagaagc

SEQ ID NO: 1007759 - RNA, 22 nt, Human
uuuuucauauuccccucucugg

SEQ ID NO: 1007760 - RNA, 20 nt, Human
caucaucacaugagccaauu

SEQ ID NO: 1007761 - RNA, 22 nt, Human
cacugugucaguuugguuagac

SEQ ID NO: 1007762 - RNA, 22 nt, Human
uaaggcauucucaugcugugaa

SEQ ID NO: 1007763 - RNA, 22 nt, Human
aauucaugaguagaaucuauau

SEQ ID NO: 1007764 - RNA, 22 nt, Human
aacagaaugcaggggaugcugc

SEQ ID NO: 1007765 - RNA, 22 nt, Human
ccugggagggcaagugcugaug

SEQ ID NO: 1007766 - RNA, 22 nt, Human
gaggcugcuguuagcccugggc

SEQ ID NO: 1007767 - RNA, 22 nt, Human
aggacaguccgggguccuccac

SEQ ID NO: 1007768 - RNA, 22 nt, Human
acuauacauugaauguuaaggu

SEQ ID NO: 1007769 - RNA, 19 nt, Human
caaggguugggucugucau

SEQ ID NO: 1007770 - RNA, 22 nt, Human
gggagcaggacauaauagcaau

SEQ ID NO: 1007771 - RNA, 22 nt, Human
ggcuuuauuugcagccauuguu

SEQ ID NO: 1007772 - RNA, 22 nt, Human
cugcagcuuuggaaaccuguuu

SEQ ID NO: 1007773 - RNA, 22 nt, Human
cagcccuuuccuucucagcuuu

SEQ ID NO: 1007774 - RNA, 22 nt, Human
gcaggccuccccugcuggagcu

SEQ ID NO: 1007775 - RNA, 22 nt, Human
ccagagcugcauccagcagguu

SEQ ID NO: 1007776 - RNA, 22 nt, Human
ucucuucauagugacacccauc

SEQ ID NO: 1007777 - RNA, 22 nt, Human
agagccugaggcccugagaggg

SEQ ID NO: 1007778 - RNA, 22 nt, Human
gggguggauuccuacaggucca

SEQ ID NO: 1007779 - RNA, 22 nt, Human
cuucaagauccauagauauugc

SEQ ID NO: 1007780 - RNA, 22 nt, Human
aguaaaaucaccaucucuuugu

SEQ ID NO: 1007781 - RNA, 22 nt, Human
uuucauaaacaguagaagacua

SEQ ID NO: 1007782 - RNA, 22 nt, Human
caggcacucagucuggaucccu

SEQ ID NO: 1007783 - RNA, 22 nt, Human
cagagacagaaaauggaucuag

SEQ ID NO: 1007784 - RNA, 22 nt, Human
agcagcuccugccaugagugcu

SEQ ID NO: 1007785 - RNA, 22 nt, Human
aaaugguauuuacucuguauua

SEQ ID NO: 1007786 - RNA, 22 nt, Human
agccccaguccgcugcgggcgg

SEQ ID NO: 1007787 - RNA, 22 nt, Human
aggcugugggaauggcugcuug

SEQ ID NO: 1007788 - RNA, 22 nt, Human
ugccugucuccucugcagggug

SEQ ID NO: 1007789 - RNA, 22 nt, Human
gagggugguggcuuaaggugcu

SEQ ID NO: 1007790 - RNA, 22 nt, Human
agucagugaaaacuagaauguu

SEQ ID NO: 1007791 - RNA, 22 nt, Human
cagcugcuguucaguuuuguuu

SEQ ID NO: 1007792 - RNA, 22 nt, Human
uuugaaagcaggugugggaggg

SEQ ID NO: 1007793 - RNA, 22 nt, Human
ccucugcagcagagagccagag

SEQ ID NO: 1007794 - RNA, 22 nt, Human
uccagccuaauguucuucccac

SEQ ID NO: 1007795 - RNA, 21 nt, Human
uggaccuguccuucucgcugu

SEQ ID NO: 1007796 - RNA, 22 nt, Human
gggcaaguccggugcccagagc

SEQ ID NO: 1007797 - RNA, 20 nt, Human
agcagcuguguuuucauccu

SEQ ID NO: 1007798 - RNA, 22 nt, Human
uccagccaacugccuagggagc

SEQ ID NO: 1007799 - RNA, 22 nt, Human
gguucacauauugagaguauuc

SEQ ID NO: 1007800 - RNA, 22 nt, Human
gcauaauauacaugcuugaucc

SEQ ID NO: 1007801 - RNA, 20 nt, Human
acauguacuaaugaauacag

SEQ ID NO: 1007802 - RNA, 22 nt, Human
ugaggcuggcaaggcugguauu

SEQ ID NO: 1007803 - RNA, 21 nt, Human
gaaaggucuuaacuuacagag

SEQ ID NO: 1007804 - RNA, 22 nt, Human
ggcagcagggcugucucccuac

SEQ ID NO: 1007805 - RNA, 23 nt, Human
cagagcuggcucagagcugccug

SEQ ID NO: 1007806 - RNA, 22 nt, Human
ugaaggugucuuugugaacauc

SEQ ID NO: 1007807 - RNA, 22 nt, Human
gcuuuccuggcccugucccugc

SEQ ID NO: 1007808 - RNA, 22 nt, Human
uguggaaaagaauaagggagau

SEQ ID NO: 1007809 - RNA, 22 nt, Human
ugucacauaauuuaucuguagg

SEQ ID NO: 1007810 - RNA, 22 nt, Human
ccagggcagaaaaagagggaau

SEQ ID NO: 1007811 - RNA, 22 nt, Human
aaguuacaggagaaagagauca

SEQ ID NO: 1007812 - RNA, 22 nt, Human
cugggcugcgggcgccccucca

SEQ ID NO: 1007813 - RNA, 19 nt, Human
caaggccaccauuucuccg

SEQ ID NO: 1007814 - RNA, 22 nt, Human
uccuuggcagcagggagcauga

SEQ ID NO: 1007815 - RNA, 23 nt, Human
cuggcucauccugguugcagugg

SEQ ID NO: 1007816 - RNA, 22 nt, Human
gaacacauuucucugacuguag

SEQ ID NO: 1007817 - RNA, 22 nt, Human
ucagcagcagcucagcauguuu

SEQ ID NO: 1007818 - RNA, 22 nt, Human
uccucugcucagcauuccucac

SEQ ID NO: 1007819 - RNA, 22 nt, Human
uugaaaggguuaaagugguaaa

SEQ ID NO: 1007820 - RNA, 21 nt, Human
uaauaauuccacuacagagua

SEQ ID NO: 1007821 - RNA, 22 nt, Human
gagaaggaguagcugaccuggg

SEQ ID NO: 1007822 - RNA, 22 nt, Human
uugcauugugauuacagaggug

SEQ ID NO: 1007823 - RNA, 22 nt, Human
ugcucuguaacaaauugacaug

SEQ ID NO: 1007824 - RNA, 22 nt, Human
ugggcagaauugugguaguuaa

SEQ ID NO: 1007825 - RNA, 22 nt, Human
ccuggcagcagcacaugccuuc

SEQ ID NO: 1007826 - RNA, 22 nt, Human
cuggagccggcgagccccagcc

SEQ ID NO: 1007827 - RNA, 20 nt, Human
aggagaaauucgggacaccu

SEQ ID NO: 1007828 - RNA, 22 nt, Human
agagaaaacucauugagguguc

SEQ ID NO: 1007829 - RNA, 23 nt, Human
cuggcuccgaagacuccaggauc

SEQ ID NO: 1007830 - RNA, 22 nt, Human
caguacuugggaaugcugggga

SEQ ID NO: 1007831 - RNA, 22 nt, Human
ccagagcccagggucaugcagg

SEQ ID NO: 1007832 - RNA, 22 nt, Human
gcuggagcugcagccugggccu

SEQ ID NO: 1007833 - RNA, 22 nt, Human
cagucucuugcuucauuaguug

SEQ ID NO: 1007834 - RNA, 22 nt, Human
agccucugacugucagcaaggu

SEQ ID NO: 1007835 - RNA, 22 nt, Human
cugcucugacccuuucaccuuc

SEQ ID NO: 1007836 - RNA, 22 nt, Human
ggggacugccuuccacagacac

SEQ ID NO: 1007837 - RNA, 22 nt, Human
ugucucugaacagcuuacuaaa

SEQ ID NO: 1007838 - RNA, 22 nt, Human
cugggcugcagcgggagcgacg

SEQ ID NO: 1007839 - RNA, 22 nt, Human
ucagaaauagucuuuaaaauga

SEQ ID NO: 1007840 - RNA, 18 nt, Human
ugggauggagaguaacug

SEQ ID NO: 1007841 - RNA, 22 nt, Human
uugcugaaaucuaugacauccu

SEQ ID NO: 1007842 - RNA, 22 nt, Human
auaugugugccauuucagcagu

SEQ ID NO: 1007843 - RNA, 22 nt, Human
uguccucuaauuggccucuugc

SEQ ID NO: 1007844 - RNA, 21 nt, Human
ggugggcacaggagagcagag

SEQ ID NO: 1007845 - RNA, 17 nt, Human
ucugggcuucagugguc

SEQ ID NO: 1007846 - RNA, 22 nt, Human
gaaagauauuuauuggcaacag

SEQ ID NO: 1007847 - RNA, 22 nt, Human
ggccuguccagccugccuggcu

SEQ ID NO: 1007848 - RNA, 22 nt, Human
ugccagaagauucucuaucaga

SEQ ID NO: 1007849 - RNA, 22 nt, Human
ugggccugaguuugggaacugg

SEQ ID NO: 1007850 - RNA, 22 nt, Human
ccugagagcgaguggccucaug

SEQ ID NO: 1007851 - RNA, 22 nt, Human
ucugucacucccugaugaugaa

SEQ ID NO: 1007852 - RNA, 22 nt, Human
cagugaggaguccagggcagag

SEQ ID NO: 1007853 - RNA, 18 nt, Human
agucuucugauccauuuu

SEQ ID NO: 1007854 - RNA, 22 nt, Human
ugggagccauuuuagaggcugc

SEQ ID NO: 1007855 - RNA, 22 nt, Human
ggccuugggauguggcugcagc

SEQ ID NO: 1007856 - RNA, 22 nt, Human
cccagguggcagaagcugcagu

SEQ ID NO: 1007857 - RNA, 22 nt, Human
ucaccacugaacagaccuuugg

SEQ ID NO: 1007858 - RNA, 22 nt, Human
gaaugugugacucuauugagca

SEQ ID NO: 1007859 - RNA, 22 nt, Human
ucuggagagucacagugccaga

SEQ ID NO: 1007860 - RNA, 22 nt, Human
aggcccuggucaggucuggcug

SEQ ID NO: 1007861 - RNA, 22 nt, Human
ucccagagccaagcuauggaug

SEQ ID NO: 1007862 - RNA, 22 nt, Human
caguugaugggacucauguggg

SEQ ID NO: 1007863 - RNA, 22 nt, Human
gagcagagacaguacaacuggc

SEQ ID NO: 1007864 - RNA, 20 nt, Human
ucucuucuggggagauaaaa

SEQ ID NO: 1007865 - RNA, 22 nt, Human
uacuaucucuucuaacuucaga

SEQ ID NO: 1007866 - RNA, 22 nt, Human
auuguguaauuuucagcucaua

SEQ ID NO: 1007867 - RNA, 22 nt, Human
uuugaaaggguuaugagacuga

SEQ ID NO: 1007868 - RNA, 22 nt, Human
aggugccagugcuguggucccc

SEQ ID NO: 1007869 - RNA, 22 nt, Human
cagugagggcccccuuccaggu

SEQ ID NO: 1007870 - RNA, 22 nt, Human
uccaugagcuagggauucauca

SEQ ID NO: 1007871 - RNA, 22 nt, Human
cugagguguugaugaccuaugc

SEQ ID NO: 1007872 - RNA, 22 nt, Human
guaggcagauaggagugcagcc

SEQ ID NO: 1007873 - RNA, 22 nt, Human
aguaugaagauuauaauuuuuc

SEQ ID NO: 1007874 - RNA, 22 nt, Human
cugugggcugaaagugcucccg

SEQ ID NO: 1007875 - RNA, 22 nt, Human
auguaucagaaauagcauuggc

SEQ ID NO: 1007876 - RNA, 22 nt, Human
ugaaaucaauugcaauguuuau

SEQ ID NO: 1007877 - RNA, 22 nt, Human
ugugucaauuuucauuccuacu

SEQ ID NO: 1007878 - RNA, 22 nt, Human
auacuuuggggguuaguguaga

SEQ ID NO: 1007879 - RNA, 22 nt, Human
cucugcagaauuugagcugcuc

SEQ ID NO: 1007880 - RNA, 22 nt, Human
cugaaggacacgugaggagcca

SEQ ID NO: 1007881 - RNA, 22 nt, Human
ugugcuucagguugucgccacg

SEQ ID NO: 1007882 - RNA, 22 nt, Human
uccaguggagugugggggugaa

SEQ ID NO: 1007883 - RNA, 22 nt, Human
gaaaauguuagcuucauaguca

SEQ ID NO: 1007884 - RNA, 22 nt, Human
uggcuguguuaccacuucaugu

SEQ ID NO: 1007885 - RNA, 22 nt, Human
agggcugcccagugugagagcu

SEQ ID NO: 1007886 - RNA, 22 nt, Human
uuuaaauucugucugccgcuua

SEQ ID NO: 1007887 - RNA, 22 nt, Human
caaaugauaccuauuacuaggc

SEQ ID NO: 1007888 - RNA, 22 nt, Human
ccagggugggaggcugaaggcg

SEQ ID NO: 1007889 - RNA, 22 nt, Human
acuucuucuucagcugggggau

SEQ ID NO: 1007890 - RNA, 22 nt, Human
aguuuuucugcuggucucacua

SEQ ID NO: 1007891 - RNA, 22 nt, Human
gcacugugacccagagcaggug

SEQ ID NO: 1007892 - RNA, 22 nt, Human
cugugucucuccuuacaagacu

SEQ ID NO: 1007893 - RNA, 22 nt, Human
uggcucugggcaccguguccac

SEQ ID NO: 1007894 - RNA, 22 nt, Human
cauuuguuggucagauuguagu

SEQ ID NO: 1007895 - RNA, 22 nt, Human
cacagaaguuucauagucucga

SEQ ID NO: 1007896 - RNA, 22 nt, Human
ccacugucugcaggccucagca

SEQ ID NO: 1007897 - RNA, 22 nt, Human
uccuugaaugaagagaggugac

SEQ ID NO: 1007898 - RNA, 17 nt, Human
agaacuguaguagcucc

SEQ ID NO: 1007899 - RNA, 22 nt, Human
ggcagcuuuuaucccugacaga

SEQ ID NO: 1007900 - RNA, 19 nt, Human
ugcaagcuuuuucuuguua

SEQ ID NO: 1007901 - RNA, 22 nt, Human
ucacugggagaugugggaaggg

SEQ ID NO: 1007902 - RNA, 22 nt, Human
aggcacuguggaagacaugguu

SEQ ID NO: 1007903 - RNA, 19 nt, Human
ccucugcgcuguccugcuc

SEQ ID NO: 1007904 - RNA, 22 nt, Human
gccuggagccucagcaaggagg

SEQ ID NO: 1007905 - RNA, 22 nt, Human
aagcacagaaaaggagcaugga

SEQ ID NO: 1007906 - RNA, 22 nt, Human
gccugagcuacuagggagucug

SEQ ID NO: 1007907 - RNA, 21 nt, Human
uucuucuuggacuguuuuggc

SEQ ID NO: 1007908 - RNA, 18 nt, Human
cagaaguccuucaaggcc

SEQ ID NO: 1007909 - RNA, 22 nt, Human
caaugugguggcagaugucagu

SEQ ID NO: 1007910 - RNA, 19 nt, Human
agcauccagucaugggauc

SEQ ID NO: 1007911 - RNA, 22 nt, Human
cacauauuugaugaagcuuugu

SEQ ID NO: 1007912 - RNA, 22 nt, Human
gaauauuuguaauuacuguuga

SEQ ID NO: 1007913 - RNA, 22 nt, Human
ccagcugcugugaggaccacag

SEQ ID NO: 1007914 - RNA, 22 nt, Human
ggaucauuaacacauccaucac

SEQ ID NO: 1007915 - RNA, 22 nt, Human
gggcacuguggggcccaugcug

SEQ ID NO: 1007916 - RNA, 22 nt, Human
gagguagccacagauagagacu

SEQ ID NO: 1007917 - RNA, 22 nt, Human
ugcagaagaaaacagcugugug

SEQ ID NO: 1007918 - RNA, 22 nt, Human
uuucuuauacuauauugucauc

SEQ ID NO: 1007919 - RNA, 22 nt, Human
gcacacagccagcugagggcua

SEQ ID NO: 1007920 - RNA, 22 nt, Human
gcauuccuacaggcugcuauga

SEQ ID NO: 1007921 - RNA, 20 nt, Human
uuugagaccagucugcccaa

SEQ ID NO: 1007922 - RNA, 22 nt, Human
cagguggggagaguguggagca

SEQ ID NO: 1007923 - RNA, 22 nt, Human
ugaagcaacuggacaaguuggc

SEQ ID NO: 1007924 - RNA, 22 nt, Human
ugguuucccauuaucugcagga

SEQ ID NO: 1007925 - RNA, 22 nt, Human
auuuguacaaauuuauguuagu

SEQ ID NO: 1007926 - RNA, 22 nt, Human
ucagccagugccuugaucuugc

SEQ ID NO: 1007927 - RNA, 22 nt, Human
uucucuggaacugaaacaagau

SEQ ID NO: 1007928 - RNA, 22 nt, Human
gauuucaaaaguagauccauca

SEQ ID NO: 1007929 - RNA, 20 nt, Human
acauugauuauguuuguaga

SEQ ID NO: 1007930 - RNA, 22 nt, Human
gucacuguuuccuauuauauuu

SEQ ID NO: 1007931 - RNA, 22 nt, Human
guucuucaaagugacaacuaaa

SEQ ID NO: 1007932 - RNA, 22 nt, Human
augcuguguggccaccuccaug

SEQ ID NO: 1007933 - RNA, 18 nt, Human
gguggcucagucaugggg

SEQ ID NO: 1007934 - RNA, 22 nt, Human
cccuugcaucccauguguggcc

SEQ ID NO: 1007935 - RNA, 22 nt, Human
uggaccugcguaggugcugggc

SEQ ID NO: 1007936 - RNA, 22 nt, Human
agggccagggaagcuguauuuu

SEQ ID NO: 1007937 - RNA, 22 nt, Human
gccggggcuggggagagacaug

SEQ ID NO: 1007938 - RNA, 18 nt, Human
aaugcacacauuuacucc

SEQ ID NO: 1007939 - RNA, 22 nt, Human
cuggcagucugccucuucacug

SEQ ID NO: 1007940 - RNA, 22 nt, Human
ggucaugcugugaaucagugcu

SEQ ID NO: 1007941 - RNA, 22 nt, Human
aggcagaggaaggguggauuug

SEQ ID NO: 1007942 - RNA, 23 nt, Human
uggcucucucagugcugcagagg

SEQ ID NO: 1007943 - RNA, 22 nt, Human
auugaaaguccuaucuaaggga

SEQ ID NO: 1007944 - RNA, 22 nt, Human
ggcuuuaugcagggauagaaau

SEQ ID NO: 1007945 - RNA, 22 nt, Human
aagcuggaacaucuugaggaag

SEQ ID NO: 1007946 - RNA, 22 nt, Human
ggugaagggccuuaggagacag

SEQ ID NO: 1007947 - RNA, 22 nt, Human
aaugggagagaacacaaagucc

SEQ ID NO: 1007948 - RNA, 22 nt, Human
uacaaaguauauuucuagcugu

SEQ ID NO: 1007949 - RNA, 22 nt, Human
cucuugaagcaggggccaguuc

SEQ ID NO: 1007950 - RNA, 22 nt, Human
gcugugcuggaaggggaccugc

SEQ ID NO: 1007951 - RNA, 22 nt, Human
uguacacaauucuuaacauaca

SEQ ID NO: 1007952 - RNA, 20 nt, Human
ugagugauggaggcggguca

SEQ ID NO: 1007953 - RNA, 22 nt, Human
uuggaaggugagucccuggguu

SEQ ID NO: 1007954 - RNA, 22 nt, Human
uuuucagugggcaaugauguga

SEQ ID NO: 1007955 - RNA, 22 nt, Human
aggcacuguucccaguuauccu

SEQ ID NO: 1007956 - RNA, 22 nt, Human
cccaggcagugcugaucccuca

SEQ ID NO: 1007957 - RNA, 22 nt, Human
gaagcagcgaaguggaagggac

SEQ ID NO: 1007958 - RNA, 22 nt, Human
cgcagaagagguugucuagucc

SEQ ID NO: 1007959 - RNA, 22 nt, Human
gucacaggccuggaugaggggc

SEQ ID NO: 1007960 - RNA, 22 nt, Human
ccucuccaguuuuaacgugacc

SEQ ID NO: 1007961 - RNA, 21 nt, Human
aggugccaaggagaagcaggc

SEQ ID NO: 1007962 - RNA, 22 nt, Human
cauuuguuaaccaguguggauu

SEQ ID NO: 1007963 - RNA, 20 nt, Human
aguuauaguaucuagccaug

SEQ ID NO: 1007964 - RNA, 22 nt, Human
gcugugcuugggaagaaucucu

SEQ ID NO: 1007965 - RNA, 22 nt, Human
ugccuggcaacuguggugggcu

SEQ ID NO: 1007966 - RNA, 22 nt, Human
gcauuuauuucuuuacugcauc

SEQ ID NO: 1007967 - RNA, 22 nt, Human
uguggcccagaugagugugcua

SEQ ID NO: 1007968 - RNA, 22 nt, Human
gagguauguaugcuacauucuu

SEQ ID NO: 1007969 - RNA, 22 nt, Human
cucagggacguuagaggacagg

SEQ ID NO: 1007970 - RNA, 22 nt, Human
uuccuccacgugacaggagcca

SEQ ID NO: 1007971 - RNA, 22 nt, Human
uugcagcuucuaccacuguuuc

SEQ ID NO: 1007972 - RNA, 19 nt, Human
cauuuagaaguacauauua

SEQ ID NO: 1007973 - RNA, 22 nt, Human
uccucagggaagaugagccuca

SEQ ID NO: 1007974 - RNA, 22 nt, Human
ucucagagggaggauuacugcc

SEQ ID NO: 1007975 - RNA, 22 nt, Human
cuccugggcucaagugauccuc

SEQ ID NO: 1007976 - RNA, 22 nt, Human
ucugagaggauuccugucccga

SEQ ID NO: 1007977 - RNA, 22 nt, Human
aauuugauucccugcaccuguu

SEQ ID NO: 1007978 - RNA, 22 nt, Human
gcauguguggaggagaugugcu

SEQ ID NO: 1007979 - RNA, 22 nt, Human
guucauauuacuuugagugcag

SEQ ID NO: 1007980 - RNA, 22 nt, Human
uagcauuuauggucaugugucc

SEQ ID NO: 1007981 - RNA, 22 nt, Human
uuccuugguagagagaauauuu

SEQ ID NO: 1007982 - RNA, 22 nt, Human
ucucuguaguugggcagcugcu

SEQ ID NO: 1007983 - RNA, 22 nt, Human
agugugggugagggaggcccuc

SEQ ID NO: 1007984 - RNA, 22 nt, Human
aauuagggaaaauuuacuugua

SEQ ID NO: 1007985 - RNA, 22 nt, Human
guuauguaaucuaacacucagu

SEQ ID NO: 1007986 - RNA, 22 nt, Human
cuggccuggcaggggaccucua

SEQ ID NO: 1007987 - RNA, 22 nt, Human
aagagcuggagcugcuacagga

SEQ ID NO: 1007988 - RNA, 22 nt, Human
gcuggccaguguggugaccacc

SEQ ID NO: 1007989 - RNA, 22 nt, Human
ucagcagaggggaaggcaucug

SEQ ID NO: 1007990 - RNA, 18 nt, Human
agugugugcccuuucagg

SEQ ID NO: 1007991 - RNA, 22 nt, Human
gcuggccugcgagggcaggcug

SEQ ID NO: 1007992 - RNA, 22 nt, Human
accaaggagccacauacaaccu

SEQ ID NO: 1007993 - RNA, 22 nt, Human
ggcucaggacugcagcguagag

SEQ ID NO: 1007994 - RNA, 22 nt, Human
caaaagauacuugcaucuaacu

SEQ ID NO: 1007995 - RNA, 22 nt, Human
ucucagaggugcccuggcaucu

SEQ ID NO: 1007996 - RNA, 22 nt, Human
uuccuguauucuaaagggaaag

SEQ ID NO: 1007997 - RNA, 22 nt, Human
cagagggcucaguccugcugga

SEQ ID NO: 1007998 - RNA, 22 nt, Human
aaauauaguaaaugcauaguuc

SEQ ID NO: 1007999 - RNA, 22 nt, Human
cacccagggcugugccugccca

SEQ ID NO: 1008000 - RNA, 22 nt, Human
gggagggaucugcuaggcaaug

SEQ ID NO: 1008001 - RNA, 22 nt, Human
cagggcuggcuguggcaaucuc

SEQ ID NO: 1008002 - RNA, 22 nt, Human
cacagcuuaugccacugauugg

SEQ ID NO: 1008003 - RNA, 22 nt, Human
gcaugucaugucauguaggaau

SEQ ID NO: 1008004 - RNA, 22 nt, Human
auguggaggaaaugaguguaca

SEQ ID NO: 1008005 - RNA, 23 nt, Human
agcacagacuagaaaggucuuuc

SEQ ID NO: 1008006 - RNA, 22 nt, Human
gcacacccucucaccagcacug

SEQ ID NO: 1008007 - RNA, 22 nt, Human
agacaugucaccaauucuuacu

SEQ ID NO: 1008008 - RNA, 22 nt, Human
acaggggcuccgaaggugaggg

SEQ ID NO: 1008009 - RNA, 22 nt, Human
uuugaauaucacaaacuuucaa

SEQ ID NO: 1008010 - RNA, 22 nt, Human
aggcagagcugauguucuguga

SEQ ID NO: 1008011 - RNA, 22 nt, Human
uccugggaagagaccugagcau

SEQ ID NO: 1008012 - RNA, 22 nt, Human
caggugggccaugaaaaaugac

SEQ ID NO: 1008013 - RNA, 22 nt, Human
acccucccauuuccauguagca

SEQ ID NO: 1008014 - RNA, 19 nt, Human
cuucuucuuggcagccaag

SEQ ID NO: 1008015 - RNA, 22 nt, Human
agaggcugaaugaugucaucau

SEQ ID NO: 1008016 - RNA, 19 nt, Human
acaagggcaggcaagguga

SEQ ID NO: 1008017 - RNA, 22 nt, Human
agaguguuucagucuuccuaga

SEQ ID NO: 1008018 - RNA, 22 nt, Human
accaaggaagagauucucaguu

SEQ ID NO: 1008019 - RNA, 22 nt, Human
agucagcagccuggccaggaga

SEQ ID NO: 1008020 - RNA, 22 nt, Human
agacaaguucugugggucaccu

SEQ ID NO: 1008021 - RNA, 22 nt, Human
gaugaagccugacuucucggug

SEQ ID NO: 1008022 - RNA, 22 nt, Human
ccagggucucugcugccugaga

SEQ ID NO: 1008023 - RNA, 21 nt, Human
cuccugggcuaagauauagug

SEQ ID NO: 1008024 - RNA, 20 nt, Human
ucccaaggaugccugggugu

SEQ ID NO: 1008025 - RNA, 17 nt, Human
uuccuggaagucauucc

SEQ ID NO: 1008026 - RNA, 22 nt, Human
ugcaccauuaauuuaugugaga

SEQ ID NO: 1008027 - RNA, 22 nt, Human
agggcugguauguccaugaaag

SEQ ID NO: 1008028 - RNA, 22 nt, Human
ggcugcuguuucagagacuguu

SEQ ID NO: 1008029 - RNA, 22 nt, Human
ccucaggaaccacauugcugcu

SEQ ID NO: 1008030 - RNA, 22 nt, Human
uuuuccuauaugcaaagaaugc

SEQ ID NO: 1008031 - RNA, 22 nt, Human
agggccagaaucccucagucua

SEQ ID NO: 1008032 - RNA, 22 nt, Human
uccucugcuccaggcuggacuu

SEQ ID NO: 1008033 - RNA, 22 nt, Human
cuggagagaaaugacaaagcua

SEQ ID NO: 1008034 - RNA, 22 nt, Human
aaagauaauguuuccuuauucu

SEQ ID NO: 1008035 - RNA, 22 nt, Human
agcagggccaacaguaaacacc

SEQ ID NO: 1008036 - RNA, 22 nt, Human
ugcugcacgauaaauaauuucu

SEQ ID NO: 1008037 - RNA, 18 nt, Human
cuuucagauggauaugcu

SEQ ID NO: 1008038 - RNA, 22 nt, Human
ccugucuguauugguuugcuau

SEQ ID NO: 1008039 - RNA, 19 nt, Human
ggucacagggguuacaagg

SEQ ID NO: 1008040 - RNA, 22 nt, Human
gucuucaacaauaacuaccacu

SEQ ID NO: 1008041 - RNA, 22 nt, Human
gcagcugagagaagaacagggc

SEQ ID NO: 1008042 - RNA, 22 nt, Human
uccauucauucauugaugaaca

SEQ ID NO: 1008043 - RNA, 22 nt, Human
ugccagcacuucuggcugucug

SEQ ID NO: 1008044 - RNA, 21 nt, Human
uuagaaagcucacuacaguua

SEQ ID NO: 1008045 - RNA, 22 nt, Human
aucuugcauuugcuaaaaugca

SEQ ID NO: 1008046 - RNA, 19 nt, Human
agucuuucccacucgucuu

SEQ ID NO: 1008047 - RNA, 22 nt, Human
cuggccagcauuuuugcuuuag

SEQ ID NO: 1008048 - RNA, 22 nt, Human
agagggcugcugcacagugcuc

SEQ ID NO: 1008049 - RNA, 22 nt, Human
uccugucugucuuuggucccuu

SEQ ID NO: 1008050 - RNA, 22 nt, Human
gguuugcauucugaaaggcuca

SEQ ID NO: 1008051 - RNA, 22 nt, Human
cuguuuauuacacuggauagca

SEQ ID NO: 1008052 - RNA, 22 nt, Human
gggugggguguaucggauccua

SEQ ID NO: 1008053 - RNA, 22 nt, Human
agcagcugcagggagggucugc

SEQ ID NO: 1008054 - RNA, 22 nt, Human
agccauccuacuaccucagcau

SEQ ID NO: 1008055 - RNA, 22 nt, Human
cuggcaggcggcagagcccagg

SEQ ID NO: 1008056 - RNA, 22 nt, Human
guuuagaauucuaacuuuaagg

SEQ ID NO: 1008057 - RNA, 22 nt, Human
aauucuauaggcaagcuauuuu

SEQ ID NO: 1008058 - RNA, 22 nt, Human
aagaacagguucuagaaccauu

SEQ ID NO: 1008059 - RNA, 22 nt, Human
acuagauaauuauaaaagguag

SEQ ID NO: 1008060 - RNA, 22 nt, Human
caaaugcauagaaagaugaaac

SEQ ID NO: 1008061 - RNA, 22 nt, Human
ugggcagagaucuggaucaaac

SEQ ID NO: 1008062 - RNA, 22 nt, Human
caaagggcucuagacucagcag

SEQ ID NO: 1008063 - RNA, 22 nt, Human
gccagcccagcuccaggggaaa

SEQ ID NO: 1008064 - RNA, 22 nt, Human
aaguuaugaaauuuggacagcu

SEQ ID NO: 1008065 - RNA, 22 nt, Human
ucuguucuauuggucuaugugu

SEQ ID NO: 1008066 - RNA, 22 nt, Human
ugagcccuaagggucaagcagg

SEQ ID NO: 1008067 - RNA, 22 nt, Human
ggcagcuggguuggccagaaac

SEQ ID NO: 1008068 - RNA, 22 nt, Human
uucugucacuugcaaucaagag

SEQ ID NO: 1008069 - RNA, 22 nt, Human
uucugugcccauuuuaaaaugg

SEQ ID NO: 1008070 - RNA, 22 nt, Human
gagguacaugaggauacacagg

SEQ ID NO: 1008071 - RNA, 21 nt, Human
uuugaaagcccuauguuuuca

SEQ ID NO: 1008072 - RNA, 22 nt, Human
cagucuuuguucccauuacuga

SEQ ID NO: 1008073 - RNA, 19 nt, Human
gggaugggcccucacccuc

SEQ ID NO: 1008074 - RNA, 22 nt, Human
aacuagucagugauucucagaa

SEQ ID NO: 1008075 - RNA, 22 nt, Human
ugccuggcaaugccagaagcca

SEQ ID NO: 1008076 - RNA, 22 nt, Human
agagggcccauguugggcugcu

SEQ ID NO: 1008077 - RNA, 22 nt, Human
uguguacucaauugagccauuu

SEQ ID NO: 1008078 - RNA, 22 nt, Human
uucacagauguauuggaacucc

SEQ ID NO: 1008079 - RNA, 22 nt, Human
aucaggaugacaacugcugggu

SEQ ID NO: 1008080 - RNA, 22 nt, Human
gggggucccaagcugggcugcu

SEQ ID NO: 1008081 - RNA, 22 nt, Human
agagccagcauuugggcccugc

SEQ ID NO: 1008082 - RNA, 18 nt, Human
ucuuuggacaacuacugg

SEQ ID NO: 1008083 - RNA, 22 nt, Human
uuucacauuagauaugucauuu

SEQ ID NO: 1008084 - RNA, 22 nt, Human
agagccuguaacaucuuucuua

SEQ ID NO: 1008085 - RNA, 22 nt, Human
gccuuggccuuccuaggccuga

SEQ ID NO: 1008086 - RNA, 22 nt, Human
uggcagcuacagacagagguga

SEQ ID NO: 1008087 - RNA, 22 nt, Human
aggaaacuguccccucauccua

SEQ ID NO: 1008088 - RNA, 22 nt, Human
aaauaugaaugauaagaguuau

SEQ ID NO: 1008089 - RNA, 22 nt, Human
ggcugccuugacccuggcuccg

SEQ ID NO: 1008090 - RNA, 22 nt, Human
cuuauuagaguuguguucuguu

SEQ ID NO: 1008091 - RNA, 22 nt, Human
uucaggaugacaccauguccag

SEQ ID NO: 1008092 - RNA, 22 nt, Human
aguagaaagaaggcacugggcc

SEQ ID NO: 1008093 - RNA, 18 nt, Human
guucaaggucaagagaga

SEQ ID NO: 1008094 - RNA, 22 nt, Human
agcagccaagguaaccugugcu

SEQ ID NO: 1008095 - RNA, 22 nt, Human
cccauggggacaccaugaagga

SEQ ID NO: 1008096 - RNA, 22 nt, Human
ucagcagauggguuguguuggc

SEQ ID NO: 1008097 - RNA, 22 nt, Human
ccugggcucaagugauccuccu

SEQ ID NO: 1008098 - RNA, 22 nt, Human
auuucuguugcuuauaaauuac

SEQ ID NO: 1008099 - RNA, 22 nt, Human
acauuugagaugccuuuuaggu

SEQ ID NO: 1008100 - RNA, 22 nt, Human
ugcacacaaaugugaacgugcc

SEQ ID NO: 1008101 - RNA, 22 nt, Human
caggguggcacaucacagcauu

SEQ ID NO: 1008102 - RNA, 22 nt, Human
cuguccuuacugcuucuggcuu

SEQ ID NO: 1008103 - RNA, 22 nt, Human
cugggccugucagggcuuuuug

SEQ ID NO: 1008104 - RNA, 22 nt, Human
uggaagcacuuggguuuuguug

SEQ ID NO: 1008105 - RNA, 22 nt, Human
gaggcugcacuggcuaaaggcu

SEQ ID NO: 1008106 - RNA, 22 nt, Human
aacagacagaaaaaugugaucu

SEQ ID NO: 1008107 - RNA, 22 nt, Human
aaaggagacuucagaucuccuu

SEQ ID NO: 1008108 - RNA, 22 nt, Human
ccagggugagugucauggguua

SEQ ID NO: 1008109 - RNA, 22 nt, Human
gcacagccacugagugagaacc

SEQ ID NO: 1008110 - RNA, 22 nt, Human
acagguggcauaggcaguuuga

SEQ ID NO: 1008111 - RNA, 22 nt, Human
ucagggcagccuaaggcaccuc

SEQ ID NO: 1008112 - RNA, 23 nt, Human
agucuucauuguauuuccagacc

SEQ ID NO: 1008113 - RNA, 22 nt, Human
uugaaaguccuucuugaguuac

SEQ ID NO: 1008114 - RNA, 19 nt, Human
cugugcaggccgggcugag

SEQ ID NO: 1008115 - RNA, 22 nt, Human
ugcagcagcagggaggaggcuc

SEQ ID NO: 1008116 - RNA, 22 nt, Human
acaauacuuaccaauguuuuug

SEQ ID NO: 1008117 - RNA, 22 nt, Human
cccugagagugagugccaccuu

SEQ ID NO: 1008118 - RNA, 22 nt, Human
uuuucguuuauuugacauguaa

SEQ ID NO: 1008119 - RNA, 22 nt, Human
guaaaucccauccuuucucugg

SEQ ID NO: 1008120 - RNA, 22 nt, Human
agaaauguuuauggcugccuau

SEQ ID NO: 1008121 - RNA, 22 nt, Human
gaggccuggcugggaggaggug

SEQ ID NO: 1008122 - RNA, 22 nt, Human
aguuuccaaagcauguucacac

SEQ ID NO: 1008123 - RNA, 22 nt, Human
gggacuggaguagaggccggug

SEQ ID NO: 1008124 - RNA, 22 nt, Human
uuucuguaaggacuuaaugcaa

SEQ ID NO: 1008125 - RNA, 22 nt, Human
cugaggugagcuucccugggcu

SEQ ID NO: 1008126 - RNA, 22 nt, Human
cucuggccugcuuccucaggua

SEQ ID NO: 1008127 - RNA, 22 nt, Human
agcuucucaggagucugaggca

SEQ ID NO: 1008128 - RNA, 22 nt, Human
guguaugagccuccagcugggc

SEQ ID NO: 1008129 - RNA, 22 nt, Human
uucauguguauggaacauuuuu

SEQ ID NO: 1008130 - RNA, 22 nt, Human
auguagcagauauuugugcaca

SEQ ID NO: 1008131 - RNA, 22 nt, Human
cuucagaggggacucaaaguca

SEQ ID NO: 1008132 - RNA, 22 nt, Human
cagguggaucucuaaggacuga

SEQ ID NO: 1008133 - RNA, 22 nt, Human
ccuggcucuucagagguuccua

SEQ ID NO: 1008134 - RNA, 22 nt, Human
cuguucauggaaaaauaguugg

SEQ ID NO: 1008135 - RNA, 22 nt, Human
aggcacugaagaacucuuuuug

SEQ ID NO: 1008136 - RNA, 22 nt, Human
aagggccauaacuugcaguguu

SEQ ID NO: 1008137 - RNA, 22 nt, Human
cuggcucuucagugcuugguuc

SEQ ID NO: 1008138 - RNA, 22 nt, Human
cagagaccccuggcaugguggu

SEQ ID NO: 1008139 - RNA, 22 nt, Human
auguaacaggugaagcucugag

SEQ ID NO: 1008140 - RNA, 18 nt, Human
gggcucugauccuucacc

SEQ ID NO: 1008141 - RNA, 22 nt, Human
gcagcuuuuuggaugucaguua

SEQ ID NO: 1008142 - RNA, 22 nt, Human
gaggccugcagcguggucccug

SEQ ID NO: 1008143 - RNA, 22 nt, Human
cccuggugguacggcacuggca

SEQ ID NO: 1008144 - RNA, 22 nt, Human
gaaacauauuaauccagugaaa

SEQ ID NO: 1008145 - RNA, 22 nt, Human
ggcagugaaaaaguauguuucc

SEQ ID NO: 1008146 - RNA, 22 nt, Human
cacugaaucucaaggggagggu

SEQ ID NO: 1008147 - RNA, 21 nt, Human
aaaggccauaaucacggagca

SEQ ID NO: 1008148 - RNA, 17 nt, Human
uggcuucccugggccac

SEQ ID NO: 1008149 - RNA, 22 nt, Human
ucuggcucucucaucacccaau

SEQ ID NO: 1008150 - RNA, 17 nt, Human
cauuuguugaucaguug

SEQ ID NO: 1008151 - RNA, 22 nt, Human
acagggccaggugagaggugcu

SEQ ID NO: 1008152 - RNA, 22 nt, Human
cccaaggcauggcaugguggca

SEQ ID NO: 1008153 - RNA, 22 nt, Human
ucuguagcaagugagaggcauu

SEQ ID NO: 1008154 - RNA, 22 nt, Human
cagaaauggaauuuuccaucac

SEQ ID NO: 1008155 - RNA, 22 nt, Human
uugauuucuuacucuuccaagg

SEQ ID NO: 1008156 - RNA, 22 nt, Human
aagaacagauucagccugaacu

SEQ ID NO: 1008157 - RNA, 22 nt, Human
ccugggagguggagguugcagu

SEQ ID NO: 1008158 - RNA, 22 nt, Human
cagcuucucagaaagcugaggu

SEQ ID NO: 1008159 - RNA, 22 nt, Human
ugucauugaggaaaacuaggug

SEQ ID NO: 1008160 - RNA, 22 nt, Human
acagccagggcauugucgccga

SEQ ID NO: 1008161 - RNA, 22 nt, Human
agagaagagcaaugauaaauuu

SEQ ID NO: 1008162 - RNA, 22 nt, Human
gugcucacugugagacguccug

SEQ ID NO: 1008163 - RNA, 22 nt, Human
ggaugcugacuuuggagcaugg

SEQ ID NO: 1008164 - RNA, 22 nt, Human
uucagugugugauaccugcugu

SEQ ID NO: 1008165 - RNA, 22 nt, Human
gcuggcucccauugguccuucc

SEQ ID NO: 1008166 - RNA, 22 nt, Human
uggaagccaggcccgcuccuaa

SEQ ID NO: 1008167 - RNA, 22 nt, Human
uccagaccauggauggcugcaa

SEQ ID NO: 1008168 - RNA, 22 nt, Human
ggcauguuucaucacaucaaga

SEQ ID NO: 1008169 - RNA, 22 nt, Human
ggaagaagggucauuggcagcc

SEQ ID NO: 1008170 - RNA, 20 nt, Human
uuucugugagaaacacuguu

SEQ ID NO: 1008171 - RNA, 22 nt, Human
uacaguaaccagucuacuuaga

SEQ ID NO: 1008172 - RNA, 22 nt, Human
ccacacagggggaugaguuauu

SEQ ID NO: 1008173 - RNA, 22 nt, Human
ucacaucuuauuagaguaucuc

SEQ ID NO: 1008174 - RNA, 22 nt, Human
agccucucuguuagucacuggg

SEQ ID NO: 1008175 - RNA, 22 nt, Human
agcaggcuuguuaugucugaga

SEQ ID NO: 1008176 - RNA, 22 nt, Human
uacuuagagcgauaauuuauac

SEQ ID NO: 1008177 - RNA, 22 nt, Human
agauuucccaaauacuuguuau

SEQ ID NO: 1008178 - RNA, 22 nt, Human
cagcuggcagcccuggcccugc

SEQ ID NO: 1008179 - RNA, 22 nt, Human
uccugccucuuuucuuauucca

SEQ ID NO: 1008180 - RNA, 19 nt, Human
aaaugugaugguacaauuc

SEQ ID NO: 1008181 - RNA, 22 nt, Human
cauuuguaucauauguaucuua

SEQ ID NO: 1008182 - RNA, 22 nt, Human
ggagccagaggcugcugcugug

SEQ ID NO: 1008183 - RNA, 22 nt, Human
cuaaaauuaccuaccaguuuag

SEQ ID NO: 1008184 - RNA, 22 nt, Human
uucucugagauagacuaagugg

SEQ ID NO: 1008185 - RNA, 23 nt, Human
auauuagggagauuagcccucua

SEQ ID NO: 1008186 - RNA, 22 nt, Human
uggggugccgacagggagggca

SEQ ID NO: 1008187 - RNA, 20 nt, Human
ugcagggcucugcuucucuc

SEQ ID NO: 1008188 - RNA, 22 nt, Human
uuuaacagaugugaaauuuuca

SEQ ID NO: 1008189 - RNA, 22 nt, Human
gcuggggagcuagaccucagca

SEQ ID NO: 1008190 - RNA, 22 nt, Human
ggagcugaaggggugggcucag

SEQ ID NO: 1008191 - RNA, 17 nt, Human
aaucuguuuacagucag

SEQ ID NO: 1008192 - RNA, 22 nt, Human
uuaaacagucccagaggcugac

SEQ ID NO: 1008193 - RNA, 22 nt, Human
gcuggcucuucaguggagauag

SEQ ID NO: 1008194 - RNA, 22 nt, Human
uuccaugaaauguguuaugcuu

SEQ ID NO: 1008195 - RNA, 17 nt, Human
aaggccauuuccaccca

SEQ ID NO: 1008196 - RNA, 22 nt, Human
gggaccugcgccacucacuguc

SEQ ID NO: 1008197 - RNA, 22 nt, Human
cccuggaggaccccaauguggc

SEQ ID NO: 1008198 - RNA, 22 nt, Human
cagauggaacacagaaaggaga

SEQ ID NO: 1008199 - RNA, 22 nt, Human
gaucuucucuuuaguagaaaca

SEQ ID NO: 1008200 - RNA, 22 nt, Human
aaucaguuagaaggaagagaau

SEQ ID NO: 1008201 - RNA, 22 nt, Human
cagaggccuuucuacagugaua

SEQ ID NO: 1008202 - RNA, 22 nt, Human
ggaugcuggggaccaaucucug

SEQ ID NO: 1008203 - RNA, 22 nt, Human
aacaaacaaacauuuugucauc

SEQ ID NO: 1008204 - RNA, 22 nt, Human
uuuccagagcaugucugcucag

SEQ ID NO: 1008205 - RNA, 22 nt, Human
ucacuugccuagcccaguucag

SEQ ID NO: 1008206 - RNA, 19 nt, Human
caggaugaucccaugacac

SEQ ID NO: 1008207 - RNA, 22 nt, Human
cagaagccugccucagaugcac

SEQ ID NO: 1008208 - RNA, 22 nt, Human
gccugaagaacagcugugagga

SEQ ID NO: 1008209 - RNA, 22 nt, Human
ucuucucuacaccagcagcccc

SEQ ID NO: 1008210 - RNA, 22 nt, Human
ggcaugggguguauguggcacg

SEQ ID NO: 1008211 - RNA, 22 nt, Human
cugggagcugaggcugacgcug

SEQ ID NO: 1008212 - RNA, 22 nt, Human
uuucaucuuccuuggcauaggu

SEQ ID NO: 1008213 - RNA, 22 nt, Human
ugguauaaaacuuuuuauugaa

SEQ ID NO: 1008214 - RNA, 21 nt, Human
ugaaaugagaaugcugagcac

SEQ ID NO: 1008215 - RNA, 22 nt, Human
acagaaagaagguguauuugag

SEQ ID NO: 1008216 - RNA, 22 nt, Human
cugaggagagaucacguggugu

SEQ ID NO: 1008217 - RNA, 22 nt, Human
gcugucuggguugagggcccug

SEQ ID NO: 1008218 - RNA, 22 nt, Human
ggcagggaaacagcugauccca

SEQ ID NO: 1008219 - RNA, 22 nt, Human
agcugcagucaagcugggccac

SEQ ID NO: 1008220 - RNA, 22 nt, Human
uuccucaugggguuccuucaga

SEQ ID NO: 1008221 - RNA, 22 nt, Human
gagcagcuagauaaagcccuuc

SEQ ID NO: 1008222 - RNA, 22 nt, Human
ugcacacaaguuggagaaugaa

SEQ ID NO: 1008223 - RNA, 22 nt, Human
ggugugccuggggcuuagcugc

SEQ ID NO: 1008224 - RNA, 22 nt, Human
gcugcugugccuggcguccugu

SEQ ID NO: 1008225 - RNA, 22 nt, Human
uuuaugagcaaugcugagggga

SEQ ID NO: 1008226 - RNA, 22 nt, Human
ggcuccuggggaggugagcuug

SEQ ID NO: 1008227 - RNA, 22 nt, Human
guccuggggaauacagaagccg

SEQ ID NO: 1008228 - RNA, 22 nt, Human
uacaguauuaugagugauugaa

SEQ ID NO: 1008229 - RNA, 22 nt, Human
ucaggcagcuccaggaauggua

SEQ ID NO: 1008230 - RNA, 22 nt, Human
agccagagcugaugucauucuc

SEQ ID NO: 1008231 - RNA, 18 nt, Human
gaucgggggcgccccaag

SEQ ID NO: 1008232 - RNA, 22 nt, Human
auuauaaagaacaugugugugg

SEQ ID NO: 1008233 - RNA, 22 nt, Human
aaucuucauuuugacaagauuc

SEQ ID NO: 1008234 - RNA, 22 nt, Human
gccaggcaggugucggagcccu

SEQ ID NO: 1008235 - RNA, 22 nt, Human
ugguccaggguguaguacagag

SEQ ID NO: 1008236 - RNA, 22 nt, Human
ucaagaaagggcuucaccagga

SEQ ID NO: 1008237 - RNA, 19 nt, Human
gccugggaugggcagaacu

SEQ ID NO: 1008238 - RNA, 23 nt, Human
ucucaagaggaagcagggcucau

SEQ ID NO: 1008239 - RNA, 22 nt, Human
gagcuuuaagggcacuggucuu

SEQ ID NO: 1008240 - RNA, 22 nt, Human
gaaacugugaggaucuuaacuu

SEQ ID NO: 1008241 - RNA, 22 nt, Human
ucuagaaaaaaacugcugugga

SEQ ID NO: 1008242 - RNA, 22 nt, Human
aaaguuuguugcuuacaaagaa

SEQ ID NO: 1008243 - RNA, 22 nt, Human
cccagcacuuugaauaugucac

SEQ ID NO: 1008244 - RNA, 22 nt, Human
acagagagggagugauaaaucc

SEQ ID NO: 1008245 - RNA, 22 nt, Human
ccagggcagugggagaaggugc

SEQ ID NO: 1008246 - RNA, 22 nt, Human
gucacacuagggccaaguggag

SEQ ID NO: 1008247 - RNA, 22 nt, Human
cagagcuggacuuaaauauauu

SEQ ID NO: 1008248 - RNA, 20 nt, Human
gggaguggugguagccugug

SEQ ID NO: 1008249 - RNA, 22 nt, Human
uauugaggaucuccugcuaauu

SEQ ID NO: 1008250 - RNA, 22 nt, Human
aguaaugucccuuaaauguggu

SEQ ID NO: 1008251 - RNA, 21 nt, Human
uucagcaguccucuagagaua

SEQ ID NO: 1008252 - RNA, 22 nt, Human
uggccuggcagagcaaggccug

SEQ ID NO: 1008253 - RNA, 22 nt, Human
cucaggauucucgacacucaca

SEQ ID NO: 1008254 - RNA, 22 nt, Human
uuuacauuucccucugucaguu

SEQ ID NO: 1008255 - RNA, 17 nt, Human
agaaagaggauccacag

SEQ ID NO: 1008256 - RNA, 22 nt, Human
acagaauauugguuacuguugc

SEQ ID NO: 1008257 - RNA, 22 nt, Human
aauuagagaucaguucuuugac

SEQ ID NO: 1008258 - RNA, 22 nt, Human
uggugguuaugcgcuuuguggg

SEQ ID NO: 1008259 - RNA, 22 nt, Human
ccacagcaugcaggccugacac

SEQ ID NO: 1008260 - RNA, 22 nt, Human
caaaguuuuaguaaacauauau

SEQ ID NO: 1008261 - RNA, 18 nt, Human
aagccagagaccacugcc

SEQ ID NO: 1008262 - RNA, 22 nt, Human
cccaggcauuuucaacuuuagu

SEQ ID NO: 1008263 - RNA, 22 nt, Human
ccaggcugccgaggaaagaaag

SEQ ID NO: 1008264 - RNA, 19 nt, Human
accugcaguaauaauuccu

SEQ ID NO: 1008265 - RNA, 22 nt, Human
uggggguguccuggugcacaca

SEQ ID NO: 1008266 - RNA, 22 nt, Human
uuaguaauguguuaauaugaau

SEQ ID NO: 1008267 - RNA, 22 nt, Human
guccucugaaguugugcaaugc

SEQ ID NO: 1008268 - RNA, 22 nt, Human
gauuuauuggucuuucauuggu

SEQ ID NO: 1008269 - RNA, 22 nt, Human
ugcagaagaaugagcuuggagu

SEQ ID NO: 1008270 - RNA, 22 nt, Human
cagggagaucuuggcuccuggu

SEQ ID NO: 1008271 - RNA, 22 nt, Human
cagggccauaucuugugcacca

SEQ ID NO: 1008272 - RNA, 22 nt, Human
accagcagaguugaggaggaca

SEQ ID NO: 1008273 - RNA, 23 nt, Human
ugcucccaggugacgcugcuguu

SEQ ID NO: 1008274 - RNA, 22 nt, Human
ucugagagagggucagaugcua

SEQ ID NO: 1008275 - RNA, 22 nt, Human
cuuaaaaucuggcaguuagcua

SEQ ID NO: 1008276 - RNA, 22 nt, Human
uggcagcaauuagcuagagcug

SEQ ID NO: 1008277 - RNA, 22 nt, Human
cuccuguauguugggcuucaca

SEQ ID NO: 1008278 - RNA, 22 nt, Human
auuagggcuggaugcaaggaaa

SEQ ID NO: 1008279 - RNA, 22 nt, Human
uugaggagcaggaugggaggcu

SEQ ID NO: 1008280 - RNA, 23 nt, Human
ggucccaguggagaggccucacc

SEQ ID NO: 1008281 - RNA, 22 nt, Human
ccagcuugaagaugugcugguu

SEQ ID NO: 1008282 - RNA, 18 nt, Human
gaugggagcaagagaaga

SEQ ID NO: 1008283 - RNA, 22 nt, Human
augcuuuuaugucacaugguca

SEQ ID NO: 1008284 - RNA, 22 nt, Human
agcugguucauucauucauggu

SEQ ID NO: 1008285 - RNA, 22 nt, Human
uggcagagagacucuccuugau

SEQ ID NO: 1008286 - RNA, 22 nt, Human
guggccuggauagacuccaucu

SEQ ID NO: 1008287 - RNA, 22 nt, Human
augucuuucgcaucaguagcua

SEQ ID NO: 1008288 - RNA, 22 nt, Human
uuuauguaguuacggacuauca

SEQ ID NO: 1008289 - RNA, 22 nt, Human
uugcaggggaaggagcagagcu

SEQ ID NO: 1008290 - RNA, 22 nt, Human
agcagccaaaugaagauuuuac

SEQ ID NO: 1008291 - RNA, 22 nt, Human
gcuggccacauugugccguccu

SEQ ID NO: 1008292 - RNA, 22 nt, Human
uuacuuuggguccugcuuauaa

SEQ ID NO: 1008293 - RNA, 22 nt, Human
gagagucuagugcaccuaguuu

SEQ ID NO: 1008294 - RNA, 22 nt, Human
ggagugacucucggggccacua

SEQ ID NO: 1008295 - RNA, 22 nt, Human
cugccagcacugccuccugagg

SEQ ID NO: 1008296 - RNA, 22 nt, Human
uggagcugggaguccugggcug

SEQ ID NO: 1008297 - RNA, 22 nt, Human
uccccagccgugaaggagagga

SEQ ID NO: 1008298 - RNA, 22 nt, Human
aucuggcuuacgaagcacuggu

SEQ ID NO: 1008299 - RNA, 22 nt, Human
uuugucagucaugucugcuuuu

SEQ ID NO: 1008300 - RNA, 22 nt, Human
aauucuugguccuaguguauaa

SEQ ID NO: 1008301 - RNA, 22 nt, Human
gcuggcuguaucaccuggccag

SEQ ID NO: 1008302 - RNA, 22 nt, Human
gcuggccauggggagugaggag

SEQ ID NO: 1008303 - RNA, 22 nt, Human
cuguagccagaagcagaaggcc

SEQ ID NO: 1008304 - RNA, 22 nt, Human
acagcuguggggacucuugccc

SEQ ID NO: 1008305 - RNA, 22 nt, Human
ucccaggcugggggccugaagu

SEQ ID NO: 1008306 - RNA, 22 nt, Human
gaacaauagugguaacaaagcc

SEQ ID NO: 1008307 - RNA, 22 nt, Human
uagagcugauaaugaggccaag

SEQ ID NO: 1008308 - RNA, 22 nt, Human
aagggcaggaaaagauggaugu

SEQ ID NO: 1008309 - RNA, 22 nt, Human
cuggggcucucuggaaugcuug

SEQ ID NO: 1008310 - RNA, 22 nt, Human
uuuuaucuaccuaugcucauuu

SEQ ID NO: 1008311 - RNA, 22 nt, Human
caucuucagguucauggucaua

SEQ ID NO: 1008312 - RNA, 22 nt, Human
acagaauuaaaguguuugugga

SEQ ID NO: 1008313 - RNA, 22 nt, Human
aucuucucauguguaaugaggu

SEQ ID NO: 1008314 - RNA, 22 nt, Human
uagggcaggugaagaaaagcua

SEQ ID NO: 1008315 - RNA, 22 nt, Human
gauuucaaagguucugcaugcc

SEQ ID NO: 1008316 - RNA, 21 nt, Human
aaauacagaaacuuguuuuca

SEQ ID NO: 1008317 - RNA, 22 nt, Human
agaugcugccucuccucacaag

SEQ ID NO: 1008318 - RNA, 22 nt, Human
uuauuccauagaagucaaggaa

SEQ ID NO: 1008319 - RNA, 22 nt, Human
cacaggcuuccaguccccagcu

SEQ ID NO: 1008320 - RNA, 22 nt, Human
uuguuuugcuaaagggucauca

SEQ ID NO: 1008321 - RNA, 22 nt, Human
ugucuuccucuuggcuugagcu

SEQ ID NO: 1008322 - RNA, 23 nt, Human
uuccagaguccacaucugccacc

SEQ ID NO: 1008323 - RNA, 22 nt, Human
acaaugcaccagcaucuucacc

SEQ ID NO: 1008324 - RNA, 22 nt, Human
gggccugucucacucccugguu

SEQ ID NO: 1008325 - RNA, 22 nt, Human
ucccugggcaucacguugcuuc

SEQ ID NO: 1008326 - RNA, 22 nt, Human
ggccucuguucugcauuccucc

SEQ ID NO: 1008327 - RNA, 22 nt, Human
uucaauucuaaacuaauauucu

SEQ ID NO: 1008328 - RNA, 22 nt, Human
ccagcugauucgguggugguug

SEQ ID NO: 1008329 - RNA, 22 nt, Human
caggacugauguuccuccagcc

SEQ ID NO: 1008330 - RNA, 22 nt, Human
ucaagugcuugugagguauuug

SEQ ID NO: 1008331 - RNA, 22 nt, Human
gcagggcucauucuaguacaau

SEQ ID NO: 1008332 - RNA, 23 nt, Human
ggccuccuggucuaggcuagacu

SEQ ID NO: 1008333 - RNA, 22 nt, Human
ccagaagaccccguccaccucc

SEQ ID NO: 1008334 - RNA, 22 nt, Human
acaggcugcugagccauuugcu

SEQ ID NO: 1008335 - RNA, 22 nt, Human
gaugcagggcuggcaggagcuu

SEQ ID NO: 1008336 - RNA, 22 nt, Human
ucaguuuuuaagaguuaugcga

SEQ ID NO: 1008337 - RNA, 22 nt, Human
agggccugggauguccuccuag

SEQ ID NO: 1008338 - RNA, 22 nt, Human
uuugugcagauguauauuugug

SEQ ID NO: 1008339 - RNA, 22 nt, Human
acaaagugaauugcaucgaguu

SEQ ID NO: 1008340 - RNA, 22 nt, Human
uaucuguuguccaugcagaaag

SEQ ID NO: 1008341 - RNA, 22 nt, Human
gaaaugcauaaucuuaguagau

SEQ ID NO: 1008342 - RNA, 21 nt, Human
gagacagcccagugccagggc

SEQ ID NO: 1008343 - RNA, 22 nt, Human
uuugcaaagaaauuauugcugu

SEQ ID NO: 1008344 - RNA, 22 nt, Human
gggggcuguccugugcauugua

SEQ ID NO: 1008345 - RNA, 22 nt, Human
gcuccagaugaaaggccagagg

SEQ ID NO: 1008346 - RNA, 22 nt, Human
gcauuguccugcuucugagugu

SEQ ID NO: 1008347 - RNA, 22 nt, Human
gggccaggucggugaaugguca

SEQ ID NO: 1008348 - RNA, 22 nt, Human
gauuuauugucccuguccugcu

SEQ ID NO: 1008349 - RNA, 21 nt, Human
gccacguuucagucuucucag

SEQ ID NO: 1008350 - RNA, 22 nt, Human
aagcugccugccacgcuagaua

SEQ ID NO: 1008351 - RNA, 22 nt, Human
ucagagaaaugaaguagggauu

SEQ ID NO: 1008352 - RNA, 23 nt, Human
aaauuauugcucuucaauugccu

SEQ ID NO: 1008353 - RNA, 22 nt, Human
ugggauaguggccaggaccccc

SEQ ID NO: 1008354 - RNA, 22 nt, Human
aggccuggguguucaccagaag

SEQ ID NO: 1008355 - RNA, 22 nt, Human
ggaggccaucagggagggcauu

SEQ ID NO: 1008356 - RNA, 22 nt, Human
ucugccugcggcugcagguggc

SEQ ID NO: 1008357 - RNA, 22 nt, Human
cuguaugaguugggaauagaau

SEQ ID NO: 1008358 - RNA, 22 nt, Human
cagugaggugcccagccugccc

SEQ ID NO: 1008359 - RNA, 22 nt, Human
ucaggccacuucacaggugauu

SEQ ID NO: 1008360 - RNA, 22 nt, Human
cagucucagaggugggaguggg

SEQ ID NO: 1008361 - RNA, 22 nt, Human
cugcccugagggccuguguguu

SEQ ID NO: 1008362 - RNA, 22 nt, Human
ccagcccugucaccaacuggag

SEQ ID NO: 1008363 - RNA, 22 nt, Human
cauuuacacuucuaaccacaag

SEQ ID NO: 1008364 - RNA, 22 nt, Human
ucagagugcagggaguagcagc

SEQ ID NO: 1008365 - RNA, 22 nt, Human
gagggcugccacguugggcgag

SEQ ID NO: 1008366 - RNA, 22 nt, Human
aaaggccaauaaagacaagcug

SEQ ID NO: 1008367 - RNA, 22 nt, Human
aagugagauuauauguacggga

SEQ ID NO: 1008368 - RNA, 22 nt, Human
gagccagccgcaagagcuguga

SEQ ID NO: 1008369 - RNA, 22 nt, Human
cgggcuccgggucuuugcaguc

SEQ ID NO: 1008370 - RNA, 22 nt, Human
cuuguacauagagaagaagccu

SEQ ID NO: 1008371 - RNA, 22 nt, Human
ucagggacugcagagggaagcu

SEQ ID NO: 1008372 - RNA, 22 nt, Human
aaaucacuaaguuauagugugg

SEQ ID NO: 1008373 - RNA, 22 nt, Human
ugggcugcuucuauuggugguc

SEQ ID NO: 1008374 - RNA, 22 nt, Human
ucugucugacaggguaugaacu

SEQ ID NO: 1008375 - RNA, 22 nt, Human
aguuauauaacuaucuagaugc

SEQ ID NO: 1008376 - RNA, 22 nt, Human
ccucacugaagaggugacauuu

SEQ ID NO: 1008377 - RNA, 22 nt, Human
cuacauuuugugauuaugaaau

SEQ ID NO: 1008378 - RNA, 22 nt, Human
ugggccuggacaaggccacuag

SEQ ID NO: 1008379 - RNA, 22 nt, Human
agugucugccaacugcaugguc

SEQ ID NO: 1008380 - RNA, 22 nt, Human
uuauucugcacuuuuaaaauau

SEQ ID NO: 1008381 - RNA, 22 nt, Human
aacagcaugcuggguaacauug

SEQ ID NO: 1008382 - RNA, 22 nt, Human
ccagggcagggaccacgugucu

SEQ ID NO: 1008383 - RNA, 22 nt, Human
cugcucuggcuguguacuucag

SEQ ID NO: 1008384 - RNA, 22 nt, Human
ggccucucucccuggcuugcag

SEQ ID NO: 1008385 - RNA, 22 nt, Human
cugggggcaagcagacagcugu

SEQ ID NO: 1008386 - RNA, 22 nt, Human
aauuaguauugcgauucauuag

SEQ ID NO: 1008387 - RNA, 22 nt, Human
gggauggcuuuguggcugacuc

SEQ ID NO: 1008388 - RNA, 22 nt, Human
agaaacuucagcuauucuuuug

SEQ ID NO: 1008389 - RNA, 22 nt, Human
aagaaauauugggccuuauaaa

SEQ ID NO: 1008390 - RNA, 22 nt, Human
caagagcucaccggagagcauu

SEQ ID NO: 1008391 - RNA, 22 nt, Human
uugaagcagcucaggaggcuua

SEQ ID NO: 1008392 - RNA, 22 nt, Human
aagaugauguuguguuuucacu

SEQ ID NO: 1008393 - RNA, 22 nt, Human
aacucaguucuuuccacaaugc

SEQ ID NO: 1008394 - RNA, 23 nt, Human
ucuuuacauacugaugaguucuc

SEQ ID NO: 1008395 - RNA, 22 nt, Human
ucaguuuuuaaaugauauaauu

SEQ ID NO: 1008396 - RNA, 22 nt, Human
acauccagaucucagcauggcu

SEQ ID NO: 1008397 - RNA, 22 nt, Human
agaaacauuuagauuauauguc

SEQ ID NO: 1008398 - RNA, 22 nt, Human
gccugagccgccugagcggcgg

SEQ ID NO: 1008399 - RNA, 22 nt, Human
augcaguaaaauaggagguaau

SEQ ID NO: 1008400 - RNA, 22 nt, Human
ugucagggcaugcgguccagcc

SEQ ID NO: 1008401 - RNA, 22 nt, Human
augucccaagauacagcuagag

SEQ ID NO: 1008402 - RNA, 20 nt, Human
guauuagguguuccucuuuc

SEQ ID NO: 1008403 - RNA, 22 nt, Human
uccugcaggcuugaguccucag

SEQ ID NO: 1008404 - RNA, 22 nt, Human
cagugcaguugguggcaggggu

SEQ ID NO: 1008405 - RNA, 22 nt, Human
ucaucuaagagucuuacauuua

SEQ ID NO: 1008406 - RNA, 22 nt, Human
uauguagaagcugcucaaagaa

SEQ ID NO: 1008407 - RNA, 20 nt, Human
uucugucagauuauauggga

SEQ ID NO: 1008408 - RNA, 23 nt, Human
uuugaaaguaucaacucgccuga

SEQ ID NO: 1008409 - RNA, 22 nt, Human
agaugauggccauguccucucc

SEQ ID NO: 1008410 - RNA, 22 nt, Human
ucuguucaguuguaccuucccc

SEQ ID NO: 1008411 - RNA, 22 nt, Human
ggcaggaggugaguggcgggug

SEQ ID NO: 1008412 - RNA, 22 nt, Human
uggcucugccacuaacuuggua

SEQ ID NO: 1008413 - RNA, 22 nt, Human
cccacaggcuagggguagggca

SEQ ID NO: 1008414 - RNA, 22 nt, Human
caugcuccaaaaacaagagaau

SEQ ID NO: 1008415 - RNA, 22 nt, Human
cuguuucaagugaagucagaca

SEQ ID NO: 1008416 - RNA, 22 nt, Human
ccagucccaggcagaaauccag

SEQ ID NO: 1008417 - RNA, 22 nt, Human
caugggagcuaucuccaucacu

SEQ ID NO: 1008418 - RNA, 21 nt, Human
auucugucaucccagcuacuu

SEQ ID NO: 1008419 - RNA, 21 nt, Human
ccagaggccucucuuggccac

SEQ ID NO: 1008420 - RNA, 22 nt, Human
ucagcuuuccuugcuuuagauu

SEQ ID NO: 1008421 - RNA, 22 nt, Human
uuugaguugcuuauuuaauagg

SEQ ID NO: 1008422 - RNA, 22 nt, Human
gcuggccugggcagaggcuaug

SEQ ID NO: 1008423 - RNA, 22 nt, Human
aaaggcuaugagauagaagaua

SEQ ID NO: 1008424 - RNA, 22 nt, Human
agggguggccugccuuacuccc

SEQ ID NO: 1008425 - RNA, 22 nt, Human
cacuggaauucaagauacugag

SEQ ID NO: 1008426 - RNA, 22 nt, Human
aagggcugaaugaaggguugaa

SEQ ID NO: 1008427 - RNA, 22 nt, Human
gccaggaguucagaugcauguu

SEQ ID NO: 1008428 - RNA, 22 nt, Human
ggauggagaugaccauggugac

SEQ ID NO: 1008429 - RNA, 22 nt, Human
cagaggccuggcuuggacaccu

SEQ ID NO: 1008430 - RNA, 22 nt, Human
gauuucaaguaucuugggcgag

SEQ ID NO: 1008431 - RNA, 22 nt, Human
augcuguggaugccuugcccca

SEQ ID NO: 1008432 - RNA, 22 nt, Human
aaaacaguuuaggcaucacagu

SEQ ID NO: 1008433 - RNA, 22 nt, Human
ugcauuguaggauguuuagcag

SEQ ID NO: 1008434 - RNA, 22 nt, Human
cucagaaguucagccuagagua

SEQ ID NO: 1008435 - RNA, 17 nt, Human
agaggcagauacuugga

SEQ ID NO: 1008436 - RNA, 22 nt, Human
cuucuucagcacaauauugaug

SEQ ID NO: 1008437 - RNA, 20 nt, Human
gaguuccccauuucuccugg

SEQ ID NO: 1008438 - RNA, 22 nt, Human
gccuggaggaauguagcugagg

SEQ ID NO: 1008439 - RNA, 22 nt, Human
gucaggauuggggucaugaguc

SEQ ID NO: 1008440 - RNA, 22 nt, Human
uuaauuuuuauguauagugugu

SEQ ID NO: 1008441 - RNA, 22 nt, Human
gagauggggaauaggagcaagc

SEQ ID NO: 1008442 - RNA, 22 nt, Human
uccuguuuaucugugugacucg

SEQ ID NO: 1008443 - RNA, 22 nt, Human
ugucaugccaccguuucccaga

SEQ ID NO: 1008444 - RNA, 22 nt, Human
aaguccaugaucaagauguggc

SEQ ID NO: 1008445 - RNA, 22 nt, Human
cagccagagaaagggcacugcc

SEQ ID NO: 1008446 - RNA, 22 nt, Human
ggcuggcacucuguccaguguc

SEQ ID NO: 1008447 - RNA, 22 nt, Human
aguggggagguccaggccaccc

SEQ ID NO: 1008448 - RNA, 23 nt, Human
gugcaugugucuuuacaguagca

SEQ ID NO: 1008449 - RNA, 22 nt, Human
cacagccugcugcacucaagaa

SEQ ID NO: 1008450 - RNA, 22 nt, Human
auguuucaccagcaaauuaccu

SEQ ID NO: 1008451 - RNA, 22 nt, Human
ucaguucuuuauuucacaguga

SEQ ID NO: 1008452 - RNA, 23 nt, Human
cccuggccuuggggcacaggcug

SEQ ID NO: 1008453 - RNA, 22 nt, Human
cugucauugagccugucagggc

SEQ ID NO: 1008454 - RNA, 22 nt, Human
uggagcugauacagcuggcuuu

SEQ ID NO: 1008455 - RNA, 22 nt, Human
aggcacugcuucuaaguaggaa

SEQ ID NO: 1008456 - RNA, 22 nt, Human
caauuucuuguuaauucucagg

SEQ ID NO: 1008457 - RNA, 17 nt, Human
ucauuuguugugacuag

SEQ ID NO: 1008458 - RNA, 22 nt, Human
acauuuuuauucaucaaagcag

SEQ ID NO: 1008459 - RNA, 22 nt, Human
ccaggacuucgaggcuacagug

SEQ ID NO: 1008460 - RNA, 22 nt, Human
auugucuguacuuuaaaaaugu

SEQ ID NO: 1008461 - RNA, 22 nt, Human
ccagcucuuggugcacuuacau

SEQ ID NO: 1008462 - RNA, 17 nt, Human
gauuuccugaaguucuu

SEQ ID NO: 1008463 - RNA, 22 nt, Human
auauauuuugcggucacguggc

SEQ ID NO: 1008464 - RNA, 22 nt, Human
gaaacaugucugacaauuuacc

SEQ ID NO: 1008465 - RNA, 22 nt, Human
ggcagagaugugggucagaauc

SEQ ID NO: 1008466 - RNA, 18 nt, Human
uggcagcaggaagccauu

SEQ ID NO: 1008467 - RNA, 22 nt, Human
cugcagggaacugaggcccaga

SEQ ID NO: 1008468 - RNA, 22 nt, Human
uccucugccccagaugaaauuu

SEQ ID NO: 1008469 - RNA, 22 nt, Human
ccagggcauccucacaucgcag

SEQ ID NO: 1008470 - RNA, 22 nt, Human
uacagaaaucacaucgcuuuga

SEQ ID NO: 1008471 - RNA, 21 nt, Human
aggcagcucaggcccagagag

SEQ ID NO: 1008472 - RNA, 19 nt, Human
ggcccaaguacugagugcc

SEQ ID NO: 1008473 - RNA, 22 nt, Human
agcagggguaacagaaggaaag

SEQ ID NO: 1008474 - RNA, 22 nt, Human
cacccaggcagguggcugagaa

SEQ ID NO: 1008475 - RNA, 22 nt, Human
ugcuucagaggaaaggcaaaag

SEQ ID NO: 1008476 - RNA, 22 nt, Human
ugcuuuaucugugagaaccuga

SEQ ID NO: 1008477 - RNA, 22 nt, Human
gagagguccauuccccugucag

SEQ ID NO: 1008478 - RNA, 22 nt, Human
uucacauuagugguucuauaua

SEQ ID NO: 1008479 - RNA, 22 nt, Human
gcaggcaguugcaguuuucuag

SEQ ID NO: 1008480 - RNA, 22 nt, Human
uacuuucuguccuucuguuaaa

SEQ ID NO: 1008481 - RNA, 22 nt, Human
uauaucaccaaaaacaguucug

SEQ ID NO: 1008482 - RNA, 22 nt, Human
ugggcuggcugaggcauucacu

SEQ ID NO: 1008483 - RNA, 22 nt, Human
uggcagagcccagaacugagca

SEQ ID NO: 1008484 - RNA, 22 nt, Human
gcuggagguuucaccugaguuu

SEQ ID NO: 1008485 - RNA, 22 nt, Human
gagaaagacguaggcugggagg

SEQ ID NO: 1008486 - RNA, 21 nt, Human
ccuccaggagcagagcccuga

SEQ ID NO: 1008487 - RNA, 22 nt, Human
gugccuggcacacagaaggcaa

SEQ ID NO: 1008488 - RNA, 21 nt, Human
ugcagccauucagcccuaugc

SEQ ID NO: 1008489 - RNA, 22 nt, Human
agcugcccccagggcugugcuu

SEQ ID NO: 1008490 - RNA, 22 nt, Human
uauagccauuuccaguggcauc

SEQ ID NO: 1008491 - RNA, 22 nt, Human
augggcugugagguccggcagg

SEQ ID NO: 1008492 - RNA, 22 nt, Human
acuuucucaaaucagacuuuaa

SEQ ID NO: 1008493 - RNA, 22 nt, Human
ugguuuugcuccaguauaaaua

SEQ ID NO: 1008494 - RNA, 22 nt, Human
uagaaacaaugacaugcuugua

SEQ ID NO: 1008495 - RNA, 22 nt, Human
agguaaagacagugaaagaggg

SEQ ID NO: 1008496 - RNA, 22 nt, Human
ccagggcauguaacuaauggug

SEQ ID NO: 1008497 - RNA, 22 nt, Human
ggagccaguuuagaccucaguu

SEQ ID NO: 1008498 - RNA, 22 nt, Human
gucccagaaacauauugcuggu

SEQ ID NO: 1008499 - RNA, 22 nt, Human
acauuuaaugauccuacuguga

SEQ ID NO: 1008500 - RNA, 22 nt, Human
gguagcacauugcauuaggaga

SEQ ID NO: 1008501 - RNA, 22 nt, Human
ugaaaugacagucuuaagcucu

SEQ ID NO: 1008502 - RNA, 22 nt, Human
aaccccgcucaggcugggugag

SEQ ID NO: 1008503 - RNA, 22 nt, Human
uagauuucucauucauagauug

SEQ ID NO: 1008504 - RNA, 22 nt, Human
ugcugccagccaggccauggag

SEQ ID NO: 1008505 - RNA, 22 nt, Human
ggucccagaauugguuagcaca

SEQ ID NO: 1008506 - RNA, 22 nt, Human
ggccuguguccuccuugcccug

SEQ ID NO: 1008507 - RNA, 22 nt, Human
agcacagaguugcagagagcgu

SEQ ID NO: 1008508 - RNA, 22 nt, Human
caggugggagccacagcguaca

SEQ ID NO: 1008509 - RNA, 22 nt, Human
ccugccuggaucagccauccug

SEQ ID NO: 1008510 - RNA, 22 nt, Human
caggaacauuuaaccacagggu

SEQ ID NO: 1008511 - RNA, 22 nt, Human
acaaagucaaauugcagccgcc

SEQ ID NO: 1008512 - RNA, 22 nt, Human
gcagggcaugggcccugucugc

SEQ ID NO: 1008513 - RNA, 22 nt, Human
cagcuugcaguacuuguuuuug

SEQ ID NO: 1008514 - RNA, 22 nt, Human
aguauugugacucaaguauucu

SEQ ID NO: 1008515 - RNA, 22 nt, Human
ucauuguuucugcuuuucauga

SEQ ID NO: 1008516 - RNA, 22 nt, Human
cacuugggagcauugcacaugu

SEQ ID NO: 1008517 - RNA, 22 nt, Human
cucaaauauaagcuaaaugugg

SEQ ID NO: 1008518 - RNA, 22 nt, Human
uggcuggacagugggcagugga

SEQ ID NO: 1008519 - RNA, 22 nt, Human
uuuaauuugaaaugaguaaccc

SEQ ID NO: 1008520 - RNA, 22 nt, Human
auucuucauuguugauucaugu

SEQ ID NO: 1008521 - RNA, 22 nt, Human
cagugcaugaaacaauaugcag

SEQ ID NO: 1008522 - RNA, 22 nt, Human
auaugauuccacuauuguaugg

SEQ ID NO: 1008523 - RNA, 22 nt, Human
caguuuauaugucagagcugua

SEQ ID NO: 1008524 - RNA, 22 nt, Human
auucacaaaaugauauagauac

SEQ ID NO: 1008525 - RNA, 18 nt, Human
uugagggaggggcagagu

SEQ ID NO: 1008526 - RNA, 22 nt, Human
gucccaggugggcuccaccucu

SEQ ID NO: 1008527 - RNA, 22 nt, Human
auuguggcuagacagucacaau

SEQ ID NO: 1008528 - RNA, 17 nt, Human
ugagacagggcaggccc

SEQ ID NO: 1008529 - RNA, 22 nt, Human
acauuuaggauguuuugagaga

SEQ ID NO: 1008530 - RNA, 22 nt, Human
acucaggaagaaagcagcuggu

SEQ ID NO: 1008531 - RNA, 23 nt, Human
agucucagcuggaaacauguguc

SEQ ID NO: 1008532 - RNA, 22 nt, Human
aaacaaguguaaacuagucugu

SEQ ID NO: 1008533 - RNA, 22 nt, Human
caaaggagguaaugggugugag

SEQ ID NO: 1008534 - RNA, 22 nt, Human
ggcagcugaccuagcaccaucc

SEQ ID NO: 1008535 - RNA, 22 nt, Human
caggaggcccaaagggcgcaga

SEQ ID NO: 1008536 - RNA, 22 nt, Human
auuuugaugcuaucuaaugaau

SEQ ID NO: 1008537 - RNA, 22 nt, Human
uuuuagaaauacugauuuagug

SEQ ID NO: 1008538 - RNA, 22 nt, Human
ggcacugagaggcucuuccuaa

SEQ ID NO: 1008539 - RNA, 20 nt, Human
uuuuccagaaaguaucauug

SEQ ID NO: 1008540 - RNA, 22 nt, Human
aggcccuggcccccagagauuc

SEQ ID NO: 1008541 - RNA, 22 nt, Human
auccuucaaggggcugacagcu

SEQ ID NO: 1008542 - RNA, 22 nt, Human
uaauacuguauacugcaaauuu

SEQ ID NO: 1008543 - RNA, 22 nt, Human
ugcuggccaauggcagaggcgg

SEQ ID NO: 1008544 - RNA, 22 nt, Human
ucugggaagcugguccuguucu

SEQ ID NO: 1008545 - RNA, 18 nt, Human
ugcuuggagcauuuacca

SEQ ID NO: 1008546 - RNA, 20 nt, Human
cagagacccaggcuucagcu

SEQ ID NO: 1008547 - RNA, 17 nt, Human
ggaaaaggaugauacag

SEQ ID NO: 1008548 - RNA, 22 nt, Human
aauuaacagagggcuuauuacu

SEQ ID NO: 1008549 - RNA, 22 nt, Human
gugcaggguagcgacggcagga

SEQ ID NO: 1008550 - RNA, 22 nt, Human
ugucucaggggcauugaaauaa

SEQ ID NO: 1008551 - RNA, 22 nt, Human
aguggaccagaagacugaagcu

SEQ ID NO: 1008552 - RNA, 22 nt, Human
uaugacauuggccaaguucugu

SEQ ID NO: 1008553 - RNA, 22 nt, Human
agaggccuaauugcuacccuuu

SEQ ID NO: 1008554 - RNA, 22 nt, Human
aaaaaaucagaucuuugguuaa

SEQ ID NO: 1008555 - RNA, 20 nt, Human
uggucuggagccagugagga

SEQ ID NO: 1008556 - RNA, 22 nt, Human
uuuuuaguagagguggguuuca

SEQ ID NO: 1008557 - RNA, 22 nt, Human
acugcagccuugaacucugggc

SEQ ID NO: 1008558 - RNA, 22 nt, Human
agagcagugcugaagaguaggg

SEQ ID NO: 1008559 - RNA, 22 nt, Human
ucauuucuguugugcaucacug

SEQ ID NO: 1008560 - RNA, 22 nt, Human
uggagccuguguuucugcccag

SEQ ID NO: 1008561 - RNA, 22 nt, Human
ucaaauaaugccauucaucauc

SEQ ID NO: 1008562 - RNA, 22 nt, Human
aacauucaaaacccaguucagu

SEQ ID NO: 1008563 - RNA, 22 nt, Human
gcugucuugcucacucuugcag

SEQ ID NO: 1008564 - RNA, 22 nt, Human
uuauuuuuaaaaguucacacag

SEQ ID NO: 1008565 - RNA, 22 nt, Human
gcugucuucacuuccugguuuc

SEQ ID NO: 1008566 - RNA, 22 nt, Human
gggagagaugcugauugccaau

SEQ ID NO: 1008567 - RNA, 22 nt, Human
ucagggcauucaagaggccugg

SEQ ID NO: 1008568 - RNA, 22 nt, Human
ucuucuuccuccacagggccca

SEQ ID NO: 1008569 - RNA, 22 nt, Human
gcugcagcagcugcaggguugu

SEQ ID NO: 1008570 - RNA, 22 nt, Human
guuucauucggcagcucauaag

SEQ ID NO: 1008571 - RNA, 22 nt, Human
uggcucaguggcagccgcagcu

SEQ ID NO: 1008572 - RNA, 22 nt, Human
ucugcucuaguugcuuccugcc

SEQ ID NO: 1008573 - RNA, 22 nt, Human
uugaaagggauauaucuuucug

SEQ ID NO: 1008574 - RNA, 22 nt, Human
cugggacacccaaggaaagagc

SEQ ID NO: 1008575 - RNA, 22 nt, Human
agcuuuauagaaaggaucagug

SEQ ID NO: 1008576 - RNA, 22 nt, Human
aucauaaagugcuaucugauug

SEQ ID NO: 1008577 - RNA, 22 nt, Human
ugaguuuuuucaacauaugaag

SEQ ID NO: 1008578 - RNA, 22 nt, Human
uauuucugggaguucagaaauu

SEQ ID NO: 1008579 - RNA, 19 nt, Human
cagcugcaccgugaccauc

SEQ ID NO: 1008580 - RNA, 18 nt, Human
gaagggagcuggaaugca

SEQ ID NO: 1008581 - RNA, 22 nt, Human
accugccuauggagccacaugg

SEQ ID NO: 1008582 - RNA, 22 nt, Human
ccagcagagcauggggaggaag

SEQ ID NO: 1008583 - RNA, 22 nt, Human
agcugcucccuauccuuuccuu

SEQ ID NO: 1008584 - RNA, 22 nt, Human
aaaaaugaaacggcugguuggc

SEQ ID NO: 1008585 - RNA, 22 nt, Human
aaagaauuuguacacccuacua

SEQ ID NO: 1008586 - RNA, 16 nt, Human
uguaugaacgucucca

SEQ ID NO: 1008587 - RNA, 22 nt, Human
ggcuuggaaaugguaaugagcu

SEQ ID NO: 1008588 - RNA, 22 nt, Human
cugcugggaaggucugcucagu

SEQ ID NO: 1008589 - RNA, 22 nt, Human
gcacugugaucaaggcuaagca

SEQ ID NO: 1008590 - RNA, 22 nt, Human
aaaaucugguaauuugaaugug

SEQ ID NO: 1008591 - RNA, 22 nt, Human
acaauacaggcuucuggacuua

SEQ ID NO: 1008592 - RNA, 22 nt, Human
cagugcauaaucuaaauggggg

SEQ ID NO: 1008593 - RNA, 22 nt, Human
uccucuggauauaagccucacc

SEQ ID NO: 1008594 - RNA, 22 nt, Human
uugaaaguagcagcugcauaug

SEQ ID NO: 1008595 - RNA, 21 nt, Human
aacaaagggaugcucaucuuu

SEQ ID NO: 1008596 - RNA, 22 nt, Human
ugucucugauaaguaguucagu

SEQ ID NO: 1008597 - RNA, 22 nt, Human
guguuuggucagacguccgggg

SEQ ID NO: 1008598 - RNA, 22 nt, Human
acuuaguauuuuucagcuuuga

SEQ ID NO: 1008599 - RNA, 22 nt, Human
acagaaggcggggacaaggcgg

SEQ ID NO: 1008600 - RNA, 21 nt, Human
cagaggcagguccugggacgg

SEQ ID NO: 1008601 - RNA, 22 nt, Human
cacagcuaggaggaaagcagag

SEQ ID NO: 1008602 - RNA, 22 nt, Human
cuguaaaacacuguaguaucug

SEQ ID NO: 1008603 - RNA, 22 nt, Human
uccagggaagagcagaggcuac

SEQ ID NO: 1008604 - RNA, 22 nt, Human
ccagagccggcucccucagcuu

SEQ ID NO: 1008605 - RNA, 22 nt, Human
cagagugaaaacugagcucaaa

SEQ ID NO: 1008606 - RNA, 22 nt, Human
ccugugucuuccccacuggugu

SEQ ID NO: 1008607 - RNA, 22 nt, Human
cucccagggccaucgagucacu

SEQ ID NO: 1008608 - RNA, 22 nt, Human
ccaggacuuuaaguccagcacu

SEQ ID NO: 1008609 - RNA, 22 nt, Human
cagcccagcagucuuagccugc

SEQ ID NO: 1008610 - RNA, 22 nt, Human
cucaguuucugacauuaaaauc

SEQ ID NO: 1008611 - RNA, 22 nt, Human
acaggcagcacuaaucucuggu

SEQ ID NO: 1008612 - RNA, 22 nt, Human
gagcucagcccaaagagcagug

SEQ ID NO: 1008613 - RNA, 22 nt, Human
cugucucagcaggaagucauca

SEQ ID NO: 1008614 - RNA, 22 nt, Human
aaucgguugaacccaggaagug

SEQ ID NO: 1008615 - RNA, 22 nt, Human
uuugcuauaaaagggucacacg

SEQ ID NO: 1008616 - RNA, 22 nt, Human
aggcccugaccugggagaucua

SEQ ID NO: 1008617 - RNA, 22 nt, Human
cucacuguuuaauagcuggauc

SEQ ID NO: 1008618 - RNA, 22 nt, Human
gggaggugauggcaagcagcgg

SEQ ID NO: 1008619 - RNA, 22 nt, Human
gaguguuccagaaacuggcccu

SEQ ID NO: 1008620 - RNA, 22 nt, Human
uaugcacacauuagcacagggu

SEQ ID NO: 1008621 - RNA, 22 nt, Human
uguggcugacuccuggucccca

SEQ ID NO: 1008622 - RNA, 22 nt, Human
cuucuuaaucccuuauauauuu

SEQ ID NO: 1008623 - RNA, 22 nt, Human
auacaguauuaccuguucagga

SEQ ID NO: 1008624 - RNA, 22 nt, Human
aggccugucuggggcucagcca

SEQ ID NO: 1008625 - RNA, 22 nt, Human
auucucaguucacuaguuucuu

SEQ ID NO: 1008626 - RNA, 22 nt, Human
uguaugaagacuucuucugugu

SEQ ID NO: 1008627 - RNA, 18 nt, Human
ugagaggcuauuuuuugc

SEQ ID NO: 1008628 - RNA, 18 nt, Human
cuucagugacagucuggc

SEQ ID NO: 1008629 - RNA, 22 nt, Human
aaaguaguuagucaugugaaaa

SEQ ID NO: 1008630 - RNA, 22 nt, Human
ucugaacauccagcaaugcaca

SEQ ID NO: 1008631 - RNA, 22 nt, Human
ggguccaggucuucaggcagag

SEQ ID NO: 1008632 - RNA, 22 nt, Human
uccaggcacuauauauacuuuu

SEQ ID NO: 1008633 - RNA, 22 nt, Human
aacagaauugcugcugccaaug

SEQ ID NO: 1008634 - RNA, 22 nt, Human
uuuccuuugcccaauacauguc

SEQ ID NO: 1008635 - RNA, 23 nt, Human
acagggcauugcuggccucgagg

SEQ ID NO: 1008636 - RNA, 22 nt, Human
ggcuccugauaggagaaugcgg

SEQ ID NO: 1008637 - RNA, 18 nt, Human
ucugagggugcgggagcu

SEQ ID NO: 1008638 - RNA, 22 nt, Human
uccauuuucaucucauguauaa

SEQ ID NO: 1008639 - RNA, 22 nt, Human
cagcaguggaacuacccaggga

SEQ ID NO: 1008640 - RNA, 22 nt, Human
aagacugucuuuucugagugac

SEQ ID NO: 1008641 - RNA, 22 nt, Human
cuucccagacgggguggcagcc

SEQ ID NO: 1008642 - RNA, 22 nt, Human
gcccagcuuuuugaggcaggca

SEQ ID NO: 1008643 - RNA, 22 nt, Human
augcacaagaggcuagaaaaga

SEQ ID NO: 1008644 - RNA, 22 nt, Human
auucugaguccaugggggcagg

SEQ ID NO: 1008645 - RNA, 22 nt, Human
gcccagcaccucucucaggguu

SEQ ID NO: 1008646 - RNA, 18 nt, Human
caggucagccuggccuca

SEQ ID NO: 1008647 - RNA, 22 nt, Human
agagccuggcucccagcuaccg

SEQ ID NO: 1008648 - RNA, 22 nt, Human
gauuuuauuagcccaaacuuug

SEQ ID NO: 1008649 - RNA, 22 nt, Human
agggcuggcuaggugcguuccc

SEQ ID NO: 1008650 - RNA, 22 nt, Human
ugcuuagacgucaaguacagcc

SEQ ID NO: 1008651 - RNA, 22 nt, Human
uggggugggcaugcgcuguccu

SEQ ID NO: 1008652 - RNA, 22 nt, Human
ucugggcuugguuagggcuguu

SEQ ID NO: 1008653 - RNA, 18 nt, Human
cucagggcaucagucugg

SEQ ID NO: 1008654 - RNA, 22 nt, Human
agaggccggccgagcccauggg

SEQ ID NO: 1008655 - RNA, 22 nt, Human
aguuggagugaacaugagauug

SEQ ID NO: 1008656 - RNA, 22 nt, Human
ggagagcagggaggcugcucug

SEQ ID NO: 1008657 - RNA, 22 nt, Human
ggcccugagcugaaguacugug

SEQ ID NO: 1008658 - RNA, 19 nt, Human
gggcuccuugggccucucu

SEQ ID NO: 1008659 - RNA, 21 nt, Human
agcagaggggacauguuugau

SEQ ID NO: 1008660 - RNA, 22 nt, Human
aaagaacagauguguggugcau

SEQ ID NO: 1008661 - RNA, 22 nt, Human
uccuucagucuucugagccaua

SEQ ID NO: 1008662 - RNA, 22 nt, Human
cccaaggccuucaagccagcuc

SEQ ID NO: 1008663 - RNA, 22 nt, Human
ucauaacagcuaagucccuuuc

SEQ ID NO: 1008664 - RNA, 22 nt, Human
acagaauacuacagacugguua

SEQ ID NO: 1008665 - RNA, 22 nt, Human
acuccugggugcugaccagcgu

SEQ ID NO: 1008666 - RNA, 20 nt, Human
acugagcugcauggagagga

SEQ ID NO: 1008667 - RNA, 22 nt, Human
augaaggcuguguggagccccc

SEQ ID NO: 1008668 - RNA, 22 nt, Human
cauuugaaccuggauguucuua

SEQ ID NO: 1008669 - RNA, 22 nt, Human
uccagcagaaaagagguaggga

SEQ ID NO: 1008670 - RNA, 22 nt, Human
aaaggccacuugaaggauuuuu

SEQ ID NO: 1008671 - RNA, 22 nt, Human
acagagcuguacaugugccaug

SEQ ID NO: 1008672 - RNA, 22 nt, Human
gaggugggagggcagucccuaa

SEQ ID NO: 1008673 - RNA, 22 nt, Human
caccugagugucaguauucuca

SEQ ID NO: 1008674 - RNA, 22 nt, Human
agugaccaacaaugcugagaag

SEQ ID NO: 1008675 - RNA, 22 nt, Human
uuggccuucccuaccugggcca

SEQ ID NO: 1008676 - RNA, 22 nt, Human
agacagaacagaauaauuguug

SEQ ID NO: 1008677 - RNA, 22 nt, Human
ucuggcucacuucaggcuucac

SEQ ID NO: 1008678 - RNA, 20 nt, Human
cacaagagaauacacacugg

SEQ ID NO: 1008679 - RNA, 23 nt, Human
gaagcagaugucugaguaggcag

SEQ ID NO: 1008680 - RNA, 22 nt, Human
uauugacaauaggcaacugagg

SEQ ID NO: 1008681 - RNA, 22 nt, Human
uacauuaacuuacguccacaug

SEQ ID NO: 1008682 - RNA, 22 nt, Human
agauggagaccuuggaugaacu

SEQ ID NO: 1008683 - RNA, 22 nt, Human
uuuauguuugacaaugaucugg

SEQ ID NO: 1008684 - RNA, 22 nt, Human
gggcagcagaggaucccuuaau

SEQ ID NO: 1008685 - RNA, 22 nt, Human
agggacacacuccaguguuauu

SEQ ID NO: 1008686 - RNA, 21 nt, Human
accaggcuugugggagggagc

SEQ ID NO: 1008687 - RNA, 22 nt, Human
aaugcugcucucauaauuauag

SEQ ID NO: 1008688 - RNA, 21 nt, Human
ccugcagcaccagaaggagau

SEQ ID NO: 1008689 - RNA, 20 nt, Human
ccuuuauuauuuguaugaug

SEQ ID NO: 1008690 - RNA, 22 nt, Human
ucacaauuuggauacagcuaug

SEQ ID NO: 1008691 - RNA, 22 nt, Human
cuggcagcguguuuaugaacau

SEQ ID NO: 1008692 - RNA, 22 nt, Human
ugagccagaggaggcugugugg

SEQ ID NO: 1008693 - RNA, 22 nt, Human
agcccuucaaccugccuacucc

SEQ ID NO: 1008694 - RNA, 22 nt, Human
aagggcagaaagggacgcuuug

SEQ ID NO: 1008695 - RNA, 21 nt, Human
ucuguucaaggaacuacggau

SEQ ID NO: 1008696 - RNA, 22 nt, Human
cccagcucaucaggagccgccc

SEQ ID NO: 1008697 - RNA, 22 nt, Human
cgcugggggaacagcgagggug

SEQ ID NO: 1008698 - RNA, 22 nt, Human
ccugugcauccgguggucauug

SEQ ID NO: 1008699 - RNA, 22 nt, Human
cauguaaaacacucagaacagu

SEQ ID NO: 1008700 - RNA, 21 nt, Human
guagggacagagaguugguga

SEQ ID NO: 1008701 - RNA, 22 nt, Human
cuuuggcaacacaugugggaca

SEQ ID NO: 1008702 - RNA, 22 nt, Human
ucucagucagccuugauguccc

SEQ ID NO: 1008703 - RNA, 22 nt, Human
auguccagaguguccuggaaag

SEQ ID NO: 1008704 - RNA, 22 nt, Human
aggccuggugaaugaaguaucu

SEQ ID NO: 1008705 - RNA, 22 nt, Human
ggcacugagcgggcucugagcg

SEQ ID NO: 1008706 - RNA, 22 nt, Human
ugcugccuugaccuccugggcu

SEQ ID NO: 1008707 - RNA, 22 nt, Human
gcugucacaaauauuucucagc

SEQ ID NO: 1008708 - RNA, 22 nt, Human
uauacagaaccgccugaagucu

SEQ ID NO: 1008709 - RNA, 22 nt, Human
cugacucuccucaagcauaaau

SEQ ID NO: 1008710 - RNA, 22 nt, Human
uguaaaaccaaaucaaucuagu

SEQ ID NO: 1008711 - RNA, 22 nt, Human
auagcuguuagauuggggucga

SEQ ID NO: 1008712 - RNA, 22 nt, Human
ccuggugccacuagagaauguc

SEQ ID NO: 1008713 - RNA, 22 nt, Human
ucucugcugagaagggcuggca

SEQ ID NO: 1008714 - RNA, 20 nt, Human
cuguggcucaugcaucugcc

SEQ ID NO: 1008715 - RNA, 22 nt, Human
gugggacucuucuuuggcagug

SEQ ID NO: 1008716 - RNA, 22 nt, Human
aguuagaauauaauuauguuaa

SEQ ID NO: 1008717 - RNA, 22 nt, Human
cacaccuguaauaccagcuacu

SEQ ID NO: 1008718 - RNA, 22 nt, Human
agcuucuguucaucuuccaggc

SEQ ID NO: 1008719 - RNA, 22 nt, Human
auucuucacuguuucagaauga

SEQ ID NO: 1008720 - RNA, 22 nt, Human
ggugcagaaggaagggagcugg

SEQ ID NO: 1008721 - RNA, 22 nt, Human
cacugaagccugggaguaagac

SEQ ID NO: 1008722 - RNA, 22 nt, Human
gccucuggggcagcugagucau

SEQ ID NO: 1008723 - RNA, 22 nt, Human
gagagcuguccggcugagcagc

SEQ ID NO: 1008724 - RNA, 21 nt, Human
agaggccuuacaggauagacc

SEQ ID NO: 1008725 - RNA, 22 nt, Human
agauacauauagaaaacaucaa

SEQ ID NO: 1008726 - RNA, 22 nt, Human
ugguaaaguguacugaauauga

SEQ ID NO: 1008727 - RNA, 23 nt, Human
uucaaaacuggaaaaucagaugc

SEQ ID NO: 1008728 - RNA, 22 nt, Human
uuguuucauggggauguuuauu

SEQ ID NO: 1008729 - RNA, 22 nt, Human
gacagggcauggugcagaguuc

SEQ ID NO: 1008730 - RNA, 22 nt, Human
ggcagauggagaagcagcaggu

SEQ ID NO: 1008731 - RNA, 22 nt, Human
cacagagagcuacgugcagcgu

SEQ ID NO: 1008732 - RNA, 19 nt, Human
cugugcuuuaaacuccuau

SEQ ID NO: 1008733 - RNA, 22 nt, Human
cugccuggaaggagcaagggga

SEQ ID NO: 1008734 - RNA, 22 nt, Human
auguaucaauuaucugucugca

SEQ ID NO: 1008735 - RNA, 22 nt, Human
uggagcagcaucacuuugagcu

SEQ ID NO: 1008736 - RNA, 22 nt, Human
gcucucugucguuaugcuucau

SEQ ID NO: 1008737 - RNA, 18 nt, Human
cguuuuuccgggauugca

SEQ ID NO: 1008738 - RNA, 22 nt, Human
ggagagcaggguccugagauac

SEQ ID NO: 1008739 - RNA, 19 nt, Human
cauuuuaagcauccccagu

SEQ ID NO: 1008740 - RNA, 22 nt, Human
acauuucuaauuuaauguaaca

SEQ ID NO: 1008741 - RNA, 22 nt, Human
uggcacugccuggcagggcccc

SEQ ID NO: 1008742 - RNA, 22 nt, Human
gacauguugaagaauauuugga

SEQ ID NO: 1008743 - RNA, 21 nt, Human
ugcaggcaggcagagaugcug

SEQ ID NO: 1008744 - RNA, 22 nt, Human
ucagcagucacauguuguccca

SEQ ID NO: 1008745 - RNA, 22 nt, Human
ggcagagguagcuggaaccagg

SEQ ID NO: 1008746 - RNA, 22 nt, Human
ucuucagacuccaaauguuuua

SEQ ID NO: 1008747 - RNA, 23 nt, Human
ucacagggcacuggcugggguug

SEQ ID NO: 1008748 - RNA, 22 nt, Human
uggcugcuagccagagcuucag

SEQ ID NO: 1008749 - RNA, 22 nt, Human
cauaauauacuacauugaugaa

SEQ ID NO: 1008750 - RNA, 22 nt, Human
aagcugccaccagcccagggca

SEQ ID NO: 1008751 - RNA, 22 nt, Human
gggugggccugucuggccaugu

SEQ ID NO: 1008752 - RNA, 22 nt, Human
gagggggagaugugcacacacu

SEQ ID NO: 1008753 - RNA, 20 nt, Human
acuuucucgguuucucaccu

SEQ ID NO: 1008754 - RNA, 22 nt, Human
agucaguggcuccgagccuggu

SEQ ID NO: 1008755 - RNA, 22 nt, Human
ggguaccaagcugcuugggggc

SEQ ID NO: 1008756 - RNA, 22 nt, Human
uuauguacaauguuaauguaaa

SEQ ID NO: 1008757 - RNA, 22 nt, Human
agagccagagaccuggguucac

SEQ ID NO: 1008758 - RNA, 22 nt, Human
accuuggggugaugcugaaaga

SEQ ID NO: 1008759 - RNA, 22 nt, Human
acauugaugaaaagguaucauu

SEQ ID NO: 1008760 - RNA, 22 nt, Human
gaagagcuguagccugcucuuu

SEQ ID NO: 1008761 - RNA, 22 nt, Human
auggcagcaaaugucuggcugg

SEQ ID NO: 1008762 - RNA, 22 nt, Human
ugcauuaugcuugugcuguaua

SEQ ID NO: 1008763 - RNA, 23 nt, Human
cugcuguuuucuguaccugaagc

SEQ ID NO: 1008764 - RNA, 22 nt, Human
cagggcaggacagauacauuac

SEQ ID NO: 1008765 - RNA, 22 nt, Human
uuugaacuucuccauucugaug

SEQ ID NO: 1008766 - RNA, 22 nt, Human
gauuauauaauggaagcucuug

SEQ ID NO: 1008767 - RNA, 22 nt, Human
augcacgccccacacuggugug

SEQ ID NO: 1008768 - RNA, 22 nt, Human
cauuuguaguaucuguuuauau

SEQ ID NO: 1008769 - RNA, 18 nt, Human
aggaagcaggaggaaggc

SEQ ID NO: 1008770 - RNA, 22 nt, Human
ucauccagaaaaaugucuuagc

SEQ ID NO: 1008771 - RNA, 22 nt, Human
ggaccugcccuggcucagaugc

SEQ ID NO: 1008772 - RNA, 22 nt, Human
ucuggagcuuguuucagauggu

SEQ ID NO: 1008773 - RNA, 22 nt, Human
acagcagagacacucaggaggc

SEQ ID NO: 1008774 - RNA, 22 nt, Human
caguuucuauggcugggcucug

SEQ ID NO: 1008775 - RNA, 22 nt, Human
uuaaagggccgauuuccaggcc

SEQ ID NO: 1008776 - RNA, 22 nt, Human
ugucauguguucuuaaauacau

SEQ ID NO: 1008777 - RNA, 22 nt, Human
acagaaauuagcagugaguuua

SEQ ID NO: 1008778 - RNA, 22 nt, Human
uuucuuuguuguuaucacauca

SEQ ID NO: 1008779 - RNA, 22 nt, Human
acacugaauguuuaagaacuug

SEQ ID NO: 1008780 - RNA, 22 nt, Human
gguuucaacuaaaucaagaagg

SEQ ID NO: 1008781 - RNA, 22 nt, Human
cuggcagcagcuucuggaucga

SEQ ID NO: 1008782 - RNA, 22 nt, Human
ccagagcugauuccugggacuu

SEQ ID NO: 1008783 - RNA, 22 nt, Human
aacagaauaguugauguacagu

SEQ ID NO: 1008784 - RNA, 23 nt, Human
agggcugaugccauugcagcucu

SEQ ID NO: 1008785 - RNA, 22 nt, Human
cacugcuuuaaggcugaguaac

SEQ ID NO: 1008786 - RNA, 22 nt, Human
ucccagggcacucacccucccu

SEQ ID NO: 1008787 - RNA, 22 nt, Human
ucagagccccuccgcuguccca

SEQ ID NO: 1008788 - RNA, 22 nt, Human
guuucgucaggcuuauucuauc

SEQ ID NO: 1008789 - RNA, 22 nt, Human
cugccuggccugaucuccacgc

SEQ ID NO: 1008790 - RNA, 22 nt, Human
gagcauuuuugucugcauuuua

SEQ ID NO: 1008791 - RNA, 22 nt, Human
gccuccugagaagccacaggcu

SEQ ID NO: 1008792 - RNA, 22 nt, Human
uucuguguggguagcuccuguu

SEQ ID NO: 1008793 - RNA, 22 nt, Human
uggccaguagauaggcaggcaa

SEQ ID NO: 1008794 - RNA, 20 nt, Human
ugggagcuggugaggucuca

SEQ ID NO: 1008795 - RNA, 23 nt, Human
aggcagagccaaggucaaaaccc

SEQ ID NO: 1008796 - RNA, 22 nt, Human
cggcuggguagaggugccgggu

SEQ ID NO: 1008797 - RNA, 22 nt, Human
uccugcagcauccgucgucugu

SEQ ID NO: 1008798 - RNA, 22 nt, Human
gugauuuugagaccuauauagu

SEQ ID NO: 1008799 - RNA, 22 nt, Human
ggccccacgggggaguccuagu

SEQ ID NO: 1008800 - RNA, 22 nt, Human
aauguauaaaguguuaauaacu

SEQ ID NO: 1008801 - RNA, 22 nt, Human
accugcagcuaaagauguaggg

SEQ ID NO: 1008802 - RNA, 22 nt, Human
cagcacugcugcuguacacaca

SEQ ID NO: 1008803 - RNA, 22 nt, Human
aggcucugucaggcggagcagc

SEQ ID NO: 1008804 - RNA, 22 nt, Human
acuuuugguucuguaacuguga

SEQ ID NO: 1008805 - RNA, 22 nt, Human
uucuggaggccccuuccuucuc

SEQ ID NO: 1008806 - RNA, 22 nt, Human
agauggggcagaauggagccau

SEQ ID NO: 1008807 - RNA, 20 nt, Human
augcuuucuugugugcugcu

SEQ ID NO: 1008808 - RNA, 22 nt, Human
cagggcucccaaauaucucuuc

SEQ ID NO: 1008809 - RNA, 22 nt, Human
cuuucucugugugguaaagggc

SEQ ID NO: 1008810 - RNA, 22 nt, Human
cagcugcuuuaguuuuccaucc

SEQ ID NO: 1008811 - RNA, 22 nt, Human
cuggcucucugagauauugagu

SEQ ID NO: 1008812 - RNA, 22 nt, Human
cagagcuggguuugggaaaccu

SEQ ID NO: 1008813 - RNA, 22 nt, Human
uccuuuuuaagucguuguggua

SEQ ID NO: 1008814 - RNA, 22 nt, Human
cuggggacuugcagacacaauu

SEQ ID NO: 1008815 - RNA, 22 nt, Human
auucuucagcaggggacacuau

SEQ ID NO: 1008816 - RNA, 22 nt, Human
agccuguggaucccugcacugg

SEQ ID NO: 1008817 - RNA, 22 nt, Human
cuuauaguaugauguugagaau

SEQ ID NO: 1008818 - RNA, 22 nt, Human
cuguccauuuucgugccuccuu

SEQ ID NO: 1008819 - RNA, 22 nt, Human
auacagauguugaauguuauau

SEQ ID NO: 1008820 - RNA, 22 nt, Human
gaaacauaguugagacacugcu

SEQ ID NO: 1008821 - RNA, 22 nt, Human
ggccucucuccagucagugcag

SEQ ID NO: 1008822 - RNA, 22 nt, Human
uuuuaauacugcuauuguagga

SEQ ID NO: 1008823 - RNA, 20 nt, Human
ggccuuggguuucgccuguu

SEQ ID NO: 1008824 - RNA, 22 nt, Human
gugcucuccuggcugcccugac

SEQ ID NO: 1008825 - RNA, 22 nt, Human
cagagcagggguuucccagguu

SEQ ID NO: 1008826 - RNA, 22 nt, Human
uuucauaugggcauuggcaaua

SEQ ID NO: 1008827 - RNA, 22 nt, Human
uugggcaaaguguuucuggagc

SEQ ID NO: 1008828 - RNA, 23 nt, Human
uugcauagacauccucauagauu

SEQ ID NO: 1008829 - RNA, 22 nt, Human
ccccuuccuuccucagacagcc

SEQ ID NO: 1008830 - RNA, 18 nt, Human
ugucucugaauuccagug

SEQ ID NO: 1008831 - RNA, 22 nt, Human
caguacuuuucaaccaguauga

SEQ ID NO: 1008832 - RNA, 22 nt, Human
uuuaaauuuagaagaaacacug

SEQ ID NO: 1008833 - RNA, 22 nt, Human
ugcagaaggccugacauugcac

SEQ ID NO: 1008834 - RNA, 22 nt, Human
aggagagaauguuccaggcuug

SEQ ID NO: 1008835 - RNA, 22 nt, Human
gcugggagacagacuuggaacc

SEQ ID NO: 1008836 - RNA, 22 nt, Human
caguacuuggucaaggaagcag

SEQ ID NO: 1008837 - RNA, 22 nt, Human
cagcuccccucuguggggcagu

SEQ ID NO: 1008838 - RNA, 22 nt, Human
agccuucacugggaccuuggau

SEQ ID NO: 1008839 - RNA, 22 nt, Human
aguccaaagcagaugagggcca

SEQ ID NO: 1008840 - RNA, 22 nt, Human
cuucuucacacuggucugaagc

SEQ ID NO: 1008841 - RNA, 22 nt, Human
cuggcugugcugcaggcuuugg

SEQ ID NO: 1008842 - RNA, 22 nt, Human
gccagguggcugagugacugag

SEQ ID NO: 1008843 - RNA, 21 nt, Human
uggcugccuacaugcugcagg

SEQ ID NO: 1008844 - RNA, 22 nt, Human
ggcagcugggucacaccgaucu

SEQ ID NO: 1008845 - RNA, 20 nt, Human
ucuggcaggugaacgagcug

SEQ ID NO: 1008846 - RNA, 22 nt, Human
augugacaauauuuggucuuau

SEQ ID NO: 1008847 - RNA, 22 nt, Human
accaggcaaaaccacaggagca

SEQ ID NO: 1008848 - RNA, 22 nt, Human
cuagaaaaauacuuuauuguga

SEQ ID NO: 1008849 - RNA, 22 nt, Human
caggauggucuucauuuggcuc

SEQ ID NO: 1008850 - RNA, 23 nt, Human
ccaggcaguagcuauugaaguga

SEQ ID NO: 1008851 - RNA, 22 nt, Human
gggcucuggauggagccugcag

SEQ ID NO: 1008852 - RNA, 22 nt, Human
aucuacaggauuuuacagaguu

SEQ ID NO: 1008853 - RNA, 22 nt, Human
cccuggaggagcuuagagcuug

SEQ ID NO: 1008854 - RNA, 21 nt, Human
agcugccacccuagcuucuga

SEQ ID NO: 1008855 - RNA, 22 nt, Human
gcugucaguuuuacccacagac

SEQ ID NO: 1008856 - RNA, 22 nt, Human
acagaacugcaggaggaaaagc

SEQ ID NO: 1008857 - RNA, 22 nt, Human
cuggcuccacucccugccugac

SEQ ID NO: 1008858 - RNA, 21 nt, Human
uccugccuuaguccagagcag

SEQ ID NO: 1008859 - RNA, 22 nt, Human
aagugauuucugccugcauguu

SEQ ID NO: 1008860 - RNA, 22 nt, Human
cugucaguucuuccagauagag

SEQ ID NO: 1008861 - RNA, 22 nt, Human
gggacagaaggaagugagcaca

SEQ ID NO: 1008862 - RNA, 21 nt, Human
uucucagaucgaguagugaga

SEQ ID NO: 1008863 - RNA, 22 nt, Human
auuacaauaagguuuauuugua

SEQ ID NO: 1008864 - RNA, 22 nt, Human
ugcauuauacuuuuagaaauuu

SEQ ID NO: 1008865 - RNA, 20 nt, Human
aggagccauugacugcagca

SEQ ID NO: 1008866 - RNA, 22 nt, Human
auguuucaccaguuuuauaaga

SEQ ID NO: 1008867 - RNA, 22 nt, Human
ccuccuggugggcgcuucuggc

SEQ ID NO: 1008868 - RNA, 22 nt, Human
agacccugucaguguuaggaaa

SEQ ID NO: 1008869 - RNA, 22 nt, Human
uggccugccuucgcugagcuga

SEQ ID NO: 1008870 - RNA, 22 nt, Human
cccucugccugggaccaagucc

SEQ ID NO: 1008871 - RNA, 22 nt, Human
aaacauuguaauuuuagcaugg

SEQ ID NO: 1008872 - RNA, 22 nt, Human
ugcagcuguuacggacccuguc

SEQ ID NO: 1008873 - RNA, 22 nt, Human
ugaaagauugugauucaauaug

SEQ ID NO: 1008874 - RNA, 19 nt, Human
agcuuccauauucucuagu

SEQ ID NO: 1008875 - RNA, 22 nt, Human
gaagcagccacggggagacaga

SEQ ID NO: 1008876 - RNA, 22 nt, Human
gcccaugcucucaggcgggccu

SEQ ID NO: 1008877 - RNA, 21 nt, Human
auaaaguuuuacaggaaugca

SEQ ID NO: 1008878 - RNA, 22 nt, Human
acacugaaugcuguuuagaaau

SEQ ID NO: 1008879 - RNA, 19 nt, Human
ggugaccaccuggucagug

SEQ ID NO: 1008880 - RNA, 22 nt, Human
acaaaugcaaguuuuaugucaa

SEQ ID NO: 1008881 - RNA, 22 nt, Human
uuccaggaggagguacuagagg

SEQ ID NO: 1008882 - RNA, 22 nt, Human
gcugccugccuaguuccacagu

SEQ ID NO: 1008883 - RNA, 22 nt, Human
agccacagucugaugccugaga

SEQ ID NO: 1008884 - RNA, 22 nt, Human
aagcuggagaguuaggugaaua

SEQ ID NO: 1008885 - RNA, 22 nt, Human
auucuucacaaauauauagaag

SEQ ID NO: 1008886 - RNA, 22 nt, Human
ccuggcagacagcacugaagcu

SEQ ID NO: 1008887 - RNA, 22 nt, Human
accugaggcuguuagucuaggu

SEQ ID NO: 1008888 - RNA, 22 nt, Human
agccacagggggugagggacaa

SEQ ID NO: 1008889 - RNA, 22 nt, Human
aggagcugagucagcccgacag

SEQ ID NO: 1008890 - RNA, 22 nt, Human
ugcauuaugcuacccagaagcu

SEQ ID NO: 1008891 - RNA, 22 nt, Human
uuucaaagguggaagagugaau

SEQ ID NO: 1008892 - RNA, 16 nt, Human
ccagaggccuggccuc

SEQ ID NO: 1008893 - RNA, 22 nt, Human
gagcagcucgagaaggaagcag

SEQ ID NO: 1008894 - RNA, 22 nt, Human
gggagcugguuccugcccucca

SEQ ID NO: 1008895 - RNA, 22 nt, Human
uuaugaaagacauuucuguugg

SEQ ID NO: 1008896 - RNA, 22 nt, Human
augcuguguuugagaaccuagg

SEQ ID NO: 1008897 - RNA, 21 nt, Human
uccuucaguucugcacuuucu

SEQ ID NO: 1008898 - RNA, 22 nt, Human
caguucuuaauaccaugugguu

SEQ ID NO: 1008899 - RNA, 22 nt, Human
ccugggcuggaguacagcagug

SEQ ID NO: 1008900 - RNA, 22 nt, Human
cagcauugaucccaggcugugg

SEQ ID NO: 1008901 - RNA, 22 nt, Human
gcugcaggggggucuggacuug

SEQ ID NO: 1008902 - RNA, 22 nt, Human
aagugacacauggcacuucuau

SEQ ID NO: 1008903 - RNA, 22 nt, Human
ccugccagucacuaugucaccu

SEQ ID NO: 1008904 - RNA, 19 nt, Human
auuugaaagcugugcuugc

SEQ ID NO: 1008905 - RNA, 22 nt, Human
gcagggagguuugcugaccugg

SEQ ID NO: 1008906 - RNA, 22 nt, Human
cugcccugggaguaccuguccu

SEQ ID NO: 1008907 - RNA, 22 nt, Human
cagggccucuccuccaggaacu

SEQ ID NO: 1008908 - RNA, 22 nt, Human
gaauagcuuccuuuuuuccaaa

SEQ ID NO: 1008909 - RNA, 16 nt, Human
cuuccucuucacuggc

SEQ ID NO: 1008910 - RNA, 22 nt, Human
gaaaacuauuggccuagaacaa

SEQ ID NO: 1008911 - RNA, 22 nt, Human
aagcuuuaagugucagucagcc

SEQ ID NO: 1008912 - RNA, 22 nt, Human
cacagcuucuccuugauaucgc

SEQ ID NO: 1008913 - RNA, 22 nt, Human
gugggacagcuggagggucccu

SEQ ID NO: 1008914 - RNA, 22 nt, Human
ggaggccaaggugggcggauca

SEQ ID NO: 1008915 - RNA, 22 nt, Human
aagggcugcuguagaagcagag

SEQ ID NO: 1008916 - RNA, 22 nt, Human
ucugggcucugucagcaccucu

SEQ ID NO: 1008917 - RNA, 22 nt, Human
acuggcagagacccugauggcc

SEQ ID NO: 1008918 - RNA, 22 nt, Human
agggcagaaguacagacacuua

SEQ ID NO: 1008919 - RNA, 22 nt, Human
gggcguggauggucagugcagg

SEQ ID NO: 1008920 - RNA, 22 nt, Human
gccaagagaaugugagagaaau

SEQ ID NO: 1008921 - RNA, 22 nt, Human
uuuuccagauuggacuuagucc

SEQ ID NO: 1008922 - RNA, 22 nt, Human
ucucuggaauuggcugaggcaa

SEQ ID NO: 1008923 - RNA, 22 nt, Human
uccagaccuagggcaccccagu

SEQ ID NO: 1008924 - RNA, 22 nt, Human
cucucugggcccaguuggcacc

SEQ ID NO: 1008925 - RNA, 22 nt, Human
ucccaaggcacagggcagggac

SEQ ID NO: 1008926 - RNA, 22 nt, Human
auguagaagugggcauuauaga

SEQ ID NO: 1008927 - RNA, 22 nt, Human
auucagcauaaucaguagcuug

SEQ ID NO: 1008928 - RNA, 22 nt, Human
cccuguccuuggcugugaggcu

SEQ ID NO: 1008929 - RNA, 22 nt, Human
cauggcagaaaccugagcugcu

SEQ ID NO: 1008930 - RNA, 22 nt, Human
uggaaagacauucagccgcugg

SEQ ID NO: 1008931 - RNA, 22 nt, Human
acauucuuaacaguuaaaaacu

SEQ ID NO: 1008932 - RNA, 22 nt, Human
aauugcaauuuucuuaaggucu

SEQ ID NO: 1008933 - RNA, 19 nt, Human
gggcucuggccucaguggg

SEQ ID NO: 1008934 - RNA, 22 nt, Human
uuucuucauucaccuucacccc

SEQ ID NO: 1008935 - RNA, 19 nt, Human
cccagagcauccugaacuu

SEQ ID NO: 1008936 - RNA, 19 nt, Human
ugcuagaaauucugugacu

SEQ ID NO: 1008937 - RNA, 22 nt, Human
gccacaugcaauugcagcacgu

SEQ ID NO: 1008938 - RNA, 22 nt, Human
gagcaggcauucuaguggcuga

SEQ ID NO: 1008939 - RNA, 22 nt, Human
uucaggaugcagagguuguagu

SEQ ID NO: 1008940 - RNA, 22 nt, Human
gcccuuccuuagacagcaggau

SEQ ID NO: 1008941 - RNA, 22 nt, Human
uggcucaggauaauuuucccaa

SEQ ID NO: 1008942 - RNA, 22 nt, Human
ccagagcccgggaccuggacuu

SEQ ID NO: 1008943 - RNA, 22 nt, Human
ggaaccaguggaaugauaugcu

SEQ ID NO: 1008944 - RNA, 22 nt, Human
guuugcauuuauuagucuucug

SEQ ID NO: 1008945 - RNA, 22 nt, Human
acagauuuuauuauucagguau

SEQ ID NO: 1008946 - RNA, 22 nt, Human
acagauuuauugaagcugcugc

SEQ ID NO: 1008947 - RNA, 22 nt, Human
agggacuauuuacccaucucac

SEQ ID NO: 1008948 - RNA, 22 nt, Human
cagcuuuaccaauauuuggaaa

SEQ ID NO: 1008949 - RNA, 22 nt, Human
aagcagaaguugaucuaccaua

SEQ ID NO: 1008950 - RNA, 23 nt, Human
acucacaaagcaggaucauguug

SEQ ID NO: 1008951 - RNA, 22 nt, Human
agccucugucaagcuuuucaaa

SEQ ID NO: 1008952 - RNA, 22 nt, Human
uuggagcccugaggaucuggau

SEQ ID NO: 1008953 - RNA, 22 nt, Human
gcuggaccaggugugcacaggc

SEQ ID NO: 1008954 - RNA, 21 nt, Human
aaggcagaagcauggaaugag

SEQ ID NO: 1008955 - RNA, 22 nt, Human
ugggaugggaucucgcuguguc

SEQ ID NO: 1008956 - RNA, 22 nt, Human
ccuggcaguggugaagaagagg

SEQ ID NO: 1008957 - RNA, 22 nt, Human
ucugcugcacaaauucaucucu

SEQ ID NO: 1008958 - RNA, 22 nt, Human
agugcuguuagguuaauauagu

SEQ ID NO: 1008959 - RNA, 22 nt, Human
agcugggccugagcuggaagcu

SEQ ID NO: 1008960 - RNA, 22 nt, Human
gccaggcugaggcucuggaaga

SEQ ID NO: 1008961 - RNA, 22 nt, Human
cauuuguaucugggcugcugug

SEQ ID NO: 1008962 - RNA, 22 nt, Human
ucugagccaauuucugugucca

SEQ ID NO: 1008963 - RNA, 22 nt, Human
augggaggguggaaaggcucug

SEQ ID NO: 1008964 - RNA, 22 nt, Human
cagcugagcucccaggccauca

SEQ ID NO: 1008965 - RNA, 19 nt, Human
uuucuuaggccuuuggccu

SEQ ID NO: 1008966 - RNA, 22 nt, Human
aagggcuccacuugaaucacac

SEQ ID NO: 1008967 - RNA, 22 nt, Human
ugggagcagcagggagaugcgg

SEQ ID NO: 1008968 - RNA, 22 nt, Human
gugaggugggcuggccagagac

SEQ ID NO: 1008969 - RNA, 22 nt, Human
caggaagagaacauggaggcug

SEQ ID NO: 1008970 - RNA, 21 nt, Human
gcaaguacuaucaucauuauc

SEQ ID NO: 1008971 - RNA, 22 nt, Human
aggcugccucgugagcucgcug

SEQ ID NO: 1008972 - RNA, 22 nt, Human
cugggcugagccugggcugugu

SEQ ID NO: 1008973 - RNA, 22 nt, Human
ggcaggcaggagcgugcuuggg

SEQ ID NO: 1008974 - RNA, 21 nt, Human
auccuugaucagaagagugcu

SEQ ID NO: 1008975 - RNA, 22 nt, Human
gcucaggauuucauccaugugu

SEQ ID NO: 1008976 - RNA, 22 nt, Human
agaugcuucaguguuuaauuua

SEQ ID NO: 1008977 - RNA, 22 nt, Human
agggcugcuccuccuucaggcc

SEQ ID NO: 1008978 - RNA, 22 nt, Human
uggcucuguucgccaucaggag

SEQ ID NO: 1008979 - RNA, 22 nt, Human
ccuugggacagccagcuucaga

SEQ ID NO: 1008980 - RNA, 22 nt, Human
uuaugcuaagugcaacaagcca

SEQ ID NO: 1008981 - RNA, 22 nt, Human
uuucaugauuaacuuagugaau

SEQ ID NO: 1008982 - RNA, 22 nt, Human
ucauggcacuuagcacaguccu

SEQ ID NO: 1008983 - RNA, 22 nt, Human
aacauauaaacucuuaaguuca

SEQ ID NO: 1008984 - RNA, 22 nt, Human
cugucccuucauuauucacuac

SEQ ID NO: 1008985 - RNA, 22 nt, Human
uauauagaaaagcagauguugg

SEQ ID NO: 1008986 - RNA, 22 nt, Human
ugugaaggcagcagcucugucc

SEQ ID NO: 1008987 - RNA, 22 nt, Human
cccaggcacaccccgaacggaa

SEQ ID NO: 1008988 - RNA, 22 nt, Human
ugggcuacucugggagccuaac

SEQ ID NO: 1008989 - RNA, 22 nt, Human
cagaaauucccauuucagauuc

SEQ ID NO: 1008990 - RNA, 22 nt, Human
agcagggccucuggcacugguc

SEQ ID NO: 1008991 - RNA, 22 nt, Human
ucccaaagcuacucuucugacu

SEQ ID NO: 1008992 - RNA, 22 nt, Human
gagcucugggaaacaaagugua

SEQ ID NO: 1008993 - RNA, 22 nt, Human
uugcuuccaguccaagucuguu

SEQ ID NO: 1008994 - RNA, 22 nt, Human
ucugaaaguaucuggaucuuuu

SEQ ID NO: 1008995 - RNA, 22 nt, Human
ccugucuggccaccagggcgau

SEQ ID NO: 1008996 - RNA, 22 nt, Human
uucaagauggccccagugagcc

SEQ ID NO: 1008997 - RNA, 22 nt, Human
uugugugguagcuucauugaac

SEQ ID NO: 1008998 - RNA, 20 nt, Human
gaggaaaagcugccaggccu

SEQ ID NO: 1008999 - RNA, 22 nt, Human
ggucucagcuggaguccuuggu

SEQ ID NO: 1009000 - RNA, 18 nt, Human
gcaggagauggguggggu

SEQ ID NO: 1009001 - RNA, 22 nt, Human
ccugggcauaaaucacuccaag

SEQ ID NO: 1009002 - RNA, 22 nt, Human
cauggcaggugugggguuuuau

SEQ ID NO: 1009003 - RNA, 20 nt, Human
cccugagacaaaggaggggc

SEQ ID NO: 1009004 - RNA, 22 nt, Human
ccuccagguguuacauaugacu

SEQ ID NO: 1009005 - RNA, 22 nt, Human
aagggcaggugggcauuucugg

SEQ ID NO: 1009006 - RNA, 22 nt, Human
aacaugaaguuuucuauaguga

SEQ ID NO: 1009007 - RNA, 22 nt, Human
aaggcagccucugccagccggg

SEQ ID NO: 1009008 - RNA, 23 nt, Human
aggaggaaaaguuaucugcugag

SEQ ID NO: 1009009 - RNA, 22 nt, Human
aaggcagagggcuggaucagag

SEQ ID NO: 1009010 - RNA, 22 nt, Human
ccuugcguuuuacagcuucuag

SEQ ID NO: 1009011 - RNA, 21 nt, Human
ugcuucucuagaucaacuacu

SEQ ID NO: 1009012 - RNA, 22 nt, Human
ccugggugacccgugagcgucc

SEQ ID NO: 1009013 - RNA, 21 nt, Human
aggaaguggccagauugggaa

SEQ ID NO: 1009014 - RNA, 20 nt, Human
gcagagcuguucugugggga

SEQ ID NO: 1009015 - RNA, 22 nt, Human
gguucccggaucuccgaguccc

SEQ ID NO: 1009016 - RNA, 22 nt, Human
ucauugcaagcucauuuaucug

SEQ ID NO: 1009017 - RNA, 17 nt, Human
cccaugagcccacuccc

SEQ ID NO: 1009018 - RNA, 22 nt, Human
agauuuccaucuuuuucaugug

SEQ ID NO: 1009019 - RNA, 22 nt, Human
gcccagcacauugcugaggacc

SEQ ID NO: 1009020 - RNA, 22 nt, Human
uauucacaugaaaacaaauuuu

SEQ ID NO: 1009021 - RNA, 22 nt, Human
uuugaauagaggccccucagaa

SEQ ID NO: 1009022 - RNA, 22 nt, Human
aauucugugcaggcagagcuau

SEQ ID NO: 1009023 - RNA, 22 nt, Human
cagcaauaaugucuacaaaucu

SEQ ID NO: 1009024 - RNA, 22 nt, Human
ccucccucuuucagucccacag

SEQ ID NO: 1009025 - RNA, 22 nt, Human
cuucagaacuauaaaaaguacu

SEQ ID NO: 1009026 - RNA, 22 nt, Human
ccauuguaaauucuguggaagu

SEQ ID NO: 1009027 - RNA, 22 nt, Human
cugccugugccaccgccucauu

SEQ ID NO: 1009028 - RNA, 22 nt, Human
guggauggauuuugaggaaugg

SEQ ID NO: 1009029 - RNA, 22 nt, Human
ucucagagagcuguguuuuccu

SEQ ID NO: 1009030 - RNA, 18 nt, Human
gggcauggaugcagcauc

SEQ ID NO: 1009031 - RNA, 22 nt, Human
acauacuuaugcuaaaaauaua

SEQ ID NO: 1009032 - RNA, 22 nt, Human
cugccgagugggucaugaggca

SEQ ID NO: 1009033 - RNA, 22 nt, Human
cagauuuaccuaacuccaaguu

SEQ ID NO: 1009034 - RNA, 22 nt, Human
uacaugcuccacuuucuccugu

SEQ ID NO: 1009035 - RNA, 21 nt, Human
auuauuauuucuguguccagc

SEQ ID NO: 1009036 - RNA, 18 nt, Human
acauuucucucugcguga

SEQ ID NO: 1009037 - RNA, 22 nt, Human
ucauuuaauagcuuuugucuuu

SEQ ID NO: 1009038 - RNA, 22 nt, Human
agccuggaggccaggagacagu

SEQ ID NO: 1009039 - RNA, 22 nt, Human
ggcugagccuggagcaucuggu

SEQ ID NO: 1009040 - RNA, 22 nt, Human
cagaagaggacuggguagcuca

SEQ ID NO: 1009041 - RNA, 22 nt, Human
aucaguuuggaacauucaggcc

SEQ ID NO: 1009042 - RNA, 22 nt, Human
ucagggcacauucugcaguggc

SEQ ID NO: 1009043 - RNA, 22 nt, Human
ucugggagguacugggaggugu

SEQ ID NO: 1009044 - RNA, 22 nt, Human
ggcugccuucagacuccagcuu

SEQ ID NO: 1009045 - RNA, 18 nt, Human
cugaaggauccaggugua

SEQ ID NO: 1009046 - RNA, 22 nt, Human
gaggcagagugcaccccaggag

SEQ ID NO: 1009047 - RNA, 22 nt, Human
gcucccagcuggagccucaaca

SEQ ID NO: 1009048 - RNA, 22 nt, Human
ucccaggacuuccaguuggagg

SEQ ID NO: 1009049 - RNA, 22 nt, Human
cacaagagagugcgcguugcaa

SEQ ID NO: 1009050 - RNA, 22 nt, Human
agcagugggggaguguuaguuu

SEQ ID NO: 1009051 - RNA, 22 nt, Human
cgcagcagccccgugguaggug

SEQ ID NO: 1009052 - RNA, 19 nt, Human
guccaguguuuuccaguca

SEQ ID NO: 1009053 - RNA, 22 nt, Human
cugagccaugagccugcgccca

SEQ ID NO: 1009054 - RNA, 22 nt, Human
aggcccugcaggaguggggaca

SEQ ID NO: 1009055 - RNA, 22 nt, Human
agcccagcaaagggagguucag

SEQ ID NO: 1009056 - RNA, 22 nt, Human
cuugcuuuguccagaaauucag

SEQ ID NO: 1009057 - RNA, 22 nt, Human
cuggcuccaucacugggugaug

SEQ ID NO: 1009058 - RNA, 22 nt, Human
ccagcucugccaagcgucagcu

SEQ ID NO: 1009059 - RNA, 22 nt, Human
cucagaguucuccugggaggug

SEQ ID NO: 1009060 - RNA, 22 nt, Human
aggccuggccccaguugcuagg

SEQ ID NO: 1009061 - RNA, 22 nt, Human
cuuauggcuguagucuggaagu

SEQ ID NO: 1009062 - RNA, 21 nt, Human
aaacugaccuugccugagaca

SEQ ID NO: 1009063 - RNA, 22 nt, Human
ggccuuggugccauggccaguu

SEQ ID NO: 1009064 - RNA, 19 nt, Human
augucccaccgccccugag

SEQ ID NO: 1009065 - RNA, 22 nt, Human
cagcuccugaggacugcuggga

SEQ ID NO: 1009066 - RNA, 22 nt, Human
ucaguuuuuacggucacaggga

SEQ ID NO: 1009067 - RNA, 22 nt, Human
cauuuauugguuaggccagcag

SEQ ID NO: 1009068 - RNA, 22 nt, Human
aaucaguuguucacucugaaaa

SEQ ID NO: 1009069 - RNA, 20 nt, Human
gugggcagaugugugcaugg

SEQ ID NO: 1009070 - RNA, 19 nt, Human
aauacaguguuauagaauu

SEQ ID NO: 1009071 - RNA, 22 nt, Human
ugcagcucauugguguccuggu

SEQ ID NO: 1009072 - RNA, 22 nt, Human
gacaggcuuugagucccagaac

SEQ ID NO: 1009073 - RNA, 22 nt, Human
cuugccuguggcuaguuggcuc

SEQ ID NO: 1009074 - RNA, 18 nt, Human
agagaugguguagaguuu

SEQ ID NO: 1009075 - RNA, 21 nt, Human
acagaguaguugaaacagaga

SEQ ID NO: 1009076 - RNA, 22 nt, Human
ggccugaggcgucccagcugug

SEQ ID NO: 1009077 - RNA, 22 nt, Human
gggcagagaaauggacaguugg

SEQ ID NO: 1009078 - RNA, 19 nt, Human
cuggccaggccaggggccc

SEQ ID NO: 1009079 - RNA, 19 nt, Human
cagagccucagagcuagaa

SEQ ID NO: 1009080 - RNA, 20 nt, Human
aaaaacaguaaugcugaaga

SEQ ID NO: 1009081 - RNA, 22 nt, Human
uugaaaacuuucuagaccaaga

SEQ ID NO: 1009082 - RNA, 22 nt, Human
ugcugaugcuguucuguuagga

SEQ ID NO: 1009083 - RNA, 22 nt, Human
gagagaagaauguuccgaggcc

SEQ ID NO: 1009084 - RNA, 22 nt, Human
agcugacugaugaagaggccuu

SEQ ID NO: 1009085 - RNA, 22 nt, Human
ccagagaggcaaaacuccuucc

SEQ ID NO: 1009086 - RNA, 22 nt, Human
cuuucacacacauacauuugga

SEQ ID NO: 1009087 - RNA, 22 nt, Human
aguggacucuucccagugcuug

SEQ ID NO: 1009088 - RNA, 22 nt, Human
ccagccaguccagcauuggugu

SEQ ID NO: 1009089 - RNA, 22 nt, Human
aagaugcagcuuccacuuuugc

SEQ ID NO: 1009090 - RNA, 22 nt, Human
aaaggccaugguuggaguguuu

SEQ ID NO: 1009091 - RNA, 22 nt, Human
cucacuggcaagacuacaggug

SEQ ID NO: 1009092 - RNA, 22 nt, Human
ucaucacuguaucauugauaga

SEQ ID NO: 1009093 - RNA, 22 nt, Human
ucuggccugggccugccggugc

SEQ ID NO: 1009094 - RNA, 22 nt, Human
cugggcagcuaccaccacugcu

SEQ ID NO: 1009095 - RNA, 22 nt, Human
aaaucuguaagcaauugcucag

SEQ ID NO: 1009096 - RNA, 22 nt, Human
uccagaggcuccaaagggagau

SEQ ID NO: 1009097 - RNA, 22 nt, Human
cacauaauaaauguuccugaug

SEQ ID NO: 1009098 - RNA, 22 nt, Human
aggugcuuggcucgugcacaca

SEQ ID NO: 1009099 - RNA, 22 nt, Human
agaguguuauuugcucuguauu

SEQ ID NO: 1009100 - RNA, 22 nt, Human
cauugucacccaaagcucauag

SEQ ID NO: 1009101 - RNA, 22 nt, Human
gcagggaccucacuacccccag

SEQ ID NO: 1009102 - RNA, 19 nt, Human
gcaggcaguggcauucgga

SEQ ID NO: 1009103 - RNA, 22 nt, Human
ugcuuccuugagcucuccaauc

SEQ ID NO: 1009104 - RNA, 22 nt, Human
cagcaguguacaaggugucaga

SEQ ID NO: 1009105 - RNA, 21 nt, Human
uucauaaaccauucucaugca

SEQ ID NO: 1009106 - RNA, 22 nt, Human
aggcacaggaaugucauccagu

SEQ ID NO: 1009107 - RNA, 22 nt, Human
acucugaggcaggucagggcag

SEQ ID NO: 1009108 - RNA, 22 nt, Human
aaaugcaggaaauuaugcuuuu

SEQ ID NO: 1009109 - RNA, 22 nt, Human
uuuauucaucaucuguucauau

SEQ ID NO: 1009110 - RNA, 22 nt, Human
uucauucuuugaaucugaggua

SEQ ID NO: 1009111 - RNA, 22 nt, Human
aaucauucuuauuucacagcaa

SEQ ID NO: 1009112 - RNA, 22 nt, Human
uacacacagaggccaugggauu

SEQ ID NO: 1009113 - RNA, 22 nt, Human
aaugauugcaaacauugagaac

SEQ ID NO: 1009114 - RNA, 22 nt, Human
uuagaaacccagacucuuaggu

SEQ ID NO: 1009115 - RNA, 22 nt, Human
uuucccagagguaugaauaagu

SEQ ID NO: 1009116 - RNA, 23 nt, Human
cucccuggaguuucuggaagaug

SEQ ID NO: 1009117 - RNA, 22 nt, Human
cagucccagacccagaaggugg

SEQ ID NO: 1009118 - RNA, 22 nt, Human
cucaggaugaaagucaugguga

SEQ ID NO: 1009119 - RNA, 22 nt, Human
uugacaauguccuuugaauuuc

SEQ ID NO: 1009120 - RNA, 22 nt, Human
cagcagcuuugccaagucagcc

SEQ ID NO: 1009121 - RNA, 22 nt, Human
cacaaaugugcagaaaugugag

SEQ ID NO: 1009122 - RNA, 22 nt, Human
caagaacauugugaucacuuca

SEQ ID NO: 1009123 - RNA, 22 nt, Human
caguguacuuggaauguaacag

SEQ ID NO: 1009124 - RNA, 22 nt, Human
cuuacagagaagaaaauguagu

SEQ ID NO: 1009125 - RNA, 22 nt, Human
agaacagaugugggcagaccug

SEQ ID NO: 1009126 - RNA, 21 nt, Human
aagagcuggaucaaggauaag

SEQ ID NO: 1009127 - RNA, 22 nt, Human
augaggcaaucaugguccaguu

SEQ ID NO: 1009128 - RNA, 22 nt, Human
ucaaaugcuguauuguaguaau

SEQ ID NO: 1009129 - RNA, 22 nt, Human
gcagcuggugcaaaugucacuc

SEQ ID NO: 1009130 - RNA, 22 nt, Human
uuucuguuaggcaucauuuuaa

SEQ ID NO: 1009131 - RNA, 22 nt, Human
cccaggcuggagugcaauggca

SEQ ID NO: 1009132 - RNA, 22 nt, Human
ugcagggaauccagucuagggu

SEQ ID NO: 1009133 - RNA, 22 nt, Human
ugagccugcaauaagcacagcc

SEQ ID NO: 1009134 - RNA, 22 nt, Human
ucuuucagccacuuaccugucu

SEQ ID NO: 1009135 - RNA, 22 nt, Human
gaaccaaguaggauacaaggag

SEQ ID NO: 1009136 - RNA, 22 nt, Human
cagagcagaaaccugggugauu

SEQ ID NO: 1009137 - RNA, 22 nt, Human
uaugaacuuuugaugugacaug

SEQ ID NO: 1009138 - RNA, 22 nt, Human
uucagagagaccaaguggcgug

SEQ ID NO: 1009139 - RNA, 22 nt, Human
gcuccacuugcagcuaggcuug

SEQ ID NO: 1009140 - RNA, 22 nt, Human
uauguacuaacuuucauucuag

SEQ ID NO: 1009141 - RNA, 22 nt, Human
cuucucaaaguugugaaucagg

SEQ ID NO: 1009142 - RNA, 22 nt, Human
ugagccuggcggaagcagcgug

SEQ ID NO: 1009143 - RNA, 22 nt, Human
auaucaguaucuauguauuugu

SEQ ID NO: 1009144 - RNA, 22 nt, Human
gcugagcugggacaguccuggg

SEQ ID NO: 1009145 - RNA, 20 nt, Human
gaagcagcuucauguagaca

SEQ ID NO: 1009146 - RNA, 22 nt, Human
uucaggauucuuucagacuggg

SEQ ID NO: 1009147 - RNA, 22 nt, Human
uuucaaugacacaaaagagaaa

SEQ ID NO: 1009148 - RNA, 22 nt, Human
gggccacauugaagggugggua

SEQ ID NO: 1009149 - RNA, 22 nt, Human
gcuggugccuuguuguuguuac

SEQ ID NO: 1009150 - RNA, 22 nt, Human
uagggacaaagagcugaggccu

SEQ ID NO: 1009151 - RNA, 22 nt, Human
auggucuguuaggagcuacuuu

SEQ ID NO: 1009152 - RNA, 22 nt, Human
cuggagcugucuucacaggccu

SEQ ID NO: 1009153 - RNA, 22 nt, Human
gcuguccagagcaugggagcaa

SEQ ID NO: 1009154 - RNA, 22 nt, Human
caaaugauagagccgauuauca

SEQ ID NO: 1009155 - RNA, 21 nt, Human
uuucuuaggcucuaaaaugac

SEQ ID NO: 1009156 - RNA, 22 nt, Human
agucucugcaugaugcagcaca

SEQ ID NO: 1009157 - RNA, 22 nt, Human
ccugggugaaaucucuccugca

SEQ ID NO: 1009158 - RNA, 22 nt, Human
aggagcugcuuaaaugguuggu

SEQ ID NO: 1009159 - RNA, 23 nt, Human
cccuggaguaaauucuuggaagg

SEQ ID NO: 1009160 - RNA, 22 nt, Human
accugaggccuccccagcagac

SEQ ID NO: 1009161 - RNA, 20 nt, Human
ugggcagcacugcuggcugg

SEQ ID NO: 1009162 - RNA, 22 nt, Human
aaccauuugcaguuacugagac

SEQ ID NO: 1009163 - RNA, 22 nt, Human
ucaaaccaccuuguuacugggg

SEQ ID NO: 1009164 - RNA, 22 nt, Human
uuugaaagacagaauauuuuug

SEQ ID NO: 1009165 - RNA, 22 nt, Human
gcagcuggggccacacuuaggc

SEQ ID NO: 1009166 - RNA, 21 nt, Human
ccaggcuccugaggcugguca

SEQ ID NO: 1009167 - RNA, 20 nt, Human
ugcugcaguuucaugggacu

SEQ ID NO: 1009168 - RNA, 22 nt, Human
uugcagcugcaguaaauguuca

SEQ ID NO: 1009169 - RNA, 22 nt, Human
gcagcccagagcgcaggacccc

SEQ ID NO: 1009170 - RNA, 22 nt, Human
auuaagggccaauccuccagcc

SEQ ID NO: 1009171 - RNA, 22 nt, Human
cagcccuggccccagguggucu

SEQ ID NO: 1009172 - RNA, 22 nt, Human
auuaaauuagcaaacugugaaa

SEQ ID NO: 1009173 - RNA, 22 nt, Human
ucagcugagcuccagcucauag

SEQ ID NO: 1009174 - RNA, 22 nt, Human
cugcucugaguauuaacggagg

SEQ ID NO: 1009175 - RNA, 22 nt, Human
aggagucacucagggcuucauc

SEQ ID NO: 1009176 - RNA, 21 nt, Human
agcagcugggcaacauggagg

SEQ ID NO: 1009177 - RNA, 22 nt, Human
agcagcaacuuauuuuucuuau

SEQ ID NO: 1009178 - RNA, 22 nt, Human
uuuuccuucuagagcagauuuc

SEQ ID NO: 1009179 - RNA, 18 nt, Human
cugccuguugcugagagg

SEQ ID NO: 1009180 - RNA, 22 nt, Human
ugccaggcccagcuccagagcu

SEQ ID NO: 1009181 - RNA, 22 nt, Human
ucaguuuuaagguuugagaauu

SEQ ID NO: 1009182 - RNA, 22 nt, Human
cugaagccacgauagcuuccua

SEQ ID NO: 1009183 - RNA, 22 nt, Human
uacacauguuuggcaaguaugu

SEQ ID NO: 1009184 - RNA, 23 nt, Human
aaaugcagggucgcagguuacag

SEQ ID NO: 1009185 - RNA, 22 nt, Human
cuacauggagaagaaaauucuu

SEQ ID NO: 1009186 - RNA, 23 nt, Human
aaauaugucugagggcaaagaau

SEQ ID NO: 1009187 - RNA, 22 nt, Human
gagaaagcuucuuucccacagg

SEQ ID NO: 1009188 - RNA, 22 nt, Human
ccaggcccugcuccucacacca

SEQ ID NO: 1009189 - RNA, 22 nt, Human
uucucuuuugugaugugagaug

SEQ ID NO: 1009190 - RNA, 22 nt, Human
cagagagaggccacugcuauua

SEQ ID NO: 1009191 - RNA, 22 nt, Human
guggguggaggcgucgagggca

SEQ ID NO: 1009192 - RNA, 22 nt, Human
auguaucaacaaauuguacagu

SEQ ID NO: 1009193 - RNA, 22 nt, Human
cauuuguauagugcuuagacca

SEQ ID NO: 1009194 - RNA, 22 nt, Human
agcagagccaggucucucugua

SEQ ID NO: 1009195 - RNA, 22 nt, Human
auauaaguuaguggucauguuu

SEQ ID NO: 1009196 - RNA, 21 nt, Human
uggcagggguaguaguacagc

SEQ ID NO: 1009197 - RNA, 22 nt, Human
acccagagccagggucaggagc

SEQ ID NO: 1009198 - RNA, 22 nt, Human
ugggggugacuaucucgggaau

SEQ ID NO: 1009199 - RNA, 22 nt, Human
gcuucauuacugacagucugug

SEQ ID NO: 1009200 - RNA, 22 nt, Human
ggcugccaggagaagcucagug

SEQ ID NO: 1009201 - RNA, 17 nt, Human
agguggcugcugcgccu

SEQ ID NO: 1009202 - RNA, 22 nt, Human
ugaaaugacaaagguuuuucuu

SEQ ID NO: 1009203 - RNA, 22 nt, Human
ggcacgugccuaaggagcaggc

SEQ ID NO: 1009204 - RNA, 23 nt, Human
gggagaauaugaggaugauggug

SEQ ID NO: 1009205 - RNA, 22 nt, Human
agcagagcuauucuugugcaau

SEQ ID NO: 1009206 - RNA, 22 nt, Human
uuaaaguucauuaaaugagcca

SEQ ID NO: 1009207 - RNA, 22 nt, Human
cuggcucagugccuucagaagu

SEQ ID NO: 1009208 - RNA, 22 nt, Human
cugggagcucagcccuggggug

SEQ ID NO: 1009209 - RNA, 22 nt, Human
aggcucagagaugaguaagcac

SEQ ID NO: 1009210 - RNA, 17 nt, Human
uggacccuugggccucc

SEQ ID NO: 1009211 - RNA, 22 nt, Human
ccagcgcuucccaucagggagg

SEQ ID NO: 1009212 - RNA, 22 nt, Human
ugcagggaagcaaggguggcuc

SEQ ID NO: 1009213 - RNA, 22 nt, Human
cagccccucccucaggcaggug

SEQ ID NO: 1009214 - RNA, 22 nt, Human
uccuucagcucucuauuuagau

SEQ ID NO: 1009215 - RNA, 22 nt, Human
cuuacauugugugcaugagggg

SEQ ID NO: 1009216 - RNA, 22 nt, Human
ggucagguuuuuaggagugacc

SEQ ID NO: 1009217 - RNA, 22 nt, Human
uuaacagagaacauagaaguag

SEQ ID NO: 1009218 - RNA, 22 nt, Human
ugcaagaggaauucuagaagca

SEQ ID NO: 1009219 - RNA, 22 nt, Human
uuugauuuacuggauauucuca

SEQ ID NO: 1009220 - RNA, 22 nt, Human
gcagaggcauuucugacgcugc

SEQ ID NO: 1009221 - RNA, 22 nt, Human
cuuauuagugucugucugaguu

SEQ ID NO: 1009222 - RNA, 22 nt, Human
ucagaaauguaagcugaugacu

SEQ ID NO: 1009223 - RNA, 22 nt, Human
uaacagaauccuguuauugcca

SEQ ID NO: 1009224 - RNA, 22 nt, Human
aggaccuguguuuuccuugaau

SEQ ID NO: 1009225 - RNA, 22 nt, Human
cauuguuaauugguaucuuaca

SEQ ID NO: 1009226 - RNA, 22 nt, Human
guuuuauaugucucugcugaca

SEQ ID NO: 1009227 - RNA, 22 nt, Human
cagacuggccacaucugcacug

SEQ ID NO: 1009228 - RNA, 22 nt, Human
auauaaaguguuuagaaagcug

SEQ ID NO: 1009229 - RNA, 22 nt, Human
cucuuaaagcuuccaguuucaa

SEQ ID NO: 1009230 - RNA, 22 nt, Human
gagcuuggugaugccuccuggu

SEQ ID NO: 1009231 - RNA, 21 nt, Human
gugcucugggcagcagagggc

SEQ ID NO: 1009232 - RNA, 22 nt, Human
ucagugugaguaccaugcucag

SEQ ID NO: 1009233 - RNA, 21 nt, Human
ucccacucuaaauggacugaa

SEQ ID NO: 1009234 - RNA, 22 nt, Human
aggcaguuuaggcagcgauuua

SEQ ID NO: 1009235 - RNA, 21 nt, Human
ggcugcugggagagcugcgug

SEQ ID NO: 1009236 - RNA, 22 nt, Human
gcugcagccaaauucauuguca

SEQ ID NO: 1009237 - RNA, 22 nt, Human
ccaugagccaggcugaggaagc

SEQ ID NO: 1009238 - RNA, 22 nt, Human
ugccuacauuccuugcuuaugg

SEQ ID NO: 1009239 - RNA, 22 nt, Human
cagcugccacaggacuuucuga

SEQ ID NO: 1009240 - RNA, 22 nt, Human
uuugcauugcauuaaguauucu

SEQ ID NO: 1009241 - RNA, 22 nt, Human
uaaggccauuauggugggcccg

SEQ ID NO: 1009242 - RNA, 22 nt, Human
ugcuucaggagaugucaccaug

SEQ ID NO: 1009243 - RNA, 22 nt, Human
uuauucuuuaaacauauauguu

SEQ ID NO: 1009244 - RNA, 22 nt, Human
aucaggaucugcaucauaagaa

SEQ ID NO: 1009245 - RNA, 22 nt, Human
gaggcccugguaggucagagug

SEQ ID NO: 1009246 - RNA, 22 nt, Human
ucccagcauaacaaacugcccg

SEQ ID NO: 1009247 - RNA, 22 nt, Human
cugccuccugccgugcagcuuc

SEQ ID NO: 1009248 - RNA, 23 nt, Human
aggugccaacugagagcugagag

SEQ ID NO: 1009249 - RNA, 22 nt, Human
aggcuggguaccugucauaugc

SEQ ID NO: 1009250 - RNA, 18 nt, Human
ugcuggcaacuacuauug

SEQ ID NO: 1009251 - RNA, 19 nt, Human
ucugcuggcagaauucccu

SEQ ID NO: 1009252 - RNA, 22 nt, Human
uauugaaauccauuacguucuu

SEQ ID NO: 1009253 - RNA, 22 nt, Human
gaagccccaaacccucgccauc

SEQ ID NO: 1009254 - RNA, 22 nt, Human
agcauuuaauuacaguuuaauu

SEQ ID NO: 1009255 - RNA, 22 nt, Human
ucuggcuccguguccgcuccca

SEQ ID NO: 1009256 - RNA, 22 nt, Human
caagggaccugagauggucucu

SEQ ID NO: 1009257 - RNA, 22 nt, Human
aaguaugugauacauguuaauu

SEQ ID NO: 1009258 - RNA, 22 nt, Human
auauuagguuggugcaaaagua

SEQ ID NO: 1009259 - RNA, 22 nt, Human
agagcucaagacgcucacagua

SEQ ID NO: 1009260 - RNA, 22 nt, Human
ucuggaguccagauccauuugg

SEQ ID NO: 1009261 - RNA, 22 nt, Human
caagaacaguuugccaaauugg

SEQ ID NO: 1009262 - RNA, 22 nt, Human
gucugagaaucuugcauaucau

SEQ ID NO: 1009263 - RNA, 22 nt, Human
ucuuugcagaauuuaacuuugc

SEQ ID NO: 1009264 - RNA, 22 nt, Human
ggugaggcccagugaucugugu

SEQ ID NO: 1009265 - RNA, 22 nt, Human
ccagcagcgauagggugagugc

SEQ ID NO: 1009266 - RNA, 22 nt, Human
acaacauuauacauagaaagcu

SEQ ID NO: 1009267 - RNA, 22 nt, Human
agggccuggcgcguggccgccg

SEQ ID NO: 1009268 - RNA, 22 nt, Human
acacuuuguuguggcauauacg

SEQ ID NO: 1009269 - RNA, 22 nt, Human
uccucugccaaagggaguugcc

SEQ ID NO: 1009270 - RNA, 22 nt, Human
augcuguguggucaaguuaauu

SEQ ID NO: 1009271 - RNA, 22 nt, Human
agagagcccgggccagggcaca

SEQ ID NO: 1009272 - RNA, 22 nt, Human
caugcacuuaccugaaauucaa

SEQ ID NO: 1009273 - RNA, 22 nt, Human
agacaggagagggaacugccgg

SEQ ID NO: 1009274 - RNA, 22 nt, Human
caggggcuguuugccucaggcc

SEQ ID NO: 1009275 - RNA, 18 nt, Human
gccaggcaggguggggaa

SEQ ID NO: 1009276 - RNA, 22 nt, Human
agccacgucccugucaggguca

SEQ ID NO: 1009277 - RNA, 22 nt, Human
aucaggaucugggagccugaaa

SEQ ID NO: 1009278 - RNA, 22 nt, Human
gccugagauucccggagccgug

SEQ ID NO: 1009279 - RNA, 18 nt, Human
auggucucauacugggag

SEQ ID NO: 1009280 - RNA, 22 nt, Human
cagcaggcugcgauugcucauu

SEQ ID NO: 1009281 - RNA, 22 nt, Human
caggauccuggcugcauggacg

SEQ ID NO: 1009282 - RNA, 20 nt, Human
gaaaugugaccucuucugug

SEQ ID NO: 1009283 - RNA, 22 nt, Human
aggcaaaauuacaaaguuauua

SEQ ID NO: 1009284 - RNA, 23 nt, Human
uggcucugugucacauacaggau

SEQ ID NO: 1009285 - RNA, 22 nt, Human
gcagccugaugaucuggguugu

SEQ ID NO: 1009286 - RNA, 22 nt, Human
gggcuggucuggcuuagucagg

SEQ ID NO: 1009287 - RNA, 22 nt, Human
aagacccacaaggcugaauguu

SEQ ID NO: 1009288 - RNA, 20 nt, Human
ucauuacagugcuaagaugu

SEQ ID NO: 1009289 - RNA, 22 nt, Human
ugugccuuaugaauucuuucug

SEQ ID NO: 1009290 - RNA, 22 nt, Human
ucuggcuccacucugugcaugc

SEQ ID NO: 1009291 - RNA, 22 nt, Human
caauaauauccugugcuguuug

SEQ ID NO: 1009292 - RNA, 22 nt, Human
agaauaugaugguuggagaauu

SEQ ID NO: 1009293 - RNA, 23 nt, Human
uauggcaugguacuuccagcaga

SEQ ID NO: 1009294 - RNA, 22 nt, Human
cauuuguaggaugcuucuuguu

SEQ ID NO: 1009295 - RNA, 22 nt, Human
uacauuuauaaggcuucucugu

SEQ ID NO: 1009296 - RNA, 20 nt, Human
gcucccagccugcagucccc

SEQ ID NO: 1009297 - RNA, 22 nt, Human
uaagauaaguggguugagaugg

SEQ ID NO: 1009298 - RNA, 22 nt, Human
cuggggccacaacggcgcacgc

SEQ ID NO: 1009299 - RNA, 20 nt, Human
cuuggccuacuuagcuuugu

SEQ ID NO: 1009300 - RNA, 22 nt, Human
ucagaacagaagcuggcuauaa

SEQ ID NO: 1009301 - RNA, 22 nt, Human
ugaaccaggaggcagccagcac

SEQ ID NO: 1009302 - RNA, 22 nt, Human
agaggcaggagguugacuugag

SEQ ID NO: 1009303 - RNA, 22 nt, Human
agggcacagccuaaagccuaug

SEQ ID NO: 1009304 - RNA, 22 nt, Human
ucaggggacagccagcuggagg

SEQ ID NO: 1009305 - RNA, 22 nt, Human
ugcuuuaucaaagcuauaguga

SEQ ID NO: 1009306 - RNA, 22 nt, Human
gcacugcagccucagauggugg

SEQ ID NO: 1009307 - RNA, 22 nt, Human
agccaacuaggagauuaaggua

SEQ ID NO: 1009308 - RNA, 22 nt, Human
aauagguagccagauauauaaa

SEQ ID NO: 1009309 - RNA, 22 nt, Human
agggagguaggagcuucuagcu

SEQ ID NO: 1009310 - RNA, 22 nt, Human
uuagauauguuuuugcuaaugc

SEQ ID NO: 1009311 - RNA, 22 nt, Human
agccagaguugaaugugagucu

SEQ ID NO: 1009312 - RNA, 19 nt, Human
cccagcuugaccaccugcu

SEQ ID NO: 1009313 - RNA, 22 nt, Human
uuuuauuaguggcuagaugggg

SEQ ID NO: 1009314 - RNA, 22 nt, Human
acagagcuucccagccugagca

SEQ ID NO: 1009315 - RNA, 19 nt, Human
agacagagcucaguggguu

SEQ ID NO: 1009316 - RNA, 22 nt, Human
cuagagggauguuaggauagca

SEQ ID NO: 1009317 - RNA, 22 nt, Human
uuuccucuuauacaguguuuau

SEQ ID NO: 1009318 - RNA, 22 nt, Human
cagccagggucaggcagcuucu

SEQ ID NO: 1009319 - RNA, 22 nt, Human
ggggacccucaggacugcgucu

SEQ ID NO: 1009320 - RNA, 23 nt, Human
aggaggccugaaacugaggcuga

SEQ ID NO: 1009321 - RNA, 22 nt, Human
ccucugaggucauggacuuggc

SEQ ID NO: 1009322 - RNA, 22 nt, Human
caggugcccagcuccugcugug

SEQ ID NO: 1009323 - RNA, 22 nt, Human
uucuuuccacagaggggaugau

SEQ ID NO: 1009324 - RNA, 20 nt, Human
gccugagcuccgccuccugu

SEQ ID NO: 1009325 - RNA, 17 nt, Human
uuagcaaaauagcacuu

SEQ ID NO: 1009326 - RNA, 22 nt, Human
aguguccccuccaagggccugg

SEQ ID NO: 1009327 - RNA, 22 nt, Human
cuggggcucacuuuggucaggc

SEQ ID NO: 1009328 - RNA, 22 nt, Human
uccucaggcggugaggaggggc

SEQ ID NO: 1009329 - RNA, 19 nt, Human
ucaaagucugagucacuuu

SEQ ID NO: 1009330 - RNA, 22 nt, Human
uuagaaaggaaucuucauuuca

SEQ ID NO: 1009331 - RNA, 22 nt, Human
cuguguccucccgcugcaccca

SEQ ID NO: 1009332 - RNA, 21 nt, Human
uuacuuuugcaccaaccuaau

SEQ ID NO: 1009333 - RNA, 22 nt, Human
cucaggaugcaggucacaggac

SEQ ID NO: 1009334 - RNA, 22 nt, Human
cuggagcucuguguguuccuga

SEQ ID NO: 1009335 - RNA, 22 nt, Human
uguacauuuagagcucaauaga

SEQ ID NO: 1009336 - RNA, 22 nt, Human
uauucaaaguaccuucauugcc

SEQ ID NO: 1009337 - RNA, 22 nt, Human
uccucuucugcccaucagaggc

SEQ ID NO: 1009338 - RNA, 22 nt, Human
ugcuguguucuccugacucacc

SEQ ID NO: 1009339 - RNA, 22 nt, Human
agccacagagcaggagaccuuu

SEQ ID NO: 1009340 - RNA, 22 nt, Human
ggcaggcuggcuuuguuccagg

SEQ ID NO: 1009341 - RNA, 22 nt, Human
ccagggucuuggagaggagugc

SEQ ID NO: 1009342 - RNA, 22 nt, Human
ccccagccagcaggaccucuga

SEQ ID NO: 1009343 - RNA, 22 nt, Human
cugucuccuccacugcauggga

SEQ ID NO: 1009344 - RNA, 22 nt, Human
ugaacuuagugggaauaucucu

SEQ ID NO: 1009345 - RNA, 22 nt, Human
ccugagcuggaagagcuugugc

SEQ ID NO: 1009346 - RNA, 22 nt, Human
ggccuggaaugcuuuccuacca

SEQ ID NO: 1009347 - RNA, 22 nt, Human
gagcugccaagauuacaaucag

SEQ ID NO: 1009348 - RNA, 22 nt, Human
cuuuggcacagucucauuugau

SEQ ID NO: 1009349 - RNA, 22 nt, Human
uuuuuggguccaggcuguaucu

SEQ ID NO: 1009350 - RNA, 22 nt, Human
ugagaauuacaaaugagucaca

SEQ ID NO: 1009351 - RNA, 20 nt, Human
caaugcacacagcugcuucu

SEQ ID NO: 1009352 - RNA, 22 nt, Human
gcugccuuugugagccaagggg

SEQ ID NO: 1009353 - RNA, 22 nt, Human
cagaacauuccaugugcccugc

SEQ ID NO: 1009354 - RNA, 21 nt, Human
cagcuucuucugugaccuggu

SEQ ID NO: 1009355 - RNA, 22 nt, Human
uuucuuaguccuagagugauuu

SEQ ID NO: 1009356 - RNA, 22 nt, Human
cauugcacucuggcuggaacgg

SEQ ID NO: 1009357 - RNA, 22 nt, Human
gcagauggacuguaugaccuga

SEQ ID NO: 1009358 - RNA, 22 nt, Human
cacuucaauuaacuucagcauu

SEQ ID NO: 1009359 - RNA, 22 nt, Human
gcugugagggcuucugaggcau

SEQ ID NO: 1009360 - RNA, 22 nt, Human
uaaaaugaucucucauguucuu

SEQ ID NO: 1009361 - RNA, 22 nt, Human
cauacauaugcauguguguaua

SEQ ID NO: 1009362 - RNA, 22 nt, Human
uaggccauucuuggagcuuacu

SEQ ID NO: 1009363 - RNA, 22 nt, Human
gggcuucucuuuagugagcuga

SEQ ID NO: 1009364 - RNA, 22 nt, Human
gcagagcuaucuucuggauuug

SEQ ID NO: 1009365 - RNA, 22 nt, Human
ugaaaucaaugucuucugucuc

SEQ ID NO: 1009366 - RNA, 22 nt, Human
gcucucugaggugcuggcagag

SEQ ID NO: 1009367 - RNA, 22 nt, Human
gaaggccacuuuguguugagaa

SEQ ID NO: 1009368 - RNA, 22 nt, Human
auaguguguaaagugcagugau

SEQ ID NO: 1009369 - RNA, 22 nt, Human
uguaggaauguuuuuaaguugg

SEQ ID NO: 1009370 - RNA, 22 nt, Human
aaguguguugacugaauugggg

SEQ ID NO: 1009371 - RNA, 22 nt, Human
gcagaacauuucacaguaucuu

SEQ ID NO: 1009372 - RNA, 22 nt, Human
uuucccaguucccugcucuaua

SEQ ID NO: 1009373 - RNA, 22 nt, Human
agguggggaggagugucucuuu

SEQ ID NO: 1009374 - RNA, 22 nt, Human
auucuuauuauaguaaaacagu

SEQ ID NO: 1009375 - RNA, 21 nt, Human
aagaaguuuggauuuuguccu

SEQ ID NO: 1009376 - RNA, 22 nt, Human
acugagcucuugacugggaguu

SEQ ID NO: 1009377 - RNA, 22 nt, Human
ucugucacuuuuauuuacugaa

SEQ ID NO: 1009378 - RNA, 22 nt, Human
cagguggggcagcugugggagc

SEQ ID NO: 1009379 - RNA, 22 nt, Human
cuggagccaugucuugacugcu

SEQ ID NO: 1009380 - RNA, 22 nt, Human
gggcuggaggaccggccucgga

SEQ ID NO: 1009381 - RNA, 22 nt, Human
ucacaaaugaggaaaucgagca

SEQ ID NO: 1009382 - RNA, 22 nt, Human
cccugagcccauaguugacauu

SEQ ID NO: 1009383 - RNA, 22 nt, Human
auuuuucucuccacuccauuaa

SEQ ID NO: 1009384 - RNA, 23 nt, Human
ucugucaccuauggcugcucuuc

SEQ ID NO: 1009385 - RNA, 22 nt, Human
uauuuccaggccccacucuaga

SEQ ID NO: 1009386 - RNA, 20 nt, Human
ugcuggggacauacagggug

SEQ ID NO: 1009387 - RNA, 22 nt, Human
gaagccaacauuccaaguagaa

SEQ ID NO: 1009388 - RNA, 22 nt, Human
gaguaagagcuggcuuuggugu

SEQ ID NO: 1009389 - RNA, 21 nt, Human
ccuauugaauauaggaagauu

SEQ ID NO: 1009390 - RNA, 22 nt, Human
uguggccagcagguggcugugu

SEQ ID NO: 1009391 - RNA, 22 nt, Human
ggcugcagaaguacuuccggau

SEQ ID NO: 1009392 - RNA, 22 nt, Human
ccaggaggcggaagguacagug

SEQ ID NO: 1009393 - RNA, 22 nt, Human
uacaguucacaguaucauaaau

SEQ ID NO: 1009394 - RNA, 22 nt, Human
acagauuuguucuuuugggcua

SEQ ID NO: 1009395 - RNA, 22 nt, Human
ucaaugauaucagcaggaugug

SEQ ID NO: 1009396 - RNA, 22 nt, Human
cccuggcauaaaacuucuccag

SEQ ID NO: 1009397 - RNA, 22 nt, Human
gcuggccugaccugaggcuggg

SEQ ID NO: 1009398 - RNA, 22 nt, Human
ugugugaaggagccacuguuca

SEQ ID NO: 1009399 - RNA, 22 nt, Human
ccagucugaggccuggugaggg

SEQ ID NO: 1009400 - RNA, 22 nt, Human
aaguaacaaugcuguugaauug

SEQ ID NO: 1009401 - RNA, 22 nt, Human
cucaccacagagccuguccagc

SEQ ID NO: 1009402 - RNA, 22 nt, Human
gccuugggggugaaagaggcua

SEQ ID NO: 1009403 - RNA, 22 nt, Human
cagcuucugucugauuagcaag

SEQ ID NO: 1009404 - RNA, 22 nt, Human
cagagcagaagcgguccucaca

SEQ ID NO: 1009405 - RNA, 22 nt, Human
cauuucugcagaauugcucuuc

SEQ ID NO: 1009406 - RNA, 22 nt, Human
acuggcagcagcagcccuuggg

SEQ ID NO: 1009407 - RNA, 22 nt, Human
aaaucaguuggaacacaagcag

SEQ ID NO: 1009408 - RNA, 22 nt, Human
ggcugccuacuuucccagaguu

SEQ ID NO: 1009409 - RNA, 22 nt, Human
cugcccagaaucacucacucga

SEQ ID NO: 1009410 - RNA, 22 nt, Human
acaugcaugucuaugggcaggu

SEQ ID NO: 1009411 - RNA, 22 nt, Human
gacuuuggcaucuagacauugu

SEQ ID NO: 1009412 - RNA, 22 nt, Human
gcccauggcagaacugugagca

SEQ ID NO: 1009413 - RNA, 22 nt, Human
cacaggcuugucagcaugaggc

SEQ ID NO: 1009414 - RNA, 22 nt, Human
ugcuuuauuaagagagaaauuu

SEQ ID NO: 1009415 - RNA, 22 nt, Human
gugaccaucagagaauaacaaa

SEQ ID NO: 1009416 - RNA, 22 nt, Human
accagagcgcucaagccuuccc

SEQ ID NO: 1009417 - RNA, 22 nt, Human
caagacaagaucuaagcaugcu

SEQ ID NO: 1009418 - RNA, 18 nt, Human
ugugguggagcugccuuc

SEQ ID NO: 1009419 - RNA, 22 nt, Human
ucucuggagcugcagauccagg

SEQ ID NO: 1009420 - RNA, 22 nt, Human
guuauguacuuuuuaaaucuug

SEQ ID NO: 1009421 - RNA, 22 nt, Human
uggcucaguuuagcagcucagu

SEQ ID NO: 1009422 - RNA, 22 nt, Human
acccagcucuuugauggucuug

SEQ ID NO: 1009423 - RNA, 22 nt, Human
caggcaggagccagggauucca

SEQ ID NO: 1009424 - RNA, 22 nt, Human
agaggccugugugcuccagugg

SEQ ID NO: 1009425 - RNA, 21 nt, Human
augugaaauaucaucagagca

SEQ ID NO: 1009426 - RNA, 22 nt, Human
aggcuggcuuggcucuccugug

SEQ ID NO: 1009427 - RNA, 22 nt, Human
uuucucauagucaugccucuua

SEQ ID NO: 1009428 - RNA, 22 nt, Human
auagucuuagaucagauaaagu

SEQ ID NO: 1009429 - RNA, 22 nt, Human
uagccuucucaagacaaaguug

SEQ ID NO: 1009430 - RNA, 22 nt, Human
gcccagugguaaaagcaggccu

SEQ ID NO: 1009431 - RNA, 22 nt, Human
ugcacagcgggugucugucagg

SEQ ID NO: 1009432 - RNA, 22 nt, Human
ucccagaggcuccagucucuau

SEQ ID NO: 1009433 - RNA, 18 nt, Human
ugaggcagucagugaugg

SEQ ID NO: 1009434 - RNA, 22 nt, Human
cagcaucuuucucuucuggagu

SEQ ID NO: 1009435 - RNA, 20 nt, Human
agugucugggccucaggccc

SEQ ID NO: 1009436 - RNA, 22 nt, Human
uugcugugucugauggcugaga

SEQ ID NO: 1009437 - RNA, 23 nt, Human
cugaggccugcugcguucagguu

SEQ ID NO: 1009438 - RNA, 22 nt, Human
uauuaggguuuugaagguuugu

SEQ ID NO: 1009439 - RNA, 22 nt, Human
gccugguggacacugggcauca

SEQ ID NO: 1009440 - RNA, 23 nt, Human
gccaggcuccggucuguggccac

SEQ ID NO: 1009441 - RNA, 21 nt, Human
ugggacagugauggcuccucc

SEQ ID NO: 1009442 - RNA, 21 nt, Human
aggugggagaccauguagguc

SEQ ID NO: 1009443 - RNA, 22 nt, Human
aaugauguauuaguacaacaca

SEQ ID NO: 1009444 - RNA, 22 nt, Human
uggguggcggccugguucugag

SEQ ID NO: 1009445 - RNA, 22 nt, Human
auaucacaaacaagucuguacu

SEQ ID NO: 1009446 - RNA, 22 nt, Human
agaggcaggaagagcugauuuu

SEQ ID NO: 1009447 - RNA, 22 nt, Human
agggugccuggaagccacucac

SEQ ID NO: 1009448 - RNA, 22 nt, Human
cugcccuggucccauggcugau

SEQ ID NO: 1009449 - RNA, 22 nt, Human
cauggacucugguuuggggagc

SEQ ID NO: 1009450 - RNA, 22 nt, Human
ccucucaucauuaucgcuuugu

SEQ ID NO: 1009451 - RNA, 22 nt, Human
ugcuccuuccucauccugugca

SEQ ID NO: 1009452 - RNA, 22 nt, Human
acuuugcaauacuuaauacaaa

SEQ ID NO: 1009453 - RNA, 23 nt, Human
gggugggccaaauuagguagccu

SEQ ID NO: 1009454 - RNA, 22 nt, Human
caggcuugggagcagagccacu

SEQ ID NO: 1009455 - RNA, 22 nt, Human
uaauuauuugaagacauuagag

SEQ ID NO: 1009456 - RNA, 22 nt, Human
gcaguguuuacauauuagaaac

SEQ ID NO: 1009457 - RNA, 22 nt, Human
acugcuuuagaccuagagcucu

SEQ ID NO: 1009458 - RNA, 22 nt, Human
gccacguugccacccgggugac

SEQ ID NO: 1009459 - RNA, 22 nt, Human
acagagaugcaaguguguauuu

SEQ ID NO: 1009460 - RNA, 22 nt, Human
ccaggaugacccccacuuuccu

SEQ ID NO: 1009461 - RNA, 20 nt, Human
ccuccuggucaggugugcag

SEQ ID NO: 1009462 - RNA, 22 nt, Human
cagugcagaacacauggaaaau

SEQ ID NO: 1009463 - RNA, 22 nt, Human
ggucucagaucuuuauuaaggc

SEQ ID NO: 1009464 - RNA, 22 nt, Human
cccugcagagccagcccugacc

SEQ ID NO: 1009465 - RNA, 22 nt, Human
cacaggggcaaacuguagggga

SEQ ID NO: 1009466 - RNA, 22 nt, Human
uagccaggcgaggucagugucg

SEQ ID NO: 1009467 - RNA, 22 nt, Human
gugugaaaaugugcacaauaug

SEQ ID NO: 1009468 - RNA, 22 nt, Human
gaaugaauagguguccagaugg

SEQ ID NO: 1009469 - RNA, 22 nt, Human
ugagcuuacgugggaacagacu

SEQ ID NO: 1009470 - RNA, 22 nt, Human
augcugugccuggaaagcggcu

SEQ ID NO: 1009471 - RNA, 18 nt, Human
acaaaugugucacaggaa

SEQ ID NO: 1009472 - RNA, 22 nt, Human
agcauuuaggagaauuugagaa

SEQ ID NO: 1009473 - RNA, 22 nt, Human
cggagccugcuuguugcagcug

SEQ ID NO: 1009474 - RNA, 22 nt, Human
cccagcccugaccuauuggaaa

SEQ ID NO: 1009475 - RNA, 22 nt, Human
agaggcugucccuugcuauucc

SEQ ID NO: 1009476 - RNA, 22 nt, Human
cuggggcugcagcgaucuucau

SEQ ID NO: 1009477 - RNA, 22 nt, Human
cagcucccgccaucgggaggca

SEQ ID NO: 1009478 - RNA, 22 nt, Human
uuuuaacuuaaaauacauagau

SEQ ID NO: 1009479 - RNA, 22 nt, Human
ucagcuuugaucucaggcaauc

SEQ ID NO: 1009480 - RNA, 22 nt, Human
ggcccaaggcccaggucgagcu

SEQ ID NO: 1009481 - RNA, 22 nt, Human
ugcauauuuguaugauguuuag

SEQ ID NO: 1009482 - RNA, 19 nt, Human
ucuggcuccgccucuuagu

SEQ ID NO: 1009483 - RNA, 22 nt, Human
gugccugcagcaauccauggca

SEQ ID NO: 1009484 - RNA, 22 nt, Human
ugcaggccucacaccuggcacc

SEQ ID NO: 1009485 - RNA, 22 nt, Human
gcucagagcaucccagugaaug

SEQ ID NO: 1009486 - RNA, 22 nt, Human
uggugagcucuuuagacuggga

SEQ ID NO: 1009487 - RNA, 22 nt, Human
uucucuuaucuggcauuauugg

SEQ ID NO: 1009488 - RNA, 22 nt, Human
uucaaugagcccggggccauag

SEQ ID NO: 1009489 - RNA, 22 nt, Human
uggggcugucccgguuuggcga

SEQ ID NO: 1009490 - RNA, 22 nt, Human
gucccuggggaaucagcuggag

SEQ ID NO: 1009491 - RNA, 22 nt, Human
auuccaggcagaccagagagau

SEQ ID NO: 1009492 - RNA, 20 nt, Human
ugggccugagccugugggcu

SEQ ID NO: 1009493 - RNA, 22 nt, Human
guaaaguucuacuagaaucaac

SEQ ID NO: 1009494 - RNA, 22 nt, Human
uucaugaauggaaucaaugcuc

SEQ ID NO: 1009495 - RNA, 22 nt, Human
uucaagauaauaggaaugaaaa

SEQ ID NO: 1009496 - RNA, 22 nt, Human
cuaggaggcgggggcugcagua

SEQ ID NO: 1009497 - RNA, 22 nt, Human
caagauggguguugugaugguu

SEQ ID NO: 1009498 - RNA, 22 nt, Human
gucauugcaguggcaaaucaca

SEQ ID NO: 1009499 - RNA, 22 nt, Human
aagaaaagaaaccugaggcuuu

SEQ ID NO: 1009500 - RNA, 22 nt, Human
ccuguucauuuguauuugucuu

SEQ ID NO: 1009501 - RNA, 22 nt, Human
uacuguauuugauaagugaagu

SEQ ID NO: 1009502 - RNA, 22 nt, Human
auguuugaaauuguaaguauau

SEQ ID NO: 1009503 - RNA, 22 nt, Human
cagaaugcaaauuuuauaauau

SEQ ID NO: 1009504 - RNA, 20 nt, Human
aggcucugccauugucccug

SEQ ID NO: 1009505 - RNA, 22 nt, Human
augcccugcaucaagugacacu

SEQ ID NO: 1009506 - RNA, 22 nt, Human
uuuucauuguaaaucaggaaac

SEQ ID NO: 1009507 - RNA, 22 nt, Human
ugaagccaucccucagauggcc

SEQ ID NO: 1009508 - RNA, 20 nt, Human
aggcucagagcaguaguaca

SEQ ID NO: 1009509 - RNA, 22 nt, Human
cuguaauucacuagggucagcg

SEQ ID NO: 1009510 - RNA, 22 nt, Human
ucccagagucuucuccuguaau

SEQ ID NO: 1009511 - RNA, 21 nt, Human
uuuaauuugcauguaugacgc

SEQ ID NO: 1009512 - RNA, 22 nt, Human
aagauuuccauuucuagcucau

SEQ ID NO: 1009513 - RNA, 17 nt, Human
ggcagcugccacuuuuu

SEQ ID NO: 1009514 - RNA, 19 nt, Human
augucuggguaacagcugc

SEQ ID NO: 1009515 - RNA, 22 nt, Human
ugucaaaaauaagagagauugu

SEQ ID NO: 1009516 - RNA, 22 nt, Human
ugccucagagugggcuugcuau

SEQ ID NO: 1009517 - RNA, 22 nt, Human
cuguggaauugaugcuuagugu

SEQ ID NO: 1009518 - RNA, 22 nt, Human
caaagguaguauauauauuguu

SEQ ID NO: 1009519 - RNA, 22 nt, Human
gugcucaggaagcuguuccugc

SEQ ID NO: 1009520 - RNA, 18 nt, Human
ucucagaggccauccuag

SEQ ID NO: 1009521 - RNA, 22 nt, Human
ccucugagaccagcucugcacc

SEQ ID NO: 1009522 - RNA, 22 nt, Human
cagggguggcugcagcagaggu

SEQ ID NO: 1009523 - RNA, 22 nt, Human
ucucaguguguuuucucucaga

SEQ ID NO: 1009524 - RNA, 22 nt, Human
gccaggcauuauuccgaucccu

SEQ ID NO: 1009525 - RNA, 22 nt, Human
ccucaggggcuuuucguuguug

SEQ ID NO: 1009526 - RNA, 22 nt, Human
gcuguucacauuuugggccaaa

SEQ ID NO: 1009527 - RNA, 22 nt, Human
gucauucuuaacaacucaguag

SEQ ID NO: 1009528 - RNA, 22 nt, Human
ucuacuguagugaugcugcagu

SEQ ID NO: 1009529 - RNA, 22 nt, Human
caaagcaaggcucaguuugaac

SEQ ID NO: 1009530 - RNA, 22 nt, Human
uuuuccucaggaaugcuaagcu

SEQ ID NO: 1009531 - RNA, 22 nt, Human
cugcaggcaucuaacugugggc

SEQ ID NO: 1009532 - RNA, 23 nt, Human
acagagguccaaacaguauaagc

SEQ ID NO: 1009533 - RNA, 22 nt, Human
ucaaugaugcugaagguagcgu

SEQ ID NO: 1009534 - RNA, 22 nt, Human
uccuggaggggacagcaugggc

SEQ ID NO: 1009535 - RNA, 22 nt, Human
agcagaacauuuucagggcugu

SEQ ID NO: 1009536 - RNA, 22 nt, Human
gugauuucuaaucaucugaaug

SEQ ID NO: 1009537 - RNA, 22 nt, Human
agucugucugucacuucugcag

SEQ ID NO: 1009538 - RNA, 22 nt, Human
uugaaaggaauacagaggccua

SEQ ID NO: 1009539 - RNA, 22 nt, Human
uacauuccauguguguguauuc

SEQ ID NO: 1009540 - RNA, 22 nt, Human
uucacauuugcccuuaugugug

SEQ ID NO: 1009541 - RNA, 22 nt, Human
ggcuucuguccucuggaucugu

SEQ ID NO: 1009542 - RNA, 22 nt, Human
auugucuucuggucuuaucuuu

SEQ ID NO: 1009543 - RNA, 18 nt, Human
gcugcugguggagggagc

SEQ ID NO: 1009544 - RNA, 22 nt, Human
aggugcagcugacaccaugugg

SEQ ID NO: 1009545 - RNA, 22 nt, Human
agccugguguggggcugcagag

SEQ ID NO: 1009546 - RNA, 19 nt, Human
uguagcaguuuaaaacaac

SEQ ID NO: 1009547 - RNA, 22 nt, Human
uuauuagguuauucucuguacu

SEQ ID NO: 1009548 - RNA, 20 nt, Human
cagcccuccaguggaggcag

SEQ ID NO: 1009549 - RNA, 22 nt, Human
gagcuuccacucuagaaggagu

SEQ ID NO: 1009550 - RNA, 22 nt, Human
gaguguucccacaccccaguug

SEQ ID NO: 1009551 - RNA, 22 nt, Human
cccugcagcuuuugcauaguca

SEQ ID NO: 1009552 - RNA, 22 nt, Human
ugucaguguauacauacaguau

SEQ ID NO: 1009553 - RNA, 22 nt, Human
aguaucaaggaucuccagcacc

SEQ ID NO: 1009554 - RNA, 21 nt, Human
agaaauguaucauucuuuucc

SEQ ID NO: 1009555 - RNA, 22 nt, Human
ccuggcuggauggagccccugg

SEQ ID NO: 1009556 - RNA, 22 nt, Human
gagcagcuccagccgcaugacu

SEQ ID NO: 1009557 - RNA, 22 nt, Human
ugcagcugguuuagaacuagau

SEQ ID NO: 1009558 - RNA, 22 nt, Human
uagacauuucugguuauugaca

SEQ ID NO: 1009559 - RNA, 22 nt, Human
ugccugggagugaccaagacuc

SEQ ID NO: 1009560 - RNA, 22 nt, Human
ggagcagagcucuucaucugca

SEQ ID NO: 1009561 - RNA, 22 nt, Human
aaagaucagucugaagcaacau

SEQ ID NO: 1009562 - RNA, 20 nt, Human
uugcagcagugaggugaagg

SEQ ID NO: 1009563 - RNA, 21 nt, Human
ugaaaguuggagucaaaugua

SEQ ID NO: 1009564 - RNA, 22 nt, Human
uguguacagcaggauuucucaa

SEQ ID NO: 1009565 - RNA, 22 nt, Human
cuuugcaaacgauuaccacaug

SEQ ID NO: 1009566 - RNA, 18 nt, Human
ugcucuggucucacuugg

SEQ ID NO: 1009567 - RNA, 22 nt, Human
uggcacugaagcuggaaagccu

SEQ ID NO: 1009568 - RNA, 22 nt, Human
cuggagcagguuuaggaguccc

SEQ ID NO: 1009569 - RNA, 23 nt, Human
cacacccaucacuaagagcuccu

SEQ ID NO: 1009570 - RNA, 19 nt, Human
uggcauugguccagauaaa

SEQ ID NO: 1009571 - RNA, 22 nt, Human
ccucaggggugcccacagcugc

SEQ ID NO: 1009572 - RNA, 22 nt, Human
cagauggcauuuccuuucuggc

SEQ ID NO: 1009573 - RNA, 22 nt, Human
uuccagaaaucuuucagcucaa

SEQ ID NO: 1009574 - RNA, 22 nt, Human
cauugacaucaggcuuggccaa

SEQ ID NO: 1009575 - RNA, 22 nt, Human
gggcagagguucaacuucaaca

SEQ ID NO: 1009576 - RNA, 22 nt, Human
aauuucaagucuugaagaagua

SEQ ID NO: 1009577 - RNA, 22 nt, Human
gcacccagccagcaucucagag

SEQ ID NO: 1009578 - RNA, 22 nt, Human
cugggcacauuuugacuagugu

SEQ ID NO: 1009579 - RNA, 22 nt, Human
agcuucuuggcucagcacuugg

SEQ ID NO: 1009580 - RNA, 19 nt, Human
cagagcugcuggccucguc

SEQ ID NO: 1009581 - RNA, 21 nt, Human
ucuggagcccuaagcugagaa

SEQ ID NO: 1009582 - RNA, 22 nt, Human
ugccucuguugagccuuggcug

SEQ ID NO: 1009583 - RNA, 22 nt, Human
uaauacuuuugccuuguauuca

SEQ ID NO: 1009584 - RNA, 22 nt, Human
uaaaaguuuuaguuguacauaa

SEQ ID NO: 1009585 - RNA, 22 nt, Human
uucaaaacagcuagauauugga

SEQ ID NO: 1009586 - RNA, 22 nt, Human
cuucaucaacucuaacaaaugu

SEQ ID NO: 1009587 - RNA, 22 nt, Human
uggcgagccccgacugaguguu

SEQ ID NO: 1009588 - RNA, 22 nt, Human
gcccaggaguugaaugcagcag

SEQ ID NO: 1009589 - RNA, 20 nt, Human
ucauuguguugccaauuccc

SEQ ID NO: 1009590 - RNA, 22 nt, Human
uggccuuguguuuuagagaaag

SEQ ID NO: 1009591 - RNA, 22 nt, Human
ccuguucaaguugcagggcugg

SEQ ID NO: 1009592 - RNA, 22 nt, Human
acaaaagugagugugucucaga

SEQ ID NO: 1009593 - RNA, 22 nt, Human
auuuaagauugcguauucaugu

SEQ ID NO: 1009594 - RNA, 22 nt, Human
ggaggggcagccauggaacucc

SEQ ID NO: 1009595 - RNA, 22 nt, Human
aaaugcagguaguauuuauuuu

SEQ ID NO: 1009596 - RNA, 22 nt, Human
uucugcaucugaauuuaaguac

SEQ ID NO: 1009597 - RNA, 22 nt, Human
cugcagggcagaagggcauaga

SEQ ID NO: 1009598 - RNA, 22 nt, Human
cauuuauugaguggccacagug

SEQ ID NO: 1009599 - RNA, 22 nt, Human
cugcaggcucgaagacacggau

SEQ ID NO: 1009600 - RNA, 22 nt, Human
gccagagcaugcacugccugca

SEQ ID NO: 1009601 - RNA, 22 nt, Human
ucagcuuuugucagaaauugua

SEQ ID NO: 1009602 - RNA, 22 nt, Human
aggcuggcgacaucuggcgggc

SEQ ID NO: 1009603 - RNA, 22 nt, Human
guuagguagaaguuuacuuuga

SEQ ID NO: 1009604 - RNA, 22 nt, Human
uggcucaggggucuggcucugu

SEQ ID NO: 1009605 - RNA, 22 nt, Human
cugggguggaggagcuccccug

SEQ ID NO: 1009606 - RNA, 22 nt, Human
acaugcauacaagcacauguag

SEQ ID NO: 1009607 - RNA, 22 nt, Human
aagggcucccugccugaggugg

SEQ ID NO: 1009608 - RNA, 22 nt, Human
agccagagagccccagguucua

SEQ ID NO: 1009609 - RNA, 22 nt, Human
agacagggucuugaucagagcu

SEQ ID NO: 1009610 - RNA, 22 nt, Human
uuuuccucugagcuuugaauaa

SEQ ID NO: 1009611 - RNA, 22 nt, Human
aaaucaguuagugguaggauug

SEQ ID NO: 1009612 - RNA, 22 nt, Human
ucccaguguggcaggccaugga

SEQ ID NO: 1009613 - RNA, 18 nt, Human
auuuugaacaaugcugua

SEQ ID NO: 1009614 - RNA, 17 nt, Human
ccagagcuacugagacu

SEQ ID NO: 1009615 - RNA, 22 nt, Human
cauguuaaaauauacauucuga

SEQ ID NO: 1009616 - RNA, 22 nt, Human
caggggacauuaaagcuccaua

SEQ ID NO: 1009617 - RNA, 22 nt, Human
uagugcacacgcauguagcagu

SEQ ID NO: 1009618 - RNA, 22 nt, Human
ccuucagaccuagacaggaauc

SEQ ID NO: 1009619 - RNA, 22 nt, Human
ugcaaucucggcacuuugggag

SEQ ID NO: 1009620 - RNA, 22 nt, Human
uagcagagcagggaucagagcc

SEQ ID NO: 1009621 - RNA, 22 nt, Human
agggcagcuaaggugcugacug

SEQ ID NO: 1009622 - RNA, 22 nt, Human
uuugugaaaugaagucacaacu

SEQ ID NO: 1009623 - RNA, 22 nt, Human
aggaaaaauaaggcagcagggc

SEQ ID NO: 1009624 - RNA, 22 nt, Human
aaacuguaagagaauaaacuac

SEQ ID NO: 1009625 - RNA, 22 nt, Human
gggaagggagggaccucagucu

SEQ ID NO: 1009626 - RNA, 22 nt, Human
acagcuugcaauggcuuucaac

SEQ ID NO: 1009627 - RNA, 22 nt, Human
ccaggaggcagagguuacagug

SEQ ID NO: 1009628 - RNA, 22 nt, Human
uguguuuugaacucaucuacug

SEQ ID NO: 1009629 - RNA, 22 nt, Human
gcugucacaucaaggcacuaaa

SEQ ID NO: 1009630 - RNA, 21 nt, Human
aggagcuguguuagcuggucg

SEQ ID NO: 1009631 - RNA, 22 nt, Human
uucuucuuuaucucaguauccu

SEQ ID NO: 1009632 - RNA, 22 nt, Human
agauguaguagugggucuuuua

SEQ ID NO: 1009633 - RNA, 22 nt, Human
uuugcagugauucuugcaguga

SEQ ID NO: 1009634 - RNA, 22 nt, Human
acauuucuuucuauucaguagc

SEQ ID NO: 1009635 - RNA, 22 nt, Human
accacugggcgggcagccugcu

SEQ ID NO: 1009636 - RNA, 22 nt, Human
uggcucagaugcucuuccagug

SEQ ID NO: 1009637 - RNA, 22 nt, Human
ugucccagacauaaguggacau

SEQ ID NO: 1009638 - RNA, 22 nt, Human
uaugcauauagaugcacacaca

SEQ ID NO: 1009639 - RNA, 22 nt, Human
ugcuuaaaauaguucauuuuug

SEQ ID NO: 1009640 - RNA, 22 nt, Human
cugagccauaagggaggcuggg

SEQ ID NO: 1009641 - RNA, 22 nt, Human
gguggggcccuggcacugguau

SEQ ID NO: 1009642 - RNA, 22 nt, Human
cauauuuauagaucuggcauuu

SEQ ID NO: 1009643 - RNA, 22 nt, Human
cagggcucgcugccagcuucag

SEQ ID NO: 1009644 - RNA, 22 nt, Human
uuuagggaagaagcccauggcc

SEQ ID NO: 1009645 - RNA, 22 nt, Human
ggaaggagggcggcaaugauga

SEQ ID NO: 1009646 - RNA, 22 nt, Human
gggagguucuguucgcacuuga

SEQ ID NO: 1009647 - RNA, 23 nt, Human
ggcuggcccggggcugcuccuga

SEQ ID NO: 1009648 - RNA, 22 nt, Human
ccuggcuguggcggugcucuca

SEQ ID NO: 1009649 - RNA, 22 nt, Human
cagucccaccaggaucgcucuu

SEQ ID NO: 1009650 - RNA, 22 nt, Human
uauguguaggaggaggacaggg

SEQ ID NO: 1009651 - RNA, 22 nt, Human
aagagcaucgguggagccccca

SEQ ID NO: 1009652 - RNA, 22 nt, Human
guuagaaagugucugcuugggu

SEQ ID NO: 1009653 - RNA, 22 nt, Human
agcugagcauuugauccaccuc

SEQ ID NO: 1009654 - RNA, 22 nt, Human
aggcuauuuccacucuucucau

SEQ ID NO: 1009655 - RNA, 21 nt, Human
uuugaaagcuacaucuauagc

SEQ ID NO: 1009656 - RNA, 22 nt, Human
acuuggagagcauugcugggga

SEQ ID NO: 1009657 - RNA, 22 nt, Human
ucugggaaugaauaagaccugu

SEQ ID NO: 1009658 - RNA, 19 nt, Human
ggcugcugguuacagaggc

SEQ ID NO: 1009659 - RNA, 22 nt, Human
uacagcauauacagaaugaaca

SEQ ID NO: 1009660 - RNA, 22 nt, Human
uagaagcaguaauagaaauagg

SEQ ID NO: 1009661 - RNA, 23 nt, Human
gggagccaggaccucgcgcccca

SEQ ID NO: 1009662 - RNA, 22 nt, Human
gaacagcccuguuaagucuguu

SEQ ID NO: 1009663 - RNA, 22 nt, Human
ccagggugcucuguggcgucgc

SEQ ID NO: 1009664 - RNA, 19 nt, Human
gcauaaaaugucaaugugu

SEQ ID NO: 1009665 - RNA, 20 nt, Human
accccagccccucuaucuga

SEQ ID NO: 1009666 - RNA, 22 nt, Human
cagcaggguuaagugacucacc

SEQ ID NO: 1009667 - RNA, 22 nt, Human
gccagcaguccugcugugugcc

SEQ ID NO: 1009668 - RNA, 22 nt, Human
gugcagcugugugagagcucca

SEQ ID NO: 1009669 - RNA, 22 nt, Human
gcagggacaucuucagaucacu

SEQ ID NO: 1009670 - RNA, 22 nt, Human
accucccagcucugagcuuggg

SEQ ID NO: 1009671 - RNA, 22 nt, Human
ucucuuccaguaagagucuuua

SEQ ID NO: 1009672 - RNA, 22 nt, Human
gcuguguuuuauguuagguuaa

SEQ ID NO: 1009673 - RNA, 22 nt, Human
ugugaaaggggucacagggaaa

SEQ ID NO: 1009674 - RNA, 22 nt, Human
gaagcagcaaaucugcaguauc

SEQ ID NO: 1009675 - RNA, 22 nt, Human
gugaaacagaagcuccuggaau

SEQ ID NO: 1009676 - RNA, 22 nt, Human
cccaggcagccccagaagcuug

SEQ ID NO: 1009677 - RNA, 22 nt, Human
gaagcagcucagauugacugaa

SEQ ID NO: 1009678 - RNA, 21 nt, Human
gccaccccuggcacaggugcu

SEQ ID NO: 1009679 - RNA, 22 nt, Human
uggcacccugaaguuggucacu

SEQ ID NO: 1009680 - RNA, 22 nt, Human
uaacauuagguagacauaagcc

SEQ ID NO: 1009681 - RNA, 22 nt, Human
gcagaggccuagguggaaggcc

SEQ ID NO: 1009682 - RNA, 22 nt, Human
ggagcagacauaaccuuacaga

SEQ ID NO: 1009683 - RNA, 22 nt, Human
cagggagaagucuggucagucc

SEQ ID NO: 1009684 - RNA, 20 nt, Human
accaauguuagcuuaguacu

SEQ ID NO: 1009685 - RNA, 23 nt, Human
cccugcagucagggugagauggu

SEQ ID NO: 1009686 - RNA, 22 nt, Human
agguacagaugaaagucuaguu

SEQ ID NO: 1009687 - RNA, 22 nt, Human
gccagcucagaugcaggaagga

SEQ ID NO: 1009688 - RNA, 22 nt, Human
caguggcaugguugacugcagu

SEQ ID NO: 1009689 - RNA, 22 nt, Human
aggaggccccuccuggguugcu

SEQ ID NO: 1009690 - RNA, 22 nt, Human
ucccagagcugauaagccuuua

SEQ ID NO: 1009691 - RNA, 22 nt, Human
agagcugggugaagugccauca

SEQ ID NO: 1009692 - RNA, 19 nt, Human
guucaaacacugauucagc

SEQ ID NO: 1009693 - RNA, 22 nt, Human
auuuuucucucacacuuaccag

SEQ ID NO: 1009694 - RNA, 19 nt, Human
gugauuucuuuccacaagc

SEQ ID NO: 1009695 - RNA, 19 nt, Human
cuggggcuuugguacugcc

SEQ ID NO: 1009696 - RNA, 22 nt, Human
auuugcuuuaagguauaaaagg

SEQ ID NO: 1009697 - RNA, 22 nt, Human
auuauguauuugguauaguuug

SEQ ID NO: 1009698 - RNA, 22 nt, Human
caguaaaagauggaaauagaau

SEQ ID NO: 1009699 - RNA, 22 nt, Human
cucagagcaaugaacaugcaaa

SEQ ID NO: 1009700 - RNA, 20 nt, Human
agaagcugauacugauggaa

SEQ ID NO: 1009701 - RNA, 22 nt, Human
ugcagcugaggccagcuaugcc

SEQ ID NO: 1009702 - RNA, 22 nt, Human
uugaagcagagaaauacuugaa

SEQ ID NO: 1009703 - RNA, 22 nt, Human
agauauauuuaagguaauaagu

SEQ ID NO: 1009704 - RNA, 22 nt, Human
augcccugcugcuggggcagug

SEQ ID NO: 1009705 - RNA, 22 nt, Human
acagucucuccacacugcaggg

SEQ ID NO: 1009706 - RNA, 22 nt, Human
aguaugaagaauacauagauga

SEQ ID NO: 1009707 - RNA, 22 nt, Human
ggcagcaggagccaucugguag

SEQ ID NO: 1009708 - RNA, 22 nt, Human
ccagcuccucuucccaguguca

SEQ ID NO: 1009709 - RNA, 22 nt, Human
uggcucagcugacucggcuucu

SEQ ID NO: 1009710 - RNA, 22 nt, Human
gcugccagccaacuugcugugc

SEQ ID NO: 1009711 - RNA, 22 nt, Human
ccucagccuuggccccaggcag

SEQ ID NO: 1009712 - RNA, 22 nt, Human
ugcaccauguaaguggccacgu

SEQ ID NO: 1009713 - RNA, 22 nt, Human
uccaggcugggcugaagggugc

SEQ ID NO: 1009714 - RNA, 22 nt, Human
aacaguaaagacagaauuuauc

SEQ ID NO: 1009715 - RNA, 22 nt, Human
ccugggcauucuuugaguucuc

SEQ ID NO: 1009716 - RNA, 19 nt, Human
ggccuggauuuagggcucc

SEQ ID NO: 1009717 - RNA, 20 nt, Human
aagauucauuguaauuaggg

SEQ ID NO: 1009718 - RNA, 22 nt, Human
ucaggcaggcagagggcaaaug

SEQ ID NO: 1009719 - RNA, 22 nt, Human
gcuggucacucugggagcugcu

SEQ ID NO: 1009720 - RNA, 22 nt, Human
uguuucaggaccuaucuuuuag

SEQ ID NO: 1009721 - RNA, 20 nt, Human
ccucaagcagacugacagcu

SEQ ID NO: 1009722 - RNA, 22 nt, Human
uaagaacaagcuggggguucca

SEQ ID NO: 1009723 - RNA, 22 nt, Human
ggcagccuccagggcacuggug

SEQ ID NO: 1009724 - RNA, 20 nt, Human
gcauggcauguagugaagug

SEQ ID NO: 1009725 - RNA, 22 nt, Human
aucaggaucaugcuggguggga

SEQ ID NO: 1009726 - RNA, 22 nt, Human
uucucuuuucaccaguugcuaa

SEQ ID NO: 1009727 - RNA, 22 nt, Human
aggaaacuccccuacaucucaa

SEQ ID NO: 1009728 - RNA, 22 nt, Human
cucaggauugugccuagggaga

SEQ ID NO: 1009729 - RNA, 22 nt, Human
aucagagaccggucaagucaug

SEQ ID NO: 1009730 - RNA, 22 nt, Human
agaugaagacucaggagcaggu

SEQ ID NO: 1009731 - RNA, 22 nt, Human
cagcuugggucaggugccugcu

SEQ ID NO: 1009732 - RNA, 22 nt, Human
ggggcagauggaacagagcaca

SEQ ID NO: 1009733 - RNA, 22 nt, Human
gcugaagagagaugcguccagc

SEQ ID NO: 1009734 - RNA, 22 nt, Human
ccauaagguugaaaacuguaca

SEQ ID NO: 1009735 - RNA, 22 nt, Human
agagcugugcuuugcaccacgu

SEQ ID NO: 1009736 - RNA, 22 nt, Human
agggggcaucagguccuggcuc

SEQ ID NO: 1009737 - RNA, 22 nt, Human
ggcaaaaaccacaauuacuuuu

SEQ ID NO: 1009738 - RNA, 22 nt, Human
gcagaggccaucaacuuugcca

SEQ ID NO: 1009739 - RNA, 18 nt, Human
ccgggcuuuggugacaca

SEQ ID NO: 1009740 - RNA, 22 nt, Human
ugcuggggucauggggcgcccg

SEQ ID NO: 1009741 - RNA, 21 nt, Human
aauguauguuuaucucacagu

SEQ ID NO: 1009742 - RNA, 22 nt, Human
caguuuauagcucuagcagcuu

SEQ ID NO: 1009743 - RNA, 22 nt, Human
ggcucccaggagggccuggagg

SEQ ID NO: 1009744 - RNA, 22 nt, Human
uaaggcacccgugagcugccag

SEQ ID NO: 1009745 - RNA, 22 nt, Human
gcugggagccguaccugucacg

SEQ ID NO: 1009746 - RNA, 17 nt, Human
ccagagaguaguuagga

SEQ ID NO: 1009747 - RNA, 22 nt, Human
ggauggcauguugggcucuguu

SEQ ID NO: 1009748 - RNA, 22 nt, Human
aaucuucacagagaaaauuagg

SEQ ID NO: 1009749 - RNA, 20 nt, Human
gggguuggcuggcacaggga

SEQ ID NO: 1009750 - RNA, 22 nt, Human
cuauuagguaugcagccuauuu

SEQ ID NO: 1009751 - RNA, 22 nt, Human
uugcauugauguuccuucuugc

SEQ ID NO: 1009752 - RNA, 22 nt, Human
aggguggagggagucccugagc

SEQ ID NO: 1009753 - RNA, 22 nt, Human
cacugaaggaaggacuacugca

SEQ ID NO: 1009754 - RNA, 22 nt, Human
agcagcuguggaaaaguaacua

SEQ ID NO: 1009755 - RNA, 22 nt, Human
uuagauaacaguagaauaucaa

SEQ ID NO: 1009756 - RNA, 22 nt, Human
ggagugaguacuggaguagcug

SEQ ID NO: 1009757 - RNA, 22 nt, Human
gccugccugcugucaucugccu

SEQ ID NO: 1009758 - RNA, 19 nt, Human
aggugaugugacucuagaa

SEQ ID NO: 1009759 - RNA, 22 nt, Human
uacuuuuagccuauuugauucu

SEQ ID NO: 1009760 - RNA, 23 nt, Human
agcuggguggccugcgugaagcu

SEQ ID NO: 1009761 - RNA, 22 nt, Human
agaacuguccuuggaggagagu

SEQ ID NO: 1009762 - RNA, 22 nt, Human
augugucaauuuucaaaugcuu

SEQ ID NO: 1009763 - RNA, 22 nt, Human
agucuucucauuucacaugcuu

SEQ ID NO: 1009764 - RNA, 22 nt, Human
gagccagguuggaggcugcagu

SEQ ID NO: 1009765 - RNA, 22 nt, Human
gugucacaagagcccaggaaac

SEQ ID NO: 1009766 - RNA, 22 nt, Human
cugcuuuggacaacuauucuug

SEQ ID NO: 1009767 - RNA, 17 nt, Human
gcuuccucaugcaguuc

SEQ ID NO: 1009768 - RNA, 22 nt, Human
agaggggcucauauccugucau

SEQ ID NO: 1009769 - RNA, 22 nt, Human
cccagccucuguuugcuccucu

SEQ ID NO: 1009770 - RNA, 22 nt, Human
caggccugcaggaaaggcuccc

SEQ ID NO: 1009771 - RNA, 22 nt, Human
ccagccuggagggcaguggugg

SEQ ID NO: 1009772 - RNA, 22 nt, Human
agaagccagcuucagcugcccg

SEQ ID NO: 1009773 - RNA, 22 nt, Human
gagauguacaauguguauuaau

SEQ ID NO: 1009774 - RNA, 22 nt, Human
agcaauauuucagcuagcaggu

SEQ ID NO: 1009775 - RNA, 22 nt, Human
ucccugggccacagcugugagc

SEQ ID NO: 1009776 - RNA, 22 nt, Human
ggggcucaguucggacagccug

SEQ ID NO: 1009777 - RNA, 17 nt, Human
accaggcaacacgccca

SEQ ID NO: 1009778 - RNA, 22 nt, Human
aaacucuggagauguuuaugca

SEQ ID NO: 1009779 - RNA, 22 nt, Human
ccccagccuuccaugggaauug

SEQ ID NO: 1009780 - RNA, 20 nt, Human
uucaggauucuagaccacac

SEQ ID NO: 1009781 - RNA, 22 nt, Human
agagugauucuaguuagggaau

SEQ ID NO: 1009782 - RNA, 22 nt, Human
gcuguccucugaucucuggagg

SEQ ID NO: 1009783 - RNA, 22 nt, Human
ucugcuguucauucuuuuagcu

SEQ ID NO: 1009784 - RNA, 22 nt, Human
uagacacaucaaguauaguuaa

SEQ ID NO: 1009785 - RNA, 22 nt, Human
accaggcagcugggggugaugu

SEQ ID NO: 1009786 - RNA, 21 nt, Human
acagcaagccuucacaugagu

SEQ ID NO: 1009787 - RNA, 22 nt, Human
cagggugcgccacucagaugua

SEQ ID NO: 1009788 - RNA, 22 nt, Human
gccucugccaagggggcugcgg

SEQ ID NO: 1009789 - RNA, 22 nt, Human
uuuauuagugcuuguaucacug

SEQ ID NO: 1009790 - RNA, 22 nt, Human
agcaagcuaccuagauagucua

SEQ ID NO: 1009791 - RNA, 18 nt, Human
cugaggcuggcaggagcc

SEQ ID NO: 1009792 - RNA, 22 nt, Human
gcugccuccugaaagcgcucug

SEQ ID NO: 1009793 - RNA, 22 nt, Human
cauggcaggaggcugcuggcag

SEQ ID NO: 1009794 - RNA, 22 nt, Human
ccagggcaauuauuuggagggu

SEQ ID NO: 1009795 - RNA, 22 nt, Human
aucugccuccaaguccaugugu

SEQ ID NO: 1009796 - RNA, 22 nt, Human
gccugugacucgucuugggcca

SEQ ID NO: 1009797 - RNA, 22 nt, Human
cuuuccaaugucacuaugaauc

SEQ ID NO: 1009798 - RNA, 22 nt, Human
ucuggccaggauggcaagacca

SEQ ID NO: 1009799 - RNA, 22 nt, Human
cuuccugguuugaagcucgccg

SEQ ID NO: 1009800 - RNA, 22 nt, Human
acuguguggaaauuugugaggg

SEQ ID NO: 1009801 - RNA, 22 nt, Human
aaccauuugccauuaucuuaag

SEQ ID NO: 1009802 - RNA, 22 nt, Human
uaagaacagugacagccaacau

SEQ ID NO: 1009803 - RNA, 22 nt, Human
ccugagugaauucccucacugu

SEQ ID NO: 1009804 - RNA, 22 nt, Human
ucuuuauuucugaaucccccau

SEQ ID NO: 1009805 - RNA, 22 nt, Human
gaacacauuagucugaguuggc

SEQ ID NO: 1009806 - RNA, 22 nt, Human
gcugccucaggcaccuccuggc

SEQ ID NO: 1009807 - RNA, 22 nt, Human
agccucucuccagcuuggcaga

SEQ ID NO: 1009808 - RNA, 22 nt, Human
ccaggcagagggauccccaucc

SEQ ID NO: 1009809 - RNA, 17 nt, Human
cugcuuugugcaacgcu

SEQ ID NO: 1009810 - RNA, 22 nt, Human
cucagggcuugaguguccagga

SEQ ID NO: 1009811 - RNA, 22 nt, Human
aaauguguuccuuugcuacaga

SEQ ID NO: 1009812 - RNA, 21 nt, Human
acaguucaugauaacuccauc

SEQ ID NO: 1009813 - RNA, 22 nt, Human
gccugucaauuuuguguacaau

SEQ ID NO: 1009814 - RNA, 22 nt, Human
caggcagcaucagucugcugua

SEQ ID NO: 1009815 - RNA, 22 nt, Human
uugagcacaacucuuggagagc

SEQ ID NO: 1009816 - RNA, 22 nt, Human
cuaguccagucucaaaaugcua

SEQ ID NO: 1009817 - RNA, 22 nt, Human
ucacaggguaucugggauggau

SEQ ID NO: 1009818 - RNA, 22 nt, Human
gugccugguuuggggaguguuc

SEQ ID NO: 1009819 - RNA, 22 nt, Human
ugcuuuauucccuucugaugug

SEQ ID NO: 1009820 - RNA, 22 nt, Human
cagaaauguucuaaugauucag

SEQ ID NO: 1009821 - RNA, 22 nt, Human
gccuggaguuguggugaagcca

SEQ ID NO: 1009822 - RNA, 22 nt, Human
ugaugguugauuauaaaucagu

SEQ ID NO: 1009823 - RNA, 22 nt, Human
ucucagagaccugaacucccug

SEQ ID NO: 1009824 - RNA, 22 nt, Human
guguuuccucuagaagccaugg

SEQ ID NO: 1009825 - RNA, 22 nt, Human
gccucugcaggugcgguuaucc

SEQ ID NO: 1009826 - RNA, 22 nt, Human
ucuccuggauggaccuucucuu

SEQ ID NO: 1009827 - RNA, 22 nt, Human
ucacaggguuuggaagccuccu

SEQ ID NO: 1009828 - RNA, 19 nt, Human
agauggggaagagugugag

SEQ ID NO: 1009829 - RNA, 22 nt, Human
ugcucauuggcgaucugaggga

SEQ ID NO: 1009830 - RNA, 22 nt, Human
aagagcugauuaagucaugagg

SEQ ID NO: 1009831 - RNA, 22 nt, Human
cccagcuugcccaggacugagg

SEQ ID NO: 1009832 - RNA, 22 nt, Human
gccuggaguucagccaaguccc

SEQ ID NO: 1009833 - RNA, 18 nt, Human
cacaggcucccagugagg

SEQ ID NO: 1009834 - RNA, 22 nt, Human
gcccaggcuagcguagagugca

SEQ ID NO: 1009835 - RNA, 20 nt, Human
cugccuggaggccucuaccu

SEQ ID NO: 1009836 - RNA, 17 nt, Human
gccugcaggcccgcaga

SEQ ID NO: 1009837 - RNA, 22 nt, Human
ucaugaacauggaauaucuuuu

SEQ ID NO: 1009838 - RNA, 22 nt, Human
caugcacaaagguaagaugcgu

SEQ ID NO: 1009839 - RNA, 22 nt, Human
gcagcaggagaguuuguccugc

SEQ ID NO: 1009840 - RNA, 22 nt, Human
aauaucuucuaaggauagaacu

SEQ ID NO: 1009841 - RNA, 21 nt, Human
agguggggcugcaccucugcu

SEQ ID NO: 1009842 - RNA, 22 nt, Human
uaucuugagagacaacacagca

SEQ ID NO: 1009843 - RNA, 23 nt, Human
cugcugugaaacaugguuuuggu

SEQ ID NO: 1009844 - RNA, 22 nt, Human
agggucugacaaugugacuuag

SEQ ID NO: 1009845 - RNA, 19 nt, Human
uccucaggggcucacagac

SEQ ID NO: 1009846 - RNA, 22 nt, Human
ggcccugggaugcucagcagug

SEQ ID NO: 1009847 - RNA, 22 nt, Human
cucucugaggaaggagcaucug

SEQ ID NO: 1009848 - RNA, 22 nt, Human
aaaggccauuacuugcuuuuag

SEQ ID NO: 1009849 - RNA, 22 nt, Human
cacagcugaaguagccaugugg

SEQ ID NO: 1009850 - RNA, 20 nt, Human
auauguguacguguauacau

SEQ ID NO: 1009851 - RNA, 22 nt, Human
cuggccuuuaaaaugaccuuau

SEQ ID NO: 1009852 - RNA, 22 nt, Human
ggaggagacccugugucaguuu

SEQ ID NO: 1009853 - RNA, 22 nt, Human
cagcauuuucuuaauguaggug

SEQ ID NO: 1009854 - RNA, 22 nt, Human
cuguagcaaguuauucaauaaa

SEQ ID NO: 1009855 - RNA, 22 nt, Human
guuaucaugcuucaucaucacu

SEQ ID NO: 1009856 - RNA, 22 nt, Human
gucaugccuggcuucuuagaca

SEQ ID NO: 1009857 - RNA, 22 nt, Human
ucugcugugauuugcuaccugu

SEQ ID NO: 1009858 - RNA, 22 nt, Human
cagagcauugagggucugccaa

SEQ ID NO: 1009859 - RNA, 22 nt, Human
ugcccaagcagaggagugauuc

SEQ ID NO: 1009860 - RNA, 22 nt, Human
uuccucuccucccaccagguga

SEQ ID NO: 1009861 - RNA, 22 nt, Human
uccugagauguggagcuccaug

SEQ ID NO: 1009862 - RNA, 22 nt, Human
uacugccuggagcauuggugcu

SEQ ID NO: 1009863 - RNA, 23 nt, Human
gcaggugguucgaacagaaguuu

SEQ ID NO: 1009864 - RNA, 22 nt, Human
ggggaugguggcauuuguaaaa

SEQ ID NO: 1009865 - RNA, 22 nt, Human
gccaggcauuuguuaggugcug

SEQ ID NO: 1009866 - RNA, 20 nt, Human
cagggcucugggccuggccu

SEQ ID NO: 1009867 - RNA, 22 nt, Human
uuaacauacaucaugaacaaug

SEQ ID NO: 1009868 - RNA, 22 nt, Human
cuuaacagcaagaucuguguca

SEQ ID NO: 1009869 - RNA, 22 nt, Human
ggucccugaagaggccuggggu

SEQ ID NO: 1009870 - RNA, 22 nt, Human
cuccccagguucaggagguggg

SEQ ID NO: 1009871 - RNA, 22 nt, Human
cugaggccuguguuggggcagu

SEQ ID NO: 1009872 - RNA, 22 nt, Human
cugggacagagcagcagugggg

SEQ ID NO: 1009873 - RNA, 22 nt, Human
uggcagcugaauggcuggaugg

SEQ ID NO: 1009874 - RNA, 22 nt, Human
cagugcagccaaggacaggcac

SEQ ID NO: 1009875 - RNA, 22 nt, Human
aaucacaauuacuuuugcacca

SEQ ID NO: 1009876 - RNA, 22 nt, Human
ucugccuucgcugcucccugaa

SEQ ID NO: 1009877 - RNA, 22 nt, Human
aaugugaaaccgcacagaauaa

SEQ ID NO: 1009878 - RNA, 22 nt, Human
accugccuaguugguucugccc

SEQ ID NO: 1009879 - RNA, 22 nt, Human
uggcccugcagaacuagccugg

SEQ ID NO: 1009880 - RNA, 22 nt, Human
aucucagggcuggagcccugga

SEQ ID NO: 1009881 - RNA, 22 nt, Human
aaaggucagcugccaucguucu

SEQ ID NO: 1009882 - RNA, 22 nt, Human
cagagguauugcaaaagccuag

SEQ ID NO: 1009883 - RNA, 22 nt, Human
ugagguguguccccagggaggu

SEQ ID NO: 1009884 - RNA, 22 nt, Human
aggcuggagggcaauggcaaga

SEQ ID NO: 1009885 - RNA, 22 nt, Human
agucuugcucuugcaucugcuu

SEQ ID NO: 1009886 - RNA, 22 nt, Human
gcuggccucaucacugacuucu

SEQ ID NO: 1009887 - RNA, 22 nt, Human
ucaaauguucccuguacuggcc

SEQ ID NO: 1009888 - RNA, 22 nt, Human
uucauacaguggcugcacucca

SEQ ID NO: 1009889 - RNA, 22 nt, Human
accccagcucugagccacacca

SEQ ID NO: 1009890 - RNA, 22 nt, Human
gcaugguggccuuaggguagcc

SEQ ID NO: 1009891 - RNA, 18 nt, Human
uggcagccagcugcuccu

SEQ ID NO: 1009892 - RNA, 22 nt, Human
gcagggugugucucauacaguu

SEQ ID NO: 1009893 - RNA, 22 nt, Human
gggcagaggcucuggcccaucc

SEQ ID NO: 1009894 - RNA, 22 nt, Human
aggacaguguggaagagggugc

SEQ ID NO: 1009895 - RNA, 22 nt, Human
gaacacaucacauuuuacagug

SEQ ID NO: 1009896 - RNA, 22 nt, Human
auuguaucuugucauuaugcau

SEQ ID NO: 1009897 - RNA, 22 nt, Human
ccagggcuccauugcucauccu

SEQ ID NO: 1009898 - RNA, 22 nt, Human
gccuaauaugcaaaauugauac

SEQ ID NO: 1009899 - RNA, 17 nt, Human
accagccucuccugggg

SEQ ID NO: 1009900 - RNA, 22 nt, Human
aagaugcuuauugcuccugcag

SEQ ID NO: 1009901 - RNA, 22 nt, Human
gagcucugacugcugggugaca

SEQ ID NO: 1009902 - RNA, 22 nt, Human
gcucugugccacaugcaguguu

SEQ ID NO: 1009903 - RNA, 22 nt, Human
ccaggcaucacgggcauguggc

SEQ ID NO: 1009904 - RNA, 22 nt, Human
ucucuggaagcgcagaucuguu

SEQ ID NO: 1009905 - RNA, 22 nt, Human
ggugcugguucaggguggcugu

SEQ ID NO: 1009906 - RNA, 22 nt, Human
gggagcugagcuggaagagaau

SEQ ID NO: 1009907 - RNA, 22 nt, Human
aauaucagcacuuuugugguau

SEQ ID NO: 1009908 - RNA, 22 nt, Human
cauguacaguuuuucuguccug

SEQ ID NO: 1009909 - RNA, 22 nt, Human
ugaugguuuuauuaauaggacc

SEQ ID NO: 1009910 - RNA, 22 nt, Human
ugcuuucaaaggcuuucuagau

SEQ ID NO: 1009911 - RNA, 22 nt, Human
augugcaaauccaaugugaaug

SEQ ID NO: 1009912 - RNA, 22 nt, Human
gcugagcugcuguucauccugc

SEQ ID NO: 1009913 - RNA, 20 nt, Human
agagccuugaggaagaugau

SEQ ID NO: 1009914 - RNA, 22 nt, Human
ccaggaagccucagaugcugag

SEQ ID NO: 1009915 - RNA, 22 nt, Human
aguugacauccagagacauucu

SEQ ID NO: 1009916 - RNA, 22 nt, Human
uucaagaugucuucacaauagu

SEQ ID NO: 1009917 - RNA, 22 nt, Human
uguucauaucauuuugaaagcu

SEQ ID NO: 1009918 - RNA, 22 nt, Human
cugaggaagacagcagcugugu

SEQ ID NO: 1009919 - RNA, 22 nt, Human
gugagcaggauuucauggugua

SEQ ID NO: 1009920 - RNA, 22 nt, Human
gucccaggcuuauguggagcuu

SEQ ID NO: 1009921 - RNA, 22 nt, Human
acugugcaugaaccgaaacaaa

SEQ ID NO: 1009922 - RNA, 22 nt, Human
ucccagaggaaauggcagcuga

SEQ ID NO: 1009923 - RNA, 21 nt, Human
auucagaaagggaauaaacuc

SEQ ID NO: 1009924 - RNA, 22 nt, Human
uaauccacaauagagauuaucu

SEQ ID NO: 1009925 - RNA, 22 nt, Human
ugggagcucagaaagggagguc

SEQ ID NO: 1009926 - RNA, 22 nt, Human
caaggcugcugcgggucgcacc

SEQ ID NO: 1009927 - RNA, 22 nt, Human
ugaagcaggguggccagauugu

SEQ ID NO: 1009928 - RNA, 22 nt, Human
cagugcuccugauguacccuug

SEQ ID NO: 1009929 - RNA, 22 nt, Human
acugcaucugaaacauggguca

SEQ ID NO: 1009930 - RNA, 22 nt, Human
auauuucuugagcaccugguau

SEQ ID NO: 1009931 - RNA, 22 nt, Human
augcugugccuucucugugcca

SEQ ID NO: 1009932 - RNA, 17 nt, Human
ucugccgacugccagcu

SEQ ID NO: 1009933 - RNA, 22 nt, Human
auguaguauuuggaaauguaaa

SEQ ID NO: 1009934 - RNA, 21 nt, Human
gaggcugucugcugcuggccu

SEQ ID NO: 1009935 - RNA, 22 nt, Human
ccuagagcucugcuuuaucuaa

SEQ ID NO: 1009936 - RNA, 22 nt, Human
acucagaagauauaaugacuca

SEQ ID NO: 1009937 - RNA, 22 nt, Human
cugggacaugauagaaacagau

SEQ ID NO: 1009938 - RNA, 22 nt, Human
auaaggcacacauagauagggu

SEQ ID NO: 1009939 - RNA, 22 nt, Human
gaggccugaggcugccuggagc

SEQ ID NO: 1009940 - RNA, 22 nt, Human
cugcuuugacuguuaagaacca

SEQ ID NO: 1009941 - RNA, 22 nt, Human
cagagcuguccaaacccugaca

SEQ ID NO: 1009942 - RNA, 22 nt, Human
auauuguugacuauaagaguaa

SEQ ID NO: 1009943 - RNA, 22 nt, Human
uggcuuccugcauggauccucu

SEQ ID NO: 1009944 - RNA, 22 nt, Human
ugcucuguaaggucagaaaagg

SEQ ID NO: 1009945 - RNA, 22 nt, Human
ugggcucugaagucagucugcu

SEQ ID NO: 1009946 - RNA, 20 nt, Human
ggccuuggccucuuugcagc

SEQ ID NO: 1009947 - RNA, 22 nt, Human
caagaugccccugguagggauc

SEQ ID NO: 1009948 - RNA, 22 nt, Human
gagggucccugcucagggccag

SEQ ID NO: 1009949 - RNA, 21 nt, Human
cacucaggguaugugccaggc

SEQ ID NO: 1009950 - RNA, 22 nt, Human
gacagaagaggaacuuggacag

SEQ ID NO: 1009951 - RNA, 22 nt, Human
caguuuuugccauuaagaguaa

SEQ ID NO: 1009952 - RNA, 22 nt, Human
gccuggagcucuccacuugggg

SEQ ID NO: 1009953 - RNA, 22 nt, Human
uaaagguagugugacauauugu

SEQ ID NO: 1009954 - RNA, 22 nt, Human
aauguguguucggggcccagag

SEQ ID NO: 1009955 - RNA, 22 nt, Human
ugagacaguuuuucuauuucca

SEQ ID NO: 1009956 - RNA, 22 nt, Human
agucccagcucugccacuuacu

SEQ ID NO: 1009957 - RNA, 22 nt, Human
agugcuuucuugcuccaucagu

SEQ ID NO: 1009958 - RNA, 22 nt, Human
ucccaggaagaucccagggacc

SEQ ID NO: 1009959 - RNA, 22 nt, Human
auuuguugcuagcagcacugau

SEQ ID NO: 1009960 - RNA, 22 nt, Human
aucuuguuaaaaugcagaaacu

SEQ ID NO: 1009961 - RNA, 22 nt, Human
uugugguuaaccgcacauuuuu

SEQ ID NO: 1009962 - RNA, 22 nt, Human
ucauccaguucacauggugagu

SEQ ID NO: 1009963 - RNA, 22 nt, Human
aagcuggcaauuaucaaaacug

SEQ ID NO: 1009964 - RNA, 22 nt, Human
uuuaugaacuacagauauaacu

SEQ ID NO: 1009965 - RNA, 22 nt, Human
ccacagggcacaagggagguug

SEQ ID NO: 1009966 - RNA, 22 nt, Human
gcugugagggucuagugaggug

SEQ ID NO: 1009967 - RNA, 20 nt, Human
agugccagggcaggugagag

SEQ ID NO: 1009968 - RNA, 22 nt, Human
ucacauuuguuccucugcacuu

SEQ ID NO: 1009969 - RNA, 22 nt, Human
cugaggcucccucgggucugcu

SEQ ID NO: 1009970 - RNA, 22 nt, Human
cucuggagaacuccuugugucu

SEQ ID NO: 1009971 - RNA, 22 nt, Human
gcagcagagaacacaaugaugg

SEQ ID NO: 1009972 - RNA, 19 nt, Human
gcugcuggcucuggcugga

SEQ ID NO: 1009973 - RNA, 22 nt, Human
ugugaaauauuuauauacucaa

SEQ ID NO: 1009974 - RNA, 22 nt, Human
cuucuuuacuuucuagaaauaa

SEQ ID NO: 1009975 - RNA, 22 nt, Human
gggucuccauguuaacaucacu

SEQ ID NO: 1009976 - RNA, 22 nt, Human
gcccagcaggacagagugguuu

SEQ ID NO: 1009977 - RNA, 22 nt, Human
aagcagccaccucaucuccacu

SEQ ID NO: 1009978 - RNA, 18 nt, Human
ucuggcucaggacugaac

SEQ ID NO: 1009979 - RNA, 22 nt, Human
cucaggagacaguguccacaug

SEQ ID NO: 1009980 - RNA, 22 nt, Human
ggaggguuagcaaaggcacaga

SEQ ID NO: 1009981 - RNA, 22 nt, Human
ccugagagagaagcgaccuggu

SEQ ID NO: 1009982 - RNA, 22 nt, Human
agcucagcuuccucuccaugcu

SEQ ID NO: 1009983 - RNA, 22 nt, Human
agcuuuaugaggagaccuuagu

SEQ ID NO: 1009984 - RNA, 22 nt, Human
gccuccugaaaggaagagcucc

SEQ ID NO: 1009985 - RNA, 22 nt, Human
uuuguuuacucauucauugaug

SEQ ID NO: 1009986 - RNA, 22 nt, Human
ggucccaggagaauaggugcaa

SEQ ID NO: 1009987 - RNA, 22 nt, Human
agccauugaguuuuaugugcua

SEQ ID NO: 1009988 - RNA, 22 nt, Human
auggacaggaacucccuuggca

SEQ ID NO: 1009989 - RNA, 22 nt, Human
ccccagcucagugcagggacau

SEQ ID NO: 1009990 - RNA, 22 nt, Human
guuauguauugggaaauccaag

SEQ ID NO: 1009991 - RNA, 22 nt, Human
gguggccucugcaggccucgac

SEQ ID NO: 1009992 - RNA, 22 nt, Human
ugagaggcagaauggugccugc

SEQ ID NO: 1009993 - RNA, 20 nt, Human
cucucccagcacagcuuccu

SEQ ID NO: 1009994 - RNA, 22 nt, Human
uacccagcccaugccuaccuca

SEQ ID NO: 1009995 - RNA, 22 nt, Human
gccucugcggggcccgagcccg

SEQ ID NO: 1009996 - RNA, 22 nt, Human
aaggcugaguaaaacagagaac

SEQ ID NO: 1009997 - RNA, 22 nt, Human
cuuuggcaaugucauuuucaau

SEQ ID NO: 1009998 - RNA, 22 nt, Human
gccugcaguucugugcuaggca

SEQ ID NO: 1009999 - RNA, 17 nt, Human
ugcugccaagucccaac

SEQ ID NO: 1010000 - RNA, 22 nt, Human
gagccaggucgggccgcggcga

SEQ ID NO: 1010001 - RNA, 22 nt, Human
aaauaguucagccacggugacu

SEQ ID NO: 1010002 - RNA, 22 nt, Human
gaagcagcuaggaucuucauuu

SEQ ID NO: 1010003 - RNA, 22 nt, Human
gccuucccacccugcgaggcug

SEQ ID NO: 1010004 - RNA, 22 nt, Human
cucuucuuggcccccaugaggg

SEQ ID NO: 1010005 - RNA, 22 nt, Human
guucuucaucauuuuagauagg

SEQ ID NO: 1010006 - RNA, 22 nt, Human
gcugucuguucgagcguguguu

SEQ ID NO: 1010007 - RNA, 22 nt, Human
auaguaacuggcauguuuauga

SEQ ID NO: 1010008 - RNA, 20 nt, Human
agagaauucccuuuggagau

SEQ ID NO: 1010009 - RNA, 20 nt, Human
gcuuccuucccagcccccac

SEQ ID NO: 1010010 - RNA, 22 nt, Human
ucuccgaucacagguuuucaau

SEQ ID NO: 1010011 - RNA, 19 nt, Human
ucucuggggacacuuucac

SEQ ID NO: 1010012 - RNA, 22 nt, Human
auuugcagagcucugaauuuug

SEQ ID NO: 1010013 - RNA, 22 nt, Human
gggccccuuguaucucuggcuc

SEQ ID NO: 1010014 - RNA, 22 nt, Human
ucccucuguguugggcaugccu

SEQ ID NO: 1010015 - RNA, 22 nt, Human
cuuagggaaucuuagagcugga

SEQ ID NO: 1010016 - RNA, 22 nt, Human
aaaugcacagguuuuaaauccu

SEQ ID NO: 1010017 - RNA, 22 nt, Human
uaguccaguaaaacagcuaacg

SEQ ID NO: 1010018 - RNA, 22 nt, Human
cuuacaaaggagaggagauagg

SEQ ID NO: 1010019 - RNA, 22 nt, Human
ccucucucuccugcacacacac

SEQ ID NO: 1010020 - RNA, 22 nt, Human
cuggcuggccggaggcaucccu

SEQ ID NO: 1010021 - RNA, 22 nt, Human
acauuuacagugcuagacaauc

SEQ ID NO: 1010022 - RNA, 22 nt, Human
cagcuccacuugaguggggccu

SEQ ID NO: 1010023 - RNA, 22 nt, Human
guccagugacaaguagcuggcc

SEQ ID NO: 1010024 - RNA, 22 nt, Human
caugaaaucugaguauguuucc

SEQ ID NO: 1010025 - RNA, 22 nt, Human
agccuggcuguaaccucauggu

SEQ ID NO: 1010026 - RNA, 22 nt, Human
gcaguggcaccgcuggcucugg

SEQ ID NO: 1010027 - RNA, 22 nt, Human
agagugaagguugacacuucac

SEQ ID NO: 1010028 - RNA, 20 nt, Human
uucuucucuaguuaucuuca

SEQ ID NO: 1010029 - RNA, 22 nt, Human
caggcugagcucuggccugggc

SEQ ID NO: 1010030 - RNA, 22 nt, Human
uuagcugcauuaucaaaguuau

SEQ ID NO: 1010031 - RNA, 22 nt, Human
uucucagaugauucagauaaac

SEQ ID NO: 1010032 - RNA, 22 nt, Human
guccaugauucugugacacccu

SEQ ID NO: 1010033 - RNA, 22 nt, Human
gacuuucucuccucccaggugu

SEQ ID NO: 1010034 - RNA, 22 nt, Human
ucuuugaauuucugacugucuu

SEQ ID NO: 1010035 - RNA, 22 nt, Human
aagcagccacuggccaguuaua

SEQ ID NO: 1010036 - RNA, 18 nt, Human
uguuuauuuuucucuuac

SEQ ID NO: 1010037 - RNA, 23 nt, Human
gcugucaguuguuuuugucucua

SEQ ID NO: 1010038 - RNA, 22 nt, Human
cugccuuugcccuugacacugu

SEQ ID NO: 1010039 - RNA, 22 nt, Human
uuucagaucauuuuuuaaguac

SEQ ID NO: 1010040 - RNA, 22 nt, Human
acaaaguccugguguauggcca

SEQ ID NO: 1010041 - RNA, 22 nt, Human
aaacugaauucccaagggcaug

SEQ ID NO: 1010042 - RNA, 22 nt, Human
ccaaaguccauaguuuacuuua

SEQ ID NO: 1010043 - RNA, 22 nt, Human
uauaacacucagaaagaaucau

SEQ ID NO: 1010044 - RNA, 22 nt, Human
ucaaauaugugauagaagcuaa

SEQ ID NO: 1010045 - RNA, 22 nt, Human
ucacacgugagguucuauccug

SEQ ID NO: 1010046 - RNA, 22 nt, Human
ugugaaagauacuaggcagagg

SEQ ID NO: 1010047 - RNA, 19 nt, Human
ggcugucuggcguguggau

SEQ ID NO: 1010048 - RNA, 22 nt, Human
uaacaauaguguuugcuaguca

SEQ ID NO: 1010049 - RNA, 22 nt, Human
accugccucuaagcagcaggug

SEQ ID NO: 1010050 - RNA, 22 nt, Human
ugcaguggaaagacucagacuu

SEQ ID NO: 1010051 - RNA, 22 nt, Human
gucaggauuuacaaacuucagu

SEQ ID NO: 1010052 - RNA, 22 nt, Human
ucuguucauaguaguguauaug

SEQ ID NO: 1010053 - RNA, 22 nt, Human
gaggugaguggaucacgagguc

SEQ ID NO: 1010054 - RNA, 22 nt, Human
gccuggcucacagagcagccuu

SEQ ID NO: 1010055 - RNA, 22 nt, Human
uggugcaagucucugaggaggg

SEQ ID NO: 1010056 - RNA, 22 nt, Human
ucagauggcacacagagccugc

SEQ ID NO: 1010057 - RNA, 22 nt, Human
cugcccugcuugaugacagcga

SEQ ID NO: 1010058 - RNA, 22 nt, Human
gcugaagcugcagcaggaggaa

SEQ ID NO: 1010059 - RNA, 22 nt, Human
aggaaaugcugaugcuccugga

SEQ ID NO: 1010060 - RNA, 20 nt, Human
gacaggagaguuagguaggu

SEQ ID NO: 1010061 - RNA, 22 nt, Human
gcuguguuugacaguagcagac

SEQ ID NO: 1010062 - RNA, 22 nt, Human
gagccugaugaaacaggcagac

SEQ ID NO: 1010063 - RNA, 22 nt, Human
ccaaggaggccccaggucagcu

SEQ ID NO: 1010064 - RNA, 22 nt, Human
caaggaaaacagaugaucaaca

SEQ ID NO: 1010065 - RNA, 22 nt, Human
cccugaggcaaaggcuagaguu

SEQ ID NO: 1010066 - RNA, 17 nt, Human
gcacugaacaauccugu

SEQ ID NO: 1010067 - RNA, 22 nt, Human
acagugaaugcccaagaaaagu

SEQ ID NO: 1010068 - RNA, 22 nt, Human
aaaugugucauauucaaaguca

SEQ ID NO: 1010069 - RNA, 22 nt, Human
agggcagaggcggacacggaag

SEQ ID NO: 1010070 - RNA, 22 nt, Human
augcugugguagacagcauucc

SEQ ID NO: 1010071 - RNA, 19 nt, Human
uguggccaugguucagcug

SEQ ID NO: 1010072 - RNA, 22 nt, Human
gcuugcuggugccugcaggcuc

SEQ ID NO: 1010073 - RNA, 20 nt, Human
ccagcugagccaaggggaga

SEQ ID NO: 1010074 - RNA, 22 nt, Human
cucagaguccauaguuuacagu

SEQ ID NO: 1010075 - RNA, 22 nt, Human
aaguaugaaucaaagacuaucu

SEQ ID NO: 1010076 - RNA, 22 nt, Human
cacaugugugcugaggacugug

SEQ ID NO: 1010077 - RNA, 22 nt, Human
cacaaugugguuugucaucuuu

SEQ ID NO: 1010078 - RNA, 19 nt, Human
aggucauugauagugcagg

SEQ ID NO: 1010079 - RNA, 22 nt, Human
guuauguaugagggaaugauua

SEQ ID NO: 1010080 - RNA, 22 nt, Human
caggugcuguccugcacauguc

SEQ ID NO: 1010081 - RNA, 22 nt, Human
uuugaaaguccuaggagagucc

SEQ ID NO: 1010082 - RNA, 22 nt, Human
gaagaacaagcagugcuuuccu

SEQ ID NO: 1010083 - RNA, 22 nt, Human
caccuggcuggaagugcuccgg

SEQ ID NO: 1010084 - RNA, 22 nt, Human
cagauggcugccaagaugggcu

SEQ ID NO: 1010085 - RNA, 21 nt, Human
gccucugcugucuuauuguga

SEQ ID NO: 1010086 - RNA, 22 nt, Human
uuugcauuucuaaugagcuccg

SEQ ID NO: 1010087 - RNA, 20 nt, Human
cugcugugugugccucagcc

SEQ ID NO: 1010088 - RNA, 23 nt, Human
aggauccugguacaggagcagag

SEQ ID NO: 1010089 - RNA, 22 nt, Human
uuugcauucuagaaaaauuucu

SEQ ID NO: 1010090 - RNA, 23 nt, Human
cauguacagaguuugauaaagug

SEQ ID NO: 1010091 - RNA, 22 nt, Human
cuugcugucccuugguaugaac

SEQ ID NO: 1010092 - RNA, 22 nt, Human
gcaggaugggagcuucacuuug

SEQ ID NO: 1010093 - RNA, 22 nt, Human
uugaaagugccaaguccuagug

SEQ ID NO: 1010094 - RNA, 22 nt, Human
cuucccuuggugaacagagcau

SEQ ID NO: 1010095 - RNA, 22 nt, Human
ggcaugggagugagcaaccuua

SEQ ID NO: 1010096 - RNA, 22 nt, Human
uguaugcuuuccaaaaaugcug

SEQ ID NO: 1010097 - RNA, 22 nt, Human
ccaccagcuuugccacccugcu

SEQ ID NO: 1010098 - RNA, 22 nt, Human
gagcuuaggccagggacaggga

SEQ ID NO: 1010099 - RNA, 22 nt, Human
ugcuuccugaggccgucuucuc

SEQ ID NO: 1010100 - RNA, 21 nt, Human
ggcagcccgcccucuccuggc

SEQ ID NO: 1010101 - RNA, 22 nt, Human
caggggacaguaugguggauga

SEQ ID NO: 1010102 - RNA, 22 nt, Human
guacauuuugagguuaaaacaa

SEQ ID NO: 1010103 - RNA, 22 nt, Human
uucugucaaauuugccauaugg

SEQ ID NO: 1010104 - RNA, 22 nt, Human
gucccaggcagagucaggaggg

SEQ ID NO: 1010105 - RNA, 22 nt, Human
guaucuuuugguggaaaaauaa

SEQ ID NO: 1010106 - RNA, 22 nt, Human
uaucuguuaugggcugaauugc

SEQ ID NO: 1010107 - RNA, 21 nt, Human
ucuccaguauccuucucugag

SEQ ID NO: 1010108 - RNA, 22 nt, Human
auaguauuuaauaguuagcuca

SEQ ID NO: 1010109 - RNA, 19 nt, Human
gcaggguguugacuguccc

SEQ ID NO: 1010110 - RNA, 22 nt, Human
gccuggcugcuagccagaggca

SEQ ID NO: 1010111 - RNA, 18 nt, Human
uccucucuuuccccaggg

SEQ ID NO: 1010112 - RNA, 22 nt, Human
ggccagaggccacagcuguguc

SEQ ID NO: 1010113 - RNA, 18 nt, Human
ccuggcuuccaucuuggu

SEQ ID NO: 1010114 - RNA, 22 nt, Human
ugcauuuccagauuucuggagu

SEQ ID NO: 1010115 - RNA, 22 nt, Human
gucaggauuuuaaaaucccagu

SEQ ID NO: 1010116 - RNA, 22 nt, Human
aauuucagaacccaaauuagcg

SEQ ID NO: 1010117 - RNA, 22 nt, Human
ugucugguggguugacaggcag

SEQ ID NO: 1010118 - RNA, 22 nt, Human
uaaauucagugaguaauuucug

SEQ ID NO: 1010119 - RNA, 19 nt, Human
gggcagaauggcaucucag

SEQ ID NO: 1010120 - RNA, 22 nt, Human
aggcccaguuauccuacuuguu

SEQ ID NO: 1010121 - RNA, 22 nt, Human
acauagcuuaaaugagaagaua

SEQ ID NO: 1010122 - RNA, 22 nt, Human
cacacaugagucuccccauugg

SEQ ID NO: 1010123 - RNA, 22 nt, Human
augcuauacucaaagaaauuca

SEQ ID NO: 1010124 - RNA, 22 nt, Human
cugggagauugaggccauggug

SEQ ID NO: 1010125 - RNA, 22 nt, Human
ucaugacaucuguuuaucucaa

SEQ ID NO: 1010126 - RNA, 22 nt, Human
uuagcaucugcuguaagcuuau

SEQ ID NO: 1010127 - RNA, 22 nt, Human
cucuuaguuuaucuuugacaaa

SEQ ID NO: 1010128 - RNA, 22 nt, Human
uauaagaaacaaggcaaauuuu

SEQ ID NO: 1010129 - RNA, 22 nt, Human
ugcagagguuuccaggcaaguu

SEQ ID NO: 1010130 - RNA, 22 nt, Human
ccucuggucccagcucugcugc

SEQ ID NO: 1010131 - RNA, 22 nt, Human
ggcacugaauuucuuggcaucu

SEQ ID NO: 1010132 - RNA, 22 nt, Human
ccuggugcuuaccagagcuuuu

SEQ ID NO: 1010133 - RNA, 21 nt, Human
uguaugcacgcacaugcacac

SEQ ID NO: 1010134 - RNA, 17 nt, Human
ucaggcugggugcagug

SEQ ID NO: 1010135 - RNA, 22 nt, Human
gguggguauaguuagggccucu

SEQ ID NO: 1010136 - RNA, 22 nt, Human
gccagccugugggggcucugug

SEQ ID NO: 1010137 - RNA, 22 nt, Human
caugauuuugucuuguguuaau

SEQ ID NO: 1010138 - RNA, 22 nt, Human
guuugcauguauuaagucaaua

SEQ ID NO: 1010139 - RNA, 17 nt, Human
agcuccugcccauggcu

SEQ ID NO: 1010140 - RNA, 22 nt, Human
cugcuguguuucacaccucugg

SEQ ID NO: 1010141 - RNA, 22 nt, Human
ggucucagcaguugcuuugacu

SEQ ID NO: 1010142 - RNA, 22 nt, Human
uagaauucauguuacuguuagc

SEQ ID NO: 1010143 - RNA, 22 nt, Human
ccagcuggaagagugcagaacu

SEQ ID NO: 1010144 - RNA, 22 nt, Human
ucagaggacaagcucccuggug

SEQ ID NO: 1010145 - RNA, 22 nt, Human
uuugaagucagacacugcuuug

SEQ ID NO: 1010146 - RNA, 23 nt, Human
agccuucaggcaaugucaguaga

SEQ ID NO: 1010147 - RNA, 23 nt, Human
uggcuucugccccauucucucca

SEQ ID NO: 1010148 - RNA, 22 nt, Human
ggcugggagcuggacaggccgg

SEQ ID NO: 1010149 - RNA, 19 nt, Human
agagaggcugugugaggga

SEQ ID NO: 1010150 - RNA, 22 nt, Human
aauaaauguuaagauugucuca

SEQ ID NO: 1010151 - RNA, 22 nt, Human
agguacagggugaaaguuuaug

SEQ ID NO: 1010152 - RNA, 22 nt, Human
auguagaacagguuaaugacag

SEQ ID NO: 1010153 - RNA, 22 nt, Human
uguguccauucaggcacugacc

SEQ ID NO: 1010154 - RNA, 22 nt, Human
cucccaagcugugcugaacugu

SEQ ID NO: 1010155 - RNA, 22 nt, Human
gggacuguaaauucauauggcc

SEQ ID NO: 1010156 - RNA, 22 nt, Human
gagaggggcgcgcagcucgcga

SEQ ID NO: 1010157 - RNA, 20 nt, Human
uucuuaaagaccucacuuug

SEQ ID NO: 1010158 - RNA, 22 nt, Human
ugggcugcugucugcacaugcu

SEQ ID NO: 1010159 - RNA, 22 nt, Human
caggaggaggugagguagaacu

SEQ ID NO: 1010160 - RNA, 22 nt, Human
guccuggcuuaguucgcuguaa

SEQ ID NO: 1010161 - RNA, 22 nt, Human
gggcaugguggcaggcaccugu

SEQ ID NO: 1010162 - RNA, 22 nt, Human
aagcuguucucuaaguuucaug

SEQ ID NO: 1010163 - RNA, 22 nt, Human
uggacucagaaguguucuuuua

SEQ ID NO: 1010164 - RNA, 22 nt, Human
uggccagguguggguucucaga

SEQ ID NO: 1010165 - RNA, 22 nt, Human
gcuguccugggaacaggcacua

SEQ ID NO: 1010166 - RNA, 22 nt, Human
agagcaggcauaaagcuuugaa

SEQ ID NO: 1010167 - RNA, 22 nt, Human
aggauccugcgcuuugggggag

SEQ ID NO: 1010168 - RNA, 22 nt, Human
aguggcagagccaaguagagcc

SEQ ID NO: 1010169 - RNA, 22 nt, Human
cccagacauaacagcagagagg

SEQ ID NO: 1010170 - RNA, 22 nt, Human
cuuccugaacaaugccaucaau

SEQ ID NO: 1010171 - RNA, 22 nt, Human
gcuggcccagggucaccuagga

SEQ ID NO: 1010172 - RNA, 17 nt, Human
aguguuuccuuaucauu

SEQ ID NO: 1010173 - RNA, 22 nt, Human
agccaaggacacggagccuccu

SEQ ID NO: 1010174 - RNA, 22 nt, Human
aggcacugauucuguuuuccau

SEQ ID NO: 1010175 - RNA, 22 nt, Human
gcuggcaccugcaccaagcagg

SEQ ID NO: 1010176 - RNA, 19 nt, Human
ugccuggacaaaugugggg

SEQ ID NO: 1010177 - RNA, 22 nt, Human
gcagggcuaauggggcaaguag

SEQ ID NO: 1010178 - RNA, 22 nt, Human
aucaggaucagggcuagcagag

SEQ ID NO: 1010179 - RNA, 17 nt, Human
gcaaucucagucuccuu

SEQ ID NO: 1010180 - RNA, 22 nt, Human
caggcagcugacugucagauau

SEQ ID NO: 1010181 - RNA, 20 nt, Human
ucagugauuaucucugagug

SEQ ID NO: 1010182 - RNA, 22 nt, Human
ucuugggaucucuucaccaccu

SEQ ID NO: 1010183 - RNA, 22 nt, Human
uguuuaaucuauaaaauggaga

SEQ ID NO: 1010184 - RNA, 22 nt, Human
ccuggagccccucuggccagcc

SEQ ID NO: 1010185 - RNA, 22 nt, Human
ugcauccuuaaccagcaucacu

SEQ ID NO: 1010186 - RNA, 22 nt, Human
ggcuucugagugcucugcuguu

SEQ ID NO: 1010187 - RNA, 22 nt, Human
ccugugugucugucacugcaca

SEQ ID NO: 1010188 - RNA, 22 nt, Human
uaugacaagguggaguaugagu

SEQ ID NO: 1010189 - RNA, 22 nt, Human
auaagguaugaaaaguaaaugg

SEQ ID NO: 1010190 - RNA, 18 nt, Human
cauuguacaaugcuuuau

SEQ ID NO: 1010191 - RNA, 22 nt, Human
aucuggcuuaccuagggugccu

SEQ ID NO: 1010192 - RNA, 22 nt, Human
aggucacacaacugucagaggc

SEQ ID NO: 1010193 - RNA, 22 nt, Human
gcagggcuauuggaaggagaug

SEQ ID NO: 1010194 - RNA, 22 nt, Human
ugcagggaggccccgcagcccu

SEQ ID NO: 1010195 - RNA, 22 nt, Human
aucaguuucugugaagaacaca

SEQ ID NO: 1010196 - RNA, 22 nt, Human
uggcucucagcucccagcagcc

SEQ ID NO: 1010197 - RNA, 22 nt, Human
agaaaaaucuuggcgcuugucu

SEQ ID NO: 1010198 - RNA, 22 nt, Human
aagagcuguaugccauaugauu

SEQ ID NO: 1010199 - RNA, 22 nt, Human
ucaggagcagcaugggugagag

SEQ ID NO: 1010200 - RNA, 22 nt, Human
aaaucaaaagacauguguuuua

SEQ ID NO: 1010201 - RNA, 22 nt, Human
uaauuucuggagggagaaagag

SEQ ID NO: 1010202 - RNA, 22 nt, Human
ucucuuaaaagauuuuaaugac

SEQ ID NO: 1010203 - RNA, 20 nt, Human
uuucacagucccuguuuccu

SEQ ID NO: 1010204 - RNA, 19 nt, Human
ggaccagguccugggcagc

SEQ ID NO: 1010205 - RNA, 22 nt, Human
uuucugcugugcuuucuugcgu

SEQ ID NO: 1010206 - RNA, 22 nt, Human
cacaggcugcccgcagcuggga

SEQ ID NO: 1010207 - RNA, 22 nt, Human
cccucagcuucucccugcagcu

SEQ ID NO: 1010208 - RNA, 22 nt, Human
ugaaauauuuagagaguaaguu

SEQ ID NO: 1010209 - RNA, 22 nt, Human
cuuuauuccuacaagauuuucu

SEQ ID NO: 1010210 - RNA, 22 nt, Human
auucugagacaauugccgucag

SEQ ID NO: 1010211 - RNA, 22 nt, Human
agcagaugagccucaugacugg

SEQ ID NO: 1010212 - RNA, 22 nt, Human
uauucauaguaaacaaaagugg

SEQ ID NO: 1010213 - RNA, 22 nt, Human
aagcugccagcugagcugaggc

SEQ ID NO: 1010214 - RNA, 22 nt, Human
aagauaaacucuugauuucuga

SEQ ID NO: 1010215 - RNA, 23 nt, Human
uggcccugugcaugcugcuuccc

SEQ ID NO: 1010216 - RNA, 22 nt, Human
uucuucuugucugcccucacau

SEQ ID NO: 1010217 - RNA, 22 nt, Human
agguacaguagacagacaguua

SEQ ID NO: 1010218 - RNA, 22 nt, Human
ugauuuccaguugcugggugcu

SEQ ID NO: 1010219 - RNA, 22 nt, Human
uaggggugaggccaggcaucag

SEQ ID NO: 1010220 - RNA, 22 nt, Human
agugcuuugaacgaaaggcuga

SEQ ID NO: 1010221 - RNA, 19 nt, Human
uaucuguuuccugcuuguc

SEQ ID NO: 1010222 - RNA, 22 nt, Human
uuggcagugucacuagggagcc

SEQ ID NO: 1010223 - RNA, 22 nt, Human
ugcuggggauccguaccaaccc

SEQ ID NO: 1010224 - RNA, 22 nt, Human
aauguaugggugagaaaguuga

SEQ ID NO: 1010225 - RNA, 22 nt, Human
cugggcacuugcucacagcucu

SEQ ID NO: 1010226 - RNA, 22 nt, Human
cguggccuuugagugagcuccc

SEQ ID NO: 1010227 - RNA, 22 nt, Human
guguuuccaguucagaaagcaa

SEQ ID NO: 1010228 - RNA, 22 nt, Human
uccugcagaccucagucagguc

SEQ ID NO: 1010229 - RNA, 22 nt, Human
cuuaauuuaaaauaguucaggc

SEQ ID NO: 1010230 - RNA, 22 nt, Human
guccaugauucuguguaguaga

SEQ ID NO: 1010231 - RNA, 22 nt, Human
aaaaaucuaugacugcuucucc

SEQ ID NO: 1010232 - RNA, 22 nt, Human
agccucucuuuauucccagcua

SEQ ID NO: 1010233 - RNA, 22 nt, Human
aauggccagcugggagaguuga

SEQ ID NO: 1010234 - RNA, 22 nt, Human
cccuuggggaugcugugucugg

SEQ ID NO: 1010235 - RNA, 22 nt, Human
acuguguguuugucuagcacag

SEQ ID NO: 1010236 - RNA, 22 nt, Human
uaugaacuagcugauuuaguuu

SEQ ID NO: 1010237 - RNA, 22 nt, Human
cagcuuucaucagugacacuca

SEQ ID NO: 1010238 - RNA, 19 nt, Human
uggcagggagaguuugaag

SEQ ID NO: 1010239 - RNA, 22 nt, Human
ggcuuccuuucacuacccucag

SEQ ID NO: 1010240 - RNA, 22 nt, Human
ggagccuguuaguugagugcuc

SEQ ID NO: 1010241 - RNA, 22 nt, Human
augcuguagaucuuagccucua

SEQ ID NO: 1010242 - RNA, 22 nt, Human
gggugggccacugagcagcgug

SEQ ID NO: 1010243 - RNA, 22 nt, Human
aacagaacccgagugugaaucu

SEQ ID NO: 1010244 - RNA, 22 nt, Human
aucaguuuuguucacuacuaua

SEQ ID NO: 1010245 - RNA, 22 nt, Human
uaagaaauuuaguuauagaaug

SEQ ID NO: 1010246 - RNA, 22 nt, Human
guuauguaucuugauugggugg

SEQ ID NO: 1010247 - RNA, 22 nt, Human
aucuggcucaccuggguaaaua

SEQ ID NO: 1010248 - RNA, 22 nt, Human
aguucuuuugugaacauaugcu

SEQ ID NO: 1010249 - RNA, 22 nt, Human
ugcuauaaguagacauucaaca

SEQ ID NO: 1010250 - RNA, 22 nt, Human
aaaacucugcaguuaguuucua

SEQ ID NO: 1010251 - RNA, 22 nt, Human
aagggcuggaucucucugagca

SEQ ID NO: 1010252 - RNA, 22 nt, Human
ggcaggcugcuugggucauguc

SEQ ID NO: 1010253 - RNA, 21 nt, Human
aauuacagauggaauuacaga

SEQ ID NO: 1010254 - RNA, 22 nt, Human
ugauuuccuggcuuuggaguuc

SEQ ID NO: 1010255 - RNA, 22 nt, Human
uguaggaguccaaucaggagac

SEQ ID NO: 1010256 - RNA, 22 nt, Human
agggcacccucucugcaguacc

SEQ ID NO: 1010257 - RNA, 20 nt, Human
gccugcagagaaggucagag

SEQ ID NO: 1010258 - RNA, 22 nt, Human
ucucuuucuauaugugagucuu

SEQ ID NO: 1010259 - RNA, 22 nt, Human
ugaaaguuacaggaaaacagau

SEQ ID NO: 1010260 - RNA, 22 nt, Human
aggcucauucuugccucugagc

SEQ ID NO: 1010261 - RNA, 22 nt, Human
cagggcagggauguugcggcag

SEQ ID NO: 1010262 - RNA, 22 nt, Human
cugugcaagacuuacuuuaaua

SEQ ID NO: 1010263 - RNA, 22 nt, Human
aacagcuuugcuucuggagaca

SEQ ID NO: 1010264 - RNA, 22 nt, Human
gugcaguggcagauccuagcuc

SEQ ID NO: 1010265 - RNA, 22 nt, Human
ugggccugccccaggcuucagc

SEQ ID NO: 1010266 - RNA, 22 nt, Human
aggcugcagugcagguaggauu

SEQ ID NO: 1010267 - RNA, 22 nt, Human
cagaauaugacaagauuuuccu

SEQ ID NO: 1010268 - RNA, 22 nt, Human
ggcuuggaaauugcaggacaca

SEQ ID NO: 1010269 - RNA, 22 nt, Human
agugaggcuaauaggcaauggu

SEQ ID NO: 1010270 - RNA, 22 nt, Human
uagucuuuuuaauaaauaaugc

SEQ ID NO: 1010271 - RNA, 20 nt, Human
gucagugucuucaguaguga

SEQ ID NO: 1010272 - RNA, 21 nt, Human
uggcucuguucaauauaugga

SEQ ID NO: 1010273 - RNA, 22 nt, Human
aaagcagguugcaauuacagug

SEQ ID NO: 1010274 - RNA, 22 nt, Human
ucccagcagggccgaccagccu

SEQ ID NO: 1010275 - RNA, 22 nt, Human
cacaccagagguuaccugcaaa

SEQ ID NO: 1010276 - RNA, 22 nt, Human
uagagugguuaacaguuuagaa

SEQ ID NO: 1010277 - RNA, 22 nt, Human
ccugucuguaucgguucagagu

SEQ ID NO: 1010278 - RNA, 16 nt, Human
gagggcagaggcggaa

SEQ ID NO: 1010279 - RNA, 22 nt, Human
uccuuccucggggacccagauc

SEQ ID NO: 1010280 - RNA, 22 nt, Human
gucuugaucuccugaccuugug

SEQ ID NO: 1010281 - RNA, 22 nt, Human
ugugccagaaaauaugcugagg

SEQ ID NO: 1010282 - RNA, 22 nt, Human
uaaauucugaucaaguuccuuc

SEQ ID NO: 1010283 - RNA, 19 nt, Human
agggcugcucuggccuggg

SEQ ID NO: 1010284 - RNA, 22 nt, Human
cagugggcugugauggauucac

SEQ ID NO: 1010285 - RNA, 22 nt, Human
uuucuucagccuucacaaccug

SEQ ID NO: 1010286 - RNA, 23 nt, Human
uggcagcagaucuuaaagugacc

SEQ ID NO: 1010287 - RNA, 22 nt, Human
ccaugcaauuucuguaaaacca

SEQ ID NO: 1010288 - RNA, 22 nt, Human
uuauuccagcuaagaguccugg

SEQ ID NO: 1010289 - RNA, 22 nt, Human
cacacuagucuauccauuagcu

SEQ ID NO: 1010290 - RNA, 22 nt, Human
ugucucaguucccuucucugga

SEQ ID NO: 1010291 - RNA, 22 nt, Human
cugucaggggcggguggagcgg

SEQ ID NO: 1010292 - RNA, 22 nt, Human
cugggagucuggccucuggucc

SEQ ID NO: 1010293 - RNA, 22 nt, Human
guauuaggugguggaauuguag

SEQ ID NO: 1010294 - RNA, 19 nt, Human
agcaccugugagagccugg

SEQ ID NO: 1010295 - RNA, 22 nt, Human
aaggcagccgugugacugcaug

SEQ ID NO: 1010296 - RNA, 22 nt, Human
uggaaagaaaguaaaggcguau

SEQ ID NO: 1010297 - RNA, 22 nt, Human
ugucucaggcccaagccaguaa

SEQ ID NO: 1010298 - RNA, 22 nt, Human
caggagcccagaguccucagcu

SEQ ID NO: 1010299 - RNA, 22 nt, Human
ccuggcaggcuggggacagugc

SEQ ID NO: 1010300 - RNA, 22 nt, Human
caggaugaagggcaaaggcaag

SEQ ID NO: 1010301 - RNA, 22 nt, Human
uuugcaaauaccaugaaacuug

SEQ ID NO: 1010302 - RNA, 22 nt, Human
ucuggucaguaauaagaagugg

SEQ ID NO: 1010303 - RNA, 22 nt, Human
cagucuggaggucagcuggcuu

SEQ ID NO: 1010304 - RNA, 22 nt, Human
agaauucuuggugguuagaaua

SEQ ID NO: 1010305 - RNA, 22 nt, Human
gcuggcuuugcacugggugcau

SEQ ID NO: 1010306 - RNA, 22 nt, Human
agaauuuuugauuaucuacucg

SEQ ID NO: 1010307 - RNA, 22 nt, Human
uguggccuugcagccuggaggu

SEQ ID NO: 1010308 - RNA, 22 nt, Human
ccugccagggccuuggaagaaa

SEQ ID NO: 1010309 - RNA, 22 nt, Human
uaggcagcugcaaacuucgguc

SEQ ID NO: 1010310 - RNA, 22 nt, Human
aaaggcuccuucucccaugacc

SEQ ID NO: 1010311 - RNA, 22 nt, Human
agcagugaugcaugacagccua

SEQ ID NO: 1010312 - RNA, 22 nt, Human
cagcugccaagaaucuuuucua

SEQ ID NO: 1010313 - RNA, 22 nt, Human
uucuacagacuauaacugugau

SEQ ID NO: 1010314 - RNA, 22 nt, Human
gcugccacgaucucugcuguag

SEQ ID NO: 1010315 - RNA, 22 nt, Human
ccaaggcuggagugcaguggcg

SEQ ID NO: 1010316 - RNA, 22 nt, Human
ucaguuuuucuauacuuuguag

SEQ ID NO: 1010317 - RNA, 22 nt, Human
uuagaaagcuuuccauagucaa

SEQ ID NO: 1010318 - RNA, 22 nt, Human
caguuauuaugaggucauuagg

SEQ ID NO: 1010319 - RNA, 22 nt, Human
ggugccagccuagugcaguggu

SEQ ID NO: 1010320 - RNA, 22 nt, Human
cuggccugaggccgccuucaga

SEQ ID NO: 1010321 - RNA, 22 nt, Human
gaugccucuuuuggcugaauua

SEQ ID NO: 1010322 - RNA, 22 nt, Human
ugggccuggaguuuguccagag

SEQ ID NO: 1010323 - RNA, 22 nt, Human
agcaccugcuaugugucaggga

SEQ ID NO: 1010324 - RNA, 23 nt, Human
aguuuuucugcaugguucuguau

SEQ ID NO: 1010325 - RNA, 22 nt, Human
aggcugcuuccuuacguggcug

SEQ ID NO: 1010326 - RNA, 22 nt, Human
ccaguccagugccaugcauggc

SEQ ID NO: 1010327 - RNA, 22 nt, Human
acagcauugcuccaucucaaga

SEQ ID NO: 1010328 - RNA, 22 nt, Human
agcugacucuggccucuggucc

SEQ ID NO: 1010329 - RNA, 20 nt, Human
agauuauuccuaagauuucu

SEQ ID NO: 1010330 - RNA, 22 nt, Human
uugggcucaggaguuugagacc

SEQ ID NO: 1010331 - RNA, 22 nt, Human
ucagaguggugguuuugccuuc

SEQ ID NO: 1010332 - RNA, 22 nt, Human
ugcagucuggauguccucagau

SEQ ID NO: 1010333 - RNA, 22 nt, Human
ggagcagagcauuucacagccu

SEQ ID NO: 1010334 - RNA, 22 nt, Human
cccuucccuucugggagaucca

SEQ ID NO: 1010335 - RNA, 22 nt, Human
agcuggccuuagugagcaccug

SEQ ID NO: 1010336 - RNA, 22 nt, Human
cagugggaagggcagaggcuuu

SEQ ID NO: 1010337 - RNA, 22 nt, Human
uguguuccugccuggcucuggu

SEQ ID NO: 1010338 - RNA, 22 nt, Human
cucccagagaccaagcugagaa

SEQ ID NO: 1010339 - RNA, 22 nt, Human
guaagcaucugucucuucugca

SEQ ID NO: 1010340 - RNA, 22 nt, Human
gccuucaggaggguuccagaca

SEQ ID NO: 1010341 - RNA, 22 nt, Human
cugaagccaugugcucacuggu

SEQ ID NO: 1010342 - RNA, 22 nt, Human
cagagagcaugggaggcccgag

SEQ ID NO: 1010343 - RNA, 22 nt, Human
aagagcauggaauggagaucca

SEQ ID NO: 1010344 - RNA, 22 nt, Human
uccaggagguagugcuuaauuu

SEQ ID NO: 1010345 - RNA, 21 nt, Human
ugcagagauaucugaagcaga

SEQ ID NO: 1010346 - RNA, 22 nt, Human
cuucuuaacuguauauacuaug

SEQ ID NO: 1010347 - RNA, 20 nt, Human
guggccucucacauucugag

SEQ ID NO: 1010348 - RNA, 22 nt, Human
gaugggggccagggccugcuuu

SEQ ID NO: 1010349 - RNA, 22 nt, Human
uaaagucaucuuuacaucuuug

SEQ ID NO: 1010350 - RNA, 22 nt, Human
ccagcuggagccaagguggacu

SEQ ID NO: 1010351 - RNA, 19 nt, Human
gagcacagcggcauuuggu

SEQ ID NO: 1010352 - RNA, 22 nt, Human
cuccugaguaguagcauuguca

SEQ ID NO: 1010353 - RNA, 22 nt, Human
aauguauguguauaucaaauca

SEQ ID NO: 1010354 - RNA, 22 nt, Human
auauauuugagaauauucauga

SEQ ID NO: 1010355 - RNA, 22 nt, Human
cucucagacugaagggccugug

SEQ ID NO: 1010356 - RNA, 22 nt, Human
agauacaucuugaacuucuaga

SEQ ID NO: 1010357 - RNA, 22 nt, Human
acaaucauuccguucacaacag

SEQ ID NO: 1010358 - RNA, 22 nt, Human
gugggagcuuuggcaucaggcu

SEQ ID NO: 1010359 - RNA, 22 nt, Human
auucuucacaccuguuccuguu

SEQ ID NO: 1010360 - RNA, 20 nt, Human
cugggaggucuuccaaauca

SEQ ID NO: 1010361 - RNA, 23 nt, Human
agccucuuuucuccugcccugca

SEQ ID NO: 1010362 - RNA, 22 nt, Human
ccagacaggaacacacaucucc

SEQ ID NO: 1010363 - RNA, 22 nt, Human
ggcaguggguuccccaaggcac

SEQ ID NO: 1010364 - RNA, 22 nt, Human
ccagccacagcuuccagcuccu

SEQ ID NO: 1010365 - RNA, 22 nt, Human
ugccagugggugugcagagacu

SEQ ID NO: 1010366 - RNA, 22 nt, Human
agaggcaguauacaauccgagc

SEQ ID NO: 1010367 - RNA, 19 nt, Human
uucacaauuaugaaauuag

SEQ ID NO: 1010368 - RNA, 22 nt, Human
acagccagguaaaggcauggca

SEQ ID NO: 1010369 - RNA, 22 nt, Human
caaggccaaagggccacuguca

SEQ ID NO: 1010370 - RNA, 22 nt, Human
aaaggugacacucugccagcug

SEQ ID NO: 1010371 - RNA, 20 nt, Human
agacaggagcccccauucag

SEQ ID NO: 1010372 - RNA, 23 nt, Human
ucagagaggcccccugcagagau

SEQ ID NO: 1010373 - RNA, 22 nt, Human
caucaucaaaacaaauggaguc

SEQ ID NO: 1010374 - RNA, 22 nt, Human
gucauuguguggacauggagaa

SEQ ID NO: 1010375 - RNA, 22 nt, Human
uuucucuugcgauaugcuacac

SEQ ID NO: 1010376 - RNA, 22 nt, Human
aaaugcauuuuuaauuagaccc

SEQ ID NO: 1010377 - RNA, 22 nt, Human
ggccugcuauuggugggcagac

SEQ ID NO: 1010378 - RNA, 22 nt, Human
cuggguggaucgcagccccagg

SEQ ID NO: 1010379 - RNA, 22 nt, Human
cucuggagcauuucaccuacau

SEQ ID NO: 1010380 - RNA, 22 nt, Human
ugcagcugcuugauucaucuug

SEQ ID NO: 1010381 - RNA, 22 nt, Human
agggcuccuaugccccauggac

SEQ ID NO: 1010382 - RNA, 22 nt, Human
gagggcugcaaugagacagaga

SEQ ID NO: 1010383 - RNA, 22 nt, Human
gagauauguuagaaagcuauug

SEQ ID NO: 1010384 - RNA, 22 nt, Human
ggcugagggccagggcuagucu

SEQ ID NO: 1010385 - RNA, 22 nt, Human
uggcucaggguccccaaauggu

SEQ ID NO: 1010386 - RNA, 22 nt, Human
uguuagaauauuguaauauucg

SEQ ID NO: 1010387 - RNA, 22 nt, Human
guuagggagggugcauaugugu

SEQ ID NO: 1010388 - RNA, 22 nt, Human
uuugcauuugcaaauaaugaaa

SEQ ID NO: 1010389 - RNA, 20 nt, Human
gaggccucagccucagcucc

SEQ ID NO: 1010390 - RNA, 22 nt, Human
agauaauuugaguaaauuaauu

SEQ ID NO: 1010391 - RNA, 22 nt, Human
ccaggcaggcgauggugcagug

SEQ ID NO: 1010392 - RNA, 22 nt, Human
auugucugaauccaaagcucug

SEQ ID NO: 1010393 - RNA, 22 nt, Human
gagccagcagccggcaccacca

SEQ ID NO: 1010394 - RNA, 22 nt, Human
cacaggguuguucugaggauuc

SEQ ID NO: 1010395 - RNA, 22 nt, Human
ucucugggauaaacugggccag

SEQ ID NO: 1010396 - RNA, 22 nt, Human
gucaggaucaaauugaaguuau

SEQ ID NO: 1010397 - RNA, 22 nt, Human
caccagcuacagacuacugugu

SEQ ID NO: 1010398 - RNA, 22 nt, Human
ccagggcaauaggaacacuuuu

SEQ ID NO: 1010399 - RNA, 22 nt, Human
aguggcaggcggagauguagga

SEQ ID NO: 1010400 - RNA, 22 nt, Human
ugcaggcuuuagccccauggcu

SEQ ID NO: 1010401 - RNA, 21 nt, Human
ggcagccugacccccagagag

SEQ ID NO: 1010402 - RNA, 22 nt, Human
gccuggcucugagggagcuccu

SEQ ID NO: 1010403 - RNA, 22 nt, Human
cgccuggaaccucuaggaccag

SEQ ID NO: 1010404 - RNA, 22 nt, Human
ggugaggcagguggcugcugag

SEQ ID NO: 1010405 - RNA, 22 nt, Human
uggcuggcccugggagugcaga

SEQ ID NO: 1010406 - RNA, 20 nt, Human
uccaguuuuggagacauucu

SEQ ID NO: 1010407 - RNA, 22 nt, Human
cccuggggcugagggauggccg

SEQ ID NO: 1010408 - RNA, 22 nt, Human
ucagggacagggugcugcugcg

SEQ ID NO: 1010409 - RNA, 22 nt, Human
ccuggcugugcauugccggccc

SEQ ID NO: 1010410 - RNA, 21 nt, Human
uuuagggaggauauuuaacuu

SEQ ID NO: 1010411 - RNA, 22 nt, Human
uggcagucauuaucgcugaguc

SEQ ID NO: 1010412 - RNA, 22 nt, Human
caguagcacuagauaugugugg

SEQ ID NO: 1010413 - RNA, 22 nt, Human
ggagaugguggaagcuggugca

SEQ ID NO: 1010414 - RNA, 22 nt, Human
gagcugggacauggguccucuc

SEQ ID NO: 1010415 - RNA, 22 nt, Human
caaggccagagccagcgauaag

SEQ ID NO: 1010416 - RNA, 23 nt, Human
ucucagaggauuccugggccuug

SEQ ID NO: 1010417 - RNA, 19 nt, Human
gaaggagagcugaguuagg

SEQ ID NO: 1010418 - RNA, 22 nt, Human
cugagcugggaguggauagugg

SEQ ID NO: 1010419 - RNA, 22 nt, Human
acucaggaauggggcugggacu

SEQ ID NO: 1010420 - RNA, 22 nt, Human
uguacuaaggcuguguagaugu

SEQ ID NO: 1010421 - RNA, 22 nt, Human
cugggcugcaggaguggggcaa

SEQ ID NO: 1010422 - RNA, 22 nt, Human
cagagguagccgagugcaaucg

SEQ ID NO: 1010423 - RNA, 21 nt, Human
cugaggcagcacagcuaguca

SEQ ID NO: 1010424 - RNA, 22 nt, Human
aaacacagggauauauauucca

SEQ ID NO: 1010425 - RNA, 22 nt, Human
ucucuucuaauuuucccgagua

SEQ ID NO: 1010426 - RNA, 22 nt, Human
gcagcuggggaggucgugggga

SEQ ID NO: 1010427 - RNA, 22 nt, Human
gagcagugagugaauguugccu

SEQ ID NO: 1010428 - RNA, 22 nt, Human
acauauuuccaugcagcauguc

SEQ ID NO: 1010429 - RNA, 22 nt, Human
auauguguauuugguuagccua

SEQ ID NO: 1010430 - RNA, 20 nt, Human
ugaugguucuuuccggguug

SEQ ID NO: 1010431 - RNA, 22 nt, Human
aagaacaguugggaggugagcc

SEQ ID NO: 1010432 - RNA, 22 nt, Human
gcuggcuguguuccuucugcca

SEQ ID NO: 1010433 - RNA, 22 nt, Human
ccagcuuucauaucaugaggua

SEQ ID NO: 1010434 - RNA, 22 nt, Human
auuauauugaguauaaccagag

SEQ ID NO: 1010435 - RNA, 22 nt, Human
cuauuucugccuaaugaccugu

SEQ ID NO: 1010436 - RNA, 22 nt, Human
ucugccugagggagcugaggaa

SEQ ID NO: 1010437 - RNA, 22 nt, Human
ucacugcaaccucugccuuccg

SEQ ID NO: 1010438 - RNA, 22 nt, Human
aaggucauuuaacaauuuauga

SEQ ID NO: 1010439 - RNA, 22 nt, Human
gauuucaagcccccagagauuc

SEQ ID NO: 1010440 - RNA, 22 nt, Human
ugugauauuugaguauugucaa

SEQ ID NO: 1010441 - RNA, 22 nt, Human
ugcccagggauaagccuagaga

SEQ ID NO: 1010442 - RNA, 22 nt, Human
uuucuuaggcucuaaaaugacu

SEQ ID NO: 1010443 - RNA, 22 nt, Human
ucacugaauacuugucucaucc

SEQ ID NO: 1010444 - RNA, 22 nt, Human
gugauaaagacgugucauaauu

SEQ ID NO: 1010445 - RNA, 22 nt, Human
uccaggcaucccccaggacaga

SEQ ID NO: 1010446 - RNA, 19 nt, Human
ccagcccugucacuucuug

SEQ ID NO: 1010447 - RNA, 22 nt, Human
uaacagaaauagaaaugagagu

SEQ ID NO: 1010448 - RNA, 23 nt, Human
agcaauaagaagggauacaugug

SEQ ID NO: 1010449 - RNA, 22 nt, Human
uccugcaggggcugaggaacca

SEQ ID NO: 1010450 - RNA, 22 nt, Human
ggggacaguuaaagaccaagac

SEQ ID NO: 1010451 - RNA, 22 nt, Human
gucacuguauccagguuccagc

SEQ ID NO: 1010452 - RNA, 22 nt, Human
uuugcacuagcauuuguccaug

SEQ ID NO: 1010453 - RNA, 22 nt, Human
aucaggauccaccuugagccug

SEQ ID NO: 1010454 - RNA, 21 nt, Human
aggcucagcagguguauaaag

SEQ ID NO: 1010455 - RNA, 22 nt, Human
cugccucaugcugccugcagcc

SEQ ID NO: 1010456 - RNA, 22 nt, Human
gagccaggcaccuucuguguug

SEQ ID NO: 1010457 - RNA, 22 nt, Human
uuguacaaaggauuuggaagag

SEQ ID NO: 1010458 - RNA, 22 nt, Human
gcagugcuuuagucuguccuuu

SEQ ID NO: 1010459 - RNA, 22 nt, Human
gcugagugagguccagagcuug

SEQ ID NO: 1010460 - RNA, 22 nt, Human
gcugggcugagcuagacuuggc

SEQ ID NO: 1010461 - RNA, 22 nt, Human
aaacucuguagcuaaacauaau

SEQ ID NO: 1010462 - RNA, 22 nt, Human
uggcaggguuggccaccuuacc

SEQ ID NO: 1010463 - RNA, 22 nt, Human
uccuuggcaugccgucuucucc

SEQ ID NO: 1010464 - RNA, 22 nt, Human
uucuugaaucacuuuagagaua

SEQ ID NO: 1010465 - RNA, 22 nt, Human
cuugcuucauuagugucuuagu

SEQ ID NO: 1010466 - RNA, 22 nt, Human
ugucucuggcccaugagcagag

SEQ ID NO: 1010467 - RNA, 22 nt, Human
gucccagagagcacuaguccau

SEQ ID NO: 1010468 - RNA, 22 nt, Human
cuguuauuucugccaggugagu

SEQ ID NO: 1010469 - RNA, 22 nt, Human
uuuucauuguuacuaugagcua

SEQ ID NO: 1010470 - RNA, 22 nt, Human
aagagcuggucacagguccauu

SEQ ID NO: 1010471 - RNA, 22 nt, Human
uagcagggucucaggagucagg

SEQ ID NO: 1010472 - RNA, 22 nt, Human
ccaggaguuggagguugcagug

SEQ ID NO: 1010473 - RNA, 21 nt, Human
gggugcuguggucaugcagga

SEQ ID NO: 1010474 - RNA, 22 nt, Human
agcucugggccaggaacccuaa

SEQ ID NO: 1010475 - RNA, 22 nt, Human
uauuccaagcacagcaacccag

SEQ ID NO: 1010476 - RNA, 20 nt, Human
ucccucaggucauugggcug

SEQ ID NO: 1010477 - RNA, 22 nt, Human
ucaggagaaucagggcuguccu

SEQ ID NO: 1010478 - RNA, 22 nt, Human
gccccugggagcagagccacca

SEQ ID NO: 1010479 - RNA, 22 nt, Human
caggcuugauuauucagacaau

SEQ ID NO: 1010480 - RNA, 22 nt, Human
aggcacugcagauuacaggcgc

SEQ ID NO: 1010481 - RNA, 22 nt, Human
uccagggagauggcagaggcug

SEQ ID NO: 1010482 - RNA, 22 nt, Human
ugaggcaguucuuacuuguauu

SEQ ID NO: 1010483 - RNA, 22 nt, Human
ccagcuuucucagaggcuucua

SEQ ID NO: 1010484 - RNA, 22 nt, Human
agagacaccgcgcaucauggcu

SEQ ID NO: 1010485 - RNA, 22 nt, Human
agugaaauuuguuuagauaggu

SEQ ID NO: 1010486 - RNA, 22 nt, Human
acucacauuucaucaggccaag

SEQ ID NO: 1010487 - RNA, 22 nt, Human
cagggguguuuuuggccaggag

SEQ ID NO: 1010488 - RNA, 22 nt, Human
ggcaggugugagaucgaggcca

SEQ ID NO: 1010489 - RNA, 22 nt, Human
cccuggagucagguuggccugg

SEQ ID NO: 1010490 - RNA, 22 nt, Human
gccuggagggucccucucugga

SEQ ID NO: 1010491 - RNA, 22 nt, Human
uuacaguauuguuaaacucuuu

SEQ ID NO: 1010492 - RNA, 22 nt, Human
uccugccucaggcucuggagua

SEQ ID NO: 1010493 - RNA, 22 nt, Human
uaauuucaccguugcuagaaau

SEQ ID NO: 1010494 - RNA, 22 nt, Human
uacagcuaggcaaaaaugacau

SEQ ID NO: 1010495 - RNA, 22 nt, Human
cugggcacaaguggcccuggau

SEQ ID NO: 1010496 - RNA, 22 nt, Human
aagaauguucuuguagucauga

SEQ ID NO: 1010497 - RNA, 19 nt, Human
cuccucagucccagagguc

SEQ ID NO: 1010498 - RNA, 22 nt, Human
uguuuauucauggcuaaugaaa

SEQ ID NO: 1010499 - RNA, 22 nt, Human
uggcuucugcuuucaguggagg

SEQ ID NO: 1010500 - RNA, 21 nt, Human
cugugcuuuuuaagugugaug

SEQ ID NO: 1010501 - RNA, 22 nt, Human
uggcagcacaagguggcccaug

SEQ ID NO: 1010502 - RNA, 22 nt, Human
guccacauaggaacccagcuuc

SEQ ID NO: 1010503 - RNA, 22 nt, Human
gcagugguccaguucacaccca

SEQ ID NO: 1010504 - RNA, 22 nt, Human
agagccaggcaggcaauguuga

SEQ ID NO: 1010505 - RNA, 22 nt, Human
caaaugcagauucaggaguucu

SEQ ID NO: 1010506 - RNA, 22 nt, Human
uaggcacuuggcguguuggaga

SEQ ID NO: 1010507 - RNA, 22 nt, Human
agggccuggugaccuggguccu

SEQ ID NO: 1010508 - RNA, 22 nt, Human
acuuguucauugaguacauaug

SEQ ID NO: 1010509 - RNA, 22 nt, Human
caggguggaaaagcuaguugga

SEQ ID NO: 1010510 - RNA, 22 nt, Human
cccugccuuguuggagccuaug

SEQ ID NO: 1010511 - RNA, 22 nt, Human
uagggcagauucgguggaguuu

SEQ ID NO: 1010512 - RNA, 22 nt, Human
auauacuuggagacuaucauug

SEQ ID NO: 1010513 - RNA, 22 nt, Human
cuuguacaggaauccaugguau

SEQ ID NO: 1010514 - RNA, 22 nt, Human
auucuguauggaaaagcacuau

SEQ ID NO: 1010515 - RNA, 22 nt, Human
ucaggcugaggucaucugcauc

SEQ ID NO: 1010516 - RNA, 22 nt, Human
ccuggcagguggagguugcagu

SEQ ID NO: 1010517 - RNA, 22 nt, Human
uagcuuuagaaauauucucaga

SEQ ID NO: 1010518 - RNA, 22 nt, Human
guacaaaguggaccugauagua

SEQ ID NO: 1010519 - RNA, 22 nt, Human
cugggccagggaggugucugua

SEQ ID NO: 1010520 - RNA, 22 nt, Human
uuucauaaccucaagcuacagu

SEQ ID NO: 1010521 - RNA, 20 nt, Human
aucugcuugccuguccucgg

SEQ ID NO: 1010522 - RNA, 22 nt, Human
uauuccuaagucccaacuacau

SEQ ID NO: 1010523 - RNA, 22 nt, Human
gggcaugguggugcacaccugu

SEQ ID NO: 1010524 - RNA, 22 nt, Human
agaggccaggcugcagagggau

SEQ ID NO: 1010525 - RNA, 22 nt, Human
gacccugccaugagugacaggg

SEQ ID NO: 1010526 - RNA, 22 nt, Human
uugaaucauuacaauagauaag

SEQ ID NO: 1010527 - RNA, 22 nt, Human
gcccagcagaucucagugucuc

SEQ ID NO: 1010528 - RNA, 22 nt, Human
uauggcauuuuguaagggcuug

SEQ ID NO: 1010529 - RNA, 22 nt, Human
cugagccagggccacacaugga

SEQ ID NO: 1010530 - RNA, 21 nt, Human
acauccaggguccucacugcc

SEQ ID NO: 1010531 - RNA, 22 nt, Human
cccuuagcuccaagggguuugg

SEQ ID NO: 1010532 - RNA, 22 nt, Human
ggccucugguucacagggagga

SEQ ID NO: 1010533 - RNA, 22 nt, Human
ucucagggccucccucuguuuc

SEQ ID NO: 1010534 - RNA, 22 nt, Human
uacauguaggugacauuuuaau

SEQ ID NO: 1010535 - RNA, 23 nt, Human
uggccucuccccaccuggcagaa

SEQ ID NO: 1010536 - RNA, 22 nt, Human
gcucuguguccacagcuggaaa

SEQ ID NO: 1010537 - RNA, 22 nt, Human
ugccuuccuggagcugaaggcu

SEQ ID NO: 1010538 - RNA, 22 nt, Human
cuggagccacugggucuuguau

SEQ ID NO: 1010539 - RNA, 22 nt, Human
uccacuuuagcaaugauugaau

SEQ ID NO: 1010540 - RNA, 22 nt, Human
uucacacacagcuuccuauugu

SEQ ID NO: 1010541 - RNA, 22 nt, Human
cugcagcuauauuuucccacag

SEQ ID NO: 1010542 - RNA, 22 nt, Human
cccagcacaggcaauuccauac

SEQ ID NO: 1010543 - RNA, 17 nt, Human
cucugcagugcauggcu

SEQ ID NO: 1010544 - RNA, 21 nt, Human
cucaggaucuuauauauuagu

SEQ ID NO: 1010545 - RNA, 22 nt, Human
uauccaauucaccauugauggg

SEQ ID NO: 1010546 - RNA, 22 nt, Human
aaaguuacuaucacaaugaaau

SEQ ID NO: 1010547 - RNA, 22 nt, Human
aagauauucaaagauuuauuag

SEQ ID NO: 1010548 - RNA, 22 nt, Human
uauaauccauucauugauuucu

SEQ ID NO: 1010549 - RNA, 22 nt, Human
ggggcacuuccaggcugaggcu

SEQ ID NO: 1010550 - RNA, 22 nt, Human
ccccaggacacauggaccaagu

SEQ ID NO: 1010551 - RNA, 22 nt, Human
ggagauggcucugcaaggucua

SEQ ID NO: 1010552 - RNA, 22 nt, Human
agccuggauucgugcauccaca

SEQ ID NO: 1010553 - RNA, 18 nt, Human
gagagcugcuaccuagcu

SEQ ID NO: 1010554 - RNA, 22 nt, Human
caaaugcaaaauauaacccugu

SEQ ID NO: 1010555 - RNA, 21 nt, Human
ucccagggccaggugccauca

SEQ ID NO: 1010556 - RNA, 22 nt, Human
ucuggcucaaaauacguacucu

SEQ ID NO: 1010557 - RNA, 23 nt, Human
ugccagaggcagucacaguggug

SEQ ID NO: 1010558 - RNA, 22 nt, Human
gcagcuuuagaaacaagggcug

SEQ ID NO: 1010559 - RNA, 22 nt, Human
aagguacagaaauuaacaagga

SEQ ID NO: 1010560 - RNA, 22 nt, Human
acugucugcaaaacucauacuc

SEQ ID NO: 1010561 - RNA, 22 nt, Human
uagaaacacagaucugguguca

SEQ ID NO: 1010562 - RNA, 22 nt, Human
agaauuguugggguaauaaaag

SEQ ID NO: 1010563 - RNA, 22 nt, Human
uaaguucauaagcuuauucuua

SEQ ID NO: 1010564 - RNA, 22 nt, Human
uagauuuuacuucugucauuac

SEQ ID NO: 1010565 - RNA, 22 nt, Human
auuugcuucugugaaaucaagu

SEQ ID NO: 1010566 - RNA, 22 nt, Human
ucugucccugagagcucaggag

SEQ ID NO: 1010567 - RNA, 22 nt, Human
ugucucugcuuuccuugcaggg

SEQ ID NO: 1010568 - RNA, 22 nt, Human
agauguuccagccaaugggaau

SEQ ID NO: 1010569 - RNA, 19 nt, Human
aggguccagggagcggcuc

SEQ ID NO: 1010570 - RNA, 16 nt, Human
ugggcagaugagaaga

SEQ ID NO: 1010571 - RNA, 22 nt, Human
ugcauugcauuugucaugaaga

SEQ ID NO: 1010572 - RNA, 22 nt, Human
ccuuuauucaauuaguccuaau

SEQ ID NO: 1010573 - RNA, 20 nt, Human
agauggugaaggccagggag

SEQ ID NO: 1010574 - RNA, 22 nt, Human
gcagggacaacugugcaccuga

SEQ ID NO: 1010575 - RNA, 22 nt, Human
uccugcaguuacaucccagcca

SEQ ID NO: 1010576 - RNA, 22 nt, Human
cccaggaggcagagguugcagu

SEQ ID NO: 1010577 - RNA, 22 nt, Human
aggaccugcuaaugugccaagu

SEQ ID NO: 1010578 - RNA, 22 nt, Human
gcaguccucucauuggccuccu

SEQ ID NO: 1010579 - RNA, 22 nt, Human
ucuuugcaaaauacaacaaugg

SEQ ID NO: 1010580 - RNA, 22 nt, Human
uguaauggaagugggauugcau

SEQ ID NO: 1010581 - RNA, 22 nt, Human
caggcugucugaauggaggccc

SEQ ID NO: 1010582 - RNA, 19 nt, Human
uuugugaagaaaaugaugc

SEQ ID NO: 1010583 - RNA, 22 nt, Human
gcuggagcuugagaggacaggg

SEQ ID NO: 1010584 - RNA, 22 nt, Human
acuggcaguggcagcagaaaga

SEQ ID NO: 1010585 - RNA, 22 nt, Human
ugcaccauuuugucaggcuacu

SEQ ID NO: 1010586 - RNA, 22 nt, Human
agagcaucuaacacauaagccu

SEQ ID NO: 1010587 - RNA, 22 nt, Human
aggggccauuguucugcccgcu

SEQ ID NO: 1010588 - RNA, 22 nt, Human
uucaggauggaguaccuuuuau

SEQ ID NO: 1010589 - RNA, 22 nt, Human
cugcagugaaaucaggaagcaa

SEQ ID NO: 1010590 - RNA, 22 nt, Human
aaaagguaguugccaaauaagg

SEQ ID NO: 1010591 - RNA, 22 nt, Human
auacauuagcucauaugauuaa

SEQ ID NO: 1010592 - RNA, 22 nt, Human
gaauacaugauacaugaacugc

SEQ ID NO: 1010593 - RNA, 17 nt, Human
uguuuucauucauugcu

SEQ ID NO: 1010594 - RNA, 22 nt, Human
ccuggaaguuggagguugcagu

SEQ ID NO: 1010595 - RNA, 22 nt, Human
gcaaagucucaagacccaagug

SEQ ID NO: 1010596 - RNA, 22 nt, Human
aaugcaguuucauuuguagaau

SEQ ID NO: 1010597 - RNA, 22 nt, Human
aagauuuaccacuuuauucaag

SEQ ID NO: 1010598 - RNA, 22 nt, Human
auaugugaaguggguuauuuug

SEQ ID NO: 1010599 - RNA, 22 nt, Human
uucaagaugcacaguggcauuc

SEQ ID NO: 1010600 - RNA, 22 nt, Human
gucucagauaacauguauucua

SEQ ID NO: 1010601 - RNA, 22 nt, Human
auuuacagaagcauguaauagc

SEQ ID NO: 1010602 - RNA, 22 nt, Human
cagaaaaccugacucuagaacu

SEQ ID NO: 1010603 - RNA, 22 nt, Human
ggccaugguuggggaagacaug

SEQ ID NO: 1010604 - RNA, 17 nt, Human
agaugcuggccacaugu

SEQ ID NO: 1010605 - RNA, 22 nt, Human
ugugcauguauugauuuguacc

SEQ ID NO: 1010606 - RNA, 22 nt, Human
uggaggagggcuggugucugua

SEQ ID NO: 1010607 - RNA, 22 nt, Human
aggaccugaaauucuugcuuuu

SEQ ID NO: 1010608 - RNA, 22 nt, Human
cucagagaagucuuugcuaaac

SEQ ID NO: 1010609 - RNA, 22 nt, Human
gaggggcugcccuggugucagg

SEQ ID NO: 1010610 - RNA, 22 nt, Human
auucaaguucuucugucuuugc

SEQ ID NO: 1010611 - RNA, 22 nt, Human
cacucugcagcugaagggcugg

SEQ ID NO: 1010612 - RNA, 22 nt, Human
cagaggccccagaacuagcucu

SEQ ID NO: 1010613 - RNA, 22 nt, Human
ucauaaaugcagugucauaaau

SEQ ID NO: 1010614 - RNA, 21 nt, Human
gcugagagguugggaaguuca

SEQ ID NO: 1010615 - RNA, 22 nt, Human
ggauguugauugaauggccauu

SEQ ID NO: 1010616 - RNA, 22 nt, Human
caggagugaguuggggucuaca

SEQ ID NO: 1010617 - RNA, 22 nt, Human
acaaaguuugugguauuccaag

SEQ ID NO: 1010618 - RNA, 22 nt, Human
aggagcugucagagugccagag

SEQ ID NO: 1010619 - RNA, 22 nt, Human
ugaagcagcuucuuucugucaa

SEQ ID NO: 1010620 - RNA, 22 nt, Human
uuucaaagucaauaucauuacc

SEQ ID NO: 1010621 - RNA, 22 nt, Human
cuaugaaaugucagauucugca

SEQ ID NO: 1010622 - RNA, 22 nt, Human
agaagccauguuuaguaggaug

SEQ ID NO: 1010623 - RNA, 22 nt, Human
cuggccuggggccucagcugcu

SEQ ID NO: 1010624 - RNA, 22 nt, Human
uaguuuuacuugcgaugauaau

SEQ ID NO: 1010625 - RNA, 22 nt, Human
uuucaaagaccauuaacuauca

SEQ ID NO: 1010626 - RNA, 22 nt, Human
ccaggguggcguagaugcuggg

SEQ ID NO: 1010627 - RNA, 22 nt, Human
uccagggacagcgcuggagcua

SEQ ID NO: 1010628 - RNA, 22 nt, Human
aagcaccugcaguugacaaaaa

SEQ ID NO: 1010629 - RNA, 19 nt, Human
ucauaaggagagaggaaau

SEQ ID NO: 1010630 - RNA, 23 nt, Human
ugaugggaaggaacgacuaccac

SEQ ID NO: 1010631 - RNA, 22 nt, Human
augccacugacauggacaauuu

SEQ ID NO: 1010632 - RNA, 22 nt, Human
uccauuggucucugugcccagg

SEQ ID NO: 1010633 - RNA, 22 nt, Human
ggucagggggaucugugaggua

SEQ ID NO: 1010634 - RNA, 22 nt, Human
auuaaauuggacgcugggggaa

SEQ ID NO: 1010635 - RNA, 22 nt, Human
gcugauguaagacuuuugguuu

SEQ ID NO: 1010636 - RNA, 22 nt, Human
gcuggcagaagagcugguucaa

SEQ ID NO: 1010637 - RNA, 22 nt, Human
uuaacaugucuugacuucaucu

SEQ ID NO: 1010638 - RNA, 22 nt, Human
gccaucacauccaggcuaccuc

SEQ ID NO: 1010639 - RNA, 20 nt, Human
cucuccuugccgacuuggca

SEQ ID NO: 1010640 - RNA, 22 nt, Human
ucauuucaaugauacuacuaag

SEQ ID NO: 1010641 - RNA, 22 nt, Human
aaaugaacucuuccugcauccc

SEQ ID NO: 1010642 - RNA, 22 nt, Human
uggcucugcaccucaguguacc

SEQ ID NO: 1010643 - RNA, 22 nt, Human
uggcacuggaaucguagccuug

SEQ ID NO: 1010644 - RNA, 22 nt, Human
ucugcagaaguggcugggccac

SEQ ID NO: 1010645 - RNA, 17 nt, Human
ugcauuguaggcuagcc

SEQ ID NO: 1010646 - RNA, 22 nt, Human
aaggcaggaugggaaaagauuu

SEQ ID NO: 1010647 - RNA, 22 nt, Human
agagcugcaggguggacccagg

SEQ ID NO: 1010648 - RNA, 22 nt, Human
gcaggggaguccacucuaugca

SEQ ID NO: 1010649 - RNA, 22 nt, Human
augcugagacuggagcagcugg

SEQ ID NO: 1010650 - RNA, 22 nt, Human
ugcuuuauuggaaccucauccu

SEQ ID NO: 1010651 - RNA, 22 nt, Human
aggguagggcccggagacagac

SEQ ID NO: 1010652 - RNA, 20 nt, Human
ccuggcuuugcaucugugau

SEQ ID NO: 1010653 - RNA, 22 nt, Human
aaaaugugcaguuuuuaagcug

SEQ ID NO: 1010654 - RNA, 22 nt, Human
ccagggagccuggugugucagc

SEQ ID NO: 1010655 - RNA, 22 nt, Human
uuugaaaguguuuacuugggaa

SEQ ID NO: 1010656 - RNA, 17 nt, Human
ggucuggggccauuggc

SEQ ID NO: 1010657 - RNA, 22 nt, Human
uagaacauaagucauucauuug

SEQ ID NO: 1010658 - RNA, 20 nt, Human
acuguucaagggccuggugg

SEQ ID NO: 1010659 - RNA, 22 nt, Human
agugaaauccuggucaacaggu

SEQ ID NO: 1010660 - RNA, 22 nt, Human
gaaaugcaaauucucucucgcu

SEQ ID NO: 1010661 - RNA, 22 nt, Human
ugaaggccacuuccugugagcu

SEQ ID NO: 1010662 - RNA, 22 nt, Human
uccugccucuugccuucuucac

SEQ ID NO: 1010663 - RNA, 22 nt, Human
agggacccugaugacugaggag

SEQ ID NO: 1010664 - RNA, 20 nt, Human
ccucucugaagaggucaucu

SEQ ID NO: 1010665 - RNA, 19 nt, Human
gagaggccugugcuugaag

SEQ ID NO: 1010666 - RNA, 22 nt, Human
cucugucccagacccaccucuc

SEQ ID NO: 1010667 - RNA, 22 nt, Human
cuuuauguuggggugucuuagu

SEQ ID NO: 1010668 - RNA, 22 nt, Human
cuggugugauugagcccaggug

SEQ ID NO: 1010669 - RNA, 22 nt, Human
auuguauaacagcauguauuuu

SEQ ID NO: 1010670 - RNA, 22 nt, Human
cagugcauagauccugaggccu

SEQ ID NO: 1010671 - RNA, 22 nt, Human
gugcuuucugcaugguuccuac

SEQ ID NO: 1010672 - RNA, 22 nt, Human
cuuucacaguccugacugagcg

SEQ ID NO: 1010673 - RNA, 22 nt, Human
cucaggggaccuggcuccgagu

SEQ ID NO: 1010674 - RNA, 22 nt, Human
ucccacucccaggcaggccucu

SEQ ID NO: 1010675 - RNA, 21 nt, Human
ggagucagggucuggcugggg

SEQ ID NO: 1010676 - RNA, 22 nt, Human
gcuccucuauuccccacauuuu

SEQ ID NO: 1010677 - RNA, 22 nt, Human
ggccagaggugguacauagcuu

SEQ ID NO: 1010678 - RNA, 22 nt, Human
ugagaaaugggucugcugaaga

SEQ ID NO: 1010679 - RNA, 22 nt, Human
acagccagaggugguccugggu

SEQ ID NO: 1010680 - RNA, 22 nt, Human
gcugccuuuuaaagccucgcuu

SEQ ID NO: 1010681 - RNA, 22 nt, Human
uuucaaacuuuacucuugaauc

SEQ ID NO: 1010682 - RNA, 22 nt, Human
ugccuggauucgguuguuguca

SEQ ID NO: 1010683 - RNA, 17 nt, Human
uccagagcacagagcuc

SEQ ID NO: 1010684 - RNA, 22 nt, Human
cagguggguguaugaaugcaaa

SEQ ID NO: 1010685 - RNA, 22 nt, Human
ugccagcccaccuuggggccuc

SEQ ID NO: 1010686 - RNA, 22 nt, Human
agugaaaugauucugagcaaga

SEQ ID NO: 1010687 - RNA, 22 nt, Human
cucagaauuacaucccauuuua

SEQ ID NO: 1010688 - RNA, 22 nt, Human
uggcucucaggccugcugcguu

SEQ ID NO: 1010689 - RNA, 18 nt, Human
aggcacuggaauuaaggg

SEQ ID NO: 1010690 - RNA, 22 nt, Human
cccagcaucccagugggcagca

SEQ ID NO: 1010691 - RNA, 23 nt, Human
cugcagucgccggccugggugcc

SEQ ID NO: 1010692 - RNA, 22 nt, Human
ucucagaggcccgacguucucc

SEQ ID NO: 1010693 - RNA, 22 nt, Human
ugggccugugaugcugggcuau

SEQ ID NO: 1010694 - RNA, 22 nt, Human
cuggcagcugcccgagaugccc

SEQ ID NO: 1010695 - RNA, 22 nt, Human
gagggcugaagauuguggcccc

SEQ ID NO: 1010696 - RNA, 22 nt, Human
cuugaaagaagggucuuuuaau

SEQ ID NO: 1010697 - RNA, 21 nt, Human
ccagcuccaggaccuuggauc

SEQ ID NO: 1010698 - RNA, 22 nt, Human
aggcacugacagauucuguguc

SEQ ID NO: 1010699 - RNA, 22 nt, Human
uagggcaggggaggaaucugaa

SEQ ID NO: 1010700 - RNA, 20 nt, Human
uauuuagauucaaguaugga

SEQ ID NO: 1010701 - RNA, 22 nt, Human
gccuguccuggaugcucugcaa

SEQ ID NO: 1010702 - RNA, 19 nt, Human
cuggcucuuggguggagga

SEQ ID NO: 1010703 - RNA, 22 nt, Human
gcuuagucaauuauaaauaggc

SEQ ID NO: 1010704 - RNA, 22 nt, Human
guauuugauagauuucaaagga

SEQ ID NO: 1010705 - RNA, 22 nt, Human
uggccugggccggcagauauac

SEQ ID NO: 1010706 - RNA, 22 nt, Human
caggaugguggcaugaucagaa

SEQ ID NO: 1010707 - RNA, 22 nt, Human
uggguagaggaauugggcuacc

SEQ ID NO: 1010708 - RNA, 22 nt, Human
uaugcacgucuauuuaugaaga

SEQ ID NO: 1010709 - RNA, 22 nt, Human
ucagcuuugccaccagcuguaa

SEQ ID NO: 1010710 - RNA, 22 nt, Human
gcacccaggccggcgacugcag

SEQ ID NO: 1010711 - RNA, 22 nt, Human
aggucccaggcauagcuggucu

SEQ ID NO: 1010712 - RNA, 22 nt, Human
cauucuuacacaauauuuuaau

SEQ ID NO: 1010713 - RNA, 22 nt, Human
uaggagaggugaauggcacacu

SEQ ID NO: 1010714 - RNA, 22 nt, Human
agucagugaaggcauugcucaa

SEQ ID NO: 1010715 - RNA, 22 nt, Human
gagcaguagaguacauggcucc

SEQ ID NO: 1010716 - RNA, 21 nt, Human
cagagcuguccaaacccugac

SEQ ID NO: 1010717 - RNA, 22 nt, Human
cagcuuugccaaguaaggucuu

SEQ ID NO: 1010718 - RNA, 22 nt, Human
cuuucacagcacaagccugccu

SEQ ID NO: 1010719 - RNA, 17 nt, Human
agcugagcuggccaggg

SEQ ID NO: 1010720 - RNA, 22 nt, Human
ccuggcaguuuugcccaggauu

SEQ ID NO: 1010721 - RNA, 22 nt, Human
ucagcaauccucccacaggugg

SEQ ID NO: 1010722 - RNA, 22 nt, Human
cuggcaguuggcagggcugcca

SEQ ID NO: 1010723 - RNA, 22 nt, Human
ggccagaaaguuaagcuguggc

SEQ ID NO: 1010724 - RNA, 22 nt, Human
gccuaggaguacagaaugguuu

SEQ ID NO: 1010725 - RNA, 22 nt, Human
cuggagagggagcccuggcagu

SEQ ID NO: 1010726 - RNA, 22 nt, Human
gcuccaggagagggaagcagau

SEQ ID NO: 1010727 - RNA, 22 nt, Human
uauuccuauggccacugcuacu

SEQ ID NO: 1010728 - RNA, 22 nt, Human
caugcuuucuguccaaauguua

SEQ ID NO: 1010729 - RNA, 22 nt, Human
gauuucuucauucauuagaugg

SEQ ID NO: 1010730 - RNA, 22 nt, Human
guucuuaagaccacaauaaaaa

SEQ ID NO: 1010731 - RNA, 22 nt, Human
ucugccuuuucacugccacuaa

SEQ ID NO: 1010732 - RNA, 19 nt, Human
acauuuagaauguacuugc

SEQ ID NO: 1010733 - RNA, 22 nt, Human
aucagcaagcauuuauugagug

SEQ ID NO: 1010734 - RNA, 22 nt, Human
augcaacaaaugcuacgaaucg

SEQ ID NO: 1010735 - RNA, 22 nt, Human
cugggcagagcuaacaccugag

SEQ ID NO: 1010736 - RNA, 22 nt, Human
uuuuucagccaugaauuacacu

SEQ ID NO: 1010737 - RNA, 22 nt, Human
agggcugggcugcuuguuguca

SEQ ID NO: 1010738 - RNA, 22 nt, Human
gcaggagugacauggaugugga

SEQ ID NO: 1010739 - RNA, 22 nt, Human
ugcauuguugaccaguugugca

SEQ ID NO: 1010740 - RNA, 22 nt, Human
ccuguucacuuugacuucucca

SEQ ID NO: 1010741 - RNA, 22 nt, Human
ccauggcauuuuaugugucuua

SEQ ID NO: 1010742 - RNA, 22 nt, Human
caggcagcugcuggguucagcc

SEQ ID NO: 1010743 - RNA, 19 nt, Human
ucucugcuucucuuggcau

SEQ ID NO: 1010744 - RNA, 22 nt, Human
ucugagagucucugaggcagau

SEQ ID NO: 1010745 - RNA, 22 nt, Human
agcugacuucuugauccaauga

SEQ ID NO: 1010746 - RNA, 22 nt, Human
cucccucugucuuguccagaaa

SEQ ID NO: 1010747 - RNA, 22 nt, Human
ugccugggugcuggcuggucac

SEQ ID NO: 1010748 - RNA, 22 nt, Human
aaggcccuaauagagcacauau

SEQ ID NO: 1010749 - RNA, 22 nt, Human
gagagcuggguucaaguagcug

SEQ ID NO: 1010750 - RNA, 22 nt, Human
ucaggagggugacaggcccugg

SEQ ID NO: 1010751 - RNA, 22 nt, Human
aagugagugguaaggagcaugg

SEQ ID NO: 1010752 - RNA, 18 nt, Human
uccagcgugcuccagggc

SEQ ID NO: 1010753 - RNA, 22 nt, Human
ccuggagcuuuuccauccugga

SEQ ID NO: 1010754 - RNA, 22 nt, Human
ccugucuguccucucaugagcc

SEQ ID NO: 1010755 - RNA, 22 nt, Human
augauacaagcaaaacuaauca

SEQ ID NO: 1010756 - RNA, 22 nt, Human
caguauuuauggcuugaguauu

SEQ ID NO: 1010757 - RNA, 22 nt, Human
uggagccugagucagcggaggc

SEQ ID NO: 1010758 - RNA, 22 nt, Human
uuugggaacucuaucauggaaa

SEQ ID NO: 1010759 - RNA, 22 nt, Human
cuccucugucuaccacgagggu

SEQ ID NO: 1010760 - RNA, 22 nt, Human
ucugucuccucugaggugccag

SEQ ID NO: 1010761 - RNA, 22 nt, Human
uccaagggcagccauagaacuu

SEQ ID NO: 1010762 - RNA, 22 nt, Human
gcagggcaaugaucccgagagg

SEQ ID NO: 1010763 - RNA, 22 nt, Human
cccaggcagucuggcucuaaag

SEQ ID NO: 1010764 - RNA, 19 nt, Human
cugguccugacugaggggu

SEQ ID NO: 1010765 - RNA, 22 nt, Human
gugugccagacaugaugcuaug

SEQ ID NO: 1010766 - RNA, 23 nt, Human
auucuucauuaucuucuagaaaa

SEQ ID NO: 1010767 - RNA, 22 nt, Human
ggguacaaagauuucauaagau

SEQ ID NO: 1010768 - RNA, 23 nt, Human
guggagccacaucacaggcuccu

SEQ ID NO: 1010769 - RNA, 22 nt, Human
cuggcucacaggugagaugcau

SEQ ID NO: 1010770 - RNA, 21 nt, Human
gugucaugguugacuuuggca

SEQ ID NO: 1010771 - RNA, 19 nt, Human
augauggucccauucaccu

SEQ ID NO: 1010772 - RNA, 22 nt, Human
uucuuucagaacacaagugauu

SEQ ID NO: 1010773 - RNA, 22 nt, Human
aguauuuccuggcuuaucugcu

SEQ ID NO: 1010774 - RNA, 22 nt, Human
gccugggagggcagcagugugg

SEQ ID NO: 1010775 - RNA, 22 nt, Human
gcucccagacugaccagaggug

SEQ ID NO: 1010776 - RNA, 22 nt, Human
cagcaguguggaagcugagggg

SEQ ID NO: 1010777 - RNA, 22 nt, Human
ugggcagaguugugaugaacug

SEQ ID NO: 1010778 - RNA, 22 nt, Human
ucuucaaacugaaaauuuagaa

SEQ ID NO: 1010779 - RNA, 22 nt, Human
acacacaauuaguuuuaugcuu

SEQ ID NO: 1010780 - RNA, 22 nt, Human
acauuucucagggaguuuugcu

SEQ ID NO: 1010781 - RNA, 22 nt, Human
acauuucuuugcuagacagcag

SEQ ID NO: 1010782 - RNA, 22 nt, Human
uaggcacuguguuuguaggagu

SEQ ID NO: 1010783 - RNA, 22 nt, Human
auuucucagugaaaugacaggc

SEQ ID NO: 1010784 - RNA, 22 nt, Human
uggcccugucccuggagccugg

SEQ ID NO: 1010785 - RNA, 22 nt, Human
uuucauaaugucacagucaaaa

SEQ ID NO: 1010786 - RNA, 22 nt, Human
uguggugagaaacugguagauu

SEQ ID NO: 1010787 - RNA, 22 nt, Human
cugcuuugaggggcucuguaua

SEQ ID NO: 1010788 - RNA, 23 nt, Human
uggcaccaggcauucuaggggua

SEQ ID NO: 1010789 - RNA, 21 nt, Human
ugcagcagaguaagcagggga

SEQ ID NO: 1010790 - RNA, 22 nt, Human
cauauuugguauaacuuaagca

SEQ ID NO: 1010791 - RNA, 22 nt, Human
cccaggcagcggggucuccuug

SEQ ID NO: 1010792 - RNA, 23 nt, Human
uggcucagggucucuuaugaagu

SEQ ID NO: 1010793 - RNA, 22 nt, Human
agagugaaggccagguuacagu

SEQ ID NO: 1010794 - RNA, 22 nt, Human
ugucccaguuuugcagguuaga

SEQ ID NO: 1010795 - RNA, 23 nt, Human
gucagcuugaccaguggagaguc

SEQ ID NO: 1010796 - RNA, 22 nt, Human
ucucuuaauaaguaaauacuga

SEQ ID NO: 1010797 - RNA, 20 nt, Human
ggcucuggaaucuggugggc

SEQ ID NO: 1010798 - RNA, 19 nt, Human
gcacacccugcaccaccau

SEQ ID NO: 1010799 - RNA, 22 nt, Human
ugggugcuucgucagcucugag

SEQ ID NO: 1010800 - RNA, 22 nt, Human
ucagagaguuuucacuagggug

SEQ ID NO: 1010801 - RNA, 20 nt, Human
cuuuggcaaugagaacaggg

SEQ ID NO: 1010802 - RNA, 22 nt, Human
cagcuuuauuaaugauugucuu

SEQ ID NO: 1010803 - RNA, 22 nt, Human
uuucucaucuggaaacagugcu

SEQ ID NO: 1010804 - RNA, 22 nt, Human
caggcuggaguuaccuuuaggg

SEQ ID NO: 1010805 - RNA, 19 nt, Human
ggcugccuggagcgagggc

SEQ ID NO: 1010806 - RNA, 22 nt, Human
gagcagcugagcuggaaugaga

SEQ ID NO: 1010807 - RNA, 22 nt, Human
agcaauauaaauguuggguaga

SEQ ID NO: 1010808 - RNA, 22 nt, Human
uggcucagaaggcugccuucac

SEQ ID NO: 1010809 - RNA, 22 nt, Human
ugaaaugaagggcuuguucugg

SEQ ID NO: 1010810 - RNA, 22 nt, Human
uugcuuugccaccagaagucua

SEQ ID NO: 1010811 - RNA, 20 nt, Human
ggcagagcuaugucuguugc

SEQ ID NO: 1010812 - RNA, 22 nt, Human
aagcaauaagccagauuuggau

SEQ ID NO: 1010813 - RNA, 17 nt, Human
ucuguccagggagugug

SEQ ID NO: 1010814 - RNA, 22 nt, Human
ucauauaaguuuaaaacuaucu

SEQ ID NO: 1010815 - RNA, 22 nt, Human
ucacaacucuuuccauuuaaua

SEQ ID NO: 1010816 - RNA, 23 nt, Human
ccagcucccaggucugaggacug

SEQ ID NO: 1010817 - RNA, 22 nt, Human
gcagcuggcccugacacgcaga

SEQ ID NO: 1010818 - RNA, 22 nt, Human
aggcaguguauugcuagcggcu

SEQ ID NO: 1010819 - RNA, 22 nt, Human
agcuuuguggcuuugcaagacu

SEQ ID NO: 1010820 - RNA, 22 nt, Human
agggccuggaacugugggcagg

SEQ ID NO: 1010821 - RNA, 22 nt, Human
agacaacaccaaaugcuagugu

SEQ ID NO: 1010822 - RNA, 22 nt, Human
uggcagggccugcucaucaucc

SEQ ID NO: 1010823 - RNA, 21 nt, Human
guggccugauuaugaaugggu

SEQ ID NO: 1010824 - RNA, 22 nt, Human
cagaggcugcucuggguggcau

SEQ ID NO: 1010825 - RNA, 22 nt, Human
ugagagagccugaaucucuuac

SEQ ID NO: 1010826 - RNA, 22 nt, Human
ugaguucucacccauucuucuu

SEQ ID NO: 1010827 - RNA, 23 nt, Human
ccugcagcugcuggggcuccacc

SEQ ID NO: 1010828 - RNA, 22 nt, Human
ccucugccaccucccacgaggc

SEQ ID NO: 1010829 - RNA, 22 nt, Human
ggcaggguggcccuccagugag

SEQ ID NO: 1010830 - RNA, 22 nt, Human
cuccucaguugucccauggaga

SEQ ID NO: 1010831 - RNA, 22 nt, Human
aaucagaaaauucaguggaauu

SEQ ID NO: 1010832 - RNA, 22 nt, Human
cucagugugaaugcucaguaaa

SEQ ID NO: 1010833 - RNA, 22 nt, Human
ucucuguacaguacaugccgug

SEQ ID NO: 1010834 - RNA, 22 nt, Human
agggacacaugugauuauuuau

SEQ ID NO: 1010835 - RNA, 22 nt, Human
cagucccaguuugagacucugg

SEQ ID NO: 1010836 - RNA, 22 nt, Human
uuucacaugguacugccuguuu

SEQ ID NO: 1010837 - RNA, 22 nt, Human
gggaccuggacaugugugugcu

SEQ ID NO: 1010838 - RNA, 22 nt, Human
caagagcucccagaccugggca

SEQ ID NO: 1010839 - RNA, 22 nt, Human
uguucauuuggcccuuuuguau

SEQ ID NO: 1010840 - RNA, 22 nt, Human
auauuccauugguuucccuucu

SEQ ID NO: 1010841 - RNA, 22 nt, Human
uggcuucuuagaccaguggccu

SEQ ID NO: 1010842 - RNA, 22 nt, Human
ccagggccaagagaccucgagg

SEQ ID NO: 1010843 - RNA, 22 nt, Human
gucucccaaccccugugcccag

SEQ ID NO: 1010844 - RNA, 22 nt, Human
uggcaaccagguggucuagggu

SEQ ID NO: 1010845 - RNA, 22 nt, Human
uaaacaugugagugugcauaua

SEQ ID NO: 1010846 - RNA, 22 nt, Human
uacauguuauuucacuauuggu

SEQ ID NO: 1010847 - RNA, 21 nt, Human
ggccugagcaccuguccaccu

SEQ ID NO: 1010848 - RNA, 22 nt, Human
gggaaaggaucagugggaggcu

SEQ ID NO: 1010849 - RNA, 22 nt, Human
guuugaaugcaguaugcauuuu

SEQ ID NO: 1010850 - RNA, 22 nt, Human
aguguccaacucagcuugucaa

SEQ ID NO: 1010851 - RNA, 22 nt, Human
acauuucugucuuagggacugu

SEQ ID NO: 1010852 - RNA, 22 nt, Human
cgggcuggcugcagcugcugga

SEQ ID NO: 1010853 - RNA, 22 nt, Human
agagggcaugcuugguggccug

SEQ ID NO: 1010854 - RNA, 22 nt, Human
aaaguuuguuauaugauaagga

SEQ ID NO: 1010855 - RNA, 22 nt, Human
uuggcugaagguuaagugcugg

SEQ ID NO: 1010856 - RNA, 23 nt, Human
gcagauggccccagagugcugcc

SEQ ID NO: 1010857 - RNA, 22 nt, Human
aauugcaacagguagacuuuuc

SEQ ID NO: 1010858 - RNA, 22 nt, Human
cugccuguuuucugauagauuu

SEQ ID NO: 1010859 - RNA, 22 nt, Human
gaaugcacucacccaucacuca

SEQ ID NO: 1010860 - RNA, 22 nt, Human
cuggggcauugggagaggccug

SEQ ID NO: 1010861 - RNA, 22 nt, Human
uagcuaucuguguccagaucca

SEQ ID NO: 1010862 - RNA, 22 nt, Human
uuguugguggaauugaugcuag

SEQ ID NO: 1010863 - RNA, 22 nt, Human
auugaaucugcacuaguauuuu

SEQ ID NO: 1010864 - RNA, 22 nt, Human
aagaacauuuuguagaaugaca

SEQ ID NO: 1010865 - RNA, 22 nt, Human
acuucauuguaauauuauagca

SEQ ID NO: 1010866 - RNA, 22 nt, Human
uggcucugugucucccagcagc

SEQ ID NO: 1010867 - RNA, 23 nt, Human
aggcccaacucugugagggcugc

SEQ ID NO: 1010868 - RNA, 22 nt, Human
ccagcagagucuaggaaggagg

SEQ ID NO: 1010869 - RNA, 22 nt, Human
auuucuuuucaagagggugcuu

SEQ ID NO: 1010870 - RNA, 22 nt, Human
uaaucacaucaggguaaauggg

SEQ ID NO: 1010871 - RNA, 22 nt, Human
cugcagagaauuguggggcuuc

SEQ ID NO: 1010872 - RNA, 22 nt, Human
agggcucugggguggcagagau

SEQ ID NO: 1010873 - RNA, 22 nt, Human
cagggccaaguuggugccuuuu

SEQ ID NO: 1010874 - RNA, 22 nt, Human
uucuggaguauuccuggcaccu

SEQ ID NO: 1010875 - RNA, 22 nt, Human
auccaaaccuggacaugagugg

SEQ ID NO: 1010876 - RNA, 22 nt, Human
acagccagaggagccaggcugg

SEQ ID NO: 1010877 - RNA, 23 nt, Human
ugcucugggaggcccuggagagc

SEQ ID NO: 1010878 - RNA, 22 nt, Human
gggugcaggcagcccaggcagg

SEQ ID NO: 1010879 - RNA, 22 nt, Human
aaaugcuguguuuuaacauaga

SEQ ID NO: 1010880 - RNA, 22 nt, Human
uuuagaaauugcagagugggug

SEQ ID NO: 1010881 - RNA, 22 nt, Human
gguggccucucaugcaagguag

SEQ ID NO: 1010882 - RNA, 22 nt, Human
gcacagggagcaggucucuggu

SEQ ID NO: 1010883 - RNA, 22 nt, Human
cccagcauuucugggcugcacu

SEQ ID NO: 1010884 - RNA, 22 nt, Human
acugugcacaauucuaaguccu

SEQ ID NO: 1010885 - RNA, 22 nt, Human
gcagggccagguacaagaagca

SEQ ID NO: 1010886 - RNA, 22 nt, Human
cagagccacugucugccaggca

SEQ ID NO: 1010887 - RNA, 22 nt, Human
aauggacaggagagcauaguca

SEQ ID NO: 1010888 - RNA, 22 nt, Human
uggcagagaacacacaugauuc

SEQ ID NO: 1010889 - RNA, 17 nt, Human
gucauucucagaaaaug

SEQ ID NO: 1010890 - RNA, 22 nt, Human
ccugggaggcggagguugcagu

SEQ ID NO: 1010891 - RNA, 22 nt, Human
aggcagagagcaguggccgucu

SEQ ID NO: 1010892 - RNA, 22 nt, Human
ucucaggaagauuagggcuaag

SEQ ID NO: 1010893 - RNA, 22 nt, Human
ucuguuccauguuuuguuccau

SEQ ID NO: 1010894 - RNA, 22 nt, Human
cacucugcgcugggcgccagcg

SEQ ID NO: 1010895 - RNA, 22 nt, Human
uagggacccucccugcucuaac

SEQ ID NO: 1010896 - RNA, 22 nt, Human
ugcuauaagaauuauauuacuc

SEQ ID NO: 1010897 - RNA, 22 nt, Human
gagcccuguagcaagucauguc

SEQ ID NO: 1010898 - RNA, 22 nt, Human
guguaaggccccagguucuuua

SEQ ID NO: 1010899 - RNA, 22 nt, Human
uuugaaagagcugauacaugaa

SEQ ID NO: 1010900 - RNA, 22 nt, Human
uauuagggaacugcaagacuaa

SEQ ID NO: 1010901 - RNA, 22 nt, Human
acagggucaagggugcuacaag

SEQ ID NO: 1010902 - RNA, 22 nt, Human
ucacagacacagggagaagcau

SEQ ID NO: 1010903 - RNA, 22 nt, Human
cagggccugagggcugcucugc

SEQ ID NO: 1010904 - RNA, 22 nt, Human
agcccggcuuccccgguugcua

SEQ ID NO: 1010905 - RNA, 23 nt, Human
gcucagagguuuuucucuggaug

SEQ ID NO: 1010906 - RNA, 22 nt, Human
uagaaaucauuuagaaguauug

SEQ ID NO: 1010907 - RNA, 22 nt, Human
aggcuccaugcaaaggcuguuu

SEQ ID NO: 1010908 - RNA, 17 nt, Human
cagacaggcugucaccc

SEQ ID NO: 1010909 - RNA, 22 nt, Human
aaaucaguuguuauauuaaaga

SEQ ID NO: 1010910 - RNA, 22 nt, Human
uccugcagcugaagcucaugug

SEQ ID NO: 1010911 - RNA, 22 nt, Human
caagagcuacccugugccauau

SEQ ID NO: 1010912 - RNA, 22 nt, Human
aaaagagguuaaccaggugugu

SEQ ID NO: 1010913 - RNA, 22 nt, Human
uauuuguauguguguacauaua

SEQ ID NO: 1010914 - RNA, 22 nt, Human
agcaccugcuuaaugugcagug

SEQ ID NO: 1010915 - RNA, 22 nt, Human
aaaguucuggcauuuucugucu

SEQ ID NO: 1010916 - RNA, 22 nt, Human
cuggggggagcugcguccagca

SEQ ID NO: 1010917 - RNA, 22 nt, Human
uggcucuguugagguauggauu

SEQ ID NO: 1010918 - RNA, 22 nt, Human
uccuuucccuuuccauccuggc

SEQ ID NO: 1010919 - RNA, 22 nt, Human
gccucugcaccaguacugugcc

SEQ ID NO: 1010920 - RNA, 23 nt, Human
uggggagaguuacccuggaagcg

SEQ ID NO: 1010921 - RNA, 22 nt, Human
caguaugagaguugaaucaagg

SEQ ID NO: 1010922 - RNA, 22 nt, Human
agggacugagcuaggaucuagu

SEQ ID NO: 1010923 - RNA, 22 nt, Human
agcuuuauauguuguuucucca

SEQ ID NO: 1010924 - RNA, 22 nt, Human
ugcuuaaacauacuauuuauau

SEQ ID NO: 1010925 - RNA, 22 nt, Human
cuggcucaggaaaguugcugcu

SEQ ID NO: 1010926 - RNA, 22 nt, Human
aaaaccaggcguuuccuauuau

SEQ ID NO: 1010927 - RNA, 22 nt, Human
caggccugucugcacaugaggc

SEQ ID NO: 1010928 - RNA, 18 nt, Human
agagcagcggcaucacac

SEQ ID NO: 1010929 - RNA, 22 nt, Human
augcuguggggagugaggguag

SEQ ID NO: 1010930 - RNA, 22 nt, Human
acaggugguaaaauggacuguc

SEQ ID NO: 1010931 - RNA, 22 nt, Human
gcauucaucuuccuccaugcag

SEQ ID NO: 1010932 - RNA, 22 nt, Human
ggcugaaguguaguggcucacu

SEQ ID NO: 1010933 - RNA, 22 nt, Human
aaaguucuggggguguuucugg

SEQ ID NO: 1010934 - RNA, 23 nt, Human
augcaguauaugucaguaguuua

SEQ ID NO: 1010935 - RNA, 22 nt, Human
ucugucacccagagugcagugg

SEQ ID NO: 1010936 - RNA, 22 nt, Human
auccaugaucaauuuauuacua

SEQ ID NO: 1010937 - RNA, 22 nt, Human
ggccuugggcuggcugcaguau

SEQ ID NO: 1010938 - RNA, 22 nt, Human
agcagcagauccaaaaaaugug

SEQ ID NO: 1010939 - RNA, 22 nt, Human
ugggcagacuaaggucaaagcu

SEQ ID NO: 1010940 - RNA, 22 nt, Human
acagagcauauaaagugcuuug

SEQ ID NO: 1010941 - RNA, 20 nt, Human
gcuuuuucuaauagcagucc

SEQ ID NO: 1010942 - RNA, 23 nt, Human
auguauuuaaauuucagugauga

SEQ ID NO: 1010943 - RNA, 22 nt, Human
gccaggcuccccggaucccugg

SEQ ID NO: 1010944 - RNA, 22 nt, Human
uuucacaacugcuuauuugaga

SEQ ID NO: 1010945 - RNA, 22 nt, Human
ucaguggagcuaagcaugagau

SEQ ID NO: 1010946 - RNA, 22 nt, Human
ucaguaacuuacuuauucaccu

SEQ ID NO: 1010947 - RNA, 22 nt, Human
acugggagggucuugaagaggg

SEQ ID NO: 1010948 - RNA, 22 nt, Human
ucaguguccggagccugagugc

SEQ ID NO: 1010949 - RNA, 22 nt, Human
uaccauuucauucuuuccucau

SEQ ID NO: 1010950 - RNA, 22 nt, Human
guucuucaucuuaaccaucugu

SEQ ID NO: 1010951 - RNA, 23 nt, Human
cauguacacacagcuguacagug

SEQ ID NO: 1010952 - RNA, 22 nt, Human
uuuuaaguuaauauaauugagg

SEQ ID NO: 1010953 - RNA, 22 nt, Human
cacuugggacaaagcuucugcu

SEQ ID NO: 1010954 - RNA, 22 nt, Human
acagaaugcguagugcauguug

SEQ ID NO: 1010955 - RNA, 22 nt, Human
uggccucugcaauggauucacc

SEQ ID NO: 1010956 - RNA, 22 nt, Human
aaaucaguucucccuuucuuca

SEQ ID NO: 1010957 - RNA, 22 nt, Human
cuggcagguggauggggacucc

SEQ ID NO: 1010958 - RNA, 22 nt, Human
cuggugccuccucccugugcuu

SEQ ID NO: 1010959 - RNA, 22 nt, Human
ucaaggagcccacagucuaaug

SEQ ID NO: 1010960 - RNA, 19 nt, Human
ggcauccacgaaugcagag

SEQ ID NO: 1010961 - RNA, 22 nt, Human
ccagagagaaaauggagggcca

SEQ ID NO: 1010962 - RNA, 22 nt, Human
agcaggcuaagggaccuguuua

SEQ ID NO: 1010963 - RNA, 22 nt, Human
ccagagucuuuauauuccugaa

SEQ ID NO: 1010964 - RNA, 22 nt, Human
gcaagcugcuuaagcucauugu

SEQ ID NO: 1010965 - RNA, 22 nt, Human
ucagucucaucaacucuauucc

SEQ ID NO: 1010966 - RNA, 22 nt, Human
gucucagagagcuacucucuua

SEQ ID NO: 1010967 - RNA, 22 nt, Human
acaggcuucucacagaaaaggg

SEQ ID NO: 1010968 - RNA, 21 nt, Human
gaaaagcaagggaguagaaca

SEQ ID NO: 1010969 - RNA, 22 nt, Human
aguuucuaccgguacauucagg

SEQ ID NO: 1010970 - RNA, 22 nt, Human
ugucucugggugauucaguccu

SEQ ID NO: 1010971 - RNA, 22 nt, Human
acuggcagaggauagcacuaau

SEQ ID NO: 1010972 - RNA, 22 nt, Human
uugcuuuguggugguucuucca

SEQ ID NO: 1010973 - RNA, 22 nt, Human
ucaucuucuauuaauagggaga

SEQ ID NO: 1010974 - RNA, 22 nt, Human
auggauaagaacaaauaucuga

SEQ ID NO: 1010975 - RNA, 22 nt, Human
cagccagggagcaaagaguuga

SEQ ID NO: 1010976 - RNA, 22 nt, Human
aagguacaccaaaguucaaguu

SEQ ID NO: 1010977 - RNA, 22 nt, Human
ccagagccccugagcuucccug

SEQ ID NO: 1010978 - RNA, 22 nt, Human
auaaagauuucuuuuucucuac

SEQ ID NO: 1010979 - RNA, 22 nt, Human
gcagagccagaauggccaggac

SEQ ID NO: 1010980 - RNA, 22 nt, Human
ggcagggaguggagacucccua

SEQ ID NO: 1010981 - RNA, 22 nt, Human
guguguccuugggccucugcag

SEQ ID NO: 1010982 - RNA, 22 nt, Human
cagagagagucaaaucuuugcu

SEQ ID NO: 1010983 - RNA, 22 nt, Human
uuucaauguaacauuuccaggc

SEQ ID NO: 1010984 - RNA, 22 nt, Human
uaccaggcagcugcacagaggc

SEQ ID NO: 1010985 - RNA, 22 nt, Human
agacaggcuuugcuguauauca

SEQ ID NO: 1010986 - RNA, 22 nt, Human
uucuuuuacauuaagauuucag

SEQ ID NO: 1010987 - RNA, 22 nt, Human
ucugggagauccaagcagaacu

SEQ ID NO: 1010988 - RNA, 21 nt, Human
ggugucaguuuuggucauuag

SEQ ID NO: 1010989 - RNA, 22 nt, Human
ucaaaaguuucacauagagaua

SEQ ID NO: 1010990 - RNA, 22 nt, Human
uaagcauaacuaaaaaugauuu

SEQ ID NO: 1010991 - RNA, 22 nt, Human
agcaccuguugcacuucauaau

SEQ ID NO: 1010992 - RNA, 22 nt, Human
uuuuccucugcaauaaaagcag

SEQ ID NO: 1010993 - RNA, 22 nt, Human
guggcugggcuccgagcggcuu

SEQ ID NO: 1010994 - RNA, 22 nt, Human
ccuggagcaaaaaucuaaggag

SEQ ID NO: 1010995 - RNA, 22 nt, Human
uuagccauuaaauuacaaggug

SEQ ID NO: 1010996 - RNA, 22 nt, Human
gcucccugcagcugagaguucc

SEQ ID NO: 1010997 - RNA, 22 nt, Human
gaccaggacacaguggcaaggu

SEQ ID NO: 1010998 - RNA, 22 nt, Human
cggcagagcuuccugcucagcg

SEQ ID NO: 1010999 - RNA, 22 nt, Human
uacagauacagaucuagauaca

SEQ ID NO: 1011000 - RNA, 21 nt, Human
aggccucuucauggccaugau

SEQ ID NO: 1011001 - RNA, 22 nt, Human
gggccucucccuucucacgcau

SEQ ID NO: 1011002 - RNA, 21 nt, Human
ggucagggggugccuccaggu

SEQ ID NO: 1011003 - RNA, 22 nt, Human
gaaggaagugcucauacuaguu

SEQ ID NO: 1011004 - RNA, 22 nt, Human
ucccagaaaaaggaggcuauga

SEQ ID NO: 1011005 - RNA, 22 nt, Human
ccaggccuagccccugagggua

SEQ ID NO: 1011006 - RNA, 22 nt, Human
ucagggcaggacaguguaggcc

SEQ ID NO: 1011007 - RNA, 22 nt, Human
agcugucagugcugugccugua

SEQ ID NO: 1011008 - RNA, 22 nt, Human
aucauucugauggucaaugcua

SEQ ID NO: 1011009 - RNA, 22 nt, Human
agguggggaaaccagcgauccc

SEQ ID NO: 1011010 - RNA, 22 nt, Human
agugccuggaccccaugacaua

SEQ ID NO: 1011011 - RNA, 22 nt, Human
gauuucaccugaucuugucauc

SEQ ID NO: 1011012 - RNA, 22 nt, Human
caguucuuuguggggaguucuc

SEQ ID NO: 1011013 - RNA, 22 nt, Human
ucuucagacccuuagcugugau

SEQ ID NO: 1011014 - RNA, 22 nt, Human
aaacaucaccauuuuaccuaau

SEQ ID NO: 1011015 - RNA, 19 nt, Human
agggaaggauucugucauu

SEQ ID NO: 1011016 - RNA, 22 nt, Human
uucauucugcaguucucagcuc

SEQ ID NO: 1011017 - RNA, 19 nt, Human
uagcagcugccaaaggaga

SEQ ID NO: 1011018 - RNA, 22 nt, Human
uuccaggauagcuuucaggaau

SEQ ID NO: 1011019 - RNA, 22 nt, Human
ugaagcuuuccuguggucagga

SEQ ID NO: 1011020 - RNA, 22 nt, Human
uagcagggaaggugugcugagc

SEQ ID NO: 1011021 - RNA, 22 nt, Human
ucaacacucuuuggcacaguua

SEQ ID NO: 1011022 - RNA, 22 nt, Human
gcucugugggugaguagaaucu

SEQ ID NO: 1011023 - RNA, 22 nt, Human
ccaggccuuucuucuuggucug

SEQ ID NO: 1011024 - RNA, 22 nt, Human
cugggacuuuacccuguggccc

SEQ ID NO: 1011025 - RNA, 22 nt, Human
uuagagaaauucugguaaugua

SEQ ID NO: 1011026 - RNA, 22 nt, Human
gcuggagccauuggcuuggccu

SEQ ID NO: 1011027 - RNA, 22 nt, Human
ugaagccuuguguggccucucu

SEQ ID NO: 1011028 - RNA, 22 nt, Human
gagugcaucguggccauuuuaa

SEQ ID NO: 1011029 - RNA, 22 nt, Human
ucauuuccucaaauucaagguu

SEQ ID NO: 1011030 - RNA, 19 nt, Human
gcuggggccugaccagaca

SEQ ID NO: 1011031 - RNA, 22 nt, Human
uggcuccuaggauggugccugg

SEQ ID NO: 1011032 - RNA, 22 nt, Human
aggcacugugcuucuuauaugu

SEQ ID NO: 1011033 - RNA, 22 nt, Human
cugagccuuauucaccagcccu

SEQ ID NO: 1011034 - RNA, 22 nt, Human
ugaaagcucugucaucauuccu

SEQ ID NO: 1011035 - RNA, 22 nt, Human
cacugcaguaacucuaggacug

SEQ ID NO: 1011036 - RNA, 22 nt, Human
auuguggugucaguuauaggca

SEQ ID NO: 1011037 - RNA, 22 nt, Human
cucugcauuuuaacagaugauu

SEQ ID NO: 1011038 - RNA, 22 nt, Human
cagaaugagauaacccagauug

SEQ ID NO: 1011039 - RNA, 22 nt, Human
ucauucuuuaccaaguugucac

SEQ ID NO: 1011040 - RNA, 22 nt, Human
gcagcuuucuugcccuaaucuu

SEQ ID NO: 1011041 - RNA, 22 nt, Human
uuacuuugcuuucucauuacag

SEQ ID NO: 1011042 - RNA, 22 nt, Human
caaggcaggcaguucacuugag

SEQ ID NO: 1011043 - RNA, 22 nt, Human
aaaugcuagggagaaacucucc

SEQ ID NO: 1011044 - RNA, 22 nt, Human
auugaaaaaugacuauugcuua

SEQ ID NO: 1011045 - RNA, 22 nt, Human
ugcagccaccaccucugcugaa

SEQ ID NO: 1011046 - RNA, 22 nt, Human
gggagagagaaaacguggcgca

SEQ ID NO: 1011047 - RNA, 22 nt, Human
uaucauuguguuauuucuucca

SEQ ID NO: 1011048 - RNA, 20 nt, Human
ggucccugcccucugucauc

SEQ ID NO: 1011049 - RNA, 22 nt, Human
ucaaagucucugcuucuguaac

SEQ ID NO: 1011050 - RNA, 22 nt, Human
uccagccuuucuacucacugag

SEQ ID NO: 1011051 - RNA, 22 nt, Human
acacagccgugaaucugcuucu

SEQ ID NO: 1011052 - RNA, 22 nt, Human
uacaagagguauauagaaacag

SEQ ID NO: 1011053 - RNA, 22 nt, Human
ucccuguccugggcaaucccag

SEQ ID NO: 1011054 - RNA, 22 nt, Human
acuuucucccacccacccgucu

SEQ ID NO: 1011055 - RNA, 22 nt, Human
uggcuuccuccagagcaggagg

SEQ ID NO: 1011056 - RNA, 22 nt, Human
cuaauacacccuauugcuuguu

SEQ ID NO: 1011057 - RNA, 22 nt, Human
gcucagccgaacuucagagcag

SEQ ID NO: 1011058 - RNA, 22 nt, Human
gcagcagaguuugggagauggu

SEQ ID NO: 1011059 - RNA, 22 nt, Human
gaggcagcagggcugguuccuu

SEQ ID NO: 1011060 - RNA, 22 nt, Human
uacaaaugaccauagccacuua

SEQ ID NO: 1011061 - RNA, 22 nt, Human
agcaguagugauggccccugag

SEQ ID NO: 1011062 - RNA, 22 nt, Human
ggacucuguuuuccugaucacu

SEQ ID NO: 1011063 - RNA, 22 nt, Human
ucuguuccaguagaaaggugca

SEQ ID NO: 1011064 - RNA, 22 nt, Human
caagagcuagaaauugguuaga

SEQ ID NO: 1011065 - RNA, 22 nt, Human
ugaaaugagauaauuuaagugc

SEQ ID NO: 1011066 - RNA, 22 nt, Human
ugggcugcggauaggccucgga

SEQ ID NO: 1011067 - RNA, 22 nt, Human
cagugggugaugaguccugggg

SEQ ID NO: 1011068 - RNA, 22 nt, Human
aaguaaaagcuuuaccaugcgc

SEQ ID NO: 1011069 - RNA, 22 nt, Human
aggugcagcugguggagucugg

SEQ ID NO: 1011070 - RNA, 22 nt, Human
ucagagaggauuuuaauaagug

SEQ ID NO: 1011071 - RNA, 22 nt, Human
uaguuuuuucaacaaauggugc

SEQ ID NO: 1011072 - RNA, 22 nt, Human
auucugagaaaugcauugucag

SEQ ID NO: 1011073 - RNA, 22 nt, Human
cagagcucuauguucauggagg

SEQ ID NO: 1011074 - RNA, 22 nt, Human
ggcucaggaugagccuucucau

SEQ ID NO: 1011075 - RNA, 22 nt, Human
cugccucucaggucccugagau

SEQ ID NO: 1011076 - RNA, 22 nt, Human
uaugccugauaacugugucucu

SEQ ID NO: 1011077 - RNA, 22 nt, Human
uuccagugaugggcaauuuggu

SEQ ID NO: 1011078 - RNA, 22 nt, Human
ucaaaguuacuugugguuuucu

SEQ ID NO: 1011079 - RNA, 22 nt, Human
ugagaaaagguugagaugauaa

SEQ ID NO: 1011080 - RNA, 22 nt, Human
cccaugccuucugacucacagg

SEQ ID NO: 1011081 - RNA, 21 nt, Human
gacaggacuagaccagagcuc

SEQ ID NO: 1011082 - RNA, 22 nt, Human
aaggccagcuuguagggcuggu

SEQ ID NO: 1011083 - RNA, 22 nt, Human
uugcaccauuucacuuccauua

SEQ ID NO: 1011084 - RNA, 22 nt, Human
agcaccauugcaaauauggcag

SEQ ID NO: 1011085 - RNA, 22 nt, Human
gcaggcagagagggguuuccag

SEQ ID NO: 1011086 - RNA, 22 nt, Human
auguuacacauaggcauaaaug

SEQ ID NO: 1011087 - RNA, 22 nt, Human
aaguucaagcucugccuaaaau

SEQ ID NO: 1011088 - RNA, 21 nt, Human
acauucacaggauauuaucau

SEQ ID NO: 1011089 - RNA, 22 nt, Human
auuucacaaagaacagaugcag

SEQ ID NO: 1011090 - RNA, 22 nt, Human
caggcacugugcugagcucugc

SEQ ID NO: 1011091 - RNA, 22 nt, Human
acaaauuuauugaagggcauau

SEQ ID NO: 1011092 - RNA, 22 nt, Human
gagagugagauccuccugggga

SEQ ID NO: 1011093 - RNA, 22 nt, Human
agcuuuaugcuuccuacaagcu

SEQ ID NO: 1011094 - RNA, 22 nt, Human
uguuuuaaucucccauugcucu

SEQ ID NO: 1011095 - RNA, 22 nt, Human
cagcuccccaugguuccugaag

SEQ ID NO: 1011096 - RNA, 22 nt, Human
cagggcugcuggccgugcccuc

SEQ ID NO: 1011097 - RNA, 22 nt, Human
aguguuguaugggaugacugcu

SEQ ID NO: 1011098 - RNA, 22 nt, Human
gaagcccaggcuuccuuggcuu

SEQ ID NO: 1011099 - RNA, 22 nt, Human
ucacauacacuaggauauuuuu

SEQ ID NO: 1011100 - RNA, 22 nt, Human
uggacaggaucugagacugaga

SEQ ID NO: 1011101 - RNA, 22 nt, Human
ccggcucggcgaccaggcugaa

SEQ ID NO: 1011102 - RNA, 21 nt, Human
cagcaaaucauugggcagacu

SEQ ID NO: 1011103 - RNA, 22 nt, Human
gcugggagugggcaagaugaga

SEQ ID NO: 1011104 - RNA, 22 nt, Human
gcugcccucccagggcaagcuu

SEQ ID NO: 1011105 - RNA, 22 nt, Human
auaugugugaugcauggacuaa

SEQ ID NO: 1011106 - RNA, 17 nt, Human
agauggcaggaggcaga

SEQ ID NO: 1011107 - RNA, 22 nt, Human
auuucccaugugaaucaauugg

SEQ ID NO: 1011108 - RNA, 22 nt, Human
cuguggaaggccuguccugaaa

SEQ ID NO: 1011109 - RNA, 22 nt, Human
agaggccacuuugccugugaug

SEQ ID NO: 1011110 - RNA, 22 nt, Human
gcagguguggaguggggugagc

SEQ ID NO: 1011111 - RNA, 22 nt, Human
uggcagcagacaaaaggccauu

SEQ ID NO: 1011112 - RNA, 22 nt, Human
uuuauuugucuugccauuuagu

SEQ ID NO: 1011113 - RNA, 22 nt, Human
uggguggaauaaaucaguucug

SEQ ID NO: 1011114 - RNA, 22 nt, Human
agguggccggugccagccgggc

SEQ ID NO: 1011115 - RNA, 23 nt, Human
acuauaaaguuguucugauuuac

SEQ ID NO: 1011116 - RNA, 22 nt, Human
gcauacagagaggauguggcau

SEQ ID NO: 1011117 - RNA, 22 nt, Human
aagcugcccaagacugaagcau

SEQ ID NO: 1011118 - RNA, 20 nt, Human
gccaggcacuguucucaaua

SEQ ID NO: 1011119 - RNA, 22 nt, Human
uacaggaggauuaucaaaggau

SEQ ID NO: 1011120 - RNA, 22 nt, Human
caggcagaagaaguggaaggac

SEQ ID NO: 1011121 - RNA, 22 nt, Human
ccaagggcucugacuugccugc

SEQ ID NO: 1011122 - RNA, 22 nt, Human
uguaauauuguagugacaguac

SEQ ID NO: 1011123 - RNA, 21 nt, Human
gcagccagccgagaccaugcc

SEQ ID NO: 1011124 - RNA, 22 nt, Human
aaaguucagauuagacucaaga

SEQ ID NO: 1011125 - RNA, 22 nt, Human
gccagagcugagacacgagucc

SEQ ID NO: 1011126 - RNA, 22 nt, Human
agcagcuguacuuucaucuguu

SEQ ID NO: 1011127 - RNA, 22 nt, Human
ggggccuguagagcuucaggga

SEQ ID NO: 1011128 - RNA, 22 nt, Human
ggaaaguggugguggaaagagg

SEQ ID NO: 1011129 - RNA, 22 nt, Human
uguuugaaacuuugaucacuaa

SEQ ID NO: 1011130 - RNA, 22 nt, Human
acuaaauacacacauuuguuca

SEQ ID NO: 1011131 - RNA, 22 nt, Human
gagccagcugagcugcacuguc

SEQ ID NO: 1011132 - RNA, 22 nt, Human
ccuggagcacauggcaggaggc

SEQ ID NO: 1011133 - RNA, 22 nt, Human
uguauacauuuaacuagauaga

SEQ ID NO: 1011134 - RNA, 22 nt, Human
cauuguauugaggauacuuaag

SEQ ID NO: 1011135 - RNA, 22 nt, Human
aggagaaggaagugcaucacua

SEQ ID NO: 1011136 - RNA, 22 nt, Human
cugaaagaauaagauguuuaca

SEQ ID NO: 1011137 - RNA, 21 nt, Human
guuugcaugaacaagucagcc

SEQ ID NO: 1011138 - RNA, 22 nt, Human
gugcugcucacaucuggaggua

SEQ ID NO: 1011139 - RNA, 22 nt, Human
agagccugcuaccucauuccag

SEQ ID NO: 1011140 - RNA, 22 nt, Human
ugaagccagcuuuggaagacac

SEQ ID NO: 1011141 - RNA, 22 nt, Human
uuuaaagaaauuccucaucuuu

SEQ ID NO: 1011142 - RNA, 22 nt, Human
uccuuagagauacugucuugaa

SEQ ID NO: 1011143 - RNA, 22 nt, Human
caggccugacccugagcuucac

SEQ ID NO: 1011144 - RNA, 22 nt, Human
gucccauaaguagugcaacuug

SEQ ID NO: 1011145 - RNA, 22 nt, Human
caggagcuacucagguuggguu

SEQ ID NO: 1011146 - RNA, 22 nt, Human
ugucccagaucacaggagggga

SEQ ID NO: 1011147 - RNA, 22 nt, Human
cugucccaggagcuguaagaca

SEQ ID NO: 1011148 - RNA, 22 nt, Human
ucugccagaaguucugagagua

SEQ ID NO: 1011149 - RNA, 22 nt, Human
guuugcauuccaauuuagggga

SEQ ID NO: 1011150 - RNA, 22 nt, Human
caagaugaaacuacagggagga

SEQ ID NO: 1011151 - RNA, 22 nt, Human
uucaggauggcggauguugggg

SEQ ID NO: 1011152 - RNA, 22 nt, Human
acauuucuaucauccuguaaug

SEQ ID NO: 1011153 - RNA, 22 nt, Human
cuggcucccguuguccuugaag

SEQ ID NO: 1011154 - RNA, 22 nt, Human
aagucacagcuaaauagcuaag

SEQ ID NO: 1011155 - RNA, 22 nt, Human
ccacugucagaggggcugugcc

SEQ ID NO: 1011156 - RNA, 22 nt, Human
gcucugaggcugugaggugcug

SEQ ID NO: 1011157 - RNA, 22 nt, Human
cugaaggaagcagaagcgaggu

SEQ ID NO: 1011158 - RNA, 18 nt, Human
gagguccugcucuagccc

SEQ ID NO: 1011159 - RNA, 22 nt, Human
uggaaggggagcuggaaagggg

SEQ ID NO: 1011160 - RNA, 22 nt, Human
gacagcagggacauguaggaag

SEQ ID NO: 1011161 - RNA, 22 nt, Human
uucuccucuguuggccuucccu

SEQ ID NO: 1011162 - RNA, 22 nt, Human
guaaaauagaauaacguggcua

SEQ ID NO: 1011163 - RNA, 18 nt, Human
ccugcagcccaggaggcc

SEQ ID NO: 1011164 - RNA, 22 nt, Human
aucaggauucaguaucuccagc

SEQ ID NO: 1011165 - RNA, 22 nt, Human
agugugaccuuauuuggaaaca

SEQ ID NO: 1011166 - RNA, 22 nt, Human
caagggaguuacugagggcggg

SEQ ID NO: 1011167 - RNA, 22 nt, Human
accaggcuggagugcaguggcg

SEQ ID NO: 1011168 - RNA, 22 nt, Human
agauacaaaagauaagauuuag

SEQ ID NO: 1011169 - RNA, 22 nt, Human
acauuucuugaugccucuguga

SEQ ID NO: 1011170 - RNA, 22 nt, Human
ccagagccuggcaucugcauaa

SEQ ID NO: 1011171 - RNA, 22 nt, Human
gggcacugugcuaggugcugag

SEQ ID NO: 1011172 - RNA, 22 nt, Human
cucuggaggccuaaggaagugg

SEQ ID NO: 1011173 - RNA, 22 nt, Human
cauauucuuuaagcaaugcucu

SEQ ID NO: 1011174 - RNA, 22 nt, Human
auuugagaugguaaauaacuuu

SEQ ID NO: 1011175 - RNA, 22 nt, Human
uucaggaugcucagaguagucu

SEQ ID NO: 1011176 - RNA, 22 nt, Human
agcuuuauauuuaaugaauucu

SEQ ID NO: 1011177 - RNA, 22 nt, Human
uugugcucuguguuauuuaagg

SEQ ID NO: 1011178 - RNA, 22 nt, Human
cucucuggaagggggagcugau

SEQ ID NO: 1011179 - RNA, 22 nt, Human
gggcuaggcuuggccagcacug

SEQ ID NO: 1011180 - RNA, 22 nt, Human
ugccuguguugauuacuuuguc

SEQ ID NO: 1011181 - RNA, 22 nt, Human
uggcucagagagggagugugga

SEQ ID NO: 1011182 - RNA, 22 nt, Human
uaaauguguuguggaugaaguu

SEQ ID NO: 1011183 - RNA, 22 nt, Human
ucacuguauuugcugaugcaua

SEQ ID NO: 1011184 - RNA, 22 nt, Human
uagcugccuuugggcuccugcu

SEQ ID NO: 1011185 - RNA, 20 nt, Human
guucucacugaucugcaggg

SEQ ID NO: 1011186 - RNA, 22 nt, Human
agugaaaacacuaguucuugcc

SEQ ID NO: 1011187 - RNA, 22 nt, Human
ccugcaggcugcaggccaguuc

SEQ ID NO: 1011188 - RNA, 22 nt, Human
ucggagcuguagaugaaacccu

SEQ ID NO: 1011189 - RNA, 22 nt, Human
ugacauaauaauccaaacauac

SEQ ID NO: 1011190 - RNA, 22 nt, Human
ggcagcagggucuagauugaug

SEQ ID NO: 1011191 - RNA, 22 nt, Human
ugcagcuucuuguccugugauu

SEQ ID NO: 1011192 - RNA, 22 nt, Human
cucuggaauuaaggaagccugu

SEQ ID NO: 1011193 - RNA, 22 nt, Human
ugucucagauacgccaucaagg

SEQ ID NO: 1011194 - RNA, 22 nt, Human
augagcuucccagacaggaugg

SEQ ID NO: 1011195 - RNA, 22 nt, Human
gcugucacaagcaucuggggca

SEQ ID NO: 1011196 - RNA, 22 nt, Human
gccaccagccccaugcgcugug

SEQ ID NO: 1011197 - RNA, 22 nt, Human
gcugucaggaacaugccuuggu

SEQ ID NO: 1011198 - RNA, 22 nt, Human
ugaaagggguugaguuacagcu

SEQ ID NO: 1011199 - RNA, 18 nt, Human
cugcuugggagacgucag

SEQ ID NO: 1011200 - RNA, 18 nt, Human
gccugggaggaggaaaug

SEQ ID NO: 1011201 - RNA, 22 nt, Human
uuuaacagguaaaguaaaugug

SEQ ID NO: 1011202 - RNA, 22 nt, Human
ccaggcugugguuuagauagag

SEQ ID NO: 1011203 - RNA, 22 nt, Human
agccauccucccaccucagccu

SEQ ID NO: 1011204 - RNA, 22 nt, Human
gucuccugagacugcagucacc

SEQ ID NO: 1011205 - RNA, 22 nt, Human
agaaaugggccuugggacacaa

SEQ ID NO: 1011206 - RNA, 22 nt, Human
guggccugccgugugguauggg

SEQ ID NO: 1011207 - RNA, 22 nt, Human
ucccuggggauguuggccugcc

SEQ ID NO: 1011208 - RNA, 22 nt, Human
ucagcauaucuugagcuucaug

SEQ ID NO: 1011209 - RNA, 22 nt, Human
aagggcaggcagagaucauaua

SEQ ID NO: 1011210 - RNA, 22 nt, Human
ggagggagcauccccuugcuga

SEQ ID NO: 1011211 - RNA, 22 nt, Human
gugcuuaauacaugucaauaac

SEQ ID NO: 1011212 - RNA, 22 nt, Human
gcucuguacgcaggaugagggg

SEQ ID NO: 1011213 - RNA, 22 nt, Human
ggcagcaggcgacuucccuauu

SEQ ID NO: 1011214 - RNA, 22 nt, Human
ucagaggucacacagcaaguuu

SEQ ID NO: 1011215 - RNA, 22 nt, Human
gccuggcaggccucaugagggg

SEQ ID NO: 1011216 - RNA, 22 nt, Human
uacauguauguguacgugcaug

SEQ ID NO: 1011217 - RNA, 22 nt, Human
ugucauuuaguccucugugugu

SEQ ID NO: 1011218 - RNA, 22 nt, Human
ggcugggcugcugggucagagc

SEQ ID NO: 1011219 - RNA, 20 nt, Human
caggccagagguuugauggc

SEQ ID NO: 1011220 - RNA, 22 nt, Human
ggcagcagcaagguuggagcug

SEQ ID NO: 1011221 - RNA, 22 nt, Human
aaaggccuugagcugggugcca

SEQ ID NO: 1011222 - RNA, 22 nt, Human
uuccagaagccuccauauuacu

SEQ ID NO: 1011223 - RNA, 22 nt, Human
ucugagaguccaucuccaagcc

SEQ ID NO: 1011224 - RNA, 22 nt, Human
caggcagccugcggucugcaca

SEQ ID NO: 1011225 - RNA, 22 nt, Human
ccuccuggcccugggccuggaa

SEQ ID NO: 1011226 - RNA, 22 nt, Human
auaucuuuguaugguucagcag

SEQ ID NO: 1011227 - RNA, 22 nt, Human
gggccacacagaaccuccuggu

SEQ ID NO: 1011228 - RNA, 22 nt, Human
aaggcaguacuuuauguccaua

SEQ ID NO: 1011229 - RNA, 22 nt, Human
agaugaagauaucugcaggggc

SEQ ID NO: 1011230 - RNA, 22 nt, Human
ugcagccaucuuucuuggagga

SEQ ID NO: 1011231 - RNA, 20 nt, Human
agcugguuaucuuaauucuu

SEQ ID NO: 1011232 - RNA, 22 nt, Human
cagagacauuaagugccaugau

SEQ ID NO: 1011233 - RNA, 22 nt, Human
uuugcauugcauacaaggaacu

SEQ ID NO: 1011234 - RNA, 22 nt, Human
gggagggaaggaggcgccgugu

SEQ ID NO: 1011235 - RNA, 22 nt, Human
gcacaugagcugcugggauggg

SEQ ID NO: 1011236 - RNA, 22 nt, Human
gccuggcugagguggggaggca

SEQ ID NO: 1011237 - RNA, 22 nt, Human
ggguguguuccuaaggaaacca

SEQ ID NO: 1011238 - RNA, 19 nt, Human
ugcuuccucaccaucuccc

SEQ ID NO: 1011239 - RNA, 23 nt, Human
gugauuucagggaacagaaucag

SEQ ID NO: 1011240 - RNA, 22 nt, Human
gacuguguccaugugcuggauu

SEQ ID NO: 1011241 - RNA, 22 nt, Human
aacuuucaggcaaugaauauuu

SEQ ID NO: 1011242 - RNA, 22 nt, Human
auucuucagaauaucuggcacu

SEQ ID NO: 1011243 - RNA, 22 nt, Human
guguguccaggcgggagucaag

SEQ ID NO: 1011244 - RNA, 18 nt, Human
uccagagguguuggagcc

SEQ ID NO: 1011245 - RNA, 22 nt, Human
uggcaggagguuuucuccagga

SEQ ID NO: 1011246 - RNA, 23 nt, Human
agggccugauggcucccgcuggc

SEQ ID NO: 1011247 - RNA, 21 nt, Human
agauuguauggaggugagagg

SEQ ID NO: 1011248 - RNA, 22 nt, Human
gggagccuugggagugccagcc

SEQ ID NO: 1011249 - RNA, 22 nt, Human
aaggcacuguacuaguuaguua

SEQ ID NO: 1011250 - RNA, 22 nt, Human
ugugugcagccucugucuuugg

SEQ ID NO: 1011251 - RNA, 22 nt, Human
ggcagcugagcauggcuaccuu

SEQ ID NO: 1011252 - RNA, 22 nt, Human
uaugaacuguacuguacuaagc

SEQ ID NO: 1011253 - RNA, 20 nt, Human
uuucuguaaggcauuaaucu

SEQ ID NO: 1011254 - RNA, 22 nt, Human
augaugguuguccuaggugcau

SEQ ID NO: 1011255 - RNA, 22 nt, Human
acaggugaccugcucauaugaa

SEQ ID NO: 1011256 - RNA, 22 nt, Human
aaagaaggaccuggaggaggau

SEQ ID NO: 1011257 - RNA, 22 nt, Human
caguacuuaacuuauaggagag

SEQ ID NO: 1011258 - RNA, 22 nt, Human
aguacuuuacuucuuacaguuu

SEQ ID NO: 1011259 - RNA, 22 nt, Human
gcagagccugggggucugcgga

SEQ ID NO: 1011260 - RNA, 22 nt, Human
uuacuucuuacaaaagaaauau

SEQ ID NO: 1011261 - RNA, 22 nt, Human
cauuagggccaccauaacaaaa

SEQ ID NO: 1011262 - RNA, 22 nt, Human
augucuuucucacagccaguuc

SEQ ID NO: 1011263 - RNA, 22 nt, Human
gcagcuuucuacuuccuacagc

SEQ ID NO: 1011264 - RNA, 22 nt, Human
cugaaggauuuaguucuuugcu

SEQ ID NO: 1011265 - RNA, 22 nt, Human
aaggccaugaccacuugcugug

SEQ ID NO: 1011266 - RNA, 22 nt, Human
accauuuaauaaguauuuccau

SEQ ID NO: 1011267 - RNA, 22 nt, Human
uuuuaccugaaccacacaguau

SEQ ID NO: 1011268 - RNA, 22 nt, Human
gccuccuggauuuuagugccau

SEQ ID NO: 1011269 - RNA, 21 nt, Human
acaugcauagagagauuucug

SEQ ID NO: 1011270 - RNA, 22 nt, Human
uucuacaauaugaauaaugaag

SEQ ID NO: 1011271 - RNA, 22 nt, Human
ucccagccuuccuuguggugaa

SEQ ID NO: 1011272 - RNA, 22 nt, Human
gcugucugcugugcacugagca

SEQ ID NO: 1011273 - RNA, 22 nt, Human
uggcucugaucagauguccagu

SEQ ID NO: 1011274 - RNA, 22 nt, Human
auguguccacaggugugagaga

SEQ ID NO: 1011275 - RNA, 22 nt, Human
uggaaggcaugggaacuguucu

SEQ ID NO: 1011276 - RNA, 22 nt, Human
gggagggacacaaagaguuccc

SEQ ID NO: 1011277 - RNA, 22 nt, Human
auguagaaauuaggaugauagu

SEQ ID NO: 1011278 - RNA, 22 nt, Human
ccagcucccugaagccuggucu

SEQ ID NO: 1011279 - RNA, 22 nt, Human
caguagcauguaauaaagacag

SEQ ID NO: 1011280 - RNA, 22 nt, Human
gcugaaugaauguauuuuaaaa

SEQ ID NO: 1011281 - RNA, 22 nt, Human
ucagguggcuuggagggggacg

SEQ ID NO: 1011282 - RNA, 22 nt, Human
agggcuggcuccguuaccuuga

SEQ ID NO: 1011283 - RNA, 22 nt, Human
ugaaggccagcagagugaaggc

SEQ ID NO: 1011284 - RNA, 22 nt, Human
gccugggugucgaucacuagug

SEQ ID NO: 1011285 - RNA, 23 nt, Human
uuucaacuccugccauuauuucu

SEQ ID NO: 1011286 - RNA, 22 nt, Human
agaaagaacgcacuugugcugc

SEQ ID NO: 1011287 - RNA, 22 nt, Human
ugccuuggugcuucuucaugug

SEQ ID NO: 1011288 - RNA, 20 nt, Human
ccagagaguagguuagugau

SEQ ID NO: 1011289 - RNA, 22 nt, Human
aagcaacucccuccucauuuuu

SEQ ID NO: 1011290 - RNA, 22 nt, Human
guguccacggcugagaaugauu

SEQ ID NO: 1011291 - RNA, 22 nt, Human
aggucacacuuggaucauagaa

SEQ ID NO: 1011292 - RNA, 22 nt, Human
agacucaagacugcagaagacg

SEQ ID NO: 1011293 - RNA, 19 nt, Human
gguaaaagugagcuucagg

SEQ ID NO: 1011294 - RNA, 22 nt, Human
uuuguaaauagcaguacucaug

SEQ ID NO: 1011295 - RNA, 22 nt, Human
ucuguaguagguuguaguucuu

SEQ ID NO: 1011296 - RNA, 22 nt, Human
cuucugcaauaaguuuuggucc

SEQ ID NO: 1011297 - RNA, 20 nt, Human
ugugggcccuuggcuggcaa

SEQ ID NO: 1011298 - RNA, 20 nt, Human
gcugcucuccacggucugca

SEQ ID NO: 1011299 - RNA, 22 nt, Human
cacucugagaaguacaagcucc

SEQ ID NO: 1011300 - RNA, 22 nt, Human
ucucugaguaagugacaguuca

SEQ ID NO: 1011301 - RNA, 22 nt, Human
auuauuucucacucacauaaua

SEQ ID NO: 1011302 - RNA, 22 nt, Human
ggcuggcagaggggagucugug

SEQ ID NO: 1011303 - RNA, 22 nt, Human
agagcugcccacacagcagauu

SEQ ID NO: 1011304 - RNA, 22 nt, Human
acuaagugauucuaagcaucuu

SEQ ID NO: 1011305 - RNA, 19 nt, Human
ugagaggcuuaaggcagcu

SEQ ID NO: 1011306 - RNA, 22 nt, Human
uguuucagucccuguguucaau

SEQ ID NO: 1011307 - RNA, 22 nt, Human
caaugauggcuaggcagcugcu

SEQ ID NO: 1011308 - RNA, 22 nt, Human
gcuggcaggagccuuucccuuu

SEQ ID NO: 1011309 - RNA, 22 nt, Human
ggcccacacugacagcugagcu

SEQ ID NO: 1011310 - RNA, 22 nt, Human
uugcagcuuagugauguuaucu

SEQ ID NO: 1011311 - RNA, 22 nt, Human
cagugguggaaugaggaauugu

SEQ ID NO: 1011312 - RNA, 22 nt, Human
ucaggagcuugguagugugauu

SEQ ID NO: 1011313 - RNA, 22 nt, Human
uuggcuuccaggaucucagcag

SEQ ID NO: 1011314 - RNA, 21 nt, Human
ccagccucagaucagggagcu

SEQ ID NO: 1011315 - RNA, 19 nt, Human
uuacaucugcaacacuggu

SEQ ID NO: 1011316 - RNA, 22 nt, Human
acaaauauuuacugaauccacu

SEQ ID NO: 1011317 - RNA, 22 nt, Human
ccuuucagaugggcauggaccg

SEQ ID NO: 1011318 - RNA, 22 nt, Human
uguuuauuacaguucuuggaau

SEQ ID NO: 1011319 - RNA, 22 nt, Human
ucugcucagugcuuaucucuaa

SEQ ID NO: 1011320 - RNA, 22 nt, Human
uugaaaggugacauuguuagag

SEQ ID NO: 1011321 - RNA, 22 nt, Human
uagggagcucuggcagaaggaa

SEQ ID NO: 1011322 - RNA, 22 nt, Human
aaguuauugcagcaauccaagu

SEQ ID NO: 1011323 - RNA, 20 nt, Human
uuccagagaucugcauuuua

SEQ ID NO: 1011324 - RNA, 22 nt, Human
gaugcacuuucuuuucaacagu

SEQ ID NO: 1011325 - RNA, 22 nt, Human
agucucuuauucccuauugcug

SEQ ID NO: 1011326 - RNA, 22 nt, Human
uagaauaugauuaauuuucuua

SEQ ID NO: 1011327 - RNA, 20 nt, Human
gcugaggucauuaugccuca

SEQ ID NO: 1011328 - RNA, 22 nt, Human
agaugaaaagauaagcagcaau

SEQ ID NO: 1011329 - RNA, 22 nt, Human
acuucacagaaauuuuaugagg

SEQ ID NO: 1011330 - RNA, 22 nt, Human
ccuggaaggugaugguacagca

SEQ ID NO: 1011331 - RNA, 18 nt, Human
caguuuuuauaucuggca

SEQ ID NO: 1011332 - RNA, 22 nt, Human
agucccagaucuacaggaggga

SEQ ID NO: 1011333 - RNA, 22 nt, Human
guuauuaguaagacucgcacau

SEQ ID NO: 1011334 - RNA, 22 nt, Human
agcagcucuggcacuguagcau

SEQ ID NO: 1011335 - RNA, 22 nt, Human
uuuguacauccuaauucugagu

SEQ ID NO: 1011336 - RNA, 22 nt, Human
gugcuaaaggguuaugaacaag

SEQ ID NO: 1011337 - RNA, 20 nt, Human
agugcaagaaagcacagcug

SEQ ID NO: 1011338 - RNA, 22 nt, Human
ggcuggcaggcacaguaugcaa

SEQ ID NO: 1011339 - RNA, 22 nt, Human
acagagcuaauguugcauaggc

SEQ ID NO: 1011340 - RNA, 22 nt, Human
gcugguuagaaaacagagcuca

SEQ ID NO: 1011341 - RNA, 22 nt, Human
agaauuagucacaauuauagga

SEQ ID NO: 1011342 - RNA, 22 nt, Human
ccagcagaagcucccgcugggu

SEQ ID NO: 1011343 - RNA, 22 nt, Human
agugcugaagacuggcuaggga

SEQ ID NO: 1011344 - RNA, 21 nt, Human
uuagcaaagcaaacacaugcu

SEQ ID NO: 1011345 - RNA, 22 nt, Human
augcuguguauuuuacucuuuc

SEQ ID NO: 1011346 - RNA, 22 nt, Human
acagaacugggaaaugcacaua

SEQ ID NO: 1011347 - RNA, 22 nt, Human
ccucagaugucuuaaggcacug

SEQ ID NO: 1011348 - RNA, 22 nt, Human
gccaaaucuugcacacucuugu

SEQ ID NO: 1011349 - RNA, 22 nt, Human
ugaaugaugcaguauaaugaua

SEQ ID NO: 1011350 - RNA, 22 nt, Human
ugaguaauaaacugucuugcuc

SEQ ID NO: 1011351 - RNA, 22 nt, Human
agagcuguagcuuccuagagcc

SEQ ID NO: 1011352 - RNA, 22 nt, Human
auuaaauuaaguggcuaauuua

SEQ ID NO: 1011353 - RNA, 22 nt, Human
cccuugggccccagcucagggc

SEQ ID NO: 1011354 - RNA, 22 nt, Human
aucugguuuggggauccuugug

SEQ ID NO: 1011355 - RNA, 22 nt, Human
aaugcacauguuguaauaaaua

SEQ ID NO: 1011356 - RNA, 22 nt, Human
gagcagcugguaggugaaccca

SEQ ID NO: 1011357 - RNA, 22 nt, Human
uuugaaagggaaauaaacuccu

SEQ ID NO: 1011358 - RNA, 22 nt, Human
ccugaagcaaggguaggcaggu

SEQ ID NO: 1011359 - RNA, 22 nt, Human
gaggccuggugugucucccgcu

SEQ ID NO: 1011360 - RNA, 22 nt, Human
cugcugagcaucagggcugccc

SEQ ID NO: 1011361 - RNA, 22 nt, Human
cagcugagucugagguucuuug

SEQ ID NO: 1011362 - RNA, 22 nt, Human
ugaaaucuuagccauucugccu

SEQ ID NO: 1011363 - RNA, 20 nt, Human
ucugcccaccccggcuccca

SEQ ID NO: 1011364 - RNA, 22 nt, Human
cugaggugcuauggaggauacg

SEQ ID NO: 1011365 - RNA, 22 nt, Human
augaaggauggcuggcugcccu

SEQ ID NO: 1011366 - RNA, 22 nt, Human
ggcuuccuggggccuccugcaa

SEQ ID NO: 1011367 - RNA, 22 nt, Human
uagauauguguuuauuaugcug

SEQ ID NO: 1011368 - RNA, 22 nt, Human
uguggcucucagauccuccaau

SEQ ID NO: 1011369 - RNA, 22 nt, Human
ugucaaauuuuuauugcaguau

SEQ ID NO: 1011370 - RNA, 22 nt, Human
uauuucuuguuauucucguuga

SEQ ID NO: 1011371 - RNA, 22 nt, Human
agcucccagagcucgagaguaa

SEQ ID NO: 1011372 - RNA, 22 nt, Human
gcuggugcauuagcugcaguuc

SEQ ID NO: 1011373 - RNA, 22 nt, Human
aagcacauuguacauuugugcu

SEQ ID NO: 1011374 - RNA, 19 nt, Human
ugaggggcucacagucuca

SEQ ID NO: 1011375 - RNA, 22 nt, Human
ggaaagaggauaguggguaggu

SEQ ID NO: 1011376 - RNA, 19 nt, Human
uggcugggugccaauggcc

SEQ ID NO: 1011377 - RNA, 22 nt, Human
cucuccucugaaguggugaccc

SEQ ID NO: 1011378 - RNA, 22 nt, Human
ucagaggguggcugggagcauc

SEQ ID NO: 1011379 - RNA, 22 nt, Human
cagcugugcuguauuaagcucu

SEQ ID NO: 1011380 - RNA, 22 nt, Human
cccuggagugccggaaucaaga

SEQ ID NO: 1011381 - RNA, 22 nt, Human
uucacagggcagcagcugagcc

SEQ ID NO: 1011382 - RNA, 22 nt, Human
cugacagucucauugauuugcu

SEQ ID NO: 1011383 - RNA, 22 nt, Human
gcaaggcagcgcggaguagcua

SEQ ID NO: 1011384 - RNA, 22 nt, Human
cacagggcagagaccugggugc

SEQ ID NO: 1011385 - RNA, 19 nt, Human
ucccuuccugucgggcucc

SEQ ID NO: 1011386 - RNA, 22 nt, Human
uacccagggcuuuucugaugca

SEQ ID NO: 1011387 - RNA, 21 nt, Human
uccagggaacuucucaggaau

SEQ ID NO: 1011388 - RNA, 22 nt, Human
uuggauccaucucaggcauagg

SEQ ID NO: 1011389 - RNA, 20 nt, Human
agugugcauuuagagucugc

SEQ ID NO: 1011390 - RNA, 22 nt, Human
caaugauugcuauuuacauaaa

SEQ ID NO: 1011391 - RNA, 22 nt, Human
gucauuucuguuucuucagugc

SEQ ID NO: 1011392 - RNA, 22 nt, Human
aggcacuguggguguggccgga

SEQ ID NO: 1011393 - RNA, 22 nt, Human
ugggaggcuuccagaccuugcu

SEQ ID NO: 1011394 - RNA, 19 nt, Human
ucccagagucuagagguug

SEQ ID NO: 1011395 - RNA, 22 nt, Human
gagagaaaugugcaguuugggc

SEQ ID NO: 1011396 - RNA, 22 nt, Human
uccuuugacuucuugcagucca

SEQ ID NO: 1011397 - RNA, 22 nt, Human
uggcucagauuuuuguaggcuu

SEQ ID NO: 1011398 - RNA, 22 nt, Human
ucccaagugucuuggaccaggg

SEQ ID NO: 1011399 - RNA, 18 nt, Human
aaaugcuaggcuacauga

SEQ ID NO: 1011400 - RNA, 22 nt, Human
cagaccucaguccucaguagga

SEQ ID NO: 1011401 - RNA, 23 nt, Human
aggcugcagaagaauagggucau

SEQ ID NO: 1011402 - RNA, 21 nt, Human
uaaauaauaaguugcugagau

SEQ ID NO: 1011403 - RNA, 19 nt, Human
gagcugccuuuugaagacc

SEQ ID NO: 1011404 - RNA, 22 nt, Human
uucacagacauugcagacugaa

SEQ ID NO: 1011405 - RNA, 22 nt, Human
cucugaauggacacuccagugu

SEQ ID NO: 1011406 - RNA, 22 nt, Human
uucucucauucaaauuaaagug

SEQ ID NO: 1011407 - RNA, 22 nt, Human
cuggcagauuggggucagcagu

SEQ ID NO: 1011408 - RNA, 22 nt, Human
uuucuaaaugguggcugcauug

SEQ ID NO: 1011409 - RNA, 22 nt, Human
acauguggucaaucuguguagg

SEQ ID NO: 1011410 - RNA, 22 nt, Human
ucacugcaaggaggcuucucaa

SEQ ID NO: 1011411 - RNA, 22 nt, Human
ggcugcuucucacucauuugca

SEQ ID NO: 1011412 - RNA, 22 nt, Human
aauucuagcauugugaaaauau

SEQ ID NO: 1011413 - RNA, 22 nt, Human
auuucuguaacuuaugaaaguu

SEQ ID NO: 1011414 - RNA, 22 nt, Human
gagcuguccuaccaggaguccu

SEQ ID NO: 1011415 - RNA, 22 nt, Human
auguacauuuuccuaauguuuu

SEQ ID NO: 1011416 - RNA, 22 nt, Human
cucccagguuccgacgccucuu

SEQ ID NO: 1011417 - RNA, 22 nt, Human
caugggcuacagaagcaugcug

SEQ ID NO: 1011418 - RNA, 22 nt, Human
aaauacauacacuguacguggc

SEQ ID NO: 1011419 - RNA, 22 nt, Human
aguaugaagcugaaugauuuua

SEQ ID NO: 1011420 - RNA, 22 nt, Human
agccauugaauuuagugccuuu

SEQ ID NO: 1011421 - RNA, 21 nt, Human
uacugagaccucacagugugc

SEQ ID NO: 1011422 - RNA, 22 nt, Human
agguaaggcuguaagcuaagcc

SEQ ID NO: 1011423 - RNA, 22 nt, Human
acugaaggaaagccuuugcaug

SEQ ID NO: 1011424 - RNA, 22 nt, Human
uucuucaaagaugucuguugga

SEQ ID NO: 1011425 - RNA, 22 nt, Human
ccaggcugggcggggaaccugg

SEQ ID NO: 1011426 - RNA, 22 nt, Human
ugaaggccagggauuugcagcc

SEQ ID NO: 1011427 - RNA, 22 nt, Human
auaauuuaauuuucacaguggu

SEQ ID NO: 1011428 - RNA, 22 nt, Human
cagcuggaugggagaccauguu

SEQ ID NO: 1011429 - RNA, 22 nt, Human
ggagugaaucacuagaugcaga

SEQ ID NO: 1011430 - RNA, 22 nt, Human
uaaauguguaaaccuccauuac

SEQ ID NO: 1011431 - RNA, 22 nt, Human
ucucuucucuagugagcaacug

SEQ ID NO: 1011432 - RNA, 22 nt, Human
augcuacagaguuugaauaugu

SEQ ID NO: 1011433 - RNA, 21 nt, Human
uccaaaucccauucuguaguc

SEQ ID NO: 1011434 - RNA, 22 nt, Human
ccugcagggugcugccacagau

SEQ ID NO: 1011435 - RNA, 22 nt, Human
cuuugaauugccguuucaucug

SEQ ID NO: 1011436 - RNA, 22 nt, Human
ugggaccaagucauuucuuuag

SEQ ID NO: 1011437 - RNA, 22 nt, Human
aagcagcuuaaauuagagccug

SEQ ID NO: 1011438 - RNA, 22 nt, Human
uccaggcagcccuuccugacuc

SEQ ID NO: 1011439 - RNA, 22 nt, Human
cuuugaaagcucccaggacuua

SEQ ID NO: 1011440 - RNA, 18 nt, Human
agucucagcggaggagua

SEQ ID NO: 1011441 - RNA, 22 nt, Human
gcccugucggaacugcgaccuc

SEQ ID NO: 1011442 - RNA, 22 nt, Human
agcugccacugagggugcacag

SEQ ID NO: 1011443 - RNA, 22 nt, Human
ggucagccuuggauuugguagc

SEQ ID NO: 1011444 - RNA, 19 nt, Human
uccugcagaccagaccugu

SEQ ID NO: 1011445 - RNA, 22 nt, Human
auagaaaacagauguccuuaaa

SEQ ID NO: 1011446 - RNA, 22 nt, Human
auuuaagacugacuucaccagu

SEQ ID NO: 1011447 - RNA, 22 nt, Human
gcccugucccuuggcuucuagg

SEQ ID NO: 1011448 - RNA, 22 nt, Human
uuacaucuaaacugugaacaau

SEQ ID NO: 1011449 - RNA, 22 nt, Human
ucucagagauguuagggaagag

SEQ ID NO: 1011450 - RNA, 22 nt, Human
ccacagagcauuagauuucaga

SEQ ID NO: 1011451 - RNA, 22 nt, Human
uccuucuuugacaaguggcaga

SEQ ID NO: 1011452 - RNA, 22 nt, Human
gaggagguuccggguggagaag

SEQ ID NO: 1011453 - RNA, 22 nt, Human
ccugaggacacacgcugcagga

SEQ ID NO: 1011454 - RNA, 22 nt, Human
cuuucauaaaggaaaugaugag

SEQ ID NO: 1011455 - RNA, 22 nt, Human
gaugccuccaaaugagggcaga

SEQ ID NO: 1011456 - RNA, 22 nt, Human
ugccuugcacauaauauacauu

SEQ ID NO: 1011457 - RNA, 22 nt, Human
gagcuggcuaauacugacuuau

SEQ ID NO: 1011458 - RNA, 22 nt, Human
gccuggaggggccaggguggua

SEQ ID NO: 1011459 - RNA, 22 nt, Human
cucauggauauaagaacuguuu

SEQ ID NO: 1011460 - RNA, 23 nt, Human
agcuggaggcugucuacucccaa

SEQ ID NO: 1011461 - RNA, 22 nt, Human
uaaggcagaaauaugagcaggg

SEQ ID NO: 1011462 - RNA, 20 nt, Human
aauuuacucacagaaugaau

SEQ ID NO: 1011463 - RNA, 22 nt, Human
gucagcugucuccccagagugg

SEQ ID NO: 1011464 - RNA, 22 nt, Human
caguggucugugcuucuguaca

SEQ ID NO: 1011465 - RNA, 22 nt, Human
caguguuucugaguuccagcuc

SEQ ID NO: 1011466 - RNA, 22 nt, Human
cugggcaggagggcucuaugga

SEQ ID NO: 1011467 - RNA, 22 nt, Human
uuucucugcugccugugucgau

SEQ ID NO: 1011468 - RNA, 22 nt, Human
aacacugcugcuggguucugug

SEQ ID NO: 1011469 - RNA, 22 nt, Human
ugagcagaacacgggauccaug

SEQ ID NO: 1011470 - RNA, 18 nt, Human
ggcugugcguggaggcug

SEQ ID NO: 1011471 - RNA, 22 nt, Human
uccugccucuccaugcuaacua

SEQ ID NO: 1011472 - RNA, 22 nt, Human
ugggcacaaacaucugccuguu

SEQ ID NO: 1011473 - RNA, 22 nt, Human
gggaccuggcaccuuugcucug

SEQ ID NO: 1011474 - RNA, 22 nt, Human
ugggcuggagcuuguugcuucc

SEQ ID NO: 1011475 - RNA, 22 nt, Human
auuucccuccagggaaagcuua

SEQ ID NO: 1011476 - RNA, 22 nt, Human
gcuccagguauuugcccuuuua

SEQ ID NO: 1011477 - RNA, 22 nt, Human
ugcucuggguccugggccuccu

SEQ ID NO: 1011478 - RNA, 22 nt, Human
caauguguuugcauauuaaaau

SEQ ID NO: 1011479 - RNA, 22 nt, Human
agagccuugaagaucuggaaaa

SEQ ID NO: 1011480 - RNA, 22 nt, Human
augcagcugugggcaagaaaug

SEQ ID NO: 1011481 - RNA, 22 nt, Human
uagagaaauaagcuuugccuug

SEQ ID NO: 1011482 - RNA, 22 nt, Human
ucugccuggaugauggcagggc

SEQ ID NO: 1011483 - RNA, 22 nt, Human
gcagcccagguguagcucuuug

SEQ ID NO: 1011484 - RNA, 22 nt, Human
uuuuuccuagcgauuugucagc

SEQ ID NO: 1011485 - RNA, 22 nt, Human
ucccagggugcgccugcccucg

SEQ ID NO: 1011486 - RNA, 22 nt, Human
cugccagguuggcgcucgcucu

SEQ ID NO: 1011487 - RNA, 20 nt, Human
uggcccuguuuucuccaggc

SEQ ID NO: 1011488 - RNA, 22 nt, Human
uuguaaaugaccuuuucuaauu

SEQ ID NO: 1011489 - RNA, 22 nt, Human
uucacagaugccugaugugugg

SEQ ID NO: 1011490 - RNA, 22 nt, Human
ucccuggcagcuaagggugguc

SEQ ID NO: 1011491 - RNA, 22 nt, Human
cccaggcugaugggaugggcca

SEQ ID NO: 1011492 - RNA, 22 nt, Human
agugaaauagcauuuaugaagc

SEQ ID NO: 1011493 - RNA, 22 nt, Human
ucugagaguacgggcugcgcgc

SEQ ID NO: 1011494 - RNA, 22 nt, Human
aaaguuugaaugauauauuagu

SEQ ID NO: 1011495 - RNA, 22 nt, Human
caccagagugggugagggugau

SEQ ID NO: 1011496 - RNA, 22 nt, Human
uggggcuggcacagucucuauu

SEQ ID NO: 1011497 - RNA, 20 nt, Human
cucugcuuuaggagagucag

SEQ ID NO: 1011498 - RNA, 22 nt, Human
gaugcacugcaguauauacugu

SEQ ID NO: 1011499 - RNA, 22 nt, Human
gccuuugcaccaucagugcaau

SEQ ID NO: 1011500 - RNA, 22 nt, Human
cuggcagcgugagcagcaucca

SEQ ID NO: 1011501 - RNA, 22 nt, Human
ccauuuguucgcccagcuccaa

SEQ ID NO: 1011502 - RNA, 22 nt, Human
uccucuggggcgugguccugga

SEQ ID NO: 1011503 - RNA, 22 nt, Human
gcaggaugaaggcagaggcuga

SEQ ID NO: 1011504 - RNA, 22 nt, Human
ugcuuuauaaccauuucugugg

SEQ ID NO: 1011505 - RNA, 22 nt, Human
cucagagaggcaguggaaguca

SEQ ID NO: 1011506 - RNA, 22 nt, Human
uccaggcacgaggcccugugca

SEQ ID NO: 1011507 - RNA, 22 nt, Human
uagaaacagaaaacuguaauag

SEQ ID NO: 1011508 - RNA, 22 nt, Human
uugauuaaacaggcauauucaa

SEQ ID NO: 1011509 - RNA, 22 nt, Human
uuguuugaggucacugauauuu

SEQ ID NO: 1011510 - RNA, 22 nt, Human
ggcuucugguaaagaccacacc

SEQ ID NO: 1011511 - RNA, 22 nt, Human
ugagcccaggaguaugaggcug

SEQ ID NO: 1011512 - RNA, 22 nt, Human
uggccagguugggcuuugcagc

SEQ ID NO: 1011513 - RNA, 22 nt, Human
acuuucucaggaauucacagac

SEQ ID NO: 1011514 - RNA, 22 nt, Human
agcugccagcaucccggaaggg

SEQ ID NO: 1011515 - RNA, 22 nt, Human
ccuggccuggcacucccucugc

SEQ ID NO: 1011516 - RNA, 22 nt, Human
gcccucagaggacagcugacuu

SEQ ID NO: 1011517 - RNA, 20 nt, Human
cucugcugcccgccggcugc

SEQ ID NO: 1011518 - RNA, 22 nt, Human
cccagcccccgagugucuggaa

SEQ ID NO: 1011519 - RNA, 22 nt, Human
gcagcugguuaaugggagaauu

SEQ ID NO: 1011520 - RNA, 22 nt, Human
ggacagcccauacacaugucug

SEQ ID NO: 1011521 - RNA, 22 nt, Human
cuggggugagcagaaacagggg

SEQ ID NO: 1011522 - RNA, 18 nt, Human
uggagcugagugcugugc

SEQ ID NO: 1011523 - RNA, 22 nt, Human
ccagcuggugacauccccaacc

SEQ ID NO: 1011524 - RNA, 22 nt, Human
acauuguagacuuuucauaugu

SEQ ID NO: 1011525 - RNA, 22 nt, Human
cagcucccaguggcagcuccuu

SEQ ID NO: 1011526 - RNA, 22 nt, Human
cugcagcugucucuacugggca

SEQ ID NO: 1011527 - RNA, 22 nt, Human
gugcaugugcauccauguguac

SEQ ID NO: 1011528 - RNA, 22 nt, Human
uucuccaacacaagcaugaugu

SEQ ID NO: 1011529 - RNA, 22 nt, Human
ggaccagagcucgggcuucuca

SEQ ID NO: 1011530 - RNA, 22 nt, Human
ggccucaguuucuccauggguu

SEQ ID NO: 1011531 - RNA, 22 nt, Human
acagagcacauagauuggaguu

SEQ ID NO: 1011532 - RNA, 22 nt, Human
gagcaggcucugccuguguguc

SEQ ID NO: 1011533 - RNA, 22 nt, Human
uacauguaagacaugagacucu

SEQ ID NO: 1011534 - RNA, 22 nt, Human
cuccaggcuucaagggccggcc

SEQ ID NO: 1011535 - RNA, 22 nt, Human
augcugugcuggcuaaccaugg

SEQ ID NO: 1011536 - RNA, 22 nt, Human
cuuagggaauugggaggaugcc

SEQ ID NO: 1011537 - RNA, 22 nt, Human
ugcaaaauaaugaacgauuuuu

SEQ ID NO: 1011538 - RNA, 22 nt, Human
cggggacacacuggcagcuccu

SEQ ID NO: 1011539 - RNA, 19 nt, Human
ucucagagcccuagaggcc

SEQ ID NO: 1011540 - RNA, 22 nt, Human
gcugccugggcaggaggcgcug

SEQ ID NO: 1011541 - RNA, 20 nt, Human
cagcaguggaugagaguuuu

SEQ ID NO: 1011542 - RNA, 22 nt, Human
ucugagagguuaagcaauuuga

SEQ ID NO: 1011543 - RNA, 21 nt, Human
gcugccaccgcgugcuccagg

SEQ ID NO: 1011544 - RNA, 22 nt, Human
augacaguucuacacuuaaucu

SEQ ID NO: 1011545 - RNA, 22 nt, Human
cauagcaacagcaucaagucaa

SEQ ID NO: 1011546 - RNA, 22 nt, Human
aggggugaaggcccgauaggag

SEQ ID NO: 1011547 - RNA, 22 nt, Human
cugaggaugguguggucuucuc

SEQ ID NO: 1011548 - RNA, 22 nt, Human
gggcaggaugcaguuucagaga

SEQ ID NO: 1011549 - RNA, 22 nt, Human
ggcagaagaaaggcuaagucuc

SEQ ID NO: 1011550 - RNA, 22 nt, Human
uguaugcaccauuguauuaccu

SEQ ID NO: 1011551 - RNA, 22 nt, Human
cagggacagccuugggguggcg

SEQ ID NO: 1011552 - RNA, 22 nt, Human
gccugucucuuggaacuuggua

SEQ ID NO: 1011553 - RNA, 22 nt, Human
uuccuguaguugugcaauguac

SEQ ID NO: 1011554 - RNA, 22 nt, Human
gccuggugugcgccgcgcagcu

SEQ ID NO: 1011555 - RNA, 22 nt, Human
uggggcugugagacuacaggau

SEQ ID NO: 1011556 - RNA, 22 nt, Human
caggcuugcugcuagagcacuu

SEQ ID NO: 1011557 - RNA, 18 nt, Human
ccuggaccugucuccuuu

SEQ ID NO: 1011558 - RNA, 22 nt, Human
uccugccucacaguugaaguuu

SEQ ID NO: 1011559 - RNA, 21 nt, Human
acaggcucuggggaugcuggg

SEQ ID NO: 1011560 - RNA, 22 nt, Human
ugggaccucucuugagagagca

SEQ ID NO: 1011561 - RNA, 22 nt, Human
gccuggguccacugaucaugcu

SEQ ID NO: 1011562 - RNA, 22 nt, Human
ucagcugccccaguggccccag

SEQ ID NO: 1011563 - RNA, 22 nt, Human
gcugucugucucugucccacca

SEQ ID NO: 1011564 - RNA, 22 nt, Human
uuugcaaagugacuauuauaug

SEQ ID NO: 1011565 - RNA, 22 nt, Human
gguggccuuucaguggaucagg

SEQ ID NO: 1011566 - RNA, 22 nt, Human
ucacauuuuccuugguaucugu

SEQ ID NO: 1011567 - RNA, 22 nt, Human
ucacagacauggugagguaaca

SEQ ID NO: 1011568 - RNA, 22 nt, Human
gcugccaauccagcugugggag

SEQ ID NO: 1011569 - RNA, 22 nt, Human
gccagggggucagcaggcacuu

SEQ ID NO: 1011570 - RNA, 22 nt, Human
ugcucugggcaacagccucccu

SEQ ID NO: 1011571 - RNA, 22 nt, Human
caaauguaaauucuuuugaagc

SEQ ID NO: 1011572 - RNA, 23 nt, Human
agggcuccuuguugauuagcauu

SEQ ID NO: 1011573 - RNA, 22 nt, Human
agcuguguguuuccacugagcu

SEQ ID NO: 1011574 - RNA, 22 nt, Human
cucugucaggcugcagaugcuc

SEQ ID NO: 1011575 - RNA, 23 nt, Human
ucaugcccaggcuccagauguca

SEQ ID NO: 1011576 - RNA, 22 nt, Human
auacauacauguaugcacauac

SEQ ID NO: 1011577 - RNA, 22 nt, Human
ggagaaggugcuggucacugug

SEQ ID NO: 1011578 - RNA, 22 nt, Human
ccaggccuggccaggggaugcc

SEQ ID NO: 1011579 - RNA, 22 nt, Human
uggagaagucaaagugaacagg

SEQ ID NO: 1011580 - RNA, 22 nt, Human
uuucacauuuuauacuuaagcc

SEQ ID NO: 1011581 - RNA, 20 nt, Human
caguagcaauaauuagaagc

SEQ ID NO: 1011582 - RNA, 22 nt, Human
ccugucagaugaaguaauugug

SEQ ID NO: 1011583 - RNA, 22 nt, Human
cagaccagcucuaugaacccaa

SEQ ID NO: 1011584 - RNA, 22 nt, Human
cauuaagauuuuuuucuacugg

SEQ ID NO: 1011585 - RNA, 22 nt, Human
cugccagcaaugugaccaugcu

SEQ ID NO: 1011586 - RNA, 22 nt, Human
caguugcuacaguucaagugug

SEQ ID NO: 1011587 - RNA, 22 nt, Human
cugugcuuaccugcccagguga

SEQ ID NO: 1011588 - RNA, 22 nt, Human
ugccagcacaaguuaagagauc

SEQ ID NO: 1011589 - RNA, 22 nt, Human
gauuuccuagacauggggcaga

SEQ ID NO: 1011590 - RNA, 22 nt, Human
acagagcauuugggacagagag

SEQ ID NO: 1011591 - RNA, 22 nt, Human
agcagagcugcaguggccugcu

SEQ ID NO: 1011592 - RNA, 21 nt, Human
agacagaacaacugcucucca

SEQ ID NO: 1011593 - RNA, 22 nt, Human
cuauuucaaggcccagauauga

SEQ ID NO: 1011594 - RNA, 22 nt, Human
gaguggggcguggauccagcgu

SEQ ID NO: 1011595 - RNA, 22 nt, Human
auucuagaugcuguaaguagca

SEQ ID NO: 1011596 - RNA, 22 nt, Human
cugguggggaguccuggucucc

SEQ ID NO: 1011597 - RNA, 20 nt, Human
cagagcuguuauggaugaug

SEQ ID NO: 1011598 - RNA, 22 nt, Human
cagaggcuguguaggcagacug

SEQ ID NO: 1011599 - RNA, 22 nt, Human
uaugcauaugaccccaagcuug

SEQ ID NO: 1011600 - RNA, 22 nt, Human
ccaaggcuccucagcuggucuu

SEQ ID NO: 1011601 - RNA, 22 nt, Human
uuauggcauauuccucauugua

SEQ ID NO: 1011602 - RNA, 22 nt, Human
ugaccaaagaguugcuuguauu

SEQ ID NO: 1011603 - RNA, 18 nt, Human
cagagcagagguggagcg

SEQ ID NO: 1011604 - RNA, 22 nt, Human
augcaguaaauguuaagaaaaa

SEQ ID NO: 1011605 - RNA, 22 nt, Human
agucccagaucuccauucgguc

SEQ ID NO: 1011606 - RNA, 22 nt, Human
gugcuuccugccuggugccuuu

SEQ ID NO: 1011607 - RNA, 22 nt, Human
gcagauggcucagacacugggg

SEQ ID NO: 1011608 - RNA, 22 nt, Human
aggcugggaagguaaaguugua

SEQ ID NO: 1011609 - RNA, 22 nt, Human
acaaaggugcgucccuucagcu

SEQ ID NO: 1011610 - RNA, 22 nt, Human
cuggagccauguauagccuaug

SEQ ID NO: 1011611 - RNA, 18 nt, Human
cccucuccugcuaguggg

SEQ ID NO: 1011612 - RNA, 22 nt, Human
uccugaggcucacuuugaaugu

SEQ ID NO: 1011613 - RNA, 21 nt, Human
ucauccagguccugcuucuuc

SEQ ID NO: 1011614 - RNA, 22 nt, Human
agggcagagggugccucaccug

SEQ ID NO: 1011615 - RNA, 21 nt, Human
uacagaaugcgcuucagucug

SEQ ID NO: 1011616 - RNA, 21 nt, Human
aaguaaaucagagaaauaacc

SEQ ID NO: 1011617 - RNA, 22 nt, Human
cagcuugugcaaagguccuggg

SEQ ID NO: 1011618 - RNA, 22 nt, Human
ugcugcugauggcaccuaggca

SEQ ID NO: 1011619 - RNA, 19 nt, Human
caugagcugcucacuuccc

SEQ ID NO: 1011620 - RNA, 22 nt, Human
ugaacagauggcccagcagagg

SEQ ID NO: 1011621 - RNA, 22 nt, Human
cccugcaggcucagacuggagu

SEQ ID NO: 1011622 - RNA, 22 nt, Human
aucaguuuauacuuauaaaucu

SEQ ID NO: 1011623 - RNA, 18 nt, Human
uagggcucuagggaguga

SEQ ID NO: 1011624 - RNA, 22 nt, Human
guuagggaagcgcuguguucuu

SEQ ID NO: 1011625 - RNA, 22 nt, Human
gccacagggcagaugcgcagag

SEQ ID NO: 1011626 - RNA, 22 nt, Human
agagcccucuucacugccccuu

SEQ ID NO: 1011627 - RNA, 22 nt, Human
ggcaaaguuuucaucucauaac

SEQ ID NO: 1011628 - RNA, 22 nt, Human
ugcagcagguuccaaaggguua

SEQ ID NO: 1011629 - RNA, 22 nt, Human
cccuggccagcucaugucugag

SEQ ID NO: 1011630 - RNA, 22 nt, Human
ucugcagcuugcacaggcaggc

SEQ ID NO: 1011631 - RNA, 22 nt, Human
ggugggcaggcgaggcccaggu

SEQ ID NO: 1011632 - RNA, 22 nt, Human
ucuggcucuguguccucaccca

SEQ ID NO: 1011633 - RNA, 22 nt, Human
gaccauuuguugaaaagauuau

SEQ ID NO: 1011634 - RNA, 22 nt, Human
uucagagacagcaaccaggaca

SEQ ID NO: 1011635 - RNA, 22 nt, Human
ucuguaucuaauuuuacaguag

SEQ ID NO: 1011636 - RNA, 22 nt, Human
cagcucucacacccuccuccca

SEQ ID NO: 1011637 - RNA, 22 nt, Human
agggaggaucugcuccuugucu

SEQ ID NO: 1011638 - RNA, 22 nt, Human
guucuucacauuucauugagga

SEQ ID NO: 1011639 - RNA, 22 nt, Human
acagagcugggaucugaaccca

SEQ ID NO: 1011640 - RNA, 22 nt, Human
cucugggcaaguaugauagaaa

SEQ ID NO: 1011641 - RNA, 22 nt, Human
ggccagaaguuggaaaagagcc

SEQ ID NO: 1011642 - RNA, 22 nt, Human
cagacagaccugcaagggcaca

SEQ ID NO: 1011643 - RNA, 22 nt, Human
aaugcuuuuugcgaaaugugca

SEQ ID NO: 1011644 - RNA, 22 nt, Human
gcucccacugcagcccugagcc

SEQ ID NO: 1011645 - RNA, 22 nt, Human
uggaguucauccaugacagcuu

SEQ ID NO: 1011646 - RNA, 22 nt, Human
uuucacauuuguuuuaagaagu

SEQ ID NO: 1011647 - RNA, 22 nt, Human
gugcuuuccauccucccugcug

SEQ ID NO: 1011648 - RNA, 22 nt, Human
accuuucauuaaagucuguagu

SEQ ID NO: 1011649 - RNA, 22 nt, Human
ugcuucucccaaccagggccug

SEQ ID NO: 1011650 - RNA, 22 nt, Human
acaacaggguaaggcaggccau

SEQ ID NO: 1011651 - RNA, 23 nt, Human
uccucccaaauuucagccucauu

SEQ ID NO: 1011652 - RNA, 22 nt, Human
ccauaaggagccagacauucca

SEQ ID NO: 1011653 - RNA, 18 nt, Human
ggcugccuguuccugaag

SEQ ID NO: 1011654 - RNA, 19 nt, Human
gccugcagaaaaggcaggg

SEQ ID NO: 1011655 - RNA, 22 nt, Human
cagcaugguggagcugcucuuu

SEQ ID NO: 1011656 - RNA, 22 nt, Human
ggcaccuggauguagcagugaa

SEQ ID NO: 1011657 - RNA, 22 nt, Human
aaaguguggucguucauuuugu

SEQ ID NO: 1011658 - RNA, 17 nt, Human
ggugagaccucccacuc

SEQ ID NO: 1011659 - RNA, 22 nt, Human
caugcacaacauacucaagagg

SEQ ID NO: 1011660 - RNA, 22 nt, Human
ucaggugggaccugcuaggaca

SEQ ID NO: 1011661 - RNA, 22 nt, Human
ugucuucaucucagacacaguu

SEQ ID NO: 1011662 - RNA, 22 nt, Human
cagagcuguuacuauucaugaa

SEQ ID NO: 1011663 - RNA, 22 nt, Human
ucugaggcauacccaggccccc

SEQ ID NO: 1011664 - RNA, 22 nt, Human
caggccugagacaucugagaua

SEQ ID NO: 1011665 - RNA, 23 nt, Human
uggacgccgacuuuggaggcgcu

SEQ ID NO: 1011666 - RNA, 22 nt, Human
ccaggguggggcaggcccacug

SEQ ID NO: 1011667 - RNA, 22 nt, Human
ugccaggccucaggagucucca

SEQ ID NO: 1011668 - RNA, 22 nt, Human
uuauuauugugaccugagaaug

SEQ ID NO: 1011669 - RNA, 22 nt, Human
aauuccugucuuaacaguucug

SEQ ID NO: 1011670 - RNA, 22 nt, Human
uuuuauguaauccuuacugucg

SEQ ID NO: 1011671 - RNA, 22 nt, Human
gcugucuguggugucagcugac

SEQ ID NO: 1011672 - RNA, 22 nt, Human
aagcagaaaaacugagcuccaa

SEQ ID NO: 1011673 - RNA, 22 nt, Human
uguuaaauguuccuuuacugga

SEQ ID NO: 1011674 - RNA, 22 nt, Human
caacagaagguguacuacugaa

SEQ ID NO: 1011675 - RNA, 22 nt, Human
ugucucagaggcaggaagagcc

SEQ ID NO: 1011676 - RNA, 22 nt, Human
uccagaaacuuuuccagucuca

SEQ ID NO: 1011677 - RNA, 22 nt, Human
caguauguuugggagacaugac

SEQ ID NO: 1011678 - RNA, 22 nt, Human
augugucuuugagacucugcua

SEQ ID NO: 1011679 - RNA, 22 nt, Human
guugggaaggcaagaaguagaa

SEQ ID NO: 1011680 - RNA, 22 nt, Human
gugccugggguugagcuaugaa

SEQ ID NO: 1011681 - RNA, 22 nt, Human
guccucuguuagaaaugugcuu

SEQ ID NO: 1011682 - RNA, 22 nt, Human
gcugggcacugucccauaggcu

SEQ ID NO: 1011683 - RNA, 22 nt, Human
guccugggcccaggggcugccu

SEQ ID NO: 1011684 - RNA, 22 nt, Human
gcauuccugagaaugcagagug

SEQ ID NO: 1011685 - RNA, 22 nt, Human
ggccugccucacagucagcacc

SEQ ID NO: 1011686 - RNA, 22 nt, Human
uucacauaaugauacaaagcuu

SEQ ID NO: 1011687 - RNA, 22 nt, Human
uuaaauauuauguugucugcaa

SEQ ID NO: 1011688 - RNA, 22 nt, Human
gggcuguggagccgcgagggcu

SEQ ID NO: 1011689 - RNA, 22 nt, Human
agcucccagaguccucugccca

SEQ ID NO: 1011690 - RNA, 22 nt, Human
acuugauuuugaaccuuucuac

SEQ ID NO: 1011691 - RNA, 22 nt, Human
uaugcauaauuggauaaguaga

SEQ ID NO: 1011692 - RNA, 22 nt, Human
uggcagcaaaaccagaaucaga

SEQ ID NO: 1011693 - RNA, 20 nt, Human
gucucaaguaucucacaguc

SEQ ID NO: 1011694 - RNA, 22 nt, Human
ucugggagaagcugaugugaag

SEQ ID NO: 1011695 - RNA, 20 nt, Human
ccacaggaguccagucgacc

SEQ ID NO: 1011696 - RNA, 22 nt, Human
gugcuuucugcugcauuccucu

SEQ ID NO: 1011697 - RNA, 21 nt, Human
agaaaaaccagcauguuuuca

SEQ ID NO: 1011698 - RNA, 19 nt, Human
ggcagcuggacgcuguuca

SEQ ID NO: 1011699 - RNA, 22 nt, Human
uaacacauauuucaagaguagu

SEQ ID NO: 1011700 - RNA, 17 nt, Human
gcugccaccuuuggagc

SEQ ID NO: 1011701 - RNA, 22 nt, Human
auggaaagccaguguuccauca

SEQ ID NO: 1011702 - RNA, 22 nt, Human
ucaguguagcagacuuguagcc

SEQ ID NO: 1011703 - RNA, 22 nt, Human
acagggcccuugccagcacaag

SEQ ID NO: 1011704 - RNA, 22 nt, Human
uggccaggcagguagaacggcc

SEQ ID NO: 1011705 - RNA, 22 nt, Human
ccagagcuaaacacacaggcug

SEQ ID NO: 1011706 - RNA, 22 nt, Human
guguaauuauauaaagaucuac

SEQ ID NO: 1011707 - RNA, 22 nt, Human
uggaaauacuugccauaaaacu

SEQ ID NO: 1011708 - RNA, 22 nt, Human
ccuccuuuccuguuuuccugag

SEQ ID NO: 1011709 - RNA, 22 nt, Human
gcagagcauguccucaggacag

SEQ ID NO: 1011710 - RNA, 22 nt, Human
auugacaagugagcugggcugc

SEQ ID NO: 1011711 - RNA, 22 nt, Human
cagagcauaauugacaugaggu

SEQ ID NO: 1011712 - RNA, 22 nt, Human
gggcugccuuucuucugggagc

SEQ ID NO: 1011713 - RNA, 22 nt, Human
gcagggaccugccacugcuguc

SEQ ID NO: 1011714 - RNA, 22 nt, Human
acagcuuugggcaaugcuauga

SEQ ID NO: 1011715 - RNA, 22 nt, Human
gcagggacaccuuugugaagcu

SEQ ID NO: 1011716 - RNA, 22 nt, Human
ugucagaugcgauaaacuagug

SEQ ID NO: 1011717 - RNA, 22 nt, Human
gcacagggaggcuggccuggcc

SEQ ID NO: 1011718 - RNA, 22 nt, Human
ugacagaacagguugggagcaa

SEQ ID NO: 1011719 - RNA, 22 nt, Human
acuguucauauucuuagaaauu

SEQ ID NO: 1011720 - RNA, 22 nt, Human
gaaacauacgauuuaggagaaa

SEQ ID NO: 1011721 - RNA, 22 nt, Human
cagagcugacccaaggauugaa

SEQ ID NO: 1011722 - RNA, 22 nt, Human
agcgggugcugugucagcccuc

SEQ ID NO: 1011723 - RNA, 22 nt, Human
agcagugggugacagagcugag

SEQ ID NO: 1011724 - RNA, 18 nt, Human
cauaauuuucuuucuuua

SEQ ID NO: 1011725 - RNA, 22 nt, Human
ggagccaguauuuaguggucuu

SEQ ID NO: 1011726 - RNA, 22 nt, Human
cugugcuucgcaacuccaaggu

SEQ ID NO: 1011727 - RNA, 22 nt, Human
ccugagccugaguggugcaggg

SEQ ID NO: 1011728 - RNA, 22 nt, Human
cucaggguaaugaaagacgaau

SEQ ID NO: 1011729 - RNA, 22 nt, Human
auguucuuguucaaaugucagu

SEQ ID NO: 1011730 - RNA, 22 nt, Human
uuuggacuuagccugcagaauu

SEQ ID NO: 1011731 - RNA, 22 nt, Human
caggggcugugggcggagccuc

SEQ ID NO: 1011732 - RNA, 22 nt, Human
gagcccuccauggagccaggca

SEQ ID NO: 1011733 - RNA, 22 nt, Human
cuguccugcaguugggggcagg

SEQ ID NO: 1011734 - RNA, 22 nt, Human
aagggccuccuggggagccugg

SEQ ID NO: 1011735 - RNA, 20 nt, Human
ucucaggguucagcaaagua

SEQ ID NO: 1011736 - RNA, 20 nt, Human
cauuuguuagcuuucuacug

SEQ ID NO: 1011737 - RNA, 22 nt, Human
acauuucucuuagaguuggacu

SEQ ID NO: 1011738 - RNA, 22 nt, Human
aagaggaacugggggcugaguc

SEQ ID NO: 1011739 - RNA, 22 nt, Human
ggugggcagcucuuggcaggca

SEQ ID NO: 1011740 - RNA, 22 nt, Human
ucagggcaaugucccucagaag

SEQ ID NO: 1011741 - RNA, 22 nt, Human
gcagagccuugcgucaugugcc

SEQ ID NO: 1011742 - RNA, 22 nt, Human
agugucugccagcugccaggug

SEQ ID NO: 1011743 - RNA, 22 nt, Human
gucucccacuuucuggccucuu

SEQ ID NO: 1011744 - RNA, 22 nt, Human
aggacaggauugagcugaacug

SEQ ID NO: 1011745 - RNA, 22 nt, Human
caucaaauaggaauauuuggca

SEQ ID NO: 1011746 - RNA, 22 nt, Human
cuucugugauuugguuaggaua

SEQ ID NO: 1011747 - RNA, 23 nt, Human
agaggcaggaguggcuugcccgg

SEQ ID NO: 1011748 - RNA, 22 nt, Human
uuucaucuucccagagaccuug

SEQ ID NO: 1011749 - RNA, 22 nt, Human
cagagccaucccagccuguggu

SEQ ID NO: 1011750 - RNA, 22 nt, Human
ggagaaggaagaaagcuacuau

SEQ ID NO: 1011751 - RNA, 22 nt, Human
cagcccaaagccccaggcuaga

SEQ ID NO: 1011752 - RNA, 22 nt, Human
cugggcagugguggcccuuccc

SEQ ID NO: 1011753 - RNA, 23 nt, Human
auguaucucauccaaggaagcuc

SEQ ID NO: 1011754 - RNA, 22 nt, Human
uccucagggcggccuccgucuu

SEQ ID NO: 1011755 - RNA, 21 nt, Human
gcaggguccuuuccauuccua

SEQ ID NO: 1011756 - RNA, 22 nt, Human
uaucuguuaggaucagagcugg

SEQ ID NO: 1011757 - RNA, 22 nt, Human
aucuaagaguuaacaucaagaa

SEQ ID NO: 1011758 - RNA, 22 nt, Human
gauuuccucacuaacauccauc

SEQ ID NO: 1011759 - RNA, 19 nt, Human
aggccugggguuuugcacu

SEQ ID NO: 1011760 - RNA, 22 nt, Human
uuucaguuacugcuauaucauu

SEQ ID NO: 1011761 - RNA, 22 nt, Human
cugucagcacucuacuacagau

SEQ ID NO: 1011762 - RNA, 22 nt, Human
ucagucucuggggcuucuguuu

SEQ ID NO: 1011763 - RNA, 21 nt, Human
uuucacaaaaguaugugacaa

SEQ ID NO: 1011764 - RNA, 19 nt, Human
augauacaggugaaaauug

SEQ ID NO: 1011765 - RNA, 22 nt, Human
uucucacuauguauguagauug

SEQ ID NO: 1011766 - RNA, 22 nt, Human
guguccagggccguguugucuu

SEQ ID NO: 1011767 - RNA, 19 nt, Human
ugagagugaggaaggcuuc

SEQ ID NO: 1011768 - RNA, 22 nt, Human
guuucaaauagguuucagcaaa

SEQ ID NO: 1011769 - RNA, 22 nt, Human
gucauuccuauccauuugauac

SEQ ID NO: 1011770 - RNA, 22 nt, Human
ccaggcugcucacaagcugccc

SEQ ID NO: 1011771 - RNA, 22 nt, Human
agucucagcuacuugggaggcu

SEQ ID NO: 1011772 - RNA, 22 nt, Human
ugcauuauuugcaugugccugu

SEQ ID NO: 1011773 - RNA, 22 nt, Human
aagcucugcucagcagacuagg

SEQ ID NO: 1011774 - RNA, 22 nt, Human
gcugccagcucacucuccugag

SEQ ID NO: 1011775 - RNA, 22 nt, Human
ugugaaggagaugaagggagug

SEQ ID NO: 1011776 - RNA, 22 nt, Human
cugcagggugacguugcccacc

SEQ ID NO: 1011777 - RNA, 22 nt, Human
cagggcucccugcagccucugu

SEQ ID NO: 1011778 - RNA, 22 nt, Human
ucccagggcagcuguccagaag

SEQ ID NO: 1011779 - RNA, 22 nt, Human
ugcuuuauugcaucaguguggg

SEQ ID NO: 1011780 - RNA, 22 nt, Human
ggcuucuccccuuugagucuuc

SEQ ID NO: 1011781 - RNA, 22 nt, Human
ugcauuucagaagaaaauucgg

SEQ ID NO: 1011782 - RNA, 22 nt, Human
agaccagcugccucccagggcc

SEQ ID NO: 1011783 - RNA, 18 nt, Human
agaguguucucagugaaa

SEQ ID NO: 1011784 - RNA, 22 nt, Human
uggagcagccaugaugacagag

SEQ ID NO: 1011785 - RNA, 22 nt, Human
cugcugugcaacauugcaccua

SEQ ID NO: 1011786 - RNA, 19 nt, Human
uguuuuguuaaagcagucc

SEQ ID NO: 1011787 - RNA, 22 nt, Human
ucccaggcaaaggcagcucauu

SEQ ID NO: 1011788 - RNA, 22 nt, Human
agaggagguggugaugcuuuaa

SEQ ID NO: 1011789 - RNA, 18 nt, Human
acacugcagcagucugcu

SEQ ID NO: 1011790 - RNA, 22 nt, Human
guggcaggucccauuggagcag

SEQ ID NO: 1011791 - RNA, 22 nt, Human
augaguugaagcuacaagaggc

SEQ ID NO: 1011792 - RNA, 22 nt, Human
aguugaauaauuagacauaucu

SEQ ID NO: 1011793 - RNA, 22 nt, Human
ugcugccaagcccgugcuccug

SEQ ID NO: 1011794 - RNA, 22 nt, Human
uggccugauuuugcuaagagaa

SEQ ID NO: 1011795 - RNA, 22 nt, Human
aaauguguuugauaggaauauu

SEQ ID NO: 1011796 - RNA, 22 nt, Human
cuggccuggcagggagggcaug

SEQ ID NO: 1011797 - RNA, 22 nt, Human
agugaaaugacugaaucagaua

SEQ ID NO: 1011798 - RNA, 22 nt, Human
uugacagcuauuuugcuuugau

SEQ ID NO: 1011799 - RNA, 22 nt, Human
ugggagcacccugaggagcuuc

SEQ ID NO: 1011800 - RNA, 22 nt, Human
agccucuguagaaagcagugug

SEQ ID NO: 1011801 - RNA, 22 nt, Human
ccagagccucuuaugaagaucg

SEQ ID NO: 1011802 - RNA, 22 nt, Human
augugaaacugaagcauccaua

SEQ ID NO: 1011803 - RNA, 22 nt, Human
ggccccugcggacugccuagag

SEQ ID NO: 1011804 - RNA, 22 nt, Human
augcucuggaguacgugaaauu

SEQ ID NO: 1011805 - RNA, 22 nt, Human
cccagcucucugcucuuagccu

SEQ ID NO: 1011806 - RNA, 18 nt, Human
acccucuggcuucugagc

SEQ ID NO: 1011807 - RNA, 22 nt, Human
uucauucuugucuuuguauagu

SEQ ID NO: 1011808 - RNA, 22 nt, Human
ugcaaacaggagaguaaguaua

SEQ ID NO: 1011809 - RNA, 22 nt, Human
agcaccaucagaugcaauaucu

SEQ ID NO: 1011810 - RNA, 22 nt, Human
caugcuuuaccaaagcagugau

SEQ ID NO: 1011811 - RNA, 23 nt, Human
agcagccauagggaagcaauaca

SEQ ID NO: 1011812 - RNA, 22 nt, Human
ccaggagcagauauggacauaa

SEQ ID NO: 1011813 - RNA, 17 nt, Human
uagcuguguuucagcua

SEQ ID NO: 1011814 - RNA, 22 nt, Human
ggcuguggggccggguacagug

SEQ ID NO: 1011815 - RNA, 22 nt, Human
agaggcuggauugagcauagac

SEQ ID NO: 1011816 - RNA, 22 nt, Human
cucagagucccuucccucgugg

SEQ ID NO: 1011817 - RNA, 22 nt, Human
uggagccaugccuggccuuucc

SEQ ID NO: 1011818 - RNA, 22 nt, Human
aagauuuacuagcauaauagcu

SEQ ID NO: 1011819 - RNA, 22 nt, Human
cugcugcauuccucuuuaugag

SEQ ID NO: 1011820 - RNA, 22 nt, Human
uucuuaaagaggcaaaacacag

SEQ ID NO: 1011821 - RNA, 22 nt, Human
gggaccaggugggugcauuccg

SEQ ID NO: 1011822 - RNA, 22 nt, Human
gucagcagugucagcucugggg

SEQ ID NO: 1011823 - RNA, 22 nt, Human
gcugucugcaucucuagagcuu

SEQ ID NO: 1011824 - RNA, 22 nt, Human
cugagccagagggagucggguc

SEQ ID NO: 1011825 - RNA, 22 nt, Human
aaggucauggcaaauuacuuuu

SEQ ID NO: 1011826 - RNA, 17 nt, Human
gagccacccugugcgag

SEQ ID NO: 1011827 - RNA, 17 nt, Human
agugacuuggaaagagc

SEQ ID NO: 1011828 - RNA, 22 nt, Human
gaggcagcaaaauauaucauaa

SEQ ID NO: 1011829 - RNA, 22 nt, Human
caggguagacaguaggugucug

SEQ ID NO: 1011830 - RNA, 22 nt, Human
uaauuucuaauucauuuucagu

SEQ ID NO: 1011831 - RNA, 22 nt, Human
gggcaguggguggcugcagccu

SEQ ID NO: 1011832 - RNA, 22 nt, Human
gacagagugcagggcuagaaga

SEQ ID NO: 1011833 - RNA, 22 nt, Human
ggcaguggugggaggcucgcuc

SEQ ID NO: 1011834 - RNA, 22 nt, Human
ucaugaaucguggaaugauuua

SEQ ID NO: 1011835 - RNA, 22 nt, Human
cuguauuuguccucuauuuauu

SEQ ID NO: 1011836 - RNA, 22 nt, Human
caauagcagcuucugaaugcaa

SEQ ID NO: 1011837 - RNA, 22 nt, Human
ucuguucagaaauggaagugcc

SEQ ID NO: 1011838 - RNA, 22 nt, Human
uaagaacuucggacauguuauc

SEQ ID NO: 1011839 - RNA, 22 nt, Human
uugugaguagugccgcaauaaa

SEQ ID NO: 1011840 - RNA, 22 nt, Human
aggcugugaguuuugucucaga

SEQ ID NO: 1011841 - RNA, 22 nt, Human
gggauggggagcuggaaagggg

SEQ ID NO: 1011842 - RNA, 22 nt, Human
cagagcugagaauguugaugcu

SEQ ID NO: 1011843 - RNA, 22 nt, Human
cauuaucucuucuauaugcuag

SEQ ID NO: 1011844 - RNA, 22 nt, Human
aagggacccuggaucaaaugga

SEQ ID NO: 1011845 - RNA, 21 nt, Human
ccacaggggcuccccugucag

SEQ ID NO: 1011846 - RNA, 22 nt, Human
caggugcugcguggcggagcug

SEQ ID NO: 1011847 - RNA, 22 nt, Human
aagggaggccagagguuuugca

SEQ ID NO: 1011848 - RNA, 22 nt, Human
ucuugcuaaagaccaacacauu

SEQ ID NO: 1011849 - RNA, 22 nt, Human
cagaacauucacucauaugugg

SEQ ID NO: 1011850 - RNA, 22 nt, Human
ggcugcugggaauaugccagcu

SEQ ID NO: 1011851 - RNA, 22 nt, Human
gcucacagccggcuggcagggg

SEQ ID NO: 1011852 - RNA, 22 nt, Human
agggcugcaggcaagauauggc

SEQ ID NO: 1011853 - RNA, 22 nt, Human
uucuugauuucaugcaguuaag

SEQ ID NO: 1011854 - RNA, 19 nt, Human
gcucagagggcccugugcu

SEQ ID NO: 1011855 - RNA, 22 nt, Human
gcagcugccuauucagggcuug

SEQ ID NO: 1011856 - RNA, 20 nt, Human
cucuuaaauguaaaguaggc

SEQ ID NO: 1011857 - RNA, 22 nt, Human
cuccuuccugccccagugauaa

SEQ ID NO: 1011858 - RNA, 22 nt, Human
aggaccagaggccagagucagc

SEQ ID NO: 1011859 - RNA, 22 nt, Human
cagcauuuagaauuugaagugu

SEQ ID NO: 1011860 - RNA, 22 nt, Human
cacaggagcuguggggcagugu

SEQ ID NO: 1011861 - RNA, 19 nt, Human
ugcagccacgugagagacu

SEQ ID NO: 1011862 - RNA, 22 nt, Human
cugugcuggcagaccuggaguu

SEQ ID NO: 1011863 - RNA, 22 nt, Human
cugcagggcagggccuccuggc

SEQ ID NO: 1011864 - RNA, 22 nt, Human
cagacaggcuagccagacucac

SEQ ID NO: 1011865 - RNA, 22 nt, Human
aguuugaaauguuggcaauauu

SEQ ID NO: 1011866 - RNA, 22 nt, Human
uuacauuuggcuauguccucua

SEQ ID NO: 1011867 - RNA, 22 nt, Human
gcaaaugaguuguaacauaaaa

SEQ ID NO: 1011868 - RNA, 22 nt, Human
agacagguaaauagagaugcug

SEQ ID NO: 1011869 - RNA, 20 nt, Human
cuuccacacaagaagcacag

SEQ ID NO: 1011870 - RNA, 22 nt, Human
gaaauauuguacuggagauguu

SEQ ID NO: 1011871 - RNA, 22 nt, Human
ucuucagauugcacugagcaag

SEQ ID NO: 1011872 - RNA, 22 nt, Human
gaggggcugggguugacuccaa

SEQ ID NO: 1011873 - RNA, 22 nt, Human
aaauuucaagcaaaguagcuau

SEQ ID NO: 1011874 - RNA, 22 nt, Human
ggaggccaggaaggcucggaga

SEQ ID NO: 1011875 - RNA, 22 nt, Human
caugagcugcugggagccuguc

SEQ ID NO: 1011876 - RNA, 17 nt, Human
acaagcaguggccaugg

SEQ ID NO: 1011877 - RNA, 22 nt, Human
ucucagagcuucaguuauuuuc

SEQ ID NO: 1011878 - RNA, 22 nt, Human
uggccugcagcucucagggaag

SEQ ID NO: 1011879 - RNA, 22 nt, Human
cagguggguacaucacagagac

SEQ ID NO: 1011880 - RNA, 22 nt, Human
ugucagagcaaugagguucagc

SEQ ID NO: 1011881 - RNA, 22 nt, Human
uggccuggccacauccagcagg

SEQ ID NO: 1011882 - RNA, 22 nt, Human
uuauuaggaacucaggauuuuu

SEQ ID NO: 1011883 - RNA, 22 nt, Human
aaauacuagaauucagaguuga

SEQ ID NO: 1011884 - RNA, 20 nt, Human
gccaacgcgcuggggcugcc

SEQ ID NO: 1011885 - RNA, 22 nt, Human
caagauggagaagcagcaaggg

SEQ ID NO: 1011886 - RNA, 22 nt, Human
ucacaggaaccaucagagaaau

SEQ ID NO: 1011887 - RNA, 22 nt, Human
ugcuggcccaguauggacugca

SEQ ID NO: 1011888 - RNA, 22 nt, Human
ccagcugagaaguguaaaguga

SEQ ID NO: 1011889 - RNA, 21 nt, Human
ggcacugagccagauggacuc

SEQ ID NO: 1011890 - RNA, 22 nt, Human
gaggccuggucuaugagauguu

SEQ ID NO: 1011891 - RNA, 22 nt, Human
agagaacaaauuaaaggugguu

SEQ ID NO: 1011892 - RNA, 22 nt, Human
gcuggccucuacaggccggcca

SEQ ID NO: 1011893 - RNA, 21 nt, Human
gcccagcaaggugagaaggcc

SEQ ID NO: 1011894 - RNA, 22 nt, Human
gcugcccauuccacuggauggu

SEQ ID NO: 1011895 - RNA, 22 nt, Human
cccaagggagugccuggucaac

SEQ ID NO: 1011896 - RNA, 22 nt, Human
ucagggacuuacaaaccagaag

SEQ ID NO: 1011897 - RNA, 22 nt, Human
aggcaggggagcuggaagggua

SEQ ID NO: 1011898 - RNA, 22 nt, Human
agcacuuuccuggcaaaugugg

SEQ ID NO: 1011899 - RNA, 20 nt, Human
gucagaggacccuagagcga

SEQ ID NO: 1011900 - RNA, 22 nt, Human
ugcagggccgcuggaggucaug

SEQ ID NO: 1011901 - RNA, 22 nt, Human
gugaaaauaaggcugguucuug

SEQ ID NO: 1011902 - RNA, 22 nt, Human
ccaguguucauaauuuuacacu

SEQ ID NO: 1011903 - RNA, 22 nt, Human
aucuggcuccuacacuugaaga

SEQ ID NO: 1011904 - RNA, 22 nt, Human
uguaugugcuugagaagguggg

SEQ ID NO: 1011905 - RNA, 22 nt, Human
augcaguggcagcuccuggugu

SEQ ID NO: 1011906 - RNA, 22 nt, Human
aggcucugcagugcuggaggac

SEQ ID NO: 1011907 - RNA, 22 nt, Human
uugcucaggcuuagagcuacua

SEQ ID NO: 1011908 - RNA, 21 nt, Human
cugcuguggcccccgacaugc

SEQ ID NO: 1011909 - RNA, 22 nt, Human
aaauggauggaauugacauuua

SEQ ID NO: 1011910 - RNA, 22 nt, Human
ccucacuggccagccaggggug

SEQ ID NO: 1011911 - RNA, 22 nt, Human
ccagccaggcuggcuguggagg

SEQ ID NO: 1011912 - RNA, 22 nt, Human
acacuaaugagaaaggaauuaa

SEQ ID NO: 1011913 - RNA, 22 nt, Human
aauauaugugguauugaccagc

SEQ ID NO: 1011914 - RNA, 22 nt, Human
uugaaagaggcaaaguuugauc

SEQ ID NO: 1011915 - RNA, 22 nt, Human
uccaggaccucccaggcuagag

SEQ ID NO: 1011916 - RNA, 17 nt, Human
ucaugcccaacuauuac

SEQ ID NO: 1011917 - RNA, 22 nt, Human
ucugccuuccccauaaucugau

SEQ ID NO: 1011918 - RNA, 19 nt, Human
uagcugccuguuaccucca

SEQ ID NO: 1011919 - RNA, 22 nt, Human
cucugugccucaguuuucuucu

SEQ ID NO: 1011920 - RNA, 20 nt, Human
uccaggcagacagcuauggg

SEQ ID NO: 1011921 - RNA, 22 nt, Human
acaugcuuucuagguccuucug

SEQ ID NO: 1011922 - RNA, 21 nt, Human
cugguguagcacucaggugcu

SEQ ID NO: 1011923 - RNA, 22 nt, Human
augagcugggccauccagugau

SEQ ID NO: 1011924 - RNA, 22 nt, Human
ugcugccucagcuuccugggcu

SEQ ID NO: 1011925 - RNA, 22 nt, Human
agcucuccacacauaggacuag

SEQ ID NO: 1011926 - RNA, 18 nt, Human
agcuggcccuggcugccg

SEQ ID NO: 1011927 - RNA, 22 nt, Human
ucaacugcaaguuugcuuaguu

SEQ ID NO: 1011928 - RNA, 22 nt, Human
cuucucucccuggcacucagac

SEQ ID NO: 1011929 - RNA, 22 nt, Human
aggagucaggaccaaauggaaa

SEQ ID NO: 1011930 - RNA, 22 nt, Human
uucaagguaugguagcugguca

SEQ ID NO: 1011931 - RNA, 22 nt, Human
aauuucaaacuaauaggaacca

SEQ ID NO: 1011932 - RNA, 22 nt, Human
agucacuguucugucaugucaa

SEQ ID NO: 1011933 - RNA, 22 nt, Human
aaguauaagcuauucuucauga

SEQ ID NO: 1011934 - RNA, 22 nt, Human
uuaggaguccagaugucuuggg

SEQ ID NO: 1011935 - RNA, 22 nt, Human
uuucaaacauagaucugaauau

SEQ ID NO: 1011936 - RNA, 22 nt, Human
gcuggccuccugcuagauggaa

SEQ ID NO: 1011937 - RNA, 22 nt, Human
gcugagggcauguguggcgacu

SEQ ID NO: 1011938 - RNA, 20 nt, Human
auugucagccuucagaggag

SEQ ID NO: 1011939 - RNA, 22 nt, Human
ggcagcucugcuccacaugagu

SEQ ID NO: 1011940 - RNA, 22 nt, Human
caggcagcauuuacucugauga

SEQ ID NO: 1011941 - RNA, 22 nt, Human
aagcaauauacugauaugauua

SEQ ID NO: 1011942 - RNA, 22 nt, Human
ccugccaggcuuugggcuucug

SEQ ID NO: 1011943 - RNA, 23 nt, Human
aguguuccaguugguugagagug

SEQ ID NO: 1011944 - RNA, 22 nt, Human
uggccacaugcgucugugaggc

SEQ ID NO: 1011945 - RNA, 22 nt, Human
uaugagaaucugcaguaugcuu

SEQ ID NO: 1011946 - RNA, 22 nt, Human
uagagcuggccgggacagcugg

SEQ ID NO: 1011947 - RNA, 22 nt, Human
uuccaagaguaaauucaaauug

SEQ ID NO: 1011948 - RNA, 22 nt, Human
caugcacagugauaucugaaga

SEQ ID NO: 1011949 - RNA, 19 nt, Human
ucaaggcucccugagggau

SEQ ID NO: 1011950 - RNA, 22 nt, Human
ucuagaaauuuugccuuguauu

SEQ ID NO: 1011951 - RNA, 20 nt, Human
uggcaucucucaauuguagg

SEQ ID NO: 1011952 - RNA, 22 nt, Human
uauaucauggagauuaacauuc

SEQ ID NO: 1011953 - RNA, 22 nt, Human
uacauguuugguaaaugauggc

SEQ ID NO: 1011954 - RNA, 22 nt, Human
uuggaugaagucuagcuuuagu

SEQ ID NO: 1011955 - RNA, 21 nt, Human
cuugaaagguagagucuacag

SEQ ID NO: 1011956 - RNA, 22 nt, Human
ucauccaguuguggagagggaa

SEQ ID NO: 1011957 - RNA, 22 nt, Human
uuucacauucagauauagacuu

SEQ ID NO: 1011958 - RNA, 22 nt, Human
ucagagaaguaagguggggugc

SEQ ID NO: 1011959 - RNA, 22 nt, Human
auauuugucaauucacuguuca

SEQ ID NO: 1011960 - RNA, 22 nt, Human
auuauguagguuaggugguugu

SEQ ID NO: 1011961 - RNA, 22 nt, Human
ucacuucacacccacuaucaug

SEQ ID NO: 1011962 - RNA, 22 nt, Human
uuugaacaugcugcaugauaau

SEQ ID NO: 1011963 - RNA, 22 nt, Human
caggacagguguucuagaucag

SEQ ID NO: 1011964 - RNA, 22 nt, Human
ccuggagcacucucccuggcug

SEQ ID NO: 1011965 - RNA, 22 nt, Human
agaauucuggaguugggaggaa

SEQ ID NO: 1011966 - RNA, 22 nt, Human
gggcuggcaggaccugggcuga

SEQ ID NO: 1011967 - RNA, 22 nt, Human
ccugcugugaagccaggccugu

SEQ ID NO: 1011968 - RNA, 22 nt, Human
gaguggggcccacugcugggug

SEQ ID NO: 1011969 - RNA, 22 nt, Human
cagcaggguauacagggaauuu

SEQ ID NO: 1011970 - RNA, 22 nt, Human
aggacuucaucaccuguauaaa

SEQ ID NO: 1011971 - RNA, 22 nt, Human
cagcuccugcagcugcugccgu

SEQ ID NO: 1011972 - RNA, 22 nt, Human
uucuuuccucccagccuuugga

SEQ ID NO: 1011973 - RNA, 22 nt, Human
gauuuucugagccuucaaauuu

SEQ ID NO: 1011974 - RNA, 22 nt, Human
uggucaggcugcucugcggcgu

SEQ ID NO: 1011975 - RNA, 21 nt, Human
cagugcucaaucugacagugg

SEQ ID NO: 1011976 - RNA, 22 nt, Human
gcugagucuugagcacugagca

SEQ ID NO: 1011977 - RNA, 22 nt, Human
aaagccuugagauccuauaguu

SEQ ID NO: 1011978 - RNA, 20 nt, Human
gccuggaggcagagauaaag

SEQ ID NO: 1011979 - RNA, 22 nt, Human
ccagggcaggagaaagacucac

SEQ ID NO: 1011980 - RNA, 22 nt, Human
agggcagcagcggcccaggccu

SEQ ID NO: 1011981 - RNA, 17 nt, Human
uggcucugaggcugaau

SEQ ID NO: 1011982 - RNA, 22 nt, Human
ggcugcagauagccagccacca

SEQ ID NO: 1011983 - RNA, 22 nt, Human
ggcucagguugggucacaugac

SEQ ID NO: 1011984 - RNA, 21 nt, Human
ucucugggaggacuugugaga

SEQ ID NO: 1011985 - RNA, 22 nt, Human
ugcauaaacagauacuucaugu

SEQ ID NO: 1011986 - RNA, 22 nt, Human
ucagcuuuuuacaugugaaaua

SEQ ID NO: 1011987 - RNA, 22 nt, Human
ucauuuaauugguuuugcucgu

SEQ ID NO: 1011988 - RNA, 22 nt, Human
ccuuccagaguucagucugccc

SEQ ID NO: 1011989 - RNA, 22 nt, Human
gcugccaccguggagaugagug

SEQ ID NO: 1011990 - RNA, 22 nt, Human
aaggaaccuggaguagagggag

SEQ ID NO: 1011991 - RNA, 22 nt, Human
gccugguguccagaggcgagug

SEQ ID NO: 1011992 - RNA, 22 nt, Human
cauuuguagcuauuuacuguau

SEQ ID NO: 1011993 - RNA, 22 nt, Human
gaugauuuuaugucuugucauu

SEQ ID NO: 1011994 - RNA, 22 nt, Human
cagcccagcacuaaguagauuu

SEQ ID NO: 1011995 - RNA, 22 nt, Human
gggaccugaggagggguuucag

SEQ ID NO: 1011996 - RNA, 22 nt, Human
uauggaaacuaauucauuuuuc

SEQ ID NO: 1011997 - RNA, 22 nt, Human
gcugucaggccaugugggccuu

SEQ ID NO: 1011998 - RNA, 22 nt, Human
uggcagaaagaaccaugugcaa

SEQ ID NO: 1011999 - RNA, 22 nt, Human
cugggcacagcguugggcucuu

SEQ ID NO: 1012000 - RNA, 22 nt, Human
ucuuuccuguaacugcuguuca

SEQ ID NO: 1012001 - RNA, 22 nt, Human
cauaucccauuggccaggacau

SEQ ID NO: 1012002 - RNA, 22 nt, Human
ugguggccaauucacagggcuc

SEQ ID NO: 1012003 - RNA, 22 nt, Human
gacauaauaaucugaccuagau

SEQ ID NO: 1012004 - RNA, 22 nt, Human
auguguuuguaccuuuaaauau

SEQ ID NO: 1012005 - RNA, 22 nt, Human
uagcaauagaaacauauaaagu

SEQ ID NO: 1012006 - RNA, 19 nt, Human
ugcagcucagggcaggggc

SEQ ID NO: 1012007 - RNA, 22 nt, Human
ccagcugguuaaaauagagaaa

SEQ ID NO: 1012008 - RNA, 22 nt, Human
uuaagaauggaaugaggaauuu

SEQ ID NO: 1012009 - RNA, 22 nt, Human
uggcucaggugugagcugaaga

SEQ ID NO: 1012010 - RNA, 22 nt, Human
cuaauguaucauggcucucagc

SEQ ID NO: 1012011 - RNA, 22 nt, Human
caauguaucaaccagaaaguuc

SEQ ID NO: 1012012 - RNA, 22 nt, Human
ucagcuuggacagcuugguuga

SEQ ID NO: 1012013 - RNA, 23 nt, Human
uagggcagcugggagggacaugc

SEQ ID NO: 1012014 - RNA, 22 nt, Human
uccuuccuggggucucugcugc

SEQ ID NO: 1012015 - RNA, 21 nt, Human
uggcucugagccucauggcug

SEQ ID NO: 1012016 - RNA, 22 nt, Human
ccugccuggagcugagugugga

SEQ ID NO: 1012017 - RNA, 22 nt, Human
agucauaugacccuucacaaac

SEQ ID NO: 1012018 - RNA, 22 nt, Human
caagaugggcaccccagcaccu

SEQ ID NO: 1012019 - RNA, 21 nt, Human
ucagcuuugcaacugcacauc

SEQ ID NO: 1012020 - RNA, 21 nt, Human
gagugucuaauccaggcuguc

SEQ ID NO: 1012021 - RNA, 22 nt, Human
caaaaugugagucccaccucaa

SEQ ID NO: 1012022 - RNA, 22 nt, Human
guuugcauggaagacagugagu

SEQ ID NO: 1012023 - RNA, 22 nt, Human
ggcucaggaccugggauugcca

SEQ ID NO: 1012024 - RNA, 18 nt, Human
ggcucaggcuauccuaac

SEQ ID NO: 1012025 - RNA, 22 nt, Human
cuggagggugagccucaucucu

SEQ ID NO: 1012026 - RNA, 22 nt, Human
uaguuaaaauaauggagauguu

SEQ ID NO: 1012027 - RNA, 21 nt, Human
auccauccaucuuggccuaac

SEQ ID NO: 1012028 - RNA, 20 nt, Human
gagacagcaaaagccucucc

SEQ ID NO: 1012029 - RNA, 22 nt, Human
cugcuguguuggcauuggauag

SEQ ID NO: 1012030 - RNA, 22 nt, Human
cuggagccuucaccaggggaaa

SEQ ID NO: 1012031 - RNA, 22 nt, Human
gaugguuugguaaaaguauguu

SEQ ID NO: 1012032 - RNA, 22 nt, Human
aaguccaguuucauuugagguc

SEQ ID NO: 1012033 - RNA, 22 nt, Human
ucugagcuuuuauuaucaaccu

SEQ ID NO: 1012034 - RNA, 22 nt, Human
uugggagcuuggacuuagugug

SEQ ID NO: 1012035 - RNA, 22 nt, Human
cuugaaagcuuugcgucuucua

SEQ ID NO: 1012036 - RNA, 22 nt, Human
ucagaacauugacauucuuauu

SEQ ID NO: 1012037 - RNA, 22 nt, Human
ucagcaguggcucucaugcagu

SEQ ID NO: 1012038 - RNA, 22 nt, Human
cugggaggauacacaagaucag

SEQ ID NO: 1012039 - RNA, 22 nt, Human
cugagaggaugcugcaguggag

SEQ ID NO: 1012040 - RNA, 22 nt, Human
cccagcuugcgggcggcaggag

SEQ ID NO: 1012041 - RNA, 22 nt, Human
ucaaggaggugcuuggcuucac

SEQ ID NO: 1012042 - RNA, 22 nt, Human
auuauuagauucuuaauuguaa

SEQ ID NO: 1012043 - RNA, 22 nt, Human
ccuuccaggugcaggcaagccu

SEQ ID NO: 1012044 - RNA, 22 nt, Human
ugccugcuaggcccugcugggu

SEQ ID NO: 1012045 - RNA, 22 nt, Human
uaacagaagaaaacauauugga

SEQ ID NO: 1012046 - RNA, 18 nt, Human
gggaucaggcugccuagg

SEQ ID NO: 1012047 - RNA, 22 nt, Human
uuuaaaauuuagaccucuccac

SEQ ID NO: 1012048 - RNA, 22 nt, Human
cuggaaauuggagaugauguuu

SEQ ID NO: 1012049 - RNA, 22 nt, Human
agggucccgaaggagacagcaa

SEQ ID NO: 1012050 - RNA, 22 nt, Human
gagcccagguucugcuuccagc

SEQ ID NO: 1012051 - RNA, 22 nt, Human
cagcagggaagcugugcuguuu

SEQ ID NO: 1012052 - RNA, 22 nt, Human
uguguauuucuggaacagacua

SEQ ID NO: 1012053 - RNA, 22 nt, Human
cagaggcauacucccagucuug

SEQ ID NO: 1012054 - RNA, 22 nt, Human
aagcagaauuucccacuaguug

SEQ ID NO: 1012055 - RNA, 22 nt, Human
agucccagugacuuggccagaa

SEQ ID NO: 1012056 - RNA, 22 nt, Human
gggagggauuaguucugccugg

SEQ ID NO: 1012057 - RNA, 22 nt, Human
ugcugccaggucuugcugucca

SEQ ID NO: 1012058 - RNA, 22 nt, Human
ccuggagcuuggucacgcugcg

SEQ ID NO: 1012059 - RNA, 22 nt, Human
gcaggcugaugacuggaguugg

SEQ ID NO: 1012060 - RNA, 22 nt, Human
gaggcugccccuuccucagcug

SEQ ID NO: 1012061 - RNA, 22 nt, Human
uuaguuaguggggcugucaguc

SEQ ID NO: 1012062 - RNA, 20 nt, Human
acccagcucugugcccuggg

SEQ ID NO: 1012063 - RNA, 22 nt, Human
uuacuuugaugaucaaugagcg

SEQ ID NO: 1012064 - RNA, 22 nt, Human
agagacaggguuuugccauguu

SEQ ID NO: 1012065 - RNA, 22 nt, Human
uggcuccuucauucuccugcca

SEQ ID NO: 1012066 - RNA, 22 nt, Human
cagagggagcccuccaggagca

SEQ ID NO: 1012067 - RNA, 22 nt, Human
auuuccaguccuaaugaucugg

SEQ ID NO: 1012068 - RNA, 21 nt, Human
ucacaucuauguuaagcaaac

SEQ ID NO: 1012069 - RNA, 22 nt, Human
acaaaugcagcauaaagugaac

SEQ ID NO: 1012070 - RNA, 22 nt, Human
uaacaucuuuagcagcucgaac

SEQ ID NO: 1012071 - RNA, 22 nt, Human
agcagccaguucucugugguag

SEQ ID NO: 1012072 - RNA, 22 nt, Human
gauuucaaggauguuagaggug

SEQ ID NO: 1012073 - RNA, 22 nt, Human
gaggcugugugucccucuggac

SEQ ID NO: 1012074 - RNA, 22 nt, Human
auggccuccgacccaugacgug

SEQ ID NO: 1012075 - RNA, 22 nt, Human
ccuggcuggcaagaucgugaag

SEQ ID NO: 1012076 - RNA, 22 nt, Human
ccagcuuuuagugggcuuauua

SEQ ID NO: 1012077 - RNA, 22 nt, Human
uucuucuucaagugcugcauuc

SEQ ID NO: 1012078 - RNA, 22 nt, Human
gggcagcugccaagugcaucgc

SEQ ID NO: 1012079 - RNA, 22 nt, Human
aaauuagucgguuuaggaauuu

SEQ ID NO: 1012080 - RNA, 22 nt, Human
aggaagccuggggcugcccucg

SEQ ID NO: 1012081 - RNA, 22 nt, Human
uccucaggaucuaggagugcuu

SEQ ID NO: 1012082 - RNA, 19 nt, Human
aguguguacugaaagcacu

SEQ ID NO: 1012083 - RNA, 21 nt, Human
uucaagauauuuaaaaggugg

SEQ ID NO: 1012084 - RNA, 22 nt, Human
uaucuuguaauagguccacuug

SEQ ID NO: 1012085 - RNA, 20 nt, Human
cuguccccgaggucaccagg

SEQ ID NO: 1012086 - RNA, 22 nt, Human
ugccugggaaccaauccuggcu

SEQ ID NO: 1012087 - RNA, 22 nt, Human
aguguuugucccguuagaaaug

SEQ ID NO: 1012088 - RNA, 22 nt, Human
gaaugcacuuccaacaucuauu

SEQ ID NO: 1012089 - RNA, 22 nt, Human
ggccucugccucaucugggcac

SEQ ID NO: 1012090 - RNA, 22 nt, Human
cguuggagacacuugaggacuu

SEQ ID NO: 1012091 - RNA, 21 nt, Human
auuuucauuuccaggggagga

SEQ ID NO: 1012092 - RNA, 22 nt, Human
ugcugcuccccagcacacagca

SEQ ID NO: 1012093 - RNA, 22 nt, Human
uuagucuucuuccuuauauguu

SEQ ID NO: 1012094 - RNA, 22 nt, Human
ggagagagaugccgccuugcuc

SEQ ID NO: 1012095 - RNA, 22 nt, Human
agcuuuauuugucauucacggc

SEQ ID NO: 1012096 - RNA, 22 nt, Human
uuguuucugaguuuucauguau

SEQ ID NO: 1012097 - RNA, 22 nt, Human
uggcugcugcuuggucuucuuc

SEQ ID NO: 1012098 - RNA, 22 nt, Human
caacugagcaguagcgucugga

SEQ ID NO: 1012099 - RNA, 22 nt, Human
uggacucagugcugccauuccc

SEQ ID NO: 1012100 - RNA, 22 nt, Human
gagccuggauugaagugggugg

SEQ ID NO: 1012101 - RNA, 22 nt, Human
agggccagaggcaccuugcagc

SEQ ID NO: 1012102 - RNA, 22 nt, Human
accagguggccccagcgugguu

SEQ ID NO: 1012103 - RNA, 22 nt, Human
uccuugaauauaauaacaguag

SEQ ID NO: 1012104 - RNA, 22 nt, Human
cugggaggugaacagaaaaacu

SEQ ID NO: 1012105 - RNA, 22 nt, Human
ucuucagagugaaagucuguga

SEQ ID NO: 1012106 - RNA, 22 nt, Human
cugggccauggaagucucugcc

SEQ ID NO: 1012107 - RNA, 22 nt, Human
uuuccuguugccaucaagaaug

SEQ ID NO: 1012108 - RNA, 22 nt, Human
uagcauuaucugucuuaucauu

SEQ ID NO: 1012109 - RNA, 22 nt, Human
agucugucuacuuaaagucugu

SEQ ID NO: 1012110 - RNA, 22 nt, Human
agggacaguuacaucaucagac

SEQ ID NO: 1012111 - RNA, 22 nt, Human
gccagccccuuagggcucuccc

SEQ ID NO: 1012112 - RNA, 20 nt, Human
cugggcugcccagcuauggg

SEQ ID NO: 1012113 - RNA, 22 nt, Human
guccucugcuucaugcccugau

SEQ ID NO: 1012114 - RNA, 22 nt, Human
uuaacacaucccugcucuaccc

SEQ ID NO: 1012115 - RNA, 23 nt, Human
ggacagggcccugcccuauggcc

SEQ ID NO: 1012116 - RNA, 21 nt, Human
ugagagccuccaaccggcuac

SEQ ID NO: 1012117 - RNA, 22 nt, Human
cugggcuacguguugacagcau

SEQ ID NO: 1012118 - RNA, 22 nt, Human
agccagcuguacugccugcuca

SEQ ID NO: 1012119 - RNA, 22 nt, Human
ggauuucuuccuuccucagaag

SEQ ID NO: 1012120 - RNA, 22 nt, Human
cacaugcaucugucauguuugg

SEQ ID NO: 1012121 - RNA, 19 nt, Human
ucucaauguucagaaagcu

SEQ ID NO: 1012122 - RNA, 22 nt, Human
cugccuugaggagguuguggga

SEQ ID NO: 1012123 - RNA, 22 nt, Human
aucaguuuguauaugaaacacu

SEQ ID NO: 1012124 - RNA, 21 nt, Human
ugugucacuaacuagaggcua

SEQ ID NO: 1012125 - RNA, 22 nt, Human
uuauuuacaacucuucucuucc

SEQ ID NO: 1012126 - RNA, 21 nt, Human
acagagccgggcacaaagcug

SEQ ID NO: 1012127 - RNA, 20 nt, Human
ugcuccaucuaaagugauua

SEQ ID NO: 1012128 - RNA, 22 nt, Human
ucaaaguuuuugagaauuacau

SEQ ID NO: 1012129 - RNA, 22 nt, Human
ugagcccaggaguuggagaccg

SEQ ID NO: 1012130 - RNA, 22 nt, Human
agucaauuaucucuaggucauc

SEQ ID NO: 1012131 - RNA, 22 nt, Human
gccaugccugugucuccaggcc

SEQ ID NO: 1012132 - RNA, 22 nt, Human
guuuuauaggugaaauauuacu

SEQ ID NO: 1012133 - RNA, 22 nt, Human
auccaugauuaguaggauaaag

SEQ ID NO: 1012134 - RNA, 22 nt, Human
acugccauuggucaaaugagug

SEQ ID NO: 1012135 - RNA, 22 nt, Human
ggagugucagaaacaguguccu

SEQ ID NO: 1012136 - RNA, 22 nt, Human
auuaaauuuucacuaggcuccc

SEQ ID NO: 1012137 - RNA, 22 nt, Human
gcacugaaugcuuuuacuguaa

SEQ ID NO: 1012138 - RNA, 22 nt, Human
cccauuuaucccaagguuacuc

SEQ ID NO: 1012139 - RNA, 22 nt, Human
uaauuuacuugcaaauaacaau

SEQ ID NO: 1012140 - RNA, 22 nt, Human
aaaauggucucagcuggcacca

SEQ ID NO: 1012141 - RNA, 22 nt, Human
ugugccauuucuauucugcagc

SEQ ID NO: 1012142 - RNA, 22 nt, Human
uuaauuuuaaccuguuuguguc

SEQ ID NO: 1012143 - RNA, 20 nt, Human
cccuggagagaagcuccacg

SEQ ID NO: 1012144 - RNA, 22 nt, Human
gcccugcugucuucagaguaua

SEQ ID NO: 1012145 - RNA, 22 nt, Human
ggcucaggcuggagugcagugg

SEQ ID NO: 1012146 - RNA, 23 nt, Human
gugagucuugccuuugcugugga

SEQ ID NO: 1012147 - RNA, 22 nt, Human
uccauuuucuugcucuagguaa

SEQ ID NO: 1012148 - RNA, 22 nt, Human
agaagccauucccuguaggcuc

SEQ ID NO: 1012149 - RNA, 22 nt, Human
ccaggagcaaagaucacuggga

SEQ ID NO: 1012150 - RNA, 22 nt, Human
gaagagcuuagacagaaucaaa

SEQ ID NO: 1012151 - RNA, 22 nt, Human
cuauaauuaugcucaaaaugua

SEQ ID NO: 1012152 - RNA, 22 nt, Human
ugcugcugaucauuuauagucu

SEQ ID NO: 1012153 - RNA, 22 nt, Human
gccaggcugcuggcugcugucc

SEQ ID NO: 1012154 - RNA, 22 nt, Human
agcuggaggauaacucacuucu

SEQ ID NO: 1012155 - RNA, 22 nt, Human
uaugaacuguaacccucaccgc

SEQ ID NO: 1012156 - RNA, 22 nt, Human
gcacagaagagcuuuggaauga

SEQ ID NO: 1012157 - RNA, 22 nt, Human
acaauauuguacccagaaguuu

SEQ ID NO: 1012158 - RNA, 23 nt, Human
uguaaaaugggguaguguuacca

SEQ ID NO: 1012159 - RNA, 22 nt, Human
gcagcguggggcugagucagcu

SEQ ID NO: 1012160 - RNA, 21 nt, Human
uguucacauggagcagaaugu

SEQ ID NO: 1012161 - RNA, 22 nt, Human
gaggcaggcagauugcuugagg

SEQ ID NO: 1012162 - RNA, 22 nt, Human
ggcuucuccagguacugagcau

SEQ ID NO: 1012163 - RNA, 22 nt, Human
gcaaauauucaagacuuuucca

SEQ ID NO: 1012164 - RNA, 21 nt, Human
acagauauuucauugaacauu

SEQ ID NO: 1012165 - RNA, 22 nt, Human
ucucucagcuuugagaccugcu

SEQ ID NO: 1012166 - RNA, 22 nt, Human
aaaacuaaauacgcuuugccuc

SEQ ID NO: 1012167 - RNA, 20 nt, Human
uggaccugucucuuuaggga

SEQ ID NO: 1012168 - RNA, 22 nt, Human
uacauugugauguuucaauaca

SEQ ID NO: 1012169 - RNA, 22 nt, Human
uguguacauaucuauccuagau

SEQ ID NO: 1012170 - RNA, 23 nt, Human
ugagcccaggaggucaaggcugc

SEQ ID NO: 1012171 - RNA, 22 nt, Human
agcugggagcagagccacagcc

SEQ ID NO: 1012172 - RNA, 22 nt, Human
ugucuucagcaaaugccuuucu

SEQ ID NO: 1012173 - RNA, 22 nt, Human
agaccugcagggccaggccugc

SEQ ID NO: 1012174 - RNA, 22 nt, Human
uaauucagggccagaaucccca

SEQ ID NO: 1012175 - RNA, 22 nt, Human
uuuccucuucuggcaggcaggg

SEQ ID NO: 1012176 - RNA, 22 nt, Human
ccuguggcucucuuuggagguc

SEQ ID NO: 1012177 - RNA, 22 nt, Human
aggcugggcaccguuuugaucc

SEQ ID NO: 1012178 - RNA, 22 nt, Human
gacccagaaggagugcccuaga

SEQ ID NO: 1012179 - RNA, 22 nt, Human
ccagcccuccuccaucagagga

SEQ ID NO: 1012180 - RNA, 22 nt, Human
aaaggucauugaaaaggaggaa

SEQ ID NO: 1012181 - RNA, 20 nt, Human
uggagccacagucagguucc

SEQ ID NO: 1012182 - RNA, 22 nt, Human
uaaggccagccagcaaaucugu

SEQ ID NO: 1012183 - RNA, 22 nt, Human
aaaaguauuuauggcuauguaa

SEQ ID NO: 1012184 - RNA, 22 nt, Human
cugccagcucucuggaggcucu

SEQ ID NO: 1012185 - RNA, 21 nt, Human
gucagcagauccagcacuugu

SEQ ID NO: 1012186 - RNA, 22 nt, Human
ucuuagaaugucaacugauguu

SEQ ID NO: 1012187 - RNA, 19 nt, Human
cugaagucuuuucagcugg

SEQ ID NO: 1012188 - RNA, 22 nt, Human
gcagccacucucauuccacgug

SEQ ID NO: 1012189 - RNA, 20 nt, Human
cccagccccuaccuguugcc

SEQ ID NO: 1012190 - RNA, 22 nt, Human
aauguauuccucaugcaagagu

SEQ ID NO: 1012191 - RNA, 22 nt, Human
aaaaguuuaagacucauucuag

SEQ ID NO: 1012192 - RNA, 22 nt, Human
gucagcaggguccccuugagug

SEQ ID NO: 1012193 - RNA, 22 nt, Human
ugcucuguauucuauggcaguu

SEQ ID NO: 1012194 - RNA, 22 nt, Human
agggcugcugcuccgggcccag

SEQ ID NO: 1012195 - RNA, 22 nt, Human
ugagcuggucuugaguguagcu

SEQ ID NO: 1012196 - RNA, 22 nt, Human
uggccuggcccugaggcccugu

SEQ ID NO: 1012197 - RNA, 16 nt, Human
cuacccagugagaagg

SEQ ID NO: 1012198 - RNA, 22 nt, Human
ggccugagcuugggcagcguau

SEQ ID NO: 1012199 - RNA, 22 nt, Human
ggaggagacaguaaaaagcacg

SEQ ID NO: 1012200 - RNA, 22 nt, Human
gguuugaacagcuuuggagaag

SEQ ID NO: 1012201 - RNA, 22 nt, Human
aaaucugguucaguaaguccuc

SEQ ID NO: 1012202 - RNA, 22 nt, Human
aaguguuuacuuaaagucaugg

SEQ ID NO: 1012203 - RNA, 22 nt, Human
agcuucuugggcuuuacacaaa

SEQ ID NO: 1012204 - RNA, 22 nt, Human
uggguaaacugggucuggagag

SEQ ID NO: 1012205 - RNA, 22 nt, Human
caggcagccaggggaccugucc

SEQ ID NO: 1012206 - RNA, 22 nt, Human
uaauuuauuucaacugccaagg

SEQ ID NO: 1012207 - RNA, 22 nt, Human
aaauguguauaugaaacaugau

SEQ ID NO: 1012208 - RNA, 22 nt, Human
aguggccagugcugcucugggg

SEQ ID NO: 1012209 - RNA, 22 nt, Human
uuuugaauaauucagaaacagc

SEQ ID NO: 1012210 - RNA, 22 nt, Human
gaagcccauuuguacagcacau

SEQ ID NO: 1012211 - RNA, 22 nt, Human
uaaugcacauagaaguacuuag

SEQ ID NO: 1012212 - RNA, 22 nt, Human
cugcugugcauauuuaucuagg

SEQ ID NO: 1012213 - RNA, 22 nt, Human
accaggggaugguuggcacugu

SEQ ID NO: 1012214 - RNA, 22 nt, Human
gcucugggaacugacugccuuc

SEQ ID NO: 1012215 - RNA, 23 nt, Human
uucaagauacgguuuccaggcug

SEQ ID NO: 1012216 - RNA, 22 nt, Human
uugaaaggccuguuuauccagc

SEQ ID NO: 1012217 - RNA, 22 nt, Human
ucuugggaaauguuugcgagcu

SEQ ID NO: 1012218 - RNA, 22 nt, Human
uugaauaguuuuggauagcaua

SEQ ID NO: 1012219 - RNA, 22 nt, Human
gugggugauguacuggaggcca

SEQ ID NO: 1012220 - RNA, 22 nt, Human
cagcugagcaucacuagucugg

SEQ ID NO: 1012221 - RNA, 22 nt, Human
auucaguaggucuagaauaaga

SEQ ID NO: 1012222 - RNA, 22 nt, Human
auugaaaauauaauucuaggag

SEQ ID NO: 1012223 - RNA, 22 nt, Human
ucagcagggagaggagaaugca

SEQ ID NO: 1012224 - RNA, 22 nt, Human
acaggcagcgucauugcugcuc

SEQ ID NO: 1012225 - RNA, 17 nt, Human
cagugcagagcccuuuc

SEQ ID NO: 1012226 - RNA, 22 nt, Human
ccagcagcccacaggcgucccu

SEQ ID NO: 1012227 - RNA, 22 nt, Human
gcagccacacuguuacagaaug

SEQ ID NO: 1012228 - RNA, 22 nt, Human
aaaugccucugcuguacacaau

SEQ ID NO: 1012229 - RNA, 22 nt, Human
cuggagccgcauggagcaggga

SEQ ID NO: 1012230 - RNA, 22 nt, Human
gaggagggagcuggaagcucuu

SEQ ID NO: 1012231 - RNA, 22 nt, Human
cugagcccaggcgggagcugag

SEQ ID NO: 1012232 - RNA, 22 nt, Human
aaacuguaaacacagcaguaca

SEQ ID NO: 1012233 - RNA, 22 nt, Human
ugcugggcuaggguggagcucu

SEQ ID NO: 1012234 - RNA, 22 nt, Human
cuuugcaaacugucacacuuuc

SEQ ID NO: 1012235 - RNA, 22 nt, Human
uuugcuauuuuucugugcagcu

SEQ ID NO: 1012236 - RNA, 22 nt, Human
aggacccagaggcagaggacgu

SEQ ID NO: 1012237 - RNA, 22 nt, Human
uuuaguaaguucacugcaaagc

SEQ ID NO: 1012238 - RNA, 22 nt, Human
ugcaauaacuacuuuaauguug

SEQ ID NO: 1012239 - RNA, 22 nt, Human
uccucaggauguggaguagaau

SEQ ID NO: 1012240 - RNA, 22 nt, Human
uggcucagcuuacuuuugaggg

SEQ ID NO: 1012241 - RNA, 22 nt, Human
ugaagccacagagcaucugccu

SEQ ID NO: 1012242 - RNA, 22 nt, Human
auggaguucuuuaaauucacag

SEQ ID NO: 1012243 - RNA, 22 nt, Human
agagaaggucacuaaggaccca

SEQ ID NO: 1012244 - RNA, 22 nt, Human
ggagccugagcggcccagggcc

SEQ ID NO: 1012245 - RNA, 22 nt, Human
cugggagagaagcgaagcuggg

SEQ ID NO: 1012246 - RNA, 22 nt, Human
ugugccuucucaguccugcuca

SEQ ID NO: 1012247 - RNA, 22 nt, Human
ccagcuuuugcacuggacuggg

SEQ ID NO: 1012248 - RNA, 22 nt, Human
cuuuggcaaugaaacacaagaa

SEQ ID NO: 1012249 - RNA, 22 nt, Human
ccucugccugcacaucauccug

SEQ ID NO: 1012250 - RNA, 22 nt, Human
augggugugaaaauggucaucu

SEQ ID NO: 1012251 - RNA, 22 nt, Human
cauacaagcguucaauagaugu

SEQ ID NO: 1012252 - RNA, 22 nt, Human
gagcccuggcagucugggaugg

SEQ ID NO: 1012253 - RNA, 22 nt, Human
ccuucuucuguguggcccaaga

SEQ ID NO: 1012254 - RNA, 22 nt, Human
aucccugcccucauggagcuua

SEQ ID NO: 1012255 - RNA, 22 nt, Human
agacagagauacuauguuguca

SEQ ID NO: 1012256 - RNA, 22 nt, Human
acagaagagcacauuuaguaug

SEQ ID NO: 1012257 - RNA, 22 nt, Human
gcucagagaugucugcugccuu

SEQ ID NO: 1012258 - RNA, 22 nt, Human
uuuaacagaugcuaugucuacc

SEQ ID NO: 1012259 - RNA, 22 nt, Human
gagguggguguaucacagguca

SEQ ID NO: 1012260 - RNA, 22 nt, Human
agucaguguagaaagcccaggc

SEQ ID NO: 1012261 - RNA, 23 nt, Human
ucuuuccucagcacacaccaaga

SEQ ID NO: 1012262 - RNA, 22 nt, Human
acagaccaaaaaaggauauugg

SEQ ID NO: 1012263 - RNA, 23 nt, Human
agcccagcagagaaccuaggucc

SEQ ID NO: 1012264 - RNA, 22 nt, Human
uuuuugcaccaaccuaauagaa

SEQ ID NO: 1012265 - RNA, 22 nt, Human
uugcauaaaugcuuaaaauuug

SEQ ID NO: 1012266 - RNA, 22 nt, Human
auaaggcagugacuucaucuau

SEQ ID NO: 1012267 - RNA, 22 nt, Human
ucccugggccuccugcuaugca

SEQ ID NO: 1012268 - RNA, 22 nt, Human
acucuucuugcugcucauuaau

SEQ ID NO: 1012269 - RNA, 22 nt, Human
ccagaggcuggcaagggcuccu

SEQ ID NO: 1012270 - RNA, 22 nt, Human
uuuaauuuuccugguaggccug

SEQ ID NO: 1012271 - RNA, 22 nt, Human
acugucuuccaggucuggaggu

SEQ ID NO: 1012272 - RNA, 22 nt, Human
ucccacacagcccgcucaccgg

SEQ ID NO: 1012273 - RNA, 22 nt, Human
ggcagcaguggcugcuauuguc

SEQ ID NO: 1012274 - RNA, 18 nt, Human
uggagccauugccaccau

SEQ ID NO: 1012275 - RNA, 22 nt, Human
guuugucuuaauuaggcaucga

SEQ ID NO: 1012276 - RNA, 22 nt, Human
acagauauuuggggaaagacgu

SEQ ID NO: 1012277 - RNA, 22 nt, Human
acauuucuccuacuuguuauuu

SEQ ID NO: 1012278 - RNA, 22 nt, Human
aggaagcucggagagggcaaau

SEQ ID NO: 1012279 - RNA, 22 nt, Human
gccaggcagcugggagggugcc

SEQ ID NO: 1012280 - RNA, 22 nt, Human
aaugggaggauuuucucucuug

SEQ ID NO: 1012281 - RNA, 22 nt, Human
uuaacaauagaguuucuucagg

SEQ ID NO: 1012282 - RNA, 22 nt, Human
cagggcucgcucgcucgcucgc

SEQ ID NO: 1012283 - RNA, 22 nt, Human
gaaucacgguauucugcacggg

SEQ ID NO: 1012284 - RNA, 22 nt, Human
gcuggccuuugaggaagcugcg

SEQ ID NO: 1012285 - RNA, 20 nt, Human
cugcugugauucccuccucc

SEQ ID NO: 1012286 - RNA, 22 nt, Human
uuugcauugcagugguuuacag

SEQ ID NO: 1012287 - RNA, 22 nt, Human
acauauuuugaaagcuuucuaa

SEQ ID NO: 1012288 - RNA, 20 nt, Human
cugccaugauugauagagug

SEQ ID NO: 1012289 - RNA, 22 nt, Human
acaggccugacacacagagggc

SEQ ID NO: 1012290 - RNA, 22 nt, Human
ugcagaagaauguaggcauaag

SEQ ID NO: 1012291 - RNA, 22 nt, Human
gcauuuccugugcuuggcauau

SEQ ID NO: 1012292 - RNA, 17 nt, Human
cagggcugucugccuag

SEQ ID NO: 1012293 - RNA, 22 nt, Human
ucuuugaugugguuaauuauga

SEQ ID NO: 1012294 - RNA, 22 nt, Human
aaucaguuguccaaaguucaca

SEQ ID NO: 1012295 - RNA, 22 nt, Human
cugccuggagcauucugaaggu

SEQ ID NO: 1012296 - RNA, 22 nt, Human
uacaugaacaaaauagcagaaa

SEQ ID NO: 1012297 - RNA, 22 nt, Human
ucugauuagagcauucuugagu

SEQ ID NO: 1012298 - RNA, 22 nt, Human
cagcugaauucuucagacucca

SEQ ID NO: 1012299 - RNA, 22 nt, Human
augagcugugggauuccagagg

SEQ ID NO: 1012300 - RNA, 22 nt, Human
uucuuuuccuacacagcgauuu

SEQ ID NO: 1012301 - RNA, 22 nt, Human
uaacagaaaagaacugaguuug

SEQ ID NO: 1012302 - RNA, 22 nt, Human
cucuucuugaaagaggaauuca

SEQ ID NO: 1012303 - RNA, 21 nt, Human
gcugcaucaaucuacccaggg

SEQ ID NO: 1012304 - RNA, 22 nt, Human
agcuugauuucucugcagugug

SEQ ID NO: 1012305 - RNA, 20 nt, Human
cacugaagacuucuugcuca

SEQ ID NO: 1012306 - RNA, 22 nt, Human
uuuacagaucuguugauuuguu

SEQ ID NO: 1012307 - RNA, 21 nt, Human
uuccagagauuguuucaccug

SEQ ID NO: 1012308 - RNA, 22 nt, Human
gcucucugccuuucucaaugac

SEQ ID NO: 1012309 - RNA, 22 nt, Human
uccaggcacagaguuggucagu

SEQ ID NO: 1012310 - RNA, 22 nt, Human
aaugucauugguaaagauuagg

SEQ ID NO: 1012311 - RNA, 22 nt, Human
cugcagccuccugggguacaug

SEQ ID NO: 1012312 - RNA, 22 nt, Human
acaaauguggacauggauaaug

SEQ ID NO: 1012313 - RNA, 22 nt, Human
gcagcuuucugggacagaaagg

SEQ ID NO: 1012314 - RNA, 22 nt, Human
gucagagagggcacgugcacac

SEQ ID NO: 1012315 - RNA, 22 nt, Human
aagccagggauuccugagggag

SEQ ID NO: 1012316 - RNA, 22 nt, Human
ggcugccucaaagcucaagcuc

SEQ ID NO: 1012317 - RNA, 22 nt, Human
ucugucacccgagcaggcgaga

SEQ ID NO: 1012318 - RNA, 22 nt, Human
cuacacaguucugccuaauggc

SEQ ID NO: 1012319 - RNA, 22 nt, Human
agagugaaguuuuugaaaguga

SEQ ID NO: 1012320 - RNA, 22 nt, Human
gcuggccugucuagagccuuac

SEQ ID NO: 1012321 - RNA, 20 nt, Human
ccuggaagagcuccccaggc

SEQ ID NO: 1012322 - RNA, 22 nt, Human
agcccaaggcuucccugcuggc

SEQ ID NO: 1012323 - RNA, 22 nt, Human
uuauguacucugcaauguuuga

SEQ ID NO: 1012324 - RNA, 22 nt, Human
uaguaacagauuuauacagucu

SEQ ID NO: 1012325 - RNA, 22 nt, Human
ccagcuuuccaggguugacugg

SEQ ID NO: 1012326 - RNA, 22 nt, Human
acgugcaggaucugguuggcga

SEQ ID NO: 1012327 - RNA, 22 nt, Human
cagcaucaccgccauuucugau

SEQ ID NO: 1012328 - RNA, 22 nt, Human
aacaacugaaaagcuuuuucug

SEQ ID NO: 1012329 - RNA, 22 nt, Human
ccugccaggagcuggugcugca

SEQ ID NO: 1012330 - RNA, 22 nt, Human
ugcagccaucgcagagucugua

SEQ ID NO: 1012331 - RNA, 22 nt, Human
gcaguaaaaaaggauaugugca

SEQ ID NO: 1012332 - RNA, 22 nt, Human
ggaggccaccugaccugcuguu

SEQ ID NO: 1012333 - RNA, 22 nt, Human
ccuggauucaagucuuucuuuc

SEQ ID NO: 1012334 - RNA, 22 nt, Human
gcagcuuuguggagaggcccau

SEQ ID NO: 1012335 - RNA, 22 nt, Human
gggucccaggaaggagcagugu

SEQ ID NO: 1012336 - RNA, 22 nt, Human
gcagcuuggauuucuguaguuu

SEQ ID NO: 1012337 - RNA, 22 nt, Human
agacagugcaagaagagcaggc

SEQ ID NO: 1012338 - RNA, 22 nt, Human
gaaugaauucagcacauggaau

SEQ ID NO: 1012339 - RNA, 22 nt, Human
cccaggcagccugcagggaagg

SEQ ID NO: 1012340 - RNA, 22 nt, Human
ugccaggagagugcaugcaggg

SEQ ID NO: 1012341 - RNA, 22 nt, Human
ucucauguauugcccuggugug

SEQ ID NO: 1012342 - RNA, 21 nt, Human
ucaggcaggcgcagagggaag

SEQ ID NO: 1012343 - RNA, 22 nt, Human
gucaccagugcuaagaggugga

SEQ ID NO: 1012344 - RNA, 22 nt, Human
ccagcugacgaugccuggucuc

SEQ ID NO: 1012345 - RNA, 19 nt, Human
uccugggcugggccagguc

SEQ ID NO: 1012346 - RNA, 23 nt, Human
gccucagagaaacagcugcacac

SEQ ID NO: 1012347 - RNA, 22 nt, Human
agagugaaaagcuagagcagua

SEQ ID NO: 1012348 - RNA, 20 nt, Human
ucuguucaaaucuuaguucc

SEQ ID NO: 1012349 - RNA, 20 nt, Human
acuugcugggcuuuguuacc

SEQ ID NO: 1012350 - RNA, 22 nt, Human
accugagggcccaaacuuggua

SEQ ID NO: 1012351 - RNA, 23 nt, Human
uaguuauuuucucuguaauuugc

SEQ ID NO: 1012352 - RNA, 22 nt, Human
uaauguguugaauauuuguaca

SEQ ID NO: 1012353 - RNA, 22 nt, Human
cauaugaaauaugaguugaaca

SEQ ID NO: 1012354 - RNA, 22 nt, Human
auuucccagcuuugaucaguuu

SEQ ID NO: 1012355 - RNA, 22 nt, Human
guaaaauucuagcaucugaaag

SEQ ID NO: 1012356 - RNA, 22 nt, Human
uuuuaucugcuucauuaguuga

SEQ ID NO: 1012357 - RNA, 19 nt, Human
ccaguagagacagcugcag

SEQ ID NO: 1012358 - RNA, 22 nt, Human
cagcaccaggcagaccuggagc

SEQ ID NO: 1012359 - RNA, 22 nt, Human
aagugguagacaaagauaauug

SEQ ID NO: 1012360 - RNA, 22 nt, Human
auccaguucucagugcuuacag

SEQ ID NO: 1012361 - RNA, 22 nt, Human
accucugcuucccggguucaag

SEQ ID NO: 1012362 - RNA, 22 nt, Human
uauuucuggcuuugagggugau

SEQ ID NO: 1012363 - RNA, 22 nt, Human
gcucccaccuuugcuaucagua

SEQ ID NO: 1012364 - RNA, 22 nt, Human
cucaggaugcaauuccaucaag

SEQ ID NO: 1012365 - RNA, 22 nt, Human
ucuuugcaugcauuuucccuua

SEQ ID NO: 1012366 - RNA, 22 nt, Human
gcuggaaggcuaggcucaguug

SEQ ID NO: 1012367 - RNA, 22 nt, Human
caguggaggcucaagugugcuu

SEQ ID NO: 1012368 - RNA, 22 nt, Human
augacaugaccugguagagaca

SEQ ID NO: 1012369 - RNA, 19 nt, Human
ucuggagcugaugcaggug

SEQ ID NO: 1012370 - RNA, 22 nt, Human
uaugcauacaaugagauauucc

SEQ ID NO: 1012371 - RNA, 22 nt, Human
ugaagcagcaaaugaugggaga

SEQ ID NO: 1012372 - RNA, 20 nt, Human
ucucugcuguccacauuugc

SEQ ID NO: 1012373 - RNA, 22 nt, Human
augaagucugcacaugcaugug

SEQ ID NO: 1012374 - RNA, 22 nt, Human
ugcuuuauuuuaaauaugccau

SEQ ID NO: 1012375 - RNA, 22 nt, Human
agcugguucagaaauuagaugg

SEQ ID NO: 1012376 - RNA, 22 nt, Human
cucuuucugauucgcugggacc

SEQ ID NO: 1012377 - RNA, 22 nt, Human
gcagccagccccucugaccucu

SEQ ID NO: 1012378 - RNA, 22 nt, Human
aggcugggaaauguauuccagc

SEQ ID NO: 1012379 - RNA, 22 nt, Human
guucauuuaugauguaacaugu

SEQ ID NO: 1012380 - RNA, 22 nt, Human
augugaaaaauuucuuauuaca

SEQ ID NO: 1012381 - RNA, 22 nt, Human
aggucacauggauaaugaucag

SEQ ID NO: 1012382 - RNA, 23 nt, Human
gccugggacugguagugugaccu

SEQ ID NO: 1012383 - RNA, 22 nt, Human
ucauaauacaaagaguucugca

SEQ ID NO: 1012384 - RNA, 22 nt, Human
ccaaagucuggagcagcagagc

SEQ ID NO: 1012385 - RNA, 22 nt, Human
uauuucugaauccaaaagguca

SEQ ID NO: 1012386 - RNA, 22 nt, Human
uggggcuccuccuggcaggagg

SEQ ID NO: 1012387 - RNA, 23 nt, Human
gcucugagggcuuaucccuccca

SEQ ID NO: 1012388 - RNA, 22 nt, Human
caagaugugccuaaucagaccu

SEQ ID NO: 1012389 - RNA, 22 nt, Human
uuuugaaagaguccugcuacag

SEQ ID NO: 1012390 - RNA, 22 nt, Human
aacaugaagguaggaugguuuu

SEQ ID NO: 1012391 - RNA, 22 nt, Human
ugguaauuuacgcauuucugua

SEQ ID NO: 1012392 - RNA, 22 nt, Human
auucuccagcucacuguccaua

SEQ ID NO: 1012393 - RNA, 22 nt, Human
gcucaggaaacagcagggcuug

SEQ ID NO: 1012394 - RNA, 22 nt, Human
cuucugaggcagcuauucaguu

SEQ ID NO: 1012395 - RNA, 22 nt, Human
acuuaaaaccagacagcgucau

SEQ ID NO: 1012396 - RNA, 22 nt, Human
ggcuggagugggcuccagaguu

SEQ ID NO: 1012397 - RNA, 22 nt, Human
cccuggaggcggagcuugcagu

SEQ ID NO: 1012398 - RNA, 22 nt, Human
ucacccuugauaauguucuucu

SEQ ID NO: 1012399 - RNA, 22 nt, Human
gcaccugauugauuucacugcu

SEQ ID NO: 1012400 - RNA, 22 nt, Human
ccuggccugugaaucugagagc

SEQ ID NO: 1012401 - RNA, 21 nt, Human
uccacaaguuagaaggaaauu

SEQ ID NO: 1012402 - RNA, 22 nt, Human
ccuggagcccaaggcagugaga

SEQ ID NO: 1012403 - RNA, 22 nt, Human
aggcuucuacguggucccaggg

SEQ ID NO: 1012404 - RNA, 22 nt, Human
ucagcuccacagcuccucugcc

SEQ ID NO: 1012405 - RNA, 22 nt, Human
gccuggaguacuccuugaagug

SEQ ID NO: 1012406 - RNA, 22 nt, Human
gcucccagggcagcgcagaaga

SEQ ID NO: 1012407 - RNA, 22 nt, Human
cugugucccuugucccagagcc

SEQ ID NO: 1012408 - RNA, 22 nt, Human
uacccagcuccucagaagacca

SEQ ID NO: 1012409 - RNA, 22 nt, Human
uaaaugugcacagguuagaagg

SEQ ID NO: 1012410 - RNA, 22 nt, Human
cagucucuaaaucaaucugaau

SEQ ID NO: 1012411 - RNA, 18 nt, Human
ugucucaggcugaaacag

SEQ ID NO: 1012412 - RNA, 22 nt, Human
aaaugcagguucuugagccaag

SEQ ID NO: 1012413 - RNA, 22 nt, Human
aaaguguacuaugucaugaaca

SEQ ID NO: 1012414 - RNA, 21 nt, Human
uugcaccaugauaaauucaga

SEQ ID NO: 1012415 - RNA, 22 nt, Human
guguauaacuaucuaucuagua

SEQ ID NO: 1012416 - RNA, 22 nt, Human
ggccagcagucacagggucaga

SEQ ID NO: 1012417 - RNA, 17 nt, Human
uguggccuucugagcuu

SEQ ID NO: 1012418 - RNA, 22 nt, Human
ugucagaggcucagggucucag

SEQ ID NO: 1012419 - RNA, 22 nt, Human
ucaagagacaggacguguuuca

SEQ ID NO: 1012420 - RNA, 22 nt, Human
gcugagggcuguaacagcagag

SEQ ID NO: 1012421 - RNA, 22 nt, Human
cugaggccagcugcagagcucu

SEQ ID NO: 1012422 - RNA, 22 nt, Human
aucuacaggcugaggugggagg

SEQ ID NO: 1012423 - RNA, 22 nt, Human
uguauuuuuaggaaugcgcuau

SEQ ID NO: 1012424 - RNA, 20 nt, Human
aggcccugccagggacggag

SEQ ID NO: 1012425 - RNA, 22 nt, Human
ccuuucucuaucgacccaucgc

SEQ ID NO: 1012426 - RNA, 22 nt, Human
aaucaguuucuuggcaaguuua

SEQ ID NO: 1012427 - RNA, 22 nt, Human
acacuuuacagcuuccuuugca

SEQ ID NO: 1012428 - RNA, 22 nt, Human
caggaaauaucuccuggcagag

SEQ ID NO: 1012429 - RNA, 22 nt, Human
aagaugauagaucugucaaugu

SEQ ID NO: 1012430 - RNA, 18 nt, Human
gugcugugggcaguggcc

SEQ ID NO: 1012431 - RNA, 22 nt, Human
cugggagacaagagagggcuga

SEQ ID NO: 1012432 - RNA, 22 nt, Human
ucaucugucccaggcuuuuuuc

SEQ ID NO: 1012433 - RNA, 22 nt, Human
ugggcaggaugcguugauucuu

SEQ ID NO: 1012434 - RNA, 22 nt, Human
gugccagggggcacugaacaga

SEQ ID NO: 1012435 - RNA, 22 nt, Human
cuucugggcauucagcugcaca

SEQ ID NO: 1012436 - RNA, 22 nt, Human
acugagcugcuugaagugaacu

SEQ ID NO: 1012437 - RNA, 22 nt, Human
cacucccuucaggagccuagga

SEQ ID NO: 1012438 - RNA, 22 nt, Human
uaucuuugcaaauaucucuaag

SEQ ID NO: 1012439 - RNA, 22 nt, Human
ccuugcugaccaucaccuuuga

SEQ ID NO: 1012440 - RNA, 22 nt, Human
auuuucagagacaucuggacuu

SEQ ID NO: 1012441 - RNA, 17 nt, Human
aggcugcugggccaggg

SEQ ID NO: 1012442 - RNA, 22 nt, Human
ugucccucauugacgcugugcc

SEQ ID NO: 1012443 - RNA, 22 nt, Human
cucaacagcucugccauacucc

SEQ ID NO: 1012444 - RNA, 22 nt, Human
uagaaacauguucuguucuguu

SEQ ID NO: 1012445 - RNA, 22 nt, Human
ggguagcaugugucagaguuug

SEQ ID NO: 1012446 - RNA, 21 nt, Human
ucagaguggaagacaguuuga

SEQ ID NO: 1012447 - RNA, 20 nt, Human
aggagcugaauuagaggguu

SEQ ID NO: 1012448 - RNA, 22 nt, Human
agggaccugucaaugacaguua

SEQ ID NO: 1012449 - RNA, 22 nt, Human
uacccagcaaucccuagagguu

SEQ ID NO: 1012450 - RNA, 22 nt, Human
ugcgcggcucagucaucuccag

SEQ ID NO: 1012451 - RNA, 22 nt, Human
cuuaagauuugcgauaccuaau

SEQ ID NO: 1012452 - RNA, 22 nt, Human
aagggagguaaagcuauuuaaa

SEQ ID NO: 1012453 - RNA, 22 nt, Human
agcccaggcagagggaugcuug

SEQ ID NO: 1012454 - RNA, 22 nt, Human
ugcuucaaguugaaauauucuu

SEQ ID NO: 1012455 - RNA, 22 nt, Human
cuggcugguuacuauuucuggu

SEQ ID NO: 1012456 - RNA, 22 nt, Human
ucucagagagaugaaacuucca

SEQ ID NO: 1012457 - RNA, 22 nt, Human
ugcuguagcccugcacagugca

SEQ ID NO: 1012458 - RNA, 22 nt, Human
uaaguaaauuuauaaugugauu

SEQ ID NO: 1012459 - RNA, 22 nt, Human
acccugagggguauagcagaag

SEQ ID NO: 1012460 - RNA, 22 nt, Human
uucauugugaacacauucugcc

SEQ ID NO: 1012461 - RNA, 22 nt, Human
ggaaaaggccacagggacacau

SEQ ID NO: 1012462 - RNA, 17 nt, Human
ugcauuguuggaaauuu

SEQ ID NO: 1012463 - RNA, 22 nt, Human
caguggcugugaccagggaccu

SEQ ID NO: 1012464 - RNA, 21 nt, Human
uccucugcucucauaccacaa

SEQ ID NO: 1012465 - RNA, 22 nt, Human
ugcagaagugagucaugaggaa

SEQ ID NO: 1012466 - RNA, 22 nt, Human
uagugcuuggcccuaccagaua

SEQ ID NO: 1012467 - RNA, 22 nt, Human
ggguaauuggggccuugcagug

SEQ ID NO: 1012468 - RNA, 19 nt, Human
agugucaucagcuacucag

SEQ ID NO: 1012469 - RNA, 22 nt, Human
ucaguuuuguauguuguaaguc

SEQ ID NO: 1012470 - RNA, 22 nt, Human
uuuaaauaggacuccugggggu

SEQ ID NO: 1012471 - RNA, 22 nt, Human
ucuguucauacagaguauagua

SEQ ID NO: 1012472 - RNA, 22 nt, Human
ggcagaccucuccagccccaca

SEQ ID NO: 1012473 - RNA, 22 nt, Human
ucuccuccuuuuuucaacauag

SEQ ID NO: 1012474 - RNA, 22 nt, Human
cagccugacaccagcuuugggc

SEQ ID NO: 1012475 - RNA, 22 nt, Human
gccaaaucuggauuuagcaaga

SEQ ID NO: 1012476 - RNA, 22 nt, Human
auguagcaucuauccugauaaa

SEQ ID NO: 1012477 - RNA, 22 nt, Human
cccaggagguggagguugcagc

SEQ ID NO: 1012478 - RNA, 22 nt, Human
gcucacugccauucucuagaug

SEQ ID NO: 1012479 - RNA, 22 nt, Human
uagggcuccacucccagagauu

SEQ ID NO: 1012480 - RNA, 22 nt, Human
gcugcugcgcuugucuacuguu

SEQ ID NO: 1012481 - RNA, 22 nt, Human
uagacacaagagaaggguauaa

SEQ ID NO: 1012482 - RNA, 22 nt, Human
aaggcacugacugugcagggga

SEQ ID NO: 1012483 - RNA, 17 nt, Human
gcuggcugacccaugcc

SEQ ID NO: 1012484 - RNA, 22 nt, Human
ucacaggguguacaucaccuau

SEQ ID NO: 1012485 - RNA, 22 nt, Human
ucaguuuugaaaacauugaaug

SEQ ID NO: 1012486 - RNA, 22 nt, Human
gggcugggauggcuugaagauu

SEQ ID NO: 1012487 - RNA, 22 nt, Human
ccucuucuaggacguccuugug

SEQ ID NO: 1012488 - RNA, 20 nt, Human
cccagggaccugagcuccau

SEQ ID NO: 1012489 - RNA, 22 nt, Human
ccuggagguggagguugcagug

SEQ ID NO: 1012490 - RNA, 22 nt, Human
agccacagucuguagccagcuu

SEQ ID NO: 1012491 - RNA, 22 nt, Human
uagcuuuaagaugagaugugga

SEQ ID NO: 1012492 - RNA, 22 nt, Human
augccuggacugacaugcacug

SEQ ID NO: 1012493 - RNA, 22 nt, Human
agggcuggccacaugauuuggu

SEQ ID NO: 1012494 - RNA, 22 nt, Human
uggaccugagccuggcccugcc

SEQ ID NO: 1012495 - RNA, 17 nt, Human
agcagcuggcacaggag

SEQ ID NO: 1012496 - RNA, 22 nt, Human
acaguaauauugaugcucguca

SEQ ID NO: 1012497 - RNA, 20 nt, Human
gccugcagguuggaugggau

SEQ ID NO: 1012498 - RNA, 22 nt, Human
ggacuggccggcgcugaggccc

SEQ ID NO: 1012499 - RNA, 22 nt, Human
uuugcauaaaggagcauuucuc

SEQ ID NO: 1012500 - RNA, 22 nt, Human
auuuaaugucgagcuauuguag

SEQ ID NO: 1012501 - RNA, 22 nt, Human
ggcuggcucagggcuugagaga

SEQ ID NO: 1012502 - RNA, 22 nt, Human
cuuauguauauuuggaacguac

SEQ ID NO: 1012503 - RNA, 22 nt, Human
gcucccagauuucagccuugug

SEQ ID NO: 1012504 - RNA, 22 nt, Human
ugggaggaucgcuugagcccag

SEQ ID NO: 1012505 - RNA, 22 nt, Human
auaauuuaaauuaguaugugau

SEQ ID NO: 1012506 - RNA, 22 nt, Human
augggcagcagcugccauucau

SEQ ID NO: 1012507 - RNA, 22 nt, Human
aagauuauggcagauaacaauu

SEQ ID NO: 1012508 - RNA, 22 nt, Human
acccugggucauauacagugug

SEQ ID NO: 1012509 - RNA, 22 nt, Human
aucagagaaguuucacuggcau

SEQ ID NO: 1012510 - RNA, 22 nt, Human
agcagagcccuuccauggccuu

SEQ ID NO: 1012511 - RNA, 19 nt, Human
aaaaacuuaguccagaaag

SEQ ID NO: 1012512 - RNA, 21 nt, Human
uguaaguuucaucugaauugg

SEQ ID NO: 1012513 - RNA, 22 nt, Human
aagccaggcaugcuuggacagu

SEQ ID NO: 1012514 - RNA, 22 nt, Human
agaaaucacaggaggcagaagg

SEQ ID NO: 1012515 - RNA, 22 nt, Human
gugggcuucuguuagggaggcu

SEQ ID NO: 1012516 - RNA, 22 nt, Human
gaaguucuuagucucauuugca

SEQ ID NO: 1012517 - RNA, 22 nt, Human
cagcuuuaggacucauaauaaa

SEQ ID NO: 1012518 - RNA, 22 nt, Human
ucauccagagcuucauaaguaa

SEQ ID NO: 1012519 - RNA, 18 nt, Human
ugucauugccagggaagc

SEQ ID NO: 1012520 - RNA, 22 nt, Human
uagaaaugcaguguacuguguc

SEQ ID NO: 1012521 - RNA, 22 nt, Human
uugaauaguguuuucaguauac

SEQ ID NO: 1012522 - RNA, 22 nt, Human
agggcucugagugggaaagagg

SEQ ID NO: 1012523 - RNA, 22 nt, Human
aagcugcccuguguuagaguuc

SEQ ID NO: 1012524 - RNA, 22 nt, Human
uagcuuuaggcacguuugaauu

SEQ ID NO: 1012525 - RNA, 22 nt, Human
gggagcuguaguccagauaccg

SEQ ID NO: 1012526 - RNA, 21 nt, Human
uucaaaguuugccuaaagauu

SEQ ID NO: 1012527 - RNA, 22 nt, Human
gcucccugcacucugcagcccu

SEQ ID NO: 1012528 - RNA, 22 nt, Human
augcugaggacaaagagaucaa

SEQ ID NO: 1012529 - RNA, 22 nt, Human
gcugcaggcgccugcggucucu

SEQ ID NO: 1012530 - RNA, 22 nt, Human
uucuccgcuaaguucucugcag

SEQ ID NO: 1012531 - RNA, 22 nt, Human
uguuuuauuucuccaagaggga

SEQ ID NO: 1012532 - RNA, 22 nt, Human
gcuuggaaguaggauugggaga

SEQ ID NO: 1012533 - RNA, 22 nt, Human
aaggcugccucugccagaggag

SEQ ID NO: 1012534 - RNA, 22 nt, Human
acauuuagcuguacaaucuaug

SEQ ID NO: 1012535 - RNA, 22 nt, Human
cugggcagugcagcuauagaac

SEQ ID NO: 1012536 - RNA, 22 nt, Human
agaauaaaucaaauguccugag

SEQ ID NO: 1012537 - RNA, 19 nt, Human
caucuggaugauucuccug

SEQ ID NO: 1012538 - RNA, 21 nt, Human
guauucuuuaugaagugaaaa

SEQ ID NO: 1012539 - RNA, 22 nt, Human
acaguuaucuuugaaauagaga

SEQ ID NO: 1012540 - RNA, 22 nt, Human
auuccaguuggguucuaauaca

SEQ ID NO: 1012541 - RNA, 22 nt, Human
ggccacuccgcugcuacuggaa

SEQ ID NO: 1012542 - RNA, 22 nt, Human
caggguggggaaauagcgcccu

SEQ ID NO: 1012543 - RNA, 22 nt, Human
augaaggcaguuaaacgucauc

SEQ ID NO: 1012544 - RNA, 22 nt, Human
cugccucuguugggcauggucu

SEQ ID NO: 1012545 - RNA, 22 nt, Human
gagccuccuccuggugugccga

SEQ ID NO: 1012546 - RNA, 23 nt, Human
uacaugcuauaauuucacccuca

SEQ ID NO: 1012547 - RNA, 22 nt, Human
cagagccaacgccaccugccca

SEQ ID NO: 1012548 - RNA, 22 nt, Human
aguaacuaugcuugagaaucag

SEQ ID NO: 1012549 - RNA, 22 nt, Human
acuuugaaggggaacauuuuaa

SEQ ID NO: 1012550 - RNA, 22 nt, Human
auguguagaacuguaaugccca

SEQ ID NO: 1012551 - RNA, 23 nt, Human
guggccuccccggaaugccucgc

SEQ ID NO: 1012552 - RNA, 22 nt, Human
gccagagccacuuuugggugau

SEQ ID NO: 1012553 - RNA, 22 nt, Human
aguguuccuugcuuucccagag

SEQ ID NO: 1012554 - RNA, 18 nt, Human
uguacaguuaugagcauu

SEQ ID NO: 1012555 - RNA, 22 nt, Human
ggggauggugggaaggcaaucu

SEQ ID NO: 1012556 - RNA, 22 nt, Human
ccagggugaccagcuggccuag

SEQ ID NO: 1012557 - RNA, 22 nt, Human
acaaaguuaacaguuggauagu

SEQ ID NO: 1012558 - RNA, 22 nt, Human
gagagcccugcuccuaucccag

SEQ ID NO: 1012559 - RNA, 22 nt, Human
gggcuacauugugagagaaguu

SEQ ID NO: 1012560 - RNA, 22 nt, Human
cauuuucaugaguuucuguuca

SEQ ID NO: 1012561 - RNA, 22 nt, Human
ggucccaguccucucccugcua

SEQ ID NO: 1012562 - RNA, 22 nt, Human
caugaaauugcuccuuuggugc

SEQ ID NO: 1012563 - RNA, 22 nt, Human
uccuucagugucccgcucaggu

SEQ ID NO: 1012564 - RNA, 22 nt, Human
uggccacagccucugccaguuc

SEQ ID NO: 1012565 - RNA, 22 nt, Human
ugggguggauagaaagugaugu

SEQ ID NO: 1012566 - RNA, 23 nt, Human
ggagugcaauggcgccaucucgg

SEQ ID NO: 1012567 - RNA, 22 nt, Human
ccugccuggcuuccagaagaga

SEQ ID NO: 1012568 - RNA, 22 nt, Human
aguaugaaccuggguucuggau

SEQ ID NO: 1012569 - RNA, 23 nt, Human
ggguccagagacaggcaugggug

SEQ ID NO: 1012570 - RNA, 23 nt, Human
gggauauggaccuuggaggaguc

SEQ ID NO: 1012571 - RNA, 22 nt, Human
cuuaacagagagaaguguugcu

SEQ ID NO: 1012572 - RNA, 22 nt, Human
gaaucauuuauuuuugacagca

SEQ ID NO: 1012573 - RNA, 22 nt, Human
aggacugggugcagagggcauc

SEQ ID NO: 1012574 - RNA, 22 nt, Human
aggccaggcaacauucugaagu

SEQ ID NO: 1012575 - RNA, 22 nt, Human
uuuugcuugagugcacaaaaug

SEQ ID NO: 1012576 - RNA, 22 nt, Human
cuuaauuuuuguaguagaugga

SEQ ID NO: 1012577 - RNA, 22 nt, Human
ugcauacacaagcauacaugua

SEQ ID NO: 1012578 - RNA, 22 nt, Human
aggcaucugaguuugcaagcuu

SEQ ID NO: 1012579 - RNA, 22 nt, Human
cagggcugguuugucgaagaaa

SEQ ID NO: 1012580 - RNA, 21 nt, Human
cuguccaguaauuccuggcac

SEQ ID NO: 1012581 - RNA, 22 nt, Human
uuuguaaagucuguucugaguu

SEQ ID NO: 1012582 - RNA, 22 nt, Human
cugguccuccuugccuucagau

SEQ ID NO: 1012583 - RNA, 22 nt, Human
gcagcugaaagggaucucuaca

SEQ ID NO: 1012584 - RNA, 22 nt, Human
cucagagucugcauuucuguca

SEQ ID NO: 1012585 - RNA, 22 nt, Human
aggaaaaaagucugugauuaua

SEQ ID NO: 1012586 - RNA, 23 nt, Human
gagcugggauacaggcuuacugc

SEQ ID NO: 1012587 - RNA, 22 nt, Human
augaagcugguuuuggcuuggg

SEQ ID NO: 1012588 - RNA, 22 nt, Human
gcacagccagcaucugagggau

SEQ ID NO: 1012589 - RNA, 22 nt, Human
aucauuccacauguaccacuag

SEQ ID NO: 1012590 - RNA, 22 nt, Human
uuuaaucaggcaaagcauaaua

SEQ ID NO: 1012591 - RNA, 22 nt, Human
aagaugcagcuuuacaauaagg

SEQ ID NO: 1012592 - RNA, 22 nt, Human
ugacagcauaacacuggucuug

SEQ ID NO: 1012593 - RNA, 22 nt, Human
uccagcagggaauuaguagucu

SEQ ID NO: 1012594 - RNA, 22 nt, Human
ccuggccuuaagggcagggagc

SEQ ID NO: 1012595 - RNA, 22 nt, Human
acagcuggcaggggggcaugaa

SEQ ID NO: 1012596 - RNA, 22 nt, Human
ugccucagaguugucccuacca

SEQ ID NO: 1012597 - RNA, 22 nt, Human
cuggguggcgucuggggccagu

SEQ ID NO: 1012598 - RNA, 22 nt, Human
cugcaggcccccuuccuggagu

SEQ ID NO: 1012599 - RNA, 22 nt, Human
cuggggugugcucagagcaggg

SEQ ID NO: 1012600 - RNA, 22 nt, Human
cuggagcaggcuugucccagcu

SEQ ID NO: 1012601 - RNA, 22 nt, Human
ugugucagagguagagauggca

SEQ ID NO: 1012602 - RNA, 22 nt, Human
auuucuguauccugcugucaga

SEQ ID NO: 1012603 - RNA, 22 nt, Human
agccuggagcuugaguuaugag

SEQ ID NO: 1012604 - RNA, 22 nt, Human
uaggaaaugcuccauugcauaa

SEQ ID NO: 1012605 - RNA, 22 nt, Human
agggaauguagcaagaugccaa

SEQ ID NO: 1012606 - RNA, 21 nt, Human
cugcaucucauagaacauguc

SEQ ID NO: 1012607 - RNA, 22 nt, Human
agucucagcaagcauggcuagu

SEQ ID NO: 1012608 - RNA, 22 nt, Human
cacagcugccauggcugcacuu

SEQ ID NO: 1012609 - RNA, 22 nt, Human
uaucaucuuguugucaugcagc

SEQ ID NO: 1012610 - RNA, 22 nt, Human
auaugugaaugauaucacuuug

SEQ ID NO: 1012611 - RNA, 22 nt, Human
ucucaggaucuaauacauggua

SEQ ID NO: 1012612 - RNA, 22 nt, Human
gccuggugguauccuggcaaga

SEQ ID NO: 1012613 - RNA, 22 nt, Human
uuaauacagucuccagaaguaa

SEQ ID NO: 1012614 - RNA, 22 nt, Human
uuagucaauagugaauauagag

SEQ ID NO: 1012615 - RNA, 22 nt, Human
cugccaaggcuggggaggacaa

SEQ ID NO: 1012616 - RNA, 22 nt, Human
cacugcuuaguugguaaaugug

SEQ ID NO: 1012617 - RNA, 21 nt, Human
uauuugcugccaucuuugagg

SEQ ID NO: 1012618 - RNA, 22 nt, Human
ugcugucccccgugucugggcu

SEQ ID NO: 1012619 - RNA, 17 nt, Human
uuuagaauacaauguuu

SEQ ID NO: 1012620 - RNA, 22 nt, Human
gcaggcagucaucuuucauauu

SEQ ID NO: 1012621 - RNA, 22 nt, Human
cagggugccaaagaacaaauau

SEQ ID NO: 1012622 - RNA, 22 nt, Human
aggcacugacaauucuggacug

SEQ ID NO: 1012623 - RNA, 22 nt, Human
ccagaggugcugggagaggucu

SEQ ID NO: 1012624 - RNA, 22 nt, Human
cagggcucaucugugugaccag

SEQ ID NO: 1012625 - RNA, 17 nt, Human
gagagcugcugcuuccg

SEQ ID NO: 1012626 - RNA, 22 nt, Human
cugagucucccggcaguggagg

SEQ ID NO: 1012627 - RNA, 22 nt, Human
auugacaagacaauggcucuua

SEQ ID NO: 1012628 - RNA, 22 nt, Human
cucaggccauucuuccagcugc

SEQ ID NO: 1012629 - RNA, 22 nt, Human
auacagaagaacuauagccacu

SEQ ID NO: 1012630 - RNA, 22 nt, Human
ccugggagguggagguugcagc

SEQ ID NO: 1012631 - RNA, 22 nt, Human
ugcagucuuccagcugcacaaa

SEQ ID NO: 1012632 - RNA, 22 nt, Human
cagaguucaaagccugcuggga

SEQ ID NO: 1012633 - RNA, 22 nt, Human
uggguagagacacagucugggg

SEQ ID NO: 1012634 - RNA, 22 nt, Human
ugcugcucuucaccauggccuc

SEQ ID NO: 1012635 - RNA, 22 nt, Human
agccugcaggaugggcagcacc

SEQ ID NO: 1012636 - RNA, 22 nt, Human
uauggcauauaguccagcauaa

SEQ ID NO: 1012637 - RNA, 22 nt, Human
gccugaaguuucaugccucuau

SEQ ID NO: 1012638 - RNA, 22 nt, Human
gcccucagcuccuggacacaug

SEQ ID NO: 1012639 - RNA, 22 nt, Human
uaccuugggcuauuaucuuuga

SEQ ID NO: 1012640 - RNA, 22 nt, Human
ggaaggaggaugcucuggccuu

SEQ ID NO: 1012641 - RNA, 22 nt, Human
ccugccugcggcccgcggggag

SEQ ID NO: 1012642 - RNA, 22 nt, Human
gagcucauucauucauugccug

SEQ ID NO: 1012643 - RNA, 22 nt, Human
guuagggagucagguggcucuu

SEQ ID NO: 1012644 - RNA, 22 nt, Human
augguguagcaugugauaugac

SEQ ID NO: 1012645 - RNA, 22 nt, Human
ggucagggcucuuccaguggcu

SEQ ID NO: 1012646 - RNA, 22 nt, Human
aaguuuuaacaaguacuuacua

SEQ ID NO: 1012647 - RNA, 21 nt, Human
ccaggguccagcugccauggu

SEQ ID NO: 1012648 - RNA, 19 nt, Human
uccucagugacaaccucag

SEQ ID NO: 1012649 - RNA, 22 nt, Human
uuuuacuuaauucuuggucaug

SEQ ID NO: 1012650 - RNA, 22 nt, Human
aggaccuggaucacagagaucu

SEQ ID NO: 1012651 - RNA, 22 nt, Human
aauucuguuacuaaugugaugu

SEQ ID NO: 1012652 - RNA, 22 nt, Human
aagaaucauccugcaagagucu

SEQ ID NO: 1012653 - RNA, 17 nt, Human
acacagccagguucucc

SEQ ID NO: 1012654 - RNA, 22 nt, Human
ugcuggaggaguuuacuguggc

SEQ ID NO: 1012655 - RNA, 22 nt, Human
gcacuaaaccaacauguaauaa

SEQ ID NO: 1012656 - RNA, 22 nt, Human
guuauauauaguauuucucuga

SEQ ID NO: 1012657 - RNA, 22 nt, Human
ugcuuuauucaggguuuacccc

SEQ ID NO: 1012658 - RNA, 22 nt, Human
ggagcacuauaauagagauuuu

SEQ ID NO: 1012659 - RNA, 22 nt, Human
cugccucuugacagaucguggc

SEQ ID NO: 1012660 - RNA, 22 nt, Human
ucaagauaccaccauuauaugu

SEQ ID NO: 1012661 - RNA, 22 nt, Human
cuucucagcauuuugucagucu

SEQ ID NO: 1012662 - RNA, 22 nt, Human
ugucauuuucuaaucuguuguc

SEQ ID NO: 1012663 - RNA, 17 nt, Human
uagagcugguucaggag

SEQ ID NO: 1012664 - RNA, 22 nt, Human
ggucaggguauaaucaagugag

SEQ ID NO: 1012665 - RNA, 22 nt, Human
aaaugcuguaacugauauucug

SEQ ID NO: 1012666 - RNA, 22 nt, Human
ugaggccagugacauauauuaa

SEQ ID NO: 1012667 - RNA, 22 nt, Human
acugagcugugacaaugcuuaa

SEQ ID NO: 1012668 - RNA, 22 nt, Human
acagagguguguguaggacagu

SEQ ID NO: 1012669 - RNA, 22 nt, Human
cuccucuggcuuccuggaggca

SEQ ID NO: 1012670 - RNA, 22 nt, Human
ucaucaaagcgcuuggaguagg

SEQ ID NO: 1012671 - RNA, 22 nt, Human
uuuuuccuaagcaguggagcug

SEQ ID NO: 1012672 - RNA, 20 nt, Human
agguauaagaaaugugauuu

SEQ ID NO: 1012673 - RNA, 22 nt, Human
ggcauccaguucugaucaacaa

SEQ ID NO: 1012674 - RNA, 22 nt, Human
ccucagagaaagguauggcuga

SEQ ID NO: 1012675 - RNA, 20 nt, Human
ucuguacacucaucuucugc

SEQ ID NO: 1012676 - RNA, 22 nt, Human
uugcuuuguuacugcaguuucc

SEQ ID NO: 1012677 - RNA, 22 nt, Human
agagaugucgccuugcccaggg

SEQ ID NO: 1012678 - RNA, 22 nt, Human
cauugcacuccaucuugggcaa

SEQ ID NO: 1012679 - RNA, 22 nt, Human
ucuguuuaggcaaaauagcuac

SEQ ID NO: 1012680 - RNA, 22 nt, Human
gcuggagccuucugcucuguug

SEQ ID NO: 1012681 - RNA, 22 nt, Human
aaugcuguaaagaugcuaucug

SEQ ID NO: 1012682 - RNA, 20 nt, Human
cacguuuuuccacuagcaaa

SEQ ID NO: 1012683 - RNA, 22 nt, Human
caggauccccaggucgccgucc

SEQ ID NO: 1012684 - RNA, 22 nt, Human
auuauuagugauguuguuacug

SEQ ID NO: 1012685 - RNA, 22 nt, Human
ucaauuaugccauugcaauauu

SEQ ID NO: 1012686 - RNA, 20 nt, Human
gugcuucagaagccauugcu

SEQ ID NO: 1012687 - RNA, 22 nt, Human
acaguaccugcucucaagcaaa

SEQ ID NO: 1012688 - RNA, 23 nt, Human
agagcuuucuaaaauguaaaucu

SEQ ID NO: 1012689 - RNA, 22 nt, Human
gcucacuggccugaagaggacg

SEQ ID NO: 1012690 - RNA, 18 nt, Human
aggcuucuuggcucaguc

SEQ ID NO: 1012691 - RNA, 22 nt, Human
augugcauuaaaugucaauguu

SEQ ID NO: 1012692 - RNA, 23 nt, Human
ucagugauguugaaccuagcagu

SEQ ID NO: 1012693 - RNA, 22 nt, Human
uaugaacauguucauugacuua

SEQ ID NO: 1012694 - RNA, 22 nt, Human
gucuucuuuaaccuacuaaagc

SEQ ID NO: 1012695 - RNA, 19 nt, Human
ccagagagcuagguacaga

SEQ ID NO: 1012696 - RNA, 22 nt, Human
ugcuagugcaggguuuucaguu

SEQ ID NO: 1012697 - RNA, 22 nt, Human
uggcucagccagcccuaggaac

SEQ ID NO: 1012698 - RNA, 22 nt, Human
ggaguucacugugcaggcucug

SEQ ID NO: 1012699 - RNA, 22 nt, Human
uccagacccaugacccugggga

SEQ ID NO: 1012700 - RNA, 21 nt, Human
cauugucgacauuuuccccuc

SEQ ID NO: 1012701 - RNA, 17 nt, Human
cccagagaugcugccuu

SEQ ID NO: 1012702 - RNA, 22 nt, Human
cagcucuggcgucagggagcga

SEQ ID NO: 1012703 - RNA, 22 nt, Human
ggcagaagauaggacagggaau

SEQ ID NO: 1012704 - RNA, 22 nt, Human
auucugucuaagcuggcuacgu

SEQ ID NO: 1012705 - RNA, 22 nt, Human
ccagaggucuccugcacgggau

SEQ ID NO: 1012706 - RNA, 22 nt, Human
ugcauuguuugauaggugaauu

SEQ ID NO: 1012707 - RNA, 21 nt, Human
aaagagcccgcugagagguuc

SEQ ID NO: 1012708 - RNA, 22 nt, Human
uucuuacuaguauguuucagca

SEQ ID NO: 1012709 - RNA, 20 nt, Human
cagcuuuagaucuuugauua

SEQ ID NO: 1012710 - RNA, 22 nt, Human
aagcagggugucuugacccaug

SEQ ID NO: 1012711 - RNA, 22 nt, Human
ggcucuggagcacagacgucug

SEQ ID NO: 1012712 - RNA, 22 nt, Human
agaggcugagaaacccucuucu

SEQ ID NO: 1012713 - RNA, 22 nt, Human
ccagugggugcugggcucugcc

SEQ ID NO: 1012714 - RNA, 22 nt, Human
ccugcugugaaacuggcauaug

SEQ ID NO: 1012715 - RNA, 22 nt, Human
uuguuucaaauauuucagaaua

SEQ ID NO: 1012716 - RNA, 22 nt, Human
agaaaugcucuuccugaccaga

SEQ ID NO: 1012717 - RNA, 22 nt, Human
ggcagcucaccucugguccagg

SEQ ID NO: 1012718 - RNA, 22 nt, Human
uaugcacauucacacaaaaaug

SEQ ID NO: 1012719 - RNA, 22 nt, Human
cagucccacuagugccaauacc

SEQ ID NO: 1012720 - RNA, 23 nt, Human
gggaccagcuagggcugugaccu

SEQ ID NO: 1012721 - RNA, 18 nt, Human
uccuccuuuggccuuuuc

SEQ ID NO: 1012722 - RNA, 22 nt, Human
uaaauuauggcuggcagagcag

SEQ ID NO: 1012723 - RNA, 22 nt, Human
gcguccagggaaggcccagcug

SEQ ID NO: 1012724 - RNA, 22 nt, Human
auacauacguacauacguaugu

SEQ ID NO: 1012725 - RNA, 22 nt, Human
ucugggagcacacgcagugauc

SEQ ID NO: 1012726 - RNA, 22 nt, Human
ucaggaucggccuuuuuuuaag

SEQ ID NO: 1012727 - RNA, 22 nt, Human
gggagggaaagcuugaucuguc

SEQ ID NO: 1012728 - RNA, 22 nt, Human
uccuccagugucuggggccuug

SEQ ID NO: 1012729 - RNA, 22 nt, Human
gcccugcugcuggcagaggcgc

SEQ ID NO: 1012730 - RNA, 22 nt, Human
ugcuuuauuuauaaaauagcaa

SEQ ID NO: 1012731 - RNA, 22 nt, Human
cccucugcaggcuggaccugcc

SEQ ID NO: 1012732 - RNA, 22 nt, Human
ccagaggugccacagaaagagc

SEQ ID NO: 1012733 - RNA, 22 nt, Human
ggcacucagagauucaggcugu

SEQ ID NO: 1012734 - RNA, 22 nt, Human
gaaaacacuuugaucugaaagu

SEQ ID NO: 1012735 - RNA, 22 nt, Human
caggugccucaggaugagacaa

SEQ ID NO: 1012736 - RNA, 22 nt, Human
gggcagaggggcgcuucccucu

SEQ ID NO: 1012737 - RNA, 22 nt, Human
agcuggccuccgggugccuggg

SEQ ID NO: 1012738 - RNA, 23 nt, Human
ugucccagagggagggauaggcu

SEQ ID NO: 1012739 - RNA, 22 nt, Human
cuggccuuuuguuucuggagaa

SEQ ID NO: 1012740 - RNA, 22 nt, Human
uugauacaggcucuauuucauc

SEQ ID NO: 1012741 - RNA, 22 nt, Human
cugaggcuuugugugcaugccu

SEQ ID NO: 1012742 - RNA, 22 nt, Human
acagaguacauucagagacuau

SEQ ID NO: 1012743 - RNA, 22 nt, Human
gugcauuuaggucacaugaugu

SEQ ID NO: 1012744 - RNA, 22 nt, Human
cugggagguggagguugcauug

SEQ ID NO: 1012745 - RNA, 22 nt, Human
gcagcugcaggcaggcuugcug

SEQ ID NO: 1012746 - RNA, 22 nt, Human
uggcuuucucccccagcuucuc

SEQ ID NO: 1012747 - RNA, 22 nt, Human
gagccugcccagcccuguccac

SEQ ID NO: 1012748 - RNA, 22 nt, Human
acagcagccuuguugguuucga

SEQ ID NO: 1012749 - RNA, 22 nt, Human
ccuuaaaagaacuaucucuucu

SEQ ID NO: 1012750 - RNA, 22 nt, Human
gccugccucaaaaucccaguuc

SEQ ID NO: 1012751 - RNA, 22 nt, Human
uuucuacagcuggugcaacuuu

SEQ ID NO: 1012752 - RNA, 22 nt, Human
gcucaggacccaggugugaccu

SEQ ID NO: 1012753 - RNA, 22 nt, Human
uaugcacauauaaccugcacug

SEQ ID NO: 1012754 - RNA, 22 nt, Human
gcagggugauagugaggcucag

SEQ ID NO: 1012755 - RNA, 22 nt, Human
ucagaaagaacacaggcaguag

SEQ ID NO: 1012756 - RNA, 22 nt, Human
uuguguccugauuugacacaau

SEQ ID NO: 1012757 - RNA, 22 nt, Human
ucugagcuggagcccaucaccu

SEQ ID NO: 1012758 - RNA, 22 nt, Human
agaauccugaugaaaaggagag

SEQ ID NO: 1012759 - RNA, 22 nt, Human
ggcagccaugcacgcugccugg

SEQ ID NO: 1012760 - RNA, 18 nt, Human
ccagguggugacagagau

SEQ ID NO: 1012761 - RNA, 22 nt, Human
cagaggcuaagaugagugggug

SEQ ID NO: 1012762 - RNA, 22 nt, Human
agucccagccuaggcugugcug

SEQ ID NO: 1012763 - RNA, 23 nt, Human
cauaaaauauuaguaugguagca

SEQ ID NO: 1012764 - RNA, 22 nt, Human
ucugcucugggccagcuauuaa

SEQ ID NO: 1012765 - RNA, 22 nt, Human
ucccagccggugccuggguccc

SEQ ID NO: 1012766 - RNA, 22 nt, Human
uauguacacauacacuuguaau

SEQ ID NO: 1012767 - RNA, 22 nt, Human
uaauuuaauccaaguguuacau

SEQ ID NO: 1012768 - RNA, 22 nt, Human
aaauuucuugaggcucucuagc

SEQ ID NO: 1012769 - RNA, 16 nt, Human
uucugucacguacggc

SEQ ID NO: 1012770 - RNA, 22 nt, Human
accucugcaaugcaaugucaug

SEQ ID NO: 1012771 - RNA, 22 nt, Human
gccugagaaggauaggaagcga

SEQ ID NO: 1012772 - RNA, 22 nt, Human
cccuugcacauuugucuuuaau

SEQ ID NO: 1012773 - RNA, 22 nt, Human
uauuuuaaagacugccagccua

SEQ ID NO: 1012774 - RNA, 22 nt, Human
uaacacugguauuucauuuagu

SEQ ID NO: 1012775 - RNA, 22 nt, Human
agggcagagcugucuaaauggc

SEQ ID NO: 1012776 - RNA, 22 nt, Human
cagagcuggcucugcauguaca

SEQ ID NO: 1012777 - RNA, 22 nt, Human
gccugcagcaugcuaggucuug

SEQ ID NO: 1012778 - RNA, 22 nt, Human
uccagggaccucccugagagcu

SEQ ID NO: 1012779 - RNA, 22 nt, Human
uugcauuuuuagaugcuucugu

SEQ ID NO: 1012780 - RNA, 22 nt, Human
ggccuggccuccagaugugggc

SEQ ID NO: 1012781 - RNA, 22 nt, Human
gcacccagagggcagggucucc

SEQ ID NO: 1012782 - RNA, 22 nt, Human
caggagugagaugcgaucacuu

SEQ ID NO: 1012783 - RNA, 17 nt, Human
ugauaguucauuuuaag

SEQ ID NO: 1012784 - RNA, 22 nt, Human
agagcuggcugcugcggugcuu

SEQ ID NO: 1012785 - RNA, 22 nt, Human
uuucaaauaccauaaaccuaau

SEQ ID NO: 1012786 - RNA, 22 nt, Human
ggguuucaugguucucacaaug

SEQ ID NO: 1012787 - RNA, 22 nt, Human
ugcccuuggguaacuugcugau

SEQ ID NO: 1012788 - RNA, 18 nt, Human
uccugccugcgggcuccc

SEQ ID NO: 1012789 - RNA, 22 nt, Human
aggaccuguaccucagcaucua

SEQ ID NO: 1012790 - RNA, 22 nt, Human
agggccugagcuggcugaccuc

SEQ ID NO: 1012791 - RNA, 22 nt, Human
ggagcagccuguguagacgggg

SEQ ID NO: 1012792 - RNA, 22 nt, Human
auaauuaauuucaguaaucucc

SEQ ID NO: 1012793 - RNA, 22 nt, Human
gcuucuauuauuuggagcugag

SEQ ID NO: 1012794 - RNA, 22 nt, Human
cuuauguauaauguuccacaua

SEQ ID NO: 1012795 - RNA, 22 nt, Human
gucucagauucagacaucuaca

SEQ ID NO: 1012796 - RNA, 22 nt, Human
ugccucugguuaucugguaccu

SEQ ID NO: 1012797 - RNA, 22 nt, Human
ucauggauggccgggaggugau

SEQ ID NO: 1012798 - RNA, 22 nt, Human
auugcaccuuggguuuugaaag

SEQ ID NO: 1012799 - RNA, 22 nt, Human
ugguaucagagccaucuguauu

SEQ ID NO: 1012800 - RNA, 22 nt, Human
aaucuguuuaguucugcguaug

SEQ ID NO: 1012801 - RNA, 22 nt, Human
acuuuguauaagacaauaaaga

SEQ ID NO: 1012802 - RNA, 22 nt, Human
uagcuuuaccauagaagaguau

SEQ ID NO: 1012803 - RNA, 22 nt, Human
uguacauagaucuugaaaauua

SEQ ID NO: 1012804 - RNA, 22 nt, Human
ucuccaagcagggcugcaaggc

SEQ ID NO: 1012805 - RNA, 22 nt, Human
ccaggccugcaucugcugcgca

SEQ ID NO: 1012806 - RNA, 22 nt, Human
uguuccauaaguggugcuuugu

SEQ ID NO: 1012807 - RNA, 22 nt, Human
cugggcagccucacacaauguu

SEQ ID NO: 1012808 - RNA, 23 nt, Human
ugugaaauuugaggucagugcuu

SEQ ID NO: 1012809 - RNA, 22 nt, Human
agcagaaccugcagaccugucu

SEQ ID NO: 1012810 - RNA, 22 nt, Human
ccucugaguccucccugguugc

SEQ ID NO: 1012811 - RNA, 22 nt, Human
uugaagcauuugcuauagcauu

SEQ ID NO: 1012812 - RNA, 22 nt, Human
acacagggcagagagcuggcuc

SEQ ID NO: 1012813 - RNA, 22 nt, Human
cucugaacucuugggcagcaug

SEQ ID NO: 1012814 - RNA, 22 nt, Human
cauggaaggcaaaagacacaga

SEQ ID NO: 1012815 - RNA, 22 nt, Human
ucagagucucccccaguuuggg

SEQ ID NO: 1012816 - RNA, 22 nt, Human
ggagcauguggggugagcaggg

SEQ ID NO: 1012817 - RNA, 22 nt, Human
ccugccugggcucacuugccag

SEQ ID NO: 1012818 - RNA, 22 nt, Human
agaaagaacguugguuaucuua

SEQ ID NO: 1012819 - RNA, 22 nt, Human
gcugagguaggagguugcagug

SEQ ID NO: 1012820 - RNA, 22 nt, Human
gcucugucuucagcacacagua

SEQ ID NO: 1012821 - RNA, 22 nt, Human
uccuugaacagagggccugggu

SEQ ID NO: 1012822 - RNA, 22 nt, Human
caguggaggccuugggaccuuu

SEQ ID NO: 1012823 - RNA, 22 nt, Human
aagugguaggaagagagcacug

SEQ ID NO: 1012824 - RNA, 22 nt, Human
gacccggcuccaggcccagcag

SEQ ID NO: 1012825 - RNA, 22 nt, Human
auggggcucugcggcugcuccc

SEQ ID NO: 1012826 - RNA, 22 nt, Human
uuguggcucgugagauguuagg

SEQ ID NO: 1012827 - RNA, 22 nt, Human
ugcucugugguccaagauggcu

SEQ ID NO: 1012828 - RNA, 22 nt, Human
ggguuggggcccagcagucugc

SEQ ID NO: 1012829 - RNA, 22 nt, Human
gagcuuccugaugccgaccagu

SEQ ID NO: 1012830 - RNA, 22 nt, Human
uguuccaauaaggaguugaaau

SEQ ID NO: 1012831 - RNA, 22 nt, Human
caauaguucgguccugaaggcc

SEQ ID NO: 1012832 - RNA, 22 nt, Human
aaguuucaugauguaauuauug

SEQ ID NO: 1012833 - RNA, 22 nt, Human
cggagcugccugccaagccugc

SEQ ID NO: 1012834 - RNA, 22 nt, Human
ccuccugguccagcaucucuuu

SEQ ID NO: 1012835 - RNA, 22 nt, Human
auucauucugaccucaagagaa

SEQ ID NO: 1012836 - RNA, 22 nt, Human
guguccaucagcagccacugug

SEQ ID NO: 1012837 - RNA, 22 nt, Human
uagggcucagagaaguggggcc

SEQ ID NO: 1012838 - RNA, 22 nt, Human
ggugggcaacauuuggccugag

SEQ ID NO: 1012839 - RNA, 20 nt, Human
acaauauguagaugaauagc

SEQ ID NO: 1012840 - RNA, 19 nt, Human
cugaggugcaguaagaggc

SEQ ID NO: 1012841 - RNA, 22 nt, Human
ucugggaaaugcuguuccuugu

SEQ ID NO: 1012842 - RNA, 22 nt, Human
gugggcuggacccuccugcucc

SEQ ID NO: 1012843 - RNA, 22 nt, Human
gacugccagaaugugaggccug

SEQ ID NO: 1012844 - RNA, 22 nt, Human
uuuccauguuggugaaaugagg

SEQ ID NO: 1012845 - RNA, 22 nt, Human
uuugaagucaggcuuucuaccc

SEQ ID NO: 1012846 - RNA, 22 nt, Human
cagcaagauuuuuaaagcaagg

SEQ ID NO: 1012847 - RNA, 22 nt, Human
cccagcagaaucugaugagggc

SEQ ID NO: 1012848 - RNA, 22 nt, Human
cccccaaggccaggcugagacc

SEQ ID NO: 1012849 - RNA, 22 nt, Human
ucuccucaccaccagcagcaga

SEQ ID NO: 1012850 - RNA, 22 nt, Human
agccuggccugggcaggcacau

SEQ ID NO: 1012851 - RNA, 22 nt, Human
gcugccugucccaggaugagga

SEQ ID NO: 1012852 - RNA, 22 nt, Human
gcuggccaggugcuuugguucu

SEQ ID NO: 1012853 - RNA, 22 nt, Human
ucacacagauugguagagcuga

SEQ ID NO: 1012854 - RNA, 22 nt, Human
agcuguguagggaaucagagaa

SEQ ID NO: 1012855 - RNA, 22 nt, Human
gcauuucuuccuggugugagcc

SEQ ID NO: 1012856 - RNA, 22 nt, Human
ggagaguggauuccagcuguau

SEQ ID NO: 1012857 - RNA, 22 nt, Human
acacagggcaaugcuuugaccu

SEQ ID NO: 1012858 - RNA, 22 nt, Human
acuguucaaguuuuaugcugga

SEQ ID NO: 1012859 - RNA, 22 nt, Human
uucugucauccuuucuagaugu

SEQ ID NO: 1012860 - RNA, 22 nt, Human
augaaaauguacauguguauaa

SEQ ID NO: 1012861 - RNA, 22 nt, Human
ccuggguggcagagguugcagu

SEQ ID NO: 1012862 - RNA, 21 nt, Human
augacagaugcugcagaucgu

SEQ ID NO: 1012863 - RNA, 22 nt, Human
agaccuggauuccaauccuacc

SEQ ID NO: 1012864 - RNA, 22 nt, Human
auguuucaaauauauagaguug

SEQ ID NO: 1012865 - RNA, 22 nt, Human
agaauucugacaauagaauugg

SEQ ID NO: 1012866 - RNA, 22 nt, Human
uuugcauuucucguaaggaaac

SEQ ID NO: 1012867 - RNA, 22 nt, Human
aguaaaauuguauuggaaaaca

SEQ ID NO: 1012868 - RNA, 22 nt, Human
agccugcuggaccaagcucaug

SEQ ID NO: 1012869 - RNA, 22 nt, Human
gcugucacacaugggaucucag

SEQ ID NO: 1012870 - RNA, 22 nt, Human
uucuuguauauaaaaaucauuu

SEQ ID NO: 1012871 - RNA, 22 nt, Human
gcacagaacuucucuuaguagg

SEQ ID NO: 1012872 - RNA, 22 nt, Human
cacccaggcuggagugcagggg

SEQ ID NO: 1012873 - RNA, 22 nt, Human
gaauauuuuuaaagggacuaau

SEQ ID NO: 1012874 - RNA, 22 nt, Human
uccaggcccauggagcagagcu

SEQ ID NO: 1012875 - RNA, 22 nt, Human
cuggagccuagguugaccuggg

SEQ ID NO: 1012876 - RNA, 22 nt, Human
ggcugggccagggccuguggac

SEQ ID NO: 1012877 - RNA, 22 nt, Human
uagagcugggcagugcucugag

SEQ ID NO: 1012878 - RNA, 22 nt, Human
ugucuuuggaauauuuagcuga

SEQ ID NO: 1012879 - RNA, 22 nt, Human
gcaggaugccagggcagcagcg

SEQ ID NO: 1012880 - RNA, 22 nt, Human
auguacaguuucuagacucaaa

SEQ ID NO: 1012881 - RNA, 19 nt, Human
augucuguugaauuucaua

SEQ ID NO: 1012882 - RNA, 22 nt, Human
aguguauugauuggaacagccu

SEQ ID NO: 1012883 - RNA, 22 nt, Human
agcacagguacggagaugcuac

SEQ ID NO: 1012884 - RNA, 22 nt, Human
agcccagguugaggcugcagug

SEQ ID NO: 1012885 - RNA, 22 nt, Human
gcccucugcacagcucugagca

SEQ ID NO: 1012886 - RNA, 22 nt, Human
acuuugaaacuaaaauucauua

SEQ ID NO: 1012887 - RNA, 22 nt, Human
cugagccagcuggcaugugcua

SEQ ID NO: 1012888 - RNA, 22 nt, Human
cauuuacuguugaaucccuagc

SEQ ID NO: 1012889 - RNA, 22 nt, Human
gcauucuuuuuaggagguuccu

SEQ ID NO: 1012890 - RNA, 22 nt, Human
aaauaauugaguuggucaauau

SEQ ID NO: 1012891 - RNA, 22 nt, Human
ucaggcagaccaccgugggcag

SEQ ID NO: 1012892 - RNA, 22 nt, Human
cagcuuuaccuuuaggaguaac

SEQ ID NO: 1012893 - RNA, 22 nt, Human
ccacccagcagaggaggcaaga

SEQ ID NO: 1012894 - RNA, 22 nt, Human
cauugacaguucuuuaaguugc

SEQ ID NO: 1012895 - RNA, 21 nt, Human
ucucugguuggaguugugcca

SEQ ID NO: 1012896 - RNA, 22 nt, Human
gccaagaguuuccagcugcaag

SEQ ID NO: 1012897 - RNA, 22 nt, Human
cagaacugggcagggagcagag

SEQ ID NO: 1012898 - RNA, 22 nt, Human
ccagguggugaaagugggcccu

SEQ ID NO: 1012899 - RNA, 22 nt, Human
cauugcacugcagcccgggcaa

SEQ ID NO: 1012900 - RNA, 22 nt, Human
aaaauucugucauuaaauugug

SEQ ID NO: 1012901 - RNA, 22 nt, Human
ggcacugaaccaggacacaagc

SEQ ID NO: 1012902 - RNA, 22 nt, Human
cuaaaugccuuuccuaccuaac

SEQ ID NO: 1012903 - RNA, 22 nt, Human
uuccuuaguguuagauucugug

SEQ ID NO: 1012904 - RNA, 22 nt, Human
augcuuuauuauuuugcaggga

SEQ ID NO: 1012905 - RNA, 22 nt, Human
cagagaaagaagcccauucauu

SEQ ID NO: 1012906 - RNA, 22 nt, Human
gcaaggagacuguagggccaag

SEQ ID NO: 1012907 - RNA, 22 nt, Human
uaaaugugcacuuuacuuuuca

SEQ ID NO: 1012908 - RNA, 22 nt, Human
auggcagggcagccucucagag

SEQ ID NO: 1012909 - RNA, 22 nt, Human
gccugagagacccauggggcaa

SEQ ID NO: 1012910 - RNA, 22 nt, Human
gcugugcuauaucucugagugu

SEQ ID NO: 1012911 - RNA, 22 nt, Human
ucucagggugaggaaagaauuu

SEQ ID NO: 1012912 - RNA, 22 nt, Human
ugguaauuaauuugauagguuc

SEQ ID NO: 1012913 - RNA, 22 nt, Human
gggccuccggggugagcugugg

SEQ ID NO: 1012914 - RNA, 22 nt, Human
gcuguucugcgucccaggcugg

SEQ ID NO: 1012915 - RNA, 22 nt, Human
gagggcugaugcuuacuuauuu

SEQ ID NO: 1012916 - RNA, 22 nt, Human
gcagccaccucccauggcgggg

SEQ ID NO: 1012917 - RNA, 22 nt, Human
cccugggacccgcugcagaggc

SEQ ID NO: 1012918 - RNA, 22 nt, Human
gcugccaugguccaggcuccag

SEQ ID NO: 1012919 - RNA, 22 nt, Human
ccaggguggaggcuggauggag

SEQ ID NO: 1012920 - RNA, 22 nt, Human
ucugggaacugagcuccccuag

SEQ ID NO: 1012921 - RNA, 22 nt, Human
aggcagcuggcagcacccaggg

SEQ ID NO: 1012922 - RNA, 22 nt, Human
caugcugugcaucuugaugacc

SEQ ID NO: 1012923 - RNA, 22 nt, Human
uaugcacacaucgcagcaggaa

SEQ ID NO: 1012924 - RNA, 19 nt, Human
uucaggauugacccuacug

SEQ ID NO: 1012925 - RNA, 22 nt, Human
uucugucagcugcuuugucuca

SEQ ID NO: 1012926 - RNA, 21 nt, Human
caguguggugaccagggucuc

SEQ ID NO: 1012927 - RNA, 22 nt, Human
ucuaaagaagaggguucugcgg

SEQ ID NO: 1012928 - RNA, 22 nt, Human
gaaauauugggacucagagcuu

SEQ ID NO: 1012929 - RNA, 22 nt, Human
gagaagccgagucagcugagcc

SEQ ID NO: 1012930 - RNA, 21 nt, Human
uugaaggaucacuucuguacc

SEQ ID NO: 1012931 - RNA, 22 nt, Human
aggcucagcccaagguggagag

SEQ ID NO: 1012932 - RNA, 22 nt, Human
gggcuucuagaccagcagugag

SEQ ID NO: 1012933 - RNA, 22 nt, Human
cccaggcagagagcuggugagc

SEQ ID NO: 1012934 - RNA, 22 nt, Human
uugggcuggcagagguggucuu

SEQ ID NO: 1012935 - RNA, 22 nt, Human
uaacacugauuuguucucaggg

SEQ ID NO: 1012936 - RNA, 22 nt, Human
uccaggaggugaggggaccaaa

SEQ ID NO: 1012937 - RNA, 22 nt, Human
aaaugucuuucaauagagaaau

SEQ ID NO: 1012938 - RNA, 22 nt, Human
ccagcucuuuuggcugagugag

SEQ ID NO: 1012939 - RNA, 22 nt, Human
ggcuccugggaugggacugagc

SEQ ID NO: 1012940 - RNA, 22 nt, Human
ucugggagcagaugaugguaua

SEQ ID NO: 1012941 - RNA, 22 nt, Human
caguucuuauuuggccaguguc

SEQ ID NO: 1012942 - RNA, 23 nt, Human
gccucugcagccuaguuaguguc

SEQ ID NO: 1012943 - RNA, 22 nt, Human
ucugucacccaggcuggagugc

SEQ ID NO: 1012944 - RNA, 22 nt, Human
uccaggagaggccugaccaggu

SEQ ID NO: 1012945 - RNA, 22 nt, Human
ugcuucaggaagaaacgccagg

SEQ ID NO: 1012946 - RNA, 22 nt, Human
ugacagcugagccccaggcaag

SEQ ID NO: 1012947 - RNA, 20 nt, Human
ugacucugcaaccgucucuc

SEQ ID NO: 1012948 - RNA, 22 nt, Human
cagcuuuguggccuugaccucg

SEQ ID NO: 1012949 - RNA, 22 nt, Human
agaucaaagccaugagagauuu

SEQ ID NO: 1012950 - RNA, 22 nt, Human
aucugucagccugggauuaggg

SEQ ID NO: 1012951 - RNA, 18 nt, Human
ucaagacaucaugaaaua

SEQ ID NO: 1012952 - RNA, 22 nt, Human
uaaggccagcaugaaugcagca

SEQ ID NO: 1012953 - RNA, 22 nt, Human
uacaaaguagaaauucaguaaa

SEQ ID NO: 1012954 - RNA, 22 nt, Human
uucacaauggcaaaccauuaaa

SEQ ID NO: 1012955 - RNA, 22 nt, Human
gugucaugggguuuguuauaca

SEQ ID NO: 1012956 - RNA, 22 nt, Human
ugccucugcugcuguggcauca

SEQ ID NO: 1012957 - RNA, 22 nt, Human
uugaagcaaggcgaaucuugug

SEQ ID NO: 1012958 - RNA, 22 nt, Human
uuucugaagauacagcuuugcu

SEQ ID NO: 1012959 - RNA, 22 nt, Human
gcuguguuggugaagcuguagc

SEQ ID NO: 1012960 - RNA, 22 nt, Human
uaauuucuucaucucugcagcu

SEQ ID NO: 1012961 - RNA, 21 nt, Human
cacaggugggucagugaggcc

SEQ ID NO: 1012962 - RNA, 22 nt, Human
agucccagugagaugaaccagg

SEQ ID NO: 1012963 - RNA, 22 nt, Human
cuguccuccggccaccuacagu

SEQ ID NO: 1012964 - RNA, 22 nt, Human
uucaaugauuuuuagggaucau

SEQ ID NO: 1012965 - RNA, 22 nt, Human
ucauacauaacuuguacaguga

SEQ ID NO: 1012966 - RNA, 22 nt, Human
agugcuuucccugaaaccuucc

SEQ ID NO: 1012967 - RNA, 22 nt, Human
agauacauugaguuuccuccug

SEQ ID NO: 1012968 - RNA, 22 nt, Human
ugcaacagacuuuauuaacucu

SEQ ID NO: 1012969 - RNA, 20 nt, Human
gagccuuccccucaccacug

SEQ ID NO: 1012970 - RNA, 22 nt, Human
gcugccugauuuacauagugaa

SEQ ID NO: 1012971 - RNA, 22 nt, Human
gccaggcaauguguuagaagcg

SEQ ID NO: 1012972 - RNA, 22 nt, Human
uuccugagggacuuuugagauu

SEQ ID NO: 1012973 - RNA, 22 nt, Human
ucauuuauaaggaugcaauuaa

SEQ ID NO: 1012974 - RNA, 22 nt, Human
gccuugggaaagugggaggaga

SEQ ID NO: 1012975 - RNA, 19 nt, Human
ccugcagggaugagagguu

SEQ ID NO: 1012976 - RNA, 23 nt, Human
uugauacagaagaaucaguuugu

SEQ ID NO: 1012977 - RNA, 19 nt, Human
ccaggaaccccuagcuacc

SEQ ID NO: 1012978 - RNA, 22 nt, Human
acugcuuuucagagucugccug

SEQ ID NO: 1012979 - RNA, 22 nt, Human
guuuuacacaccuaugaaagac

SEQ ID NO: 1012980 - RNA, 22 nt, Human
agcagccaggaaucugcagagc

SEQ ID NO: 1012981 - RNA, 22 nt, Human
ugggccuguugccugaguccau

SEQ ID NO: 1012982 - RNA, 22 nt, Human
cuggcucacuagcccugcccug

SEQ ID NO: 1012983 - RNA, 22 nt, Human
uaaucuguauuccuacuuugca

SEQ ID NO: 1012984 - RNA, 22 nt, Human
ucuacuuuucccuauacaguuu

SEQ ID NO: 1012985 - RNA, 22 nt, Human
ggaggugaggccguagggugug

SEQ ID NO: 1012986 - RNA, 20 nt, Human
ucucagcauaagaacccuuc

SEQ ID NO: 1012987 - RNA, 22 nt, Human
ugucugugaccucuuuggagcc

SEQ ID NO: 1012988 - RNA, 22 nt, Human
uggccugcagaggcuguggggc

SEQ ID NO: 1012989 - RNA, 18 nt, Human
gccuggcuucggagccgc

SEQ ID NO: 1012990 - RNA, 22 nt, Human
gcagcuggagcaucuucucauc

SEQ ID NO: 1012991 - RNA, 22 nt, Human
guggccugccagcagauggcgc

SEQ ID NO: 1012992 - RNA, 22 nt, Human
acacugaauauacaaugaauau

SEQ ID NO: 1012993 - RNA, 22 nt, Human
ucuguccauucagccauccauc

SEQ ID NO: 1012994 - RNA, 22 nt, Human
uccagagcagguggucagaagg

SEQ ID NO: 1012995 - RNA, 22 nt, Human
gagcacagcuggagguagcauu

SEQ ID NO: 1012996 - RNA, 15 nt, Human
ugauuuccuacuaac

SEQ ID NO: 1012997 - RNA, 23 nt, Human
aaugauuucaugaugauagcagc

SEQ ID NO: 1012998 - RNA, 22 nt, Human
cacaggccugucucuuucuaac

SEQ ID NO: 1012999 - RNA, 22 nt, Human
aaagucuuuauuuuguaucuuu

SEQ ID NO: 1013000 - RNA, 22 nt, Human
aggccuccugcagggaugagug

SEQ ID NO: 1013001 - RNA, 22 nt, Human
cuauugaauuaacuauuaaagu

SEQ ID NO: 1013002 - RNA, 22 nt, Human
uuugaaaguucuucugacacua

SEQ ID NO: 1013003 - RNA, 22 nt, Human
ggaaccaggaguuacacgaguu

SEQ ID NO: 1013004 - RNA, 23 nt, Human
aaacuacauuuauaguuuuucuc

SEQ ID NO: 1013005 - RNA, 22 nt, Human
ggcugcaggcagaggcugucug

SEQ ID NO: 1013006 - RNA, 22 nt, Human
aggguauaaagagcaagcagaa

SEQ ID NO: 1013007 - RNA, 22 nt, Human
gaugaaaaaagacgagcauaua

SEQ ID NO: 1013008 - RNA, 19 nt, Human
aggcugugagggaggacuc

SEQ ID NO: 1013009 - RNA, 22 nt, Human
ccacagggacuguuaaaacccu

SEQ ID NO: 1013010 - RNA, 21 nt, Human
aaggagccuaggaggcucagg

SEQ ID NO: 1013011 - RNA, 22 nt, Human
aaaaauaggucaaccguguaug

SEQ ID NO: 1013012 - RNA, 22 nt, Human
ggcccugggcagaggagugggc

SEQ ID NO: 1013013 - RNA, 22 nt, Human
auuuucaucauggguuuaacau

SEQ ID NO: 1013014 - RNA, 22 nt, Human
cauugaaaccuaacauaggcug

SEQ ID NO: 1013015 - RNA, 22 nt, Human
caggaaagguagucacaaugua

SEQ ID NO: 1013016 - RNA, 22 nt, Human
aaguuugcauagauuaagcauu

SEQ ID NO: 1013017 - RNA, 22 nt, Human
gaggucaggcuugcagcagggu

SEQ ID NO: 1013018 - RNA, 22 nt, Human
caguuucugggcguucacaggu

SEQ ID NO: 1013019 - RNA, 22 nt, Human
ugcaggagcugugcggugaggg

SEQ ID NO: 1013020 - RNA, 22 nt, Human
cuucagaaugggacuguguuug

SEQ ID NO: 1013021 - RNA, 22 nt, Human
cugccuggguucaaguccuguu

SEQ ID NO: 1013022 - RNA, 19 nt, Human
agaaaucucgagauuuguu

SEQ ID NO: 1013023 - RNA, 22 nt, Human
ccagagaguaggaggcauuauu

SEQ ID NO: 1013024 - RNA, 22 nt, Human
aauaucaguauauuguaucagu

SEQ ID NO: 1013025 - RNA, 22 nt, Human
aggccugaggaccuucuggagg

SEQ ID NO: 1013026 - RNA, 22 nt, Human
gaggaugugucuggucugggca

SEQ ID NO: 1013027 - RNA, 22 nt, Human
uagacacauccguggaagcuuc

SEQ ID NO: 1013028 - RNA, 22 nt, Human
uauaguacauggaaucuucaua

SEQ ID NO: 1013029 - RNA, 22 nt, Human
uguguauucagcaagcgaaaca

SEQ ID NO: 1013030 - RNA, 22 nt, Human
aauugucaaacacaaauaagag

SEQ ID NO: 1013031 - RNA, 22 nt, Human
acguguucaauuuccaucugac

SEQ ID NO: 1013032 - RNA, 22 nt, Human
aggccuuuguggagcucauggc

SEQ ID NO: 1013033 - RNA, 22 nt, Human
gugggagcauggucccagugcc

SEQ ID NO: 1013034 - RNA, 22 nt, Human
ugcacacaguucucaggaaaga

SEQ ID NO: 1013035 - RNA, 22 nt, Human
aauguaugaagguuccaguuuc

SEQ ID NO: 1013036 - RNA, 21 nt, Human
uucuucaguuuaauauaaaau

SEQ ID NO: 1013037 - RNA, 22 nt, Human
cuacuuuaauuuucugcagaga

SEQ ID NO: 1013038 - RNA, 22 nt, Human
gccuggcaaggcccuguugacu

SEQ ID NO: 1013039 - RNA, 22 nt, Human
uggcugccuagucccucagccu

SEQ ID NO: 1013040 - RNA, 22 nt, Human
acccagcuggaugcauggaggc

SEQ ID NO: 1013041 - RNA, 18 nt, Human
gagacacaagggccugga

SEQ ID NO: 1013042 - RNA, 22 nt, Human
acugcuuacccggccugacuuc

SEQ ID NO: 1013043 - RNA, 22 nt, Human
gcacugaaauuauaugcauuug

SEQ ID NO: 1013044 - RNA, 22 nt, Human
gcauggcagccaguacauggug

SEQ ID NO: 1013045 - RNA, 22 nt, Human
caggcacuagcagaaugaggcu

SEQ ID NO: 1013046 - RNA, 22 nt, Human
agggccagcccauaaugccaaa

SEQ ID NO: 1013047 - RNA, 22 nt, Human
ugcugggcuagaagcugaggcc

SEQ ID NO: 1013048 - RNA, 22 nt, Human
ggcagggguccugguguugacu

SEQ ID NO: 1013049 - RNA, 22 nt, Human
cacaugaugguggaagccauag

SEQ ID NO: 1013050 - RNA, 22 nt, Human
cuggagagaccgaaagaggcug

SEQ ID NO: 1013051 - RNA, 22 nt, Human
ggagcugcacgcucugaagccu

SEQ ID NO: 1013052 - RNA, 22 nt, Human
agaggcugcacuugcucaugau

SEQ ID NO: 1013053 - RNA, 22 nt, Human
ucugucacuuauuaagauggau

SEQ ID NO: 1013054 - RNA, 22 nt, Human
uauugacagagggucagaagag

SEQ ID NO: 1013055 - RNA, 22 nt, Human
ccaaagucagugcucagucguc

SEQ ID NO: 1013056 - RNA, 22 nt, Human
ccacuugugaaauaaucaaaua

SEQ ID NO: 1013057 - RNA, 22 nt, Human
auuaucuauguagaaugauuuu

SEQ ID NO: 1013058 - RNA, 22 nt, Human
uccugucuaaagaccugcaggc

SEQ ID NO: 1013059 - RNA, 22 nt, Human
agcagggcucuguggagggugg

SEQ ID NO: 1013060 - RNA, 22 nt, Human
uagugcuuaauaaauuucagaa

SEQ ID NO: 1013061 - RNA, 22 nt, Human
cuggcccagagagcagagcuua

SEQ ID NO: 1013062 - RNA, 22 nt, Human
uucucuuagcuguaaagucaau

SEQ ID NO: 1013063 - RNA, 22 nt, Human
uuugaaguguuauuucuaucac

SEQ ID NO: 1013064 - RNA, 22 nt, Human
aggcagcaauugaaaucauugu

SEQ ID NO: 1013065 - RNA, 22 nt, Human
gaggcccaguccugcaagcacg

SEQ ID NO: 1013066 - RNA, 22 nt, Human
aguuuuuccugauuuuacagaa

SEQ ID NO: 1013067 - RNA, 22 nt, Human
gaccaggagauuugagcuaggc

SEQ ID NO: 1013068 - RNA, 22 nt, Human
cagaguguugaccauaagccca

SEQ ID NO: 1013069 - RNA, 22 nt, Human
agauuucacaugcugcucuauu

SEQ ID NO: 1013070 - RNA, 22 nt, Human
ugcauauuguccuugauauuau

SEQ ID NO: 1013071 - RNA, 22 nt, Human
auauucuugugauuauaaagua

SEQ ID NO: 1013072 - RNA, 22 nt, Human
uuuuccucuguauuugaaaugc

SEQ ID NO: 1013073 - RNA, 22 nt, Human
gccaggcuccaggcccuccuga

SEQ ID NO: 1013074 - RNA, 22 nt, Human
auuccaguucuccucucuaaag

SEQ ID NO: 1013075 - RNA, 22 nt, Human
ugaggcuguucuaccagggcca

SEQ ID NO: 1013076 - RNA, 22 nt, Human
aggcccuggcacugccugggag

SEQ ID NO: 1013077 - RNA, 22 nt, Human
cugcucuguucccccaucaucu

SEQ ID NO: 1013078 - RNA, 22 nt, Human
cuuccaaacccaggguaugggc

SEQ ID NO: 1013079 - RNA, 22 nt, Human
aucagcaaucucguguauuagg

SEQ ID NO: 1013080 - RNA, 22 nt, Human
uucccaugccuggccccuaucc

SEQ ID NO: 1013081 - RNA, 22 nt, Human
auauguguacgugcaguauaua

SEQ ID NO: 1013082 - RNA, 22 nt, Human
ugacacagauuagagacauacc

SEQ ID NO: 1013083 - RNA, 22 nt, Human
uaaggccaauuaacaaccaggg

SEQ ID NO: 1013084 - RNA, 22 nt, Human
ccugucucccuggcauggcuca

SEQ ID NO: 1013085 - RNA, 22 nt, Human
aucuacauaaaacgaauacaua

SEQ ID NO: 1013086 - RNA, 22 nt, Human
cuugaaagucagcagaguggau

SEQ ID NO: 1013087 - RNA, 22 nt, Human
ggaugcaggacggcauggaugu

SEQ ID NO: 1013088 - RNA, 22 nt, Human
ccagccagcugcccuuggggcc

SEQ ID NO: 1013089 - RNA, 22 nt, Human
ugcagggaaaguguuggcagca

SEQ ID NO: 1013090 - RNA, 22 nt, Human
ggugcucaagagggcauccucu

SEQ ID NO: 1013091 - RNA, 22 nt, Human
aucaguuugauaauaaggcuug

SEQ ID NO: 1013092 - RNA, 22 nt, Human
ggccugagcagacagcaugaug

SEQ ID NO: 1013093 - RNA, 22 nt, Human
ucucugauguauaucagagaac

SEQ ID NO: 1013094 - RNA, 22 nt, Human
uguucuugggaaucuuacaguu

SEQ ID NO: 1013095 - RNA, 22 nt, Human
ggccuggaagaggacagagaaa

SEQ ID NO: 1013096 - RNA, 17 nt, Human
aaugaaugaauucuuug

SEQ ID NO: 1013097 - RNA, 20 nt, Human
ccaagagcaugcaugaggaa

SEQ ID NO: 1013098 - RNA, 22 nt, Human
guggccagaagacugcaaugcu

SEQ ID NO: 1013099 - RNA, 22 nt, Human
uguggagcacuguuccuggcau

SEQ ID NO: 1013100 - RNA, 22 nt, Human
caggcugaucagggcugggaug

SEQ ID NO: 1013101 - RNA, 22 nt, Human
uuucuuagcgaugcuugauaaa

SEQ ID NO: 1013102 - RNA, 22 nt, Human
uucuuucccuuccagcagcucc

SEQ ID NO: 1013103 - RNA, 22 nt, Human
gggcuccagcccgggaccaggu

SEQ ID NO: 1013104 - RNA, 22 nt, Human
guuuccaaccccaccaaagugc

SEQ ID NO: 1013105 - RNA, 22 nt, Human
uaguuaggaauagcagcgacuc

SEQ ID NO: 1013106 - RNA, 21 nt, Human
ucugucugguuuuagaguggc

SEQ ID NO: 1013107 - RNA, 22 nt, Human
uuugcauuuuagauuuaggccu

SEQ ID NO: 1013108 - RNA, 22 nt, Human
cagagcauuuggaagccacgug

SEQ ID NO: 1013109 - RNA, 22 nt, Human
ucaugcccagagcaguaaauua

SEQ ID NO: 1013110 - RNA, 21 nt, Human
uaagaacauuaucuucuuccu

SEQ ID NO: 1013111 - RNA, 22 nt, Human
agggcucuguccccagaggccc

SEQ ID NO: 1013112 - RNA, 22 nt, Human
agcucccagaaggcccugcgcc

SEQ ID NO: 1013113 - RNA, 21 nt, Human
ucugggcccaugcugccucac

SEQ ID NO: 1013114 - RNA, 22 nt, Human
auugaaagauauacuguucuca

SEQ ID NO: 1013115 - RNA, 22 nt, Human
cccugagaugccucacccuagu

SEQ ID NO: 1013116 - RNA, 22 nt, Human
agggcagaaaucgauuacaccu

SEQ ID NO: 1013117 - RNA, 22 nt, Human
caguuucucucaauaagcaucg

SEQ ID NO: 1013118 - RNA, 22 nt, Human
gcuggccuucugcagaguucug

SEQ ID NO: 1013119 - RNA, 22 nt, Human
agcaggguuuggggauuggcac

SEQ ID NO: 1013120 - RNA, 22 nt, Human
cccuggaguagcacugggucgc

SEQ ID NO: 1013121 - RNA, 22 nt, Human
uccaggcagggcagccaucaag

SEQ ID NO: 1013122 - RNA, 22 nt, Human
cugugucccaguaccuugggua

SEQ ID NO: 1013123 - RNA, 22 nt, Human
cacuacuugaaagaauuacaga

SEQ ID NO: 1013124 - RNA, 22 nt, Human
aaauuguugaucuacaguaagg

SEQ ID NO: 1013125 - RNA, 23 nt, Human
augcucugggcugugggaccugc

SEQ ID NO: 1013126 - RNA, 22 nt, Human
uuggaaagauuauuauuaugaa

SEQ ID NO: 1013127 - RNA, 22 nt, Human
guguacauauugagucugcuga

SEQ ID NO: 1013128 - RNA, 22 nt, Human
agucuacaaagaaaaguuauug

SEQ ID NO: 1013129 - RNA, 22 nt, Human
cugcacagagcagggcagacac

SEQ ID NO: 1013130 - RNA, 22 nt, Human
ccucccagugccuccagagcag

SEQ ID NO: 1013131 - RNA, 22 nt, Human
uugcaacaucugaacauuuauc

SEQ ID NO: 1013132 - RNA, 22 nt, Human
aggccuuccucggagacaggga

SEQ ID NO: 1013133 - RNA, 22 nt, Human
uggcccugcuuaugucucucuu

SEQ ID NO: 1013134 - RNA, 22 nt, Human
uguccucagauaugucuacucu

SEQ ID NO: 1013135 - RNA, 22 nt, Human
ccagggcaucacauccaguguu

SEQ ID NO: 1013136 - RNA, 22 nt, Human
auguguaggugaaucgaggcug

SEQ ID NO: 1013137 - RNA, 22 nt, Human
uauuaucauugguaauaugguc

SEQ ID NO: 1013138 - RNA, 22 nt, Human
gugugcaguagagaaagagcag

SEQ ID NO: 1013139 - RNA, 20 nt, Human
guugaaaguaauaugaugcu

SEQ ID NO: 1013140 - RNA, 22 nt, Human
agcacauucugccuugcuuugc

SEQ ID NO: 1013141 - RNA, 22 nt, Human
gggacagacccaugggccaggu

SEQ ID NO: 1013142 - RNA, 22 nt, Human
ccugaggcccuggcugugcuga

SEQ ID NO: 1013143 - RNA, 22 nt, Human
gguggggccugcuccagcggcc

SEQ ID NO: 1013144 - RNA, 22 nt, Human
ggacuggacucucaggcucaca

SEQ ID NO: 1013145 - RNA, 22 nt, Human
uggcagagcuggcugcggauga

SEQ ID NO: 1013146 - RNA, 22 nt, Human
ugccugcugcuaagcucuuugu

SEQ ID NO: 1013147 - RNA, 22 nt, Human
ccaguugguuucaaugggacag

SEQ ID NO: 1013148 - RNA, 17 nt, Human
cagcucugcaucuuccu

SEQ ID NO: 1013149 - RNA, 22 nt, Human
ucaauaaaauuguuuuccuauc

SEQ ID NO: 1013150 - RNA, 20 nt, Human
agacccucuggacugggccc

SEQ ID NO: 1013151 - RNA, 22 nt, Human
cugucucucuaggacacugggg

SEQ ID NO: 1013152 - RNA, 22 nt, Human
cagugagggcauucagugcugg

SEQ ID NO: 1013153 - RNA, 17 nt, Human
ucaggauccaggguucu

SEQ ID NO: 1013154 - RNA, 18 nt, Human
ugggcacaaugaacagca

SEQ ID NO: 1013155 - RNA, 22 nt, Human
guaucuuuuacaccaggaaauu

SEQ ID NO: 1013156 - RNA, 22 nt, Human
uugcauuguaggauguuagaag

SEQ ID NO: 1013157 - RNA, 22 nt, Human
uucuugcaggucacucacugag

SEQ ID NO: 1013158 - RNA, 20 nt, Human
uugauucaagggcugaugga

SEQ ID NO: 1013159 - RNA, 22 nt, Human
gcaggcugauagaggauuccau

SEQ ID NO: 1013160 - RNA, 22 nt, Human
ggccuuggggaggauggugucc

SEQ ID NO: 1013161 - RNA, 22 nt, Human
agcucccugagaugccacagca

SEQ ID NO: 1013162 - RNA, 22 nt, Human
uugaacaguuuugucagguuca

SEQ ID NO: 1013163 - RNA, 22 nt, Human
guccuggguccccgcaggucag

SEQ ID NO: 1013164 - RNA, 22 nt, Human
gcugccuguccugaggaguccg

SEQ ID NO: 1013165 - RNA, 22 nt, Human
acugccaaugguaguuugaugg

SEQ ID NO: 1013166 - RNA, 22 nt, Human
ucugagccguauggcuuggcua

SEQ ID NO: 1013167 - RNA, 22 nt, Human
aauaacuucauguaacauuuaa

SEQ ID NO: 1013168 - RNA, 22 nt, Human
agagguagagguugcagugagc

SEQ ID NO: 1013169 - RNA, 22 nt, Human
acaugauuuuuaaagagauaau

SEQ ID NO: 1013170 - RNA, 22 nt, Human
uccaugaggcagggaggcuggc

SEQ ID NO: 1013171 - RNA, 22 nt, Human
accucugccacuuucuaacucu

SEQ ID NO: 1013172 - RNA, 22 nt, Human
uccuuggggacgcugacaucgu

SEQ ID NO: 1013173 - RNA, 22 nt, Human
aggagcagaacuguuguggagg

SEQ ID NO: 1013174 - RNA, 22 nt, Human
auaaacaguagagaaagguggu

SEQ ID NO: 1013175 - RNA, 22 nt, Human
ggguccagcuacaucagggugg

SEQ ID NO: 1013176 - RNA, 22 nt, Human
cagcaaaauuugaggauugccu

SEQ ID NO: 1013177 - RNA, 20 nt, Human
uguacacaguacuuuacaau

SEQ ID NO: 1013178 - RNA, 22 nt, Human
augcugugagugugccgcagag

SEQ ID NO: 1013179 - RNA, 22 nt, Human
augauuuccaguuguugcuaag

SEQ ID NO: 1013180 - RNA, 22 nt, Human
uuuagacauggcuugcucacuu

SEQ ID NO: 1013181 - RNA, 22 nt, Human
aggucaccauggcaugcuccac

SEQ ID NO: 1013182 - RNA, 22 nt, Human
cugcagagguugguucuaagau

SEQ ID NO: 1013183 - RNA, 22 nt, Human
aauuuagauugauaaacaugga

SEQ ID NO: 1013184 - RNA, 22 nt, Human
gcaccugggcaaggauucagag

SEQ ID NO: 1013185 - RNA, 22 nt, Human
ugcugccuuagcagccaggcaa

SEQ ID NO: 1013186 - RNA, 22 nt, Human
agaggccuuucuguugagugaa

SEQ ID NO: 1013187 - RNA, 22 nt, Human
aaaugucugagacuucugaacu

SEQ ID NO: 1013188 - RNA, 22 nt, Human
ucuucacaugaccuucaugucu

SEQ ID NO: 1013189 - RNA, 22 nt, Human
agcagcucaaagccugcaagga

SEQ ID NO: 1013190 - RNA, 22 nt, Human
ccagagaggggaagggcuugcc

SEQ ID NO: 1013191 - RNA, 22 nt, Human
cacacauugaauucauucuugu

SEQ ID NO: 1013192 - RNA, 22 nt, Human
auuugucuuuggaccugugaga

SEQ ID NO: 1013193 - RNA, 22 nt, Human
gcuggcagggacagcugcgugu

SEQ ID NO: 1013194 - RNA, 19 nt, Human
ucuuuggcuaaauugggug

SEQ ID NO: 1013195 - RNA, 22 nt, Human
augaguucaauuguuucaguca

SEQ ID NO: 1013196 - RNA, 22 nt, Human
ggccugcugggccccacagucc

SEQ ID NO: 1013197 - RNA, 22 nt, Human
cuccagugagugagcaggcgac

SEQ ID NO: 1013198 - RNA, 22 nt, Human
auuugucugcuugcugccuucc

SEQ ID NO: 1013199 - RNA, 22 nt, Human
agcuugaguuuuggaugaagug

SEQ ID NO: 1013200 - RNA, 22 nt, Human
uaggccagaggagcagcuuugg

SEQ ID NO: 1013201 - RNA, 22 nt, Human
cacaauuuccuugcuucacuuu

SEQ ID NO: 1013202 - RNA, 22 nt, Human
ggucucagcccucgccagcagc

SEQ ID NO: 1013203 - RNA, 22 nt, Human
acugaaauacugcucuuggauu

SEQ ID NO: 1013204 - RNA, 20 nt, Human
aaucagaaagugugagcucu

SEQ ID NO: 1013205 - RNA, 22 nt, Human
auuuucaaaacaucugcugugu

SEQ ID NO: 1013206 - RNA, 22 nt, Human
gcagacaggcccaguggaggga

SEQ ID NO: 1013207 - RNA, 22 nt, Human
agguauauauucugguccuuau

SEQ ID NO: 1013208 - RNA, 22 nt, Human
agugucauuccagggacccucg

SEQ ID NO: 1013209 - RNA, 22 nt, Human
uccaugaguuugaggaaaagag

SEQ ID NO: 1013210 - RNA, 22 nt, Human
agugcuuuagagaaauggugcu

SEQ ID NO: 1013211 - RNA, 22 nt, Human
cccuggcagaaugucucugggc

SEQ ID NO: 1013212 - RNA, 22 nt, Human
gagugcaggccugagcaccauc

SEQ ID NO: 1013213 - RNA, 22 nt, Human
ugcaggugccucuugagcuugu

SEQ ID NO: 1013214 - RNA, 22 nt, Human
gaauucuuuucuuucugaaagu

SEQ ID NO: 1013215 - RNA, 22 nt, Human
ucucacuuuccagacuuuucaa

SEQ ID NO: 1013216 - RNA, 21 nt, Human
aggcacuguuugugguuuggg

SEQ ID NO: 1013217 - RNA, 22 nt, Human
auguguaaaaagugcuuaauau

SEQ ID NO: 1013218 - RNA, 22 nt, Human
acugaaggaaacuuuuguguuu

SEQ ID NO: 1013219 - RNA, 22 nt, Human
gccaggcauguccucugcagaa

SEQ ID NO: 1013220 - RNA, 22 nt, Human
uauacaauggcugaaucaucca

SEQ ID NO: 1013221 - RNA, 18 nt, Human
gaggauggaaggagaugc

SEQ ID NO: 1013222 - RNA, 22 nt, Human
cucugagcugaaacaugagcau

SEQ ID NO: 1013223 - RNA, 22 nt, Human
ugccuugguucucuacuuggag

SEQ ID NO: 1013224 - RNA, 22 nt, Human
aucucccagccacagcauucuu

SEQ ID NO: 1013225 - RNA, 22 nt, Human
ggcucugccugcccagcagcac

SEQ ID NO: 1013226 - RNA, 22 nt, Human
aaugcugcaagaggugaaaaga

SEQ ID NO: 1013227 - RNA, 22 nt, Human
ugcugucugcaacaguacuaca

SEQ ID NO: 1013228 - RNA, 22 nt, Human
aaaaugaugcuguaauuuggca

SEQ ID NO: 1013229 - RNA, 22 nt, Human
gcagaggccugaagguggcggg

SEQ ID NO: 1013230 - RNA, 22 nt, Human
ugggagcaagcuggugcuggag

SEQ ID NO: 1013231 - RNA, 22 nt, Human
gccuucagcggccgcucgcugc

SEQ ID NO: 1013232 - RNA, 22 nt, Human
uuucacaaucaaauggugaaau

SEQ ID NO: 1013233 - RNA, 22 nt, Human
aaagacugguguguuacauaua

SEQ ID NO: 1013234 - RNA, 22 nt, Human
aauuagggaggacaaagguaca

SEQ ID NO: 1013235 - RNA, 22 nt, Human
uuucaaaauuuugcagugguaa

SEQ ID NO: 1013236 - RNA, 22 nt, Human
uccaggcaaagggacuagcagg

SEQ ID NO: 1013237 - RNA, 22 nt, Human
auguuaaaugguuuauuauuaa

SEQ ID NO: 1013238 - RNA, 20 nt, Human
agggccugcucugugguguc

SEQ ID NO: 1013239 - RNA, 22 nt, Human
cugccucugcgucccacagagu

SEQ ID NO: 1013240 - RNA, 22 nt, Human
agcccaggaaucugcaucuuga

SEQ ID NO: 1013241 - RNA, 23 nt, Human
aggcuuccuaucuuagagcuggg

SEQ ID NO: 1013242 - RNA, 22 nt, Human
agaauaguggcaaugacugcac

SEQ ID NO: 1013243 - RNA, 22 nt, Human
gugugcagugagcaaaagaucu

SEQ ID NO: 1013244 - RNA, 22 nt, Human
aagcuuccugaaugcucauuua

SEQ ID NO: 1013245 - RNA, 22 nt, Human
uggcucaggaucuaagcagaau

SEQ ID NO: 1013246 - RNA, 22 nt, Human
cuaaaugacuuccagugguuau

SEQ ID NO: 1013247 - RNA, 22 nt, Human
acaggcacugucaagucaugaa

SEQ ID NO: 1013248 - RNA, 22 nt, Human
cugucuguuuuaccuucuccag

SEQ ID NO: 1013249 - RNA, 22 nt, Human
aaaauuuugcccuauccuucau

SEQ ID NO: 1013250 - RNA, 22 nt, Human
uggcagcuccuggggccagcac

SEQ ID NO: 1013251 - RNA, 22 nt, Human
ucuuaaaccacaaaauucagag

SEQ ID NO: 1013252 - RNA, 22 nt, Human
aguccaaggagagacagcauuu

SEQ ID NO: 1013253 - RNA, 21 nt, Human
cugccuugaaugguacuggga

SEQ ID NO: 1013254 - RNA, 22 nt, Human
uccuucaggguugaggccgacu

SEQ ID NO: 1013255 - RNA, 22 nt, Human
uagcugccuaugugauaagaga

SEQ ID NO: 1013256 - RNA, 22 nt, Human
ucugagggugggagaaggagcu

SEQ ID NO: 1013257 - RNA, 22 nt, Human
ucacuuauugcucaucucaugc

SEQ ID NO: 1013258 - RNA, 22 nt, Human
ggcugcagguugguuggcagcu

SEQ ID NO: 1013259 - RNA, 22 nt, Human
gauuucuugauaauucaaaucc

SEQ ID NO: 1013260 - RNA, 19 nt, Human
ccauggcaaugaucugaug

SEQ ID NO: 1013261 - RNA, 22 nt, Human
gcugucucggggcuuucuccug

SEQ ID NO: 1013262 - RNA, 22 nt, Human
gauguagagggaagauuuuaaa

SEQ ID NO: 1013263 - RNA, 23 nt, Human
acauacauggagauaaagugaug

SEQ ID NO: 1013264 - RNA, 22 nt, Human
auaugccauuagcuagaaauaa

SEQ ID NO: 1013265 - RNA, 22 nt, Human
ggccugcuuuccgagccugcag

SEQ ID NO: 1013266 - RNA, 22 nt, Human
uagcugcccaucuuuccuuuag

SEQ ID NO: 1013267 - RNA, 21 nt, Human
agcuggugucagagcucuggg

SEQ ID NO: 1013268 - RNA, 22 nt, Human
aguccagucucacucuuggcag

SEQ ID NO: 1013269 - RNA, 22 nt, Human
uggcugggccgggccuugugcc

SEQ ID NO: 1013270 - RNA, 22 nt, Human
ucaccaggcuggaaugcagugg

SEQ ID NO: 1013271 - RNA, 18 nt, Human
caugggugacagguggau

SEQ ID NO: 1013272 - RNA, 22 nt, Human
gugucccacucuggaggugaag

SEQ ID NO: 1013273 - RNA, 22 nt, Human
aggagagagaacacuugggucc

SEQ ID NO: 1013274 - RNA, 22 nt, Human
cagugagguggauggauggccu

SEQ ID NO: 1013275 - RNA, 22 nt, Human
uuccaguucccaugaggauuaa

SEQ ID NO: 1013276 - RNA, 23 nt, Human
uuaggcacuuaguagggccagag

SEQ ID NO: 1013277 - RNA, 22 nt, Human
uuucuuccuuaccuuacuagag

SEQ ID NO: 1013278 - RNA, 22 nt, Human
ucucacagugcaggucugucuc

SEQ ID NO: 1013279 - RNA, 22 nt, Human
uuguuuuuaugaacauccagga

SEQ ID NO: 1013280 - RNA, 22 nt, Human
ucaggauggcuucugcaucaaa

SEQ ID NO: 1013281 - RNA, 22 nt, Human
aggagccuccuucucaugugca

SEQ ID NO: 1013282 - RNA, 22 nt, Human
auucuuggagcagucaaagaag

SEQ ID NO: 1013283 - RNA, 22 nt, Human
uuuguuuagaaagagauuggug

SEQ ID NO: 1013284 - RNA, 22 nt, Human
uaauuuuacuuccugagcaccu

SEQ ID NO: 1013285 - RNA, 22 nt, Human
gaaaaugugucaucccuacugu

SEQ ID NO: 1013286 - RNA, 22 nt, Human
ccagguggaaggucugugcucu

SEQ ID NO: 1013287 - RNA, 22 nt, Human
gagcuggugaucagcuggagga

SEQ ID NO: 1013288 - RNA, 18 nt, Human
ccagcaugccagaggcug

SEQ ID NO: 1013289 - RNA, 22 nt, Human
gcucaggaaauaguuuaguguu

SEQ ID NO: 1013290 - RNA, 22 nt, Human
uuggccuuguuaaggaggcccu

SEQ ID NO: 1013291 - RNA, 22 nt, Human
ccuccagcgcgauccacuccgg

SEQ ID NO: 1013292 - RNA, 22 nt, Human
augcugcacaagccacauguag

SEQ ID NO: 1013293 - RNA, 22 nt, Human
gaaucucaaggcuugugaggau

SEQ ID NO: 1013294 - RNA, 22 nt, Human
gggcugacucugcacugagcca

SEQ ID NO: 1013295 - RNA, 22 nt, Human
cagaauuuagcacaauguaugg

SEQ ID NO: 1013296 - RNA, 22 nt, Human
caaggagaguaauugaaugaga

SEQ ID NO: 1013297 - RNA, 22 nt, Human
augccaggccccacgcugggca

SEQ ID NO: 1013298 - RNA, 22 nt, Human
uuuaucuuuggaucuucagaaa

SEQ ID NO: 1013299 - RNA, 22 nt, Human
gcucaggaucagccaccucuuu

SEQ ID NO: 1013300 - RNA, 22 nt, Human
gcacugaacuuuaaucauuucu

SEQ ID NO: 1013301 - RNA, 22 nt, Human
acauuuaaauaugccuuauauu

SEQ ID NO: 1013302 - RNA, 22 nt, Human
agccuggccaggccugcccagg

SEQ ID NO: 1013303 - RNA, 22 nt, Human
gaccauuuuuacagagcauuca

SEQ ID NO: 1013304 - RNA, 22 nt, Human
ucuucagauggccaguuguccc

SEQ ID NO: 1013305 - RNA, 22 nt, Human
caaaaguucucacccagacaug

SEQ ID NO: 1013306 - RNA, 20 nt, Human
aagagcauaguacaggaaga

SEQ ID NO: 1013307 - RNA, 22 nt, Human
uuucuaggucuuccauacugcc

SEQ ID NO: 1013308 - RNA, 22 nt, Human
ucaauucugguccucaggaacu

SEQ ID NO: 1013309 - RNA, 22 nt, Human
agagccaggcggcugggcaccu

SEQ ID NO: 1013310 - RNA, 22 nt, Human
gucccugcaucaccacgggacu

SEQ ID NO: 1013311 - RNA, 22 nt, Human
ucaaauaccagcaauuucaugu

SEQ ID NO: 1013312 - RNA, 22 nt, Human
gggccuggcaugcagccccguu

SEQ ID NO: 1013313 - RNA, 22 nt, Human
gcugccuguggcccuucugggu

SEQ ID NO: 1013314 - RNA, 22 nt, Human
uauuucuguaugcauaaaagga

SEQ ID NO: 1013315 - RNA, 22 nt, Human
ucucuggguuuuuguccuguac

SEQ ID NO: 1013316 - RNA, 22 nt, Human
ucucacuggguauaaaugagua

SEQ ID NO: 1013317 - RNA, 22 nt, Human
auuuagacuucccagcacugug

SEQ ID NO: 1013318 - RNA, 22 nt, Human
uugaagcauuucuuugagcuuc

SEQ ID NO: 1013319 - RNA, 22 nt, Human
ggagucccagcaaagccuuccc

SEQ ID NO: 1013320 - RNA, 22 nt, Human
acagagcaauaacagggagagg

SEQ ID NO: 1013321 - RNA, 22 nt, Human
uuucacauaugguuguugauug

SEQ ID NO: 1013322 - RNA, 22 nt, Human
acagcuguauccccagagcuca

SEQ ID NO: 1013323 - RNA, 18 nt, Human
gguggcaggucagaugcc

SEQ ID NO: 1013324 - RNA, 21 nt, Human
ggagggcagcccagacuggcu

SEQ ID NO: 1013325 - RNA, 22 nt, Human
gggucuggcaugcugagaugga

SEQ ID NO: 1013326 - RNA, 22 nt, Human
uuaggaaauuaugguuucagau

SEQ ID NO: 1013327 - RNA, 22 nt, Human
aaauccuaaggagaauaugauu

SEQ ID NO: 1013328 - RNA, 22 nt, Human
ucuugggaucaccuccuggcuu

SEQ ID NO: 1013329 - RNA, 22 nt, Human
ucaaagucuaucuguaauuacu

SEQ ID NO: 1013330 - RNA, 22 nt, Human
auauuucaugggguuccauacu

SEQ ID NO: 1013331 - RNA, 22 nt, Human
agggcugccugcucugcauuga

SEQ ID NO: 1013332 - RNA, 22 nt, Human
uuugaaagggacaaagucacug

SEQ ID NO: 1013333 - RNA, 23 nt, Human
ucagagaaguuguaggcugggga

SEQ ID NO: 1013334 - RNA, 21 nt, Human
uggcugagccaggugugugga

SEQ ID NO: 1013335 - RNA, 22 nt, Human
ugcauauugugaaaauguagau

SEQ ID NO: 1013336 - RNA, 22 nt, Human
cacaggagguuaggaagugguc

SEQ ID NO: 1013337 - RNA, 22 nt, Human
gucucagaguccuacuuauucc

SEQ ID NO: 1013338 - RNA, 22 nt, Human
cugggaggcagucucucuagaa

SEQ ID NO: 1013339 - RNA, 22 nt, Human
caagaugaucccugaaggcagc

SEQ ID NO: 1013340 - RNA, 22 nt, Human
acagcagcgucaacuuaaaauu

SEQ ID NO: 1013341 - RNA, 22 nt, Human
acagugugaugggccugccuga

SEQ ID NO: 1013342 - RNA, 22 nt, Human
gucuucuguaagaugagguccc

SEQ ID NO: 1013343 - RNA, 22 nt, Human
cagguggcuucucccuaggcca

SEQ ID NO: 1013344 - RNA, 22 nt, Human
accaugaucugcucugguguuu

SEQ ID NO: 1013345 - RNA, 22 nt, Human
auggaaagcuaagccauuuacc

SEQ ID NO: 1013346 - RNA, 22 nt, Human
ucccagagucagagguggggcc

SEQ ID NO: 1013347 - RNA, 22 nt, Human
cagcaaaagccagcauaagcuc

SEQ ID NO: 1013348 - RNA, 19 nt, Human
uagagcugcuuccuggcag

SEQ ID NO: 1013349 - RNA, 22 nt, Human
ucuguucaguugauuagacaga

SEQ ID NO: 1013350 - RNA, 22 nt, Human
uacuuuuuagcacagugugugc

SEQ ID NO: 1013351 - RNA, 22 nt, Human
auuuugaaaagcauuugaguaa

SEQ ID NO: 1013352 - RNA, 22 nt, Human
aguguccccuacagaggcauuc

SEQ ID NO: 1013353 - RNA, 22 nt, Human
agagccaggacugugucucacu

SEQ ID NO: 1013354 - RNA, 22 nt, Human
ugaggccaggaucccaggcucu

SEQ ID NO: 1013355 - RNA, 22 nt, Human
caggggcuuuuccucuauaagg

SEQ ID NO: 1013356 - RNA, 22 nt, Human
ccaggugguucaggucaccaua

SEQ ID NO: 1013357 - RNA, 22 nt, Human
acuguguggaccacucugaggc

SEQ ID NO: 1013358 - RNA, 22 nt, Human
uggcucagaagaaaagguaaac

SEQ ID NO: 1013359 - RNA, 22 nt, Human
aguaaugugccugaaauacuug

SEQ ID NO: 1013360 - RNA, 22 nt, Human
gaugggaggaaccugggucccu

SEQ ID NO: 1013361 - RNA, 22 nt, Human
uugcaauagccuuauuuccaaa

SEQ ID NO: 1013362 - RNA, 18 nt, Human
gcugagguggugucagag

SEQ ID NO: 1013363 - RNA, 22 nt, Human
ggcucugcccagaugaagagga

SEQ ID NO: 1013364 - RNA, 22 nt, Human
gaaauuauugcuagagacugca

SEQ ID NO: 1013365 - RNA, 22 nt, Human
uuugugaagggaacagaagugu

SEQ ID NO: 1013366 - RNA, 22 nt, Human
aagaugcgguugaccauggugu

SEQ ID NO: 1013367 - RNA, 22 nt, Human
aggcacuucucaaauucaugcc

SEQ ID NO: 1013368 - RNA, 22 nt, Human
caggugggccgggguuuguucu

SEQ ID NO: 1013369 - RNA, 22 nt, Human
ucagagccaaucauggugcauu

SEQ ID NO: 1013370 - RNA, 22 nt, Human
caagagagaugcagcucacuca

SEQ ID NO: 1013371 - RNA, 22 nt, Human
aucacgucaugguuugaucugg

SEQ ID NO: 1013372 - RNA, 22 nt, Human
cagaagaauggugucugagcuc

SEQ ID NO: 1013373 - RNA, 18 nt, Human
ugcuggguaacuguaugg

SEQ ID NO: 1013374 - RNA, 22 nt, Human
ugggcaggauaauaucucaugu

SEQ ID NO: 1013375 - RNA, 22 nt, Human
ggggccugcgagguucaacuuc

SEQ ID NO: 1013376 - RNA, 22 nt, Human
cagagcaguccuugucaaucag

SEQ ID NO: 1013377 - RNA, 22 nt, Human
ggagcagcuugcaugcucaggg

SEQ ID NO: 1013378 - RNA, 22 nt, Human
aggcugccuguuccaaucuccu

SEQ ID NO: 1013379 - RNA, 22 nt, Human
gcagggacagggcagggccuuu

SEQ ID NO: 1013380 - RNA, 22 nt, Human
cccagggcuuuucucacuagac

SEQ ID NO: 1013381 - RNA, 22 nt, Human
uggcccgaccucugcucaugca

SEQ ID NO: 1013382 - RNA, 22 nt, Human
cugaggccccucuugugagcau

SEQ ID NO: 1013383 - RNA, 22 nt, Human
acaggcugcugggcuccgugcu

SEQ ID NO: 1013384 - RNA, 22 nt, Human
uuccaguugguagaauguaagg

SEQ ID NO: 1013385 - RNA, 22 nt, Human
ggcagcagaacuggcccuguau

SEQ ID NO: 1013386 - RNA, 22 nt, Human
agcaucuggugagggccuaguu

SEQ ID NO: 1013387 - RNA, 22 nt, Human
ucagagcugcccaugcaagggg

SEQ ID NO: 1013388 - RNA, 22 nt, Human
caaaauguucuggcaccuuuaa

SEQ ID NO: 1013389 - RNA, 22 nt, Human
aaaagaggagugguuuaugaca

SEQ ID NO: 1013390 - RNA, 22 nt, Human
aagcgccaugguuccugcgcag

SEQ ID NO: 1013391 - RNA, 22 nt, Human
gaggacagcuuagggcuuccug

SEQ ID NO: 1013392 - RNA, 22 nt, Human
gcugggagcaaagccaugcaua

SEQ ID NO: 1013393 - RNA, 19 nt, Human
cucuggccucuggaugcug

SEQ ID NO: 1013394 - RNA, 22 nt, Human
uugggcugaacccugcagcuga

SEQ ID NO: 1013395 - RNA, 22 nt, Human
uaaguggaagguuauaugcuaa

SEQ ID NO: 1013396 - RNA, 22 nt, Human
ucacugcucucuaagcaucgcc

SEQ ID NO: 1013397 - RNA, 19 nt, Human
cucugccucuggcuguggc

SEQ ID NO: 1013398 - RNA, 22 nt, Human
uaaaguucagugcaugaaugug

SEQ ID NO: 1013399 - RNA, 22 nt, Human
ugcccaggguggagugcagcgg

SEQ ID NO: 1013400 - RNA, 22 nt, Human
uggagcaggccggaaguggcuu

SEQ ID NO: 1013401 - RNA, 22 nt, Human
ugucaugccauuuaaaauguuu

SEQ ID NO: 1013402 - RNA, 19 nt, Human
auaaggcagugacuuuuuu

SEQ ID NO: 1013403 - RNA, 22 nt, Human
cuggggcugcggacgggagccc

SEQ ID NO: 1013404 - RNA, 22 nt, Human
aaggcacuuaacgugggaggau

SEQ ID NO: 1013405 - RNA, 21 nt, Human
ucccucagaagcucuugguca

SEQ ID NO: 1013406 - RNA, 22 nt, Human
cuggcagcucuacucagagccu

SEQ ID NO: 1013407 - RNA, 22 nt, Human
cuguuuaucucuaaccuguuua

SEQ ID NO: 1013408 - RNA, 22 nt, Human
ugauuuccaauaaggagaaugu

SEQ ID NO: 1013409 - RNA, 22 nt, Human
ucucauucauacccuacaugcu

SEQ ID NO: 1013410 - RNA, 22 nt, Human
cauaauuuuuuuaagucagaac

SEQ ID NO: 1013411 - RNA, 22 nt, Human
agcucauggugcuaucucaggg

SEQ ID NO: 1013412 - RNA, 22 nt, Human
guugaaagaugucuugguuccc

SEQ ID NO: 1013413 - RNA, 22 nt, Human
uggcagagucucuccuuuccag

SEQ ID NO: 1013414 - RNA, 22 nt, Human
aucacauucuuucaaagcaguc

SEQ ID NO: 1013415 - RNA, 22 nt, Human
gauuucuuuaugaaguacagaa

SEQ ID NO: 1013416 - RNA, 22 nt, Human
agccacagagagggagcugcaa

SEQ ID NO: 1013417 - RNA, 22 nt, Human
ucugccuggauuuuggaaagcu

SEQ ID NO: 1013418 - RNA, 22 nt, Human
aucuggcuauuucuggucgggg

SEQ ID NO: 1013419 - RNA, 22 nt, Human
auaauuuacaacugcuuuuaau

SEQ ID NO: 1013420 - RNA, 22 nt, Human
cccaggucuaugccagcucuga

SEQ ID NO: 1013421 - RNA, 22 nt, Human
ugcugccuccaacuccugggcu

SEQ ID NO: 1013422 - RNA, 22 nt, Human
ugaaaguugcacauaagagaau

SEQ ID NO: 1013423 - RNA, 22 nt, Human
acuaaggaauaugacaaacuca

SEQ ID NO: 1013424 - RNA, 22 nt, Human
ugcagaagcagagccgguggcc

SEQ ID NO: 1013425 - RNA, 22 nt, Human
auguguauacuugugcuuacuc

SEQ ID NO: 1013426 - RNA, 22 nt, Human
guguuuuaagaaagaagcucag

SEQ ID NO: 1013427 - RNA, 22 nt, Human
cugaaggacuuggugauaguug

SEQ ID NO: 1013428 - RNA, 22 nt, Human
ugagcaucuuuuuacagguuua

SEQ ID NO: 1013429 - RNA, 22 nt, Human
aaauucuuucauggcuaauaag

SEQ ID NO: 1013430 - RNA, 22 nt, Human
ggcuuccuggagaaggucugag

SEQ ID NO: 1013431 - RNA, 22 nt, Human
aggauccuccuuagaaaagacc

SEQ ID NO: 1013432 - RNA, 22 nt, Human
agcccagccggauucccaguuc

SEQ ID NO: 1013433 - RNA, 22 nt, Human
ccuggagcaggagcugcagagg

SEQ ID NO: 1013434 - RNA, 22 nt, Human
caugugguucaaguacuccaca

SEQ ID NO: 1013435 - RNA, 22 nt, Human
cagcccugagaaggaggaucuc

SEQ ID NO: 1013436 - RNA, 22 nt, Human
aagcaaaagguuacacuucugg

SEQ ID NO: 1013437 - RNA, 22 nt, Human
ugacccugcuucuuggugcagg

SEQ ID NO: 1013438 - RNA, 22 nt, Human
ucucuuaauuuuggaauagugu

SEQ ID NO: 1013439 - RNA, 22 nt, Human
gaugggcguggcgcguuuggug

SEQ ID NO: 1013440 - RNA, 22 nt, Human
uuuguaaaaggaggaagcaugg

SEQ ID NO: 1013441 - RNA, 21 nt, Human
caugaagccgguucccuguuu

SEQ ID NO: 1013442 - RNA, 22 nt, Human
ccagccugaaaugccucauccu

SEQ ID NO: 1013443 - RNA, 22 nt, Human
ugucccagucaaggcugucauc

SEQ ID NO: 1013444 - RNA, 21 nt, Human
gccagagcaguacaaugaggu

SEQ ID NO: 1013445 - RNA, 22 nt, Human
acuguucaucucuuagaaagua

SEQ ID NO: 1013446 - RNA, 21 nt, Human
ugggaccuauuucaacuggau

SEQ ID NO: 1013447 - RNA, 22 nt, Human
ucugauuagcaguuuagggaaa

SEQ ID NO: 1013448 - RNA, 22 nt, Human
ccagcagcccucuuccaagacu

SEQ ID NO: 1013449 - RNA, 22 nt, Human
uaugaaaagguggccaauguag

SEQ ID NO: 1013450 - RNA, 22 nt, Human
uacauugcuuucuaauacaucu

SEQ ID NO: 1013451 - RNA, 22 nt, Human
aguuacaaccaugacacaagca

SEQ ID NO: 1013452 - RNA, 22 nt, Human
gaauauuuucaguacagauggu

SEQ ID NO: 1013453 - RNA, 22 nt, Human
uuucucuaaauagggaggcuua

SEQ ID NO: 1013454 - RNA, 22 nt, Human
cucagaguccccaguggguuug

SEQ ID NO: 1013455 - RNA, 22 nt, Human
ccugacgaaaggcgugcuggag

SEQ ID NO: 1013456 - RNA, 22 nt, Human
ugcccugcagugagugcgucug

SEQ ID NO: 1013457 - RNA, 22 nt, Human
auguccuuugcuucucuggucc

SEQ ID NO: 1013458 - RNA, 22 nt, Human
ccugucuggccuuccacggggg

SEQ ID NO: 1013459 - RNA, 22 nt, Human
ucauuuguacuugugugcuugu

SEQ ID NO: 1013460 - RNA, 22 nt, Human
auuugucuucaguagguucuuc

SEQ ID NO: 1013461 - RNA, 22 nt, Human
cacagugcaugaugggcagaag

SEQ ID NO: 1013462 - RNA, 22 nt, Human
aaguuugagaagcuuauagaua

SEQ ID NO: 1013463 - RNA, 22 nt, Human
uuaguuagucccugguaccuuu

SEQ ID NO: 1013464 - RNA, 22 nt, Human
gccuugggauucuuggaugcuc

SEQ ID NO: 1013465 - RNA, 22 nt, Human
ccaggcugcuuagccuuaucuu

SEQ ID NO: 1013466 - RNA, 22 nt, Human
aaugcacaaaaauuguauguaa

SEQ ID NO: 1013467 - RNA, 22 nt, Human
ugggccuggagcccuggagagu

SEQ ID NO: 1013468 - RNA, 22 nt, Human
ugagccuggguggucgaggcug

SEQ ID NO: 1013469 - RNA, 17 nt, Human
agccccucagcgucacc

SEQ ID NO: 1013470 - RNA, 22 nt, Human
cugcuccacaccuccauuuccu

SEQ ID NO: 1013471 - RNA, 22 nt, Human
aaggcccuggcaggaagcagga

SEQ ID NO: 1013472 - RNA, 20 nt, Human
ucaggaugugcugagugaag

SEQ ID NO: 1013473 - RNA, 22 nt, Human
agggcagauggaacuuccccga

SEQ ID NO: 1013474 - RNA, 22 nt, Human
acaggcugccuaccaaguauca

SEQ ID NO: 1013475 - RNA, 20 nt, Human
ggccugagcauggcuggcag

SEQ ID NO: 1013476 - RNA, 22 nt, Human
agcagcugggcucagagcuggg

SEQ ID NO: 1013477 - RNA, 22 nt, Human
ugucccauggauaccaggcuau

SEQ ID NO: 1013478 - RNA, 22 nt, Human
ccagccuccauguagauagcug

SEQ ID NO: 1013479 - RNA, 23 nt, Human
aucauucuccaaucuggagcagg

SEQ ID NO: 1013480 - RNA, 22 nt, Human
ggcagaguggagugcggccucc

SEQ ID NO: 1013481 - RNA, 22 nt, Human
aggagggugauccgggcugguc

SEQ ID NO: 1013482 - RNA, 22 nt, Human
ugccugucuucaggagugucac

SEQ ID NO: 1013483 - RNA, 22 nt, Human
gccugccuuuuggaggcacauu

SEQ ID NO: 1013484 - RNA, 22 nt, Human
gcugccuguguggccacucacu

SEQ ID NO: 1013485 - RNA, 22 nt, Human
agcagggcagugcuucagcucu

SEQ ID NO: 1013486 - RNA, 22 nt, Human
aggagaguaccauugggccgca

SEQ ID NO: 1013487 - RNA, 22 nt, Human
agguggggccaaaugcuacagu

SEQ ID NO: 1013488 - RNA, 22 nt, Human
agacaggaugcauacucuuggu

SEQ ID NO: 1013489 - RNA, 22 nt, Human
gccagagcagaauagaguggcc

SEQ ID NO: 1013490 - RNA, 22 nt, Human
uucauauauaugcacuacguac

SEQ ID NO: 1013491 - RNA, 22 nt, Human
ugaaggaaagagggaacauccc

SEQ ID NO: 1013492 - RNA, 22 nt, Human
acauuucuuagccuaguuccag

SEQ ID NO: 1013493 - RNA, 22 nt, Human
auuucaaggcuauuaauauaaa

SEQ ID NO: 1013494 - RNA, 22 nt, Human
aagggcucugugcuugucccau

SEQ ID NO: 1013495 - RNA, 22 nt, Human
uucucugaucuugcuagacuga

SEQ ID NO: 1013496 - RNA, 22 nt, Human
aaaucugggucaagguggagug

SEQ ID NO: 1013497 - RNA, 22 nt, Human
uguaugcagcaaaacaauuagu

SEQ ID NO: 1013498 - RNA, 22 nt, Human
agaaugcaguuugaaauaaggu

SEQ ID NO: 1013499 - RNA, 22 nt, Human
uccucccacauaggacaauggg

SEQ ID NO: 1013500 - RNA, 22 nt, Human
uggcucuguugugcugagccag

SEQ ID NO: 1013501 - RNA, 22 nt, Human
ugagauguaagguaugcuuacu

SEQ ID NO: 1013502 - RNA, 22 nt, Human
uccuggagauaauugcagugaa

SEQ ID NO: 1013503 - RNA, 22 nt, Human
auaaugaggauuugcauauuag

SEQ ID NO: 1013504 - RNA, 19 nt, Human
ccagucccauacaggagau

SEQ ID NO: 1013505 - RNA, 22 nt, Human
auguuauuaaaguacagauucu

SEQ ID NO: 1013506 - RNA, 22 nt, Human
agaaaucugacugcugugcaca

SEQ ID NO: 1013507 - RNA, 22 nt, Human
uguaugaauauguauuuucaua

SEQ ID NO: 1013508 - RNA, 21 nt, Human
agccuggcccagggggaggcu

SEQ ID NO: 1013509 - RNA, 22 nt, Human
cagagccccccuucugaucaca

SEQ ID NO: 1013510 - RNA, 22 nt, Human
gugguaaucggauucuuaccgg

SEQ ID NO: 1013511 - RNA, 22 nt, Human
agucucaggcagaggaaggcua

SEQ ID NO: 1013512 - RNA, 22 nt, Human
ccugucaggguuugccucagaa

SEQ ID NO: 1013513 - RNA, 20 nt, Human
gggugagauguaggagaggg

SEQ ID NO: 1013514 - RNA, 22 nt, Human
gccuggagaccugcuccucuac

SEQ ID NO: 1013515 - RNA, 22 nt, Human
guccucagucaguuuggugggg

SEQ ID NO: 1013516 - RNA, 22 nt, Human
ucuucagaggaagucagucuuu

SEQ ID NO: 1013517 - RNA, 22 nt, Human
agggucugacuccucuggcaag

SEQ ID NO: 1013518 - RNA, 22 nt, Human
gccuucugaucgcuggacugac

SEQ ID NO: 1013519 - RNA, 22 nt, Human
aagcuccccgaaacccaccucu

SEQ ID NO: 1013520 - RNA, 22 nt, Human
cagucccagaagagccugggag

SEQ ID NO: 1013521 - RNA, 22 nt, Human
agcuggccuguuagagcugagu

SEQ ID NO: 1013522 - RNA, 22 nt, Human
gcacccaguuugucucaggguu

SEQ ID NO: 1013523 - RNA, 22 nt, Human
cuguucaugcugauucuguaug

SEQ ID NO: 1013524 - RNA, 22 nt, Human
ugucagagcaaggccaggccag

SEQ ID NO: 1013525 - RNA, 22 nt, Human
gcugcuggcaucuagggggugg

SEQ ID NO: 1013526 - RNA, 22 nt, Human
cagggugcagugucgcugcuag

SEQ ID NO: 1013527 - RNA, 22 nt, Human
uuucaagcauaacugggaagag

SEQ ID NO: 1013528 - RNA, 22 nt, Human
ggaaggucgagcugcaucuggc

SEQ ID NO: 1013529 - RNA, 22 nt, Human
agggaaagguagugaggucaca

SEQ ID NO: 1013530 - RNA, 22 nt, Human
guucuucaggccauccucccag

SEQ ID NO: 1013531 - RNA, 19 nt, Human
uuucccagcccuugcugug

SEQ ID NO: 1013532 - RNA, 22 nt, Human
cagcucugcugggaggaugcag

SEQ ID NO: 1013533 - RNA, 22 nt, Human
uauuucagcccuacuacuuggc

SEQ ID NO: 1013534 - RNA, 22 nt, Human
aagugaguggccuggagaggug

SEQ ID NO: 1013535 - RNA, 17 nt, Human
agguggguggaucaccu

SEQ ID NO: 1013536 - RNA, 23 nt, Human
ggccuggcccagggcccugauga

SEQ ID NO: 1013537 - RNA, 23 nt, Human
cauggcagcaagagcucauggcc

SEQ ID NO: 1013538 - RNA, 22 nt, Human
agagccugggcagcuccucugg

SEQ ID NO: 1013539 - RNA, 22 nt, Human
ugggagcaguucagguguggcu

SEQ ID NO: 1013540 - RNA, 22 nt, Human
aggggagccccugguccuggug

SEQ ID NO: 1013541 - RNA, 22 nt, Human
uaaagguacgaagugagggauu

SEQ ID NO: 1013542 - RNA, 22 nt, Human
aaaugcacugaacacauguugu

SEQ ID NO: 1013543 - RNA, 22 nt, Human
ggcugccaggagggaggccagu

SEQ ID NO: 1013544 - RNA, 22 nt, Human
ugcugucaguuggcaggaugag

SEQ ID NO: 1013545 - RNA, 22 nt, Human
gggauggacuuggggacuccag

SEQ ID NO: 1013546 - RNA, 22 nt, Human
cuggugggagcagcaggcagcu

SEQ ID NO: 1013547 - RNA, 17 nt, Human
cgagggcuugcuggcuc

SEQ ID NO: 1013548 - RNA, 22 nt, Human
ucucuucugaaaccugucuuua

SEQ ID NO: 1013549 - RNA, 22 nt, Human
acccaggccugagagacaggag

SEQ ID NO: 1013550 - RNA, 22 nt, Human
agucuuuccugcuugacuguuc

SEQ ID NO: 1013551 - RNA, 22 nt, Human
ucagggcauccauugccuguug

SEQ ID NO: 1013552 - RNA, 22 nt, Human
ggacacaagcuccggggcugca

SEQ ID NO: 1013553 - RNA, 22 nt, Human
cauuuacauuuaagguuaauau

SEQ ID NO: 1013554 - RNA, 20 nt, Human
aggcugccaggucucacauc

SEQ ID NO: 1013555 - RNA, 22 nt, Human
uccugcagccacugcaggcaga

SEQ ID NO: 1013556 - RNA, 22 nt, Human
acuccuggguugcaguccucaa

SEQ ID NO: 1013557 - RNA, 22 nt, Human
uguucuucuagauugccuuuua

SEQ ID NO: 1013558 - RNA, 22 nt, Human
uauuccagguuucuuguuguau

SEQ ID NO: 1013559 - RNA, 18 nt, Human
aggccagcccugcuacug

SEQ ID NO: 1013560 - RNA, 22 nt, Human
gacucugcuacaggccgagguu

SEQ ID NO: 1013561 - RNA, 18 nt, Human
gucauugcaacauacugu

SEQ ID NO: 1013562 - RNA, 22 nt, Human
ugagccuguggggugacaacca

SEQ ID NO: 1013563 - RNA, 22 nt, Human
acugcagccuuugggcucauaa

SEQ ID NO: 1013564 - RNA, 22 nt, Human
cagugccucuuaagugucaccc

SEQ ID NO: 1013565 - RNA, 22 nt, Human
cccaggccccagggcuugucag

SEQ ID NO: 1013566 - RNA, 22 nt, Human
acagccugcugccugcuucuug

SEQ ID NO: 1013567 - RNA, 22 nt, Human
ccugcagacacuuguccagcaa

SEQ ID NO: 1013568 - RNA, 22 nt, Human
uuuggccacuugggaguccagg

SEQ ID NO: 1013569 - RNA, 22 nt, Human
uggaaggcaacggagugagcug

SEQ ID NO: 1013570 - RNA, 22 nt, Human
uuuccucuucuucccaugucau

SEQ ID NO: 1013571 - RNA, 22 nt, Human
cucugggcaccaaagagcagcu

SEQ ID NO: 1013572 - RNA, 22 nt, Human
augggagugacagggccacugg

SEQ ID NO: 1013573 - RNA, 22 nt, Human
gaaaggcaguacagcugagccu

SEQ ID NO: 1013574 - RNA, 22 nt, Human
auugaaagaguuuucugcugca

SEQ ID NO: 1013575 - RNA, 22 nt, Human
aaguuuuccuguguccaagaug

SEQ ID NO: 1013576 - RNA, 22 nt, Human
uuugcauuauauuuauagaaga

SEQ ID NO: 1013577 - RNA, 22 nt, Human
cagucucucagcuuucagcugu

SEQ ID NO: 1013578 - RNA, 22 nt, Human
acaauucugaugguuucccagu

SEQ ID NO: 1013579 - RNA, 22 nt, Human
ugcaagcacucaaugcaaacag

SEQ ID NO: 1013580 - RNA, 22 nt, Human
caauuucucuuuauaucucaca

SEQ ID NO: 1013581 - RNA, 20 nt, Human
aauguauauuuuaugccagg

SEQ ID NO: 1013582 - RNA, 22 nt, Human
gccuggcaggggccugggagug

SEQ ID NO: 1013583 - RNA, 22 nt, Human
guuaugaaauaaauauagauca

SEQ ID NO: 1013584 - RNA, 22 nt, Human
gggcagcagagcccugccgagu

SEQ ID NO: 1013585 - RNA, 22 nt, Human
cagguuuagguggacgugcagg

SEQ ID NO: 1013586 - RNA, 22 nt, Human
guggccugaugccagcccugug

SEQ ID NO: 1013587 - RNA, 17 nt, Human
ggcagcugugugcaugc

SEQ ID NO: 1013588 - RNA, 22 nt, Human
auaacuuucuucacccuugcug

SEQ ID NO: 1013589 - RNA, 22 nt, Human
gaggaaccaaucugugauauuc

SEQ ID NO: 1013590 - RNA, 22 nt, Human
cccaaggcugcagugagcauga

SEQ ID NO: 1013591 - RNA, 22 nt, Human
uggcugaacuaaugugcuguuu

SEQ ID NO: 1013592 - RNA, 22 nt, Human
aagggaggggauguaagccugg

SEQ ID NO: 1013593 - RNA, 20 nt, Human
uggggccuguuucugugguu

SEQ ID NO: 1013594 - RNA, 21 nt, Human
aagcaggacauaugaugcccu

SEQ ID NO: 1013595 - RNA, 22 nt, Human
uaaaauguagcuucuaggcugg

SEQ ID NO: 1013596 - RNA, 22 nt, Human
gcagcccaaaaaagagguagau

SEQ ID NO: 1013597 - RNA, 22 nt, Human
uuugauaagagcugcugaaacu

SEQ ID NO: 1013598 - RNA, 22 nt, Human
gcugcagcagaaguucucagag

SEQ ID NO: 1013599 - RNA, 22 nt, Human
gugcauuugugcaugcacaugu

SEQ ID NO: 1013600 - RNA, 22 nt, Human
aggagaguucacacuggucaga

SEQ ID NO: 1013601 - RNA, 22 nt, Human
gccuggagugguccugcugccc

SEQ ID NO: 1013602 - RNA, 19 nt, Human
gcacccugaggucauggcc

SEQ ID NO: 1013603 - RNA, 17 nt, Human
cugagcauccgugcucu

SEQ ID NO: 1013604 - RNA, 22 nt, Human
gacagcagacagaacuaccugc

SEQ ID NO: 1013605 - RNA, 22 nt, Human
gacacagcacuguacaaggaau

SEQ ID NO: 1013606 - RNA, 22 nt, Human
ucugcugugggucuauauuuua

SEQ ID NO: 1013607 - RNA, 22 nt, Human
caaugauucugcaacugugugc

SEQ ID NO: 1013608 - RNA, 22 nt, Human
uugcauuccaguccccacugug

SEQ ID NO: 1013609 - RNA, 22 nt, Human
ucucagagauuuauggaaaacu

SEQ ID NO: 1013610 - RNA, 22 nt, Human
acugcagcaaagcccgugucuu

SEQ ID NO: 1013611 - RNA, 23 nt, Human
agaggccagccuuuggagacacc

SEQ ID NO: 1013612 - RNA, 22 nt, Human
ucuuuccuacuuuauugugaac

SEQ ID NO: 1013613 - RNA, 20 nt, Human
gcacugaaauucaauguuug

SEQ ID NO: 1013614 - RNA, 22 nt, Human
aaaauguaaagcuugaguguag

SEQ ID NO: 1013615 - RNA, 22 nt, Human
uggcagaggagaauuaagauua

SEQ ID NO: 1013616 - RNA, 22 nt, Human
gcaagcugcucuuauguggagg

SEQ ID NO: 1013617 - RNA, 22 nt, Human
cacaguggauugggugaugccc

SEQ ID NO: 1013618 - RNA, 22 nt, Human
aaggcacuagcaagcugccugg

SEQ ID NO: 1013619 - RNA, 22 nt, Human
auuuucaucgcuagguuggccu

SEQ ID NO: 1013620 - RNA, 22 nt, Human
ucauugcacuccagccugggca

SEQ ID NO: 1013621 - RNA, 22 nt, Human
acuuugcagggcuugauaucca

SEQ ID NO: 1013622 - RNA, 22 nt, Human
auuuucaugacuaccuuaaaua

SEQ ID NO: 1013623 - RNA, 18 nt, Human
ugagagugugugcucuug

SEQ ID NO: 1013624 - RNA, 22 nt, Human
gccagagccggcuucacaggau

SEQ ID NO: 1013625 - RNA, 22 nt, Human
cacagggccuggggcagcugcu

SEQ ID NO: 1013626 - RNA, 22 nt, Human
uaaauuaugucacaugacucug

SEQ ID NO: 1013627 - RNA, 22 nt, Human
gaugcagaaaguagacaccauc

SEQ ID NO: 1013628 - RNA, 22 nt, Human
agccagacauggcuccugcucc

SEQ ID NO: 1013629 - RNA, 22 nt, Human
ugugcagagcccacaggcagcu

SEQ ID NO: 1013630 - RNA, 22 nt, Human
cacagggcagugcugcccacuc

SEQ ID NO: 1013631 - RNA, 22 nt, Human
gaaaugugggucaugacccauu

SEQ ID NO: 1013632 - RNA, 22 nt, Human
cccagcccagcguucgaggggu

SEQ ID NO: 1013633 - RNA, 22 nt, Human
gaggcacugcugggccccugua

SEQ ID NO: 1013634 - RNA, 23 nt, Human
cuggcucuguagguggcauccuu

SEQ ID NO: 1013635 - RNA, 22 nt, Human
uuauagaaggagcauucacuua

SEQ ID NO: 1013636 - RNA, 22 nt, Human
uccagggcugacuugggagagg

SEQ ID NO: 1013637 - RNA, 22 nt, Human
ggagcuggucagccuugagcau

SEQ ID NO: 1013638 - RNA, 22 nt, Human
ugcaagagguaaaaugaaagga

SEQ ID NO: 1013639 - RNA, 22 nt, Human
cccuggguucuggcugggcugc

SEQ ID NO: 1013640 - RNA, 22 nt, Human
aggcacuugaauugaugauguu

SEQ ID NO: 1013641 - RNA, 17 nt, Human
uucucuuccuggauagu

SEQ ID NO: 1013642 - RNA, 20 nt, Human
agucccagaucaaauuucug

SEQ ID NO: 1013643 - RNA, 22 nt, Human
gcucugcuggagggaaagagaa

SEQ ID NO: 1013644 - RNA, 22 nt, Human
ucccagggacugggcuaggcuu

SEQ ID NO: 1013645 - RNA, 22 nt, Human
ugggggagauugugcaucucua

SEQ ID NO: 1013646 - RNA, 22 nt, Human
uaacagaaacagauaaguguaa

SEQ ID NO: 1013647 - RNA, 22 nt, Human
ucugguuagccaauaaugccaa

SEQ ID NO: 1013648 - RNA, 22 nt, Human
cucugcugcccaggccugcuag

SEQ ID NO: 1013649 - RNA, 22 nt, Human
aggcacagagaaugcccuccau

SEQ ID NO: 1013650 - RNA, 22 nt, Human
auggcccaggccuccuguggcu

SEQ ID NO: 1013651 - RNA, 22 nt, Human
agagggaucacccuguuucugg

SEQ ID NO: 1013652 - RNA, 22 nt, Human
aagggcuggcccugggaagagu

SEQ ID NO: 1013653 - RNA, 22 nt, Human
ggcucugcgcgguaaagugacu

SEQ ID NO: 1013654 - RNA, 22 nt, Human
acaguaaugauucugagucucu

SEQ ID NO: 1013655 - RNA, 22 nt, Human
ucagagagguuggugauaagaa

SEQ ID NO: 1013656 - RNA, 22 nt, Human
agcauuuauuucuuagaaauug

SEQ ID NO: 1013657 - RNA, 22 nt, Human
cagcccaggccgacaguuccuc

SEQ ID NO: 1013658 - RNA, 22 nt, Human
gggacuucauagcuaggcacuu

SEQ ID NO: 1013659 - RNA, 22 nt, Human
aggggcuggcuuaucugagagu

SEQ ID NO: 1013660 - RNA, 19 nt, Human
ccagcagacacagcugccc

SEQ ID NO: 1013661 - RNA, 22 nt, Human
ccuggcagcgccgaagcuggcc

SEQ ID NO: 1013662 - RNA, 22 nt, Human
cugcugugcaggugccuaugau

SEQ ID NO: 1013663 - RNA, 22 nt, Human
aaggccaggacaccaggggacu

SEQ ID NO: 1013664 - RNA, 22 nt, Human
cagagcugugauaaauagauau

SEQ ID NO: 1013665 - RNA, 22 nt, Human
uguauuagagcaguagaauuau

SEQ ID NO: 1013666 - RNA, 22 nt, Human
gaagaagcaggaguguguagca

SEQ ID NO: 1013667 - RNA, 22 nt, Human
ggcuuccuaauacucccuacac

SEQ ID NO: 1013668 - RNA, 19 nt, Human
agccagggugagaaggagc

SEQ ID NO: 1013669 - RNA, 22 nt, Human
gcagagaguugggcugcgccag

SEQ ID NO: 1013670 - RNA, 22 nt, Human
ucauugaauuucacagcuuuau

SEQ ID NO: 1013671 - RNA, 22 nt, Human
cugagaaggaagccuccacucu

SEQ ID NO: 1013672 - RNA, 22 nt, Human
auucagugugagguuuucaagu

SEQ ID NO: 1013673 - RNA, 22 nt, Human
ucacagugaugacgugggagca

SEQ ID NO: 1013674 - RNA, 22 nt, Human
ggccugagaaccauggggccaa

SEQ ID NO: 1013675 - RNA, 22 nt, Human
gcuuucucuucacugauguuca

SEQ ID NO: 1013676 - RNA, 20 nt, Human
uuucaguugguuaauggcau

SEQ ID NO: 1013677 - RNA, 20 nt, Human
cugcucugcuuugcaggugg

SEQ ID NO: 1013678 - RNA, 22 nt, Human
ccuucauugcaucuuuaagaga

SEQ ID NO: 1013679 - RNA, 22 nt, Human
gccugcuggcuguccauugcag

SEQ ID NO: 1013680 - RNA, 22 nt, Human
cagaugaggcaaccucauugcu

SEQ ID NO: 1013681 - RNA, 22 nt, Human
aucagcaagauguaauuucuau

SEQ ID NO: 1013682 - RNA, 22 nt, Human
uggacagguuugggugccuguu

SEQ ID NO: 1013683 - RNA, 22 nt, Human
gagcucuggcagggcaggucug

SEQ ID NO: 1013684 - RNA, 22 nt, Human
ggccccuggcaccaggcugauu

SEQ ID NO: 1013685 - RNA, 22 nt, Human
uacagagacuuuauggcacaaa

SEQ ID NO: 1013686 - RNA, 22 nt, Human
gccaggcugcuccagggaggcc

SEQ ID NO: 1013687 - RNA, 22 nt, Human
aacagcauaaguauuuauuuca

SEQ ID NO: 1013688 - RNA, 22 nt, Human
gggcuggaucuccugcaggcag

SEQ ID NO: 1013689 - RNA, 22 nt, Human
cagagcuggggacuguuggaug

SEQ ID NO: 1013690 - RNA, 22 nt, Human
agcaccuggucuccuggcgcug

SEQ ID NO: 1013691 - RNA, 22 nt, Human
acugucugcccugagaugccag

SEQ ID NO: 1013692 - RNA, 22 nt, Human
uacuuacagaaggaagcaauug

SEQ ID NO: 1013693 - RNA, 22 nt, Human
gggccagagcuuggcagcuggg

SEQ ID NO: 1013694 - RNA, 22 nt, Human
acaccauacucauguugguucc

SEQ ID NO: 1013695 - RNA, 22 nt, Human
uugcaccaaaugaguuaaaauu

SEQ ID NO: 1013696 - RNA, 22 nt, Human
gcuguucacaucuggaccauuu

SEQ ID NO: 1013697 - RNA, 19 nt, Human
uggaccugugcccauggcu

SEQ ID NO: 1013698 - RNA, 22 nt, Human
guuucauacagauuauucaugg

SEQ ID NO: 1013699 - RNA, 22 nt, Human
auucuucacauggauaggaucu

SEQ ID NO: 1013700 - RNA, 22 nt, Human
cuguguuggcuuuucucuugua

SEQ ID NO: 1013701 - RNA, 22 nt, Human
cuguuuuugugcugugucuccc

SEQ ID NO: 1013702 - RNA, 22 nt, Human
aauguguagauguugcauuccu

SEQ ID NO: 1013703 - RNA, 22 nt, Human
gcugcccagcaggccccagggg

SEQ ID NO: 1013704 - RNA, 22 nt, Human
agggggaggcugugcugcgucu

SEQ ID NO: 1013705 - RNA, 22 nt, Human
ugcagaccucccauggcugccu

SEQ ID NO: 1013706 - RNA, 18 nt, Human
aaauguacuguccauggc

SEQ ID NO: 1013707 - RNA, 21 nt, Human
cagcuuugucugucuucgggg

SEQ ID NO: 1013708 - RNA, 22 nt, Human
accaaggaguuugguauuuuag

SEQ ID NO: 1013709 - RNA, 22 nt, Human
cacugcuuauaaauucuaggca

SEQ ID NO: 1013710 - RNA, 22 nt, Human
caguguguggauccucccagga

SEQ ID NO: 1013711 - RNA, 22 nt, Human
uuugcauuaucucacuuauaua

SEQ ID NO: 1013712 - RNA, 21 nt, Human
aucacauuggcuguuauuauu

SEQ ID NO: 1013713 - RNA, 22 nt, Human
gcuggccugcaaagcccggcug

SEQ ID NO: 1013714 - RNA, 17 nt, Human
cacaggugugguuugag

SEQ ID NO: 1013715 - RNA, 22 nt, Human
uaaauguguguagccaucugug

SEQ ID NO: 1013716 - RNA, 22 nt, Human
ucaggaguccugccugcagccu

SEQ ID NO: 1013717 - RNA, 22 nt, Human
ccuggaggcucugggagggcag

SEQ ID NO: 1013718 - RNA, 22 nt, Human
cuguacaggugaggagggggcu

SEQ ID NO: 1013719 - RNA, 22 nt, Human
cuguaaauaugaagaauauaug

SEQ ID NO: 1013720 - RNA, 22 nt, Human
uggaggccagagguacugggac

SEQ ID NO: 1013721 - RNA, 19 nt, Human
gcaucagagcagaaggggu

SEQ ID NO: 1013722 - RNA, 23 nt, Human
ugcaggggaggcuuaaagcaggu

SEQ ID NO: 1013723 - RNA, 22 nt, Human
cagcccugccauggagccuccu

SEQ ID NO: 1013724 - RNA, 22 nt, Human
agugacugggcagggcagggcc

SEQ ID NO: 1013725 - RNA, 22 nt, Human
gccugagcccaggugugcagag

SEQ ID NO: 1013726 - RNA, 21 nt, Human
cagagcugaaggguguagugu

SEQ ID NO: 1013727 - RNA, 22 nt, Human
ucucaggaguagugggauccau

SEQ ID NO: 1013728 - RNA, 22 nt, Human
gggcugcuuuuuucuuagcaga

SEQ ID NO: 1013729 - RNA, 22 nt, Human
cccucccagaugggcuugaggu

SEQ ID NO: 1013730 - RNA, 22 nt, Human
aagagguaaccauagcaaccac

SEQ ID NO: 1013731 - RNA, 22 nt, Human
aaacaugagcaucucuucaagc

SEQ ID NO: 1013732 - RNA, 22 nt, Human
agagcagaggcauggccguggg

SEQ ID NO: 1013733 - RNA, 22 nt, Human
cccagcaucuccaggcauggcc

SEQ ID NO: 1013734 - RNA, 22 nt, Human
uuggcaguaaaagaaaaugcuu

SEQ ID NO: 1013735 - RNA, 22 nt, Human
gggcagagagcuggaacuccuu

SEQ ID NO: 1013736 - RNA, 22 nt, Human
aggcagcagggccacuggcuga

SEQ ID NO: 1013737 - RNA, 22 nt, Human
gagacugcauagauggccacaa

SEQ ID NO: 1013738 - RNA, 19 nt, Human
ucucacaucagcuccuagc

SEQ ID NO: 1013739 - RNA, 22 nt, Human
ccacccuggacaggccucugag

SEQ ID NO: 1013740 - RNA, 22 nt, Human
aagagcugcaucuaagccauga

SEQ ID NO: 1013741 - RNA, 23 nt, Human
agaccugcaucugauaggcccug

SEQ ID NO: 1013742 - RNA, 22 nt, Human
aaggcacugagccagccgucuc

SEQ ID NO: 1013743 - RNA, 22 nt, Human
ccugucugaggaggugcucuuu

SEQ ID NO: 1013744 - RNA, 22 nt, Human
aggcucugaucagguggcugug

SEQ ID NO: 1013745 - RNA, 17 nt, Human
gagugcugguggagcuc

SEQ ID NO: 1013746 - RNA, 23 nt, Human
ccugaagggucaggguccucagc

SEQ ID NO: 1013747 - RNA, 22 nt, Human
gcaggcugugaggcucagaugg

SEQ ID NO: 1013748 - RNA, 22 nt, Human
cauaauuucccaagagauugaa

SEQ ID NO: 1013749 - RNA, 22 nt, Human
agaaaagguugaaaguaggauu

SEQ ID NO: 1013750 - RNA, 22 nt, Human
aggagccaguuccaccccagga

SEQ ID NO: 1013751 - RNA, 22 nt, Human
uguuuuuaaauaaugauagaaa

SEQ ID NO: 1013752 - RNA, 22 nt, Human
guucuucagaggggaaagaacc

SEQ ID NO: 1013753 - RNA, 22 nt, Human
cuuaagaauauugaaguugugg

SEQ ID NO: 1013754 - RNA, 22 nt, Human
uuucacauuuaggcgugaauug

SEQ ID NO: 1013755 - RNA, 22 nt, Human
agucucagggccacccggggaa

SEQ ID NO: 1013756 - RNA, 22 nt, Human
ggcagcucacugauuagcaauu

SEQ ID NO: 1013757 - RNA, 22 nt, Human
uauaauuuuaagugguaaauua

SEQ ID NO: 1013758 - RNA, 22 nt, Human
gggcugagucugcugccuguca

SEQ ID NO: 1013759 - RNA, 22 nt, Human
agcugcccuucucuugcccuug

SEQ ID NO: 1013760 - RNA, 22 nt, Human
gacagaggcaagaccagaagcc

SEQ ID NO: 1013761 - RNA, 22 nt, Human
caugaguucaucugcuucucuu

SEQ ID NO: 1013762 - RNA, 22 nt, Human
acaugauucuugauaggcauug

SEQ ID NO: 1013763 - RNA, 22 nt, Human
aagcaggcauuccagagacaau

SEQ ID NO: 1013764 - RNA, 18 nt, Human
gucaccuggaucagauua

SEQ ID NO: 1013765 - RNA, 23 nt, Human
ugauuuccagugagucaguggga

SEQ ID NO: 1013766 - RNA, 21 nt, Human
ugagccaggcugacggcugug

SEQ ID NO: 1013767 - RNA, 22 nt, Human
cacagggcagaggguccguggc

SEQ ID NO: 1013768 - RNA, 22 nt, Human
agagccagcaacucuagcccug

SEQ ID NO: 1013769 - RNA, 22 nt, Human
aagaacugugcuccaggcucca

SEQ ID NO: 1013770 - RNA, 22 nt, Human
aguugaaauuagaguccuggcu

SEQ ID NO: 1013771 - RNA, 21 nt, Human
ccagcagcucaaggaucucuu

SEQ ID NO: 1013772 - RNA, 22 nt, Human
cugccaucugagccaaaagugc

SEQ ID NO: 1013773 - RNA, 22 nt, Human
cagaggcagugggguugcuccu

SEQ ID NO: 1013774 - RNA, 22 nt, Human
guggagcccugccuugcucaug

SEQ ID NO: 1013775 - RNA, 22 nt, Human
ugacacauuaaaugcucacaaa

SEQ ID NO: 1013776 - RNA, 22 nt, Human
cauucuuauauuuacucauuca

SEQ ID NO: 1013777 - RNA, 22 nt, Human
gcaguggauccaaugguaucuu

SEQ ID NO: 1013778 - RNA, 22 nt, Human
ggccugagucacaucaggagag

SEQ ID NO: 1013779 - RNA, 22 nt, Human
cauaauuucacugucguauggc

SEQ ID NO: 1013780 - RNA, 21 nt, Human
gcauggcaggucacuggggca

SEQ ID NO: 1013781 - RNA, 22 nt, Human
uggggcuggggaucuugagccu

SEQ ID NO: 1013782 - RNA, 22 nt, Human
cugccuuggcccuaguucaugg

SEQ ID NO: 1013783 - RNA, 22 nt, Human
uuagauaaauuaagacuuuaca

SEQ ID NO: 1013784 - RNA, 22 nt, Human
gcagcugauggaaguccuauug

SEQ ID NO: 1013785 - RNA, 22 nt, Human
cugccagcagaggccagcgcug

SEQ ID NO: 1013786 - RNA, 22 nt, Human
agcagagcggggccuccggaag

SEQ ID NO: 1013787 - RNA, 22 nt, Human
cccugcaguccuuucuuggcuc

SEQ ID NO: 1013788 - RNA, 22 nt, Human
aucagugcuaaagcaaaugccc

SEQ ID NO: 1013789 - RNA, 22 nt, Human
guggccuggaugagcuucgaca

SEQ ID NO: 1013790 - RNA, 22 nt, Human
ggaugcugcuaucaggcuucga

SEQ ID NO: 1013791 - RNA, 22 nt, Human
ucacaugaguauuauuuuccaa

SEQ ID NO: 1013792 - RNA, 22 nt, Human
cccauuuagauaacaguucaaa

SEQ ID NO: 1013793 - RNA, 22 nt, Human
uuuuccuacugauaaacaguua

SEQ ID NO: 1013794 - RNA, 17 nt, Human
acaggcagaucaccuga

SEQ ID NO: 1013795 - RNA, 22 nt, Human
augcugucgaaaccaaacaucu

SEQ ID NO: 1013796 - RNA, 22 nt, Human
ggagagugggagcaacuguugc

SEQ ID NO: 1013797 - RNA, 22 nt, Human
cuguggagugcuuggcucagug

SEQ ID NO: 1013798 - RNA, 22 nt, Human
gcuuccaaaucuguucaaaaug

SEQ ID NO: 1013799 - RNA, 22 nt, Human
gaacagaagaggcuggugccac

SEQ ID NO: 1013800 - RNA, 22 nt, Human
auucuaggcuugaaacaugaag

SEQ ID NO: 1013801 - RNA, 22 nt, Human
uccugggcccaggcugccaggg

SEQ ID NO: 1013802 - RNA, 22 nt, Human
cuguauuuaguuaaaaugcuaa

SEQ ID NO: 1013803 - RNA, 22 nt, Human
aauguacaauaagacaaagagg

SEQ ID NO: 1013804 - RNA, 22 nt, Human
auuuucauuuugcagggugaga

SEQ ID NO: 1013805 - RNA, 22 nt, Human
aggccaaguagcuagcauugaa

SEQ ID NO: 1013806 - RNA, 23 nt, Human
caggacaugggaggaaguauggc

SEQ ID NO: 1013807 - RNA, 22 nt, Human
ggcuugcuucuuguccaggaau

SEQ ID NO: 1013808 - RNA, 22 nt, Human
cagccaucaguaaagacagcuu

SEQ ID NO: 1013809 - RNA, 22 nt, Human
cccugcagcauucucuaacugg

SEQ ID NO: 1013810 - RNA, 22 nt, Human
agcaaaguagcugcuguucuua

SEQ ID NO: 1013811 - RNA, 21 nt, Human
gcacagugccaggcacacagu

SEQ ID NO: 1013812 - RNA, 22 nt, Human
uucaacuaauguuuauuuuaug

SEQ ID NO: 1013813 - RNA, 22 nt, Human
gaaauaagaguccaugccaggu

SEQ ID NO: 1013814 - RNA, 22 nt, Human
ucugaaggugcuagagaaagcu

SEQ ID NO: 1013815 - RNA, 22 nt, Human
ccagcuccagguagaugggcag

SEQ ID NO: 1013816 - RNA, 22 nt, Human
caaauguguuuuuucuucuaca

SEQ ID NO: 1013817 - RNA, 22 nt, Human
cugcuucugggaugauggagua

SEQ ID NO: 1013818 - RNA, 22 nt, Human
aagccucaccuuuuagaagcua

SEQ ID NO: 1013819 - RNA, 22 nt, Human
cagcuuuaguaacccacugcuc

SEQ ID NO: 1013820 - RNA, 21 nt, Human
uaaaucucuguauucuucagu

SEQ ID NO: 1013821 - RNA, 22 nt, Human
agccccaggcccggacgccucu

SEQ ID NO: 1013822 - RNA, 22 nt, Human
aaaggccaccaacaugaagcau

SEQ ID NO: 1013823 - RNA, 22 nt, Human
acugccuugucucuugccuguu

SEQ ID NO: 1013824 - RNA, 22 nt, Human
ucuggagcuuccucauuuacag

SEQ ID NO: 1013825 - RNA, 22 nt, Human
auuuguaauuucuuaucugugu

SEQ ID NO: 1013826 - RNA, 22 nt, Human
uuuguuaaauauuuauugagug

SEQ ID NO: 1013827 - RNA, 22 nt, Human
uauuugaaaguguacaaaaacu

SEQ ID NO: 1013828 - RNA, 22 nt, Human
ggcucuggguucugcaaugcgu

SEQ ID NO: 1013829 - RNA, 22 nt, Human
aauauuuguuaguguuuuaaug

SEQ ID NO: 1013830 - RNA, 22 nt, Human
cagcaggcucugaguggcugcc

SEQ ID NO: 1013831 - RNA, 22 nt, Human
cugcaggggcuggaguuggcuu

SEQ ID NO: 1013832 - RNA, 22 nt, Human
aggggccugguuggccucuguu

SEQ ID NO: 1013833 - RNA, 22 nt, Human
aaagcucuuauagcagagugug

SEQ ID NO: 1013834 - RNA, 19 nt, Human
acuggcaguuucugcaugg

SEQ ID NO: 1013835 - RNA, 22 nt, Human
aagauggagcacgagcagaagc

SEQ ID NO: 1013836 - RNA, 22 nt, Human
gcugcugucacggugcuaaggg

SEQ ID NO: 1013837 - RNA, 22 nt, Human
uccuugaauugugccacuuacc

SEQ ID NO: 1013838 - RNA, 22 nt, Human
agcccuccucacaucagcgucc

SEQ ID NO: 1013839 - RNA, 22 nt, Human
uucaagaucgaguuuaaaguga

SEQ ID NO: 1013840 - RNA, 22 nt, Human
ugcugaaaacucaaccauugug

SEQ ID NO: 1013841 - RNA, 22 nt, Human
ggcugggcucgcugauuggcug

SEQ ID NO: 1013842 - RNA, 19 nt, Human
uguguguuuauauauguau

SEQ ID NO: 1013843 - RNA, 22 nt, Human
ugcuuaaaaugaugauuauuuu

SEQ ID NO: 1013844 - RNA, 22 nt, Human
agggaguuagaaauccaggaua

SEQ ID NO: 1013845 - RNA, 22 nt, Human
aaaaguguccagauuaugaaga

SEQ ID NO: 1013846 - RNA, 22 nt, Human
gccagacacuccccugggcagg

SEQ ID NO: 1013847 - RNA, 22 nt, Human
cauuuauucauuugcuagggcu

SEQ ID NO: 1013848 - RNA, 22 nt, Human
agaacagaggccuuauguuuca

SEQ ID NO: 1013849 - RNA, 22 nt, Human
uauugaguuacagaaaauacuu

SEQ ID NO: 1013850 - RNA, 23 nt, Human
acuuuagauaaauuaugugcaca

SEQ ID NO: 1013851 - RNA, 21 nt, Human
agagaagggacucuuccaguc

SEQ ID NO: 1013852 - RNA, 19 nt, Human
cucagagaggggcagugcc

SEQ ID NO: 1013853 - RNA, 22 nt, Human
auaugcaagcacauagaauacu

SEQ ID NO: 1013854 - RNA, 22 nt, Human
uccaaggcauagacacagugcc

SEQ ID NO: 1013855 - RNA, 20 nt, Human
gucugaggagcagugggaaa

SEQ ID NO: 1013856 - RNA, 22 nt, Human
ucugucacucuagagauggcag

SEQ ID NO: 1013857 - RNA, 22 nt, Human
ggcuggccuguguggccgccac

SEQ ID NO: 1013858 - RNA, 22 nt, Human
agcugucuuucugccuccugau

SEQ ID NO: 1013859 - RNA, 22 nt, Human
uagaaaugcccagauucugcua

SEQ ID NO: 1013860 - RNA, 22 nt, Human
aagggcucuucuauuuauggcc

SEQ ID NO: 1013861 - RNA, 22 nt, Human
auuguacuuuuauuacauguag

SEQ ID NO: 1013862 - RNA, 21 nt, Human
ugaagccugaggcauagcccc

SEQ ID NO: 1013863 - RNA, 22 nt, Human
ugaggcacaggcagugcccccg

SEQ ID NO: 1013864 - RNA, 22 nt, Human
auguccagagccggccugcuga

SEQ ID NO: 1013865 - RNA, 22 nt, Human
gccaggcagacaggucaucagg

SEQ ID NO: 1013866 - RNA, 20 nt, Human
agaauucuuacccuuugaug

SEQ ID NO: 1013867 - RNA, 22 nt, Human
cuuucauuugauaagaaugcca

SEQ ID NO: 1013868 - RNA, 20 nt, Human
gcaaauggaucccacaagcc

SEQ ID NO: 1013869 - RNA, 20 nt, Human
ucaggcaguggggaaaggca

SEQ ID NO: 1013870 - RNA, 22 nt, Human
uuuccucuucgauuaaguuugg

SEQ ID NO: 1013871 - RNA, 22 nt, Human
acacagggauauuucagguggu

SEQ ID NO: 1013872 - RNA, 22 nt, Human
gugucccaaucuacuuuucccu

SEQ ID NO: 1013873 - RNA, 22 nt, Human
gccaggguggcagaaggcccca

SEQ ID NO: 1013874 - RNA, 22 nt, Human
gcccucuggcagccuuggcugg

SEQ ID NO: 1013875 - RNA, 22 nt, Human
ucucuggggauggaccugggag

SEQ ID NO: 1013876 - RNA, 22 nt, Human
ucacacguccuugcuacuccuc

SEQ ID NO: 1013877 - RNA, 22 nt, Human
aguggggucuccuccagccccc

SEQ ID NO: 1013878 - RNA, 22 nt, Human
auguauuucuauguagugaaga

SEQ ID NO: 1013879 - RNA, 22 nt, Human
caggcugggacugaccccugcu

SEQ ID NO: 1013880 - RNA, 22 nt, Human
agaaaguuuugugcuauauaug

SEQ ID NO: 1013881 - RNA, 22 nt, Human
acuguucauccuuuuugaacaa

SEQ ID NO: 1013882 - RNA, 22 nt, Human
cauugcacuccagcuugggcaa

SEQ ID NO: 1013883 - RNA, 22 nt, Human
ggcugcagagcugggugggccu

SEQ ID NO: 1013884 - RNA, 22 nt, Human
ugagccuggagucguggagggg

SEQ ID NO: 1013885 - RNA, 22 nt, Human
gccucugcgccucagccgaccu

SEQ ID NO: 1013886 - RNA, 23 nt, Human
aauguauguuaguaucuuagaga

SEQ ID NO: 1013887 - RNA, 19 nt, Human
ucaaugcaugaaaucagcc

SEQ ID NO: 1013888 - RNA, 22 nt, Human
ccuccugggacaggcuggcaca

SEQ ID NO: 1013889 - RNA, 22 nt, Human
aggcccugcccagagcuccucg

SEQ ID NO: 1013890 - RNA, 22 nt, Human
aacuuucagcaaguaauucugg

SEQ ID NO: 1013891 - RNA, 22 nt, Human
uagcacaucuucuuggccugca

SEQ ID NO: 1013892 - RNA, 22 nt, Human
gaggcaugucuggccuguccca

SEQ ID NO: 1013893 - RNA, 22 nt, Human
ugcauuguugaauauuucauag

SEQ ID NO: 1013894 - RNA, 22 nt, Human
cuggcagcuggaggcuagaggc

SEQ ID NO: 1013895 - RNA, 17 nt, Human
gccaaaggguuccaauc

SEQ ID NO: 1013896 - RNA, 22 nt, Human
accccaagacaguagaagagaa

SEQ ID NO: 1013897 - RNA, 22 nt, Human
ugaaaucugucccacuuuagcu

SEQ ID NO: 1013898 - RNA, 22 nt, Human
gcugcccuaauaucacauguua

SEQ ID NO: 1013899 - RNA, 22 nt, Human
ugccucuguggaaauggugguc

SEQ ID NO: 1013900 - RNA, 22 nt, Human
gcacugggggcagcagugaggg

SEQ ID NO: 1013901 - RNA, 22 nt, Human
gaggggcucuugggcaugaagg

SEQ ID NO: 1013902 - RNA, 22 nt, Human
ugccuggcaagaggggcuggcu

SEQ ID NO: 1013903 - RNA, 22 nt, Human
gcaaggaccuuugagcgugcca

SEQ ID NO: 1013904 - RNA, 22 nt, Human
agacagcaugauacaugaugcu

SEQ ID NO: 1013905 - RNA, 22 nt, Human
ucuguucacugagcaauggcaa

SEQ ID NO: 1013906 - RNA, 19 nt, Human
uacuuuuucaggacagagu

SEQ ID NO: 1013907 - RNA, 22 nt, Human
ucuuggagacucuuguauauuu

SEQ ID NO: 1013908 - RNA, 22 nt, Human
gcagcuuuaaucugaauaagua

SEQ ID NO: 1013909 - RNA, 22 nt, Human
gauuuccuugcauauugguaau

SEQ ID NO: 1013910 - RNA, 22 nt, Human
gaggaggaaacccuguuccucu

SEQ ID NO: 1013911 - RNA, 22 nt, Human
aggcuggcgucaggggcuguac

SEQ ID NO: 1013912 - RNA, 22 nt, Human
uggcagagaugaagaguuguuu

SEQ ID NO: 1013913 - RNA, 22 nt, Human
ccuggcagucaggggaguccuu

SEQ ID NO: 1013914 - RNA, 22 nt, Human
acagcuuuaguguggguggugc

SEQ ID NO: 1013915 - RNA, 22 nt, Human
gcugugugaaaacugggccugg

SEQ ID NO: 1013916 - RNA, 22 nt, Human
ugaggaugacgauggcaauggc

SEQ ID NO: 1013917 - RNA, 22 nt, Human
ugaggccacuuccccacagccc

SEQ ID NO: 1013918 - RNA, 22 nt, Human
augcuguguuuuaaauggaaau

SEQ ID NO: 1013919 - RNA, 22 nt, Human
ucucagagcucacaccuccugg

SEQ ID NO: 1013920 - RNA, 22 nt, Human
agagccuggucugagauaggac

SEQ ID NO: 1013921 - RNA, 22 nt, Human
ugugaaagucaaauuaauugaa

SEQ ID NO: 1013922 - RNA, 22 nt, Human
cagaggcugggaccucaggcau

SEQ ID NO: 1013923 - RNA, 23 nt, Human
cccuguagcccaggacaggcuuu

SEQ ID NO: 1013924 - RNA, 22 nt, Human
gcuuuguguagaaggaggaugg

SEQ ID NO: 1013925 - RNA, 22 nt, Human
aacaaucaaguuucuaaaugac

SEQ ID NO: 1013926 - RNA, 22 nt, Human
ccugcagguugcagaggcggaa

SEQ ID NO: 1013927 - RNA, 22 nt, Human
uaugaguacaaggacucugucu

SEQ ID NO: 1013928 - RNA, 22 nt, Human
guguguccucaguaguggcaug

SEQ ID NO: 1013929 - RNA, 22 nt, Human
uugcuuccucgaggccagcgug

SEQ ID NO: 1013930 - RNA, 22 nt, Human
uuuugaaagccagguuuguaug

SEQ ID NO: 1013931 - RNA, 22 nt, Human
aacagacaacuccuguggcuca

SEQ ID NO: 1013932 - RNA, 22 nt, Human
auauucuucuuguucagacuau

SEQ ID NO: 1013933 - RNA, 22 nt, Human
cauuuucucaaugaacccucuu

SEQ ID NO: 1013934 - RNA, 22 nt, Human
agccacaccuguccugccagcu

SEQ ID NO: 1013935 - RNA, 22 nt, Human
ccugucagcugauggcuaugua

SEQ ID NO: 1013936 - RNA, 22 nt, Human
aucugucaucagcaccacaggu

SEQ ID NO: 1013937 - RNA, 22 nt, Human
agucuacaaucuuaaaugaacu

SEQ ID NO: 1013938 - RNA, 22 nt, Human
uauguacacacacaugcaugua

SEQ ID NO: 1013939 - RNA, 22 nt, Human
cccagggaagggcuaccugagg

SEQ ID NO: 1013940 - RNA, 22 nt, Human
aaaauaucagcaaagggugaca

SEQ ID NO: 1013941 - RNA, 22 nt, Human
ccagucagccaagcugcagcgg

SEQ ID NO: 1013942 - RNA, 22 nt, Human
uauagaaguaagcauugugaug

SEQ ID NO: 1013943 - RNA, 22 nt, Human
cuuacauuaaguaagagauuga

SEQ ID NO: 1013944 - RNA, 22 nt, Human
uugcagggcaggaccauggaca

SEQ ID NO: 1013945 - RNA, 22 nt, Human
uguccucacaggaaugaacuuu

SEQ ID NO: 1013946 - RNA, 22 nt, Human
ggagggagucagcugauuagaa

SEQ ID NO: 1013947 - RNA, 22 nt, Human
ucucuggaguauaaccagggau

SEQ ID NO: 1013948 - RNA, 22 nt, Human
ggaggccaucuggcuggaggcu

SEQ ID NO: 1013949 - RNA, 19 nt, Human
uccaggcauccuucaggcu

SEQ ID NO: 1013950 - RNA, 19 nt, Human
uuugaaaggauuguuauuu

SEQ ID NO: 1013951 - RNA, 22 nt, Human
cugcccuguggcucugagucau

SEQ ID NO: 1013952 - RNA, 22 nt, Human
gcugucuggaggcucugaggga

SEQ ID NO: 1013953 - RNA, 22 nt, Human
cagcugcaguucaaugcuugcu

SEQ ID NO: 1013954 - RNA, 22 nt, Human
uagauuuccucuuccucauucc

SEQ ID NO: 1013955 - RNA, 22 nt, Human
ugggugagugggaaaagcccag

SEQ ID NO: 1013956 - RNA, 22 nt, Human
guuauaaauaccuaauaggauu

SEQ ID NO: 1013957 - RNA, 22 nt, Human
ccaaguacucucaccaaagcuu

SEQ ID NO: 1013958 - RNA, 22 nt, Human
cagaggaggccaccgcauaggc

SEQ ID NO: 1013959 - RNA, 22 nt, Human
ggcaaaaaguucccaucagugu

SEQ ID NO: 1013960 - RNA, 22 nt, Human
cuggccaggcucucacgugguc

SEQ ID NO: 1013961 - RNA, 22 nt, Human
auacuuucugaccaauuaauug

SEQ ID NO: 1013962 - RNA, 22 nt, Human
uuucuagaggcuccaggggagu

SEQ ID NO: 1013963 - RNA, 22 nt, Human
gccaguuccuguggagucagag

SEQ ID NO: 1013964 - RNA, 22 nt, Human
agccuucaaccuagcuagagca

SEQ ID NO: 1013965 - RNA, 22 nt, Human
agagcuguucaacguagcaaug

SEQ ID NO: 1013966 - RNA, 22 nt, Human
uuacaguuuaguccaagccaga

SEQ ID NO: 1013967 - RNA, 22 nt, Human
uaaguucaaugaacucaguucu

SEQ ID NO: 1013968 - RNA, 22 nt, Human
uucaagaucuuccaaaggauac

SEQ ID NO: 1013969 - RNA, 22 nt, Human
aauacuuuccuauauaaggugc

SEQ ID NO: 1013970 - RNA, 23 nt, Human
uggcucugagcuuccugguggcc

SEQ ID NO: 1013971 - RNA, 22 nt, Human
ugcuguggcaguuuauguauag

SEQ ID NO: 1013972 - RNA, 23 nt, Human
gccugggacucaggaggagcuca

SEQ ID NO: 1013973 - RNA, 22 nt, Human
gcagcuuuaaaggaggcucuga

SEQ ID NO: 1013974 - RNA, 22 nt, Human
uccugggccuguacuccauccg

SEQ ID NO: 1013975 - RNA, 22 nt, Human
cagagacuggagugcaguggcg

SEQ ID NO: 1013976 - RNA, 22 nt, Human
cagcuccucacgagucuugaaa

SEQ ID NO: 1013977 - RNA, 22 nt, Human
cagccagccucucaaccaugca

SEQ ID NO: 1013978 - RNA, 22 nt, Human
uguuccuaaauaugaauggaga

SEQ ID NO: 1013979 - RNA, 22 nt, Human
ugcaggcuguaaucugaggcua

SEQ ID NO: 1013980 - RNA, 22 nt, Human
acuguucacagauuagucgaug

SEQ ID NO: 1013981 - RNA, 22 nt, Human
gcuguauuccugcacuguauag

SEQ ID NO: 1013982 - RNA, 22 nt, Human
gcaaggacucccugggucauuc

SEQ ID NO: 1013983 - RNA, 18 nt, Human
ugagaggcagguagagga

SEQ ID NO: 1013984 - RNA, 22 nt, Human
gcagugacagggcugcugccuu

SEQ ID NO: 1013985 - RNA, 22 nt, Human
uucuacaugguugcucagaggg

SEQ ID NO: 1013986 - RNA, 22 nt, Human
uaguaucuuucuauauuuccca

SEQ ID NO: 1013987 - RNA, 22 nt, Human
ucuugauuacaaauaacaucau

SEQ ID NO: 1013988 - RNA, 22 nt, Human
uuuuucuugugcuggaucuaau

SEQ ID NO: 1013989 - RNA, 22 nt, Human
agcaccugcacaguggaggaaa

SEQ ID NO: 1013990 - RNA, 22 nt, Human
acagaauuaucaggaaauguua

SEQ ID NO: 1013991 - RNA, 22 nt, Human
uccagagccuauauguucaacu

SEQ ID NO: 1013992 - RNA, 20 nt, Human
cauuugaaucuccauucugc

SEQ ID NO: 1013993 - RNA, 22 nt, Human
cugccuuggaaaaugugguaau

SEQ ID NO: 1013994 - RNA, 22 nt, Human
ggcucagaaacuaaaggcgcug

SEQ ID NO: 1013995 - RNA, 22 nt, Human
cacugaagccacuggaagagga

SEQ ID NO: 1013996 - RNA, 19 nt, Human
gaguuauugccagggcaug

SEQ ID NO: 1013997 - RNA, 22 nt, Human
ugggcagaggcagcagaaaccu

SEQ ID NO: 1013998 - RNA, 22 nt, Human
cuguuuucaaagagagagaaug

SEQ ID NO: 1013999 - RNA, 22 nt, Human
uggaguuccuuugaaaggcucu

SEQ ID NO: 1014000 - RNA, 22 nt, Human
ccaggcuggauuuugcaguuca

SEQ ID NO: 1014001 - RNA, 22 nt, Human
uggcacugagcagccgcggcag

SEQ ID NO: 1014002 - RNA, 22 nt, Human
uuagaaaggagcuuauuucuuu

SEQ ID NO: 1014003 - RNA, 22 nt, Human
gcugggcuugguuucccugcuu

SEQ ID NO: 1014004 - RNA, 18 nt, Human
ugcuuuaugcuuauauaa

SEQ ID NO: 1014005 - RNA, 22 nt, Human
auuuucugguugagguuuaaca

SEQ ID NO: 1014006 - RNA, 22 nt, Human
ugcaguggaagagguggagauc

SEQ ID NO: 1014007 - RNA, 22 nt, Human
acauacuaugaauacauguguc

SEQ ID NO: 1014008 - RNA, 21 nt, Human
ucuagaauccuguauaagacu

SEQ ID NO: 1014009 - RNA, 19 nt, Human
uggggcuguguuuugaccc

SEQ ID NO: 1014010 - RNA, 22 nt, Human
ccuggcagcauugguagagauu

SEQ ID NO: 1014011 - RNA, 22 nt, Human
uaacagaauagcagaaacagaa

SEQ ID NO: 1014012 - RNA, 22 nt, Human
aaacacaccuuuggaacuguga

SEQ ID NO: 1014013 - RNA, 22 nt, Human
agagcccuuucuccaggcaccu

SEQ ID NO: 1014014 - RNA, 22 nt, Human
ccuggcacgaagggcugagguu

SEQ ID NO: 1014015 - RNA, 22 nt, Human
uaugaaacauucauacaaauaa

SEQ ID NO: 1014016 - RNA, 22 nt, Human
ucccagauuguugauggcuuaa

SEQ ID NO: 1014017 - RNA, 22 nt, Human
gccugccuggagcuugagguga

SEQ ID NO: 1014018 - RNA, 23 nt, Human
acacaaggguaacugccagccau

SEQ ID NO: 1014019 - RNA, 22 nt, Human
aaaauauuuuagggccaggaga

SEQ ID NO: 1014020 - RNA, 22 nt, Human
augggaggaucacuugaggcca

SEQ ID NO: 1014021 - RNA, 22 nt, Human
aacaaaugauuguugguuggag

SEQ ID NO: 1014022 - RNA, 22 nt, Human
uaaugucaaggugauagauuug

SEQ ID NO: 1014023 - RNA, 22 nt, Human
ucagugucuugggcuugaaugc

SEQ ID NO: 1014024 - RNA, 22 nt, Human
aaagccuugcccgucacuggga

SEQ ID NO: 1014025 - RNA, 22 nt, Human
gcugccuggagcucagccugcc

SEQ ID NO: 1014026 - RNA, 22 nt, Human
aggugaaguugaggaggcagaa

SEQ ID NO: 1014027 - RNA, 22 nt, Human
aucucuguaaaccauaaauuga

SEQ ID NO: 1014028 - RNA, 17 nt, Human
uuucagauucacuuucu

SEQ ID NO: 1014029 - RNA, 22 nt, Human
uuuauucugugcuacaugaaga

SEQ ID NO: 1014030 - RNA, 22 nt, Human
ccagcugcgggcaucgagaguu

SEQ ID NO: 1014031 - RNA, 22 nt, Human
gcagggucuugagaggcagcca

SEQ ID NO: 1014032 - RNA, 22 nt, Human
caugaagcauguuuugucauga

SEQ ID NO: 1014033 - RNA, 21 nt, Human
ggcccugguuacgccuccucu

SEQ ID NO: 1014034 - RNA, 22 nt, Human
cucagagcccaggguacacccg

SEQ ID NO: 1014035 - RNA, 23 nt, Human
gcagacagagcagacuaagacaa

SEQ ID NO: 1014036 - RNA, 22 nt, Human
cuggggcuucaaugcuucggug

SEQ ID NO: 1014037 - RNA, 22 nt, Human
cccagagccucauucuguuggg

SEQ ID NO: 1014038 - RNA, 22 nt, Human
gagcucuggguggcaggugucu

SEQ ID NO: 1014039 - RNA, 21 nt, Human
agggagcuauuuauaguaagc

SEQ ID NO: 1014040 - RNA, 22 nt, Human
aggccucuucagggagcaugga

SEQ ID NO: 1014041 - RNA, 22 nt, Human
uccucaggucaaagcaggagaa

SEQ ID NO: 1014042 - RNA, 22 nt, Human
uauuucugauugcucaugaggc

SEQ ID NO: 1014043 - RNA, 22 nt, Human
cuccagugcacccagaggauuu

SEQ ID NO: 1014044 - RNA, 22 nt, Human
cuucacauguuggaguccuuug

SEQ ID NO: 1014045 - RNA, 20 nt, Human
uuucugugcccaggucuguu

SEQ ID NO: 1014046 - RNA, 22 nt, Human
cagagcucagagcugccaggca

SEQ ID NO: 1014047 - RNA, 22 nt, Human
agggcagaaaccaccuugaugg

SEQ ID NO: 1014048 - RNA, 22 nt, Human
agucucagaaaauaugcuuuuu

SEQ ID NO: 1014049 - RNA, 22 nt, Human
ccugggcagggcuggacucuca

SEQ ID NO: 1014050 - RNA, 22 nt, Human
cugagaggugacagcgugcugg

SEQ ID NO: 1014051 - RNA, 22 nt, Human
cauguuaauaugcauugaguac

SEQ ID NO: 1014052 - RNA, 22 nt, Human
uugaaggaggcuccuuuuuaaa

SEQ ID NO: 1014053 - RNA, 22 nt, Human
ucagggcagguuaacuugggug

SEQ ID NO: 1014054 - RNA, 22 nt, Human
aggcacugguccauuuucugca

SEQ ID NO: 1014055 - RNA, 22 nt, Human
ucagggcaaagggcagaguuug

SEQ ID NO: 1014056 - RNA, 18 nt, Human
gcugucugaggucugagg

SEQ ID NO: 1014057 - RNA, 22 nt, Human
gcaggccucuguugagggccuu

SEQ ID NO: 1014058 - RNA, 22 nt, Human
uuucacaaaugucuuuaacuug

SEQ ID NO: 1014059 - RNA, 22 nt, Human
gcaggcaguuauuuaguagaau

SEQ ID NO: 1014060 - RNA, 22 nt, Human
gccuugccucagccauggaaac

SEQ ID NO: 1014061 - RNA, 22 nt, Human
aauaugugagguauguucagug

SEQ ID NO: 1014062 - RNA, 22 nt, Human
uucucagugaaguuuagaacau

SEQ ID NO: 1014063 - RNA, 22 nt, Human
uccuggguccauggcagccgaa

SEQ ID NO: 1014064 - RNA, 22 nt, Human
ucaggaugagcucauaacuaug

SEQ ID NO: 1014065 - RNA, 22 nt, Human
agggagagguugaaaccucagu

SEQ ID NO: 1014066 - RNA, 22 nt, Human
uauuuagaaugcguguacgugu

SEQ ID NO: 1014067 - RNA, 21 nt, Human
ccaggcagagcugugaguucu

SEQ ID NO: 1014068 - RNA, 22 nt, Human
gauguuucaugcuagcaugugu

SEQ ID NO: 1014069 - RNA, 22 nt, Human
ccaucagcaugggagcaugggc

SEQ ID NO: 1014070 - RNA, 22 nt, Human
cuguggaguuuguggcgcugac

SEQ ID NO: 1014071 - RNA, 22 nt, Human
aguucucaagacaauuaccugu

SEQ ID NO: 1014072 - RNA, 22 nt, Human
uuaaagaugcagcuuuagagaa

SEQ ID NO: 1014073 - RNA, 22 nt, Human
cagggccugcuuccuucuuguu

SEQ ID NO: 1014074 - RNA, 22 nt, Human
agcagcaggagccgugggguga

SEQ ID NO: 1014075 - RNA, 17 nt, Human
ugaaggccaugaccacg

SEQ ID NO: 1014076 - RNA, 22 nt, Human
aucaggauuauuaaaucuggau

SEQ ID NO: 1014077 - RNA, 22 nt, Human
gcucugagcacugugcggcugg

SEQ ID NO: 1014078 - RNA, 22 nt, Human
ccugggagcuguggaaaggcug

SEQ ID NO: 1014079 - RNA, 22 nt, Human
cuucaagagaaugcagggaugu

SEQ ID NO: 1014080 - RNA, 22 nt, Human
gccugccugcugugugcaaguu

SEQ ID NO: 1014081 - RNA, 22 nt, Human
aggcccugagaaaaucccugca

SEQ ID NO: 1014082 - RNA, 22 nt, Human
ugcccagcacugugccagucac

SEQ ID NO: 1014083 - RNA, 22 nt, Human
guagggacaauauguuauuaga

SEQ ID NO: 1014084 - RNA, 22 nt, Human
guacauguugguuguuuccagu

SEQ ID NO: 1014085 - RNA, 22 nt, Human
uuaugcaaaggggccucuuccu

SEQ ID NO: 1014086 - RNA, 22 nt, Human
augucuuuggcuuugacauggc

SEQ ID NO: 1014087 - RNA, 23 nt, Human
ggcacugaagcuacaauggugag

SEQ ID NO: 1014088 - RNA, 22 nt, Human
ccuggcagacugugagggcagg

SEQ ID NO: 1014089 - RNA, 22 nt, Human
cugggcaguuuuacaucauugc

SEQ ID NO: 1014090 - RNA, 22 nt, Human
ugagccuggccugcagagacca

SEQ ID NO: 1014091 - RNA, 22 nt, Human
uacaguagaauuuuuaguaacu

SEQ ID NO: 1014092 - RNA, 22 nt, Human
ccaggccauucccagaguugcu

SEQ ID NO: 1014093 - RNA, 22 nt, Human
guggccagcaagugcugccucu

SEQ ID NO: 1014094 - RNA, 22 nt, Human
ccugcuucagggaugauggcac

SEQ ID NO: 1014095 - RNA, 22 nt, Human
uguagcacagagcuuugacacu

SEQ ID NO: 1014096 - RNA, 22 nt, Human
gccaggcaugggcuucugggcg

SEQ ID NO: 1014097 - RNA, 22 nt, Human
ugccagccagguucugaggcua

SEQ ID NO: 1014098 - RNA, 22 nt, Human
aucugucuugccuugcauauuu

SEQ ID NO: 1014099 - RNA, 22 nt, Human
acaggacuguggaaggaucucu

SEQ ID NO: 1014100 - RNA, 22 nt, Human
cagcuggcuccaccucugggcu

SEQ ID NO: 1014101 - RNA, 22 nt, Human
gauaccagacagggagggagaa

SEQ ID NO: 1014102 - RNA, 19 nt, Human
agucccaggcccgaaagag

SEQ ID NO: 1014103 - RNA, 22 nt, Human
gaccaaggaagaggggagccag

SEQ ID NO: 1014104 - RNA, 22 nt, Human
ccagccuggacugggucuugug

SEQ ID NO: 1014105 - RNA, 22 nt, Human
ucagagaguuggaaagaauuaa

SEQ ID NO: 1014106 - RNA, 22 nt, Human
aaaugcuugcucuugauuauuu

SEQ ID NO: 1014107 - RNA, 22 nt, Human
caucacccggaacugugucugc

SEQ ID NO: 1014108 - RNA, 22 nt, Human
uagcuuuccuuguugccugugc

SEQ ID NO: 1014109 - RNA, 22 nt, Human
ggguccagacacuccagaggaa

SEQ ID NO: 1014110 - RNA, 22 nt, Human
accaucaguacuggaugcugac

SEQ ID NO: 1014111 - RNA, 22 nt, Human
uucuucaaaauccagcaugauu

SEQ ID NO: 1014112 - RNA, 22 nt, Human
guggagacuucuacuagagacc

SEQ ID NO: 1014113 - RNA, 22 nt, Human
gggcugacaccacccaggcgca

SEQ ID NO: 1014114 - RNA, 22 nt, Human
cucuggaguucucaugaggaac

SEQ ID NO: 1014115 - RNA, 19 nt, Human
cagcugccuuuucuuugca

SEQ ID NO: 1014116 - RNA, 22 nt, Human
gaaacuuacuuacucacauuuc

SEQ ID NO: 1014117 - RNA, 22 nt, Human
uuguccuuaccucaaucuggaa

SEQ ID NO: 1014118 - RNA, 22 nt, Human
uaaauucccaacucugcucuuc

SEQ ID NO: 1014119 - RNA, 22 nt, Human
aaaguuguucaguaagaaacuc

SEQ ID NO: 1014120 - RNA, 22 nt, Human
uauguuaaauguuugauguuua

SEQ ID NO: 1014121 - RNA, 22 nt, Human
ugaagcaggugaauggaugucg

SEQ ID NO: 1014122 - RNA, 22 nt, Human
gagcuggcuccgccaugcugcu

SEQ ID NO: 1014123 - RNA, 22 nt, Human
aggcaguggcugagaccagggg

SEQ ID NO: 1014124 - RNA, 22 nt, Human
ggcuucagugacuggugcccuc

SEQ ID NO: 1014125 - RNA, 22 nt, Human
guuaauuugcagcuuucgagcu

SEQ ID NO: 1014126 - RNA, 22 nt, Human
agauggggcucaguguggaggc

SEQ ID NO: 1014127 - RNA, 22 nt, Human
gccaccagguuagauccagccu

SEQ ID NO: 1014128 - RNA, 22 nt, Human
aagaacaacugcuuuaaaagca

SEQ ID NO: 1014129 - RNA, 20 nt, Human
agggucaguagcacagagcu

SEQ ID NO: 1014130 - RNA, 22 nt, Human
ccugggagguggauguugcggu

SEQ ID NO: 1014131 - RNA, 22 nt, Human
cacuggggaaaacaggcuucuu

SEQ ID NO: 1014132 - RNA, 22 nt, Human
gauuuuucaguauaaaauauau

SEQ ID NO: 1014133 - RNA, 22 nt, Human
aucuguuccccuaugcucucua

SEQ ID NO: 1014134 - RNA, 22 nt, Human
uacaacauuguguugcuucaua

SEQ ID NO: 1014135 - RNA, 22 nt, Human
uagcauuuauuccagauuugga

SEQ ID NO: 1014136 - RNA, 22 nt, Human
cuuucauucuuagauauuagug

SEQ ID NO: 1014137 - RNA, 22 nt, Human
ccagcuuuaucaagucugagcu

SEQ ID NO: 1014138 - RNA, 21 nt, Human
ggccugaguauaggacaggcc

SEQ ID NO: 1014139 - RNA, 22 nt, Human
aaggcuaugaucuuuuucauga

SEQ ID NO: 1014140 - RNA, 22 nt, Human
uucauacacgaaaaugcaugca

SEQ ID NO: 1014141 - RNA, 22 nt, Human
agcagagaagacacaggcuuca

SEQ ID NO: 1014142 - RNA, 22 nt, Human
cacuggaauauggcguugaacc

SEQ ID NO: 1014143 - RNA, 23 nt, Human
auggagcugguacuagcuaccuc

SEQ ID NO: 1014144 - RNA, 22 nt, Human
uuucauuuugguuaugccauaa

SEQ ID NO: 1014145 - RNA, 22 nt, Human
gggcugggcaugguguucccuc

SEQ ID NO: 1014146 - RNA, 22 nt, Human
ccagggcagcgccccuccacgc

SEQ ID NO: 1014147 - RNA, 22 nt, Human
cagcauuuggaggagaggcuuu

SEQ ID NO: 1014148 - RNA, 22 nt, Human
ccugugugcugaugacgacaga

SEQ ID NO: 1014149 - RNA, 22 nt, Human
gggaggucagggugccugcugg

SEQ ID NO: 1014150 - RNA, 22 nt, Human
aaugauggucauggcaacuuuu

SEQ ID NO: 1014151 - RNA, 22 nt, Human
cagggcaggaauuugacauugc

SEQ ID NO: 1014152 - RNA, 22 nt, Human
cuggguaaguuccuaaggcuca

SEQ ID NO: 1014153 - RNA, 22 nt, Human
agcuggugcugaagcucuugag

SEQ ID NO: 1014154 - RNA, 22 nt, Human
ucccagagcaguacuccaggag

SEQ ID NO: 1014155 - RNA, 20 nt, Human
aggcacuguugucuguaucc

SEQ ID NO: 1014156 - RNA, 22 nt, Human
aagccaggggcugcuuaggaga

SEQ ID NO: 1014157 - RNA, 22 nt, Human
auuauauaggacuugcccuucc

SEQ ID NO: 1014158 - RNA, 18 nt, Human
aucucccauuggccaagg

SEQ ID NO: 1014159 - RNA, 22 nt, Human
uucaggaugaaagugugcaaca

SEQ ID NO: 1014160 - RNA, 22 nt, Human
aacauuucagcaaauaagaaca

SEQ ID NO: 1014161 - RNA, 22 nt, Human
augcuguggccagaguucaacu

SEQ ID NO: 1014162 - RNA, 22 nt, Human
gcgaaaaauguguaaauauguu

SEQ ID NO: 1014163 - RNA, 22 nt, Human
gcuuccuggagggagagagcug

SEQ ID NO: 1014164 - RNA, 22 nt, Human
cccuuggggcucuuugccaggc

SEQ ID NO: 1014165 - RNA, 22 nt, Human
acugccuuauaugcugugugug

SEQ ID NO: 1014166 - RNA, 22 nt, Human
cuuggcagcuuuuggaggagcc

SEQ ID NO: 1014167 - RNA, 22 nt, Human
augcaccugaacuccaucagcu

SEQ ID NO: 1014168 - RNA, 22 nt, Human
cagcuggcaaguggagcagggu

SEQ ID NO: 1014169 - RNA, 22 nt, Human
uggacagcgaaagugccuggga

SEQ ID NO: 1014170 - RNA, 22 nt, Human
ggcugccuggaccuccucuuuc

SEQ ID NO: 1014171 - RNA, 22 nt, Human
ugaaagcagcaccaauaccauu

SEQ ID NO: 1014172 - RNA, 18 nt, Human
ggagagugagaucaaaca

SEQ ID NO: 1014173 - RNA, 22 nt, Human
agggugccugcugcagguucag

SEQ ID NO: 1014174 - RNA, 22 nt, Human
ucagaagccggaagugcuccuc

SEQ ID NO: 1014175 - RNA, 19 nt, Human
cagucccaaauucuuguca

SEQ ID NO: 1014176 - RNA, 18 nt, Human
cccagcuccacuucccuc

SEQ ID NO: 1014177 - RNA, 22 nt, Human
gcagcuguggguuccaagucua

SEQ ID NO: 1014178 - RNA, 22 nt, Human
gccuguguggaugcgccggugc

SEQ ID NO: 1014179 - RNA, 22 nt, Human
aucagcaagauugugucuugua

SEQ ID NO: 1014180 - RNA, 22 nt, Human
ccagcugguguuccuuaggacc

SEQ ID NO: 1014181 - RNA, 22 nt, Human
gcuagaaaucgacuucagaauu

SEQ ID NO: 1014182 - RNA, 22 nt, Human
ucagugcuucggcgagcaccua

SEQ ID NO: 1014183 - RNA, 22 nt, Human
gguccuggaaauugacggaaag

SEQ ID NO: 1014184 - RNA, 22 nt, Human
cagacagaaggcuccuugaggu

SEQ ID NO: 1014185 - RNA, 22 nt, Human
acagcuuuuuacuaauagauug

SEQ ID NO: 1014186 - RNA, 17 nt, Human
gucugggcuuuagagac

SEQ ID NO: 1014187 - RNA, 22 nt, Human
uuugaauagcauaggauuacau

SEQ ID NO: 1014188 - RNA, 17 nt, Human
agcagaagucagaggga

SEQ ID NO: 1014189 - RNA, 22 nt, Human
aauaacuuuuaaaagacccugg

SEQ ID NO: 1014190 - RNA, 22 nt, Human
ucugucuucaucagcaugugau

SEQ ID NO: 1014191 - RNA, 20 nt, Human
uuuacauuuugaaacaguga

SEQ ID NO: 1014192 - RNA, 22 nt, Human
gcucugugcaguucagggacac

SEQ ID NO: 1014193 - RNA, 22 nt, Human
guggaauguccuugaucauaag

SEQ ID NO: 1014194 - RNA, 22 nt, Human
caggccagguggcaggcaaaac

SEQ ID NO: 1014195 - RNA, 20 nt, Human
cuccucaguuccaugggagg

SEQ ID NO: 1014196 - RNA, 22 nt, Human
cuggccugugggcugucuccgg

SEQ ID NO: 1014197 - RNA, 22 nt, Human
cucaggaugucggugacuauug

SEQ ID NO: 1014198 - RNA, 22 nt, Human
cuugaaucuggcuuugccacuu

SEQ ID NO: 1014199 - RNA, 22 nt, Human
cccuggagugugacgaggcauu

SEQ ID NO: 1014200 - RNA, 22 nt, Human
uuuuauagcugaauaguauucc

SEQ ID NO: 1014201 - RNA, 22 nt, Human
ugccuguccugaggaugagggu

SEQ ID NO: 1014202 - RNA, 22 nt, Human
aaaaauguuaucuacuguccga

SEQ ID NO: 1014203 - RNA, 20 nt, Human
aggaaaaggguggugguaga

SEQ ID NO: 1014204 - RNA, 22 nt, Human
uguaguaagugcgcaauaaaua

SEQ ID NO: 1014205 - RNA, 22 nt, Human
cagcauuuaaugcagugcuucc

SEQ ID NO: 1014206 - RNA, 19 nt, Human
gccugccuggguuucugag

SEQ ID NO: 1014207 - RNA, 22 nt, Human
acaaagucuuuuacaacaguca

SEQ ID NO: 1014208 - RNA, 22 nt, Human
agagcuggaaucagaccucagg

SEQ ID NO: 1014209 - RNA, 22 nt, Human
agugugucugaucacuugugag

SEQ ID NO: 1014210 - RNA, 22 nt, Human
cagcuggcguggagugauugca

SEQ ID NO: 1014211 - RNA, 22 nt, Human
ugcuggcccuggcucagggaac

SEQ ID NO: 1014212 - RNA, 22 nt, Human
gguggccucgguggugcacagg

SEQ ID NO: 1014213 - RNA, 22 nt, Human
acaggccugagauuuugcauuu

SEQ ID NO: 1014214 - RNA, 22 nt, Human
acugauuacacgaguucugacu

SEQ ID NO: 1014215 - RNA, 22 nt, Human
gaggcugauucggggaacagca

SEQ ID NO: 1014216 - RNA, 22 nt, Human
ggcuggcacugaggagagcucu

SEQ ID NO: 1014217 - RNA, 22 nt, Human
aggaccugagaguuggaaaucc

SEQ ID NO: 1014218 - RNA, 22 nt, Human
ggccaagauggaaggagagaug

SEQ ID NO: 1014219 - RNA, 22 nt, Human
ccugcagaccacacucaguccu

SEQ ID NO: 1014220 - RNA, 23 nt, Human
auuucuaggggauuuucuggugc

SEQ ID NO: 1014221 - RNA, 22 nt, Human
auuaauuuuucugacagccaca

SEQ ID NO: 1014222 - RNA, 22 nt, Human
agcaggugaauuccuggaugug

SEQ ID NO: 1014223 - RNA, 22 nt, Human
uagggcucagaguccaguuucu

SEQ ID NO: 1014224 - RNA, 22 nt, Human
uuugaacaagagcuucacauua

SEQ ID NO: 1014225 - RNA, 22 nt, Human
cucugggcaggaccaguggacc

SEQ ID NO: 1014226 - RNA, 22 nt, Human
ugcccaaguguuuggcugaguc

SEQ ID NO: 1014227 - RNA, 22 nt, Human
ggcucagguuaccagucccucc

SEQ ID NO: 1014228 - RNA, 22 nt, Human
ugggggagccuucacaguagcu

SEQ ID NO: 1014229 - RNA, 22 nt, Human
ugaugauguuuaucuugguauu

SEQ ID NO: 1014230 - RNA, 22 nt, Human
ucuggcucagggcucugaggga

SEQ ID NO: 1014231 - RNA, 21 nt, Human
aaaguucaugcuuuaauauuc

SEQ ID NO: 1014232 - RNA, 22 nt, Human
guuuuuccugcugacuuggguc

SEQ ID NO: 1014233 - RNA, 17 nt, Human
aaguccagaguugagca

SEQ ID NO: 1014234 - RNA, 22 nt, Human
accagcucagaagccagaaaga

SEQ ID NO: 1014235 - RNA, 22 nt, Human
uggccucaagucugagggccuu

SEQ ID NO: 1014236 - RNA, 22 nt, Human
ccuuuccuuuuuagugugggag

SEQ ID NO: 1014237 - RNA, 22 nt, Human
uuguuuuaucuuucuacagacu

SEQ ID NO: 1014238 - RNA, 22 nt, Human
gggcugagggguaucucauggg

SEQ ID NO: 1014239 - RNA, 21 nt, Human
agagucugcauuucugacaag

SEQ ID NO: 1014240 - RNA, 22 nt, Human
uggcagcugauuagauggugcc

SEQ ID NO: 1014241 - RNA, 23 nt, Human
gugcucugcggucugcuagucug

SEQ ID NO: 1014242 - RNA, 22 nt, Human
aucaguuugagugcugugucaa

SEQ ID NO: 1014243 - RNA, 22 nt, Human
auguuucagauacagaucaaau

SEQ ID NO: 1014244 - RNA, 19 nt, Human
agacaaguuuccagaagcc

SEQ ID NO: 1014245 - RNA, 22 nt, Human
uaagaacaguagaacaguaggu

SEQ ID NO: 1014246 - RNA, 22 nt, Human
uuuaguagaaugauacagggca

SEQ ID NO: 1014247 - RNA, 22 nt, Human
ugggagaagcagcagccaagug

SEQ ID NO: 1014248 - RNA, 20 nt, Human
ggcugcugugggcagagagg

SEQ ID NO: 1014249 - RNA, 22 nt, Human
aucagcaagcaugguuaggugu

SEQ ID NO: 1014250 - RNA, 22 nt, Human
gccuugggcacaggcagggccc

SEQ ID NO: 1014251 - RNA, 22 nt, Human
auuuuuaugacaaaccauccuc

SEQ ID NO: 1014252 - RNA, 22 nt, Human
ccaggacuuauuacaguauaac

SEQ ID NO: 1014253 - RNA, 22 nt, Human
gcagggacaucuuugucuagua

SEQ ID NO: 1014254 - RNA, 22 nt, Human
uuaagauagaacccaguagucu

SEQ ID NO: 1014255 - RNA, 22 nt, Human
agagccugcaucaggcuugggg

SEQ ID NO: 1014256 - RNA, 22 nt, Human
ucagaggauugccucagcgagc

SEQ ID NO: 1014257 - RNA, 22 nt, Human
ucuaaaaaagucuguucacuug

SEQ ID NO: 1014258 - RNA, 22 nt, Human
uaaauuauguuccauguccuuu

SEQ ID NO: 1014259 - RNA, 22 nt, Human
ucauguaaguauagaaagcagu

SEQ ID NO: 1014260 - RNA, 22 nt, Human
uaauuuuaugacaguguauuuu

SEQ ID NO: 1014261 - RNA, 22 nt, Human
ugcuggcuguauaugugagagu

SEQ ID NO: 1014262 - RNA, 22 nt, Human
aaguuucauuguucauguaaca

SEQ ID NO: 1014263 - RNA, 22 nt, Human
augaaaacggaccagagcuauu

SEQ ID NO: 1014264 - RNA, 22 nt, Human
uccuugaagaaugauucuugga

SEQ ID NO: 1014265 - RNA, 22 nt, Human
aucuuucagagcuccaucaggg

SEQ ID NO: 1014266 - RNA, 20 nt, Human
uacugggcaagcccacagac

SEQ ID NO: 1014267 - RNA, 22 nt, Human
aauguugaggauaucagaaaau

SEQ ID NO: 1014268 - RNA, 22 nt, Human
uaccugcaaaguuccuuuugcc

SEQ ID NO: 1014269 - RNA, 22 nt, Human
gcaugugucuccccaguggagg

SEQ ID NO: 1014270 - RNA, 20 nt, Human
agaaauauugaguucagagg

SEQ ID NO: 1014271 - RNA, 22 nt, Human
uaagacaauucuucagucacaa

SEQ ID NO: 1014272 - RNA, 22 nt, Human
uccugccuguuuaccuguacuu

SEQ ID NO: 1014273 - RNA, 22 nt, Human
auuaaaauuccaagguaugcca

SEQ ID NO: 1014274 - RNA, 22 nt, Human
ggccuugggcagacacgucaca

SEQ ID NO: 1014275 - RNA, 22 nt, Human
gcugugaguggaggaggcugag

SEQ ID NO: 1014276 - RNA, 23 nt, Human
uuuauuuauuuaggcugagggau

SEQ ID NO: 1014277 - RNA, 22 nt, Human
ucuggagccuuggaugggaaag

SEQ ID NO: 1014278 - RNA, 22 nt, Human
agggcuggcaagggauugaaau

SEQ ID NO: 1014279 - RNA, 22 nt, Human
ucugucugcucauuuaccucag

SEQ ID NO: 1014280 - RNA, 22 nt, Human
aaggcacugaaaaauugugugu

SEQ ID NO: 1014281 - RNA, 22 nt, Human
acagcagagugugagauagcca

SEQ ID NO: 1014282 - RNA, 22 nt, Human
uugggagcaaauaggaaagagg

SEQ ID NO: 1014283 - RNA, 22 nt, Human
cauugcuuugugcauauuuaaa

SEQ ID NO: 1014284 - RNA, 22 nt, Human
aaauaguuacuucugcugucuu

SEQ ID NO: 1014285 - RNA, 22 nt, Human
caaauucacaugauugcuucug

SEQ ID NO: 1014286 - RNA, 22 nt, Human
uauuuugacuauuaaaccaaca

SEQ ID NO: 1014287 - RNA, 22 nt, Human
uauucacaaaaugagguccuca

SEQ ID NO: 1014288 - RNA, 22 nt, Human
ucaggggcccuucccucagcag

SEQ ID NO: 1014289 - RNA, 20 nt, Human
ugaaaggugggaauuguggg

SEQ ID NO: 1014290 - RNA, 22 nt, Human
ugaaagguuaaaaguaguauug

SEQ ID NO: 1014291 - RNA, 22 nt, Human
uggcccuguggaggucagugag

SEQ ID NO: 1014292 - RNA, 22 nt, Human
agcuggagaucaugcugauacu

SEQ ID NO: 1014293 - RNA, 22 nt, Human
aucaguuuugggggacauacug

SEQ ID NO: 1014294 - RNA, 22 nt, Human
caacugcugacaccaucacucc

SEQ ID NO: 1014295 - RNA, 22 nt, Human
uugugucugggggagugacauc

SEQ ID NO: 1014296 - RNA, 22 nt, Human
aacagaaaagguagguggcuuu

SEQ ID NO: 1014297 - RNA, 22 nt, Human
uucaggauucugugucugacaa

SEQ ID NO: 1014298 - RNA, 22 nt, Human
ugcagcauucuuggccacuacu

SEQ ID NO: 1014299 - RNA, 22 nt, Human
agcugccaccucugccuuuggg

SEQ ID NO: 1014300 - RNA, 18 nt, Human
acagaaauagcugugccu

SEQ ID NO: 1014301 - RNA, 22 nt, Human
gauuucuuuagguguaauagug

SEQ ID NO: 1014302 - RNA, 22 nt, Human
gaacacauguccuccuuggauu

SEQ ID NO: 1014303 - RNA, 22 nt, Human
gcaggggcuacucugagcuucc

SEQ ID NO: 1014304 - RNA, 22 nt, Human
ccauggcaauggucagucuauu

SEQ ID NO: 1014305 - RNA, 22 nt, Human
gggugggguucaggaaucuuca

SEQ ID NO: 1014306 - RNA, 22 nt, Human
agcagggcagugaucagaaagg

SEQ ID NO: 1014307 - RNA, 22 nt, Human
gaggcugcccaacuggagugga

SEQ ID NO: 1014308 - RNA, 22 nt, Human
gggguugguuuaaaugcuugag

SEQ ID NO: 1014309 - RNA, 22 nt, Human
ggugaggggagagugaaagaaa

SEQ ID NO: 1014310 - RNA, 22 nt, Human
uaccugagcccagugcagcaua

SEQ ID NO: 1014311 - RNA, 20 nt, Human
guccaggacccagcaggagg

SEQ ID NO: 1014312 - RNA, 22 nt, Human
gccagcucccaagugagccccu

SEQ ID NO: 1014313 - RNA, 22 nt, Human
gcccuggccuucaucucagaca

SEQ ID NO: 1014314 - RNA, 22 nt, Human
ccagcuuguuugaagcucguca

SEQ ID NO: 1014315 - RNA, 22 nt, Human
gcaaggcugugcacuuugcauu

SEQ ID NO: 1014316 - RNA, 22 nt, Human
gagcaccgccuccacgaugccc

SEQ ID NO: 1014317 - RNA, 22 nt, Human
caggauggagggagggcuguua

SEQ ID NO: 1014318 - RNA, 22 nt, Human
ugaaaaggguagaucccuaagu

SEQ ID NO: 1014319 - RNA, 22 nt, Human
cagcuuugauucuuucugccau

SEQ ID NO: 1014320 - RNA, 22 nt, Human
uucauaaugagguccuagaggc

SEQ ID NO: 1014321 - RNA, 22 nt, Human
uucauguaauuccauaagguaa

SEQ ID NO: 1014322 - RNA, 22 nt, Human
aggggcucaaagugugcaggga

SEQ ID NO: 1014323 - RNA, 22 nt, Human
guauuagguuggugcaaaagua

SEQ ID NO: 1014324 - RNA, 22 nt, Human
ugucucugugacuccuuccgcc

SEQ ID NO: 1014325 - RNA, 22 nt, Human
cagccaggagccucugcaacua

SEQ ID NO: 1014326 - RNA, 22 nt, Human
cuggccuucagacucggacuga

SEQ ID NO: 1014327 - RNA, 22 nt, Human
agccugagugcuuaggacuguu

SEQ ID NO: 1014328 - RNA, 22 nt, Human
ccaggcucaggugcgagagaca

SEQ ID NO: 1014329 - RNA, 22 nt, Human
auacauuagaaucugguacuca

SEQ ID NO: 1014330 - RNA, 22 nt, Human
uaguaaaaguuuaguugaaagu

SEQ ID NO: 1014331 - RNA, 22 nt, Human
auguucuuccaaaucuguaaca

SEQ ID NO: 1014332 - RNA, 22 nt, Human
ggcucuggaaaguguccuugau

SEQ ID NO: 1014333 - RNA, 17 nt, Human
ugaauucaaucugcacu

SEQ ID NO: 1014334 - RNA, 22 nt, Human
ccugccugcuuucugcuuugca

SEQ ID NO: 1014335 - RNA, 21 nt, Human
uaugaacaugaccaauagucc

SEQ ID NO: 1014336 - RNA, 22 nt, Human
gaaauauuacaguggaggggau

SEQ ID NO: 1014337 - RNA, 22 nt, Human
caaggccauaagagauacaaaa

SEQ ID NO: 1014338 - RNA, 22 nt, Human
uacauauuugucuuuguacugu

SEQ ID NO: 1014339 - RNA, 22 nt, Human
acucucucacagcuuggcugau

SEQ ID NO: 1014340 - RNA, 22 nt, Human
gcagagugagccgaggcugcuc

SEQ ID NO: 1014341 - RNA, 23 nt, Human
gagagcugacugucaagacuguu

SEQ ID NO: 1014342 - RNA, 22 nt, Human
ugaaggccuaacuuccagugcu

SEQ ID NO: 1014343 - RNA, 22 nt, Human
gugcagguguuuuggcugccag

SEQ ID NO: 1014344 - RNA, 17 nt, Human
agcagcugaagcagcca

SEQ ID NO: 1014345 - RNA, 22 nt, Human
aggcaggugggucacuugaguc

SEQ ID NO: 1014346 - RNA, 22 nt, Human
ggaggccaaggaggagcuugcc

SEQ ID NO: 1014347 - RNA, 22 nt, Human
uuagggaaggcugcugucagcu

SEQ ID NO: 1014348 - RNA, 22 nt, Human
gucaaguuuauccgcucauuca

SEQ ID NO: 1014349 - RNA, 22 nt, Human
uggagccagcccaggccccucu

SEQ ID NO: 1014350 - RNA, 22 nt, Human
cagacacagauaugcauauggc

SEQ ID NO: 1014351 - RNA, 22 nt, Human
uguuuucauuugauguaacaaa

SEQ ID NO: 1014352 - RNA, 22 nt, Human
ucuuuacacaagacaagaauaa

SEQ ID NO: 1014353 - RNA, 22 nt, Human
cccucccaggaguggccagaga

SEQ ID NO: 1014354 - RNA, 21 nt, Human
cucacaggaugcaguguuacu

SEQ ID NO: 1014355 - RNA, 23 nt, Human
uugaaagguagcuggcagcuaga

SEQ ID NO: 1014356 - RNA, 22 nt, Human
ccuggcaggccccuccuggauu

SEQ ID NO: 1014357 - RNA, 22 nt, Human
ucauugcaggcauuccccugcc

SEQ ID NO: 1014358 - RNA, 22 nt, Human
gaggagcuggcagcgucuccgc

SEQ ID NO: 1014359 - RNA, 22 nt, Human
uugcugugaaaccaugggaagu

SEQ ID NO: 1014360 - RNA, 22 nt, Human
aauuugcaugaugagaacaaua

SEQ ID NO: 1014361 - RNA, 21 nt, Human
ucucuggaauuagaccauguu

SEQ ID NO: 1014362 - RNA, 22 nt, Human
ggaggcugcugccucacguggg

SEQ ID NO: 1014363 - RNA, 22 nt, Human
cagagccaugguaugggcuugu

SEQ ID NO: 1014364 - RNA, 22 nt, Human
aguccuuugggaaaaaugacua

SEQ ID NO: 1014365 - RNA, 22 nt, Human
uggcacugggacagaugcucuc

SEQ ID NO: 1014366 - RNA, 22 nt, Human
uaaaugugggggccacgggcuu

SEQ ID NO: 1014367 - RNA, 22 nt, Human
ugguacuuggaggcagaaaaau

SEQ ID NO: 1014368 - RNA, 22 nt, Human
ugagggaguuggguguauagga

SEQ ID NO: 1014369 - RNA, 22 nt, Human
gccaggcuggugucacaacucu

SEQ ID NO: 1014370 - RNA, 22 nt, Human
cccugcagggaggauucugaag

SEQ ID NO: 1014371 - RNA, 22 nt, Human
ucuccuuuaagauuuccucagg

SEQ ID NO: 1014372 - RNA, 22 nt, Human
ugagcccaggaguuggaggcug

SEQ ID NO: 1014373 - RNA, 22 nt, Human
gaggguccccaugcagagcuca

SEQ ID NO: 1014374 - RNA, 22 nt, Human
ggcgcuggccacgguggcucug

SEQ ID NO: 1014375 - RNA, 22 nt, Human
auaugaagucagacaaacuggg

SEQ ID NO: 1014376 - RNA, 22 nt, Human
acuguagcugccacuggaugca

SEQ ID NO: 1014377 - RNA, 22 nt, Human
aucauucuagcuguuguguuga

SEQ ID NO: 1014378 - RNA, 22 nt, Human
auaauaaaccaggaugggucug

SEQ ID NO: 1014379 - RNA, 22 nt, Human
acuucuugggacccuggcaccg

SEQ ID NO: 1014380 - RNA, 22 nt, Human
cccagcucaagcagagagcuaa

SEQ ID NO: 1014381 - RNA, 22 nt, Human
aggcucuguuauucuagagggc

SEQ ID NO: 1014382 - RNA, 22 nt, Human
uuuauucuugagagugagaaga

SEQ ID NO: 1014383 - RNA, 22 nt, Human
aauacaguaauuuugaugaguu

SEQ ID NO: 1014384 - RNA, 22 nt, Human
uugaaaaaauugguagaggaug

SEQ ID NO: 1014385 - RNA, 22 nt, Human
cagggccuucguaaguguccgg

SEQ ID NO: 1014386 - RNA, 22 nt, Human
aaaugucuguuagucauaucau

SEQ ID NO: 1014387 - RNA, 22 nt, Human
cacagcuucccaaaguggaccu

SEQ ID NO: 1014388 - RNA, 22 nt, Human
ugccugucuuuccucccucgua

SEQ ID NO: 1014389 - RNA, 22 nt, Human
aaaauccugcugacucgagaug

SEQ ID NO: 1014390 - RNA, 22 nt, Human
aguccaggaguugggugacauu

SEQ ID NO: 1014391 - RNA, 19 nt, Human
ugccagcauuaggcugaag

SEQ ID NO: 1014392 - RNA, 22 nt, Human
aaaggucagacuuaggcugggc

SEQ ID NO: 1014393 - RNA, 22 nt, Human
aggucacccguuugacuaucca

SEQ ID NO: 1014394 - RNA, 22 nt, Human
cuggagagauccuccugaaaaa

SEQ ID NO: 1014395 - RNA, 22 nt, Human
aggagcugaagucucugcacuc

SEQ ID NO: 1014396 - RNA, 22 nt, Human
uuuaaaaaacuagucugagucu

SEQ ID NO: 1014397 - RNA, 22 nt, Human
ggugaagggugucauggcauuu

SEQ ID NO: 1014398 - RNA, 22 nt, Human
aagauaauauucauuaacuaga

SEQ ID NO: 1014399 - RNA, 22 nt, Human
ggcugcuugcuguuucuuggau

SEQ ID NO: 1014400 - RNA, 22 nt, Human
ugaaugaguuuggcugcuguuc

SEQ ID NO: 1014401 - RNA, 22 nt, Human
cuggagcuccagggucuccucu

SEQ ID NO: 1014402 - RNA, 22 nt, Human
ggaccugcauuuuaacaagauc

SEQ ID NO: 1014403 - RNA, 22 nt, Human
accuugggcaaguuggaaacug

SEQ ID NO: 1014404 - RNA, 21 nt, Human
ugcagcugacacugguaugcc

SEQ ID NO: 1014405 - RNA, 22 nt, Human
agugaaauaugcccauugcugu

SEQ ID NO: 1014406 - RNA, 22 nt, Human
aggcugagauagguggaucauu

SEQ ID NO: 1014407 - RNA, 22 nt, Human
cccugcagagggaugggggcag

SEQ ID NO: 1014408 - RNA, 22 nt, Human
ccauggccgccgcugcucagga

SEQ ID NO: 1014409 - RNA, 22 nt, Human
ucugcugucacucauuugcuuc

SEQ ID NO: 1014410 - RNA, 22 nt, Human
ucuagaaacaugacauugaucu

SEQ ID NO: 1014411 - RNA, 22 nt, Human
auggggugagacuaggauuaaa

SEQ ID NO: 1014412 - RNA, 22 nt, Human
agcauccaacaggagggaaggg

SEQ ID NO: 1014413 - RNA, 22 nt, Human
uuuuccuuucaucaggacaaag

SEQ ID NO: 1014414 - RNA, 22 nt, Human
ucugugcauuguaacaacuaaa

SEQ ID NO: 1014415 - RNA, 22 nt, Human
ugggcuguccagcaccugggcu

SEQ ID NO: 1014416 - RNA, 22 nt, Human
cuuacauugucuuaguuuucaa

SEQ ID NO: 1014417 - RNA, 22 nt, Human
gcaagcugaugugauagugaaa

SEQ ID NO: 1014418 - RNA, 22 nt, Human
aguauguauuuuauacuuacag

SEQ ID NO: 1014419 - RNA, 22 nt, Human
agccuggaccaggggccucaga

SEQ ID NO: 1014420 - RNA, 22 nt, Human
aaugcauauguaggcaagcagu

SEQ ID NO: 1014421 - RNA, 22 nt, Human
uguauagaguuggaagaugacu

SEQ ID NO: 1014422 - RNA, 23 nt, Human
aaguucaagucacagccugucuu

SEQ ID NO: 1014423 - RNA, 22 nt, Human
aaggccauuauucugauauauu

SEQ ID NO: 1014424 - RNA, 19 nt, Human
ucacaggcaucuccccaga

SEQ ID NO: 1014425 - RNA, 22 nt, Human
uauacacaaggugugcauuugu

SEQ ID NO: 1014426 - RNA, 22 nt, Human
aggccuagaggaauggccaggg

SEQ ID NO: 1014427 - RNA, 20 nt, Human
ccaccuggccaaggcugugc

SEQ ID NO: 1014428 - RNA, 21 nt, Human
uggcucugaaagagugcugca

SEQ ID NO: 1014429 - RNA, 22 nt, Human
aggguggggugcuacaucuuua

SEQ ID NO: 1014430 - RNA, 22 nt, Human
gaguuauuuguagggauuauau

SEQ ID NO: 1014431 - RNA, 22 nt, Human
aggaccaguaugagagcaucug

SEQ ID NO: 1014432 - RNA, 22 nt, Human
augucacagcucccauuccucc

SEQ ID NO: 1014433 - RNA, 22 nt, Human
uccugcagagccgcccucaggu

SEQ ID NO: 1014434 - RNA, 22 nt, Human
agccacaggaaacagagacagc

SEQ ID NO: 1014435 - RNA, 22 nt, Human
ggagaggcgaugagucacagcc

SEQ ID NO: 1014436 - RNA, 22 nt, Human
auauuaggaguuaaauguauua

SEQ ID NO: 1014437 - RNA, 21 nt, Human
ucauuuuuauugcuaccuugc

SEQ ID NO: 1014438 - RNA, 22 nt, Human
uuguuucagcuguaugcuaugu

SEQ ID NO: 1014439 - RNA, 22 nt, Human
cuucuucaagagaaugggagac

SEQ ID NO: 1014440 - RNA, 22 nt, Human
cucucaggcuugggucguggca

SEQ ID NO: 1014441 - RNA, 22 nt, Human
gccugucugcgucacgcuuauu

SEQ ID NO: 1014442 - RNA, 22 nt, Human
cuccaggccagggaaguggaca

SEQ ID NO: 1014443 - RNA, 21 nt, Human
ggacuuacauagguaaggggu

SEQ ID NO: 1014444 - RNA, 22 nt, Human
agaaaugaaaccaaagccuaga

SEQ ID NO: 1014445 - RNA, 20 nt, Human
aaaauauguauaacucuucu

SEQ ID NO: 1014446 - RNA, 22 nt, Human
gcagggcugcagagggcacugu

SEQ ID NO: 1014447 - RNA, 22 nt, Human
uuauugccugauugaggucauu

SEQ ID NO: 1014448 - RNA, 22 nt, Human
ucaguuuugauuccugguucuc

SEQ ID NO: 1014449 - RNA, 22 nt, Human
accccagaggcggaggcugcag

SEQ ID NO: 1014450 - RNA, 22 nt, Human
ugcucugucaagaaaagaugcc

SEQ ID NO: 1014451 - RNA, 22 nt, Human
aaggccagacaggaccacaucu

SEQ ID NO: 1014452 - RNA, 19 nt, Human
ugaaggagggggauggcca

SEQ ID NO: 1014453 - RNA, 22 nt, Human
ccugucacgaugacugcacucu

SEQ ID NO: 1014454 - RNA, 22 nt, Human
cugggccagucucggccgcucu

SEQ ID NO: 1014455 - RNA, 22 nt, Human
aagauucagccaaauuguucau

SEQ ID NO: 1014456 - RNA, 22 nt, Human
ugaauaaucuuggguauuaaua

SEQ ID NO: 1014457 - RNA, 22 nt, Human
uuuccucugggcccugccaccc

SEQ ID NO: 1014458 - RNA, 22 nt, Human
auguuucaugacugagcaaaau

SEQ ID NO: 1014459 - RNA, 22 nt, Human
ucaggaauccagacagggcaca

SEQ ID NO: 1014460 - RNA, 22 nt, Human
auacaacagaaaaugauuauuc

SEQ ID NO: 1014461 - RNA, 18 nt, Human
guaggucaguaccaagca

SEQ ID NO: 1014462 - RNA, 22 nt, Human
aaaguucagugccuucuauaca

SEQ ID NO: 1014463 - RNA, 22 nt, Human
uccaugagagguaacuuuacaa

SEQ ID NO: 1014464 - RNA, 22 nt, Human
cugcugucuuuauuucacugcu

SEQ ID NO: 1014465 - RNA, 22 nt, Human
aggcugaggcagguggaucacc

SEQ ID NO: 1014466 - RNA, 22 nt, Human
cugcccugucugcagccuggcu

SEQ ID NO: 1014467 - RNA, 22 nt, Human
caaggccaguucaccaagggca

SEQ ID NO: 1014468 - RNA, 22 nt, Human
uuuagggacaagggucuggggu

SEQ ID NO: 1014469 - RNA, 22 nt, Human
gagcccaggcagagguugcagu

SEQ ID NO: 1014470 - RNA, 22 nt, Human
ucugggaagcugcgugccuguu

SEQ ID NO: 1014471 - RNA, 22 nt, Human
cacacaugucucuccaugcucu

SEQ ID NO: 1014472 - RNA, 22 nt, Human
cagguggcaugacugccuacaa

SEQ ID NO: 1014473 - RNA, 22 nt, Human
augggagccaucgcauuugcug

SEQ ID NO: 1014474 - RNA, 22 nt, Human
gguuucaaauuaaagucuuaag

SEQ ID NO: 1014475 - RNA, 22 nt, Human
ugcuacaauucacaucuggaua

SEQ ID NO: 1014476 - RNA, 22 nt, Human
ugcagaggagcuggaaggcugg

SEQ ID NO: 1014477 - RNA, 22 nt, Human
uuccuauuuccaugaaacacaa

SEQ ID NO: 1014478 - RNA, 22 nt, Human
uaugcacagaaguuugcugaau

SEQ ID NO: 1014479 - RNA, 22 nt, Human
ccacaggaccagaggagaucac

SEQ ID NO: 1014480 - RNA, 22 nt, Human
ugacaccacaacuagccauuga

SEQ ID NO: 1014481 - RNA, 22 nt, Human
ggggugggguuacucauugugc

SEQ ID NO: 1014482 - RNA, 22 nt, Human
uagugcuuaacacaaagugauu

SEQ ID NO: 1014483 - RNA, 22 nt, Human
gcuggccagugucccagggauc

SEQ ID NO: 1014484 - RNA, 22 nt, Human
aaaucuggccccuugccuauuu

SEQ ID NO: 1014485 - RNA, 20 nt, Human
agcccaggccugugugaguc

SEQ ID NO: 1014486 - RNA, 22 nt, Human
uuuuucaagacaaccugcaugu

SEQ ID NO: 1014487 - RNA, 22 nt, Human
ucacagggauggaauagaaaua

SEQ ID NO: 1014488 - RNA, 22 nt, Human
aggaggccgggauucuggagau

SEQ ID NO: 1014489 - RNA, 22 nt, Human
uaucuguuccaggcacucagcu

SEQ ID NO: 1014490 - RNA, 23 nt, Human
uugcauguagcccaugaguaacu

SEQ ID NO: 1014491 - RNA, 22 nt, Human
acuggagcccguggaggcgcag

SEQ ID NO: 1014492 - RNA, 22 nt, Human
cacaugggcguaauguccaugg

SEQ ID NO: 1014493 - RNA, 22 nt, Human
ucccuggacagccuugccuggg

SEQ ID NO: 1014494 - RNA, 22 nt, Human
cagcucugaagaaaggugucua

SEQ ID NO: 1014495 - RNA, 22 nt, Human
ccugccugucaucgccugcgcc

SEQ ID NO: 1014496 - RNA, 22 nt, Human
ugaaaucuacccuauucagggu

SEQ ID NO: 1014497 - RNA, 22 nt, Human
auuuuuccaugauacuuaucug

SEQ ID NO: 1014498 - RNA, 21 nt, Human
gagcauggcuuacaucagcag

SEQ ID NO: 1014499 - RNA, 21 nt, Human
uagggcucuauuuuuauuuca

SEQ ID NO: 1014500 - RNA, 22 nt, Human
cacucugacuggcccugcagga

SEQ ID NO: 1014501 - RNA, 22 nt, Human
uucuucaugcuguugcugcuug

SEQ ID NO: 1014502 - RNA, 20 nt, Human
agcuggccuguccuaggccu

SEQ ID NO: 1014503 - RNA, 22 nt, Human
ugggaccugaagcagguuggca

SEQ ID NO: 1014504 - RNA, 22 nt, Human
ucaugcuuauugcauauuugga

SEQ ID NO: 1014505 - RNA, 17 nt, Human
uauauguaugccucucc

SEQ ID NO: 1014506 - RNA, 22 nt, Human
cucaccaggaacagcugcggag

SEQ ID NO: 1014507 - RNA, 22 nt, Human
caaauguguagagcuuuugggg

SEQ ID NO: 1014508 - RNA, 22 nt, Human
ugcaggcaggggaugagcagcc

SEQ ID NO: 1014509 - RNA, 22 nt, Human
cugacccauauaagaguggagg

SEQ ID NO: 1014510 - RNA, 21 nt, Human
gcucucugcaugguggcucag

SEQ ID NO: 1014511 - RNA, 22 nt, Human
agucucugggcaugguugugac

SEQ ID NO: 1014512 - RNA, 22 nt, Human
ccaggggcuggugcugagcugg

SEQ ID NO: 1014513 - RNA, 22 nt, Human
ugcagaguaaaagcagaugcua

SEQ ID NO: 1014514 - RNA, 22 nt, Human
cuuuucaugccagcccaucaca

SEQ ID NO: 1014515 - RNA, 22 nt, Human
uucaggauucucucccauuuac

SEQ ID NO: 1014516 - RNA, 22 nt, Human
uuccaaaggaauggggagcuau

SEQ ID NO: 1014517 - RNA, 22 nt, Human
uuugacauuggcuuauucuguu

SEQ ID NO: 1014518 - RNA, 22 nt, Human
uagagcuagcuucaaaaugcga

SEQ ID NO: 1014519 - RNA, 22 nt, Human
agcacagauucugaagaguccu

SEQ ID NO: 1014520 - RNA, 22 nt, Human
agagacugcgugucagcgcugg

SEQ ID NO: 1014521 - RNA, 16 nt, Human
ugggaccuguggccaa

SEQ ID NO: 1014522 - RNA, 22 nt, Human
uuccuuaguugacugucuuagu

SEQ ID NO: 1014523 - RNA, 22 nt, Human
gggacaggccccucgcuagcuu

SEQ ID NO: 1014524 - RNA, 22 nt, Human
caauacuuccuuguuagaggca

SEQ ID NO: 1014525 - RNA, 22 nt, Human
gcuggcaucacuggcuucggug

SEQ ID NO: 1014526 - RNA, 22 nt, Human
aacaaauguguggcaguguggg

SEQ ID NO: 1014527 - RNA, 22 nt, Human
aaaucagugcucauuugaaagg

SEQ ID NO: 1014528 - RNA, 22 nt, Human
ucuuuguaacugucuauugaga

SEQ ID NO: 1014529 - RNA, 22 nt, Human
aucuggcucacuuagucuagga

SEQ ID NO: 1014530 - RNA, 18 nt, Human
ucugucuguacaaguauc

SEQ ID NO: 1014531 - RNA, 22 nt, Human
ggggcagagcauagcuccaauu

SEQ ID NO: 1014532 - RNA, 22 nt, Human
ucugucaccauucagcuugaau

SEQ ID NO: 1014533 - RNA, 22 nt, Human
guggcccugucccaggccuccu

SEQ ID NO: 1014534 - RNA, 22 nt, Human
agccacagucaaccuguccaua

SEQ ID NO: 1014535 - RNA, 22 nt, Human
agagcuguggauaguccuggau

SEQ ID NO: 1014536 - RNA, 22 nt, Human
gcagagccaggagagacccuug

SEQ ID NO: 1014537 - RNA, 22 nt, Human
uguucuuuggcuucacagcucu

SEQ ID NO: 1014538 - RNA, 22 nt, Human
guacaugucaaaaaaugcauaa

SEQ ID NO: 1014539 - RNA, 22 nt, Human
gaaggccaagaggcuccaagau

SEQ ID NO: 1014540 - RNA, 18 nt, Human
gucuggaggucaggagcu

SEQ ID NO: 1014541 - RNA, 22 nt, Human
agcagcugccagagagaguucc

SEQ ID NO: 1014542 - RNA, 22 nt, Human
uuccaugaaggagacugagaag

SEQ ID NO: 1014543 - RNA, 22 nt, Human
ucugagagccucuagccuaagu

SEQ ID NO: 1014544 - RNA, 22 nt, Human
uggcuggcgccgggcuagccac

SEQ ID NO: 1014545 - RNA, 22 nt, Human
uucaagaugccagggacgcggc

SEQ ID NO: 1014546 - RNA, 22 nt, Human
aaggcugagagucacaguccua

SEQ ID NO: 1014547 - RNA, 21 nt, Human
ugucagaaauaagcaugugau

SEQ ID NO: 1014548 - RNA, 22 nt, Human
uucugucucuguguuuacauua

SEQ ID NO: 1014549 - RNA, 22 nt, Human
uacauaauuaaucuuuaaguuc

SEQ ID NO: 1014550 - RNA, 22 nt, Human
ugcagggcacacgcacgggugu

SEQ ID NO: 1014551 - RNA, 22 nt, Human
ucaaaguaaaaguauagaguuu

SEQ ID NO: 1014552 - RNA, 22 nt, Human
uccagggcuuggcugggacggu

SEQ ID NO: 1014553 - RNA, 22 nt, Human
gcaguucuacuuauccauagac

SEQ ID NO: 1014554 - RNA, 22 nt, Human
cagaggccuauccaguguccau

SEQ ID NO: 1014555 - RNA, 22 nt, Human
ugcacacacaugaaguagcaug

SEQ ID NO: 1014556 - RNA, 22 nt, Human
uggggacacagagccaaacuau

SEQ ID NO: 1014557 - RNA, 22 nt, Human
aaguuucaaauguugauuaugc

SEQ ID NO: 1014558 - RNA, 22 nt, Human
gggacugggagauccuccuggc

SEQ ID NO: 1014559 - RNA, 22 nt, Human
ccaggagccacucaggcccaca

SEQ ID NO: 1014560 - RNA, 22 nt, Human
ccuguucaagggaugauugacc

SEQ ID NO: 1014561 - RNA, 21 nt, Human
ugaaugaggaggauggcauuu

SEQ ID NO: 1014562 - RNA, 22 nt, Human
gagcuuuaagggauaaaaugau

SEQ ID NO: 1014563 - RNA, 22 nt, Human
gacagcaggaugugaggggaug

SEQ ID NO: 1014564 - RNA, 22 nt, Human
uggggcgcgagguccuggcucc

SEQ ID NO: 1014565 - RNA, 22 nt, Human
gcagcugccccgacugugaguc

SEQ ID NO: 1014566 - RNA, 22 nt, Human
aggcucagagagcuguguccau

SEQ ID NO: 1014567 - RNA, 20 nt, Human
gcugucuggauuagaagccu

SEQ ID NO: 1014568 - RNA, 22 nt, Human
augaguaagaccauaauuuuug

SEQ ID NO: 1014569 - RNA, 22 nt, Human
aagcuuucagagcagaauguga

SEQ ID NO: 1014570 - RNA, 22 nt, Human
agugcauauaugaagaguauga

SEQ ID NO: 1014571 - RNA, 22 nt, Human
uauuccagaugaaaucauucag

SEQ ID NO: 1014572 - RNA, 22 nt, Human
caggaaugacugcagauggggc

SEQ ID NO: 1014573 - RNA, 22 nt, Human
caaaucuauauguugauauucu

SEQ ID NO: 1014574 - RNA, 22 nt, Human
gacagggcgcccagccuguuuc

SEQ ID NO: 1014575 - RNA, 22 nt, Human
uaagaauuguguugaauagagu

SEQ ID NO: 1014576 - RNA, 22 nt, Human
uccugccuaccuugcggaggug

SEQ ID NO: 1014577 - RNA, 22 nt, Human
ugaaggagcucaaugaugaugc

SEQ ID NO: 1014578 - RNA, 22 nt, Human
cauuugcagagggugacacucu

SEQ ID NO: 1014579 - RNA, 22 nt, Human
ugugaaaagcaggcuacuuucu

SEQ ID NO: 1014580 - RNA, 22 nt, Human
gcuggcuguuggagguaccugc

SEQ ID NO: 1014581 - RNA, 22 nt, Human
cuuccagagauagggccucaag

SEQ ID NO: 1014582 - RNA, 22 nt, Human
gacccaggguuucugcacaggg

SEQ ID NO: 1014583 - RNA, 22 nt, Human
caauuucuggaacuaauucuga

SEQ ID NO: 1014584 - RNA, 21 nt, Human
ggccuuggcgggggccgaauu

SEQ ID NO: 1014585 - RNA, 22 nt, Human
agaggcagcagucauacuacag

SEQ ID NO: 1014586 - RNA, 22 nt, Human
uccugaggcacaauccuagaau

SEQ ID NO: 1014587 - RNA, 19 nt, Human
ggaggccuggguauuugcc

SEQ ID NO: 1014588 - RNA, 22 nt, Human
gccugcagggccugggccuacc

SEQ ID NO: 1014589 - RNA, 18 nt, Human
acagaggcagacauguau

SEQ ID NO: 1014590 - RNA, 22 nt, Human
uggagcaggaagucuauggcug

SEQ ID NO: 1014591 - RNA, 22 nt, Human
cugcuucuaagaaccugcagcu

SEQ ID NO: 1014592 - RNA, 22 nt, Human
gagcugaguuaccuccagauca

SEQ ID NO: 1014593 - RNA, 22 nt, Human
caguacuuauuucuauuuaggg

SEQ ID NO: 1014594 - RNA, 22 nt, Human
cccaggcucccaggugggacaa

SEQ ID NO: 1014595 - RNA, 22 nt, Human
ccuguucaugaaacugcuuucc

SEQ ID NO: 1014596 - RNA, 22 nt, Human
ucacuuuugaucccuaugcagu

SEQ ID NO: 1014597 - RNA, 20 nt, Human
gccuggcacccggggcuggc

SEQ ID NO: 1014598 - RNA, 22 nt, Human
ugaacaguuucaagaaaacuuu

SEQ ID NO: 1014599 - RNA, 22 nt, Human
gcucugcugcuuacuagauggu

SEQ ID NO: 1014600 - RNA, 21 nt, Human
uugaccaagggugcgugcucc

SEQ ID NO: 1014601 - RNA, 22 nt, Human
acaauucuggguauuuauauag

SEQ ID NO: 1014602 - RNA, 22 nt, Human
uacagaguggugagaucuuuug

SEQ ID NO: 1014603 - RNA, 19 nt, Human
uuagggacaugaauucuag

SEQ ID NO: 1014604 - RNA, 22 nt, Human
cccuggagguggagguugcagg

SEQ ID NO: 1014605 - RNA, 22 nt, Human
cuuagaaauaaugguuucaguu

SEQ ID NO: 1014606 - RNA, 22 nt, Human
ucaggauaaaauguaauggcaa

SEQ ID NO: 1014607 - RNA, 22 nt, Human
aagugaagaaauacaugagaau

SEQ ID NO: 1014608 - RNA, 22 nt, Human
aguacauauaguaauuuagcca

SEQ ID NO: 1014609 - RNA, 22 nt, Human
gaaaagcuaggccaguucagcu

SEQ ID NO: 1014610 - RNA, 22 nt, Human
ccagcuucucucugaugcagcu

SEQ ID NO: 1014611 - RNA, 22 nt, Human
acacauuucucuuuuuguaagu

SEQ ID NO: 1014612 - RNA, 22 nt, Human
cuguccucuguccucagcagga

SEQ ID NO: 1014613 - RNA, 22 nt, Human
cugggcuccuaaccauccaggu

SEQ ID NO: 1014614 - RNA, 22 nt, Human
cuccagggaggagcacggguuc

SEQ ID NO: 1014615 - RNA, 22 nt, Human
ucaguuuucauuucaugagcag

SEQ ID NO: 1014616 - RNA, 22 nt, Human
agaagccacuggagguugagau

SEQ ID NO: 1014617 - RNA, 22 nt, Human
accugccuucucaaggacauga

SEQ ID NO: 1014618 - RNA, 22 nt, Human
guuguauucuucaauaucagag

SEQ ID NO: 1014619 - RNA, 20 nt, Human
aggcagacaaggagucuguu

SEQ ID NO: 1014620 - RNA, 23 nt, Human
ucugagagaacaaugccuccuau

SEQ ID NO: 1014621 - RNA, 22 nt, Human
cagggcaguuuuacuucucucu

SEQ ID NO: 1014622 - RNA, 22 nt, Human
uuagaacuuaaacuucagaaag

SEQ ID NO: 1014623 - RNA, 22 nt, Human
agggacagucuacuguucacug

SEQ ID NO: 1014624 - RNA, 22 nt, Human
acuccuggggcugccaucacag

SEQ ID NO: 1014625 - RNA, 22 nt, Human
ucugggaacagccuggcugugu

SEQ ID NO: 1014626 - RNA, 22 nt, Human
aacagugagaagguggacagga

SEQ ID NO: 1014627 - RNA, 22 nt, Human
ucaugaauauugaaugcuucau

SEQ ID NO: 1014628 - RNA, 22 nt, Human
uggaggcaucagagugcuuggc

SEQ ID NO: 1014629 - RNA, 22 nt, Human
ugcugugcuggcggcagaggcc

SEQ ID NO: 1014630 - RNA, 22 nt, Human
caugggagguuggcuuggcaug

SEQ ID NO: 1014631 - RNA, 22 nt, Human
aaguuugacagaaguuucuaau

SEQ ID NO: 1014632 - RNA, 22 nt, Human
cccaggcagcccuucugacgca

SEQ ID NO: 1014633 - RNA, 22 nt, Human
cuacugaguccuucagcugcca

SEQ ID NO: 1014634 - RNA, 22 nt, Human
uccagaccaugugagaggcgca

SEQ ID NO: 1014635 - RNA, 22 nt, Human
aaggaagacacagaugaaguga

SEQ ID NO: 1014636 - RNA, 22 nt, Human
cugaggcuggggaagggaagug

SEQ ID NO: 1014637 - RNA, 22 nt, Human
uggcucuguuuuaugaguacca

SEQ ID NO: 1014638 - RNA, 20 nt, Human
ccagucccugagcaccaggg

SEQ ID NO: 1014639 - RNA, 22 nt, Human
cuucuucaucuguaaaacuugg

SEQ ID NO: 1014640 - RNA, 22 nt, Human
cuggccagacuacacaugugug

SEQ ID NO: 1014641 - RNA, 22 nt, Human
aggucauuggggacuaucuccg

SEQ ID NO: 1014642 - RNA, 22 nt, Human
ccuggcugggccugauuucuca

SEQ ID NO: 1014643 - RNA, 22 nt, Human
cagagguaccagcagccucugg

SEQ ID NO: 1014644 - RNA, 22 nt, Human
cugcucucuguuccccuggauc

SEQ ID NO: 1014645 - RNA, 22 nt, Human
guacauuuuacuuuguuugaau

SEQ ID NO: 1014646 - RNA, 20 nt, Human
gccagcccugacacaggagc

SEQ ID NO: 1014647 - RNA, 22 nt, Human
ggcaguggguggaucucaggga

SEQ ID NO: 1014648 - RNA, 22 nt, Human
ggcugagcacuuuaggcaggag

SEQ ID NO: 1014649 - RNA, 22 nt, Human
uuugcauuuauaaguuggugga

SEQ ID NO: 1014650 - RNA, 19 nt, Human
auacacauacguaaacuga

SEQ ID NO: 1014651 - RNA, 22 nt, Human
ugcugcucaaugagaugccauc

SEQ ID NO: 1014652 - RNA, 22 nt, Human
aaacacauuagcccuguggaaa

SEQ ID NO: 1014653 - RNA, 22 nt, Human
cagggcacaguuauggaggugg

SEQ ID NO: 1014654 - RNA, 22 nt, Human
ugacuuccugcacucaggugau

SEQ ID NO: 1014655 - RNA, 22 nt, Human
cugcuggagguuggagcaugca

SEQ ID NO: 1014656 - RNA, 22 nt, Human
aaugaacaucaaaugccuacca

SEQ ID NO: 1014657 - RNA, 22 nt, Human
uuugaaagcaccauuugaguag

SEQ ID NO: 1014658 - RNA, 20 nt, Human
uggcuccugcgguggaacca

SEQ ID NO: 1014659 - RNA, 22 nt, Human
gagccaaggguugccauggaga

SEQ ID NO: 1014660 - RNA, 22 nt, Human
cugggagcuuuuagaaaugcag

SEQ ID NO: 1014661 - RNA, 22 nt, Human
cucacagguaccagcacccucc

SEQ ID NO: 1014662 - RNA, 22 nt, Human
gcacuugguaggacuucaguga

SEQ ID NO: 1014663 - RNA, 22 nt, Human
acagggcaaccucugggagacu

SEQ ID NO: 1014664 - RNA, 22 nt, Human
auacuuuggucacuauuauugg

SEQ ID NO: 1014665 - RNA, 22 nt, Human
gauggcagcagcagccagggau

SEQ ID NO: 1014666 - RNA, 22 nt, Human
aaguucaaguguaaucuuuauu

SEQ ID NO: 1014667 - RNA, 22 nt, Human
agggccugggguagcuuacugc

SEQ ID NO: 1014668 - RNA, 22 nt, Human
agagcugggacuuggacucaau

SEQ ID NO: 1014669 - RNA, 22 nt, Human
cuugcugggguaagucugugcu

SEQ ID NO: 1014670 - RNA, 23 nt, Human
agaaaagcuuggacacauggccu

SEQ ID NO: 1014671 - RNA, 22 nt, Human
cugccuuccaaccccagacucc

SEQ ID NO: 1014672 - RNA, 22 nt, Human
aauaucaacaguguccuucuaa

SEQ ID NO: 1014673 - RNA, 22 nt, Human
aucaggaugacuauaaggcugc

SEQ ID NO: 1014674 - RNA, 22 nt, Human
cagcucugugggagcguaugug

SEQ ID NO: 1014675 - RNA, 23 nt, Human
gaggcacucaggaaaugugagug

SEQ ID NO: 1014676 - RNA, 22 nt, Human
acagaaauugggcaaauggaag

SEQ ID NO: 1014677 - RNA, 19 nt, Human
uggaggagaggaaaaguca

SEQ ID NO: 1014678 - RNA, 22 nt, Human
gccacugcacuccagcccaggc

SEQ ID NO: 1014679 - RNA, 22 nt, Human
ucaaaugcugccuuugugugcc

SEQ ID NO: 1014680 - RNA, 21 nt, Human
cucuggagucaagagcuucca

SEQ ID NO: 1014681 - RNA, 22 nt, Human
ccaggcugggcuacaaguugag

SEQ ID NO: 1014682 - RNA, 22 nt, Human
uggcccugacugauguggaggg

SEQ ID NO: 1014683 - RNA, 22 nt, Human
uauuaggguaaauuugacaugc

SEQ ID NO: 1014684 - RNA, 22 nt, Human
ugccucagucuaaagucucuca

SEQ ID NO: 1014685 - RNA, 22 nt, Human
uguaugaaagaacaagggcuua

SEQ ID NO: 1014686 - RNA, 19 nt, Human
gcaggcacagcccugggug

SEQ ID NO: 1014687 - RNA, 22 nt, Human
gagagugaggcaucaggggcag

SEQ ID NO: 1014688 - RNA, 22 nt, Human
ucacauaaauuauacaauuuca

SEQ ID NO: 1014689 - RNA, 21 nt, Human
uggcucaguugcugggcacag

SEQ ID NO: 1014690 - RNA, 23 nt, Human
caugccaguuugugcaggcagau

SEQ ID NO: 1014691 - RNA, 22 nt, Human
aucuucaacuugaucauuugaa

SEQ ID NO: 1014692 - RNA, 22 nt, Human
accugcagccacuucucuccuu

SEQ ID NO: 1014693 - RNA, 22 nt, Human
agaccaagacuauaaugagagg

SEQ ID NO: 1014694 - RNA, 19 nt, Human
uggcaucuguaaaauggug

SEQ ID NO: 1014695 - RNA, 22 nt, Human
uuuuuccaccguacuuccugag

SEQ ID NO: 1014696 - RNA, 22 nt, Human
uuuaagacuuagauuuauuggg

SEQ ID NO: 1014697 - RNA, 22 nt, Human
aagauucucagagugaaagaau

SEQ ID NO: 1014698 - RNA, 22 nt, Human
gagagcugucagcguagcaccg

SEQ ID NO: 1014699 - RNA, 22 nt, Human
cagcagcugggaaggaggcuga

SEQ ID NO: 1014700 - RNA, 22 nt, Human
uguagaaccuguuuauuauaga

SEQ ID NO: 1014701 - RNA, 22 nt, Human
ggcuucucucccccagcuccac

SEQ ID NO: 1014702 - RNA, 22 nt, Human
gcucugagaggugcagcaguaa

SEQ ID NO: 1014703 - RNA, 22 nt, Human
aagcaccucuaugauugcuuuu

SEQ ID NO: 1014704 - RNA, 19 nt, Human
agugaaauggaguauucaa

SEQ ID NO: 1014705 - RNA, 22 nt, Human
agcagccuuugaucaucuggga

SEQ ID NO: 1014706 - RNA, 22 nt, Human
ucuucauauauaaaguggaaua

SEQ ID NO: 1014707 - RNA, 22 nt, Human
uggaaugacagagagucugaau

SEQ ID NO: 1014708 - RNA, 19 nt, Human
acagggcagcaauaggaua

SEQ ID NO: 1014709 - RNA, 22 nt, Human
ggcagcuguaagaugagugaau

SEQ ID NO: 1014710 - RNA, 20 nt, Human
ugcuguaagauuagagagcu

SEQ ID NO: 1014711 - RNA, 22 nt, Human
aucuggcucgcuaggcucuggg

SEQ ID NO: 1014712 - RNA, 17 nt, Human
ucagagggaugagcagg

SEQ ID NO: 1014713 - RNA, 22 nt, Human
cagggcccaagacacaaugagg

SEQ ID NO: 1014714 - RNA, 22 nt, Human
aaccaggacaauuugaauagaa

SEQ ID NO: 1014715 - RNA, 22 nt, Human
ucccagcagcauagcucagaau

SEQ ID NO: 1014716 - RNA, 21 nt, Human
ugcaugcuauguuuuuauuuc

SEQ ID NO: 1014717 - RNA, 22 nt, Human
uccagugguacauggagacacu

SEQ ID NO: 1014718 - RNA, 22 nt, Human
augccagggucacagucauauu

SEQ ID NO: 1014719 - RNA, 19 nt, Human
ucccgcccacugagcgugc

SEQ ID NO: 1014720 - RNA, 22 nt, Human
uuuagggaauagaagaucugaa

SEQ ID NO: 1014721 - RNA, 22 nt, Human
caaggccacugcucagguuucc

SEQ ID NO: 1014722 - RNA, 22 nt, Human
uauucacaggcuggagugaugu

SEQ ID NO: 1014723 - RNA, 22 nt, Human
caggccuggagugcaauggcac

SEQ ID NO: 1014724 - RNA, 22 nt, Human
ugagccagguuaagacaggagc

SEQ ID NO: 1014725 - RNA, 22 nt, Human
gguggcuggaggagcugaugga

SEQ ID NO: 1014726 - RNA, 22 nt, Human
cccugcagccuugcaugccuuc

SEQ ID NO: 1014727 - RNA, 22 nt, Human
acaaaaguguaggaauuccuua

SEQ ID NO: 1014728 - RNA, 22 nt, Human
agaggcucugccgccucaggua

SEQ ID NO: 1014729 - RNA, 22 nt, Human
gccaggcacugcucuaagcccu

SEQ ID NO: 1014730 - RNA, 22 nt, Human
augcaagauguauagaagacuu

SEQ ID NO: 1014731 - RNA, 21 nt, Human
gcugcugccccuagugaggcc

SEQ ID NO: 1014732 - RNA, 22 nt, Human
ggcucagacucccaggcccucu

SEQ ID NO: 1014733 - RNA, 22 nt, Human
uccugcagcugcagaccugggg

SEQ ID NO: 1014734 - RNA, 22 nt, Human
uggcagaguggaccauacucaa

SEQ ID NO: 1014735 - RNA, 22 nt, Human
ucuuugaaagcuguucuagagu

SEQ ID NO: 1014736 - RNA, 22 nt, Human
cagcugggagcuccauuagaua

SEQ ID NO: 1014737 - RNA, 22 nt, Human
gugcugcagagucucgugccgc

SEQ ID NO: 1014738 - RNA, 22 nt, Human
gagccagguuugaaucucaguc

SEQ ID NO: 1014739 - RNA, 22 nt, Human
augaagcugaaaaaggcauaua

SEQ ID NO: 1014740 - RNA, 22 nt, Human
uuccuguaugucagugaagagc

SEQ ID NO: 1014741 - RNA, 22 nt, Human
uuugaacugauaaucuucuguu

SEQ ID NO: 1014742 - RNA, 22 nt, Human
gcagccagaagacucagaacaa

SEQ ID NO: 1014743 - RNA, 22 nt, Human
ccaccagcagugugcaaggauu

SEQ ID NO: 1014744 - RNA, 22 nt, Human
uuugcauuguaauauuuaguuc

SEQ ID NO: 1014745 - RNA, 22 nt, Human
cuuuauguucaguacaaugcuu

SEQ ID NO: 1014746 - RNA, 22 nt, Human
acacugcagaugaaagcauaag

SEQ ID NO: 1014747 - RNA, 22 nt, Human
ucuugggaccauuuacacauac

SEQ ID NO: 1014748 - RNA, 22 nt, Human
guguccagagaaacucacagcu

SEQ ID NO: 1014749 - RNA, 22 nt, Human
caggagaagguuuggagugcag

SEQ ID NO: 1014750 - RNA, 20 nt, Human
ccuaggcaugcugagucucc

SEQ ID NO: 1014751 - RNA, 22 nt, Human
agcagccagaaagggcagucga

SEQ ID NO: 1014752 - RNA, 20 nt, Human
ucagugauuuugaagaggaa

SEQ ID NO: 1014753 - RNA, 22 nt, Human
acauacauaugacaacuuuccu

SEQ ID NO: 1014754 - RNA, 22 nt, Human
uagcuuuaggaugguucucuug

SEQ ID NO: 1014755 - RNA, 22 nt, Human
aagauggaguaguguaaugguu

SEQ ID NO: 1014756 - RNA, 22 nt, Human
agcugccucagcaacacagacc

SEQ ID NO: 1014757 - RNA, 22 nt, Human
guuuacauauuuuaauugguga

SEQ ID NO: 1014758 - RNA, 22 nt, Human
cucuccagaauaugccgccgug

SEQ ID NO: 1014759 - RNA, 22 nt, Human
ugggcuccguugccuggggcag

SEQ ID NO: 1014760 - RNA, 22 nt, Human
gcucagaggaugcuccuuuaug

SEQ ID NO: 1014761 - RNA, 22 nt, Human
ugcagcccuuccuuccucuggg

SEQ ID NO: 1014762 - RNA, 22 nt, Human
accaggcagucaccguccagga

SEQ ID NO: 1014763 - RNA, 18 nt, Human
ugaacagaugaguugaag

SEQ ID NO: 1014764 - RNA, 22 nt, Human
ucagaggaaaggucagauggcu

SEQ ID NO: 1014765 - RNA, 22 nt, Human
ggcuggcaagugucugcucaug

SEQ ID NO: 1014766 - RNA, 22 nt, Human
ggcucuggugggaagguuagau

SEQ ID NO: 1014767 - RNA, 22 nt, Human
ccucagggccaucucugucccu

SEQ ID NO: 1014768 - RNA, 22 nt, Human
ugauuuccccagucuugcugcu

SEQ ID NO: 1014769 - RNA, 22 nt, Human
aaaaaucacuuuuauaggcagc

SEQ ID NO: 1014770 - RNA, 22 nt, Human
aagagguugucugugaugaguu

SEQ ID NO: 1014771 - RNA, 22 nt, Human
gugaggugguacaauauuaacu

SEQ ID NO: 1014772 - RNA, 22 nt, Human
agcaggagcugugggaagaugg

SEQ ID NO: 1014773 - RNA, 19 nt, Human
ugggcuuccccagggcaga

SEQ ID NO: 1014774 - RNA, 22 nt, Human
uuaugacaggaaaaucacagaa

SEQ ID NO: 1014775 - RNA, 22 nt, Human
ccagucacagguguguuuauau

SEQ ID NO: 1014776 - RNA, 22 nt, Human
uaguuaggaaaguccagggagc

SEQ ID NO: 1014777 - RNA, 22 nt, Human
uuucaaagaguuguaaauuacu

SEQ ID NO: 1014778 - RNA, 21 nt, Human
ucauuugugaucugauuucca

SEQ ID NO: 1014779 - RNA, 22 nt, Human
cucuggaauguuuacaugcccu

SEQ ID NO: 1014780 - RNA, 22 nt, Human
cuuaacagauacaucugugguu

SEQ ID NO: 1014781 - RNA, 22 nt, Human
ucaugacaacuauauuauucca

SEQ ID NO: 1014782 - RNA, 22 nt, Human
ccaaaugugccuguuucaacaa

SEQ ID NO: 1014783 - RNA, 22 nt, Human
uuucugaagggcagcagacucu

SEQ ID NO: 1014784 - RNA, 22 nt, Human
gagggcucaacuacuacuaggc

SEQ ID NO: 1014785 - RNA, 22 nt, Human
accaggcaugauguggagcaca

SEQ ID NO: 1014786 - RNA, 22 nt, Human
uuucacauacaguguauaguag

SEQ ID NO: 1014787 - RNA, 19 nt, Human
aauuagggagucgguuaag

SEQ ID NO: 1014788 - RNA, 18 nt, Human
aaacuggcuuggccugug

SEQ ID NO: 1014789 - RNA, 22 nt, Human
cagcugccuaugaccuagccuc

SEQ ID NO: 1014790 - RNA, 20 nt, Human
uacagaaugcaauaaaaugg

SEQ ID NO: 1014791 - RNA, 22 nt, Human
uuccaguuaaggaagcuauucu

SEQ ID NO: 1014792 - RNA, 22 nt, Human
ggcuucccuuuccgagaggaga

SEQ ID NO: 1014793 - RNA, 22 nt, Human
cucaggaggugguagaggcccu

SEQ ID NO: 1014794 - RNA, 22 nt, Human
ucagggcaccaaaaaagaugcc

SEQ ID NO: 1014795 - RNA, 22 nt, Human
cuggagcucuccagagccccgu

SEQ ID NO: 1014796 - RNA, 22 nt, Human
ccaggccagcaggcacaccugc

SEQ ID NO: 1014797 - RNA, 22 nt, Human
uuacaaaguucugaguucaaac

SEQ ID NO: 1014798 - RNA, 22 nt, Human
aaggcucccucuucucgagugu

SEQ ID NO: 1014799 - RNA, 22 nt, Human
uagcuuuaauaagcugcugaau

SEQ ID NO: 1014800 - RNA, 21 nt, Human
gcaaccagaccacagggcagu

SEQ ID NO: 1014801 - RNA, 22 nt, Human
ucugucaggagauuggcagcug

SEQ ID NO: 1014802 - RNA, 22 nt, Human
agauggaguuaguaccagaguc

SEQ ID NO: 1014803 - RNA, 22 nt, Human
ucucucuuuuuaaucauguaau

SEQ ID NO: 1014804 - RNA, 22 nt, Human
guuugcauaaaguggaugcagg

SEQ ID NO: 1014805 - RNA, 22 nt, Human
ucacaugcuacugagccagacc

SEQ ID NO: 1014806 - RNA, 22 nt, Human
cagagcuggagaaguggauuua

SEQ ID NO: 1014807 - RNA, 22 nt, Human
ugauuuccugugcgcccuuagg

SEQ ID NO: 1014808 - RNA, 22 nt, Human
uaugaagacaaugauagcauga

SEQ ID NO: 1014809 - RNA, 21 nt, Human
ccuggcugcacaguugcuggu

SEQ ID NO: 1014810 - RNA, 21 nt, Human
aggcucagagaucaaacagua

SEQ ID NO: 1014811 - RNA, 22 nt, Human
ccaaagucugcauuuuaacaug

SEQ ID NO: 1014812 - RNA, 22 nt, Human
aagccgggccugagaaaugaca

SEQ ID NO: 1014813 - RNA, 20 nt, Human
uuaucugucaaucugucuca

SEQ ID NO: 1014814 - RNA, 22 nt, Human
ugugcuucugcagagacuauuu

SEQ ID NO: 1014815 - RNA, 22 nt, Human
ucucagggccccaaaggcuagu

SEQ ID NO: 1014816 - RNA, 22 nt, Human
auguaguguagagauuagucuc

SEQ ID NO: 1014817 - RNA, 22 nt, Human
uucacaggaauguaggggucuu

SEQ ID NO: 1014818 - RNA, 22 nt, Human
ucacauuuuuuacuggacuuaa

SEQ ID NO: 1014819 - RNA, 22 nt, Human
acaguaauaaguguuggugagg

SEQ ID NO: 1014820 - RNA, 21 nt, Human
agcagcagaucuggugagggc

SEQ ID NO: 1014821 - RNA, 22 nt, Human
caggcugcagugcaguggcuau

SEQ ID NO: 1014822 - RNA, 20 nt, Human
uggaaguucuguugcauugg

SEQ ID NO: 1014823 - RNA, 19 nt, Human
gcuccugggccucacucau

SEQ ID NO: 1014824 - RNA, 22 nt, Human
aguguuccacacaucuggggaa

SEQ ID NO: 1014825 - RNA, 19 nt, Human
accucugcagagauguuua

SEQ ID NO: 1014826 - RNA, 22 nt, Human
uaaagguagcaugaaacugcaa

SEQ ID NO: 1014827 - RNA, 22 nt, Human
ucauugcaguagggagagaccc

SEQ ID NO: 1014828 - RNA, 22 nt, Human
gugucccagccccacaggccug

SEQ ID NO: 1014829 - RNA, 22 nt, Human
cacaggaggaggugcccgggcc

SEQ ID NO: 1014830 - RNA, 22 nt, Human
cugcuguguggauucaauggcu

SEQ ID NO: 1014831 - RNA, 22 nt, Human
gcagcuuuggagguggaacucu

SEQ ID NO: 1014832 - RNA, 22 nt, Human
gcuggcugcgucaucacagggc

SEQ ID NO: 1014833 - RNA, 22 nt, Human
uuugaaagccuggcuuuucucu

SEQ ID NO: 1014834 - RNA, 22 nt, Human
ccagccucacuggcaucaccua

SEQ ID NO: 1014835 - RNA, 22 nt, Human
auuaguaaaacauuguauaugu

SEQ ID NO: 1014836 - RNA, 22 nt, Human
cccagggaaugacucuggccuu

SEQ ID NO: 1014837 - RNA, 22 nt, Human
uucaaucauuagaaucucaggc

SEQ ID NO: 1014838 - RNA, 19 nt, Human
cuuugucagaacaugcuuc

SEQ ID NO: 1014839 - RNA, 22 nt, Human
uuugaaaggaauuaggaugaca

SEQ ID NO: 1014840 - RNA, 22 nt, Human
gaaaucugucuuuguuugaaua

SEQ ID NO: 1014841 - RNA, 22 nt, Human
ccuggcagaauauuaaagugca

SEQ ID NO: 1014842 - RNA, 22 nt, Human
cagggcugagaauuuagagaca

SEQ ID NO: 1014843 - RNA, 22 nt, Human
guaugcaucgacucaagucuga

SEQ ID NO: 1014844 - RNA, 22 nt, Human
uuguaacagcugcuuaauagag

SEQ ID NO: 1014845 - RNA, 22 nt, Human
uucuucaguguagcaacuguau

SEQ ID NO: 1014846 - RNA, 22 nt, Human
caauauucaguggaaaagccau

SEQ ID NO: 1014847 - RNA, 22 nt, Human
uucuucagucccacuagccaca

SEQ ID NO: 1014848 - RNA, 22 nt, Human
uuauuuucuccucagaaagugg

SEQ ID NO: 1014849 - RNA, 22 nt, Human
cugcuguggccagccaggucaa

SEQ ID NO: 1014850 - RNA, 22 nt, Human
ccaggccuucugaggacacucu

SEQ ID NO: 1014851 - RNA, 22 nt, Human
accgaaggaaacuggaaccguu

SEQ ID NO: 1014852 - RNA, 22 nt, Human
cuucccugauaagagccucaga

SEQ ID NO: 1014853 - RNA, 22 nt, Human
uguuuauugagugccuacuaua

SEQ ID NO: 1014854 - RNA, 18 nt, Human
acccaggcucaugguccu

SEQ ID NO: 1014855 - RNA, 22 nt, Human
cugggaggauucauugagguga

SEQ ID NO: 1014856 - RNA, 22 nt, Human
aacugcuguggccuaguacuua

SEQ ID NO: 1014857 - RNA, 18 nt, Human
cugagggcagccccuggg

SEQ ID NO: 1014858 - RNA, 22 nt, Human
gcuguguccucacacagccuuu

SEQ ID NO: 1014859 - RNA, 22 nt, Human
ggacucagcagccaggaguggc

SEQ ID NO: 1014860 - RNA, 22 nt, Human
aaugagcuagaccugcuuccuc

SEQ ID NO: 1014861 - RNA, 22 nt, Human
cauucucaauaguagaugagua

SEQ ID NO: 1014862 - RNA, 22 nt, Human
agagcagauggagcuggaagag

SEQ ID NO: 1014863 - RNA, 22 nt, Human
cagggccaagcugcagcaucug

SEQ ID NO: 1014864 - RNA, 22 nt, Human
ccacaggcugcugcaggucccg

SEQ ID NO: 1014865 - RNA, 22 nt, Human
cuugugcaauugacauugaauc

SEQ ID NO: 1014866 - RNA, 19 nt, Human
caggaaugagguaauggcu

SEQ ID NO: 1014867 - RNA, 22 nt, Human
uuugaaaucuaaucaaggaaca

SEQ ID NO: 1014868 - RNA, 22 nt, Human
cagcccuggaacagcugacuca

SEQ ID NO: 1014869 - RNA, 22 nt, Human
aaggucauuguugcauguucuc

SEQ ID NO: 1014870 - RNA, 22 nt, Human
ggagccuguggccgucacgacu

SEQ ID NO: 1014871 - RNA, 22 nt, Human
ugcuggagaucauuaauguuca

SEQ ID NO: 1014872 - RNA, 22 nt, Human
aauguauggauucaugucugug

SEQ ID NO: 1014873 - RNA, 22 nt, Human
ugacagggcuagaggcaaugca

SEQ ID NO: 1014874 - RNA, 22 nt, Human
uggagcugagagccaggcuggc

SEQ ID NO: 1014875 - RNA, 22 nt, Human
auguacaguggaaacuaacaaa

SEQ ID NO: 1014876 - RNA, 22 nt, Human
uauuccaaaaucccaaacugcc

SEQ ID NO: 1014877 - RNA, 19 nt, Human
ugcaggaggacugagcaga

SEQ ID NO: 1014878 - RNA, 22 nt, Human
aaaugauugucaaaguucuguu

SEQ ID NO: 1014879 - RNA, 22 nt, Human
caggagcucuuaaggaugugau

SEQ ID NO: 1014880 - RNA, 22 nt, Human
ucucaccauggugcuugcuuau

SEQ ID NO: 1014881 - RNA, 22 nt, Human
agcauggggcaaugcaugugcu

SEQ ID NO: 1014882 - RNA, 22 nt, Human
uggcuguggacucagauggcuc

SEQ ID NO: 1014883 - RNA, 22 nt, Human
ucuggcucaggagcuguguuca

SEQ ID NO: 1014884 - RNA, 22 nt, Human
ggugcagcugcagccugggagc

SEQ ID NO: 1014885 - RNA, 22 nt, Human
ucauacaucuuguauaucuauc

SEQ ID NO: 1014886 - RNA, 22 nt, Human
ugcugucuuccaggauggugaa

SEQ ID NO: 1014887 - RNA, 22 nt, Human
uggguacuccuauuaguucagu

SEQ ID NO: 1014888 - RNA, 22 nt, Human
cacaauuuguuuuaucaguauu

SEQ ID NO: 1014889 - RNA, 22 nt, Human
agaaguuaccacauacuucucu

SEQ ID NO: 1014890 - RNA, 22 nt, Human
aacagcaauagcacuauucauu

SEQ ID NO: 1014891 - RNA, 22 nt, Human
cuggcugugcagucuuccagaa

SEQ ID NO: 1014892 - RNA, 21 nt, Human
aacauuucaggauccaaauug

SEQ ID NO: 1014893 - RNA, 22 nt, Human
aguuuaugaaacacagauuuga

SEQ ID NO: 1014894 - RNA, 22 nt, Human
agagccuguuuugugggagaug

SEQ ID NO: 1014895 - RNA, 22 nt, Human
caaagguaaagaucugcugugg

SEQ ID NO: 1014896 - RNA, 22 nt, Human
acagagccacuuuggugccuac

SEQ ID NO: 1014897 - RNA, 22 nt, Human
agaggccagggacacugcucaa

SEQ ID NO: 1014898 - RNA, 22 nt, Human
gaggccugucgcuaggccucug

SEQ ID NO: 1014899 - RNA, 22 nt, Human
agcugcugaaugacacugcaag

SEQ ID NO: 1014900 - RNA, 22 nt, Human
ugcugaggagguggcugugcuu

SEQ ID NO: 1014901 - RNA, 22 nt, Human
uggccugggccugccggugcaa

SEQ ID NO: 1014902 - RNA, 22 nt, Human
cccuggaggaaaaucugaggcu

SEQ ID NO: 1014903 - RNA, 22 nt, Human
ucacaccuguaaucccaggccu

SEQ ID NO: 1014904 - RNA, 22 nt, Human
gcccagcuuuucacuuccacac

SEQ ID NO: 1014905 - RNA, 22 nt, Human
agcucccaggcagucaugagga

SEQ ID NO: 1014906 - RNA, 22 nt, Human
cugccagccaggccagguaggc

SEQ ID NO: 1014907 - RNA, 17 nt, Human
cucagaguugcuuuguc

SEQ ID NO: 1014908 - RNA, 22 nt, Human
agggcagagagaugaaugggau

SEQ ID NO: 1014909 - RNA, 22 nt, Human
gaagcccacguuuggugaugua

SEQ ID NO: 1014910 - RNA, 22 nt, Human
aucugccucuucuucauugcga

SEQ ID NO: 1014911 - RNA, 22 nt, Human
ggggcagagaauaaaaaccuaa

SEQ ID NO: 1014912 - RNA, 22 nt, Human
cacugugggguuuggcuggaac

SEQ ID NO: 1014913 - RNA, 22 nt, Human
uucauaguguuuccuuccagug

SEQ ID NO: 1014914 - RNA, 22 nt, Human
uuucaacaccagagaccaugcg

SEQ ID NO: 1014915 - RNA, 22 nt, Human
caagcagagacuagauagcugu

SEQ ID NO: 1014916 - RNA, 22 nt, Human
uggcacugccaaccugcuaggu

SEQ ID NO: 1014917 - RNA, 22 nt, Human
cugcucuagagagcauuaguca

SEQ ID NO: 1014918 - RNA, 22 nt, Human
ucugccuguucaagucuucuag

SEQ ID NO: 1014919 - RNA, 22 nt, Human
uaaaugcagauuccugagccua

SEQ ID NO: 1014920 - RNA, 23 nt, Human
uccaagggcuacaaacacagacc

SEQ ID NO: 1014921 - RNA, 17 nt, Human
gccuuccuuccuccaca

SEQ ID NO: 1014922 - RNA, 22 nt, Human
cagcuggcgggcagagccgcca

SEQ ID NO: 1014923 - RNA, 22 nt, Human
auucuggauuaucaguccacca

SEQ ID NO: 1014924 - RNA, 22 nt, Human
auuauaggcuugagccaccgug

SEQ ID NO: 1014925 - RNA, 22 nt, Human
cucuggaguggguggccgggag

SEQ ID NO: 1014926 - RNA, 22 nt, Human
aagacuguacauuuuccagucu

SEQ ID NO: 1014927 - RNA, 22 nt, Human
aggcucugugauccacaaugag

SEQ ID NO: 1014928 - RNA, 22 nt, Human
aucuagaaguggcaugaauuac

SEQ ID NO: 1014929 - RNA, 21 nt, Human
caauaaacugcacauugagac

SEQ ID NO: 1014930 - RNA, 22 nt, Human
cugucuguuucugauucaaccu

SEQ ID NO: 1014931 - RNA, 22 nt, Human
guuagaauaaaaggucagagag

SEQ ID NO: 1014932 - RNA, 22 nt, Human
ggcagggucuggacugaaagcu

SEQ ID NO: 1014933 - RNA, 22 nt, Human
acagaauucucucugcagaggc

SEQ ID NO: 1014934 - RNA, 21 nt, Human
uucuucaugaugauuaauggc

SEQ ID NO: 1014935 - RNA, 22 nt, Human
cugaggccucucuccugggcuu

SEQ ID NO: 1014936 - RNA, 22 nt, Human
aauaauuuccagccaacuggaa

SEQ ID NO: 1014937 - RNA, 22 nt, Human
gagaggccaaaaucccugcccc

SEQ ID NO: 1014938 - RNA, 22 nt, Human
cguguacagucuaucuuuuuuc

SEQ ID NO: 1014939 - RNA, 22 nt, Human
aggccugaggaccagauaaaug

SEQ ID NO: 1014940 - RNA, 22 nt, Human
ggagggcaucaaucaggccugg

SEQ ID NO: 1014941 - RNA, 23 nt, Human
agaagcagcuucuggaguaucgg

SEQ ID NO: 1014942 - RNA, 22 nt, Human
cacaauguauauguauaucaaa

SEQ ID NO: 1014943 - RNA, 22 nt, Human
cccagcuccgagcuccgagccg

SEQ ID NO: 1014944 - RNA, 22 nt, Human
agcagccaauuggaggaugaag

SEQ ID NO: 1014945 - RNA, 22 nt, Human
ucacugcagacaaccucaguca

SEQ ID NO: 1014946 - RNA, 22 nt, Human
caguggccugagccaggcuucc

SEQ ID NO: 1014947 - RNA, 22 nt, Human
ugucaaagccugaaucacauag

SEQ ID NO: 1014948 - RNA, 22 nt, Human
auuuauuaagcaucugcuaugu

SEQ ID NO: 1014949 - RNA, 22 nt, Human
ccagcucucagcgggagacuca

SEQ ID NO: 1014950 - RNA, 22 nt, Human
gcuggcagccaagugaagaggg

SEQ ID NO: 1014951 - RNA, 22 nt, Human
uccucaggugacuagguaucuu

SEQ ID NO: 1014952 - RNA, 22 nt, Human
guggcugcuaagucuccuuccu

SEQ ID NO: 1014953 - RNA, 22 nt, Human
gaugugagugguagcugggauu

SEQ ID NO: 1014954 - RNA, 22 nt, Human
agccagggacgcugcaggcuac

SEQ ID NO: 1014955 - RNA, 22 nt, Human
ugggaccugcccuggccccauc

SEQ ID NO: 1014956 - RNA, 22 nt, Human
agaauucuguucuucgggugug

SEQ ID NO: 1014957 - RNA, 22 nt, Human
ugccugugucacagugauguuu

SEQ ID NO: 1014958 - RNA, 21 nt, Human
uauacaugugugcauacgugu

SEQ ID NO: 1014959 - RNA, 22 nt, Human
guucuugccagcauccucaggu

SEQ ID NO: 1014960 - RNA, 22 nt, Human
gcaaggcuuugugaauuuuaaa

SEQ ID NO: 1014961 - RNA, 22 nt, Human
ggcaggagggcggacaaugacc

SEQ ID NO: 1014962 - RNA, 23 nt, Human
ccucccaccuauuucacuuucuu

SEQ ID NO: 1014963 - RNA, 22 nt, Human
gcauccagucuuggcuccugga

SEQ ID NO: 1014964 - RNA, 22 nt, Human
cagcugccccgcuggcugacca

SEQ ID NO: 1014965 - RNA, 22 nt, Human
uacaaagucagaauaacaggug

SEQ ID NO: 1014966 - RNA, 22 nt, Human
caggggcuuaagugacagaagg

SEQ ID NO: 1014967 - RNA, 21 nt, Human
cccuugccugcacuccucggc

SEQ ID NO: 1014968 - RNA, 22 nt, Human
auucuuggcaaggagauuuaaa

SEQ ID NO: 1014969 - RNA, 22 nt, Human
uucacauuucauaccacagcuu

SEQ ID NO: 1014970 - RNA, 21 nt, Human
agaugaggauacugaggccua

SEQ ID NO: 1014971 - RNA, 22 nt, Human
cagaggcaggaagaugggcagu

SEQ ID NO: 1014972 - RNA, 22 nt, Human
uagcagcugugaguaaaagcca

SEQ ID NO: 1014973 - RNA, 22 nt, Human
gggcccacuggcugucugaccc

SEQ ID NO: 1014974 - RNA, 22 nt, Human
gcagcuuugaagacuuauuugc

SEQ ID NO: 1014975 - RNA, 22 nt, Human
gcucuccacugaccacggggca

SEQ ID NO: 1014976 - RNA, 22 nt, Human
aaauuugauaagccauuguuac

SEQ ID NO: 1014977 - RNA, 22 nt, Human
caggaaaggugugucaugaugg

SEQ ID NO: 1014978 - RNA, 22 nt, Human
cugagccauccauaccagcuua

SEQ ID NO: 1014979 - RNA, 22 nt, Human
uucaagauggcugcaaauacuu

SEQ ID NO: 1014980 - RNA, 22 nt, Human
acacaguauuacaauaggugcu

SEQ ID NO: 1014981 - RNA, 22 nt, Human
cucugcagaggcccaaggcuga

SEQ ID NO: 1014982 - RNA, 22 nt, Human
gcagggcugcugaaacuuguuu

SEQ ID NO: 1014983 - RNA, 22 nt, Human
acugaaggcuuaacucuuucau

SEQ ID NO: 1014984 - RNA, 17 nt, Human
auuucacuuagcaugag

SEQ ID NO: 1014985 - RNA, 22 nt, Human
agagcccugaagcagagcuaaa

SEQ ID NO: 1014986 - RNA, 19 nt, Human
ucgagucaagacacuaggc

SEQ ID NO: 1014987 - RNA, 22 nt, Human
ugccuaggaaaccucaugcuuc

SEQ ID NO: 1014988 - RNA, 18 nt, Human
gcccagaggucugggccc

SEQ ID NO: 1014989 - RNA, 22 nt, Human
auggagacgcaagggaccuagg

SEQ ID NO: 1014990 - RNA, 22 nt, Human
cugggccagcaacugcaaugga

SEQ ID NO: 1014991 - RNA, 22 nt, Human
cugcuguguuagcagguuuagu

SEQ ID NO: 1014992 - RNA, 22 nt, Human
ucuccuucgaggcccagcuccc

SEQ ID NO: 1014993 - RNA, 22 nt, Human
ucugaaaugcaaauuugacuga

SEQ ID NO: 1014994 - RNA, 22 nt, Human
aagcagccagccaucaugcccg

SEQ ID NO: 1014995 - RNA, 22 nt, Human
aggcacugaccugcuuccuuga

SEQ ID NO: 1014996 - RNA, 22 nt, Human
aauuucaauuacuuuugcacca

SEQ ID NO: 1014997 - RNA, 22 nt, Human
ccagagucuaugaguccucauu

SEQ ID NO: 1014998 - RNA, 22 nt, Human
cacagggccacuuucccaguaa

SEQ ID NO: 1014999 - RNA, 21 nt, Human
gcacagggacagaucaucaca

SEQ ID NO: 1015000 - RNA, 22 nt, Human
uccaggcaaaaaccaacuacag

SEQ ID NO: 1015001 - RNA, 22 nt, Human
uuccaaagaaauugaccaagac

SEQ ID NO: 1015002 - RNA, 22 nt, Human
cugaggcucaagggcagguggg

SEQ ID NO: 1015003 - RNA, 18 nt, Human
uuucacaaccuccagagg

SEQ ID NO: 1015004 - RNA, 17 nt, Human
aggugcagaggcagagc

SEQ ID NO: 1015005 - RNA, 22 nt, Human
uucuucaaugugcccuguuuuc

SEQ ID NO: 1015006 - RNA, 22 nt, Human
gccugguggugugcucaagugg

SEQ ID NO: 1015007 - RNA, 22 nt, Human
ggcugccucuggaagcuggaga

SEQ ID NO: 1015008 - RNA, 22 nt, Human
uuucagcugguaaaggaguagc

SEQ ID NO: 1015009 - RNA, 22 nt, Human
acagauuugacugguaccuggc

SEQ ID NO: 1015010 - RNA, 22 nt, Human
gggccuggggacaccaccauga

SEQ ID NO: 1015011 - RNA, 22 nt, Human
uccuucuuucccccuagucauu

SEQ ID NO: 1015012 - RNA, 22 nt, Human
uucauugucucuguuugccuuc

SEQ ID NO: 1015013 - RNA, 22 nt, Human
ugagcuguagcagaugcuguug

SEQ ID NO: 1015014 - RNA, 22 nt, Human
aaaagacauaugugggcauucu

SEQ ID NO: 1015015 - RNA, 22 nt, Human
aaaagucagucucuccuagcuc

SEQ ID NO: 1015016 - RNA, 22 nt, Human
uccagcagguccgagacaaguu

SEQ ID NO: 1015017 - RNA, 22 nt, Human
ccuggccacucagguguggggc

SEQ ID NO: 1015018 - RNA, 22 nt, Human
auccaggcgaaugcagaaggcc

SEQ ID NO: 1015019 - RNA, 21 nt, Human
cugcuuuacuucagaggaucu

SEQ ID NO: 1015020 - RNA, 22 nt, Human
aggcuggcccuacuggcugccu

SEQ ID NO: 1015021 - RNA, 22 nt, Human
ucucuucuaauuaggguccaug

SEQ ID NO: 1015022 - RNA, 20 nt, Human
aguguuccggaagacuggca

SEQ ID NO: 1015023 - RNA, 22 nt, Human
ccaggagcuggagggugcagug

SEQ ID NO: 1015024 - RNA, 18 nt, Human
cccucuugcacaaagcaa

SEQ ID NO: 1015025 - RNA, 22 nt, Human
uauuuccagcaguaagaagaca

SEQ ID NO: 1015026 - RNA, 22 nt, Human
ccuggcagcuccuccccggcgg

SEQ ID NO: 1015027 - RNA, 22 nt, Human
gcugaagggagugcugagucug

SEQ ID NO: 1015028 - RNA, 22 nt, Human
ucaggagagaaagaauacaauu

SEQ ID NO: 1015029 - RNA, 22 nt, Human
aaucuucuacuugacaguucuc

SEQ ID NO: 1015030 - RNA, 22 nt, Human
uggauaaacucacuguaaguug

SEQ ID NO: 1015031 - RNA, 22 nt, Human
uaacacauagauauuuuaacuu

SEQ ID NO: 1015032 - RNA, 22 nt, Human
gguggccuccagggcauaggug

SEQ ID NO: 1015033 - RNA, 22 nt, Human
gccuggccugaacuaggaggug

SEQ ID NO: 1015034 - RNA, 21 nt, Human
ugguuugcggccaaaguuaaa

SEQ ID NO: 1015035 - RNA, 22 nt, Human
gaggacugcagaugggugcauc

SEQ ID NO: 1015036 - RNA, 22 nt, Human
ccucucuguaagggucccuccc

SEQ ID NO: 1015037 - RNA, 22 nt, Human
agaaggaguguacaggucaugc

SEQ ID NO: 1015038 - RNA, 22 nt, Human
ucuguggccuguguccaagugc

SEQ ID NO: 1015039 - RNA, 22 nt, Human
uaugaagauauaucugaucucu

SEQ ID NO: 1015040 - RNA, 22 nt, Human
uuaucacuuaugagcuuuuugc

SEQ ID NO: 1015041 - RNA, 22 nt, Human
uggccucuggcugaggacuaac

SEQ ID NO: 1015042 - RNA, 22 nt, Human
gacccagccugguuuuuauagg

SEQ ID NO: 1015043 - RNA, 22 nt, Human
accucugccaagaugugcuccc

SEQ ID NO: 1015044 - RNA, 22 nt, Human
aauucuuguuguuaguauauuu

SEQ ID NO: 1015045 - RNA, 22 nt, Human
uucucagaggagucgggagcug

SEQ ID NO: 1015046 - RNA, 20 nt, Human
agggcagcuugaggagccgg

SEQ ID NO: 1015047 - RNA, 19 nt, Human
cagaacagaggucauggcc

SEQ ID NO: 1015048 - RNA, 22 nt, Human
aauaugcauuaacuguguacau

SEQ ID NO: 1015049 - RNA, 22 nt, Human
ugcuuuauucgacaucugguag

SEQ ID NO: 1015050 - RNA, 17 nt, Human
ggugaguguccaggugg

SEQ ID NO: 1015051 - RNA, 22 nt, Human
aaaauguguuuaugcauuucgu

SEQ ID NO: 1015052 - RNA, 22 nt, Human
gcuuuggagccuguguucugcc

SEQ ID NO: 1015053 - RNA, 22 nt, Human
cagagcugcaaaugccccuccg

SEQ ID NO: 1015054 - RNA, 22 nt, Human
cacaggaggaggccagagcgua

SEQ ID NO: 1015055 - RNA, 22 nt, Human
ggggagaguccuuuccaguucc

SEQ ID NO: 1015056 - RNA, 22 nt, Human
gagcucccuggagguucagaua

SEQ ID NO: 1015057 - RNA, 22 nt, Human
ggccaggcugcccugggagcag

SEQ ID NO: 1015058 - RNA, 22 nt, Human
acacauuuacauguuuacguau

SEQ ID NO: 1015059 - RNA, 22 nt, Human
aaaguguugggaagaaagugca

SEQ ID NO: 1015060 - RNA, 22 nt, Human
ccugugaggucaucugugguaa

SEQ ID NO: 1015061 - RNA, 22 nt, Human
ggccugcacagagguggcucua

SEQ ID NO: 1015062 - RNA, 17 nt, Human
aggcagcucagaacauc

SEQ ID NO: 1015063 - RNA, 22 nt, Human
agauuucaaugugagcauuagu

SEQ ID NO: 1015064 - RNA, 22 nt, Human
cugucaucacaguugagcagcc

SEQ ID NO: 1015065 - RNA, 22 nt, Human
ucaggugguccuaagugccauc

SEQ ID NO: 1015066 - RNA, 22 nt, Human
aucagagacaaaaccagcacuu

SEQ ID NO: 1015067 - RNA, 22 nt, Human
ugucuguacaaauuuucugugu

SEQ ID NO: 1015068 - RNA, 22 nt, Human
acagaaauauucguggugcuug

SEQ ID NO: 1015069 - RNA, 22 nt, Human
uacuuuaaaaacugauaauuca

SEQ ID NO: 1015070 - RNA, 22 nt, Human
agguggggugagcugcagacua

SEQ ID NO: 1015071 - RNA, 22 nt, Human
aguuuauguaaaauuaguaaug

SEQ ID NO: 1015072 - RNA, 20 nt, Human
aacacagauaccaaagguug

SEQ ID NO: 1015073 - RNA, 22 nt, Human
ugcagccaggaaauauuugcug

SEQ ID NO: 1015074 - RNA, 22 nt, Human
ggcuucccagcagagggcgcac

SEQ ID NO: 1015075 - RNA, 22 nt, Human
ccuccaggaacuugagagacac

SEQ ID NO: 1015076 - RNA, 21 nt, Human
uaucuacuggugucuuucaga

SEQ ID NO: 1015077 - RNA, 22 nt, Human
ggagauagacuuggugagccac

SEQ ID NO: 1015078 - RNA, 22 nt, Human
ugggcagaggacagggaagauc

SEQ ID NO: 1015079 - RNA, 23 nt, Human
agggaaaguaguaauggccuuug

SEQ ID NO: 1015080 - RNA, 22 nt, Human
gaaaauguuuguccggagcuga

SEQ ID NO: 1015081 - RNA, 22 nt, Human
gaccuggaggauccucuucuug

SEQ ID NO: 1015082 - RNA, 22 nt, Human
uggcagucggacuucuaucuca

SEQ ID NO: 1015083 - RNA, 22 nt, Human
uggcuuccugcacagugucugc

SEQ ID NO: 1015084 - RNA, 22 nt, Human
aaaggucaaaaucgugacauug

SEQ ID NO: 1015085 - RNA, 22 nt, Human
uggagcaggcaucuuucucucu

SEQ ID NO: 1015086 - RNA, 22 nt, Human
ggaugcaggggcagcagagccu

SEQ ID NO: 1015087 - RNA, 22 nt, Human
cagcucucuaaggucuugcuuu

SEQ ID NO: 1015088 - RNA, 22 nt, Human
gcccacacaccagcucaggagg

SEQ ID NO: 1015089 - RNA, 22 nt, Human
aggccuggccuuuauguucaag

SEQ ID NO: 1015090 - RNA, 22 nt, Human
aaguuuaacuugaauucuuucu

SEQ ID NO: 1015091 - RNA, 22 nt, Human
aggccugagccccagguuuguu

SEQ ID NO: 1015092 - RNA, 22 nt, Human
uaggcacugaguacauauuggu

SEQ ID NO: 1015093 - RNA, 22 nt, Human
ccaaggagcugcaggcacuugu

SEQ ID NO: 1015094 - RNA, 22 nt, Human
ccucucauagucuguauccuuu

SEQ ID NO: 1015095 - RNA, 22 nt, Human
caguuucuuggaugccaauuuc

SEQ ID NO: 1015096 - RNA, 22 nt, Human
gaggcuggugguuaguuccauu

SEQ ID NO: 1015097 - RNA, 22 nt, Human
gcaucuaauccaguccagcauc

SEQ ID NO: 1015098 - RNA, 22 nt, Human
uccaggaggccucauuuccugu

SEQ ID NO: 1015099 - RNA, 22 nt, Human
cccagcauccucagggagcggg

SEQ ID NO: 1015100 - RNA, 22 nt, Human
ccagggcaaaugagaucauagc

SEQ ID NO: 1015101 - RNA, 22 nt, Human
gcaaaucaccaccuagcuggau

SEQ ID NO: 1015102 - RNA, 22 nt, Human
uuauuuaaugugaucugaagag

SEQ ID NO: 1015103 - RNA, 22 nt, Human
guuauuagaagugaaggauugu

SEQ ID NO: 1015104 - RNA, 22 nt, Human
gcagggucgcucuaggagauca

SEQ ID NO: 1015105 - RNA, 22 nt, Human
cuagccugggauuugaacuuau

SEQ ID NO: 1015106 - RNA, 22 nt, Human
uaaagcacauaucuuacaauaa

SEQ ID NO: 1015107 - RNA, 22 nt, Human
aaauacagauuccagggucuua

SEQ ID NO: 1015108 - RNA, 22 nt, Human
auaugcauaugucaaaacuuau

SEQ ID NO: 1015109 - RNA, 22 nt, Human
gcuuuuucaaaugaaagcuggu

SEQ ID NO: 1015110 - RNA, 22 nt, Human
guacauuucauuuaaaugaugu

SEQ ID NO: 1015111 - RNA, 22 nt, Human
cagcuugaaauauuaggagaug

SEQ ID NO: 1015112 - RNA, 22 nt, Human
gaaggaaaaauacucuguaagg

SEQ ID NO: 1015113 - RNA, 17 nt, Human
cuggagccuccaacucc

SEQ ID NO: 1015114 - RNA, 22 nt, Human
ggugggcacccgagacuggauc

SEQ ID NO: 1015115 - RNA, 22 nt, Human
uuuggaaugguaccuucaguug

SEQ ID NO: 1015116 - RNA, 22 nt, Human
ccugagaggcccucucacuguc

SEQ ID NO: 1015117 - RNA, 22 nt, Human
ucugaggcuaagagacagaggc

SEQ ID NO: 1015118 - RNA, 22 nt, Human
uuauucuucuucucuugccagg

SEQ ID NO: 1015119 - RNA, 16 nt, Human
agcagggcgggaagga

SEQ ID NO: 1015120 - RNA, 22 nt, Human
aucaguuuuuauuaauguagcu

SEQ ID NO: 1015121 - RNA, 22 nt, Human
gaacagcugcuagagaucugug

SEQ ID NO: 1015122 - RNA, 22 nt, Human
cugcucuggggaagccagaugu

SEQ ID NO: 1015123 - RNA, 22 nt, Human
ccaaagagcuagaauuauaggc

SEQ ID NO: 1015124 - RNA, 22 nt, Human
cagcuuuauugagguauaauug

SEQ ID NO: 1015125 - RNA, 22 nt, Human
acuucacagauauuuauuuggu

SEQ ID NO: 1015126 - RNA, 22 nt, Human
gaggcucugugaugugccaggc

SEQ ID NO: 1015127 - RNA, 22 nt, Human
aucaggauucaccccagagcug

SEQ ID NO: 1015128 - RNA, 22 nt, Human
uagggacacugcucaugaguuc

SEQ ID NO: 1015129 - RNA, 22 nt, Human
uguauacaggauuacucauagc

SEQ ID NO: 1015130 - RNA, 22 nt, Human
uaacagaaaggggacagaaaua

SEQ ID NO: 1015131 - RNA, 22 nt, Human
gugcaugugucuuuauaguagc

SEQ ID NO: 1015132 - RNA, 20 nt, Human
guaaaauauggucuuugggu

SEQ ID NO: 1015133 - RNA, 22 nt, Human
gugacaguggucacuuguaguu

SEQ ID NO: 1015134 - RNA, 20 nt, Human
cccucccagaugcuucccaa

SEQ ID NO: 1015135 - RNA, 22 nt, Human
cagggcucccuugcaaggaggg

SEQ ID NO: 1015136 - RNA, 22 nt, Human
gaagcacauggcuauagcuauu

SEQ ID NO: 1015137 - RNA, 22 nt, Human
gggugaggagcugccagucaug

SEQ ID NO: 1015138 - RNA, 20 nt, Human
ucccuggaggugguggcauc

SEQ ID NO: 1015139 - RNA, 22 nt, Human
cugggagcuggaugcccugccc

SEQ ID NO: 1015140 - RNA, 19 nt, Human
cuuauuagagugagagcuu

SEQ ID NO: 1015141 - RNA, 22 nt, Human
cagagccagaacuagaccuugu

SEQ ID NO: 1015142 - RNA, 21 nt, Human
ccagacuggccuaugugguag

SEQ ID NO: 1015143 - RNA, 19 nt, Human
aggcugcaagguggugggc

SEQ ID NO: 1015144 - RNA, 22 nt, Human
augaagcuaaacccugcagcca

SEQ ID NO: 1015145 - RNA, 20 nt, Human
aauaaaagaagccuucaccc

SEQ ID NO: 1015146 - RNA, 22 nt, Human
uccagggccaagucauggaacc

SEQ ID NO: 1015147 - RNA, 22 nt, Human
gggcuggaggugagcaggacag

SEQ ID NO: 1015148 - RNA, 22 nt, Human
uacauagcaaggaaaugacaga

SEQ ID NO: 1015149 - RNA, 22 nt, Human
agcugccaggccccugagaacc

SEQ ID NO: 1015150 - RNA, 22 nt, Human
gggccugacugagagcuccuca

SEQ ID NO: 1015151 - RNA, 23 nt, Human
uggggcugauggagacggaccag

SEQ ID NO: 1015152 - RNA, 22 nt, Human
gguggcagcgucuaucugacau

SEQ ID NO: 1015153 - RNA, 18 nt, Human
uggugaaggguggaggag

SEQ ID NO: 1015154 - RNA, 19 nt, Human
ucugucacuggggguauuc

SEQ ID NO: 1015155 - RNA, 22 nt, Human
aucuagcaguguuauaauugga

SEQ ID NO: 1015156 - RNA, 22 nt, Human
ugcugccaccugguggcugaag

SEQ ID NO: 1015157 - RNA, 19 nt, Human
aauccaggauaagccccuu

SEQ ID NO: 1015158 - RNA, 22 nt, Human
aucugcuugaaugagcaacagg

SEQ ID NO: 1015159 - RNA, 22 nt, Human
cuccaggggccagaagccuggc

SEQ ID NO: 1015160 - RNA, 22 nt, Human
uaccuuggguugaguucauucu

SEQ ID NO: 1015161 - RNA, 22 nt, Human
cugggagcccugacuagccugg

SEQ ID NO: 1015162 - RNA, 22 nt, Human
caaauucucacccuguuugauu

SEQ ID NO: 1015163 - RNA, 22 nt, Human
uuggcucaggaccccugugacu

SEQ ID NO: 1015164 - RNA, 22 nt, Human
uagggcagccacccaggcugcu

SEQ ID NO: 1015165 - RNA, 22 nt, Human
acacaguaccccaaggcugggc

SEQ ID NO: 1015166 - RNA, 22 nt, Human
aaucaagaaaaugaggauucuu

SEQ ID NO: 1015167 - RNA, 22 nt, Human
ucugcugcugagcacacuccua

SEQ ID NO: 1015168 - RNA, 22 nt, Human
cagggcucacucggcuggcguc

SEQ ID NO: 1015169 - RNA, 22 nt, Human
agcuuuaccugccuuggggcac

SEQ ID NO: 1015170 - RNA, 22 nt, Human
auccaggcugcgggucucaagu

SEQ ID NO: 1015171 - RNA, 22 nt, Human
guguaugauuucaaauggcuag

SEQ ID NO: 1015172 - RNA, 22 nt, Human
agcaguggcuggauggugugcu

SEQ ID NO: 1015173 - RNA, 22 nt, Human
augucacagucugacucaguga

SEQ ID NO: 1015174 - RNA, 20 nt, Human
ccugccugccucggcucauu

SEQ ID NO: 1015175 - RNA, 22 nt, Human
uggcagcugucuguggggucuc

SEQ ID NO: 1015176 - RNA, 22 nt, Human
uaagcugugggagauuggcaua

SEQ ID NO: 1015177 - RNA, 22 nt, Human
agaaugcuccagagcugaaaga

SEQ ID NO: 1015178 - RNA, 21 nt, Human
uggcacugcuuagcagguucc

SEQ ID NO: 1015179 - RNA, 22 nt, Human
uggcagugccccuugaccagug

SEQ ID NO: 1015180 - RNA, 22 nt, Human
caacugugaauuuuaugauacc

SEQ ID NO: 1015181 - RNA, 22 nt, Human
guaucuuuccacaucuucagua

SEQ ID NO: 1015182 - RNA, 22 nt, Human
ugggagcagccucagcuucggg

SEQ ID NO: 1015183 - RNA, 22 nt, Human
caugggcucuucuggacugcac

SEQ ID NO: 1015184 - RNA, 22 nt, Human
uagcacauuguugaccagaagg

SEQ ID NO: 1015185 - RNA, 22 nt, Human
uggagcauauucuggagcuugg

SEQ ID NO: 1015186 - RNA, 22 nt, Human
ugggcugcagagcccggccuuc

SEQ ID NO: 1015187 - RNA, 22 nt, Human
gaggccugguagccgagcccca

SEQ ID NO: 1015188 - RNA, 22 nt, Human
acugaaagauaaaucaguuagc

SEQ ID NO: 1015189 - RNA, 21 nt, Human
agggcagauuagcuguaagag

SEQ ID NO: 1015190 - RNA, 22 nt, Human
auugaauagaugcauuauacua

SEQ ID NO: 1015191 - RNA, 22 nt, Human
aaggcacuuuuccugagaugau

SEQ ID NO: 1015192 - RNA, 22 nt, Human
agagacaggauaucugcucaug

SEQ ID NO: 1015193 - RNA, 22 nt, Human
ugaugcugagccugggacugac

SEQ ID NO: 1015194 - RNA, 22 nt, Human
ucaggcagaggauggggagcgu

SEQ ID NO: 1015195 - RNA, 22 nt, Human
uaagaacauaaauucauacggg

SEQ ID NO: 1015196 - RNA, 20 nt, Human
agugacagagacuguguggc

SEQ ID NO: 1015197 - RNA, 22 nt, Human
ugagccuggggccugggcagcg

SEQ ID NO: 1015198 - RNA, 22 nt, Human
aguccagugucaaggugccauu

SEQ ID NO: 1015199 - RNA, 19 nt, Human
agccuggcuuugcucugcu

SEQ ID NO: 1015200 - RNA, 22 nt, Human
uggcagcuuccugcucauagga

SEQ ID NO: 1015201 - RNA, 22 nt, Human
cuggggaggcagggcugccccu

SEQ ID NO: 1015202 - RNA, 22 nt, Human
gcaggugggggucggugcaucu

SEQ ID NO: 1015203 - RNA, 22 nt, Human
uaagaagcuucugcuaaugccu

SEQ ID NO: 1015204 - RNA, 22 nt, Human
guggugcaggccagcaggggcg

SEQ ID NO: 1015205 - RNA, 19 nt, Human
agccuggagggcuggucac

SEQ ID NO: 1015206 - RNA, 22 nt, Human
cuucugugcuucacaguugcca

SEQ ID NO: 1015207 - RNA, 22 nt, Human
agcugcccuggcggagcugcuc

SEQ ID NO: 1015208 - RNA, 22 nt, Human
ggccugagucccaccuggcugu

SEQ ID NO: 1015209 - RNA, 22 nt, Human
uuucuguaauuaaaagggcagg

SEQ ID NO: 1015210 - RNA, 22 nt, Human
ccugaggggcugcaggccagcu

SEQ ID NO: 1015211 - RNA, 22 nt, Human
ggcuggcuggcugguagacaag

SEQ ID NO: 1015212 - RNA, 22 nt, Human
uggcagcuggagggcaauggcc

SEQ ID NO: 1015213 - RNA, 22 nt, Human
uugaaauaucaaguuauuagug

SEQ ID NO: 1015214 - RNA, 22 nt, Human
agagcuggguggacuuguaguu

SEQ ID NO: 1015215 - RNA, 22 nt, Human
gucaggauuaaugggaguaugc

SEQ ID NO: 1015216 - RNA, 22 nt, Human
uggcagaguucgcuccuauuca

SEQ ID NO: 1015217 - RNA, 22 nt, Human
uucacagaauggcaaguuaugg

SEQ ID NO: 1015218 - RNA, 22 nt, Human
agaucucaccucuguguauuau

SEQ ID NO: 1015219 - RNA, 22 nt, Human
ucuggcucccuggagcuccaca

SEQ ID NO: 1015220 - RNA, 22 nt, Human
gcagagcccuggggguauggug

SEQ ID NO: 1015221 - RNA, 17 nt, Human
uuuucucucuuggauuc

SEQ ID NO: 1015222 - RNA, 22 nt, Human
gcuguucaagacuaggaaauuu

SEQ ID NO: 1015223 - RNA, 22 nt, Human
uggcucuggggacaguaagucc

SEQ ID NO: 1015224 - RNA, 22 nt, Human
ccaggagcagggcuggcugcac

SEQ ID NO: 1015225 - RNA, 22 nt, Human
agugcauuauauguuucaaugg

SEQ ID NO: 1015226 - RNA, 21 nt, Human
uuuauguacuucauagaguag

SEQ ID NO: 1015227 - RNA, 22 nt, Human
aucagcaaguccuguuaauucu

SEQ ID NO: 1015228 - RNA, 22 nt, Human
cuggagcuaauaauccaucuga

SEQ ID NO: 1015229 - RNA, 22 nt, Human
gcuugggauaugcugauguaaa

SEQ ID NO: 1015230 - RNA, 22 nt, Human
uuagaaaucaccucugaagauc

SEQ ID NO: 1015231 - RNA, 22 nt, Human
gccuuggccaacaccuugcaaa

SEQ ID NO: 1015232 - RNA, 22 nt, Human
caaaugugguuucucagcauuc

SEQ ID NO: 1015233 - RNA, 22 nt, Human
cagagcuguauuuaucuuucca

SEQ ID NO: 1015234 - RNA, 22 nt, Human
agcucccagcagagcuggccac

SEQ ID NO: 1015235 - RNA, 22 nt, Human
auguaugaugcuaggcucucag

SEQ ID NO: 1015236 - RNA, 22 nt, Human
ugauuuccacgugcacccaggu

SEQ ID NO: 1015237 - RNA, 22 nt, Human
aggagaaguaaggcuagaugau

SEQ ID NO: 1015238 - RNA, 22 nt, Human
caggcagggagcuggaaaggau

SEQ ID NO: 1015239 - RNA, 22 nt, Human
ggcacagagcccagcuuccuag

SEQ ID NO: 1015240 - RNA, 22 nt, Human
cagaguguauucugcaguugca

SEQ ID NO: 1015241 - RNA, 22 nt, Human
uccuugaagcaacgugcagaca

SEQ ID NO: 1015242 - RNA, 22 nt, Human
cccaagaucuuucgugcacuaa

SEQ ID NO: 1015243 - RNA, 22 nt, Human
uccuugaaaggggcugcagggc

SEQ ID NO: 1015244 - RNA, 22 nt, Human
uucagagaugacaccugguguu

SEQ ID NO: 1015245 - RNA, 22 nt, Human
ucaggcaguagaauugcuugaa

SEQ ID NO: 1015246 - RNA, 22 nt, Human
ucuuucaaugagcauucuuucc

SEQ ID NO: 1015247 - RNA, 22 nt, Human
aggcacugugcugaugucuuau

SEQ ID NO: 1015248 - RNA, 20 nt, Human
ucagauuuuucuaacuuuga

SEQ ID NO: 1015249 - RNA, 22 nt, Human
gcagaggcacagccccagauga

SEQ ID NO: 1015250 - RNA, 22 nt, Human
aagaauguuaguuucugauaca

SEQ ID NO: 1015251 - RNA, 22 nt, Human
caguuucuacgaaggucaaccc

SEQ ID NO: 1015252 - RNA, 17 nt, Human
aagacagaagccaugag

SEQ ID NO: 1015253 - RNA, 22 nt, Human
uccaugagacagauacuguaag

SEQ ID NO: 1015254 - RNA, 22 nt, Human
agugaaauaaagcugccuaugg

SEQ ID NO: 1015255 - RNA, 22 nt, Human
agaugggcgcccuggacugagg

SEQ ID NO: 1015256 - RNA, 22 nt, Human
guucuucagucacaucacagaa

SEQ ID NO: 1015257 - RNA, 22 nt, Human
ccucccaccauuuagagagagc

SEQ ID NO: 1015258 - RNA, 21 nt, Human
agaugcugugcuccaggagca

SEQ ID NO: 1015259 - RNA, 22 nt, Human
acaugucaauuuaguacucuua

SEQ ID NO: 1015260 - RNA, 22 nt, Human
aaauacagaguugcuuaaaagc

SEQ ID NO: 1015261 - RNA, 22 nt, Human
augauguuauuuucagaaacau

SEQ ID NO: 1015262 - RNA, 22 nt, Human
gggcucucaaggcagggcccca

SEQ ID NO: 1015263 - RNA, 22 nt, Human
cugggcuggcgcauccgacacg

SEQ ID NO: 1015264 - RNA, 22 nt, Human
acacaugcugauaagaauauaa

SEQ ID NO: 1015265 - RNA, 22 nt, Human
ggcaguagccagggacuggcag

SEQ ID NO: 1015266 - RNA, 22 nt, Human
ugggcagauguccucugaagug

SEQ ID NO: 1015267 - RNA, 20 nt, Human
gguagcagcugcugucaucc

SEQ ID NO: 1015268 - RNA, 21 nt, Human
acagaggcauacagcuuaagg

SEQ ID NO: 1015269 - RNA, 22 nt, Human
auuuccagugcacugaauagaa

SEQ ID NO: 1015270 - RNA, 22 nt, Human
acccugagucagacagccugac

SEQ ID NO: 1015271 - RNA, 22 nt, Human
ucaguauccacaaaugcucaaa

SEQ ID NO: 1015272 - RNA, 22 nt, Human
gaggcagcugaaggagugacag

SEQ ID NO: 1015273 - RNA, 23 nt, Human
ccugggcauuggcugcagcuucu

SEQ ID NO: 1015274 - RNA, 22 nt, Human
cuccuuccccuacucagcaucc

SEQ ID NO: 1015275 - RNA, 22 nt, Human
auuugcaaagucguaucuguga

SEQ ID NO: 1015276 - RNA, 22 nt, Human
guuuuauaggcuguugcuauau

SEQ ID NO: 1015277 - RNA, 22 nt, Human
uauuugauagagauaaaugaua

SEQ ID NO: 1015278 - RNA, 22 nt, Human
ccaggagucuggaugagguguc

SEQ ID NO: 1015279 - RNA, 22 nt, Human
agggagcuguggucagcucagu

SEQ ID NO: 1015280 - RNA, 22 nt, Human
ucagagaugcagugccaccuac

SEQ ID NO: 1015281 - RNA, 22 nt, Human
uggagugaaguaaagaggacaa

SEQ ID NO: 1015282 - RNA, 22 nt, Human
guccagagauggacgagcagau

SEQ ID NO: 1015283 - RNA, 22 nt, Human
ugggcaaguaucggacucugag

SEQ ID NO: 1015284 - RNA, 22 nt, Human
gaaggccauuuuuagguagaau

SEQ ID NO: 1015285 - RNA, 22 nt, Human
gcugccugcacagagcugcuuu

SEQ ID NO: 1015286 - RNA, 22 nt, Human
agaggccuaaccaagauguccu

SEQ ID NO: 1015287 - RNA, 22 nt, Human
uagaaguuaaaggaauacagaa

SEQ ID NO: 1015288 - RNA, 22 nt, Human
aaaugcacagaggccagagagg

SEQ ID NO: 1015289 - RNA, 20 nt, Human
ggcugccuccuuccuuuccu

SEQ ID NO: 1015290 - RNA, 22 nt, Human
ugucaugcagguuuguuauaga

SEQ ID NO: 1015291 - RNA, 22 nt, Human
cagggccugccugguuccugga

SEQ ID NO: 1015292 - RNA, 22 nt, Human
ugggcugcuguuacaggggcug

SEQ ID NO: 1015293 - RNA, 22 nt, Human
aggaccugccaggugcaaagca

SEQ ID NO: 1015294 - RNA, 21 nt, Human
acagggcaugcagcuggcugu

SEQ ID NO: 1015295 - RNA, 21 nt, Human
cagaggggcuagccuggcugc

SEQ ID NO: 1015296 - RNA, 22 nt, Human
ugccaggcauauggccucuuug

SEQ ID NO: 1015297 - RNA, 22 nt, Human
cagacacaccaggcccauucug

SEQ ID NO: 1015298 - RNA, 22 nt, Human
ugucucaguacacuccgauguu

SEQ ID NO: 1015299 - RNA, 22 nt, Human
agccccacacucucucugagaa

SEQ ID NO: 1015300 - RNA, 22 nt, Human
aacaguaaugugguguuggguu

SEQ ID NO: 1015301 - RNA, 22 nt, Human
aaaaaguuucaacugccaacuc

SEQ ID NO: 1015302 - RNA, 22 nt, Human
gagaggccauggcugugcagug

SEQ ID NO: 1015303 - RNA, 23 nt, Human
ccagcuccgugagccucgggcuc

SEQ ID NO: 1015304 - RNA, 22 nt, Human
uggcccugcuguaucaucugcu

SEQ ID NO: 1015305 - RNA, 22 nt, Human
cacuggugacuucugagcugga

SEQ ID NO: 1015306 - RNA, 22 nt, Human
ccaggccugugcaaggagggag

SEQ ID NO: 1015307 - RNA, 20 nt, Human
ucucccaggcucagggaaga

SEQ ID NO: 1015308 - RNA, 20 nt, Human
gccugccucagcuagcugag

SEQ ID NO: 1015309 - RNA, 22 nt, Human
gcaaaugcucuccuuggucagg

SEQ ID NO: 1015310 - RNA, 22 nt, Human
ggagcugaugacgucaccaugg

SEQ ID NO: 1015311 - RNA, 22 nt, Human
ugucaugcuuauguuacauacu

SEQ ID NO: 1015312 - RNA, 22 nt, Human
agagugucugguagcugcucug

SEQ ID NO: 1015313 - RNA, 22 nt, Human
ucaguggauauuucuguggcug

SEQ ID NO: 1015314 - RNA, 22 nt, Human
ugugccugaguuggcugaguac

SEQ ID NO: 1015315 - RNA, 22 nt, Human
uuuuuaagagauucuccagucu

SEQ ID NO: 1015316 - RNA, 22 nt, Human
cugccagcucgccacaaugaca

SEQ ID NO: 1015317 - RNA, 22 nt, Human
gcugcuccgucugagcucuggu

SEQ ID NO: 1015318 - RNA, 21 nt, Human
aggcuguccuuugccagcccu

SEQ ID NO: 1015319 - RNA, 22 nt, Human
ggcucuggugcccuggcuccca

SEQ ID NO: 1015320 - RNA, 22 nt, Human
aaaaacugcaauuacuuuuguc

SEQ ID NO: 1015321 - RNA, 22 nt, Human
agcugccagaugacagugcuau

SEQ ID NO: 1015322 - RNA, 22 nt, Human
auucuucaccauggauaauuug

SEQ ID NO: 1015323 - RNA, 22 nt, Human
cuggcucaccuccgcuccagca

SEQ ID NO: 1015324 - RNA, 22 nt, Human
ugguuuaccccuguccuauauc

SEQ ID NO: 1015325 - RNA, 22 nt, Human
augaaaacuuuagccucauuag

SEQ ID NO: 1015326 - RNA, 22 nt, Human
ccagcuuuuggggugacaauuu

SEQ ID NO: 1015327 - RNA, 22 nt, Human
uaugcacaccuggguccuuguc

SEQ ID NO: 1015328 - RNA, 22 nt, Human
uuugcauugccucugacuuaug

SEQ ID NO: 1015329 - RNA, 20 nt, Human
uaacuuucuaugcuuucagc

SEQ ID NO: 1015330 - RNA, 23 nt, Human
aaggccagaauuucaauggugcc

SEQ ID NO: 1015331 - RNA, 22 nt, Human
auucuccacacauccagaccuu

SEQ ID NO: 1015332 - RNA, 22 nt, Human
acucaggaaaugagaggcucuc

SEQ ID NO: 1015333 - RNA, 21 nt, Human
ugcucacagaugugcucagug

SEQ ID NO: 1015334 - RNA, 22 nt, Human
gcuggccugggcagccugucgg

SEQ ID NO: 1015335 - RNA, 19 nt, Human
uggcaggcccaggauggac

SEQ ID NO: 1015336 - RNA, 22 nt, Human
ccugggcaaaugccagagacaa

SEQ ID NO: 1015337 - RNA, 21 nt, Human
gcaggaugcaucuuggugucu

SEQ ID NO: 1015338 - RNA, 19 nt, Human
gcucugugaugcugagggg

SEQ ID NO: 1015339 - RNA, 20 nt, Human
cagggccacgcuccaaggca

SEQ ID NO: 1015340 - RNA, 22 nt, Human
cccuccagccauggacccaggu

SEQ ID NO: 1015341 - RNA, 22 nt, Human
cugcucugcaaggcacagugau

SEQ ID NO: 1015342 - RNA, 22 nt, Human
cagccucucuguaucucaggau

SEQ ID NO: 1015343 - RNA, 22 nt, Human
ggagggcucaauugacuccuga

SEQ ID NO: 1015344 - RNA, 23 nt, Human
ugcuucucugcuugacaguucug

SEQ ID NO: 1015345 - RNA, 22 nt, Human
aucuggcugagcgaggcccaca

SEQ ID NO: 1015346 - RNA, 23 nt, Human
cccagcuuucccacugccgagag

SEQ ID NO: 1015347 - RNA, 22 nt, Human
aggacagaccuaggacuggagc

SEQ ID NO: 1015348 - RNA, 22 nt, Human
aagaggucauaccagauaaggg

SEQ ID NO: 1015349 - RNA, 22 nt, Human
aaucuucagugucuaaaaagca

SEQ ID NO: 1015350 - RNA, 22 nt, Human
ucccagccacagguguagcccu

SEQ ID NO: 1015351 - RNA, 22 nt, Human
acccaggguagaaccucagagc

SEQ ID NO: 1015352 - RNA, 22 nt, Human
gcucuggacccuggaguggcug

SEQ ID NO: 1015353 - RNA, 22 nt, Human
ucauacaauucaaucucugauu

SEQ ID NO: 1015354 - RNA, 22 nt, Human
uggcagaggaggcucagauuga

SEQ ID NO: 1015355 - RNA, 22 nt, Human
agggaggauaguagucaguuua

SEQ ID NO: 1015356 - RNA, 22 nt, Human
uucucagagugaccaagucuuu

SEQ ID NO: 1015357 - RNA, 22 nt, Human
uggcagcugaggggaggcuuug

SEQ ID NO: 1015358 - RNA, 22 nt, Human
uaccugcagcgggaauccauua

SEQ ID NO: 1015359 - RNA, 20 nt, Human
ucugaggcugagcucuacuu

SEQ ID NO: 1015360 - RNA, 22 nt, Human
gugcuuccaucuagagggucac

SEQ ID NO: 1015361 - RNA, 22 nt, Human
ggcuuuaugcacagcagauggu

SEQ ID NO: 1015362 - RNA, 22 nt, Human
aguggggacuuaugccagcauu

SEQ ID NO: 1015363 - RNA, 22 nt, Human
gggcugcugcugccagcgacac

SEQ ID NO: 1015364 - RNA, 22 nt, Human
ucucugaaggggagcuguuuaa

SEQ ID NO: 1015365 - RNA, 15 nt, Human
ugggcagaucacuug

SEQ ID NO: 1015366 - RNA, 22 nt, Human
ggcagagcuuguuccuucuguu

SEQ ID NO: 1015367 - RNA, 22 nt, Human
cacaaugcguacauauaucaaa

SEQ ID NO: 1015368 - RNA, 21 nt, Human
aauuagggugccucuuauaau

SEQ ID NO: 1015369 - RNA, 22 nt, Human
caggucagaggcgcagccccca

SEQ ID NO: 1015370 - RNA, 22 nt, Human
agcaccugccugcauuggcuau

SEQ ID NO: 1015371 - RNA, 22 nt, Human
aggcugcuucagcugcagggag

SEQ ID NO: 1015372 - RNA, 22 nt, Human
auguaacuguuauauuuuguug

SEQ ID NO: 1015373 - RNA, 22 nt, Human
auaugaaaauguuuuagcugua

SEQ ID NO: 1015374 - RNA, 22 nt, Human
cagagcugguguuacaagucca

SEQ ID NO: 1015375 - RNA, 22 nt, Human
gcuugcucaacccccgucucuc

SEQ ID NO: 1015376 - RNA, 22 nt, Human
ugagcagagucgcuccagagug

SEQ ID NO: 1015377 - RNA, 22 nt, Human
uuaauaaacaggugcagcugaa

SEQ ID NO: 1015378 - RNA, 22 nt, Human
ugaacccaggagguugcaguga

SEQ ID NO: 1015379 - RNA, 22 nt, Human
gacagccucaugaggagcaaaa

SEQ ID NO: 1015380 - RNA, 22 nt, Human
uaugcacauugguuuccucauu

SEQ ID NO: 1015381 - RNA, 22 nt, Human
ugugccaggcacuugcccaggc

SEQ ID NO: 1015382 - RNA, 22 nt, Human
guccaagagucaagaagggggc

SEQ ID NO: 1015383 - RNA, 22 nt, Human
caauuucugggccucacacaag

SEQ ID NO: 1015384 - RNA, 22 nt, Human
cuguccagcugaccagagcagc

SEQ ID NO: 1015385 - RNA, 22 nt, Human
ugaggugaagaguggagcucag

SEQ ID NO: 1015386 - RNA, 22 nt, Human
ggaggaccugcuggcccugcaa

SEQ ID NO: 1015387 - RNA, 22 nt, Human
aggggugaaagagggcccucaa

SEQ ID NO: 1015388 - RNA, 22 nt, Human
uggccucuuaggacauccucua

SEQ ID NO: 1015389 - RNA, 17 nt, Human
gcagcagagagacccuc

SEQ ID NO: 1015390 - RNA, 22 nt, Human
ugagccaggcacugcuccugga

SEQ ID NO: 1015391 - RNA, 22 nt, Human
ccuccugggcuccugucugcac

SEQ ID NO: 1015392 - RNA, 22 nt, Human
gcagggcuguucaggagggugg

SEQ ID NO: 1015393 - RNA, 22 nt, Human
cugcuuugggcagcuuuguggc

SEQ ID NO: 1015394 - RNA, 19 nt, Human
uuacuuggcaaagucaguc

SEQ ID NO: 1015395 - RNA, 22 nt, Human
agcucacaguguccuuccucaa

SEQ ID NO: 1015396 - RNA, 22 nt, Human
aaggcacuacgcugcuggggcg

SEQ ID NO: 1015397 - RNA, 23 nt, Human
gacagagugagaccuugucuuac

SEQ ID NO: 1015398 - RNA, 22 nt, Human
gccuggcuccuaagagcacaac

SEQ ID NO: 1015399 - RNA, 22 nt, Human
ggggaggcugaugugggcaaag

SEQ ID NO: 1015400 - RNA, 22 nt, Human
uuucagauuaucucaacuuugg

SEQ ID NO: 1015401 - RNA, 21 nt, Human
cccugcaggccagggcugagc

SEQ ID NO: 1015402 - RNA, 22 nt, Human
cagguacacucccuugugcuga

SEQ ID NO: 1015403 - RNA, 22 nt, Human
uucugggacaucuggacaguuu

SEQ ID NO: 1015404 - RNA, 22 nt, Human
uucauucccuuauauuagcauu

SEQ ID NO: 1015405 - RNA, 22 nt, Human
uccaggaggaggaaggcugcca

SEQ ID NO: 1015406 - RNA, 22 nt, Human
ugggagagugcucaaugugcaa

SEQ ID NO: 1015407 - RNA, 22 nt, Human
agggcagccugagugcuggccc

SEQ ID NO: 1015408 - RNA, 22 nt, Human
ugcuuggcuuucugagcuucug

SEQ ID NO: 1015409 - RNA, 22 nt, Human
ucaaugauaguacaaucagccu

SEQ ID NO: 1015410 - RNA, 22 nt, Human
ucaggaggccaccaggaccugu

SEQ ID NO: 1015411 - RNA, 22 nt, Human
uugaagcaugguacuuguucaa

SEQ ID NO: 1015412 - RNA, 22 nt, Human
aggaguguggccagggcucugg

SEQ ID NO: 1015413 - RNA, 22 nt, Human
cagucccacaagaucuccacaa

SEQ ID NO: 1015414 - RNA, 22 nt, Human
gcucuggguagccacugccugg

SEQ ID NO: 1015415 - RNA, 22 nt, Human
uguucaauccccagguccugaa

SEQ ID NO: 1015416 - RNA, 22 nt, Human
cugagacuuucaugugcuuuua

SEQ ID NO: 1015417 - RNA, 22 nt, Human
uuucaguguaucuuccaaaagc

SEQ ID NO: 1015418 - RNA, 22 nt, Human
agagaauuacagaagaauguca

SEQ ID NO: 1015419 - RNA, 22 nt, Human
caggcagagugagguggucuaa

SEQ ID NO: 1015420 - RNA, 22 nt, Human
uggcugggggugcuauagcugc

SEQ ID NO: 1015421 - RNA, 22 nt, Human
cugcuguguaucauuuuagaug

SEQ ID NO: 1015422 - RNA, 22 nt, Human
caggagcagaggguggucagca

SEQ ID NO: 1015423 - RNA, 22 nt, Human
guguguuuagcauuagcagggg

SEQ ID NO: 1015424 - RNA, 22 nt, Human
uggcugugggaugagagccuca

SEQ ID NO: 1015425 - RNA, 22 nt, Human
gaggaggcuaagugggcucugg

SEQ ID NO: 1015426 - RNA, 22 nt, Human
ggucccugcugaagccuuggug

SEQ ID NO: 1015427 - RNA, 22 nt, Human
cuguggcuaggaagcuguggga

SEQ ID NO: 1015428 - RNA, 22 nt, Human
ucuucucucauguaggagggaa

SEQ ID NO: 1015429 - RNA, 22 nt, Human
cccagguggguuggccucuguc

SEQ ID NO: 1015430 - RNA, 22 nt, Human
agagcuggauggucaagauggc

SEQ ID NO: 1015431 - RNA, 22 nt, Human
ccuggcugccgagugugcagcg

SEQ ID NO: 1015432 - RNA, 22 nt, Human
gcaggccuuggcaaugagccug

SEQ ID NO: 1015433 - RNA, 22 nt, Human
gggcuggcucccagguguugaa

SEQ ID NO: 1015434 - RNA, 22 nt, Human
uauuuagaacagacaauagaaa

SEQ ID NO: 1015435 - RNA, 22 nt, Human
gcucaaggcaggcagacaugag

SEQ ID NO: 1015436 - RNA, 22 nt, Human
aaauucaguuuuaauaaucacu

SEQ ID NO: 1015437 - RNA, 22 nt, Human
ucauucuccucuggaaaaggca

SEQ ID NO: 1015438 - RNA, 22 nt, Human
gcaggagcugcucuccugacga

SEQ ID NO: 1015439 - RNA, 22 nt, Human
uauguacauguuaaagggcaaa

SEQ ID NO: 1015440 - RNA, 22 nt, Human
cacagacccagaagggaugaag

SEQ ID NO: 1015441 - RNA, 22 nt, Human
guguauaaugcuguuuguacau

SEQ ID NO: 1015442 - RNA, 20 nt, Human
ggaagcagagaacuguuuuc

SEQ ID NO: 1015443 - RNA, 22 nt, Human
acagugucugacacauuguagc

SEQ ID NO: 1015444 - RNA, 22 nt, Human
guaggaagcucugaggcuaguu

SEQ ID NO: 1015445 - RNA, 18 nt, Human
cucugcuaaugggcagcu

SEQ ID NO: 1015446 - RNA, 22 nt, Human
uggggccuggucagagcugcac

SEQ ID NO: 1015447 - RNA, 22 nt, Human
uauauguaaauaagucuaaugu

SEQ ID NO: 1015448 - RNA, 22 nt, Human
ucccagcccagauuugugugac

SEQ ID NO: 1015449 - RNA, 22 nt, Human
cuuuguagcugcuucugauuua

SEQ ID NO: 1015450 - RNA, 22 nt, Human
gaggcccaggucaagcagccac

SEQ ID NO: 1015451 - RNA, 22 nt, Human
cagucccuaguggagcucacag

SEQ ID NO: 1015452 - RNA, 20 nt, Human
ugggccuguggcagaagucu

SEQ ID NO: 1015453 - RNA, 22 nt, Human
uggcugcuuguuuuagugaggc

SEQ ID NO: 1015454 - RNA, 18 nt, Human
ugaccugcgcuucacggu

SEQ ID NO: 1015455 - RNA, 22 nt, Human
cuuuauuagauguagacuuucu

SEQ ID NO: 1015456 - RNA, 22 nt, Human
aauguaugugauuauuccucua

SEQ ID NO: 1015457 - RNA, 22 nt, Human
guaaaauugcaauuacuuuugc

SEQ ID NO: 1015458 - RNA, 19 nt, Human
ugaggccaaggucacagau

SEQ ID NO: 1015459 - RNA, 22 nt, Human
ccucccaccguaucucaguggc

SEQ ID NO: 1015460 - RNA, 22 nt, Human
agaauucucuuccauugaaaca

SEQ ID NO: 1015461 - RNA, 22 nt, Human
gaauccaggguuguuugagcua

SEQ ID NO: 1015462 - RNA, 22 nt, Human
aaacagaaauuuccucaugcuc

SEQ ID NO: 1015463 - RNA, 22 nt, Human
cugcugugcacccaggaaggcu

SEQ ID NO: 1015464 - RNA, 22 nt, Human
ucucaaaucaaacuuugagcuu

SEQ ID NO: 1015465 - RNA, 17 nt, Human
ccuuucucuuucaucuc

SEQ ID NO: 1015466 - RNA, 20 nt, Human
uucuggaggcuacaagucug

SEQ ID NO: 1015467 - RNA, 22 nt, Human
ucaggaugaccacgagccucua

SEQ ID NO: 1015468 - RNA, 22 nt, Human
uugcauuguugcaaugaaguau

SEQ ID NO: 1015469 - RNA, 17 nt, Human
acaggccugcuugcacu

SEQ ID NO: 1015470 - RNA, 22 nt, Human
aaaucucaggccucuauuuacu

SEQ ID NO: 1015471 - RNA, 22 nt, Human
caggggaagaugccaagggaga

SEQ ID NO: 1015472 - RNA, 22 nt, Human
ugcaccugagaggucucugagg

SEQ ID NO: 1015473 - RNA, 22 nt, Human
ucaccugggagggcugugguag

SEQ ID NO: 1015474 - RNA, 20 nt, Human
aagagaagaagucuuugaaa

SEQ ID NO: 1015475 - RNA, 22 nt, Human
uuagccauauagaaaaagagcu

SEQ ID NO: 1015476 - RNA, 22 nt, Human
ccugggcuuucaaaaccagccu

SEQ ID NO: 1015477 - RNA, 23 nt, Human
uguagcaucucuuauuucucagc

SEQ ID NO: 1015478 - RNA, 22 nt, Human
uuugacauggaauaacucauuu

SEQ ID NO: 1015479 - RNA, 22 nt, Human
uaagcuauuccugaagaagguu

SEQ ID NO: 1015480 - RNA, 22 nt, Human
ggagagaaauugagguagcaag

SEQ ID NO: 1015481 - RNA, 22 nt, Human
aaggcuuuuaacuacuguuuua

SEQ ID NO: 1015482 - RNA, 22 nt, Human
uguacaaugccgagacuaacuc

SEQ ID NO: 1015483 - RNA, 22 nt, Human
gagcuuuaccuuagguucuguu

SEQ ID NO: 1015484 - RNA, 22 nt, Human
gccagcagguugucaaggagcu

SEQ ID NO: 1015485 - RNA, 22 nt, Human
uggaugcuguaggacacgcucu

SEQ ID NO: 1015486 - RNA, 22 nt, Human
cugaggccucuguucaccagaa

SEQ ID NO: 1015487 - RNA, 22 nt, Human
cuuacauuuaaucaugugucau

SEQ ID NO: 1015488 - RNA, 22 nt, Human
gaaggagcuaaagggagcccug

SEQ ID NO: 1015489 - RNA, 20 nt, Human
uauuuacaacuuagagccuc

SEQ ID NO: 1015490 - RNA, 21 nt, Human
uagggcaggcauuggaagaga

SEQ ID NO: 1015491 - RNA, 22 nt, Human
agcugccagggacugggcaugg

SEQ ID NO: 1015492 - RNA, 22 nt, Human
gcuucuaucccuccacugcacu

SEQ ID NO: 1015493 - RNA, 22 nt, Human
aacaugcugccuuucuacgagu

SEQ ID NO: 1015494 - RNA, 22 nt, Human
ucacagaauagcacuguaagcg

SEQ ID NO: 1015495 - RNA, 22 nt, Human
auccccagaaaauaggugccua

SEQ ID NO: 1015496 - RNA, 22 nt, Human
agcugucuaccugcagaguccu

SEQ ID NO: 1015497 - RNA, 22 nt, Human
uggcagaggcucugugauguug

SEQ ID NO: 1015498 - RNA, 22 nt, Human
uaucuacaggugucagguaaga

SEQ ID NO: 1015499 - RNA, 17 nt, Human
agcugccagggagugug

SEQ ID NO: 1015500 - RNA, 23 nt, Human
cugcagccgcguggggacgugga

SEQ ID NO: 1015501 - RNA, 22 nt, Human
acauguguauagccuguauaga

SEQ ID NO: 1015502 - RNA, 22 nt, Human
cagaccugagguugaguaccag

SEQ ID NO: 1015503 - RNA, 22 nt, Human
cuggaugcuuccucucugcuag

SEQ ID NO: 1015504 - RNA, 22 nt, Human
ccacccugagccgcaagagcag

SEQ ID NO: 1015505 - RNA, 22 nt, Human
uaaggcaccauaauauauuuaa

SEQ ID NO: 1015506 - RNA, 22 nt, Human
gcugagcuagcuaucucagucu

SEQ ID NO: 1015507 - RNA, 22 nt, Human
uccugagggcgauucagcaggu

SEQ ID NO: 1015508 - RNA, 22 nt, Human
gggaucagaaacauagcccuga

SEQ ID NO: 1015509 - RNA, 23 nt, Human
uccaugagaugugggcuucuagu

SEQ ID NO: 1015510 - RNA, 18 nt, Human
accugccuguucuucucu

SEQ ID NO: 1015511 - RNA, 22 nt, Human
aaaaaugcuuggacuuaauaaa

SEQ ID NO: 1015512 - RNA, 22 nt, Human
ugguccuggggaucugcaguga

SEQ ID NO: 1015513 - RNA, 22 nt, Human
aagaguuaagcaacagauacca

SEQ ID NO: 1015514 - RNA, 22 nt, Human
agggccuggcuucacuuucuca

SEQ ID NO: 1015515 - RNA, 22 nt, Human
ugggcugccagcucuccagaug

SEQ ID NO: 1015516 - RNA, 22 nt, Human
uuuccucuccggggccuccagg

SEQ ID NO: 1015517 - RNA, 20 nt, Human
cuguagggugcagcaggcuc

SEQ ID NO: 1015518 - RNA, 22 nt, Human
aaagcucacaguaauacaaggc

SEQ ID NO: 1015519 - RNA, 22 nt, Human
gguuugcacgauauuuccaugg

SEQ ID NO: 1015520 - RNA, 22 nt, Human
gcucucugccauaugaggauac

SEQ ID NO: 1015521 - RNA, 22 nt, Human
acagggcagagugaaaugcuau

SEQ ID NO: 1015522 - RNA, 19 nt, Human
guuucauuaagauaggaaa

SEQ ID NO: 1015523 - RNA, 22 nt, Human
cugcccugccuggccagugugg

SEQ ID NO: 1015524 - RNA, 22 nt, Human
agguaggguuaauggagauaua

SEQ ID NO: 1015525 - RNA, 17 nt, Human
cucacggaggaugaauc

SEQ ID NO: 1015526 - RNA, 22 nt, Human
cuccucagucaggucuaggguc

SEQ ID NO: 1015527 - RNA, 23 nt, Human
cagaagcaccuguugacugcugc

SEQ ID NO: 1015528 - RNA, 22 nt, Human
ggucccaggaagugcggcggcg

SEQ ID NO: 1015529 - RNA, 22 nt, Human
ccagggcacguugggacaguac

SEQ ID NO: 1015530 - RNA, 18 nt, Human
cugcugugucgucugggc

SEQ ID NO: 1015531 - RNA, 22 nt, Human
gaggccuggcucugcccuccug

SEQ ID NO: 1015532 - RNA, 22 nt, Human
uucuuaacucaaauauauaucc

SEQ ID NO: 1015533 - RNA, 22 nt, Human
aagccagauagaagaacucauu

SEQ ID NO: 1015534 - RNA, 22 nt, Human
gagcugcccugagcuuugcaug

SEQ ID NO: 1015535 - RNA, 22 nt, Human
uuuggaauguaguuuaaucauc

SEQ ID NO: 1015536 - RNA, 22 nt, Human
aaguucaagucuccugaguaua

SEQ ID NO: 1015537 - RNA, 22 nt, Human
cuucucagcaugguuacuguga

SEQ ID NO: 1015538 - RNA, 22 nt, Human
auuauuagacuuauaugguagu

SEQ ID NO: 1015539 - RNA, 22 nt, Human
gugcagugacccuggagagcug

SEQ ID NO: 1015540 - RNA, 22 nt, Human
cucucugggggccaugccaaga

SEQ ID NO: 1015541 - RNA, 22 nt, Human
cucagggggaaucaggucacag

SEQ ID NO: 1015542 - RNA, 22 nt, Human
ucuggcucuccagugcucuuag

SEQ ID NO: 1015543 - RNA, 22 nt, Human
gcuuccugauauucauacuguu

SEQ ID NO: 1015544 - RNA, 22 nt, Human
agccuggauccauguggcuacc

SEQ ID NO: 1015545 - RNA, 23 nt, Human
cccagagcacagccuccagaugc

SEQ ID NO: 1015546 - RNA, 22 nt, Human
cagagccuaaaacgacuccacu

SEQ ID NO: 1015547 - RNA, 22 nt, Human
cagcugaggucaaagaagcagg

SEQ ID NO: 1015548 - RNA, 22 nt, Human
uuucuggcagcgggacaggggu

SEQ ID NO: 1015549 - RNA, 22 nt, Human
ucucuggccgagagucccuggg

SEQ ID NO: 1015550 - RNA, 22 nt, Human
uguuuauaccuugguauaacca

SEQ ID NO: 1015551 - RNA, 22 nt, Human
aguaugaaaguuaaucaauuua

SEQ ID NO: 1015552 - RNA, 22 nt, Human
cacaugggugugccuggaggaa

SEQ ID NO: 1015553 - RNA, 22 nt, Human
aaaugcagaucccugaaucuca

SEQ ID NO: 1015554 - RNA, 22 nt, Human
ugggagcaggugugcuagggaa

SEQ ID NO: 1015555 - RNA, 19 nt, Human
gacagugcaguuguaguac

SEQ ID NO: 1015556 - RNA, 21 nt, Human
ggcagcugaccgcgcggugca

SEQ ID NO: 1015557 - RNA, 22 nt, Human
cccugccuacaggguuuucuuu

SEQ ID NO: 1015558 - RNA, 22 nt, Human
caguguggugagauuccaggug

SEQ ID NO: 1015559 - RNA, 22 nt, Human
ugaacagaucaauagaacugac

SEQ ID NO: 1015560 - RNA, 22 nt, Human
ugcacagagagaugagacacgu

SEQ ID NO: 1015561 - RNA, 22 nt, Human
cagggcaggaugcugugauuau

SEQ ID NO: 1015562 - RNA, 22 nt, Human
agggauguaaauucuucuucuu

SEQ ID NO: 1015563 - RNA, 22 nt, Human
aggucaaguuuagauagaguua

SEQ ID NO: 1015564 - RNA, 22 nt, Human
uuaacauuguccuuagcagauu

SEQ ID NO: 1015565 - RNA, 22 nt, Human
acaugauauuaaugucuuauuu

SEQ ID NO: 1015566 - RNA, 22 nt, Human
uuagaacugaagaagauuaagg

SEQ ID NO: 1015567 - RNA, 21 nt, Human
uucuccccagcgaauccucgg

SEQ ID NO: 1015568 - RNA, 22 nt, Human
auuugucuuugagugcccugcu

SEQ ID NO: 1015569 - RNA, 20 nt, Human
ccagaagagaugaucaucca

SEQ ID NO: 1015570 - RNA, 22 nt, Human
ugaaugauuugggugcauucag

SEQ ID NO: 1015571 - RNA, 22 nt, Human
caagggcucuuuugaggaaugu

SEQ ID NO: 1015572 - RNA, 22 nt, Human
cagcaauaacucaaagccauuu

SEQ ID NO: 1015573 - RNA, 22 nt, Human
caaagguauaaguuaauauaca

SEQ ID NO: 1015574 - RNA, 22 nt, Human
caaugguggugucagaagagau

SEQ ID NO: 1015575 - RNA, 22 nt, Human
gggcucucgauuagacccuggg

SEQ ID NO: 1015576 - RNA, 22 nt, Human
cccagccucugggcucacccaa

SEQ ID NO: 1015577 - RNA, 22 nt, Human
uuauguauggauggcugaaagu

SEQ ID NO: 1015578 - RNA, 22 nt, Human
ccuuccuggagcccaugcagau

SEQ ID NO: 1015579 - RNA, 22 nt, Human
agugcuguccaguuucacaggu

SEQ ID NO: 1015580 - RNA, 22 nt, Human
uucuuaaaacuuauggacaggu

SEQ ID NO: 1015581 - RNA, 22 nt, Human
ugaaauuaugcauuguuguacc

SEQ ID NO: 1015582 - RNA, 22 nt, Human
uggcucagaacuacuucuaguu

SEQ ID NO: 1015583 - RNA, 20 nt, Human
gugggcagcaggcauacugg

SEQ ID NO: 1015584 - RNA, 22 nt, Human
ggcugcugugaccucaggugau

SEQ ID NO: 1015585 - RNA, 20 nt, Human
ugccaugguaacagagugug

SEQ ID NO: 1015586 - RNA, 22 nt, Human
uucagaaagugaaucuuguuau

SEQ ID NO: 1015587 - RNA, 22 nt, Human
ugcuguuauacuuagcugguua

SEQ ID NO: 1015588 - RNA, 22 nt, Human
caggggcaagaaugcugucagc

SEQ ID NO: 1015589 - RNA, 22 nt, Human
ucucagggcagcaaggaagcau

SEQ ID NO: 1015590 - RNA, 22 nt, Human
cacugcauggaugauggcugua

SEQ ID NO: 1015591 - RNA, 22 nt, Human
uccuaguucucugccagucgcu

SEQ ID NO: 1015592 - RNA, 22 nt, Human
cagagccugccucuggcugugg

SEQ ID NO: 1015593 - RNA, 17 nt, Human
ugcauguccuuuguucc

SEQ ID NO: 1015594 - RNA, 22 nt, Human
guuuuucuaggaccaugugauu

SEQ ID NO: 1015595 - RNA, 22 nt, Human
ggcagcuccucucagcaaaaga

SEQ ID NO: 1015596 - RNA, 22 nt, Human
ugcugccacugguagucucauu

SEQ ID NO: 1015597 - RNA, 20 nt, Human
ucauugcacauaauggaagc

SEQ ID NO: 1015598 - RNA, 22 nt, Human
gcagagcacccugcagugguau

SEQ ID NO: 1015599 - RNA, 22 nt, Human
ugggaaauguguuucuggacca

SEQ ID NO: 1015600 - RNA, 22 nt, Human
ccugggucuugguucaugcucu

SEQ ID NO: 1015601 - RNA, 22 nt, Human
gacaggcuuccuaagugccaga

SEQ ID NO: 1015602 - RNA, 22 nt, Human
uugggagcuuggccgagaugua

SEQ ID NO: 1015603 - RNA, 22 nt, Human
gcagggccagggcucaggcugu

SEQ ID NO: 1015604 - RNA, 22 nt, Human
gcaggaguguauuugcauguaa

SEQ ID NO: 1015605 - RNA, 19 nt, Human
ccugggagucagcugaagg

SEQ ID NO: 1015606 - RNA, 22 nt, Human
cucaaggaaagucuggagaaga

SEQ ID NO: 1015607 - RNA, 22 nt, Human
ggcagcaguccauggcccaagg

SEQ ID NO: 1015608 - RNA, 22 nt, Human
agacagcauggagcugauaaca

SEQ ID NO: 1015609 - RNA, 22 nt, Human
gggcugcuuuuaagggucucag

SEQ ID NO: 1015610 - RNA, 22 nt, Human
uccaggcaaagugcugggcugc

SEQ ID NO: 1015611 - RNA, 22 nt, Human
ucuucuuaugugccauuaucuc

SEQ ID NO: 1015612 - RNA, 22 nt, Human
ucccagagccucugccacucug

SEQ ID NO: 1015613 - RNA, 22 nt, Human
auugcuuaucuaucuuuaaguc

SEQ ID NO: 1015614 - RNA, 22 nt, Human
gcagagcagugcuugcccagcg

SEQ ID NO: 1015615 - RNA, 19 nt, Human
gcucagcagacccagugcu

SEQ ID NO: 1015616 - RNA, 22 nt, Human
gauuuuaauuauaggagguccu

SEQ ID NO: 1015617 - RNA, 22 nt, Human
gccccucccagucaggagcacu

SEQ ID NO: 1015618 - RNA, 20 nt, Human
cuguuaaaagguaugaauuc

SEQ ID NO: 1015619 - RNA, 22 nt, Human
ucuucucaguuucucuaggaug

SEQ ID NO: 1015620 - RNA, 22 nt, Human
gucccagaggacagggucacau

SEQ ID NO: 1015621 - RNA, 22 nt, Human
aucuggguucaccaugcuccug

SEQ ID NO: 1015622 - RNA, 22 nt, Human
ugcuugggaauguggagucaga

SEQ ID NO: 1015623 - RNA, 22 nt, Human
agucccagcccaguccuguaag

SEQ ID NO: 1015624 - RNA, 22 nt, Human
uauuucagucacuucuucucug

SEQ ID NO: 1015625 - RNA, 22 nt, Human
aaaguuugcaauuuauguuaau

SEQ ID NO: 1015626 - RNA, 22 nt, Human
uaagaacauuuucggaaagaua

SEQ ID NO: 1015627 - RNA, 22 nt, Human
uucaaauuaccacauuugcuua

SEQ ID NO: 1015628 - RNA, 22 nt, Human
aggcacaguggcucacaccugu

SEQ ID NO: 1015629 - RNA, 22 nt, Human
cacaaaaguaggaggcaggcgg

SEQ ID NO: 1015630 - RNA, 22 nt, Human
cagaggccauauuucuucacuc

SEQ ID NO: 1015631 - RNA, 22 nt, Human
uagaaaagaauuuuauuugaua

SEQ ID NO: 1015632 - RNA, 22 nt, Human
caggugggaccaugauagggca

SEQ ID NO: 1015633 - RNA, 22 nt, Human
ucuggaaguuagaggaggaaag

SEQ ID NO: 1015634 - RNA, 22 nt, Human
ccacccagccagaugcaggaag

SEQ ID NO: 1015635 - RNA, 22 nt, Human
uucuuaacuggaaaaugucaga

SEQ ID NO: 1015636 - RNA, 22 nt, Human
agcugagcucaggcugauguaa

SEQ ID NO: 1015637 - RNA, 22 nt, Human
agggaaauuaaugugagcaaug

SEQ ID NO: 1015638 - RNA, 22 nt, Human
gugcugucaauugcuuucagua

SEQ ID NO: 1015639 - RNA, 22 nt, Human
cagauggcaacagcucugugac

SEQ ID NO: 1015640 - RNA, 22 nt, Human
agugaguggacccugcaaggaa

SEQ ID NO: 1015641 - RNA, 22 nt, Human
ggggcagcuaccggaaguaggg

SEQ ID NO: 1015642 - RNA, 22 nt, Human
gaaccucagugaaacuggaggu

SEQ ID NO: 1015643 - RNA, 22 nt, Human
agacaggacacaagcugcauaa

SEQ ID NO: 1015644 - RNA, 22 nt, Human
ucagcaguguaguuuaucauuc

SEQ ID NO: 1015645 - RNA, 22 nt, Human
cauugcacuucugcuuuuccuc

SEQ ID NO: 1015646 - RNA, 22 nt, Human
cgcuggccauagccuccugugu

SEQ ID NO: 1015647 - RNA, 22 nt, Human
caagagcuuuagaaaugcucau

SEQ ID NO: 1015648 - RNA, 22 nt, Human
uagaaagcuugggguguuuaaa

SEQ ID NO: 1015649 - RNA, 22 nt, Human
aucuauuaugcugagaaacugu

SEQ ID NO: 1015650 - RNA, 22 nt, Human
uucaagucaaggaaagaggucu

SEQ ID NO: 1015651 - RNA, 22 nt, Human
cagcauggagacaaagugggca

SEQ ID NO: 1015652 - RNA, 22 nt, Human
aaugauggauuuagacaagcug

SEQ ID NO: 1015653 - RNA, 22 nt, Human
gccuucagcccugacuggccag

SEQ ID NO: 1015654 - RNA, 22 nt, Human
aucacugucgucaucugagauu

SEQ ID NO: 1015655 - RNA, 21 nt, Human
gcaaauguucaggaaaaaaga

SEQ ID NO: 1015656 - RNA, 22 nt, Human
acagauuuaggacuguagcgau

SEQ ID NO: 1015657 - RNA, 22 nt, Human
cagguggagcugacugagggca

SEQ ID NO: 1015658 - RNA, 22 nt, Human
aagcaucucuauguggagagug

SEQ ID NO: 1015659 - RNA, 22 nt, Human
uuccauaauuaaguggagagaa

SEQ ID NO: 1015660 - RNA, 22 nt, Human
uucacauuggugauauguuucu

SEQ ID NO: 1015661 - RNA, 19 nt, Human
uccuccuuacuuccucuug

SEQ ID NO: 1015662 - RNA, 22 nt, Human
cucuggacacuggcaugggguc

SEQ ID NO: 1015663 - RNA, 22 nt, Human
cuggagcuaggaaguccaagau

SEQ ID NO: 1015664 - RNA, 22 nt, Human
ucucagucuuugcaaggaugcu

SEQ ID NO: 1015665 - RNA, 22 nt, Human
cauaauuugauaugcuugaugg

SEQ ID NO: 1015666 - RNA, 22 nt, Human
ccaggcaggcuagaauguaaau

SEQ ID NO: 1015667 - RNA, 22 nt, Human
ugauuucaaguagugacaugcu

SEQ ID NO: 1015668 - RNA, 22 nt, Human
cagccaggagcucccccugcuc

SEQ ID NO: 1015669 - RNA, 22 nt, Human
agggccugugcuuccugagaua

SEQ ID NO: 1015670 - RNA, 22 nt, Human
uaacuuucacaucacacugacu

SEQ ID NO: 1015671 - RNA, 22 nt, Human
agaagcagacucugaggcaagg

SEQ ID NO: 1015672 - RNA, 22 nt, Human
caaauguauucucacuucaggg

SEQ ID NO: 1015673 - RNA, 22 nt, Human
cuuaagaugaggucaugcuaua

SEQ ID NO: 1015674 - RNA, 22 nt, Human
gcucaggagcugacagccucaa

SEQ ID NO: 1015675 - RNA, 22 nt, Human
uuggcagugaugcagcuuguuc

SEQ ID NO: 1015676 - RNA, 22 nt, Human
uuugcagucaaauuugcuaaau

SEQ ID NO: 1015677 - RNA, 22 nt, Human
auuucugugcaguaaaugguga

SEQ ID NO: 1015678 - RNA, 23 nt, Human
ucagcugcuuccuccugccugcc

SEQ ID NO: 1015679 - RNA, 22 nt, Human
ggggaaggauugaguugaccca

SEQ ID NO: 1015680 - RNA, 22 nt, Human
gucuuucuaugaugaacuguug

SEQ ID NO: 1015681 - RNA, 22 nt, Human
ugggcuccucgucacucgcugu

SEQ ID NO: 1015682 - RNA, 22 nt, Human
cauugcacuccacccuaggcaa

SEQ ID NO: 1015683 - RNA, 22 nt, Human
caaggccaguccauuuuggaag

SEQ ID NO: 1015684 - RNA, 22 nt, Human
uggccugguccuugucaaggca

SEQ ID NO: 1015685 - RNA, 22 nt, Human
acagagcaugcucaguguguga

SEQ ID NO: 1015686 - RNA, 22 nt, Human
caguuaaaggcccaauaucugg

SEQ ID NO: 1015687 - RNA, 22 nt, Human
cugugccuaagaugcaugucuc

SEQ ID NO: 1015688 - RNA, 22 nt, Human
cuggccuuuagccccagugucu

SEQ ID NO: 1015689 - RNA, 22 nt, Human
cagacaggguccuguccgucac

SEQ ID NO: 1015690 - RNA, 22 nt, Human
acaugcauaggagaagucuuua

SEQ ID NO: 1015691 - RNA, 22 nt, Human
gcacacaguauaugcucauuaa

SEQ ID NO: 1015692 - RNA, 22 nt, Human
cugccagucuaugcugcucggc

SEQ ID NO: 1015693 - RNA, 22 nt, Human
gcugagcucccagcaguaucug

SEQ ID NO: 1015694 - RNA, 22 nt, Human
aagaacuuccuaauauauuuuc

SEQ ID NO: 1015695 - RNA, 22 nt, Human
agcagccacacgccuccuucuc

SEQ ID NO: 1015696 - RNA, 22 nt, Human
ugcuuuauaggggauugcaggc

SEQ ID NO: 1015697 - RNA, 22 nt, Human
ucugccuuggcaaccacagcuu

SEQ ID NO: 1015698 - RNA, 22 nt, Human
ucccagaggcaguugguaacuu

SEQ ID NO: 1015699 - RNA, 22 nt, Human
uaaaugugucuauggacccgcc

SEQ ID NO: 1015700 - RNA, 22 nt, Human
ucucagagauucagggagaagu

SEQ ID NO: 1015701 - RNA, 22 nt, Human
aguaaacauaauuuaccuguag

SEQ ID NO: 1015702 - RNA, 20 nt, Human
aucagcaacugccacucagu

SEQ ID NO: 1015703 - RNA, 22 nt, Human
ucauucagguugggcaaguguc

SEQ ID NO: 1015704 - RNA, 22 nt, Human
uaauuauuaugacaacaauugc

SEQ ID NO: 1015705 - RNA, 22 nt, Human
uccagggaucuuuagagucuuu

SEQ ID NO: 1015706 - RNA, 22 nt, Human
gcagcugcuguggcaucaagcu

SEQ ID NO: 1015707 - RNA, 22 nt, Human
cugcuuuguggaaucacacugg

SEQ ID NO: 1015708 - RNA, 22 nt, Human
uccagggguaccggccaggcag

SEQ ID NO: 1015709 - RNA, 22 nt, Human
auucuucaccugagucagucua

SEQ ID NO: 1015710 - RNA, 22 nt, Human
ggccuuggugcucuguguugca

SEQ ID NO: 1015711 - RNA, 22 nt, Human
uuagccauuaauguccugugca

SEQ ID NO: 1015712 - RNA, 22 nt, Human
ugggagcugggguuggacgucu

SEQ ID NO: 1015713 - RNA, 22 nt, Human
auccaggccuugaaguaccagu

SEQ ID NO: 1015714 - RNA, 22 nt, Human
uuccaaagucauguugcugaua

SEQ ID NO: 1015715 - RNA, 22 nt, Human
aagaugauaggacuugcuuaag

SEQ ID NO: 1015716 - RNA, 22 nt, Human
ucccccacucuaaaggagccuu

SEQ ID NO: 1015717 - RNA, 22 nt, Human
ucaggggcuugaggugcauguc

SEQ ID NO: 1015718 - RNA, 22 nt, Human
uucuagaugauaaaccagcagc

SEQ ID NO: 1015719 - RNA, 22 nt, Human
cuggcuccauccuugagcucug

SEQ ID NO: 1015720 - RNA, 22 nt, Human
aagcaagacagaaguuacugcc

SEQ ID NO: 1015721 - RNA, 22 nt, Human
aggagucagauaugggaaaguu

SEQ ID NO: 1015722 - RNA, 22 nt, Human
aacaugauuuaguauaaugcag

SEQ ID NO: 1015723 - RNA, 22 nt, Human
ucauuuguggaagugauugugg

SEQ ID NO: 1015724 - RNA, 22 nt, Human
cagaagaguagcugaacaaguu

SEQ ID NO: 1015725 - RNA, 23 nt, Human
cuccucguaacucuguggugggu

SEQ ID NO: 1015726 - RNA, 22 nt, Human
uucuuuccccauggaguucgga

SEQ ID NO: 1015727 - RNA, 22 nt, Human
ggcugaaggaugaaagcugcag

SEQ ID NO: 1015728 - RNA, 22 nt, Human
gagcagaacuacucacauaucg

SEQ ID NO: 1015729 - RNA, 20 nt, Human
agaggccaguuaggagucua

SEQ ID NO: 1015730 - RNA, 22 nt, Human
ggagccagagucugcaguguaa

SEQ ID NO: 1015731 - RNA, 22 nt, Human
gccuucaggaaaucaguccuug

SEQ ID NO: 1015732 - RNA, 22 nt, Human
cugcagccucaaccuccugagc

SEQ ID NO: 1015733 - RNA, 22 nt, Human
uuuuccucuguuauuaguguga

SEQ ID NO: 1015734 - RNA, 22 nt, Human
gcugccucccccauggcuggaa

SEQ ID NO: 1015735 - RNA, 22 nt, Human
ccagagagagaggucaauggca

SEQ ID NO: 1015736 - RNA, 22 nt, Human
gaaggagagagacaucgucccu

SEQ ID NO: 1015737 - RNA, 22 nt, Human
cagcagcccacgcgugcugucc

SEQ ID NO: 1015738 - RNA, 22 nt, Human
aaguccuuggagaauagaaagg

SEQ ID NO: 1015739 - RNA, 22 nt, Human
gaagagcuaaaggcacaggcuu

SEQ ID NO: 1015740 - RNA, 22 nt, Human
agcugaaagugcuuugaggacu

SEQ ID NO: 1015741 - RNA, 19 nt, Human
cuguggcugaccucuggcc

SEQ ID NO: 1015742 - RNA, 22 nt, Human
augcuacagcaucucucaucag

SEQ ID NO: 1015743 - RNA, 18 nt, Human
uggagcagguaggcauga

SEQ ID NO: 1015744 - RNA, 22 nt, Human
cagaaggcuggcagauugagau

SEQ ID NO: 1015745 - RNA, 22 nt, Human
caaggccagggaauuuuucugg

SEQ ID NO: 1015746 - RNA, 22 nt, Human
uaugcacacaggcuuaauucau

SEQ ID NO: 1015747 - RNA, 22 nt, Human
gagguucacaggcuaucacagu

SEQ ID NO: 1015748 - RNA, 22 nt, Human
ucugugaacaucacauugacag

SEQ ID NO: 1015749 - RNA, 22 nt, Human
aggagcugcauggauaccuggu

SEQ ID NO: 1015750 - RNA, 22 nt, Human
uccugccuuagagcaaggaaaa

SEQ ID NO: 1015751 - RNA, 20 nt, Human
aggaaaaauggaaacuggag

SEQ ID NO: 1015752 - RNA, 22 nt, Human
gaucauuugcaggaaacauuaa

SEQ ID NO: 1015753 - RNA, 22 nt, Human
ggacagcauaucagcagggcag

SEQ ID NO: 1015754 - RNA, 22 nt, Human
gcccacagcucguuccucuccu

SEQ ID NO: 1015755 - RNA, 22 nt, Human
uuugacaguaauaaagcacaag

SEQ ID NO: 1015756 - RNA, 22 nt, Human
ggggaccugggcuucaaggguu

SEQ ID NO: 1015757 - RNA, 22 nt, Human
agucucuuuaaucacagugucu

SEQ ID NO: 1015758 - RNA, 22 nt, Human
acaggggaauuuacugucauua

SEQ ID NO: 1015759 - RNA, 22 nt, Human
cagggcucccucuggcucccag

SEQ ID NO: 1015760 - RNA, 22 nt, Human
cuggcugaggucaccaguagcu

SEQ ID NO: 1015761 - RNA, 22 nt, Human
augaguaaaaccacuauuuaca

SEQ ID NO: 1015762 - RNA, 22 nt, Human
cauguuuuguguacagaauauu

SEQ ID NO: 1015763 - RNA, 22 nt, Human
cucaggauuuacuaauuucaag

SEQ ID NO: 1015764 - RNA, 22 nt, Human
agccuggaagaaccugaagucu

SEQ ID NO: 1015765 - RNA, 18 nt, Human
gggcuguguucaugccca

SEQ ID NO: 1015766 - RNA, 22 nt, Human
caugcuguguguuuuagcucca

SEQ ID NO: 1015767 - RNA, 22 nt, Human
auguuuccauuuucuuguauca

SEQ ID NO: 1015768 - RNA, 22 nt, Human
ugaagcaguuacuggguguuaa

SEQ ID NO: 1015769 - RNA, 21 nt, Human
uggaaagauucaaagaccagg

SEQ ID NO: 1015770 - RNA, 22 nt, Human
cugucucugucuuaacucccag

SEQ ID NO: 1015771 - RNA, 22 nt, Human
auuugucuagugguauucacgu

SEQ ID NO: 1015772 - RNA, 22 nt, Human
uauucacauucucaggccuggu

SEQ ID NO: 1015773 - RNA, 22 nt, Human
accagcuguguccuggcugcag

SEQ ID NO: 1015774 - RNA, 22 nt, Human
ugguggcaauguccuggagaag

SEQ ID NO: 1015775 - RNA, 22 nt, Human
ugcauuaucuuuaauguucuca

SEQ ID NO: 1015776 - RNA, 20 nt, Human
uaugaagauaugugaacagc

SEQ ID NO: 1015777 - RNA, 22 nt, Human
aucaggaucacugggagucuug

SEQ ID NO: 1015778 - RNA, 22 nt, Human
acaggugugagaacaugccuug

SEQ ID NO: 1015779 - RNA, 22 nt, Human
uggggcugaggagccucacucu

SEQ ID NO: 1015780 - RNA, 22 nt, Human
gggcaguggcucacgccuguaa

SEQ ID NO: 1015781 - RNA, 22 nt, Human
acuccagggcugaacgaggccc

SEQ ID NO: 1015782 - RNA, 22 nt, Human
cacauccuucagcugagcccag

SEQ ID NO: 1015783 - RNA, 18 nt, Human
ugugaacacauuuuucug

SEQ ID NO: 1015784 - RNA, 16 nt, Human
gggcugggggauucug

SEQ ID NO: 1015785 - RNA, 22 nt, Human
ucaggagauggucuuuauaggc

SEQ ID NO: 1015786 - RNA, 22 nt, Human
gaggaaaagagacagguuauug

SEQ ID NO: 1015787 - RNA, 22 nt, Human
caaggagauaaaauguugagcu

SEQ ID NO: 1015788 - RNA, 22 nt, Human
caggaugagaggcccagggaag

SEQ ID NO: 1015789 - RNA, 17 nt, Human
uguuccauuugaccacc

SEQ ID NO: 1015790 - RNA, 22 nt, Human
gaagcagcuggugagauggagc

SEQ ID NO: 1015791 - RNA, 22 nt, Human
aaagcccauguggaaguacagg

SEQ ID NO: 1015792 - RNA, 22 nt, Human
gucuuuaugguaugaaaacuga

SEQ ID NO: 1015793 - RNA, 22 nt, Human
aauggcucugauguuguuguga

SEQ ID NO: 1015794 - RNA, 21 nt, Human
uccugcagaaugccuuccuac

SEQ ID NO: 1015795 - RNA, 22 nt, Human
ccaggcauccauugcuuccucu

SEQ ID NO: 1015796 - RNA, 22 nt, Human
gcagcucccaucagggcacaga

SEQ ID NO: 1015797 - RNA, 22 nt, Human
ucagggcauacucuucaagguc

SEQ ID NO: 1015798 - RNA, 23 nt, Human
ugcugguguuuuugggaccaggg

SEQ ID NO: 1015799 - RNA, 21 nt, Human
ugccagcauuaaacagucauu

SEQ ID NO: 1015800 - RNA, 22 nt, Human
uuucaaaguugggaauuguaau

SEQ ID NO: 1015801 - RNA, 22 nt, Human
gcacugggugugaggcagcguc

SEQ ID NO: 1015802 - RNA, 22 nt, Human
caauuucucgaacucuaaucca

SEQ ID NO: 1015803 - RNA, 22 nt, Human
cgcugggcgccgaccugcuggc

SEQ ID NO: 1015804 - RNA, 22 nt, Human
ggcuguggucugggugcucccc

SEQ ID NO: 1015805 - RNA, 22 nt, Human
gcuggcuugauaguuucugcuu

SEQ ID NO: 1015806 - RNA, 22 nt, Human
uccaggacuagcauuucugaua

SEQ ID NO: 1015807 - RNA, 22 nt, Human
auacaugucaucauauguuugu

SEQ ID NO: 1015808 - RNA, 22 nt, Human
uuucacaauuuuaaggagcaaa

SEQ ID NO: 1015809 - RNA, 22 nt, Human
uauaguaaaauuuucauuuaug

SEQ ID NO: 1015810 - RNA, 20 nt, Human
uuucaguuaucuugaccuuc

SEQ ID NO: 1015811 - RNA, 22 nt, Human
cauggcagcaauuuuccugacu

SEQ ID NO: 1015812 - RNA, 22 nt, Human
caguuucuucaucaguuaagca

SEQ ID NO: 1015813 - RNA, 22 nt, Human
aauguacaaggguuccaguuuu

SEQ ID NO: 1015814 - RNA, 22 nt, Human
gugccugcugcagagucgcugu

SEQ ID NO: 1015815 - RNA, 22 nt, Human
uuauuuugguaaauguuugccu

SEQ ID NO: 1015816 - RNA, 22 nt, Human
agcagcauuaugauauaucuua

SEQ ID NO: 1015817 - RNA, 22 nt, Human
uugcaaaagccgaggcacucca

SEQ ID NO: 1015818 - RNA, 22 nt, Human
aguggcaggaaaguggaagaga

SEQ ID NO: 1015819 - RNA, 22 nt, Human
auguccagccaaccacuggauu

SEQ ID NO: 1015820 - RNA, 21 nt, Human
agaaaaguagaguuuucagag

SEQ ID NO: 1015821 - RNA, 22 nt, Human
ugacaauacagagagagcaaaa

SEQ ID NO: 1015822 - RNA, 22 nt, Human
agagccagccuucucagcuuac

SEQ ID NO: 1015823 - RNA, 22 nt, Human
gcuguucucuguaacaugcauu

SEQ ID NO: 1015824 - RNA, 22 nt, Human
gucccuggucuaccguggcuuc

SEQ ID NO: 1015825 - RNA, 22 nt, Human
caaaugcuaacuucuuuccaaa

SEQ ID NO: 1015826 - RNA, 22 nt, Human
cugugagcuggguggccaggac

SEQ ID NO: 1015827 - RNA, 22 nt, Human
uggagggcaucuguggucaggc

SEQ ID NO: 1015828 - RNA, 22 nt, Human
gcuuccugucccucagccauga

SEQ ID NO: 1015829 - RNA, 21 nt, Human
gccaccucgucucggagcagc

SEQ ID NO: 1015830 - RNA, 22 nt, Human
auuucauugaaguuaauucuuc

SEQ ID NO: 1015831 - RNA, 22 nt, Human
caggaugggugucggccagcac

SEQ ID NO: 1015832 - RNA, 20 nt, Human
ucuggcucuuugcuccuccc

SEQ ID NO: 1015833 - RNA, 22 nt, Human
ugaugaaacugagguuccaaga

SEQ ID NO: 1015834 - RNA, 22 nt, Human
uguuuuguuuaugagagcacag

SEQ ID NO: 1015835 - RNA, 22 nt, Human
aucuguaaaugcaaauguagcu

SEQ ID NO: 1015836 - RNA, 22 nt, Human
aggcacugaaggaagcuugcgc

SEQ ID NO: 1015837 - RNA, 22 nt, Human
uugggaaggcguggaagcagaa

SEQ ID NO: 1015838 - RNA, 22 nt, Human
uuuauugcauacacaaauguca

SEQ ID NO: 1015839 - RNA, 22 nt, Human
ucugaacagaaaagaugcacaa

SEQ ID NO: 1015840 - RNA, 17 nt, Human
cugaggcccagggccca

SEQ ID NO: 1015841 - RNA, 22 nt, Human
uagcagaaccagcagucaauuu

SEQ ID NO: 1015842 - RNA, 22 nt, Human
ugaaacagucuccagacuugga

SEQ ID NO: 1015843 - RNA, 22 nt, Human
cccugcagaccaaugccauaga

SEQ ID NO: 1015844 - RNA, 22 nt, Human
uuggaaauacagcaguuacuuu

SEQ ID NO: 1015845 - RNA, 22 nt, Human
cauuguuauagcauuacacacc

SEQ ID NO: 1015846 - RNA, 22 nt, Human
uuugacaaauccuucagcaaug

SEQ ID NO: 1015847 - RNA, 22 nt, Human
cagcacuggggccacuggaguu

SEQ ID NO: 1015848 - RNA, 22 nt, Human
ccagaggcauguucaaagcaau

SEQ ID NO: 1015849 - RNA, 22 nt, Human
ccucugcucccuggugucugag

SEQ ID NO: 1015850 - RNA, 21 nt, Human
agugaaaugaaguguaugcuc

SEQ ID NO: 1015851 - RNA, 22 nt, Human
ccagcccucacugaggccucuc

SEQ ID NO: 1015852 - RNA, 22 nt, Human
cuggcaggcagacuucugcaag

SEQ ID NO: 1015853 - RNA, 22 nt, Human
ugagaauuuuuugucaugcauu

SEQ ID NO: 1015854 - RNA, 22 nt, Human
auauaauacaaccugcuaagug

SEQ ID NO: 1015855 - RNA, 22 nt, Human
caggugaccuuuguccuaaguu

SEQ ID NO: 1015856 - RNA, 22 nt, Human
gccugggaagacuaagugggag

SEQ ID NO: 1015857 - RNA, 22 nt, Human
gguggguuuggaagagcaggcu

SEQ ID NO: 1015858 - RNA, 22 nt, Human
gcagcugagcgugaggaagagu

SEQ ID NO: 1015859 - RNA, 22 nt, Human
uacauauacugagugauuugcu

SEQ ID NO: 1015860 - RNA, 22 nt, Human
uccauuuuagagaugaagaaac

SEQ ID NO: 1015861 - RNA, 19 nt, Human
ggucucagugcagcugcag

SEQ ID NO: 1015862 - RNA, 22 nt, Human
auucauaacggcaaaugucacc

SEQ ID NO: 1015863 - RNA, 22 nt, Human
aggcuucccagcugagcucagc

SEQ ID NO: 1015864 - RNA, 22 nt, Human
uagcuagaaugcuucgugauau

SEQ ID NO: 1015865 - RNA, 22 nt, Human
cugcucuguuucuuagcugggu

SEQ ID NO: 1015866 - RNA, 22 nt, Human
aguuagaaaguaaaucauuuga

SEQ ID NO: 1015867 - RNA, 22 nt, Human
ucugcaucauuuuucagagccg

SEQ ID NO: 1015868 - RNA, 22 nt, Human
uugggagcauuuagaaaagacg

SEQ ID NO: 1015869 - RNA, 22 nt, Human
cacugaaggacaguaggaaggg

SEQ ID NO: 1015870 - RNA, 22 nt, Human
acagaggucauggagaguucuc

SEQ ID NO: 1015871 - RNA, 22 nt, Human
cauaaguuggguaauauaauga

SEQ ID NO: 1015872 - RNA, 22 nt, Human
cagcuggggcagccacgugcgg

SEQ ID NO: 1015873 - RNA, 22 nt, Human
ucuuuggauaucgcuagaccgu

SEQ ID NO: 1015874 - RNA, 22 nt, Human
uucuucuccuaaggagaguccu

SEQ ID NO: 1015875 - RNA, 22 nt, Human
uggcucagcagguuagaaacua

SEQ ID NO: 1015876 - RNA, 22 nt, Human
caucacagggggcuagaagucu

SEQ ID NO: 1015877 - RNA, 22 nt, Human
aguguuugagacacauuucacu

SEQ ID NO: 1015878 - RNA, 22 nt, Human
ucacauuuucuacuacuguacg

SEQ ID NO: 1015879 - RNA, 22 nt, Human
gagccugggacugggggucaug

SEQ ID NO: 1015880 - RNA, 22 nt, Human
uccugcagccaagggucaucga

SEQ ID NO: 1015881 - RNA, 22 nt, Human
cuacauaaauauuuaugugucu

SEQ ID NO: 1015882 - RNA, 22 nt, Human
ccugccuguacuagagacccag

SEQ ID NO: 1015883 - RNA, 22 nt, Human
cuggagccugcaguuuucacuu

SEQ ID NO: 1015884 - RNA, 22 nt, Human
aggcccuguccauggugcugaa

SEQ ID NO: 1015885 - RNA, 22 nt, Human
aucaaaguuucccagaaguugu

SEQ ID NO: 1015886 - RNA, 22 nt, Human
ggcugugauugguggaugugaa

SEQ ID NO: 1015887 - RNA, 22 nt, Human
ucucccacuggccuuguaugau

SEQ ID NO: 1015888 - RNA, 22 nt, Human
cagugucuccagaugcuccaau

SEQ ID NO: 1015889 - RNA, 15 nt, Human
cagucccagggaccc

SEQ ID NO: 1015890 - RNA, 22 nt, Human
ccugccugcguccucugagggc

SEQ ID NO: 1015891 - RNA, 22 nt, Human
uggcccugcuaugauccugcaa

SEQ ID NO: 1015892 - RNA, 22 nt, Human
gagggcucugucuggaagggaa

SEQ ID NO: 1015893 - RNA, 22 nt, Human
ugcuggaggggccugaccagga

SEQ ID NO: 1015894 - RNA, 16 nt, Human
uccaggcauaucugag

SEQ ID NO: 1015895 - RNA, 22 nt, Human
gguccccagcaguggcugcuuc

SEQ ID NO: 1015896 - RNA, 23 nt, Human
uggagaugccccacucccugucu

SEQ ID NO: 1015897 - RNA, 22 nt, Human
uuagaaagaacuuuagauauca

SEQ ID NO: 1015898 - RNA, 22 nt, Human
cagugccaugucugagccccua

SEQ ID NO: 1015899 - RNA, 22 nt, Human
gucuuuauuugagauugucauu

SEQ ID NO: 1015900 - RNA, 21 nt, Human
agcucagccgggcacaguggc

SEQ ID NO: 1015901 - RNA, 22 nt, Human
ugaaagguuauuuaggucugcu

SEQ ID NO: 1015902 - RNA, 23 nt, Human
ucuugaaaagccuacagcaguuc

SEQ ID NO: 1015903 - RNA, 19 nt, Human
ccaggccaucccaguuccc

SEQ ID NO: 1015904 - RNA, 22 nt, Human
uaaauguggagacucaggaguc

SEQ ID NO: 1015905 - RNA, 22 nt, Human
gccuggcaggccugggccagca

SEQ ID NO: 1015906 - RNA, 22 nt, Human
gugugcccuuguucagcagagu

SEQ ID NO: 1015907 - RNA, 22 nt, Human
auucccaucgucaacuucacug

SEQ ID NO: 1015908 - RNA, 22 nt, Human
uguccaggucagcagcagggac

SEQ ID NO: 1015909 - RNA, 22 nt, Human
gcucagggaacuuuuugcaggc

SEQ ID NO: 1015910 - RNA, 22 nt, Human
uggaggaaucagggcuuaggcu

SEQ ID NO: 1015911 - RNA, 22 nt, Human
uggagcugggguuugaaucugg

SEQ ID NO: 1015912 - RNA, 22 nt, Human
cagcuuguuaccgagggagggu

SEQ ID NO: 1015913 - RNA, 22 nt, Human
uuguuuucuccacugcaucuua

SEQ ID NO: 1015914 - RNA, 22 nt, Human
uacaaagucacauugaaaugaa

SEQ ID NO: 1015915 - RNA, 17 nt, Human
gcagugaaaagagauca

SEQ ID NO: 1015916 - RNA, 18 nt, Human
ucaaagucuggcuccacu

SEQ ID NO: 1015917 - RNA, 22 nt, Human
aguauaaagugguuuucagcac

SEQ ID NO: 1015918 - RNA, 22 nt, Human
auacacauguguaugugcaugc

SEQ ID NO: 1015919 - RNA, 22 nt, Human
cugcagaggucuugcugauggu

SEQ ID NO: 1015920 - RNA, 22 nt, Human
ccaagaugaucuuuacaguguu

SEQ ID NO: 1015921 - RNA, 22 nt, Human
auuucauacuaaggcucaaaaa

SEQ ID NO: 1015922 - RNA, 22 nt, Human
acuaggggcucaggcccaggga

SEQ ID NO: 1015923 - RNA, 19 nt, Human
uccccagcaccucugaguc

SEQ ID NO: 1015924 - RNA, 22 nt, Human
gugaaacacccuccaaugcaca

SEQ ID NO: 1015925 - RNA, 22 nt, Human
uuugaaguggaaaaggauuuaa

SEQ ID NO: 1015926 - RNA, 21 nt, Human
agagaauugccuuagauguuc

SEQ ID NO: 1015927 - RNA, 22 nt, Human
cacuuaagcaguuaauuuaucu

SEQ ID NO: 1015928 - RNA, 22 nt, Human
caggguacagaguuuucuaaac

SEQ ID NO: 1015929 - RNA, 21 nt, Human
ugcuggccucaagggugacuu

SEQ ID NO: 1015930 - RNA, 22 nt, Human
auaucacaguaguuguuuaguu

SEQ ID NO: 1015931 - RNA, 22 nt, Human
aauuuccagaccccauccacag

SEQ ID NO: 1015932 - RNA, 22 nt, Human
uugcugaagugaagguauguuu

SEQ ID NO: 1015933 - RNA, 22 nt, Human
uggaaagaauuccuaugguuca

SEQ ID NO: 1015934 - RNA, 22 nt, Human
gcucagagcacucagacucagc

SEQ ID NO: 1015935 - RNA, 22 nt, Human
gcuggccauggccugcgccauc

SEQ ID NO: 1015936 - RNA, 22 nt, Human
gacauucacagguaaacauucc

SEQ ID NO: 1015937 - RNA, 19 nt, Human
ggcuccuguggcugcagcc

SEQ ID NO: 1015938 - RNA, 22 nt, Human
cuacauaaauuuaucacagacu

SEQ ID NO: 1015939 - RNA, 22 nt, Human
aaauaguuagcccugcauauau

SEQ ID NO: 1015940 - RNA, 22 nt, Human
auuugcuuucagguauaaaagg

SEQ ID NO: 1015941 - RNA, 22 nt, Human
uuuucagaggccuaagagguuu

SEQ ID NO: 1015942 - RNA, 22 nt, Human
cugagcucuaaugucagccuug

SEQ ID NO: 1015943 - RNA, 22 nt, Human
gaacaguaaauuuaugcagcac

SEQ ID NO: 1015944 - RNA, 22 nt, Human
guaacagaggguuugcagauau

SEQ ID NO: 1015945 - RNA, 22 nt, Human
ugggagcagccaacauggccuu

SEQ ID NO: 1015946 - RNA, 22 nt, Human
gacccaggggcagggagaaagu

SEQ ID NO: 1015947 - RNA, 23 nt, Human
uggaccugaaccagugccucugu

SEQ ID NO: 1015948 - RNA, 22 nt, Human
ugcugcauuuaucuucucaaac

SEQ ID NO: 1015949 - RNA, 22 nt, Human
uaauaguuaugguugguucuca

SEQ ID NO: 1015950 - RNA, 22 nt, Human
cauuuauucaugaucuguagcu

SEQ ID NO: 1015951 - RNA, 22 nt, Human
gagccagccuucuucugagguc

SEQ ID NO: 1015952 - RNA, 22 nt, Human
gcugucugggaggccuccacuu

SEQ ID NO: 1015953 - RNA, 22 nt, Human
ggcuggaaguccaagaucaaga

SEQ ID NO: 1015954 - RNA, 22 nt, Human
gggcugaccaaugccuugcuuu

SEQ ID NO: 1015955 - RNA, 22 nt, Human
caggccucuccuuagucuggca

SEQ ID NO: 1015956 - RNA, 22 nt, Human
auaugaagaauuccaauuugga

SEQ ID NO: 1015957 - RNA, 22 nt, Human
uagcuuuaaugaguugguaaga

SEQ ID NO: 1015958 - RNA, 22 nt, Human
ucaggcacugcuuucugauaug

SEQ ID NO: 1015959 - RNA, 21 nt, Human
aguuugaugcaauuucugaga

SEQ ID NO: 1015960 - RNA, 20 nt, Human
ucagaggcugccagcugggg

SEQ ID NO: 1015961 - RNA, 22 nt, Human
uaaaguucuggugagagguaag

SEQ ID NO: 1015962 - RNA, 22 nt, Human
cauuuagagucuugcaauuuua

SEQ ID NO: 1015963 - RNA, 22 nt, Human
gcacagguugcaaaaguucaca

SEQ ID NO: 1015964 - RNA, 22 nt, Human
acagaauucuaguauguggcuu

SEQ ID NO: 1015965 - RNA, 22 nt, Human
uguaugcagggcuuguaugcag

SEQ ID NO: 1015966 - RNA, 20 nt, Human
auacacauucauagaaaaau

SEQ ID NO: 1015967 - RNA, 22 nt, Human
aaggagucucagcugggccuga

SEQ ID NO: 1015968 - RNA, 22 nt, Human
agaggccaugcuagaggccugg

SEQ ID NO: 1015969 - RNA, 22 nt, Human
aaguuucauguggagguagacu

SEQ ID NO: 1015970 - RNA, 22 nt, Human
cauggcugcgagaagagugggu

SEQ ID NO: 1015971 - RNA, 22 nt, Human
uagaaaugauugguugagcucu

SEQ ID NO: 1015972 - RNA, 22 nt, Human
cucuucuugucucugguuagaa

SEQ ID NO: 1015973 - RNA, 22 nt, Human
ggcugccauaacugauaccaua

SEQ ID NO: 1015974 - RNA, 22 nt, Human
gaaaccucuuagccucucuuug

SEQ ID NO: 1015975 - RNA, 20 nt, Human
acuggagccaucucagccua

SEQ ID NO: 1015976 - RNA, 22 nt, Human
auguaucaugcaggguccauga

SEQ ID NO: 1015977 - RNA, 22 nt, Human
cugagcuuccaguuccuccagg

SEQ ID NO: 1015978 - RNA, 22 nt, Human
ucagagugugacuuggucauga

SEQ ID NO: 1015979 - RNA, 22 nt, Human
cuggaggcugaguugggucucc

SEQ ID NO: 1015980 - RNA, 22 nt, Human
ccagcccuugcugaaggguggc

SEQ ID NO: 1015981 - RNA, 22 nt, Human
aguaaaauuaauggaucagaag

SEQ ID NO: 1015982 - RNA, 22 nt, Human
aaauccuaagcagaggaauuua

SEQ ID NO: 1015983 - RNA, 22 nt, Human
ugcuugaaagggguuucccagu

SEQ ID NO: 1015984 - RNA, 22 nt, Human
ucucauugguauauacaugugu

SEQ ID NO: 1015985 - RNA, 21 nt, Human
aagccucaagcagaagacaga

SEQ ID NO: 1015986 - RNA, 22 nt, Human
uucagaauauuuguuuuacaug

SEQ ID NO: 1015987 - RNA, 22 nt, Human
caggaaccuaaagagacauuac

SEQ ID NO: 1015988 - RNA, 22 nt, Human
aggucauuguuaagucaccaua

SEQ ID NO: 1015989 - RNA, 22 nt, Human
agccaggacguugcucagcucc

SEQ ID NO: 1015990 - RNA, 22 nt, Human
aauauaaugcuguuuuaugcca

SEQ ID NO: 1015991 - RNA, 22 nt, Human
aaguauuucguucugaaaaagu

SEQ ID NO: 1015992 - RNA, 22 nt, Human
acaaaugcuuaguucaccaaaa

SEQ ID NO: 1015993 - RNA, 22 nt, Human
ugcagggauuagaggccgggga

SEQ ID NO: 1015994 - RNA, 22 nt, Human
ccagcccugccagagagagcug

SEQ ID NO: 1015995 - RNA, 22 nt, Human
guucuucagcauuagaagucau

SEQ ID NO: 1015996 - RNA, 22 nt, Human
uccuggaguauuucuguggugu

SEQ ID NO: 1015997 - RNA, 22 nt, Human
uggccucuuacgacauagccuu

SEQ ID NO: 1015998 - RNA, 22 nt, Human
gcaggguccauggaggcagccc

SEQ ID NO: 1015999 - RNA, 22 nt, Human
ugcagcucauugcuggggucug

SEQ ID NO: 1016000 - RNA, 22 nt, Human
cuuggccucuucucaggguggg

SEQ ID NO: 1016001 - RNA, 22 nt, Human
acaagaauuuacauguagugga

SEQ ID NO: 1016002 - RNA, 22 nt, Human
gaaacccaaacuaagacaguag

SEQ ID NO: 1016003 - RNA, 22 nt, Human
ccuggcugggguagaagugagg

SEQ ID NO: 1016004 - RNA, 20 nt, Human
gcccaagguccagaaggggg

SEQ ID NO: 1016005 - RNA, 22 nt, Human
uccucagggggccaacccagcc

SEQ ID NO: 1016006 - RNA, 21 nt, Human
guggcucugccaggacugaaa

SEQ ID NO: 1016007 - RNA, 22 nt, Human
aaagguaguacuucuagaaggg

SEQ ID NO: 1016008 - RNA, 22 nt, Human
uucuucaaccaucuacauaaac

SEQ ID NO: 1016009 - RNA, 22 nt, Human
agccaagcacucaacuccugga

SEQ ID NO: 1016010 - RNA, 22 nt, Human
guaguucugcagugucaccuga

SEQ ID NO: 1016011 - RNA, 22 nt, Human
ccagagcugaugggcccagggu

SEQ ID NO: 1016012 - RNA, 22 nt, Human
gcauuuagcuuuaaaauauuuc

SEQ ID NO: 1016013 - RNA, 22 nt, Human
accaggggugucaacagcauuu

SEQ ID NO: 1016014 - RNA, 22 nt, Human
caagaaauguuuacugagcauc

SEQ ID NO: 1016015 - RNA, 22 nt, Human
cauuuccacuucugaaaacugg

SEQ ID NO: 1016016 - RNA, 22 nt, Human
ucaggaucaggggccuuuccuu

SEQ ID NO: 1016017 - RNA, 22 nt, Human
cagggcugugcccaucuucccc

SEQ ID NO: 1016018 - RNA, 22 nt, Human
aucaguuauuuuuaagcuauaa

SEQ ID NO: 1016019 - RNA, 22 nt, Human
ccucccuuggccauagccagcc

SEQ ID NO: 1016020 - RNA, 22 nt, Human
acauuucucuugaugucucuau

SEQ ID NO: 1016021 - RNA, 22 nt, Human
ucaugucaguuucuucuauaaa

SEQ ID NO: 1016022 - RNA, 22 nt, Human
aagauguaucaguuaagucuuc

SEQ ID NO: 1016023 - RNA, 22 nt, Human
auaaaaacugacccauccuuug

SEQ ID NO: 1016024 - RNA, 21 nt, Human
gcagccagacgggauucaguu

SEQ ID NO: 1016025 - RNA, 22 nt, Human
uggguggcacuucuggggucca

SEQ ID NO: 1016026 - RNA, 22 nt, Human
gcagcuuggugaaaggugaugg

SEQ ID NO: 1016027 - RNA, 21 nt, Human
gaauaguucuguggcagcagu

SEQ ID NO: 1016028 - RNA, 22 nt, Human
aaagagcucacaguccacugga

SEQ ID NO: 1016029 - RNA, 22 nt, Human
cagaugagaguggccaggguuc

SEQ ID NO: 1016030 - RNA, 22 nt, Human
uccugagaugagacagugcugc

SEQ ID NO: 1016031 - RNA, 22 nt, Human
ucucuuuuauguacacccugac

SEQ ID NO: 1016032 - RNA, 22 nt, Human
agaggcccugggcuggugugcu

SEQ ID NO: 1016033 - RNA, 22 nt, Human
agagccuggagguucugcugaa

SEQ ID NO: 1016034 - RNA, 22 nt, Human
agagugauggguugugcugacc

SEQ ID NO: 1016035 - RNA, 22 nt, Human
uggugaagucagcggagcccgg

SEQ ID NO: 1016036 - RNA, 22 nt, Human
uuugcauuuugauaagaucacu

SEQ ID NO: 1016037 - RNA, 23 nt, Human
acugucugauauguuuuccauca

SEQ ID NO: 1016038 - RNA, 22 nt, Human
ugccugcucuuaccacucuccc

SEQ ID NO: 1016039 - RNA, 22 nt, Human
ugccugucucugacugccauua

SEQ ID NO: 1016040 - RNA, 22 nt, Human
gcaggagccaggccgagcuggu

SEQ ID NO: 1016041 - RNA, 18 nt, Human
agcugcagaccaggaggu

SEQ ID NO: 1016042 - RNA, 22 nt, Human
aagagggaggugcgggugcaga

SEQ ID NO: 1016043 - RNA, 22 nt, Human
aauaauguugacgauagucuua

SEQ ID NO: 1016044 - RNA, 22 nt, Human
cagaggcccagugagagggcug

SEQ ID NO: 1016045 - RNA, 23 nt, Human
gaguguucauagcaggcucuugc

SEQ ID NO: 1016046 - RNA, 22 nt, Human
caaaguuuggcucucaugacau

SEQ ID NO: 1016047 - RNA, 23 nt, Human
uuuuaauuuggacauaagaagau

SEQ ID NO: 1016048 - RNA, 22 nt, Human
ucagagagcagaacuuuuuuac

SEQ ID NO: 1016049 - RNA, 22 nt, Human
ucuggagccacaaaccucagcu

SEQ ID NO: 1016050 - RNA, 22 nt, Human
ucccuucacagaugcgauguuu

SEQ ID NO: 1016051 - RNA, 22 nt, Human
gagggcagaaaauuaugcggug

SEQ ID NO: 1016052 - RNA, 19 nt, Human
gcugggagcagacccuccc

SEQ ID NO: 1016053 - RNA, 22 nt, Human
ccucaugguacuuacuguagcu

SEQ ID NO: 1016054 - RNA, 22 nt, Human
ucaaguauaucuagucauuagg

SEQ ID NO: 1016055 - RNA, 22 nt, Human
cugucagguuggucucagagcu

SEQ ID NO: 1016056 - RNA, 23 nt, Human
uggcucuguggaucccucaggag

SEQ ID NO: 1016057 - RNA, 22 nt, Human
uggcuucagacuucugcuacgu

SEQ ID NO: 1016058 - RNA, 21 nt, Human
uucaaugaaaacaaagugagg

SEQ ID NO: 1016059 - RNA, 22 nt, Human
ucagcuccagaguugcacagug

SEQ ID NO: 1016060 - RNA, 22 nt, Human
gcuggccugggcucaagaccag

SEQ ID NO: 1016061 - RNA, 22 nt, Human
ggcacugggagaggugagacgg

SEQ ID NO: 1016062 - RNA, 22 nt, Human
cagacacagcaauucuguguug

SEQ ID NO: 1016063 - RNA, 22 nt, Human
uucauuccugagcccauauuua

SEQ ID NO: 1016064 - RNA, 22 nt, Human
gaacaucagucauaauuuaacg

SEQ ID NO: 1016065 - RNA, 22 nt, Human
augcaguacauacaaacacuga

SEQ ID NO: 1016066 - RNA, 22 nt, Human
gccucugcaucaucacuccagc

SEQ ID NO: 1016067 - RNA, 22 nt, Human
cucagagaaaugucacaacaau

SEQ ID NO: 1016068 - RNA, 22 nt, Human
uucaagaugacccagucacacg

SEQ ID NO: 1016069 - RNA, 22 nt, Human
aggugccaauuuucagugaaca

SEQ ID NO: 1016070 - RNA, 22 nt, Human
uuucagugcuucuguuuaccgg

SEQ ID NO: 1016071 - RNA, 22 nt, Human
gaaggcuugcagcucuguggca

SEQ ID NO: 1016072 - RNA, 22 nt, Human
cauucacucagcgaugccagua

SEQ ID NO: 1016073 - RNA, 22 nt, Human
ucagcugcucuguugagcugaa

SEQ ID NO: 1016074 - RNA, 22 nt, Human
auuuggaaacaauuauauucuu

SEQ ID NO: 1016075 - RNA, 22 nt, Human
acccagaggugucuagcaagcu

SEQ ID NO: 1016076 - RNA, 22 nt, Human
auacaucuuccuuuuaaaaugc

SEQ ID NO: 1016077 - RNA, 22 nt, Human
gguggagcuggaccaggagagg

SEQ ID NO: 1016078 - RNA, 22 nt, Human
agcugccuccauggucaaagau

SEQ ID NO: 1016079 - RNA, 21 nt, Human
gccagccuguuuaccuguggu

SEQ ID NO: 1016080 - RNA, 22 nt, Human
cuuuggcaugguccucacuaua

SEQ ID NO: 1016081 - RNA, 22 nt, Human
ugccaaauugcccuauaaauga

SEQ ID NO: 1016082 - RNA, 17 nt, Human
cauguguaugugggagu

SEQ ID NO: 1016083 - RNA, 22 nt, Human
cucagcuggcaauucuggcucc

SEQ ID NO: 1016084 - RNA, 20 nt, Human
ugcagcuucaccugugucau

SEQ ID NO: 1016085 - RNA, 22 nt, Human
uggcucaguuaggucagaaaca

SEQ ID NO: 1016086 - RNA, 22 nt, Human
aaugucugccagaacugaucau

SEQ ID NO: 1016087 - RNA, 22 nt, Human
accaguccgcggagcuccgggg

SEQ ID NO: 1016088 - RNA, 22 nt, Human
aaaugcuacauacacaucaggg

SEQ ID NO: 1016089 - RNA, 22 nt, Human
cauuuucagcacccaucugaaa

SEQ ID NO: 1016090 - RNA, 22 nt, Human
cugugugugucugcagcauacu

SEQ ID NO: 1016091 - RNA, 22 nt, Human
cuggcagcauuaacagagagca

SEQ ID NO: 1016092 - RNA, 22 nt, Human
cugcagcuccccugagaucaag

SEQ ID NO: 1016093 - RNA, 22 nt, Human
uggcucuggauuaaucuaggaa

SEQ ID NO: 1016094 - RNA, 22 nt, Human
aagggcuccauccuuauaaaug

SEQ ID NO: 1016095 - RNA, 22 nt, Human
ucagggcaagauugguuaauaa

SEQ ID NO: 1016096 - RNA, 22 nt, Human
uuucaugaggggcaaaaucuca

SEQ ID NO: 1016097 - RNA, 22 nt, Human
agggacuugaugucagggagau

SEQ ID NO: 1016098 - RNA, 22 nt, Human
gagcagugaagacagaaguaca

SEQ ID NO: 1016099 - RNA, 22 nt, Human
gcacagcucgagcucaggaggg

SEQ ID NO: 1016100 - RNA, 22 nt, Human
aacucagcauccugcacagaga

SEQ ID NO: 1016101 - RNA, 22 nt, Human
gccuucaguagugucagcugua

SEQ ID NO: 1016102 - RNA, 22 nt, Human
ugcucuccggcuuccguggccu

SEQ ID NO: 1016103 - RNA, 22 nt, Human
uugucuguccaggcaccccaag

SEQ ID NO: 1016104 - RNA, 22 nt, Human
aagagcaucuauuucacagugg

SEQ ID NO: 1016105 - RNA, 22 nt, Human
cagagcugcgcuuuuuccuggu

SEQ ID NO: 1016106 - RNA, 22 nt, Human
gcucuguguugucagaggcacc

SEQ ID NO: 1016107 - RNA, 22 nt, Human
agcugcagauucuaucuagaag

SEQ ID NO: 1016108 - RNA, 22 nt, Human
cagggcucuuccggagcaggga

SEQ ID NO: 1016109 - RNA, 22 nt, Human
ugaggccaaugacccugggcag

SEQ ID NO: 1016110 - RNA, 22 nt, Human
cagaguggcacucugcuggaug

SEQ ID NO: 1016111 - RNA, 20 nt, Human
uccagcugucuuucagagac

SEQ ID NO: 1016112 - RNA, 22 nt, Human
uugaaaggugcugugugcugau

SEQ ID NO: 1016113 - RNA, 22 nt, Human
gaggaaaauggaguguaauuaa

SEQ ID NO: 1016114 - RNA, 22 nt, Human
ggcagagcugcaugagcacuca

SEQ ID NO: 1016115 - RNA, 22 nt, Human
uggcccugcuggccaaaggcua

SEQ ID NO: 1016116 - RNA, 22 nt, Human
ggcagugacuguucagacgucc

SEQ ID NO: 1016117 - RNA, 22 nt, Human
cccagcucucgcacuuacuagc

SEQ ID NO: 1016118 - RNA, 22 nt, Human
ugcagugggccggaggccaggg

SEQ ID NO: 1016119 - RNA, 22 nt, Human
ucugcaggaaaaaagugccugg

SEQ ID NO: 1016120 - RNA, 22 nt, Human
guauuugauacaugaaauggug

SEQ ID NO: 1016121 - RNA, 21 nt, Human
acagcagacaggcuuaggacc

SEQ ID NO: 1016122 - RNA, 22 nt, Human
acagccauagaugcuuauguaa

SEQ ID NO: 1016123 - RNA, 20 nt, Human
cuucaggacccauccucccc

SEQ ID NO: 1016124 - RNA, 22 nt, Human
ugcagaagcugcaggucagugg

SEQ ID NO: 1016125 - RNA, 20 nt, Human
ugcucaggauggagaggugu

SEQ ID NO: 1016126 - RNA, 22 nt, Human
agcaggugcauggcgagcgcgg

SEQ ID NO: 1016127 - RNA, 22 nt, Human
cuggccugagcacagcggcugc

SEQ ID NO: 1016128 - RNA, 22 nt, Human
uuccucuccucacaugagucac

SEQ ID NO: 1016129 - RNA, 22 nt, Human
ucucccacgguacaggauaaac

SEQ ID NO: 1016130 - RNA, 22 nt, Human
cagcuuugugcaaugcagucuc

SEQ ID NO: 1016131 - RNA, 22 nt, Human
agccugccuugggcugcuugag

SEQ ID NO: 1016132 - RNA, 22 nt, Human
aggugauguccacagcuugcag

SEQ ID NO: 1016133 - RNA, 22 nt, Human
uauugaaaugaaugacagugau

SEQ ID NO: 1016134 - RNA, 22 nt, Human
gaggggcucuuuaauaguaaca

SEQ ID NO: 1016135 - RNA, 22 nt, Human
aacaaagucguugccuagaaga

SEQ ID NO: 1016136 - RNA, 22 nt, Human
ugccugaggagucagggcaggu

SEQ ID NO: 1016137 - RNA, 22 nt, Human
ugggcagaaggaagagccaccu

SEQ ID NO: 1016138 - RNA, 22 nt, Human
caggcagcagaggaguguggga

SEQ ID NO: 1016139 - RNA, 22 nt, Human
aaucacaugugcucaauuuuaa

SEQ ID NO: 1016140 - RNA, 22 nt, Human
uucaagaucuggguuuucagcu

SEQ ID NO: 1016141 - RNA, 22 nt, Human
uagauuucaggcuggcuugcgg

SEQ ID NO: 1016142 - RNA, 22 nt, Human
aaaugaccagaauacaggcuuc

SEQ ID NO: 1016143 - RNA, 22 nt, Human
uggcuggggagccccgacuccc

SEQ ID NO: 1016144 - RNA, 22 nt, Human
uuucaguggguuuauuucaugu

SEQ ID NO: 1016145 - RNA, 22 nt, Human
aaaugcacucugcuucugugac

SEQ ID NO: 1016146 - RNA, 22 nt, Human
aagcugccuugcugaggagaaa

SEQ ID NO: 1016147 - RNA, 22 nt, Human
cccuggcaugcaugucccuggc

SEQ ID NO: 1016148 - RNA, 22 nt, Human
uaaguuuaaauguacaugaagc

SEQ ID NO: 1016149 - RNA, 22 nt, Human
ggggauggaggcgugugguccu

SEQ ID NO: 1016150 - RNA, 22 nt, Human
cugugucggacgugggcagcag

SEQ ID NO: 1016151 - RNA, 22 nt, Human
acuguccaagcaugccuggcuu

SEQ ID NO: 1016152 - RNA, 22 nt, Human
uccagccuaggggaacagcugc

SEQ ID NO: 1016153 - RNA, 22 nt, Human
ccugguggacagcagccagcag

SEQ ID NO: 1016154 - RNA, 21 nt, Human
gaggccacuaauaggggcaga

SEQ ID NO: 1016155 - RNA, 22 nt, Human
guuauaaaggugauaaugguca

SEQ ID NO: 1016156 - RNA, 22 nt, Human
aaguguauauaugacuuauaaa

SEQ ID NO: 1016157 - RNA, 22 nt, Human
uuucuugacugcuuaggaaugc

SEQ ID NO: 1016158 - RNA, 22 nt, Human
ccugagguggcugcagcacugc

SEQ ID NO: 1016159 - RNA, 22 nt, Human
ugaagcagagaauuugacaguc

SEQ ID NO: 1016160 - RNA, 19 nt, Human
agcauuuggaauucuacac

SEQ ID NO: 1016161 - RNA, 22 nt, Human
aaugaacacagcccucuacuuu

SEQ ID NO: 1016162 - RNA, 22 nt, Human
ucaucugucauccacaaagcug

SEQ ID NO: 1016163 - RNA, 22 nt, Human
aaagaacaauguggaaucuccu

SEQ ID NO: 1016164 - RNA, 22 nt, Human
augaaacaguguguauagcaaa

SEQ ID NO: 1016165 - RNA, 22 nt, Human
gcucccagcauugcugcugaau

SEQ ID NO: 1016166 - RNA, 22 nt, Human
uuagccauguugaagauuuaga

SEQ ID NO: 1016167 - RNA, 22 nt, Human
ggcugccugaggcugaggcccg

SEQ ID NO: 1016168 - RNA, 19 nt, Human
aagcagcccuggcaagagc

SEQ ID NO: 1016169 - RNA, 20 nt, Human
uugagcuuuuaguacagaca

SEQ ID NO: 1016170 - RNA, 22 nt, Human
cuggcuuccaugcuguaguggc

SEQ ID NO: 1016171 - RNA, 22 nt, Human
gcccugagggguggugucugua

SEQ ID NO: 1016172 - RNA, 22 nt, Human
aagcagccuggacuugggcugg

SEQ ID NO: 1016173 - RNA, 22 nt, Human
gcugucugcaagccaggaaaug

SEQ ID NO: 1016174 - RNA, 22 nt, Human
uguagcauguaaauugguuauu

SEQ ID NO: 1016175 - RNA, 22 nt, Human
gaagaacaccugcugcccagug

SEQ ID NO: 1016176 - RNA, 22 nt, Human
uauuuucuguggaggaccagau

SEQ ID NO: 1016177 - RNA, 22 nt, Human
uucuuuucuuuaggcauugugu

SEQ ID NO: 1016178 - RNA, 22 nt, Human
agaaauguauagugaauuuuuc

SEQ ID NO: 1016179 - RNA, 22 nt, Human
aggcagcccacaggacacagga

SEQ ID NO: 1016180 - RNA, 22 nt, Human
uggcagcaaguucuugggaggu

SEQ ID NO: 1016181 - RNA, 22 nt, Human
aaauccuaaaaguuugacuuaa

SEQ ID NO: 1016182 - RNA, 22 nt, Human
gcugggcaagugccuuggguuu

SEQ ID NO: 1016183 - RNA, 22 nt, Human
ccagggcaacgcugucucagag

SEQ ID NO: 1016184 - RNA, 22 nt, Human
ccugucuggaacauggccuguu

SEQ ID NO: 1016185 - RNA, 22 nt, Human
aacauucuauuuugcuaaaaca

SEQ ID NO: 1016186 - RNA, 22 nt, Human
gccugugcauagcagcggacuc

SEQ ID NO: 1016187 - RNA, 22 nt, Human
gccugggaaaugguggggucag

SEQ ID NO: 1016188 - RNA, 22 nt, Human
agaauaauacugaaaugcugaa

SEQ ID NO: 1016189 - RNA, 22 nt, Human
uucaugcuuuuaccgcuguuaa

SEQ ID NO: 1016190 - RNA, 22 nt, Human
auaaucuuucuuuuccagauag

SEQ ID NO: 1016191 - RNA, 21 nt, Human
cgcagagcgaacuugcggcgc

SEQ ID NO: 1016192 - RNA, 22 nt, Human
agcugccaucagccuuuggaug

SEQ ID NO: 1016193 - RNA, 22 nt, Human
cauuuagacauuugauuugggg

SEQ ID NO: 1016194 - RNA, 22 nt, Human
uuccuaauggcaaaacauguuu

SEQ ID NO: 1016195 - RNA, 22 nt, Human
auuuguagugaagugaaaauaa

SEQ ID NO: 1016196 - RNA, 22 nt, Human
auguagaaaguucauagaugcg

SEQ ID NO: 1016197 - RNA, 22 nt, Human
accaggcaguauggugcugcaa

SEQ ID NO: 1016198 - RNA, 22 nt, Human
ggcugccauaacagaguaccac

SEQ ID NO: 1016199 - RNA, 22 nt, Human
uaugugcaguuugcucuuaaca

SEQ ID NO: 1016200 - RNA, 22 nt, Human
uuugaaaggaaguuaauacuuu

SEQ ID NO: 1016201 - RNA, 22 nt, Human
gagagugaggccugggaaucua

SEQ ID NO: 1016202 - RNA, 22 nt, Human
ugauucacagacuucacaaggc

SEQ ID NO: 1016203 - RNA, 22 nt, Human
ucagcaguuuuauaugcagcuu

SEQ ID NO: 1016204 - RNA, 22 nt, Human
cacauguacagaagcaggcugg

SEQ ID NO: 1016205 - RNA, 22 nt, Human
augugcaugcacuuacaugugu

SEQ ID NO: 1016206 - RNA, 22 nt, Human
ucccagcagucagagcuaugug

SEQ ID NO: 1016207 - RNA, 22 nt, Human
ucacaugcccuguauuuaccag

SEQ ID NO: 1016208 - RNA, 22 nt, Human
ucugggagagcacguggcugac

SEQ ID NO: 1016209 - RNA, 22 nt, Human
aaacauugcuaaauaaugcugc

SEQ ID NO: 1016210 - RNA, 23 nt, Human
ucccuggaggcagguccagggcc

SEQ ID NO: 1016211 - RNA, 22 nt, Human
cugugcaagcccaagauaaaac

SEQ ID NO: 1016212 - RNA, 22 nt, Human
agucucuuccuucaaggcuggu

SEQ ID NO: 1016213 - RNA, 23 nt, Human
ucuguucaaggcuuucuccuuga

SEQ ID NO: 1016214 - RNA, 22 nt, Human
uauuugagcgaagcaguguuuu

SEQ ID NO: 1016215 - RNA, 22 nt, Human
ccugccugucccucaguccaca

SEQ ID NO: 1016216 - RNA, 22 nt, Human
aucuuucaaucaggaaaaaucu

SEQ ID NO: 1016217 - RNA, 22 nt, Human
gggcacagagggucuugaagaa

SEQ ID NO: 1016218 - RNA, 22 nt, Human
cugcuucuccaaaguaggacuu

SEQ ID NO: 1016219 - RNA, 22 nt, Human
acauaugauauugaggaucuca

SEQ ID NO: 1016220 - RNA, 22 nt, Human
ugcagggauuauguagggguug

SEQ ID NO: 1016221 - RNA, 22 nt, Human
ucucaagagggaggcaaucaug

SEQ ID NO: 1016222 - RNA, 22 nt, Human
uguacauugucacucaucaagu

SEQ ID NO: 1016223 - RNA, 22 nt, Human
uggcgugcccuccagacuuggc

SEQ ID NO: 1016224 - RNA, 22 nt, Human
gccuugggccagcugcucugga

SEQ ID NO: 1016225 - RNA, 21 nt, Human
auaagcaugcugauuacauuu

SEQ ID NO: 1016226 - RNA, 22 nt, Human
ggcccuguccuggcugucuccg

SEQ ID NO: 1016227 - RNA, 22 nt, Human
ggccugugucugugccuguccu

SEQ ID NO: 1016228 - RNA, 22 nt, Human
uuuauguaauuucauaggugug

SEQ ID NO: 1016229 - RNA, 22 nt, Human
aaugauuggcacuagauacaca

SEQ ID NO: 1016230 - RNA, 22 nt, Human
ggagaccagaaggaagcuucga

SEQ ID NO: 1016231 - RNA, 22 nt, Human
gccuggagcuacuggacacuga

SEQ ID NO: 1016232 - RNA, 22 nt, Human
uuuauuguuguuagucauaagu

SEQ ID NO: 1016233 - RNA, 22 nt, Human
uucuuguauguaugcaaaauca

SEQ ID NO: 1016234 - RNA, 22 nt, Human
ucugccugcuaacuccugcacc

SEQ ID NO: 1016235 - RNA, 22 nt, Human
guaucuuucccaccaaucacaa

SEQ ID NO: 1016236 - RNA, 22 nt, Human
caagagcucagaaacccuugcu

SEQ ID NO: 1016237 - RNA, 22 nt, Human
uguaucaaggguuuauguaagc

SEQ ID NO: 1016238 - RNA, 22 nt, Human
ggaggggccggcugccugccac

SEQ ID NO: 1016239 - RNA, 19 nt, Human
ugucuuaauuaacucagag

SEQ ID NO: 1016240 - RNA, 22 nt, Human
agggcagaccacgugcaaggau

SEQ ID NO: 1016241 - RNA, 22 nt, Human
gcaggugguccccguggagugg

SEQ ID NO: 1016242 - RNA, 22 nt, Human
agcaacaggaaauagcugauua

SEQ ID NO: 1016243 - RNA, 22 nt, Human
cugggagcuuggagccuuuggu

SEQ ID NO: 1016244 - RNA, 22 nt, Human
cuccagggagcuguggagguuu

SEQ ID NO: 1016245 - RNA, 22 nt, Human
acaggcugcccgcuccccaccu

SEQ ID NO: 1016246 - RNA, 22 nt, Human
aggagcugcaaauauuaguaau

SEQ ID NO: 1016247 - RNA, 23 nt, Human
ggaguuggauuguacuugcugcu

SEQ ID NO: 1016248 - RNA, 23 nt, Human
acagaaaguucugcuggacagag

SEQ ID NO: 1016249 - RNA, 22 nt, Human
aggugccagaugcacagcugaa

SEQ ID NO: 1016250 - RNA, 22 nt, Human
aauauugagaaccagcauguuu

SEQ ID NO: 1016251 - RNA, 19 nt, Human
ucugccucuggucaggcuc

SEQ ID NO: 1016252 - RNA, 22 nt, Human
ggcuccacugcugaccacucca

SEQ ID NO: 1016253 - RNA, 22 nt, Human
aauccagguggcggagguugug

SEQ ID NO: 1016254 - RNA, 22 nt, Human
ugggagcaguugugaagcucag

SEQ ID NO: 1016255 - RNA, 22 nt, Human
uucucuucuguucagugcccaa

SEQ ID NO: 1016256 - RNA, 21 nt, Human
gccugggauaguggccuccgg

SEQ ID NO: 1016257 - RNA, 21 nt, Human
agcagcugcaguuucuaucug

SEQ ID NO: 1016258 - RNA, 22 nt, Human
ugcugggggcuuucuggauacc

SEQ ID NO: 1016259 - RNA, 22 nt, Human
gaggggcuggcuguggucccau

SEQ ID NO: 1016260 - RNA, 22 nt, Human
auuuccuuugcaaagacugugc

SEQ ID NO: 1016261 - RNA, 22 nt, Human
ccugggcaucucaugcaccugc

SEQ ID NO: 1016262 - RNA, 22 nt, Human
aaucaguuaaauauugaguaca

SEQ ID NO: 1016263 - RNA, 22 nt, Human
ggucuuccgagaggccugugcu

SEQ ID NO: 1016264 - RNA, 19 nt, Human
gggaccugacuaauuggca

SEQ ID NO: 1016265 - RNA, 22 nt, Human
caaaugugacuuuugggcuucu

SEQ ID NO: 1016266 - RNA, 21 nt, Human
ugaaaucugaugggacaaaug

SEQ ID NO: 1016267 - RNA, 22 nt, Human
ccucagaguaggucucagcugu

SEQ ID NO: 1016268 - RNA, 22 nt, Human
ugggccugauucuugaauccug

SEQ ID NO: 1016269 - RNA, 22 nt, Human
ucagagugguagccuauuuucu

SEQ ID NO: 1016270 - RNA, 22 nt, Human
uguaucaaaccaaauuaauucu

SEQ ID NO: 1016271 - RNA, 22 nt, Human
guaacugaggcagcuuuuaaga

SEQ ID NO: 1016272 - RNA, 22 nt, Human
gguuucaacucagcuaguaagg

SEQ ID NO: 1016273 - RNA, 22 nt, Human
aggacucaucccugcuugucag

SEQ ID NO: 1016274 - RNA, 22 nt, Human
gagacagaguuucacucuuguu

SEQ ID NO: 1016275 - RNA, 22 nt, Human
gcccagaguucaaggcugcagu

SEQ ID NO: 1016276 - RNA, 22 nt, Human
cacauaaguggguuccauugca

SEQ ID NO: 1016277 - RNA, 22 nt, Human
uuuggaaaguguacaaauuuga

SEQ ID NO: 1016278 - RNA, 22 nt, Human
aggcagaauguuggaaaggaag

SEQ ID NO: 1016279 - RNA, 22 nt, Human
ucacuggggccuuuggucagga

SEQ ID NO: 1016280 - RNA, 22 nt, Human
gagugugggcacgggggccuug

SEQ ID NO: 1016281 - RNA, 22 nt, Human
agccucugguccucccucagcu

SEQ ID NO: 1016282 - RNA, 22 nt, Human
agugacagcugggaaggugaaa

SEQ ID NO: 1016283 - RNA, 22 nt, Human
cuguacauauacauuuuuuucc

SEQ ID NO: 1016284 - RNA, 22 nt, Human
ggaagggcaaaagagaugaacu

SEQ ID NO: 1016285 - RNA, 22 nt, Human
cccagcuccuuacagggccgaa

SEQ ID NO: 1016286 - RNA, 22 nt, Human
uccaggagguuuggaggaagca

SEQ ID NO: 1016287 - RNA, 19 nt, Human
ggaaacaggggccagagga

SEQ ID NO: 1016288 - RNA, 17 nt, Human
uauacacagacagacug

SEQ ID NO: 1016289 - RNA, 18 nt, Human
ccucagggagagagacgc

SEQ ID NO: 1016290 - RNA, 22 nt, Human
agaaauuccuaagguacacaag

SEQ ID NO: 1016291 - RNA, 20 nt, Human
auuuggcaugaaguauugau

SEQ ID NO: 1016292 - RNA, 22 nt, Human
acagagagaggcccgaggcugc

SEQ ID NO: 1016293 - RNA, 22 nt, Human
cuuaacauccugcauuuuucuu

SEQ ID NO: 1016294 - RNA, 22 nt, Human
cacagucacauaucuaugugug

SEQ ID NO: 1016295 - RNA, 23 nt, Human
gccaggcacaugguggacacgca

SEQ ID NO: 1016296 - RNA, 22 nt, Human
cuugauguauaaguugauaugu

SEQ ID NO: 1016297 - RNA, 22 nt, Human
agcagcagaggucagaaaggua

SEQ ID NO: 1016298 - RNA, 22 nt, Human
uugcugaaaacaguggguauug

SEQ ID NO: 1016299 - RNA, 22 nt, Human
agagccugggaauuugcauguu

SEQ ID NO: 1016300 - RNA, 22 nt, Human
ugaaggcauugaugaaggaauc

SEQ ID NO: 1016301 - RNA, 22 nt, Human
aagaguuuucuauaaucuuggc

SEQ ID NO: 1016302 - RNA, 22 nt, Human
cauugcacaucugagaagagau

SEQ ID NO: 1016303 - RNA, 22 nt, Human
uggcucuguuuguuaacuagac

SEQ ID NO: 1016304 - RNA, 22 nt, Human
uaccugcacagccagccaugug

SEQ ID NO: 1016305 - RNA, 22 nt, Human
agugggcagcccaggaggucuu

SEQ ID NO: 1016306 - RNA, 17 nt, Human
auccccagcaucuagaa

SEQ ID NO: 1016307 - RNA, 22 nt, Human
ccagagccucgcccggagccuc

SEQ ID NO: 1016308 - RNA, 22 nt, Human
uucaggauaugugauaucugaa

SEQ ID NO: 1016309 - RNA, 22 nt, Human
gcugggagucgcgucuguggcc

SEQ ID NO: 1016310 - RNA, 22 nt, Human
ggccccaggaccuccacggucc

SEQ ID NO: 1016311 - RNA, 22 nt, Human
cugggcugucaauggcccucug

SEQ ID NO: 1016312 - RNA, 22 nt, Human
ccaggagcuggcauguggagag

SEQ ID NO: 1016313 - RNA, 22 nt, Human
uucagcaagaccaccauguacc

SEQ ID NO: 1016314 - RNA, 22 nt, Human
uuucauaauauccagagauuuu

SEQ ID NO: 1016315 - RNA, 22 nt, Human
uccaggcuagguuuacaggaca

SEQ ID NO: 1016316 - RNA, 22 nt, Human
gugcccugguccccagcauaua

SEQ ID NO: 1016317 - RNA, 19 nt, Human
agcaacaccguuuauuucc

SEQ ID NO: 1016318 - RNA, 22 nt, Human
agaggcuccuagccacuggcuu

SEQ ID NO: 1016319 - RNA, 22 nt, Human
uuuccucugucaugacagcuga

SEQ ID NO: 1016320 - RNA, 22 nt, Human
cacaaauggccguguucaaaga

SEQ ID NO: 1016321 - RNA, 22 nt, Human
acccagccacagcauugaggga

SEQ ID NO: 1016322 - RNA, 18 nt, Human
cucugucauaagugucau

SEQ ID NO: 1016323 - RNA, 22 nt, Human
caggagugaaaugaggcccagg

SEQ ID NO: 1016324 - RNA, 20 nt, Human
gauuacaaaaugaaaugcau

SEQ ID NO: 1016325 - RNA, 22 nt, Human
gggcugcuuccuggggaaugcu

SEQ ID NO: 1016326 - RNA, 22 nt, Human
gcaucuaaauaaacgugggagu

SEQ ID NO: 1016327 - RNA, 22 nt, Human
uggggcacuuaugaugugccac

SEQ ID NO: 1016328 - RNA, 22 nt, Human
gaaaguuucuucauuaagaugu

SEQ ID NO: 1016329 - RNA, 22 nt, Human
ucugaaauagaagugucuuucu

SEQ ID NO: 1016330 - RNA, 22 nt, Human
ggcugccuccugcugggcugga

SEQ ID NO: 1016331 - RNA, 20 nt, Human
uuuuuccuucucuacaggca

SEQ ID NO: 1016332 - RNA, 22 nt, Human
aucauuuuuaagagacucuucu

SEQ ID NO: 1016333 - RNA, 22 nt, Human
cuggcagggugggcuuugcuuu

SEQ ID NO: 1016334 - RNA, 22 nt, Human
aauucuguaacuuuacugaauu

SEQ ID NO: 1016335 - RNA, 22 nt, Human
gcagccacccucaaggcugaau

SEQ ID NO: 1016336 - RNA, 22 nt, Human
ccagcuuuauagcuucaaagga

SEQ ID NO: 1016337 - RNA, 22 nt, Human
caggcagcugcgacaagagagc

SEQ ID NO: 1016338 - RNA, 22 nt, Human
cuguccugauggugccacuggu

SEQ ID NO: 1016339 - RNA, 22 nt, Human
uccugagauaaaucucauguga

SEQ ID NO: 1016340 - RNA, 22 nt, Human
ccagcccugccucucagggccc

SEQ ID NO: 1016341 - RNA, 22 nt, Human
cugagcugaaacuugagaggcu

SEQ ID NO: 1016342 - RNA, 22 nt, Human
ugaaggcccagccacagaaugg

SEQ ID NO: 1016343 - RNA, 22 nt, Human
auuucacucucccugccacuua

SEQ ID NO: 1016344 - RNA, 22 nt, Human
gugcauuggugcgccacuucac

SEQ ID NO: 1016345 - RNA, 22 nt, Human
ugcauguggaccccuggugccu

SEQ ID NO: 1016346 - RNA, 22 nt, Human
aaaucaguucacguucugaggu

SEQ ID NO: 1016347 - RNA, 22 nt, Human
cagggccuccccggcagucuuu

SEQ ID NO: 1016348 - RNA, 22 nt, Human
caaagagcuguucagugucgcu

SEQ ID NO: 1016349 - RNA, 22 nt, Human
ccugugugcacacgaggccaug

SEQ ID NO: 1016350 - RNA, 18 nt, Human
cucagagaugcccuuauu

SEQ ID NO: 1016351 - RNA, 22 nt, Human
uuucuucagccacuccaaacug

SEQ ID NO: 1016352 - RNA, 23 nt, Human
gccugccugaccugugcaaaguc

SEQ ID NO: 1016353 - RNA, 22 nt, Human
auaaauuuauaauuguuuccug

SEQ ID NO: 1016354 - RNA, 22 nt, Human
caggaacagcaccaggagcuag

SEQ ID NO: 1016355 - RNA, 22 nt, Human
ucccuggccauuccucuaggcc

SEQ ID NO: 1016356 - RNA, 22 nt, Human
uggcugggagcuggaacugggc

SEQ ID NO: 1016357 - RNA, 22 nt, Human
cugcugugauugggagaaaccg

SEQ ID NO: 1016358 - RNA, 22 nt, Human
ugcucccaggcucuguggucug

SEQ ID NO: 1016359 - RNA, 22 nt, Human
aggaugggccugggauaugcuu

SEQ ID NO: 1016360 - RNA, 22 nt, Human
uuaauuuauguccaaaccagau

SEQ ID NO: 1016361 - RNA, 22 nt, Human
auccaaaucaugucagaagaac

SEQ ID NO: 1016362 - RNA, 22 nt, Human
uacagaaaaacuggcauugaag

SEQ ID NO: 1016363 - RNA, 22 nt, Human
ucuucucuccugcuuggcagaa

SEQ ID NO: 1016364 - RNA, 22 nt, Human
ucccuggguucccguggaagug

SEQ ID NO: 1016365 - RNA, 22 nt, Human
ggcagggaagcuggcaucacgg

SEQ ID NO: 1016366 - RNA, 22 nt, Human
uauuagguaaaggacuugcagg

SEQ ID NO: 1016367 - RNA, 22 nt, Human
aagagggcugcaaucuuauugc

SEQ ID NO: 1016368 - RNA, 16 nt, Human
ggagagugucugcaaa

SEQ ID NO: 1016369 - RNA, 22 nt, Human
gggcugacgaaggccaugugug

SEQ ID NO: 1016370 - RNA, 22 nt, Human
cacuguguaagaagaugggcuu

SEQ ID NO: 1016371 - RNA, 22 nt, Human
cacuguaucuuuuccaaagucu

SEQ ID NO: 1016372 - RNA, 22 nt, Human
ggaggugggagacauaggcggc

SEQ ID NO: 1016373 - RNA, 22 nt, Human
agaggccagguccagaguuugu

SEQ ID NO: 1016374 - RNA, 22 nt, Human
ggcugccacgucgaggguccaa

SEQ ID NO: 1016375 - RNA, 22 nt, Human
uguugagacugagggagucagc

SEQ ID NO: 1016376 - RNA, 22 nt, Human
uuggcuucuggcagucuggacg

SEQ ID NO: 1016377 - RNA, 22 nt, Human
aaucucuugggaggaaugaauu

SEQ ID NO: 1016378 - RNA, 22 nt, Human
agggugggcuagacucuucccc

SEQ ID NO: 1016379 - RNA, 22 nt, Human
ggcacugaucugauuucccucc

SEQ ID NO: 1016380 - RNA, 22 nt, Human
accugcagguguuuccacacuu

SEQ ID NO: 1016381 - RNA, 22 nt, Human
gcagugugaccgagcuugcuuc

SEQ ID NO: 1016382 - RNA, 22 nt, Human
ugggcugccggcaggcucugcc

SEQ ID NO: 1016383 - RNA, 22 nt, Human
uuauccuggauuauauauguga

SEQ ID NO: 1016384 - RNA, 22 nt, Human
ucagcuccucagagccucaguu

SEQ ID NO: 1016385 - RNA, 22 nt, Human
augaggcaucugcagucacuag

SEQ ID NO: 1016386 - RNA, 22 nt, Human
cuucucagucaccugugagucu

SEQ ID NO: 1016387 - RNA, 22 nt, Human
aggcauggcuuuaggcaggcgu

SEQ ID NO: 1016388 - RNA, 22 nt, Human
ggagccuuccagacugcccaca

SEQ ID NO: 1016389 - RNA, 22 nt, Human
ccugcacuaccuggggcugcug

SEQ ID NO: 1016390 - RNA, 22 nt, Human
aaccugcaguuuuuauucugag

SEQ ID NO: 1016391 - RNA, 22 nt, Human
cauaagaaauaaugaugaugac

SEQ ID NO: 1016392 - RNA, 22 nt, Human
gcaggaguuaggcgucguggau

SEQ ID NO: 1016393 - RNA, 22 nt, Human
agugcuuugagcguuugaaaag

SEQ ID NO: 1016394 - RNA, 22 nt, Human
caaggcaggaagccugucuuau

SEQ ID NO: 1016395 - RNA, 22 nt, Human
uggcagccacaucucguggauu

SEQ ID NO: 1016396 - RNA, 22 nt, Human
auaaggaaugauguaucaguuu

SEQ ID NO: 1016397 - RNA, 22 nt, Human
gaaggagacccugaagaugcug

SEQ ID NO: 1016398 - RNA, 22 nt, Human
agaaaugugaauuucauuuccu

SEQ ID NO: 1016399 - RNA, 22 nt, Human
gcagagaggauauuauugucca

SEQ ID NO: 1016400 - RNA, 22 nt, Human
uuuguguuuguacaaugcacua

SEQ ID NO: 1016401 - RNA, 22 nt, Human
gaaggccacaaaaaaugucaua

SEQ ID NO: 1016402 - RNA, 22 nt, Human
caggcacuguguuaggcacugu

SEQ ID NO: 1016403 - RNA, 22 nt, Human
auggcacuaagagggagcugga

SEQ ID NO: 1016404 - RNA, 22 nt, Human
caggggcuagcacuuaauguuu

SEQ ID NO: 1016405 - RNA, 22 nt, Human
gggagcuguaagggacagguag

SEQ ID NO: 1016406 - RNA, 22 nt, Human
ugagccagauaagggcucacgc

SEQ ID NO: 1016407 - RNA, 19 nt, Human
ggcagaagguguaggggga

SEQ ID NO: 1016408 - RNA, 22 nt, Human
gucugcccucacgccagcuggg

SEQ ID NO: 1016409 - RNA, 22 nt, Human
uagcagcucugauucugggccc

SEQ ID NO: 1016410 - RNA, 22 nt, Human
gccugccuuugugaggaagcgg

SEQ ID NO: 1016411 - RNA, 22 nt, Human
gccucugcggagcuguacauca

SEQ ID NO: 1016412 - RNA, 19 nt, Human
ccaggccuccugggagguc

SEQ ID NO: 1016413 - RNA, 22 nt, Human
aggcagaaaauagucauccaaa

SEQ ID NO: 1016414 - RNA, 22 nt, Human
cugcccugucuuuuucugauga

SEQ ID NO: 1016415 - RNA, 22 nt, Human
agggcccaggacagcaucaggg

SEQ ID NO: 1016416 - RNA, 19 nt, Human
uagucuuuauucuuaauuu

SEQ ID NO: 1016417 - RNA, 21 nt, Human
ucccugcuuucuggcccaguc

SEQ ID NO: 1016418 - RNA, 19 nt, Human
agaggccucagcagcuggc

SEQ ID NO: 1016419 - RNA, 22 nt, Human
aggggcugcuggguccgccccu

SEQ ID NO: 1016420 - RNA, 22 nt, Human
caucacuguccucagcauucca

SEQ ID NO: 1016421 - RNA, 22 nt, Human
uaaaauguguuucuguaugguu

SEQ ID NO: 1016422 - RNA, 22 nt, Human
acaaguaccaaaugcucaagua

SEQ ID NO: 1016423 - RNA, 22 nt, Human
cagccugcccuggaagcccagc

SEQ ID NO: 1016424 - RNA, 22 nt, Human
ggccucugggguccugagccca

SEQ ID NO: 1016425 - RNA, 22 nt, Human
guuugaaaaaagcaguauguaa

SEQ ID NO: 1016426 - RNA, 22 nt, Human
cuggcucaggguggucuggguc

SEQ ID NO: 1016427 - RNA, 22 nt, Human
ccucccuggccagagcagcagc

SEQ ID NO: 1016428 - RNA, 22 nt, Human
cuggugcuggagccuagucccu

SEQ ID NO: 1016429 - RNA, 23 nt, Human
cuuuucauugccuuagcgcagag

SEQ ID NO: 1016430 - RNA, 22 nt, Human
cucuggaguuagugaucugggc

SEQ ID NO: 1016431 - RNA, 22 nt, Human
uggcagcuggcucugcgcaggc

SEQ ID NO: 1016432 - RNA, 22 nt, Human
uguacaauagcuauuaucucca

SEQ ID NO: 1016433 - RNA, 22 nt, Human
gcagacagacugcagugauuuu

SEQ ID NO: 1016434 - RNA, 22 nt, Human
cuccagggagcugcgggagcca

SEQ ID NO: 1016435 - RNA, 22 nt, Human
agggacuggcucucugagcagg

SEQ ID NO: 1016436 - RNA, 22 nt, Human
ucaggggacuuaggagagaagu

SEQ ID NO: 1016437 - RNA, 22 nt, Human
gcagcuggagccagccagacac

SEQ ID NO: 1016438 - RNA, 22 nt, Human
gcugugggugcuggcuccaccc

SEQ ID NO: 1016439 - RNA, 22 nt, Human
aagagcuggcccaaucugagca

SEQ ID NO: 1016440 - RNA, 22 nt, Human
acaguggagaaggcaugaggcu

SEQ ID NO: 1016441 - RNA, 22 nt, Human
aaguguuuggggaucauuuuaa

SEQ ID NO: 1016442 - RNA, 22 nt, Human
gagccuggagcuggaacgaagc

SEQ ID NO: 1016443 - RNA, 22 nt, Human
auaaacagaguaguugcuacug

SEQ ID NO: 1016444 - RNA, 22 nt, Human
uggaaauguauuugggcaugcc

SEQ ID NO: 1016445 - RNA, 22 nt, Human
uggccugcccagagcagcucug

SEQ ID NO: 1016446 - RNA, 22 nt, Human
guccucugcccaggucaagguu

SEQ ID NO: 1016447 - RNA, 22 nt, Human
aagagcuggcucuugcagcagc

SEQ ID NO: 1016448 - RNA, 23 nt, Human
uuagagaugauuaaaaaaucuug

SEQ ID NO: 1016449 - RNA, 22 nt, Human
cugcaggauucucccaguugga

SEQ ID NO: 1016450 - RNA, 22 nt, Human
guuauugcaguauagaggucua

SEQ ID NO: 1016451 - RNA, 22 nt, Human
auacauauaugguacuuccugg

SEQ ID NO: 1016452 - RNA, 22 nt, Human
cucucugguuucagcgaagggg

SEQ ID NO: 1016453 - RNA, 22 nt, Human
uggugagcucuggcagucugug

SEQ ID NO: 1016454 - RNA, 22 nt, Human
uggccuggaaccuggcagggac

SEQ ID NO: 1016455 - RNA, 22 nt, Human
agcugccaucugaagaacugca

SEQ ID NO: 1016456 - RNA, 22 nt, Human
ucagaaaagguagcugugacaa

SEQ ID NO: 1016457 - RNA, 18 nt, Human
uucaccagugugaugggu

SEQ ID NO: 1016458 - RNA, 22 nt, Human
uuccauaauaggcuuaagugaa

SEQ ID NO: 1016459 - RNA, 22 nt, Human
uuuagaaguucacacauuuaaa

SEQ ID NO: 1016460 - RNA, 22 nt, Human
cuguauuuucaugccuacguac

SEQ ID NO: 1016461 - RNA, 22 nt, Human
aaacaccagucccaguauacac

SEQ ID NO: 1016462 - RNA, 22 nt, Human
acagagcuaaauuucaauccca

SEQ ID NO: 1016463 - RNA, 22 nt, Human
uccuugaauccuagcauccuau

SEQ ID NO: 1016464 - RNA, 22 nt, Human
cucccacuccuggcucaccaca

SEQ ID NO: 1016465 - RNA, 22 nt, Human
cugcagagcagccaguccccca

SEQ ID NO: 1016466 - RNA, 22 nt, Human
gcagugaaucuggcaagaauuu

SEQ ID NO: 1016467 - RNA, 22 nt, Human
gagcccugauuugcagcauuug

SEQ ID NO: 1016468 - RNA, 22 nt, Human
ccagacuguggaguuccuggug

SEQ ID NO: 1016469 - RNA, 22 nt, Human
aaagauuugaaauuaggcauca

SEQ ID NO: 1016470 - RNA, 22 nt, Human
uuuucauuagaaugacugagaa

SEQ ID NO: 1016471 - RNA, 22 nt, Human
gcagcugcuggaaguuccugcc

SEQ ID NO: 1016472 - RNA, 22 nt, Human
auguccagggcacacagcagug

SEQ ID NO: 1016473 - RNA, 22 nt, Human
cuguguggccucaagccagccu

SEQ ID NO: 1016474 - RNA, 22 nt, Human
aauuaugauuggucuaaaccag

SEQ ID NO: 1016475 - RNA, 22 nt, Human
gccugggagagggauagugcag

SEQ ID NO: 1016476 - RNA, 22 nt, Human
ucccagagcucugacaccagcu

SEQ ID NO: 1016477 - RNA, 22 nt, Human
ucuggcucccagccugcucuca

SEQ ID NO: 1016478 - RNA, 22 nt, Human
agugcauugcaucucugcuuca

SEQ ID NO: 1016479 - RNA, 22 nt, Human
aaaaguaauugcaauuuuguag

SEQ ID NO: 1016480 - RNA, 22 nt, Human
ccuguucacgguguguuguuag

SEQ ID NO: 1016481 - RNA, 22 nt, Human
gagccuguguuuccuguagcca

SEQ ID NO: 1016482 - RNA, 22 nt, Human
cuagagaggcagauguccugug

SEQ ID NO: 1016483 - RNA, 22 nt, Human
gggcagcucuggcugugggaag

SEQ ID NO: 1016484 - RNA, 22 nt, Human
gggaucagcaagccacugcacc

SEQ ID NO: 1016485 - RNA, 22 nt, Human
gggcacugcuggaggcucccug

SEQ ID NO: 1016486 - RNA, 22 nt, Human
agcagcuuacauguggccuauc

SEQ ID NO: 1016487 - RNA, 22 nt, Human
uugcauguuauuuaaucuguau

SEQ ID NO: 1016488 - RNA, 22 nt, Human
aagcccagaugggagcauuuca

SEQ ID NO: 1016489 - RNA, 22 nt, Human
aaggcacugaacuuaaauucug

SEQ ID NO: 1016490 - RNA, 22 nt, Human
agcagcaugaugacagagucuc

SEQ ID NO: 1016491 - RNA, 22 nt, Human
ggcccagccggcgagucucgcg

SEQ ID NO: 1016492 - RNA, 22 nt, Human
gauuucaauccagcuuucuucu

SEQ ID NO: 1016493 - RNA, 22 nt, Human
acugaaggucucagcaaggaug

SEQ ID NO: 1016494 - RNA, 22 nt, Human
cuuggggcugucacucuggcau

SEQ ID NO: 1016495 - RNA, 17 nt, Human
ugccagccugucccagg

SEQ ID NO: 1016496 - RNA, 22 nt, Human
gcaccuggcugcccagguggag

SEQ ID NO: 1016497 - RNA, 22 nt, Human
gugcccaggcccaaggcaccac

SEQ ID NO: 1016498 - RNA, 22 nt, Human
ugggcuccaauuuguccuuuca

SEQ ID NO: 1016499 - RNA, 22 nt, Human
ggcuucugaaaucucugugcgu

SEQ ID NO: 1016500 - RNA, 22 nt, Human
agcuccugaaaagcgcuugcuu

SEQ ID NO: 1016501 - RNA, 22 nt, Human
uuguauuucuccacuuucuguu

SEQ ID NO: 1016502 - RNA, 22 nt, Human
uuuguucaugccuauauucuca

SEQ ID NO: 1016503 - RNA, 22 nt, Human
uagcugugagcacccaggcugu

SEQ ID NO: 1016504 - RNA, 22 nt, Human
cccaggaggccaagguugcagu

SEQ ID NO: 1016505 - RNA, 18 nt, Human
ccucaggggaccuggcag

SEQ ID NO: 1016506 - RNA, 22 nt, Human
gcagagccaugggagguuuuug

SEQ ID NO: 1016507 - RNA, 22 nt, Human
cagcuucccuuggcugagcaga

SEQ ID NO: 1016508 - RNA, 22 nt, Human
aggggacacggcuucuccaggg

SEQ ID NO: 1016509 - RNA, 23 nt, Human
ccaggccucucagagggugugcc

SEQ ID NO: 1016510 - RNA, 22 nt, Human
caaagaugcugauguuggauca

SEQ ID NO: 1016511 - RNA, 22 nt, Human
uggugugggcguggcaggcaag

SEQ ID NO: 1016512 - RNA, 22 nt, Human
ucucaggggccuggaguccugg

SEQ ID NO: 1016513 - RNA, 22 nt, Human
agcuucuugaccaagccuguaa

SEQ ID NO: 1016514 - RNA, 22 nt, Human
uuccauauguauauagcuguua

SEQ ID NO: 1016515 - RNA, 22 nt, Human
aaaggaagaugccaggacucug

SEQ ID NO: 1016516 - RNA, 22 nt, Human
gucuccugagccuugacugcaa

SEQ ID NO: 1016517 - RNA, 22 nt, Human
uggugcugauaauggcaggauu

SEQ ID NO: 1016518 - RNA, 22 nt, Human
ggagcagagcugggcuuggcug

SEQ ID NO: 1016519 - RNA, 22 nt, Human
ugagcuggucacuccuucugaa

SEQ ID NO: 1016520 - RNA, 22 nt, Human
uuuuucauugcagccucucucc

SEQ ID NO: 1016521 - RNA, 22 nt, Human
acaguguccuuguggucccugu

SEQ ID NO: 1016522 - RNA, 22 nt, Human
agcugcugcggaaagaugccac

SEQ ID NO: 1016523 - RNA, 22 nt, Human
agagccagcauuugacacuggc

SEQ ID NO: 1016524 - RNA, 22 nt, Human
gaggcuccccaugaggccccag

SEQ ID NO: 1016525 - RNA, 19 nt, Human
uggcucugucgaaggcaca

SEQ ID NO: 1016526 - RNA, 22 nt, Human
aggcucugacccaugggaccca

SEQ ID NO: 1016527 - RNA, 22 nt, Human
uauuucuaagagauaucuguac

SEQ ID NO: 1016528 - RNA, 21 nt, Human
agcugagcccagaagacuggu

SEQ ID NO: 1016529 - RNA, 19 nt, Human
aggaaagguggccuuagca

SEQ ID NO: 1016530 - RNA, 22 nt, Human
ugcagcauugcaaagcagucuu

SEQ ID NO: 1016531 - RNA, 21 nt, Human
aggcugcuggcucaggguccu

SEQ ID NO: 1016532 - RNA, 22 nt, Human
cuugggaaugcuaacagaugac

SEQ ID NO: 1016533 - RNA, 22 nt, Human
aguuuguaucaauuugcuuuau

SEQ ID NO: 1016534 - RNA, 22 nt, Human
uccagucaucucccuucacauu

SEQ ID NO: 1016535 - RNA, 22 nt, Human
agccuggccacucagggccuga

SEQ ID NO: 1016536 - RNA, 22 nt, Human
cccagcuugcaaauggguugcu

SEQ ID NO: 1016537 - RNA, 19 nt, Human
aaaguuuuauucucauuug

SEQ ID NO: 1016538 - RNA, 16 nt, Human
auuuccagauuaugca

SEQ ID NO: 1016539 - RNA, 22 nt, Human
aucagcaaggcaaucacugcag

SEQ ID NO: 1016540 - RNA, 20 nt, Human
cagagaccaggccagguguc

SEQ ID NO: 1016541 - RNA, 22 nt, Human
uuggccuuaaccucucugugcc

SEQ ID NO: 1016542 - RNA, 22 nt, Human
guggagcccugguagggacccc

SEQ ID NO: 1016543 - RNA, 22 nt, Human
caguacuuguccucagguguua

SEQ ID NO: 1016544 - RNA, 22 nt, Human
augaugguaaauucaguauccg

SEQ ID NO: 1016545 - RNA, 22 nt, Human
uuuaagaugguauuuuauaaag

SEQ ID NO: 1016546 - RNA, 22 nt, Human
aguauucuggaauucuauguga

SEQ ID NO: 1016547 - RNA, 22 nt, Human
uacaguaaagcugcuaugaauu

SEQ ID NO: 1016548 - RNA, 22 nt, Human
aauuaugagguagauaucacau

SEQ ID NO: 1016549 - RNA, 22 nt, Human
aggugcugccccgagaaggaug

SEQ ID NO: 1016550 - RNA, 22 nt, Human
uaaauguaccuucugccuuacu

SEQ ID NO: 1016551 - RNA, 19 nt, Human
uucauucucuuauuguugu

SEQ ID NO: 1016552 - RNA, 23 nt, Human
ccacuagcaccuguucaacuucu

SEQ ID NO: 1016553 - RNA, 22 nt, Human
aaucugucguaguaaaaagcag

SEQ ID NO: 1016554 - RNA, 22 nt, Human
auacaacuuuacaugcaauucc

SEQ ID NO: 1016555 - RNA, 22 nt, Human
aagaaauguagagccuaguaaa

SEQ ID NO: 1016556 - RNA, 22 nt, Human
aaauguuuugcucccauguggu

SEQ ID NO: 1016557 - RNA, 22 nt, Human
ccuggcagcaggugggcccgug

SEQ ID NO: 1016558 - RNA, 22 nt, Human
auuucucaucaagugccaacuc

SEQ ID NO: 1016559 - RNA, 22 nt, Human
aagaacauguuaaaagauucac

SEQ ID NO: 1016560 - RNA, 22 nt, Human
ugauugaagaggugaggaaguu

SEQ ID NO: 1016561 - RNA, 22 nt, Human
agcuggcaguaugacuggugac

SEQ ID NO: 1016562 - RNA, 22 nt, Human
ugaaaucuuuaguuucuguccc

SEQ ID NO: 1016563 - RNA, 22 nt, Human
aggcucuguuugcugugguacc

SEQ ID NO: 1016564 - RNA, 22 nt, Human
uuugcaauuugugcugcaaaug

SEQ ID NO: 1016565 - RNA, 22 nt, Human
auuguaauuuuagagaaagugg

SEQ ID NO: 1016566 - RNA, 22 nt, Human
auugaaaaauucacaauucugg

SEQ ID NO: 1016567 - RNA, 22 nt, Human
aggcuucuaggguuggcagcgg

SEQ ID NO: 1016568 - RNA, 21 nt, Human
ccugccaggaaacugaguguc

SEQ ID NO: 1016569 - RNA, 22 nt, Human
gggcuggcucugucuagaaagg

SEQ ID NO: 1016570 - RNA, 22 nt, Human
auuuggaaaugcaucucuugag

SEQ ID NO: 1016571 - RNA, 22 nt, Human
gcagaggcagggcccuccucca

SEQ ID NO: 1016572 - RNA, 22 nt, Human
cagcagugcuucagugugagau

SEQ ID NO: 1016573 - RNA, 22 nt, Human
uggagcagagaugggagcccaa

SEQ ID NO: 1016574 - RNA, 22 nt, Human
uuucacauguggaaugccaggu

SEQ ID NO: 1016575 - RNA, 22 nt, Human
cagggcagcuuccuuuguuagg

SEQ ID NO: 1016576 - RNA, 22 nt, Human
ugaacgcagguccacauggcuc

SEQ ID NO: 1016577 - RNA, 22 nt, Human
ucucccacugcaagcccaggcu

SEQ ID NO: 1016578 - RNA, 22 nt, Human
acaggcagagaacucagccaga

SEQ ID NO: 1016579 - RNA, 22 nt, Human
auuuauuaugggauuuggcuca

SEQ ID NO: 1016580 - RNA, 22 nt, Human
caagagcugaggcuggagaggu

SEQ ID NO: 1016581 - RNA, 22 nt, Human
aaugaugggaaggagaaaagca

SEQ ID NO: 1016582 - RNA, 22 nt, Human
gcaguggcaugaugugggcuca

SEQ ID NO: 1016583 - RNA, 22 nt, Human
agcuuuaucccuugcccaucga

SEQ ID NO: 1016584 - RNA, 17 nt, Human
aggaaacauuuucuuuc

SEQ ID NO: 1016585 - RNA, 22 nt, Human
ccagaggaggggggucuuucug

SEQ ID NO: 1016586 - RNA, 22 nt, Human
agucccagccuguaggauuggg

SEQ ID NO: 1016587 - RNA, 22 nt, Human
aaacaugcauucaagaaaaucu

SEQ ID NO: 1016588 - RNA, 22 nt, Human
uggccuggugucugcgaggccu

SEQ ID NO: 1016589 - RNA, 22 nt, Human
agagccagguguagucucggag

SEQ ID NO: 1016590 - RNA, 22 nt, Human
ggaguuggugagcaccaggcuu

SEQ ID NO: 1016591 - RNA, 22 nt, Human
aaaaaugcugugguagcugugu

SEQ ID NO: 1016592 - RNA, 22 nt, Human
ugggccugggucuuugcugcca

SEQ ID NO: 1016593 - RNA, 22 nt, Human
auuuauguaucuguguagauca

SEQ ID NO: 1016594 - RNA, 22 nt, Human
cuucagaauccagaaucagaau

SEQ ID NO: 1016595 - RNA, 22 nt, Human
ggccugcugacccaaguccugu

SEQ ID NO: 1016596 - RNA, 22 nt, Human
gcagugaaacaauaggaucaaa

SEQ ID NO: 1016597 - RNA, 22 nt, Human
uggccucugggaaagcagauuc

SEQ ID NO: 1016598 - RNA, 22 nt, Human
ggcuccuguccccucagcugcu

SEQ ID NO: 1016599 - RNA, 22 nt, Human
cagaaauggagcccaggaaucu

SEQ ID NO: 1016600 - RNA, 22 nt, Human
caggcagcccugcaccaagugu

SEQ ID NO: 1016601 - RNA, 22 nt, Human
ccaguggguaggccauggugag

SEQ ID NO: 1016602 - RNA, 22 nt, Human
uggcuggcuuguucacugacug

SEQ ID NO: 1016603 - RNA, 22 nt, Human
cagggcccauggcucagguagg

SEQ ID NO: 1016604 - RNA, 22 nt, Human
cagaggcaaaagagguggaggu

SEQ ID NO: 1016605 - RNA, 22 nt, Human
uacaguaagaugaaauagcaau

SEQ ID NO: 1016606 - RNA, 17 nt, Human
caaggccagcaucuuca

SEQ ID NO: 1016607 - RNA, 22 nt, Human
gaaaucugcggugaggccugag

SEQ ID NO: 1016608 - RNA, 22 nt, Human
auuacucugucugccucugacc

SEQ ID NO: 1016609 - RNA, 22 nt, Human
uagaggugucacuuugggaagu

SEQ ID NO: 1016610 - RNA, 22 nt, Human
ucugcagcuuuuugguggggug

SEQ ID NO: 1016611 - RNA, 22 nt, Human
cauuccuuaacguggggagucu

SEQ ID NO: 1016612 - RNA, 22 nt, Human
augagcuguaagguggcuuccu

SEQ ID NO: 1016613 - RNA, 22 nt, Human
cucuucucugcagccuuugaag

SEQ ID NO: 1016614 - RNA, 22 nt, Human
uggcucugggaaucuguugcuu

SEQ ID NO: 1016615 - RNA, 22 nt, Human
ugcaguggcgccaucucagcuc

SEQ ID NO: 1016616 - RNA, 22 nt, Human
agguaugagauaaaucaaugaa

SEQ ID NO: 1016617 - RNA, 22 nt, Human
gagucuuugguaaagucugcug

SEQ ID NO: 1016618 - RNA, 22 nt, Human
aaaguugugaaaccgaacaugu

SEQ ID NO: 1016619 - RNA, 22 nt, Human
cagggcuguuagcugcugcucu

SEQ ID NO: 1016620 - RNA, 22 nt, Human
uuucuguagggauuucacaguu

SEQ ID NO: 1016621 - RNA, 22 nt, Human
ccagcuuuagguugccugccag

SEQ ID NO: 1016622 - RNA, 22 nt, Human
uaaguucagaguucucauuugu

SEQ ID NO: 1016623 - RNA, 22 nt, Human
uuaaaaugaauauugauuagca

SEQ ID NO: 1016624 - RNA, 22 nt, Human
gaggcugguaggaaaggaaaca

SEQ ID NO: 1016625 - RNA, 22 nt, Human
aguaaaaucuuaagcacagugg

SEQ ID NO: 1016626 - RNA, 22 nt, Human
ugcagcaggcacaggacggaag

SEQ ID NO: 1016627 - RNA, 22 nt, Human
ggcagcuccuccuagucugccc

SEQ ID NO: 1016628 - RNA, 22 nt, Human
gcucugucauuuugcagacacu

SEQ ID NO: 1016629 - RNA, 22 nt, Human
caguacuuaguucucaugguuu

SEQ ID NO: 1016630 - RNA, 22 nt, Human
ugauacagucagcucacaauug

SEQ ID NO: 1016631 - RNA, 22 nt, Human
agugggcaugaucuggugucug

SEQ ID NO: 1016632 - RNA, 22 nt, Human
aaaguuugagugauuugacaca

SEQ ID NO: 1016633 - RNA, 22 nt, Human
agaagucauuuauguuagauga

SEQ ID NO: 1016634 - RNA, 22 nt, Human
uaaauguguuagucaugguuuu

SEQ ID NO: 1016635 - RNA, 22 nt, Human
uuccagggcuaauuccugugga

SEQ ID NO: 1016636 - RNA, 22 nt, Human
auucugucauuucaagaaaaac

SEQ ID NO: 1016637 - RNA, 22 nt, Human
cacuggcaugugaggcgguggc

SEQ ID NO: 1016638 - RNA, 22 nt, Human
cagggccuccuaaggcaucuaa

SEQ ID NO: 1016639 - RNA, 22 nt, Human
ggcagcugauuagcaucaagga

SEQ ID NO: 1016640 - RNA, 22 nt, Human
aaacagaaggguagguaaacau

SEQ ID NO: 1016641 - RNA, 22 nt, Human
cagccaggccuggugaccaaag

SEQ ID NO: 1016642 - RNA, 22 nt, Human
ugccugagugauguggcagcca

SEQ ID NO: 1016643 - RNA, 22 nt, Human
cauuacauuucaaaauguuucc

SEQ ID NO: 1016644 - RNA, 22 nt, Human
agggagcuuccgaacuacagcu

SEQ ID NO: 1016645 - RNA, 22 nt, Human
ucccacugugaauccaaggccu

SEQ ID NO: 1016646 - RNA, 22 nt, Human
cucugaagggagggccaagccc

SEQ ID NO: 1016647 - RNA, 22 nt, Human
cugggugguuuugaugugaauu

SEQ ID NO: 1016648 - RNA, 22 nt, Human
cugccuugaaaaugaagcuuua

SEQ ID NO: 1016649 - RNA, 22 nt, Human
cacauaauacauguuccacuua

SEQ ID NO: 1016650 - RNA, 22 nt, Human
gguuucaaugagaagugcuugu

SEQ ID NO: 1016651 - RNA, 22 nt, Human
gccucugcccauccaccaucag

SEQ ID NO: 1016652 - RNA, 20 nt, Human
cgugcugugaccuugagcau

SEQ ID NO: 1016653 - RNA, 22 nt, Human
ucucuccuuaucauuguguuua

SEQ ID NO: 1016654 - RNA, 23 nt, Human
aguuccagaaaaaugcucaagca

SEQ ID NO: 1016655 - RNA, 22 nt, Human
uuucucugaggcuggccucccu

SEQ ID NO: 1016656 - RNA, 22 nt, Human
auuuagaacuuuguuugccaau

SEQ ID NO: 1016657 - RNA, 22 nt, Human
gaggugagaagggggucagaug

SEQ ID NO: 1016658 - RNA, 22 nt, Human
gcccucagaguuccccacagug

SEQ ID NO: 1016659 - RNA, 22 nt, Human
cagagccugcucacgucucugu

SEQ ID NO: 1016660 - RNA, 22 nt, Human
cuguuuauaaauagaggggagu

SEQ ID NO: 1016661 - RNA, 22 nt, Human
gccuguccacuaaacagccaag

SEQ ID NO: 1016662 - RNA, 22 nt, Human
aguuuucuguucuacaauuuga

SEQ ID NO: 1016663 - RNA, 22 nt, Human
gcauccagagguagccacugug

SEQ ID NO: 1016664 - RNA, 22 nt, Human
cugaagaugucugagaugcuca

SEQ ID NO: 1016665 - RNA, 22 nt, Human
ugaaguccuagaacuccuggua

SEQ ID NO: 1016666 - RNA, 22 nt, Human
ugcuggggagugauugaccauc

SEQ ID NO: 1016667 - RNA, 22 nt, Human
acugggaggcaaagagcaagga

SEQ ID NO: 1016668 - RNA, 22 nt, Human
auccuugagaaaauaaaugacc

SEQ ID NO: 1016669 - RNA, 22 nt, Human
ccacacugaaccucagugucuu

SEQ ID NO: 1016670 - RNA, 22 nt, Human
cccaggcacacugaagugacau

SEQ ID NO: 1016671 - RNA, 22 nt, Human
acccaggcugcuucucaguggc

SEQ ID NO: 1016672 - RNA, 22 nt, Human
gcugucacacauggccccagcu

SEQ ID NO: 1016673 - RNA, 22 nt, Human
gcauuuguguucuuccuagagc

SEQ ID NO: 1016674 - RNA, 21 nt, Human
gauuucacuuaccuucauuua

SEQ ID NO: 1016675 - RNA, 19 nt, Human
guggccucggagcgcgcgg

SEQ ID NO: 1016676 - RNA, 22 nt, Human
gguuucaacuucaaccucucca

SEQ ID NO: 1016677 - RNA, 22 nt, Human
acauuucucauucuccccuaac

SEQ ID NO: 1016678 - RNA, 22 nt, Human
ucugagggcuugaggggaagua

SEQ ID NO: 1016679 - RNA, 22 nt, Human
aggcugggcuccgcccaacucc

SEQ ID NO: 1016680 - RNA, 22 nt, Human
gcacagaacagagaaauagcca

SEQ ID NO: 1016681 - RNA, 22 nt, Human
aggucauuuuugccuucuauuu

SEQ ID NO: 1016682 - RNA, 22 nt, Human
agccacagcaacaagugcaauu

SEQ ID NO: 1016683 - RNA, 17 nt, Human
ucccaggaacagggaau

SEQ ID NO: 1016684 - RNA, 22 nt, Human
gcaggaagaugagcucagguaa

SEQ ID NO: 1016685 - RNA, 22 nt, Human
gcugaguguaaugauggcagag

SEQ ID NO: 1016686 - RNA, 22 nt, Human
cgagaguuagcuaggagucaca

SEQ ID NO: 1016687 - RNA, 22 nt, Human
gugauuucaaauauagagugag

SEQ ID NO: 1016688 - RNA, 22 nt, Human
agagacagaggcaauauagcuu

SEQ ID NO: 1016689 - RNA, 22 nt, Human
cccagccuuugcuuccugguuc

SEQ ID NO: 1016690 - RNA, 22 nt, Human
uccucuggggucagggcacuac

SEQ ID NO: 1016691 - RNA, 22 nt, Human
cuguauuucccacauucucuau

SEQ ID NO: 1016692 - RNA, 22 nt, Human
uuccucaucugugcaccucacu

SEQ ID NO: 1016693 - RNA, 22 nt, Human
gagcagcuggacaggccucccu

SEQ ID NO: 1016694 - RNA, 22 nt, Human
auugaaagauaggcuacugugg

SEQ ID NO: 1016695 - RNA, 22 nt, Human
acuugggauuucagaugcugug

SEQ ID NO: 1016696 - RNA, 20 nt, Human
gcagcugaaaguaugacacc

SEQ ID NO: 1016697 - RNA, 22 nt, Human
cauacauuuugcauauuuacca

SEQ ID NO: 1016698 - RNA, 22 nt, Human
gccuaggaguggggauggcggu

SEQ ID NO: 1016699 - RNA, 22 nt, Human
agagcuggacgucugagcccua

SEQ ID NO: 1016700 - RNA, 22 nt, Human
gcucuuccauuucucuugaacu

SEQ ID NO: 1016701 - RNA, 22 nt, Human
cagccuccugggacacucaccg

SEQ ID NO: 1016702 - RNA, 22 nt, Human
ggcagcuggggcagugcccugu

SEQ ID NO: 1016703 - RNA, 22 nt, Human
gguggagcuguggacaggaagg

SEQ ID NO: 1016704 - RNA, 22 nt, Human
caguuuauuuccaagaugacaa

SEQ ID NO: 1016705 - RNA, 22 nt, Human
uggcaggggaggugcuugcuua

SEQ ID NO: 1016706 - RNA, 22 nt, Human
uuguuacagcagugauuucaga

SEQ ID NO: 1016707 - RNA, 22 nt, Human
acugugugacuguuauuacugu

SEQ ID NO: 1016708 - RNA, 18 nt, Human
ggccugaggauuucagca

SEQ ID NO: 1016709 - RNA, 22 nt, Human
ucggggucuuugacacgcucug

SEQ ID NO: 1016710 - RNA, 21 nt, Human
uuucuucacuuugccccaugu

SEQ ID NO: 1016711 - RNA, 22 nt, Human
ugucaccagcugcuccucagga

SEQ ID NO: 1016712 - RNA, 22 nt, Human
aguccuucaagaaaucuggaaa

SEQ ID NO: 1016713 - RNA, 22 nt, Human
uuugaaauaugaggcauuauga

SEQ ID NO: 1016714 - RNA, 22 nt, Human
uuccaugaaagugaaauggagc

SEQ ID NO: 1016715 - RNA, 22 nt, Human
uacauaguauucacauuguuuu

SEQ ID NO: 1016716 - RNA, 19 nt, Human
cacagggcaggucucaugu

SEQ ID NO: 1016717 - RNA, 22 nt, Human
cagaggaguucaguacacagcc

SEQ ID NO: 1016718 - RNA, 22 nt, Human
ugcuuuauaucucucuucuuag

SEQ ID NO: 1016719 - RNA, 22 nt, Human
gcacugcaucuacuggcaagua

SEQ ID NO: 1016720 - RNA, 22 nt, Human
agccacagguguuggccagugu

SEQ ID NO: 1016721 - RNA, 22 nt, Human
cucuuaaauaacaucauugcuu

SEQ ID NO: 1016722 - RNA, 22 nt, Human
caccagcuuugcccacugccca

SEQ ID NO: 1016723 - RNA, 22 nt, Human
cuggccuguccugacccagccu

SEQ ID NO: 1016724 - RNA, 22 nt, Human
gagagcugcauucucagacaca

SEQ ID NO: 1016725 - RNA, 22 nt, Human
aagagcuggaagugaagauaac

SEQ ID NO: 1016726 - RNA, 22 nt, Human
ucuuuauugcuacugguuuguc

SEQ ID NO: 1016727 - RNA, 22 nt, Human
ucucagagaucuuucugcaugu

SEQ ID NO: 1016728 - RNA, 23 nt, Human
ugaaacauuuaggguagaauuuc

SEQ ID NO: 1016729 - RNA, 22 nt, Human
aggcaguguguagcuggaagag

SEQ ID NO: 1016730 - RNA, 22 nt, Human
auucuccaucaccacuggcacu

SEQ ID NO: 1016731 - RNA, 22 nt, Human
caggagacuauggcccaaggcc

SEQ ID NO: 1016732 - RNA, 22 nt, Human
uagugcuugagucucuccguac

SEQ ID NO: 1016733 - RNA, 22 nt, Human
gcuguucacggaggaggauggg

SEQ ID NO: 1016734 - RNA, 20 nt, Human
aagagcugacucacaguggu

SEQ ID NO: 1016735 - RNA, 22 nt, Human
uaaaucacuccuaauaaucagu

SEQ ID NO: 1016736 - RNA, 22 nt, Human
agaaaagggcaggagggauaca

SEQ ID NO: 1016737 - RNA, 23 nt, Human
agcuccagaacauagcacaggaa

SEQ ID NO: 1016738 - RNA, 22 nt, Human
ggcuuuauaggguagaggauca

SEQ ID NO: 1016739 - RNA, 22 nt, Human
cagcaucuaaucuucaugccgg

SEQ ID NO: 1016740 - RNA, 22 nt, Human
gcuggcagucccaucagcuggg

SEQ ID NO: 1016741 - RNA, 22 nt, Human
auuucuacaguacacaugcauu

SEQ ID NO: 1016742 - RNA, 22 nt, Human
gaguguggugaacaggagcacc

SEQ ID NO: 1016743 - RNA, 22 nt, Human
ccagcuggcaggagagucaggg

SEQ ID NO: 1016744 - RNA, 22 nt, Human
gcucagaaaagugaggcucagu

SEQ ID NO: 1016745 - RNA, 22 nt, Human
gaaucucaguggaagcaggaag

SEQ ID NO: 1016746 - RNA, 22 nt, Human
uugauacauuuuuaggauaaac

SEQ ID NO: 1016747 - RNA, 22 nt, Human
ccuacucugagcgccuccgcau

SEQ ID NO: 1016748 - RNA, 22 nt, Human
agccacagugcaagagagaaaa

SEQ ID NO: 1016749 - RNA, 22 nt, Human
gcuuccuaaaugcacagggcag

SEQ ID NO: 1016750 - RNA, 22 nt, Human
cagcagcuucuguugaucagaa

SEQ ID NO: 1016751 - RNA, 22 nt, Human
uuacaguaugaucaacuuuuca

SEQ ID NO: 1016752 - RNA, 22 nt, Human
gggcugcugccaaucacagccu

SEQ ID NO: 1016753 - RNA, 20 nt, Human
cuguggaauuuuaccaugcg

SEQ ID NO: 1016754 - RNA, 22 nt, Human
ccagagagaaauggauuugagu

SEQ ID NO: 1016755 - RNA, 22 nt, Human
uuccaggaagauucaacaaaag

SEQ ID NO: 1016756 - RNA, 22 nt, Human
ggaggacaggggcugcagcaca

SEQ ID NO: 1016757 - RNA, 22 nt, Human
uucaaacaguguagaauauaug

SEQ ID NO: 1016758 - RNA, 22 nt, Human
uagcagggccaggcugggaacc

SEQ ID NO: 1016759 - RNA, 22 nt, Human
augauggugagguugagcacag

SEQ ID NO: 1016760 - RNA, 19 nt, Human
gcuggcagauguggccgug

SEQ ID NO: 1016761 - RNA, 22 nt, Human
augucuuuauaaauguauaaug

SEQ ID NO: 1016762 - RNA, 22 nt, Human
cuuccucaugugcaaugcaagc

SEQ ID NO: 1016763 - RNA, 19 nt, Human
ucaguuuuagucaucaguu

SEQ ID NO: 1016764 - RNA, 22 nt, Human
agugcuuugugcucucacugca

SEQ ID NO: 1016765 - RNA, 22 nt, Human
acuccugguuuguguccuggcu

SEQ ID NO: 1016766 - RNA, 22 nt, Human
ugucccaguuuaucugggacug

SEQ ID NO: 1016767 - RNA, 22 nt, Human
gagccaggcccguacuugcugu

SEQ ID NO: 1016768 - RNA, 19 nt, Human
ccugggaggcggagguugc

SEQ ID NO: 1016769 - RNA, 22 nt, Human
ccagcuccaaguuugggcauca

SEQ ID NO: 1016770 - RNA, 22 nt, Human
ugagagugguucagcucagaag

SEQ ID NO: 1016771 - RNA, 22 nt, Human
gcucugcugagauaucugggag

SEQ ID NO: 1016772 - RNA, 22 nt, Human
aagacugugucuauggcuacuc

SEQ ID NO: 1016773 - RNA, 22 nt, Human
gcugguuaggugagggugcgcc

SEQ ID NO: 1016774 - RNA, 22 nt, Human
ugggcucucuggcaggaaggcu

SEQ ID NO: 1016775 - RNA, 22 nt, Human
auugucuuuggugcuuccagga

SEQ ID NO: 1016776 - RNA, 22 nt, Human
ggccuggcucuugcccagccug

SEQ ID NO: 1016777 - RNA, 22 nt, Human
agagcagauggccagggggccu

SEQ ID NO: 1016778 - RNA, 22 nt, Human
aagagcaucaaugacucgcagu

SEQ ID NO: 1016779 - RNA, 17 nt, Human
aggccagaugaggcaag

SEQ ID NO: 1016780 - RNA, 22 nt, Human
agauaugacuagaagcucauuu

SEQ ID NO: 1016781 - RNA, 22 nt, Human
uguacacugcaggaugcauugc

SEQ ID NO: 1016782 - RNA, 22 nt, Human
cagcuugcuaauuuugacuuca

SEQ ID NO: 1016783 - RNA, 22 nt, Human
uaaaugcaaugugcuuuaccag

SEQ ID NO: 1016784 - RNA, 22 nt, Human
agauacaugucaagagacuuau

SEQ ID NO: 1016785 - RNA, 18 nt, Human
cauuaugugguuauagaa

SEQ ID NO: 1016786 - RNA, 22 nt, Human
cugcugucauagccaucccucc

SEQ ID NO: 1016787 - RNA, 22 nt, Human
agucauauguggcauuuucuaa

SEQ ID NO: 1016788 - RNA, 19 nt, Human
caggagagcaugcacuuug

SEQ ID NO: 1016789 - RNA, 22 nt, Human
ucuguucauguugggcuuuucc

SEQ ID NO: 1016790 - RNA, 22 nt, Human
guucuucagauuccauuucagu

SEQ ID NO: 1016791 - RNA, 22 nt, Human
cagggcagccaggccccguggg

SEQ ID NO: 1016792 - RNA, 22 nt, Human
aggugagugugacugcaagaga

SEQ ID NO: 1016793 - RNA, 22 nt, Human
cuuuaagacucugcucuuggug

SEQ ID NO: 1016794 - RNA, 22 nt, Human
ucccuggcuguguucaggugcg

SEQ ID NO: 1016795 - RNA, 22 nt, Human
cccagacugcagagcgggcaga

SEQ ID NO: 1016796 - RNA, 22 nt, Human
cauuucuguacauguuuuggug

SEQ ID NO: 1016797 - RNA, 22 nt, Human
gccugcagccagggaguucucu

SEQ ID NO: 1016798 - RNA, 22 nt, Human
guucuccauucagcuuccugug

SEQ ID NO: 1016799 - RNA, 23 nt, Human
gccagccuugcucuccugcagcc

SEQ ID NO: 1016800 - RNA, 20 nt, Human
uugauucccucuaaacucgc

SEQ ID NO: 1016801 - RNA, 18 nt, Human
caggaugagugaugggga

SEQ ID NO: 1016802 - RNA, 22 nt, Human
gggcccuggauuuaagcaugga

SEQ ID NO: 1016803 - RNA, 22 nt, Human
aacauuuaugguagucauugca

SEQ ID NO: 1016804 - RNA, 22 nt, Human
caggauggucucgaucuccuga

SEQ ID NO: 1016805 - RNA, 22 nt, Human
cuuccugcaggacagccaucug

SEQ ID NO: 1016806 - RNA, 22 nt, Human
cugggcugugguguggcccaaa

SEQ ID NO: 1016807 - RNA, 22 nt, Human
ucccuggguccugcuugcucuc

SEQ ID NO: 1016808 - RNA, 19 nt, Human
agugcagggagcacccuca

SEQ ID NO: 1016809 - RNA, 22 nt, Human
uuguuacacauaauaacauuuu

SEQ ID NO: 1016810 - RNA, 22 nt, Human
aagggcucugugugccucccca

SEQ ID NO: 1016811 - RNA, 22 nt, Human
aaggcugauuagacugauagcu

SEQ ID NO: 1016812 - RNA, 22 nt, Human
ggcagcucugugucugggaagc

SEQ ID NO: 1016813 - RNA, 22 nt, Human
cgaugguucuggcugcuuguau

SEQ ID NO: 1016814 - RNA, 22 nt, Human
gagcacccuuugcacaucaguc

SEQ ID NO: 1016815 - RNA, 21 nt, Human
aggcagaaagagcccaggcug

SEQ ID NO: 1016816 - RNA, 22 nt, Human
gcuuggcauugaccauuaucau

SEQ ID NO: 1016817 - RNA, 22 nt, Human
ccagcuuuucuuaucauuauaa

SEQ ID NO: 1016818 - RNA, 22 nt, Human
ugucccaguucccaggguugcu

SEQ ID NO: 1016819 - RNA, 22 nt, Human
ccaggcagcaaauuuucugaau

SEQ ID NO: 1016820 - RNA, 22 nt, Human
agagcugugaaaaugagguuug

SEQ ID NO: 1016821 - RNA, 22 nt, Human
caaggccaguuucuccuaguca

SEQ ID NO: 1016822 - RNA, 19 nt, Human
uuugcagugguuccuuugu

SEQ ID NO: 1016823 - RNA, 22 nt, Human
cugcagaggguuugagcauccu

SEQ ID NO: 1016824 - RNA, 22 nt, Human
ugagagggcccagagcacacca

SEQ ID NO: 1016825 - RNA, 22 nt, Human
ccuguucaaugcccuggcuuca

SEQ ID NO: 1016826 - RNA, 22 nt, Human
uaauaucuggcauucaaacaug

SEQ ID NO: 1016827 - RNA, 22 nt, Human
uggcagaguuauggguauuuau

SEQ ID NO: 1016828 - RNA, 22 nt, Human
auugacaaucuacuauguucug

SEQ ID NO: 1016829 - RNA, 21 nt, Human
gcugucucuggcuccugggaa

SEQ ID NO: 1016830 - RNA, 22 nt, Human
uuauuaaugaguacaaguuauu

SEQ ID NO: 1016831 - RNA, 22 nt, Human
gccugccugaaggcuguaccag

SEQ ID NO: 1016832 - RNA, 22 nt, Human
agugcagugguuaggagccagg

SEQ ID NO: 1016833 - RNA, 22 nt, Human
auaguggugagcugcauuuaug

SEQ ID NO: 1016834 - RNA, 22 nt, Human
ugcaggccggcccuaggccuca

SEQ ID NO: 1016835 - RNA, 17 nt, Human
gagaguguauuggaugc

SEQ ID NO: 1016836 - RNA, 22 nt, Human
ccugcucagagcgucuugugug

SEQ ID NO: 1016837 - RNA, 22 nt, Human
agggcugccugacuccagagcc

SEQ ID NO: 1016838 - RNA, 22 nt, Human
auugcuguggaaauauaagaug

SEQ ID NO: 1016839 - RNA, 22 nt, Human
aaugcuguauaucuuagcuaau

SEQ ID NO: 1016840 - RNA, 22 nt, Human
gcagagcucaagguguucagcu

SEQ ID NO: 1016841 - RNA, 22 nt, Human
gauccuugcaacucugugaggu

SEQ ID NO: 1016842 - RNA, 22 nt, Human
cugcugugacagcugccguguu

SEQ ID NO: 1016843 - RNA, 22 nt, Human
ucccagacaaucauuggccacc

SEQ ID NO: 1016844 - RNA, 22 nt, Human
ccuggcucuguccucgcgcaaa

SEQ ID NO: 1016845 - RNA, 22 nt, Human
uggcuuccaaaggaaugggccu

SEQ ID NO: 1016846 - RNA, 22 nt, Human
caaagcucaugcucuuagccau

SEQ ID NO: 1016847 - RNA, 21 nt, Human
uccugcagggcagcagagugg

SEQ ID NO: 1016848 - RNA, 22 nt, Human
agugacugacaccuguaauccc

SEQ ID NO: 1016849 - RNA, 22 nt, Human
gcaguggggcgcugggaguugg

SEQ ID NO: 1016850 - RNA, 22 nt, Human
ggggcagagucuggacuguugu

SEQ ID NO: 1016851 - RNA, 22 nt, Human
ugccucagcugaggccgcucca

SEQ ID NO: 1016852 - RNA, 22 nt, Human
ucacugcaaucucugccuucca

SEQ ID NO: 1016853 - RNA, 22 nt, Human
acagugugguuugagcacuggg

SEQ ID NO: 1016854 - RNA, 22 nt, Human
ucacaacuugaagcugauuuaa

SEQ ID NO: 1016855 - RNA, 22 nt, Human
auauuucuccaaauguuuucaa

SEQ ID NO: 1016856 - RNA, 20 nt, Human
ggaccagguggggcgguggc

SEQ ID NO: 1016857 - RNA, 22 nt, Human
agcaguggaccucagugcuauu

SEQ ID NO: 1016858 - RNA, 22 nt, Human
uaauuucuagggacuaaggugc

SEQ ID NO: 1016859 - RNA, 22 nt, Human
uccucugcuccaucuuuacugu

SEQ ID NO: 1016860 - RNA, 22 nt, Human
gaaaggccagcucacagaugag

SEQ ID NO: 1016861 - RNA, 22 nt, Human
ggugacugguuuaucuggcagu

SEQ ID NO: 1016862 - RNA, 22 nt, Human
uuggcuucucuuaacccuaaag

SEQ ID NO: 1016863 - RNA, 22 nt, Human
cucugggcaaagaugccucauc

SEQ ID NO: 1016864 - RNA, 22 nt, Human
gcagaagcugggcagcgaggug

SEQ ID NO: 1016865 - RNA, 22 nt, Human
ccugccugcagaaaguaucucc

SEQ ID NO: 1016866 - RNA, 22 nt, Human
uuuuaagaugcuaguauuucag

SEQ ID NO: 1016867 - RNA, 22 nt, Human
uaacuacauuucacugcaauua

SEQ ID NO: 1016868 - RNA, 22 nt, Human
ggucucaggagacuggagagca

SEQ ID NO: 1016869 - RNA, 22 nt, Human
agaguguuuuucugucaaggac

SEQ ID NO: 1016870 - RNA, 22 nt, Human
cucuugggauuugcaggcucag

SEQ ID NO: 1016871 - RNA, 22 nt, Human
gggagggaggugaugcuuggcu

SEQ ID NO: 1016872 - RNA, 22 nt, Human
ugaaacuucuaauaugaauagu

SEQ ID NO: 1016873 - RNA, 22 nt, Human
auguagcagaagauguuuuccu

SEQ ID NO: 1016874 - RNA, 21 nt, Human
aacauuucugggagaacucac

SEQ ID NO: 1016875 - RNA, 22 nt, Human
ugccuugcgggcguuucuguug

SEQ ID NO: 1016876 - RNA, 22 nt, Human
cuuccucacggugcaacaggaa

SEQ ID NO: 1016877 - RNA, 22 nt, Human
gaguccaguuguucacagaggc

SEQ ID NO: 1016878 - RNA, 22 nt, Human
aaacugcuuuccacaguggcua

SEQ ID NO: 1016879 - RNA, 22 nt, Human
cagagcuguugcggggcuuggc

SEQ ID NO: 1016880 - RNA, 22 nt, Human
ggggggugcugaucaguggagc

SEQ ID NO: 1016881 - RNA, 22 nt, Human
uugaaaguuuauggagucugca

SEQ ID NO: 1016882 - RNA, 22 nt, Human
uccauugucuuugguccuagcc

SEQ ID NO: 1016883 - RNA, 18 nt, Human
ucucuuuuccccucauug

SEQ ID NO: 1016884 - RNA, 22 nt, Human
ugucaaaaugacuuuacuacag

SEQ ID NO: 1016885 - RNA, 22 nt, Human
gcucccaccaggcagaccuacc

SEQ ID NO: 1016886 - RNA, 19 nt, Human
ugcauaaauuauauacuuu

SEQ ID NO: 1016887 - RNA, 22 nt, Human
augaaacaugagaaauggagag

SEQ ID NO: 1016888 - RNA, 20 nt, Human
aggcugggguguuuugccca

SEQ ID NO: 1016889 - RNA, 22 nt, Human
auugugcaaauauuaucuguag

SEQ ID NO: 1016890 - RNA, 21 nt, Human
ggucuuccaaauaaggagaaa

SEQ ID NO: 1016891 - RNA, 22 nt, Human
aggcgcugcgcuggggccagaa

SEQ ID NO: 1016892 - RNA, 22 nt, Human
uugaagcauuguggcuuguauu

SEQ ID NO: 1016893 - RNA, 22 nt, Human
uuagggacaaauuugcagaacc

SEQ ID NO: 1016894 - RNA, 22 nt, Human
ccacccagaccagggaucuggg

SEQ ID NO: 1016895 - RNA, 19 nt, Human
ggcugccuuuccuuaccag

SEQ ID NO: 1016896 - RNA, 20 nt, Human
ucagaugggagugagccauc

SEQ ID NO: 1016897 - RNA, 22 nt, Human
uaauuuaauuccauggauucua

SEQ ID NO: 1016898 - RNA, 22 nt, Human
uggcucagaguucaucuuuuag

SEQ ID NO: 1016899 - RNA, 19 nt, Human
ucaaagcaagcauguucug

SEQ ID NO: 1016900 - RNA, 21 nt, Human
uggagcugccacuuguccucc

SEQ ID NO: 1016901 - RNA, 22 nt, Human
caaggccugccucuggcagaaa

SEQ ID NO: 1016902 - RNA, 22 nt, Human
acagcaagccagcuugucacug

SEQ ID NO: 1016903 - RNA, 20 nt, Human
acaggggcagcacaauaaug

SEQ ID NO: 1016904 - RNA, 22 nt, Human
cacauugaaaugacccaauaau

SEQ ID NO: 1016905 - RNA, 22 nt, Human
auuuugcuggucugaauuacuu

SEQ ID NO: 1016906 - RNA, 22 nt, Human
ucuucaaguuccaaagugcagg

SEQ ID NO: 1016907 - RNA, 22 nt, Human
auuuaugacuggugaauagaac

SEQ ID NO: 1016908 - RNA, 21 nt, Human
agagccugagaucuuccagca

SEQ ID NO: 1016909 - RNA, 22 nt, Human
gagcucuguguagccugagggu

SEQ ID NO: 1016910 - RNA, 22 nt, Human
ggcugggcaggucugcacaggg

SEQ ID NO: 1016911 - RNA, 22 nt, Human
cagcauggugccagugagucca

SEQ ID NO: 1016912 - RNA, 17 nt, Human
ugaaggaaggaugaugu

SEQ ID NO: 1016913 - RNA, 22 nt, Human
cuagaauugcauucuaugaaua

SEQ ID NO: 1016914 - RNA, 22 nt, Human
ccagagcaauucucacagaacu

SEQ ID NO: 1016915 - RNA, 22 nt, Human
cagggcuagugacaccccaguc

SEQ ID NO: 1016916 - RNA, 22 nt, Human
aaggagagagcuuugcuggaac

SEQ ID NO: 1016917 - RNA, 22 nt, Human
aacacaaagaagcugcaggauc

SEQ ID NO: 1016918 - RNA, 22 nt, Human
aaucuggcauuugagaguagga

SEQ ID NO: 1016919 - RNA, 22 nt, Human
ggaccugaacauaaaacgaggc

SEQ ID NO: 1016920 - RNA, 22 nt, Human
gcugccucugcgacucugggcg

SEQ ID NO: 1016921 - RNA, 22 nt, Human
cucuugggagugcucuggagaa

SEQ ID NO: 1016922 - RNA, 22 nt, Human
ucugcaggaggcuggcugcagg

SEQ ID NO: 1016923 - RNA, 22 nt, Human
ucuuugcaggagcccuuugaac

SEQ ID NO: 1016924 - RNA, 22 nt, Human
ugguuuugcuaaaauagaaaga

SEQ ID NO: 1016925 - RNA, 21 nt, Human
gcagacugcccugcugucccc

SEQ ID NO: 1016926 - RNA, 22 nt, Human
aagacagaccacgugacagggc

SEQ ID NO: 1016927 - RNA, 22 nt, Human
uagaaauccccagucucauagu

SEQ ID NO: 1016928 - RNA, 17 nt, Human
acagagguuauacagac

SEQ ID NO: 1016929 - RNA, 22 nt, Human
ggcaccugcucaucuggacuca

SEQ ID NO: 1016930 - RNA, 22 nt, Human
uuaacacauauuuaucaauugc

SEQ ID NO: 1016931 - RNA, 22 nt, Human
aaguauauuuuuugaagcauau

SEQ ID NO: 1016932 - RNA, 22 nt, Human
agcaccaugaccuugccauuga

SEQ ID NO: 1016933 - RNA, 20 nt, Human
aggcacuggggauagguaag

SEQ ID NO: 1016934 - RNA, 22 nt, Human
cuguggaaauaaacaaugcuaa

SEQ ID NO: 1016935 - RNA, 22 nt, Human
uccuugaauggacauuacacug

SEQ ID NO: 1016936 - RNA, 22 nt, Human
uccaggcaaggauaauaaacau

SEQ ID NO: 1016937 - RNA, 22 nt, Human
gucccugggaugcccuucuggg

SEQ ID NO: 1016938 - RNA, 22 nt, Human
gcuguucacagacucugcucug

SEQ ID NO: 1016939 - RNA, 22 nt, Human
cugccagcucaaagcgcagcua

SEQ ID NO: 1016940 - RNA, 22 nt, Human
gcuucucgggccugaugucguc

SEQ ID NO: 1016941 - RNA, 21 nt, Human
aagaagcaauuuauuggaagg

SEQ ID NO: 1016942 - RNA, 22 nt, Human
guacacauuaugcuucucuaaa

SEQ ID NO: 1016943 - RNA, 22 nt, Human
gaaggucaccuccccucucugg

SEQ ID NO: 1016944 - RNA, 22 nt, Human
uucucuuugacauuauucaggu

SEQ ID NO: 1016945 - RNA, 22 nt, Human
ucucagagccuaacuaaccuaa

SEQ ID NO: 1016946 - RNA, 22 nt, Human
aaucuggcauguaagcuuagag

SEQ ID NO: 1016947 - RNA, 22 nt, Human
gaggccugggagccuguccucc

SEQ ID NO: 1016948 - RNA, 22 nt, Human
gcacagggagacagccguggcc

SEQ ID NO: 1016949 - RNA, 22 nt, Human
auaaaaguuuccaaucaugccu

SEQ ID NO: 1016950 - RNA, 22 nt, Human
ucagaaauacuaucagcuuuug

SEQ ID NO: 1016951 - RNA, 22 nt, Human
uuuacaaccucauauucugaug

SEQ ID NO: 1016952 - RNA, 22 nt, Human
auuucuguuugcuacuauaagu

SEQ ID NO: 1016953 - RNA, 22 nt, Human
ucugagaggcagaccuuccuaa

SEQ ID NO: 1016954 - RNA, 22 nt, Human
uggcaucucaaacaggcagauu

SEQ ID NO: 1016955 - RNA, 22 nt, Human
ggccucaguuucuucaacugua

SEQ ID NO: 1016956 - RNA, 22 nt, Human
auuucugauaaacguaagcugc

SEQ ID NO: 1016957 - RNA, 20 nt, Human
gagagcuggggaugaggcug

SEQ ID NO: 1016958 - RNA, 22 nt, Human
cagcugccacuugcucucggcu

SEQ ID NO: 1016959 - RNA, 22 nt, Human
uugucugucccagcuugugcau

SEQ ID NO: 1016960 - RNA, 22 nt, Human
aaauauaauuucugccucaaua

SEQ ID NO: 1016961 - RNA, 22 nt, Human
cugcauuagucaugcuuugcag

SEQ ID NO: 1016962 - RNA, 22 nt, Human
uucagagauggaaggcagaaug

SEQ ID NO: 1016963 - RNA, 22 nt, Human
guggcagcggcccaggccgucu

SEQ ID NO: 1016964 - RNA, 22 nt, Human
ccaagggcugcugaggugucca

SEQ ID NO: 1016965 - RNA, 22 nt, Human
cugggagccuggcaguugcuga

SEQ ID NO: 1016966 - RNA, 22 nt, Human
agggccugucagcgguguccug

SEQ ID NO: 1016967 - RNA, 22 nt, Human
acuguucauuuguccuguaucu

SEQ ID NO: 1016968 - RNA, 22 nt, Human
uuccuuguuuguagcucuggga

SEQ ID NO: 1016969 - RNA, 22 nt, Human
acagcaggauuuggcgauguug

SEQ ID NO: 1016970 - RNA, 22 nt, Human
ugccacagaggugaagcccacu

SEQ ID NO: 1016971 - RNA, 22 nt, Human
cucugggcaaguuucuucauga

SEQ ID NO: 1016972 - RNA, 22 nt, Human
cuucaagaagacagcagagcau

SEQ ID NO: 1016973 - RNA, 22 nt, Human
ucagggacuaggugcugccuga

SEQ ID NO: 1016974 - RNA, 22 nt, Human
cacagcugcccuacuccaugug

SEQ ID NO: 1016975 - RNA, 22 nt, Human
aaggccaugcacauccuaggca

SEQ ID NO: 1016976 - RNA, 22 nt, Human
agcccaagcuaugaggugaccu

SEQ ID NO: 1016977 - RNA, 20 nt, Human
gcagagccucacugcaaggg

SEQ ID NO: 1016978 - RNA, 22 nt, Human
aucuggcucccuuggaauccgu

SEQ ID NO: 1016979 - RNA, 22 nt, Human
cccuugggugccagccacaagu

SEQ ID NO: 1016980 - RNA, 22 nt, Human
ggauggcaggacaaggacccag

SEQ ID NO: 1016981 - RNA, 22 nt, Human
agagugaucagauaucaggugu

SEQ ID NO: 1016982 - RNA, 22 nt, Human
ucuucucccaucuccaggcagg

SEQ ID NO: 1016983 - RNA, 22 nt, Human
cacagaaucugugacuccaaga

SEQ ID NO: 1016984 - RNA, 22 nt, Human
ggcugugcgggcagccguggga

SEQ ID NO: 1016985 - RNA, 22 nt, Human
uuucaguuuccagcuuugucau

SEQ ID NO: 1016986 - RNA, 23 nt, Human
aucaaacuggugagaaugucagu

SEQ ID NO: 1016987 - RNA, 22 nt, Human
cucuggagguggagguugcagu

SEQ ID NO: 1016988 - RNA, 22 nt, Human
ccuuuuucaauauagaauugca

SEQ ID NO: 1016989 - RNA, 22 nt, Human
uugaaggacauccuauuucuag

SEQ ID NO: 1016990 - RNA, 22 nt, Human
guaacaaaguuucuaggugcug

SEQ ID NO: 1016991 - RNA, 22 nt, Human
acucaggaaauugagauaaugg

SEQ ID NO: 1016992 - RNA, 22 nt, Human
auaaacacuucuagggcacaca

SEQ ID NO: 1016993 - RNA, 22 nt, Human
gccagagcugagugagguucuu

SEQ ID NO: 1016994 - RNA, 22 nt, Human
auggggcuguucucugcccugc

SEQ ID NO: 1016995 - RNA, 21 nt, Human
cauuagggcagaagcaggaag

SEQ ID NO: 1016996 - RNA, 22 nt, Human
agcucccagcuccuuugagaga

SEQ ID NO: 1016997 - RNA, 22 nt, Human
aaggaaccauuugugugcaugg

SEQ ID NO: 1016998 - RNA, 19 nt, Human
cacaucagcagggcugugg

SEQ ID NO: 1016999 - RNA, 22 nt, Human
agagucuuccaggcagccugag

SEQ ID NO: 1017000 - RNA, 22 nt, Human
aaggcagcccuggcucagccug

SEQ ID NO: 1017001 - RNA, 22 nt, Human
ccucuggggguccucagagucu

SEQ ID NO: 1017002 - RNA, 22 nt, Human
caggcaggugcagauuccucuu

SEQ ID NO: 1017003 - RNA, 22 nt, Human
gcugaagcccacguggcuugua

SEQ ID NO: 1017004 - RNA, 22 nt, Human
uuccucagagggcgcuggggaa

SEQ ID NO: 1017005 - RNA, 22 nt, Human
cauuguuaccaucuuuuaccua

SEQ ID NO: 1017006 - RNA, 22 nt, Human
gggcuacagacaugcucuaagc

SEQ ID NO: 1017007 - RNA, 22 nt, Human
ggccugcucugcagccucuaca

SEQ ID NO: 1017008 - RNA, 22 nt, Human
aaauugcaaaaguacuuuuagg

SEQ ID NO: 1017009 - RNA, 22 nt, Human
gcugcuguugauuuaguccaau

SEQ ID NO: 1017010 - RNA, 22 nt, Human
cuggcagguccagcuggacuca

SEQ ID NO: 1017011 - RNA, 22 nt, Human
ugaagguggcauaggagagaug

SEQ ID NO: 1017012 - RNA, 22 nt, Human
uacauguaauuuucauaguaag

SEQ ID NO: 1017013 - RNA, 22 nt, Human
acaggcucucagccaguuggca

SEQ ID NO: 1017014 - RNA, 22 nt, Human
uauuucagggagaauaaauuug

SEQ ID NO: 1017015 - RNA, 22 nt, Human
gcaucuucacacaaagccagug

SEQ ID NO: 1017016 - RNA, 22 nt, Human
uacaguaucuucuggcaagcau

SEQ ID NO: 1017017 - RNA, 21 nt, Human
guccagagagccggcuccuga

SEQ ID NO: 1017018 - RNA, 22 nt, Human
caaugugucaggaaaagggcca

SEQ ID NO: 1017019 - RNA, 22 nt, Human
gcagacuggucuucagccuugg

SEQ ID NO: 1017020 - RNA, 22 nt, Human
aggcucagcugguggugaucgc

SEQ ID NO: 1017021 - RNA, 22 nt, Human
agcuuccucaccucagaggucu

SEQ ID NO: 1017022 - RNA, 22 nt, Human
ugcagccaauucauucauucuu

SEQ ID NO: 1017023 - RNA, 23 nt, Human
agagccugaaagacuucuggcac

SEQ ID NO: 1017024 - RNA, 20 nt, Human
agcugaggcaccugagguua

SEQ ID NO: 1017025 - RNA, 22 nt, Human
guccucuguguaggcugcagac

SEQ ID NO: 1017026 - RNA, 22 nt, Human
caggcugcagcagcaguggccc

SEQ ID NO: 1017027 - RNA, 22 nt, Human
aucaaaguggaaguuuacuagg

SEQ ID NO: 1017028 - RNA, 22 nt, Human
ggugaaggcacaagagggcaag

SEQ ID NO: 1017029 - RNA, 22 nt, Human
aaugaugguuaaacacuggagg

SEQ ID NO: 1017030 - RNA, 22 nt, Human
aaaagagucuuaggcagucaua

SEQ ID NO: 1017031 - RNA, 20 nt, Human
uuucacaaugaacaugucuc

SEQ ID NO: 1017032 - RNA, 22 nt, Human
ggugcuggacacguggcacucc

SEQ ID NO: 1017033 - RNA, 20 nt, Human
gccuggaggcaaugggaaga

SEQ ID NO: 1017034 - RNA, 21 nt, Human
aggggacagaguagcuccagg

SEQ ID NO: 1017035 - RNA, 22 nt, Human
gaggcagcuuggggcugugggu

SEQ ID NO: 1017036 - RNA, 22 nt, Human
uauuuaauuagugauuguagag

SEQ ID NO: 1017037 - RNA, 23 nt, Human
caugggagugagaaugccagcuc

SEQ ID NO: 1017038 - RNA, 22 nt, Human
acugugugcccugacgccaggg

SEQ ID NO: 1017039 - RNA, 22 nt, Human
guuauacauauguguuaacaaa

SEQ ID NO: 1017040 - RNA, 22 nt, Human
ucacauucucagcaucuauaca

SEQ ID NO: 1017041 - RNA, 22 nt, Human
gagacagcagggccagggccug

SEQ ID NO: 1017042 - RNA, 22 nt, Human
uugacacaguuuucucauuaag

SEQ ID NO: 1017043 - RNA, 22 nt, Human
gauuucuugaccccugucucag

SEQ ID NO: 1017044 - RNA, 22 nt, Human
gugucauggaaaauugcaaugg

SEQ ID NO: 1017045 - RNA, 22 nt, Human
caaggaaaaagcgagcucgggg

SEQ ID NO: 1017046 - RNA, 22 nt, Human
acugugggagcgcaguggcagc

SEQ ID NO: 1017047 - RNA, 22 nt, Human
aguuuucacacucaccaaaagg

SEQ ID NO: 1017048 - RNA, 22 nt, Human
agcagccacagcagaucugagu

SEQ ID NO: 1017049 - RNA, 20 nt, Human
accuugaacccgccagccau

SEQ ID NO: 1017050 - RNA, 22 nt, Human
ccaccaggacagcccugagggg

SEQ ID NO: 1017051 - RNA, 22 nt, Human
uacauuccacuagugacuggcg

SEQ ID NO: 1017052 - RNA, 22 nt, Human
gggaguggguuuggccuaggcc

SEQ ID NO: 1017053 - RNA, 22 nt, Human
uaaaauagcaugugcagugaaa

SEQ ID NO: 1017054 - RNA, 22 nt, Human
gauggcagucaaccaggugagg

SEQ ID NO: 1017055 - RNA, 22 nt, Human
ucuguccauuuuccauuuuggc

SEQ ID NO: 1017056 - RNA, 22 nt, Human
aagaggaaaugauugacuauau

SEQ ID NO: 1017057 - RNA, 22 nt, Human
gaagcuucguggcucuucaaau

SEQ ID NO: 1017058 - RNA, 23 nt, Human
uggauaaagcugugcugcauagg

SEQ ID NO: 1017059 - RNA, 22 nt, Human
guggccugccgcaccccaauau

SEQ ID NO: 1017060 - RNA, 22 nt, Human
ccagcccuugagauggaaggga

SEQ ID NO: 1017061 - RNA, 22 nt, Human
cacugagaggucucauuuccaa

SEQ ID NO: 1017062 - RNA, 22 nt, Human
uggagccaggagccugggaguc

SEQ ID NO: 1017063 - RNA, 22 nt, Human
guacuucccugggaggcaagca

SEQ ID NO: 1017064 - RNA, 22 nt, Human
ugugugucagagucuccauggu

SEQ ID NO: 1017065 - RNA, 22 nt, Human
gcuggcucagggacuagaguuu

SEQ ID NO: 1017066 - RNA, 22 nt, Human
uauguacaaucagcaguucaua

SEQ ID NO: 1017067 - RNA, 22 nt, Human
ugagcuuacuucuguacacaga

SEQ ID NO: 1017068 - RNA, 20 nt, Human
gugccuggagaagaggcugu

SEQ ID NO: 1017069 - RNA, 22 nt, Human
ucaaaguuuguggcaauuuauu

SEQ ID NO: 1017070 - RNA, 22 nt, Human
agacaaagaaaccguagaagca

SEQ ID NO: 1017071 - RNA, 22 nt, Human
ggugaguugggguucacagguc

SEQ ID NO: 1017072 - RNA, 22 nt, Human
uccaggagagguguggggacug

SEQ ID NO: 1017073 - RNA, 22 nt, Human
uuguuucaggaugguuuguuac

SEQ ID NO: 1017074 - RNA, 22 nt, Human
guucaaagcuccugguacagua

SEQ ID NO: 1017075 - RNA, 22 nt, Human
uuucagauggagguuuaggaca

SEQ ID NO: 1017076 - RNA, 22 nt, Human
acucagaaccauuuacucugag

SEQ ID NO: 1017077 - RNA, 19 nt, Human
gcugugugaccuugggcaa

SEQ ID NO: 1017078 - RNA, 22 nt, Human
gcagccacagaggagggaugca

SEQ ID NO: 1017079 - RNA, 22 nt, Human
aacaaauggaacacaaaucuuu

SEQ ID NO: 1017080 - RNA, 22 nt, Human
gcugucuccauagcuguguguc

SEQ ID NO: 1017081 - RNA, 22 nt, Human
caggaacaauguaagucucauu

SEQ ID NO: 1017082 - RNA, 22 nt, Human
uucaggauccccaccgcguuua

SEQ ID NO: 1017083 - RNA, 22 nt, Human
guggaaugaauagauuugcauu

SEQ ID NO: 1017084 - RNA, 22 nt, Human
uauacuuuccugcaacuuugau

SEQ ID NO: 1017085 - RNA, 22 nt, Human
aauguaugugcaucauuuacau

SEQ ID NO: 1017086 - RNA, 22 nt, Human
ggugccaggcucccagcucagg

SEQ ID NO: 1017087 - RNA, 22 nt, Human
uagaaacugauagucuugugcu

SEQ ID NO: 1017088 - RNA, 22 nt, Human
cacagggcagguacucucagag

SEQ ID NO: 1017089 - RNA, 22 nt, Human
aguggcagagugcacucaggca

SEQ ID NO: 1017090 - RNA, 22 nt, Human
ggaagggccucgggcgugggac

SEQ ID NO: 1017091 - RNA, 22 nt, Human
ggagucaggagcaggcugggcu

SEQ ID NO: 1017092 - RNA, 22 nt, Human
gcacacagauuaggaaacagaa

SEQ ID NO: 1017093 - RNA, 18 nt, Human
aguggucuguuauaucau

SEQ ID NO: 1017094 - RNA, 22 nt, Human
aaaaguucccugguuagaaaag

SEQ ID NO: 1017095 - RNA, 22 nt, Human
uuuuuguagucauuagaagagg

SEQ ID NO: 1017096 - RNA, 22 nt, Human
gcacagggccuggcacauaaga

SEQ ID NO: 1017097 - RNA, 22 nt, Human
uuaaacagacaguaaaugaaac

SEQ ID NO: 1017098 - RNA, 22 nt, Human
gggcagcagcaggaggucucug

SEQ ID NO: 1017099 - RNA, 22 nt, Human
gucauauacacugcauguaauc

SEQ ID NO: 1017100 - RNA, 22 nt, Human
augaugugugcugaucaagcuu

SEQ ID NO: 1017101 - RNA, 22 nt, Human
aggcacugggggaugagcaagg

SEQ ID NO: 1017102 - RNA, 22 nt, Human
gcugccagucuaaugggaaaca

SEQ ID NO: 1017103 - RNA, 22 nt, Human
agccagagcagggaauuggaca

SEQ ID NO: 1017104 - RNA, 22 nt, Human
ucacguuuuacugagugagaua

SEQ ID NO: 1017105 - RNA, 22 nt, Human
ugugugcauucacaugcaugcc

SEQ ID NO: 1017106 - RNA, 22 nt, Human
uacuuacacagcuguagaaggu

SEQ ID NO: 1017107 - RNA, 22 nt, Human
uaucuaaauggaauauuccaga

SEQ ID NO: 1017108 - RNA, 22 nt, Human
aggggcuguggaaaccaacucu

SEQ ID NO: 1017109 - RNA, 22 nt, Human
cauuucugucacguucuuuuau

SEQ ID NO: 1017110 - RNA, 22 nt, Human
auuuagaaguuggagggcaaga

SEQ ID NO: 1017111 - RNA, 22 nt, Human
uucuuauagaagcaaccauugu

SEQ ID NO: 1017112 - RNA, 22 nt, Human
cagacccugggccacagaggag

SEQ ID NO: 1017113 - RNA, 22 nt, Human
uccaugucuucaugugucuaac

SEQ ID NO: 1017114 - RNA, 22 nt, Human
uuaaauuccagccucauaauag

SEQ ID NO: 1017115 - RNA, 22 nt, Human
agugugagcccuggaguggugc

SEQ ID NO: 1017116 - RNA, 22 nt, Human
aggacuccauguguccuggaga

SEQ ID NO: 1017117 - RNA, 22 nt, Human
gccuugcuuugcuucuggacag

SEQ ID NO: 1017118 - RNA, 22 nt, Human
cuagaaauacaggcacgugcca

SEQ ID NO: 1017119 - RNA, 22 nt, Human
gcccagcagcugguggagaagg

SEQ ID NO: 1017120 - RNA, 23 nt, Human
ugggggugcacgggccacaucuu

SEQ ID NO: 1017121 - RNA, 22 nt, Human
ucucagagcuucagaaagcacc

SEQ ID NO: 1017122 - RNA, 22 nt, Human
gucuggggaagucagggcauca

SEQ ID NO: 1017123 - RNA, 22 nt, Human
gccuggagaaaggaagguggga

SEQ ID NO: 1017124 - RNA, 22 nt, Human
aaguauuucuggccugugaaag

SEQ ID NO: 1017125 - RNA, 22 nt, Human
gagcagcucugggugacccagu

SEQ ID NO: 1017126 - RNA, 22 nt, Human
agucucugcaugccugcugugc

SEQ ID NO: 1017127 - RNA, 22 nt, Human
ggcuggaaaagacaaagcuauu

SEQ ID NO: 1017128 - RNA, 22 nt, Human
gugguuuucuccaacccagaac

SEQ ID NO: 1017129 - RNA, 22 nt, Human
ucauugcagcuucagguguuca

SEQ ID NO: 1017130 - RNA, 22 nt, Human
auaugagaguaaaugccgaucu

SEQ ID NO: 1017131 - RNA, 21 nt, Human
gcagagccugagguucuugag

SEQ ID NO: 1017132 - RNA, 22 nt, Human
uguguuccuucgucuucccuuc

SEQ ID NO: 1017133 - RNA, 22 nt, Human
cugcuguggugucaagcaucuc

SEQ ID NO: 1017134 - RNA, 22 nt, Human
ucccaggaucugagggcagaga

SEQ ID NO: 1017135 - RNA, 22 nt, Human
gggccuggggugacguaccccu

SEQ ID NO: 1017136 - RNA, 22 nt, Human
uggccuggugcucaggcaguag

SEQ ID NO: 1017137 - RNA, 22 nt, Human
caggaugugaggaggccauuug

SEQ ID NO: 1017138 - RNA, 22 nt, Human
cuguccuaugaguacucacuag

SEQ ID NO: 1017139 - RNA, 17 nt, Human
uucucugagcuguauug

SEQ ID NO: 1017140 - RNA, 22 nt, Human
acaaaugucuccucuuuuguua

SEQ ID NO: 1017141 - RNA, 22 nt, Human
gccugccuucggugcgcagcgg

SEQ ID NO: 1017142 - RNA, 22 nt, Human
uguguacaagaguguuuacugu

SEQ ID NO: 1017143 - RNA, 22 nt, Human
augauggugggagaugacccag

SEQ ID NO: 1017144 - RNA, 22 nt, Human
gaucauuuacuuguucuggacu

SEQ ID NO: 1017145 - RNA, 22 nt, Human
accagagcuuacaugcuagaaa

SEQ ID NO: 1017146 - RNA, 22 nt, Human
uuucaugugcaauuagcaauau

SEQ ID NO: 1017147 - RNA, 22 nt, Human
auccugucaucauaguacuuga

SEQ ID NO: 1017148 - RNA, 22 nt, Human
uccuuuccaugcuucuagaggc

SEQ ID NO: 1017149 - RNA, 22 nt, Human
gcacugcagguggguggagagg

SEQ ID NO: 1017150 - RNA, 22 nt, Human
ugaaacaaugugaaguugcuga

SEQ ID NO: 1017151 - RNA, 22 nt, Human
cuuagggagaaugccucugcag

SEQ ID NO: 1017152 - RNA, 18 nt, Human
uccugcagcuucuaugua

SEQ ID NO: 1017153 - RNA, 22 nt, Human
uugaaaguuaucuagauucuga

SEQ ID NO: 1017154 - RNA, 22 nt, Human
cagccagguucaaguccuuaua

SEQ ID NO: 1017155 - RNA, 22 nt, Human
uugaaggacaucuuguuucuag

SEQ ID NO: 1017156 - RNA, 22 nt, Human
ugaguucuaguggcugcagauu

SEQ ID NO: 1017157 - RNA, 23 nt, Human
cccagcagagaugaggagggguc

SEQ ID NO: 1017158 - RNA, 22 nt, Human
gccucugcaauuacauugugcc

SEQ ID NO: 1017159 - RNA, 22 nt, Human
gcagagccugugucugagcaaa

SEQ ID NO: 1017160 - RNA, 22 nt, Human
ucagcugaguucuagagcacuc

SEQ ID NO: 1017161 - RNA, 22 nt, Human
cuucucaguugcaagugucaga

SEQ ID NO: 1017162 - RNA, 22 nt, Human
gcucugcuguguuuguucagca

SEQ ID NO: 1017163 - RNA, 18 nt, Human
cagggccccagaauuauc

SEQ ID NO: 1017164 - RNA, 22 nt, Human
gaagcagcaaguauaggacagg

SEQ ID NO: 1017165 - RNA, 22 nt, Human
cacagaauaaauugguaucaga

SEQ ID NO: 1017166 - RNA, 22 nt, Human
aaggcagauauaaagacuagag

SEQ ID NO: 1017167 - RNA, 22 nt, Human
gccuuuuuuguugcucugucac

SEQ ID NO: 1017168 - RNA, 22 nt, Human
uggaggugagugugguacagca

SEQ ID NO: 1017169 - RNA, 22 nt, Human
gucccagaugucuggaacuccc

SEQ ID NO: 1017170 - RNA, 22 nt, Human
auucaagagcccauguuuccug

SEQ ID NO: 1017171 - RNA, 22 nt, Human
gagggcaggggucuugcacggu

SEQ ID NO: 1017172 - RNA, 22 nt, Human
uagcagugccaggauuuugcug

SEQ ID NO: 1017173 - RNA, 22 nt, Human
ucccagggacaccaagcuguuu

SEQ ID NO: 1017174 - RNA, 22 nt, Human
ucccuggcugggggcugccuug

SEQ ID NO: 1017175 - RNA, 22 nt, Human
ucauuguuauguuuugcugucu

SEQ ID NO: 1017176 - RNA, 22 nt, Human
ggagagcugguagcuggcucca

SEQ ID NO: 1017177 - RNA, 22 nt, Human
gccaggcaguucaaguacacca

SEQ ID NO: 1017178 - RNA, 22 nt, Human
cucaggauuuaaaggggcacuc

SEQ ID NO: 1017179 - RNA, 22 nt, Human
uaaugcacagaauugacauggg

SEQ ID NO: 1017180 - RNA, 22 nt, Human
aauuucagagguagagauucua

SEQ ID NO: 1017181 - RNA, 22 nt, Human
uacauacacaaauauacuguuu

SEQ ID NO: 1017182 - RNA, 22 nt, Human
cuggugagacgguugacaggag

SEQ ID NO: 1017183 - RNA, 22 nt, Human
uucauucaucucuaaaaugccu

SEQ ID NO: 1017184 - RNA, 22 nt, Human
ccaggcagccaagugugugugu

SEQ ID NO: 1017185 - RNA, 22 nt, Human
cugcagcuguagaggacagugg

SEQ ID NO: 1017186 - RNA, 22 nt, Human
gaaggccacaagagaaguuaag

SEQ ID NO: 1017187 - RNA, 22 nt, Human
ccagccacugggccacugccag

SEQ ID NO: 1017188 - RNA, 22 nt, Human
gccuaauaacuagcuguguaac

SEQ ID NO: 1017189 - RNA, 22 nt, Human
aucuguucuucaaaauauuaca

SEQ ID NO: 1017190 - RNA, 22 nt, Human
gagaugaauguaaacaaaggca

SEQ ID NO: 1017191 - RNA, 22 nt, Human
acagacauuuucuguauugccu

SEQ ID NO: 1017192 - RNA, 22 nt, Human
ccagcagcuuuauuggcucucc

SEQ ID NO: 1017193 - RNA, 22 nt, Human
gagagcugugguuugaccaggc

SEQ ID NO: 1017194 - RNA, 22 nt, Human
cagcuggcagaaccugcaucca

SEQ ID NO: 1017195 - RNA, 22 nt, Human
auucuucaaagagugucaaagu

SEQ ID NO: 1017196 - RNA, 22 nt, Human
acagggucauuuuaugaucugu

SEQ ID NO: 1017197 - RNA, 22 nt, Human
cugcuguguuccuccugcaucu

SEQ ID NO: 1017198 - RNA, 22 nt, Human
cagcaggcagccauuucacugu

SEQ ID NO: 1017199 - RNA, 22 nt, Human
ugagccagaguggagugugccu

SEQ ID NO: 1017200 - RNA, 22 nt, Human
uucuuucccagaagauauguuu

SEQ ID NO: 1017201 - RNA, 22 nt, Human
ucuucacaggagccugccugcc

SEQ ID NO: 1017202 - RNA, 19 nt, Human
uuagccauccacagugaaa

SEQ ID NO: 1017203 - RNA, 22 nt, Human
guugaaaguggagaaccugguu

SEQ ID NO: 1017204 - RNA, 22 nt, Human
guccugucccccaaggcugugg

SEQ ID NO: 1017205 - RNA, 22 nt, Human
aaggcacucagccuugggacag

SEQ ID NO: 1017206 - RNA, 22 nt, Human
cccaguccuaaagcagacgcca

SEQ ID NO: 1017207 - RNA, 22 nt, Human
ugaaaaggagccuuagguaggu

SEQ ID NO: 1017208 - RNA, 22 nt, Human
cucagagauauagucccugcuu

SEQ ID NO: 1017209 - RNA, 22 nt, Human
cuuuauguccuugaagaguugu

SEQ ID NO: 1017210 - RNA, 22 nt, Human
uucagcaaacacgaugcuuguu

SEQ ID NO: 1017211 - RNA, 22 nt, Human
ugaaaucuucacuaagucucuu

SEQ ID NO: 1017212 - RNA, 22 nt, Human
ucauacaucuguccuggagcuc

SEQ ID NO: 1017213 - RNA, 22 nt, Human
cuggccaacuugcuuguuggca

SEQ ID NO: 1017214 - RNA, 22 nt, Human
ggucccaguugcccaggucagg

SEQ ID NO: 1017215 - RNA, 22 nt, Human
ugaaagaacuagcaucuucaag

SEQ ID NO: 1017216 - RNA, 22 nt, Human
uggcaggguggcaacuuuuggu

SEQ ID NO: 1017217 - RNA, 22 nt, Human
ggcgugggaaguggggcuucug

SEQ ID NO: 1017218 - RNA, 22 nt, Human
aaugauuuggcaaaggaaucca

SEQ ID NO: 1017219 - RNA, 22 nt, Human
uaccuuuugcuuauuaugacac

SEQ ID NO: 1017220 - RNA, 22 nt, Human
uucaugugauaaaugugugacu

SEQ ID NO: 1017221 - RNA, 22 nt, Human
gcugagagcaguguggccuuaa

SEQ ID NO: 1017222 - RNA, 22 nt, Human
cucugugcccuacugcucagcu

SEQ ID NO: 1017223 - RNA, 22 nt, Human
ggugucccaggccagcugugug

SEQ ID NO: 1017224 - RNA, 22 nt, Human
ggcucugcagugacuugagggg

SEQ ID NO: 1017225 - RNA, 22 nt, Human
aauuucaaugcacucaugguug

SEQ ID NO: 1017226 - RNA, 20 nt, Human
aggcacuggauuucuuauau

SEQ ID NO: 1017227 - RNA, 22 nt, Human
cugcacaguuugauuucuugcu

SEQ ID NO: 1017228 - RNA, 22 nt, Human
ugccugaguuuaacccucagag

SEQ ID NO: 1017229 - RNA, 19 nt, Human
gccaggagggcucuggcug

SEQ ID NO: 1017230 - RNA, 22 nt, Human
agcugaugccauguggaacagu

SEQ ID NO: 1017231 - RNA, 22 nt, Human
uacauucagaagaauggacacg

SEQ ID NO: 1017232 - RNA, 22 nt, Human
cugucugcuagaacaucuauac

SEQ ID NO: 1017233 - RNA, 22 nt, Human
acauaucuuucccucuccugaa

SEQ ID NO: 1017234 - RNA, 22 nt, Human
aagcccagcaucccugcaccag

SEQ ID NO: 1017235 - RNA, 19 nt, Human
ccagguggaacugagguag

SEQ ID NO: 1017236 - RNA, 22 nt, Human
guaacauaguuugugcuucauc

SEQ ID NO: 1017237 - RNA, 22 nt, Human
aggagcugaaacuucucauaug

SEQ ID NO: 1017238 - RNA, 20 nt, Human
ccuguucacugcgcaguuuc

SEQ ID NO: 1017239 - RNA, 22 nt, Human
auguuuuauauuuugcagcagu

SEQ ID NO: 1017240 - RNA, 22 nt, Human
gagccucguggcggccacugcg

SEQ ID NO: 1017241 - RNA, 22 nt, Human
acuggaaaugagaugauaucag

SEQ ID NO: 1017242 - RNA, 22 nt, Human
ucuuccucuagaucugaggccc

SEQ ID NO: 1017243 - RNA, 22 nt, Human
ccagccagccuugaucugagua

SEQ ID NO: 1017244 - RNA, 20 nt, Human
gcugccagugccugaugcuu

SEQ ID NO: 1017245 - RNA, 22 nt, Human
agcagccauuuaaaaugaauug

SEQ ID NO: 1017246 - RNA, 22 nt, Human
uguuuaagcugaugagguaucg

SEQ ID NO: 1017247 - RNA, 22 nt, Human
cacccacccacugcucauuggc

SEQ ID NO: 1017248 - RNA, 23 nt, Human
agagcuuagggaauucacaugag

SEQ ID NO: 1017249 - RNA, 23 nt, Human
aaagacugcugagaauuuuagga

SEQ ID NO: 1017250 - RNA, 22 nt, Human
ugggcuccuugggagcaaguga

SEQ ID NO: 1017251 - RNA, 22 nt, Human
uaauacagaaguguauuaaaau

SEQ ID NO: 1017252 - RNA, 22 nt, Human
gucucuggguuaagcagugcau

SEQ ID NO: 1017253 - RNA, 22 nt, Human
ugcuuuauagacaaggaaguag

SEQ ID NO: 1017254 - RNA, 21 nt, Human
ugauuuccagaaaauuggccc

SEQ ID NO: 1017255 - RNA, 22 nt, Human
cagugagggaagaucucagcac

SEQ ID NO: 1017256 - RNA, 22 nt, Human
aaaaugcaugagaaugugcucg

SEQ ID NO: 1017257 - RNA, 22 nt, Human
agccaaggagugcagguggcuu

SEQ ID NO: 1017258 - RNA, 22 nt, Human
cuguacaucccgagagccagua

SEQ ID NO: 1017259 - RNA, 22 nt, Human
gaaguacaguuuuaucuagcca

SEQ ID NO: 1017260 - RNA, 22 nt, Human
aauguuaaaaccuucagugcuu

SEQ ID NO: 1017261 - RNA, 22 nt, Human
gcaguguuaggaauaaaaauga

SEQ ID NO: 1017262 - RNA, 22 nt, Human
ugcuuuggaucuauuugcugag

SEQ ID NO: 1017263 - RNA, 22 nt, Human
cccucaggagaugucagcugga

SEQ ID NO: 1017264 - RNA, 22 nt, Human
cagggcagaacauauagauagu

SEQ ID NO: 1017265 - RNA, 22 nt, Human
ggccucuggucaagacaagcau

SEQ ID NO: 1017266 - RNA, 22 nt, Human
ucaagcaucuuggucuacgauc

SEQ ID NO: 1017267 - RNA, 22 nt, Human
accacugcccauggugaaaacu

SEQ ID NO: 1017268 - RNA, 22 nt, Human
uggcucugcugaaccuagugca

SEQ ID NO: 1017269 - RNA, 22 nt, Human
cucagggccaaggaugcuguug

SEQ ID NO: 1017270 - RNA, 22 nt, Human
agccaggggauucaucagggac

SEQ ID NO: 1017271 - RNA, 22 nt, Human
gcuggugagcaaaggagaagga

SEQ ID NO: 1017272 - RNA, 22 nt, Human
uggcagggccugaaucuuauac

SEQ ID NO: 1017273 - RNA, 22 nt, Human
aaggccuggauuuagguuguga

SEQ ID NO: 1017274 - RNA, 22 nt, Human
cccagggauuauaaaggugaaa

SEQ ID NO: 1017275 - RNA, 22 nt, Human
auugagaauccauuugagauga

SEQ ID NO: 1017276 - RNA, 22 nt, Human
agagccaggugcugcuguuuga

SEQ ID NO: 1017277 - RNA, 22 nt, Human
aagccagccagugccagucuua

SEQ ID NO: 1017278 - RNA, 22 nt, Human
agcagcauucucugguaugggg

SEQ ID NO: 1017279 - RNA, 22 nt, Human
uacccaggaggaaacugaggcu

SEQ ID NO: 1017280 - RNA, 22 nt, Human
gucaggaugagggaugaggagu

SEQ ID NO: 1017281 - RNA, 22 nt, Human
aagagcugcccaaggugaacag

SEQ ID NO: 1017282 - RNA, 22 nt, Human
ccagcuuuggaguguuguugcu

SEQ ID NO: 1017283 - RNA, 22 nt, Human
uggaaagagguagaggaucugg

SEQ ID NO: 1017284 - RNA, 22 nt, Human
cuugcaggauuuugcugcugua

SEQ ID NO: 1017285 - RNA, 22 nt, Human
ccugagggcgccgagcucccag

SEQ ID NO: 1017286 - RNA, 22 nt, Human
cuggugggaggcaagguggaag

SEQ ID NO: 1017287 - RNA, 22 nt, Human
uuuauacuccacucugcaagcg

SEQ ID NO: 1017288 - RNA, 23 nt, Human
caguacuuaguguagcguuaauu

SEQ ID NO: 1017289 - RNA, 22 nt, Human
aauauuucuccuucguuauagc

SEQ ID NO: 1017290 - RNA, 22 nt, Human
aguccaguguguucuggcagca

SEQ ID NO: 1017291 - RNA, 22 nt, Human
gcuggccucgcaggcaggaugu

SEQ ID NO: 1017292 - RNA, 22 nt, Human
aaaggaagauugagcuuuucca

SEQ ID NO: 1017293 - RNA, 23 nt, Human
ugaaggccuggaggacgcguugu

SEQ ID NO: 1017294 - RNA, 22 nt, Human
cagggcucagggacugcagaaa

SEQ ID NO: 1017295 - RNA, 23 nt, Human
ggccauggagacuuagaaugggc

SEQ ID NO: 1017296 - RNA, 22 nt, Human
guguaauugaaauugagaacca

SEQ ID NO: 1017297 - RNA, 22 nt, Human
gggucuggacggcugcaggaag

SEQ ID NO: 1017298 - RNA, 22 nt, Human
uugacaauugggagauauaaag

SEQ ID NO: 1017299 - RNA, 22 nt, Human
cacacucauuagucauuucucu

SEQ ID NO: 1017300 - RNA, 22 nt, Human
aagccaggaagagagccuucac

SEQ ID NO: 1017301 - RNA, 22 nt, Human
agugcuccuauggaucaguugu

SEQ ID NO: 1017302 - RNA, 22 nt, Human
caaaugcuggcccugcuacuua

SEQ ID NO: 1017303 - RNA, 22 nt, Human
gggcagagacucagaaacagaa

SEQ ID NO: 1017304 - RNA, 22 nt, Human
uggcuuccgccgcgggccucgg

SEQ ID NO: 1017305 - RNA, 22 nt, Human
uucacagucacccuucuccaug

SEQ ID NO: 1017306 - RNA, 22 nt, Human
cauggcaggugcagauucugug

SEQ ID NO: 1017307 - RNA, 22 nt, Human
ugcagggccagacuggguugga

SEQ ID NO: 1017308 - RNA, 22 nt, Human
uccauuuucuaaguaucacuua

SEQ ID NO: 1017309 - RNA, 22 nt, Human
gcaccacaucaaugaggggagc

SEQ ID NO: 1017310 - RNA, 22 nt, Human
ccacaggggcccacgagccgcu

SEQ ID NO: 1017311 - RNA, 22 nt, Human
cuccucccugcgauugcucugc

SEQ ID NO: 1017312 - RNA, 22 nt, Human
uugcauguguaauuuuucuaaa

SEQ ID NO: 1017313 - RNA, 22 nt, Human
uggccucugugggagcugagca

SEQ ID NO: 1017314 - RNA, 22 nt, Human
ccaggcagggcucaaggaaccu

SEQ ID NO: 1017315 - RNA, 22 nt, Human
uaaacaucugucauguguuuau

SEQ ID NO: 1017316 - RNA, 22 nt, Human
gcugcaggagcuggagcugugg

SEQ ID NO: 1017317 - RNA, 22 nt, Human
gcucugagagugggugauucug

SEQ ID NO: 1017318 - RNA, 22 nt, Human
guccucagggaauguggcgggu

SEQ ID NO: 1017319 - RNA, 22 nt, Human
cccagcucucucaguucugcuu

SEQ ID NO: 1017320 - RNA, 22 nt, Human
aggccuggugugccggaugcag

SEQ ID NO: 1017321 - RNA, 22 nt, Human
agcuuuauuaacucuccaggug

SEQ ID NO: 1017322 - RNA, 22 nt, Human
gaagagcugugauucaggcuua

SEQ ID NO: 1017323 - RNA, 18 nt, Human
ugggcugccuggccucug

SEQ ID NO: 1017324 - RNA, 22 nt, Human
ugaagcaggaaacuucuuguuu

SEQ ID NO: 1017325 - RNA, 22 nt, Human
agcugccaaguuucucaguuua

SEQ ID NO: 1017326 - RNA, 22 nt, Human
aaaucagucccucuuggaauuu

SEQ ID NO: 1017327 - RNA, 22 nt, Human
cagggagcuuucccaggacccu

SEQ ID NO: 1017328 - RNA, 22 nt, Human
ucagcugcucaaauuuauguca

SEQ ID NO: 1017329 - RNA, 22 nt, Human
auugaaaggcaaaguaggaagc

SEQ ID NO: 1017330 - RNA, 22 nt, Human
ugaauaguccuuggaauaacug

SEQ ID NO: 1017331 - RNA, 22 nt, Human
ucccaggacaggccacauggaa

SEQ ID NO: 1017332 - RNA, 21 nt, Human
aagcuucccugcucuccaggg

SEQ ID NO: 1017333 - RNA, 22 nt, Human
gcugcuucucugauggagucca

SEQ ID NO: 1017334 - RNA, 22 nt, Human
gccagggcucgcggucccucgu

SEQ ID NO: 1017335 - RNA, 22 nt, Human
gugcugugugauccaugcuggc

SEQ ID NO: 1017336 - RNA, 22 nt, Human
ugcauugauagaaaaacaugga

SEQ ID NO: 1017337 - RNA, 22 nt, Human
uccuuucaccaaaaaguguugu

SEQ ID NO: 1017338 - RNA, 22 nt, Human
acagagagaauuggguuuacag

SEQ ID NO: 1017339 - RNA, 22 nt, Human
guuuuguugcugcagagcucaa

SEQ ID NO: 1017340 - RNA, 22 nt, Human
agugaaauacugucguuuuuag

SEQ ID NO: 1017341 - RNA, 22 nt, Human
auuucuucaggucagaaauaga

SEQ ID NO: 1017342 - RNA, 22 nt, Human
ggcucuggugugaagcagccuc

SEQ ID NO: 1017343 - RNA, 22 nt, Human
ggcucccacccauagggcgagu

SEQ ID NO: 1017344 - RNA, 20 nt, Human
ugucagugccugaggcacag

SEQ ID NO: 1017345 - RNA, 22 nt, Human
acugaaggguaaugugggagcc

SEQ ID NO: 1017346 - RNA, 22 nt, Human
cucacaggcaucucaucaggcu

SEQ ID NO: 1017347 - RNA, 22 nt, Human
uuacaugguuguuggaaaugcu

SEQ ID NO: 1017348 - RNA, 22 nt, Human
ugccucugugggccuuccuggc

SEQ ID NO: 1017349 - RNA, 21 nt, Human
ccuucuccacagggucuccgg

SEQ ID NO: 1017350 - RNA, 22 nt, Human
uccaggcaagggaggagcaugg

SEQ ID NO: 1017351 - RNA, 22 nt, Human
ucugucugcaccuaagcacagu

SEQ ID NO: 1017352 - RNA, 22 nt, Human
uucuucaauuauuggaaagaaa

SEQ ID NO: 1017353 - RNA, 22 nt, Human
accaggaggccuggagcacaaa

SEQ ID NO: 1017354 - RNA, 22 nt, Human
gggcugugggacccggcacuuu

SEQ ID NO: 1017355 - RNA, 21 nt, Human
uccucugcagugagguggccu

SEQ ID NO: 1017356 - RNA, 22 nt, Human
ugauucuauggaaggcauaagg

SEQ ID NO: 1017357 - RNA, 22 nt, Human
cagggccagccgcagcauccac

SEQ ID NO: 1017358 - RNA, 22 nt, Human
guccagggcuaaaucagguucc

SEQ ID NO: 1017359 - RNA, 22 nt, Human
uucaggaucauuuguuuuaucu

SEQ ID NO: 1017360 - RNA, 22 nt, Human
gggagggaaggaccuuaugaau

SEQ ID NO: 1017361 - RNA, 22 nt, Human
ugggcucuccuggaggacaaca

SEQ ID NO: 1017362 - RNA, 22 nt, Human
acacaggggaaaguggagcuga

SEQ ID NO: 1017363 - RNA, 22 nt, Human
caggcacugugcuagauccuug

SEQ ID NO: 1017364 - RNA, 22 nt, Human
cuggcucauagagcagcuccaa

SEQ ID NO: 1017365 - RNA, 22 nt, Human
ugcagggauuguuggcauccau

SEQ ID NO: 1017366 - RNA, 22 nt, Human
cgcuggggcuuuuugcuugaga

SEQ ID NO: 1017367 - RNA, 22 nt, Human
gagcugccugaacaagcagcag

SEQ ID NO: 1017368 - RNA, 22 nt, Human
auacaagacucagcacagacgg

SEQ ID NO: 1017369 - RNA, 22 nt, Human
auugacaauguauuuguaucug

SEQ ID NO: 1017370 - RNA, 22 nt, Human
aaaauacacauacuaggggaaa

SEQ ID NO: 1017371 - RNA, 22 nt, Human
augggaugcauggcuguggcca

SEQ ID NO: 1017372 - RNA, 19 nt, Human
auaaggcaggaggaaauuu

SEQ ID NO: 1017373 - RNA, 20 nt, Human
uccaugaguuagagacuaua

SEQ ID NO: 1017374 - RNA, 22 nt, Human
ccugggucacucaggcaggcgg

SEQ ID NO: 1017375 - RNA, 23 nt, Human
auacauacagucuuacugacuuu

SEQ ID NO: 1017376 - RNA, 22 nt, Human
caguguggagggagagagccug

SEQ ID NO: 1017377 - RNA, 22 nt, Human
aguaacaagugccaacguuaga

SEQ ID NO: 1017378 - RNA, 22 nt, Human
auaacuuagaguaggcaaaagu

SEQ ID NO: 1017379 - RNA, 22 nt, Human
uuuuguuguaauauaccuaucc

SEQ ID NO: 1017380 - RNA, 22 nt, Human
uggggagugaugccucggauaa

SEQ ID NO: 1017381 - RNA, 22 nt, Human
ugggagcaggaagcaggaagua

SEQ ID NO: 1017382 - RNA, 17 nt, Human
ugguggcuggagucagg

SEQ ID NO: 1017383 - RNA, 22 nt, Human
ucauuuguucaucugcucuucu

SEQ ID NO: 1017384 - RNA, 22 nt, Human
gcaagcaagcagguagagcuga

SEQ ID NO: 1017385 - RNA, 22 nt, Human
caguggcagagaacagagaccu

SEQ ID NO: 1017386 - RNA, 22 nt, Human
cccuccccacaaagcuucacac

SEQ ID NO: 1017387 - RNA, 22 nt, Human
uguauauucugccuaaaagcuu

SEQ ID NO: 1017388 - RNA, 22 nt, Human
aagcugccugggaggaagggcu

SEQ ID NO: 1017389 - RNA, 22 nt, Human
cagagccaaaccucagggcccg

SEQ ID NO: 1017390 - RNA, 22 nt, Human
gcccuuccaacccagagggcaa

SEQ ID NO: 1017391 - RNA, 22 nt, Human
ucugucacuauuggccagaaca

SEQ ID NO: 1017392 - RNA, 22 nt, Human
uccuugggaaaucacuagcacu

SEQ ID NO: 1017393 - RNA, 20 nt, Human
gcccuggagccuuguccugg

SEQ ID NO: 1017394 - RNA, 22 nt, Human
gaaaucugaacucuguauccuu

SEQ ID NO: 1017395 - RNA, 22 nt, Human
uuucauguuuauggaaaaugag

SEQ ID NO: 1017396 - RNA, 22 nt, Human
uuaguuuucccaucuuuauggu

SEQ ID NO: 1017397 - RNA, 22 nt, Human
auuucaguguugguuagcaagc

SEQ ID NO: 1017398 - RNA, 21 nt, Human
uuacaaagcaagugcuguguc

SEQ ID NO: 1017399 - RNA, 22 nt, Human
aggcucagauucacauuugguu

SEQ ID NO: 1017400 - RNA, 22 nt, Human
aauaacaggcucaucagaugcu

SEQ ID NO: 1017401 - RNA, 22 nt, Human
cagagcaggcccacugcccucc

SEQ ID NO: 1017402 - RNA, 18 nt, Human
cucaccauucugcccaau

SEQ ID NO: 1017403 - RNA, 23 nt, Human
aggcccugccugucccucuuuuu

SEQ ID NO: 1017404 - RNA, 22 nt, Human
gccugcuguuaacugcaggaau

SEQ ID NO: 1017405 - RNA, 18 nt, Human
guccugagcucugcugua

SEQ ID NO: 1017406 - RNA, 22 nt, Human
ugagccuguccugugcauguga

SEQ ID NO: 1017407 - RNA, 19 nt, Human
uucacauuggaagaaguag

SEQ ID NO: 1017408 - RNA, 22 nt, Human
acaguaaaaagccuuagaauuu

SEQ ID NO: 1017409 - RNA, 22 nt, Human
ccucugcugcuguugagcaccg

SEQ ID NO: 1017410 - RNA, 22 nt, Human
uacccaggagaaacagcagggc

SEQ ID NO: 1017411 - RNA, 22 nt, Human
uucuucaacaaggacacuguua

SEQ ID NO: 1017412 - RNA, 22 nt, Human
aucuggcuuucuuaaugacuua

SEQ ID NO: 1017413 - RNA, 22 nt, Human
uccauggguagcccugguugag

SEQ ID NO: 1017414 - RNA, 22 nt, Human
gagggcaguagccucguacccu

SEQ ID NO: 1017415 - RNA, 22 nt, Human
cuugaaagucacaugcagcccu

SEQ ID NO: 1017416 - RNA, 22 nt, Human
uggcucaguuucaguccugguu

SEQ ID NO: 1017417 - RNA, 23 nt, Human
gccuggagaaaagcugcaguuca

SEQ ID NO: 1017418 - RNA, 22 nt, Human
aguaggaggcgggagcaugaag

SEQ ID NO: 1017419 - RNA, 22 nt, Human
ggagcugcauuuagggagccuu

SEQ ID NO: 1017420 - RNA, 22 nt, Human
ggagccagcagggugacacuga

SEQ ID NO: 1017421 - RNA, 22 nt, Human
ucccagagugagccaggggcag

SEQ ID NO: 1017422 - RNA, 22 nt, Human
uccagccacucagcagggauug

SEQ ID NO: 1017423 - RNA, 18 nt, Human
cccacggugcuguagggc

SEQ ID NO: 1017424 - RNA, 19 nt, Human
guggccagggcaggggcug

SEQ ID NO: 1017425 - RNA, 22 nt, Human
cagucccaucucccagguggcu

SEQ ID NO: 1017426 - RNA, 22 nt, Human
cauugcuguuaauugucucuag

SEQ ID NO: 1017427 - RNA, 22 nt, Human
uggcuaggcuccaagagcugga

SEQ ID NO: 1017428 - RNA, 20 nt, Human
caggaggcaaggucaagguc

SEQ ID NO: 1017429 - RNA, 22 nt, Human
aggcacaguuucauccccgggc

SEQ ID NO: 1017430 - RNA, 22 nt, Human
ccugggaggcuguuuccagccu

SEQ ID NO: 1017431 - RNA, 22 nt, Human
cacauuucugugagucaauauu

SEQ ID NO: 1017432 - RNA, 22 nt, Human
uugauuucuauucagauguaga

SEQ ID NO: 1017433 - RNA, 18 nt, Human
aggagccuuugcacugga

SEQ ID NO: 1017434 - RNA, 23 nt, Human
agacagaggcugaggcuggccgc

SEQ ID NO: 1017435 - RNA, 22 nt, Human
ucacugcucagucuguacuaca

SEQ ID NO: 1017436 - RNA, 19 nt, Human
uuugaaagaguuuuauugg

SEQ ID NO: 1017437 - RNA, 22 nt, Human
cagcacuggggggauucggagc

SEQ ID NO: 1017438 - RNA, 22 nt, Human
auugaaagguuuugagcagaua

SEQ ID NO: 1017439 - RNA, 22 nt, Human
agucacaguuccuacccaguaa

SEQ ID NO: 1017440 - RNA, 22 nt, Human
aggagagucuugagucacuggu

SEQ ID NO: 1017441 - RNA, 19 nt, Human
ggcucucuuaaagcuguuu

SEQ ID NO: 1017442 - RNA, 22 nt, Human
aaaaaugucauuauggaacuga

SEQ ID NO: 1017443 - RNA, 22 nt, Human
gcucccagaaccaaggcugggg

SEQ ID NO: 1017444 - RNA, 22 nt, Human
ccucagagguuuucauucugua

SEQ ID NO: 1017445 - RNA, 22 nt, Human
guccucaggaaagcagauaaca

SEQ ID NO: 1017446 - RNA, 22 nt, Human
ggcaguggcuccucucuacucc

SEQ ID NO: 1017447 - RNA, 22 nt, Human
gcagggaggaagagaugcuucc

SEQ ID NO: 1017448 - RNA, 22 nt, Human
uaaaacuuaacuauccagauua

SEQ ID NO: 1017449 - RNA, 22 nt, Human
cuugggagacacaagaagacau

SEQ ID NO: 1017450 - RNA, 22 nt, Human
aagagcauauuaauaguggaga

SEQ ID NO: 1017451 - RNA, 22 nt, Human
ugggcagcagcaaagccagacu

SEQ ID NO: 1017452 - RNA, 22 nt, Human
uucacaggauauaugugcaggg

SEQ ID NO: 1017453 - RNA, 22 nt, Human
aggguggcaguuacuggagcaa

SEQ ID NO: 1017454 - RNA, 22 nt, Human
guaaaguucuauuugaauuuag

SEQ ID NO: 1017455 - RNA, 19 nt, Human
ugccugucaguagaucuca

SEQ ID NO: 1017456 - RNA, 22 nt, Human
uugcucuguaauaaucuggggu

SEQ ID NO: 1017457 - RNA, 22 nt, Human
ucugggagccaugccuuggagu

SEQ ID NO: 1017458 - RNA, 22 nt, Human
guuacacaggaaaacauuagca

SEQ ID NO: 1017459 - RNA, 22 nt, Human
uccaggcauagaaggcacgcac

SEQ ID NO: 1017460 - RNA, 22 nt, Human
uguaugaaaaggaauagauuga

SEQ ID NO: 1017461 - RNA, 18 nt, Human
agcuggggccucuggucc

SEQ ID NO: 1017462 - RNA, 22 nt, Human
gaaagaagcuuuagauggcuau

SEQ ID NO: 1017463 - RNA, 22 nt, Human
cucugggaccauggcaagugcg

SEQ ID NO: 1017464 - RNA, 22 nt, Human
gcagggcucaacaggacacccc

SEQ ID NO: 1017465 - RNA, 22 nt, Human
ugggagcaaaugacugggagau

SEQ ID NO: 1017466 - RNA, 20 nt, Human
ucagagucaucaaagauggu

SEQ ID NO: 1017467 - RNA, 22 nt, Human
ccuguucacugcacaguuuccg

SEQ ID NO: 1017468 - RNA, 20 nt, Human
caagcccucuuuagccugcc

SEQ ID NO: 1017469 - RNA, 19 nt, Human
ccuggcccugcugcgcggg

SEQ ID NO: 1017470 - RNA, 22 nt, Human
agcaccuugcucuuggccuucc

SEQ ID NO: 1017471 - RNA, 22 nt, Human
caucuggcuagcuaucauugug

SEQ ID NO: 1017472 - RNA, 22 nt, Human
ccagggcacuuaggcccagccc

SEQ ID NO: 1017473 - RNA, 22 nt, Human
cacauggggcgcugcauuggcc

SEQ ID NO: 1017474 - RNA, 22 nt, Human
ugggaccugcucuuggaaugag

SEQ ID NO: 1017475 - RNA, 22 nt, Human
ucaaggcuaaacuuucagagua

SEQ ID NO: 1017476 - RNA, 22 nt, Human
gagcugcuucugugugccgggu

SEQ ID NO: 1017477 - RNA, 22 nt, Human
ccaggcugagcaugauuggagc

SEQ ID NO: 1017478 - RNA, 22 nt, Human
ugaaaucugcaugcaaaguccu

SEQ ID NO: 1017479 - RNA, 22 nt, Human
ucugggugcccuuugcucuguu

SEQ ID NO: 1017480 - RNA, 22 nt, Human
aggcuccuugcucacaggcuca

SEQ ID NO: 1017481 - RNA, 22 nt, Human
uucuaucauacuugaauacauu

SEQ ID NO: 1017482 - RNA, 22 nt, Human
ucagaagcugguguccuuugaa

SEQ ID NO: 1017483 - RNA, 21 nt, Human
ccuguucacagaucuguaacu

SEQ ID NO: 1017484 - RNA, 22 nt, Human
acagggccauuaucuguucuag

SEQ ID NO: 1017485 - RNA, 22 nt, Human
aauacuauguugugacacauga

SEQ ID NO: 1017486 - RNA, 22 nt, Human
cccaggcaucccauuaaggagc

SEQ ID NO: 1017487 - RNA, 22 nt, Human
ucagccugcgucauggugacac

SEQ ID NO: 1017488 - RNA, 22 nt, Human
cccagccagccucuucccauau

SEQ ID NO: 1017489 - RNA, 22 nt, Human
uacaaagucaccagcuucuugc

SEQ ID NO: 1017490 - RNA, 19 nt, Human
cugucaggggcuggauguu

SEQ ID NO: 1017491 - RNA, 22 nt, Human
acauuaucccuggcacaacugc

SEQ ID NO: 1017492 - RNA, 22 nt, Human
gaucuucuauguaaugaagugu

SEQ ID NO: 1017493 - RNA, 22 nt, Human
aagauuucagaguuugggggaa

SEQ ID NO: 1017494 - RNA, 22 nt, Human
ugaaagcacucacuucugcucu

SEQ ID NO: 1017495 - RNA, 18 nt, Human
uuucacagauucaugacu

SEQ ID NO: 1017496 - RNA, 22 nt, Human
gcucugagccgggggccugucc

SEQ ID NO: 1017497 - RNA, 22 nt, Human
ggcuuugccuggaauuuccuug

SEQ ID NO: 1017498 - RNA, 22 nt, Human
aagaauacguaucaacaauggu

SEQ ID NO: 1017499 - RNA, 22 nt, Human
uagauaaauuagaaaguuuacu

SEQ ID NO: 1017500 - RNA, 22 nt, Human
guguaucaaagcacagacuuca

SEQ ID NO: 1017501 - RNA, 22 nt, Human
auaacagauacucucugugagg

SEQ ID NO: 1017502 - RNA, 22 nt, Human
cacaggcucuucucacuugauu

SEQ ID NO: 1017503 - RNA, 22 nt, Human
ugggggugugccagggaccucc

SEQ ID NO: 1017504 - RNA, 22 nt, Human
uuccucucucuugccagaaugu

SEQ ID NO: 1017505 - RNA, 22 nt, Human
ucuuuacaaucuaagcauaguu

SEQ ID NO: 1017506 - RNA, 18 nt, Human
gccugccuagagcuugcc

SEQ ID NO: 1017507 - RNA, 22 nt, Human
uauaacaguuuaggugguguca

SEQ ID NO: 1017508 - RNA, 22 nt, Human
uguuagaaauuauuaguaauau

SEQ ID NO: 1017509 - RNA, 22 nt, Human
aucaaaguccaucagaagguag

SEQ ID NO: 1017510 - RNA, 22 nt, Human
ucauccaguaugacuggugucu

SEQ ID NO: 1017511 - RNA, 21 nt, Human
acagugugcuucucucccucc

SEQ ID NO: 1017512 - RNA, 22 nt, Human
ggcuguggcagcuggaaguggu

SEQ ID NO: 1017513 - RNA, 22 nt, Human
guguggcuaccucagaggagca

SEQ ID NO: 1017514 - RNA, 22 nt, Human
acauuucuggaguuucucaaca

SEQ ID NO: 1017515 - RNA, 22 nt, Human
ccucacuuuccuuucuccuggg

SEQ ID NO: 1017516 - RNA, 22 nt, Human
aaguguguauuguuuaugcugc

SEQ ID NO: 1017517 - RNA, 22 nt, Human
uuugacagacauuuacuacauu

SEQ ID NO: 1017518 - RNA, 22 nt, Human
uacauggugguggcacuugacu

SEQ ID NO: 1017519 - RNA, 22 nt, Human
uuucagaaaacuuaucaucagu

SEQ ID NO: 1017520 - RNA, 22 nt, Human
acugucuguccugcucuccgug

SEQ ID NO: 1017521 - RNA, 22 nt, Human
acaaaccagcuuaagcaagaug

SEQ ID NO: 1017522 - RNA, 22 nt, Human
uguggcucucaugcacucccag

SEQ ID NO: 1017523 - RNA, 22 nt, Human
uuugaaaggugucgagaugugu

SEQ ID NO: 1017524 - RNA, 22 nt, Human
uccuucaguuaaagaucucaca

SEQ ID NO: 1017525 - RNA, 22 nt, Human
augcaucuauucccaagggcag

SEQ ID NO: 1017526 - RNA, 22 nt, Human
ugagccaggcuccaugccaccu

SEQ ID NO: 1017527 - RNA, 22 nt, Human
gcuguccucuuggacucagggc

SEQ ID NO: 1017528 - RNA, 22 nt, Human
cccagccuggugcacugugggg

SEQ ID NO: 1017529 - RNA, 22 nt, Human
uaacagaaauuuuaguuagggg

SEQ ID NO: 1017530 - RNA, 22 nt, Human
uggccucucuaccaggcagccu

SEQ ID NO: 1017531 - RNA, 23 nt, Human
uugcuuucaucaugagaugcucc

SEQ ID NO: 1017532 - RNA, 22 nt, Human
ugcuagaauaccuaccuggagg

SEQ ID NO: 1017533 - RNA, 22 nt, Human
ggggcccagcaccccuccucgc

SEQ ID NO: 1017534 - RNA, 22 nt, Human
gcagccccaggagacgcccagg

SEQ ID NO: 1017535 - RNA, 22 nt, Human
cuggccgguauuugccucuggg

SEQ ID NO: 1017536 - RNA, 22 nt, Human
gcagcuuuguaaaguaugaagc

SEQ ID NO: 1017537 - RNA, 22 nt, Human
ggcugcaggcaggguauccacu

SEQ ID NO: 1017538 - RNA, 22 nt, Human
gauuuuauauggcauacugugg

SEQ ID NO: 1017539 - RNA, 22 nt, Human
acaaaguuauucuuucagagga

SEQ ID NO: 1017540 - RNA, 22 nt, Human
uacccaggggcugagcagaggu

SEQ ID NO: 1017541 - RNA, 22 nt, Human
gggcccuggggccugauuugca

SEQ ID NO: 1017542 - RNA, 22 nt, Human
aaguucuacuguggguaaaaug

SEQ ID NO: 1017543 - RNA, 22 nt, Human
ccagggugggguccaggaacca

SEQ ID NO: 1017544 - RNA, 22 nt, Human
aacaugaaaguugcuaagugca

SEQ ID NO: 1017545 - RNA, 22 nt, Human
ucaggagcugcacugggcccac

SEQ ID NO: 1017546 - RNA, 22 nt, Human
gcaaugauauugaagugaugaa

SEQ ID NO: 1017547 - RNA, 22 nt, Human
gccucaggacuggcauacucau

SEQ ID NO: 1017548 - RNA, 22 nt, Human
uguagcucuccagccagcaagg

SEQ ID NO: 1017549 - RNA, 22 nt, Human
uuggaauucaaguuguagcuua

SEQ ID NO: 1017550 - RNA, 22 nt, Human
cagacagggaccucgcuccaga

SEQ ID NO: 1017551 - RNA, 22 nt, Human
ggagcuguugcgcaugcgcucg

SEQ ID NO: 1017552 - RNA, 22 nt, Human
cagagcagguaucuuuggugaa

SEQ ID NO: 1017553 - RNA, 22 nt, Human
gggccccaaaaugccaggcucu

SEQ ID NO: 1017554 - RNA, 22 nt, Human
uucugucaaaugccaguagaga

SEQ ID NO: 1017555 - RNA, 22 nt, Human
aggaggcccuagagcucuagag

SEQ ID NO: 1017556 - RNA, 22 nt, Human
gauaugaaguggcauugugaag

SEQ ID NO: 1017557 - RNA, 22 nt, Human
gcaggagagccagcaggcuucc

SEQ ID NO: 1017558 - RNA, 20 nt, Human
agugucuggugcagggccuc

SEQ ID NO: 1017559 - RNA, 23 nt, Human
gccucuggagccccagugcucag

SEQ ID NO: 1017560 - RNA, 22 nt, Human
augcaguaaauguucuaguuug

SEQ ID NO: 1017561 - RNA, 22 nt, Human
ggcugccugcucaggugcggcg

SEQ ID NO: 1017562 - RNA, 22 nt, Human
aggcccuggguuagggcccacu

SEQ ID NO: 1017563 - RNA, 22 nt, Human
gagugugucggucagcguggcg

SEQ ID NO: 1017564 - RNA, 21 nt, Human
ggggcagagcuaggcccugca

SEQ ID NO: 1017565 - RNA, 22 nt, Human
cugugccuuuguagcugugccu

SEQ ID NO: 1017566 - RNA, 22 nt, Human
auuguauuagcacaauacaauu

SEQ ID NO: 1017567 - RNA, 22 nt, Human
ugccucugaggaagauuguguu

SEQ ID NO: 1017568 - RNA, 22 nt, Human
uacaaguaaauuguagauacca

SEQ ID NO: 1017569 - RNA, 22 nt, Human
agaagaaaugaggccguucugc

SEQ ID NO: 1017570 - RNA, 22 nt, Human
uagccgggugugguggaacucc

SEQ ID NO: 1017571 - RNA, 22 nt, Human
aucuggcugcugugcuuaagcu

SEQ ID NO: 1017572 - RNA, 22 nt, Human
gcaggcuggaggcuguucuggg

SEQ ID NO: 1017573 - RNA, 22 nt, Human
aauuuguuaaaagugagugaca

SEQ ID NO: 1017574 - RNA, 22 nt, Human
ugagccugguugcagugucugg

SEQ ID NO: 1017575 - RNA, 22 nt, Human
aggggccuggacauggacgcgc

SEQ ID NO: 1017576 - RNA, 19 nt, Human
uugaaagauuagcuuucua

SEQ ID NO: 1017577 - RNA, 22 nt, Human
uaaaguuuggcagacaauaaca

SEQ ID NO: 1017578 - RNA, 22 nt, Human
aaguugaaugcguacgugacau

SEQ ID NO: 1017579 - RNA, 22 nt, Human
auauucacugagcauaaagcca

SEQ ID NO: 1017580 - RNA, 22 nt, Human
aaauaaguaguuuaguguugug

SEQ ID NO: 1017581 - RNA, 22 nt, Human
aacauacagugagcaguggacu

SEQ ID NO: 1017582 - RNA, 22 nt, Human
ggaggccaaggcgggcggauca

SEQ ID NO: 1017583 - RNA, 22 nt, Human
ugaugggacugccagcugcuga

SEQ ID NO: 1017584 - RNA, 22 nt, Human
aggccagguuccucaaucuuga

SEQ ID NO: 1017585 - RNA, 22 nt, Human
caugucuggguauaugcauaug

SEQ ID NO: 1017586 - RNA, 22 nt, Human
acauuuuaauaugcuuagugug

SEQ ID NO: 1017587 - RNA, 22 nt, Human
uccucacagucaacacuuugag

SEQ ID NO: 1017588 - RNA, 22 nt, Human
ccaggcagagggaauagcaagu

SEQ ID NO: 1017589 - RNA, 22 nt, Human
agaggccaucugcucugugggg

SEQ ID NO: 1017590 - RNA, 22 nt, Human
ccugguggccuucagcccacaa

SEQ ID NO: 1017591 - RNA, 22 nt, Human
acugcuuacaaaaggaaagaau

SEQ ID NO: 1017592 - RNA, 22 nt, Human
cagcugcuguuacugcuuauua

SEQ ID NO: 1017593 - RNA, 22 nt, Human
gccagcagggcccaaaugcugg

SEQ ID NO: 1017594 - RNA, 22 nt, Human
ucuggcucaggucagacaggga

SEQ ID NO: 1017595 - RNA, 22 nt, Human
acaagagacaagagguucuucu

SEQ ID NO: 1017596 - RNA, 22 nt, Human
gggggcuggaauauccaucaac

SEQ ID NO: 1017597 - RNA, 22 nt, Human
cuggagcuggcuuccuuccacu

SEQ ID NO: 1017598 - RNA, 22 nt, Human
ccuggagauuauuugguccaau

SEQ ID NO: 1017599 - RNA, 22 nt, Human
gccuggaguagcauggcaagcc

SEQ ID NO: 1017600 - RNA, 22 nt, Human
aaagacuuggcuuaugauuugc

SEQ ID NO: 1017601 - RNA, 23 nt, Human
uccaggcaugagcucuggaugga

SEQ ID NO: 1017602 - RNA, 22 nt, Human
ucaggcugagaaaaucuggacc

SEQ ID NO: 1017603 - RNA, 22 nt, Human
cuuggcagagggcugggcucag

SEQ ID NO: 1017604 - RNA, 22 nt, Human
agccuccaaaugucaggucccg

SEQ ID NO: 1017605 - RNA, 22 nt, Human
ggaggccauaguuugggaguca

SEQ ID NO: 1017606 - RNA, 22 nt, Human
gagggagugccagagggccagc

SEQ ID NO: 1017607 - RNA, 22 nt, Human
agcuuuaugggagcuuagauaa

SEQ ID NO: 1017608 - RNA, 22 nt, Human
ucagaacauuuaaaaagugguu

SEQ ID NO: 1017609 - RNA, 22 nt, Human
agcuuuauucaugauuucaggg

SEQ ID NO: 1017610 - RNA, 22 nt, Human
guggccucugugcuccugccua

SEQ ID NO: 1017611 - RNA, 22 nt, Human
uucucuagguuuuagaugaaga

SEQ ID NO: 1017612 - RNA, 22 nt, Human
acugggaguucuccaugucccu

SEQ ID NO: 1017613 - RNA, 22 nt, Human
acacauauauacauauuugugc

SEQ ID NO: 1017614 - RNA, 22 nt, Human
ugcaucuuacguuuugaaaggg

SEQ ID NO: 1017615 - RNA, 23 nt, Human
uggcccugaaucuguccuggagg

SEQ ID NO: 1017616 - RNA, 22 nt, Human
cauuuguauguuccuccuuagg

SEQ ID NO: 1017617 - RNA, 22 nt, Human
agacagcaggggagucugguuu

SEQ ID NO: 1017618 - RNA, 19 nt, Human
gugcuuuuuaagagcucag

SEQ ID NO: 1017619 - RNA, 22 nt, Human
cugggcacaggggagcagaguc

SEQ ID NO: 1017620 - RNA, 22 nt, Human
ggccucuguuuggagccaggau

SEQ ID NO: 1017621 - RNA, 22 nt, Human
uuuaaaaucagaugggaguugg

SEQ ID NO: 1017622 - RNA, 22 nt, Human
gucccagggagguucagggcuu

SEQ ID NO: 1017623 - RNA, 18 nt, Human
acagaacucaggggcacc

SEQ ID NO: 1017624 - RNA, 21 nt, Human
gccugcagaccccaccaggcu

SEQ ID NO: 1017625 - RNA, 19 nt, Human
aggcucugagcuccuggag

SEQ ID NO: 1017626 - RNA, 22 nt, Human
ugccugggggacuaaggccaaa

SEQ ID NO: 1017627 - RNA, 22 nt, Human
ucaggauguccaaaauccagcc

SEQ ID NO: 1017628 - RNA, 22 nt, Human
caggccuggguucaaaucccuu

SEQ ID NO: 1017629 - RNA, 22 nt, Human
ggauggcagucugcaugagaaa

SEQ ID NO: 1017630 - RNA, 22 nt, Human
uuuauuaugauggacaccuucg

SEQ ID NO: 1017631 - RNA, 22 nt, Human
uaggacaggugaggggcugugg

SEQ ID NO: 1017632 - RNA, 22 nt, Human
ugaaacauuugaugaucuuugg

SEQ ID NO: 1017633 - RNA, 22 nt, Human
uaguuaggguucugcagagaca

SEQ ID NO: 1017634 - RNA, 22 nt, Human
gccugccuguuggcugaggugc

SEQ ID NO: 1017635 - RNA, 22 nt, Human
acagggccucagccagggcaga

SEQ ID NO: 1017636 - RNA, 22 nt, Human
gggacuggaacuacuggugcag

SEQ ID NO: 1017637 - RNA, 22 nt, Human
agcuccuccugugccaggccag

SEQ ID NO: 1017638 - RNA, 22 nt, Human
gagacugcauuguccaaggguu

SEQ ID NO: 1017639 - RNA, 22 nt, Human
cuguccuggagggcauaggacg

SEQ ID NO: 1017640 - RNA, 22 nt, Human
agauuucccucuuguauuugca

SEQ ID NO: 1017641 - RNA, 22 nt, Human
ccagggcaggggcuggaguuca

SEQ ID NO: 1017642 - RNA, 22 nt, Human
cacugcagcaccaugcagggcu

SEQ ID NO: 1017643 - RNA, 22 nt, Human
aggcacugagaggcuguguugc

SEQ ID NO: 1017644 - RNA, 22 nt, Human
uuucaaacauaucuucauuacu

SEQ ID NO: 1017645 - RNA, 22 nt, Human
cugagggccuuggcuccugccc

SEQ ID NO: 1017646 - RNA, 22 nt, Human
cugcuguguggugaaacucagu

SEQ ID NO: 1017647 - RNA, 22 nt, Human
cauugcucaggcccagcaggaa

SEQ ID NO: 1017648 - RNA, 22 nt, Human
ugucuucaguaaaauacacuau

SEQ ID NO: 1017649 - RNA, 20 nt, Human
ucugucucugagcuagacuu

SEQ ID NO: 1017650 - RNA, 19 nt, Human
uuuuccuucuauauguuuc

SEQ ID NO: 1017651 - RNA, 19 nt, Human
cugagcagcggcagcacuu

SEQ ID NO: 1017652 - RNA, 22 nt, Human
cagggcaguuugugccuaugag

SEQ ID NO: 1017653 - RNA, 22 nt, Human
ggaggaccccagcagcucccca

SEQ ID NO: 1017654 - RNA, 22 nt, Human
gccugcagcugcuuccacacac

SEQ ID NO: 1017655 - RNA, 22 nt, Human
uguuuucagucauauagcaggu

SEQ ID NO: 1017656 - RNA, 20 nt, Human
augugucuguaaacaacucu

SEQ ID NO: 1017657 - RNA, 22 nt, Human
ggcaaggccugcagcucagugu

SEQ ID NO: 1017658 - RNA, 22 nt, Human
uauaauuuggggaaaguggugu

SEQ ID NO: 1017659 - RNA, 22 nt, Human
cacugcucgcugcagcauggcc

SEQ ID NO: 1017660 - RNA, 22 nt, Human
uaguccagccuuggguguagcc

SEQ ID NO: 1017661 - RNA, 22 nt, Human
ccugugggaggggccuggcgcg

SEQ ID NO: 1017662 - RNA, 22 nt, Human
ucugcagcuucuugccagagag

SEQ ID NO: 1017663 - RNA, 22 nt, Human
caagggcucacggucugcuggg

SEQ ID NO: 1017664 - RNA, 22 nt, Human
ugucucagaauggcucauaaua

SEQ ID NO: 1017665 - RNA, 22 nt, Human
aaaugcagauugucauucagga

SEQ ID NO: 1017666 - RNA, 22 nt, Human
cagaggugcauacaggucauua

SEQ ID NO: 1017667 - RNA, 22 nt, Human
caggccugggcuucggggcuga

SEQ ID NO: 1017668 - RNA, 22 nt, Human
uuaggaaaaucaugagagauga

SEQ ID NO: 1017669 - RNA, 22 nt, Human
cagggcagagggaaacuccuuu

SEQ ID NO: 1017670 - RNA, 22 nt, Human
cuguuuaucccuuuggucagca

SEQ ID NO: 1017671 - RNA, 22 nt, Human
acagaccaaguuuccagcaggu

SEQ ID NO: 1017672 - RNA, 22 nt, Human
ccucuggggugagugggccacu

SEQ ID NO: 1017673 - RNA, 22 nt, Human
ucagagaguuacacaaauuguu

SEQ ID NO: 1017674 - RNA, 22 nt, Human
acuugggucaaguagcucacag

SEQ ID NO: 1017675 - RNA, 22 nt, Human
ccugcccagcuucaccucaggc

SEQ ID NO: 1017676 - RNA, 22 nt, Human
aggucauuccuugucuucuugc

SEQ ID NO: 1017677 - RNA, 22 nt, Human
gcuccucuucucccacugaaug

SEQ ID NO: 1017678 - RNA, 22 nt, Human
gaugccugcauuucaggagagu

SEQ ID NO: 1017679 - RNA, 22 nt, Human
agcccuagagcuggaggucagu

SEQ ID NO: 1017680 - RNA, 22 nt, Human
uuuuuccuagugcuuucuggua

SEQ ID NO: 1017681 - RNA, 22 nt, Human
caccaucagcagcaggugucaa

SEQ ID NO: 1017682 - RNA, 22 nt, Human
uauuuauaaucugccaaagaga

SEQ ID NO: 1017683 - RNA, 22 nt, Human
uuaguaaauaaagucuacuuuc

SEQ ID NO: 1017684 - RNA, 22 nt, Human
ucuggcucauacaagccugcaa

SEQ ID NO: 1017685 - RNA, 20 nt, Human
uuucuugucggcuguugcug

SEQ ID NO: 1017686 - RNA, 22 nt, Human
ugccugucuuggaguccuggcc

SEQ ID NO: 1017687 - RNA, 22 nt, Human
uccuucagccaugggcucucca

SEQ ID NO: 1017688 - RNA, 22 nt, Human
auuugcaugcuucuauugugaa

SEQ ID NO: 1017689 - RNA, 22 nt, Human
aucuuucuccauauacaucuuu

SEQ ID NO: 1017690 - RNA, 22 nt, Human
ucagggcauguauguuucuuua

SEQ ID NO: 1017691 - RNA, 22 nt, Human
gaggggcuggcacgauggcugc

SEQ ID NO: 1017692 - RNA, 22 nt, Human
uauuccaguucaccuuuucauc

SEQ ID NO: 1017693 - RNA, 17 nt, Human
uagcugccccgaaugcu

SEQ ID NO: 1017694 - RNA, 22 nt, Human
uuagauaauguuauuguaauuu

SEQ ID NO: 1017695 - RNA, 22 nt, Human
gucccuggaauggacucugcgc

SEQ ID NO: 1017696 - RNA, 22 nt, Human
gccaggcuggaaagaacagaca

SEQ ID NO: 1017697 - RNA, 22 nt, Human
aaggacagaaacagauugcugg

SEQ ID NO: 1017698 - RNA, 22 nt, Human
ucugggaacacacgucacuuca

SEQ ID NO: 1017699 - RNA, 22 nt, Human
aggguccaucaaggacugcaca

SEQ ID NO: 1017700 - RNA, 22 nt, Human
augcauaauguauguauugacu

SEQ ID NO: 1017701 - RNA, 22 nt, Human
accagagcuggcucugagcacc

SEQ ID NO: 1017702 - RNA, 22 nt, Human
ugcuuuauguggcugauacuca

SEQ ID NO: 1017703 - RNA, 22 nt, Human
cucuccaggacuuuggcccaau

SEQ ID NO: 1017704 - RNA, 22 nt, Human
cagcuggcauaccugggcccgg

SEQ ID NO: 1017705 - RNA, 22 nt, Human
uggcagagucugggcuugggca

SEQ ID NO: 1017706 - RNA, 21 nt, Human
ggcagccucuguggaagggga

SEQ ID NO: 1017707 - RNA, 22 nt, Human
ccagccagucccgcaugaccgc

SEQ ID NO: 1017708 - RNA, 22 nt, Human
cccagcuugucugauucagccu

SEQ ID NO: 1017709 - RNA, 22 nt, Human
ccucuugccaaucagcuacaga

SEQ ID NO: 1017710 - RNA, 22 nt, Human
agccucugugacucacagguca

SEQ ID NO: 1017711 - RNA, 22 nt, Human
cucuggaaaaccacuagcagga

SEQ ID NO: 1017712 - RNA, 22 nt, Human
auuguuaugaaaauaagauguu

SEQ ID NO: 1017713 - RNA, 22 nt, Human
ucaaagcaucagucaauuuagg

SEQ ID NO: 1017714 - RNA, 22 nt, Human
aucuuugaagaggacuugaagu

SEQ ID NO: 1017715 - RNA, 22 nt, Human
guaagagcacugucuccugcug

SEQ ID NO: 1017716 - RNA, 22 nt, Human
aggagcugcagauucugccuug

SEQ ID NO: 1017717 - RNA, 22 nt, Human
cacccugggcugggccuguuaa

SEQ ID NO: 1017718 - RNA, 22 nt, Human
agcagagcgccugcucagaggg

SEQ ID NO: 1017719 - RNA, 22 nt, Human
ccugggcaacauagugagaccu

SEQ ID NO: 1017720 - RNA, 22 nt, Human
cagaauuugaaguaauauucca

SEQ ID NO: 1017721 - RNA, 22 nt, Human
agccuauuccaggaugagcuca

SEQ ID NO: 1017722 - RNA, 22 nt, Human
gacagcauggugucuguucagg

SEQ ID NO: 1017723 - RNA, 22 nt, Human
cugagcugggcucucuugaggg

SEQ ID NO: 1017724 - RNA, 22 nt, Human
uuacuuuggauggucaagaaag

SEQ ID NO: 1017725 - RNA, 22 nt, Human
uggcagcacuagguacugagcu

SEQ ID NO: 1017726 - RNA, 22 nt, Human
uccauggggcccaggaugagag

SEQ ID NO: 1017727 - RNA, 22 nt, Human
uccugcagguggaugauucucu

SEQ ID NO: 1017728 - RNA, 22 nt, Human
ugucuuuagagucacaaaacca

SEQ ID NO: 1017729 - RNA, 22 nt, Human
uuucaguuguccuguuaauagc

SEQ ID NO: 1017730 - RNA, 22 nt, Human
gcugucccgcugacuuccagcu

SEQ ID NO: 1017731 - RNA, 22 nt, Human
ugcucccagggacucuggcugg

SEQ ID NO: 1017732 - RNA, 22 nt, Human
uugacagcaaagauugugccua

SEQ ID NO: 1017733 - RNA, 22 nt, Human
aaaugcagauuuugaugcagca

SEQ ID NO: 1017734 - RNA, 22 nt, Human
cauggcagggcugugggcaggu

SEQ ID NO: 1017735 - RNA, 22 nt, Human
gagggaaagguuaauacaugau

SEQ ID NO: 1017736 - RNA, 22 nt, Human
uaacagaagagcaggcagcccu

SEQ ID NO: 1017737 - RNA, 22 nt, Human
acaggccacaguggagucucug

SEQ ID NO: 1017738 - RNA, 22 nt, Human
cuggcugggagcgagcugcuca

SEQ ID NO: 1017739 - RNA, 22 nt, Human
gcugcucuuuucagagaugaga

SEQ ID NO: 1017740 - RNA, 22 nt, Human
guauccuuugcggaaauuucua

SEQ ID NO: 1017741 - RNA, 22 nt, Human
gcuaggagauugagcucugaag

SEQ ID NO: 1017742 - RNA, 22 nt, Human
ccaggaagcggugagggcugcc

SEQ ID NO: 1017743 - RNA, 22 nt, Human
agcugguguccuccuggagcug

SEQ ID NO: 1017744 - RNA, 22 nt, Human
gugggagcuucaucaagcaguu

SEQ ID NO: 1017745 - RNA, 22 nt, Human
ugcugcuccugccuggcuccca

SEQ ID NO: 1017746 - RNA, 22 nt, Human
ucccagccugacagugcaucaa

SEQ ID NO: 1017747 - RNA, 22 nt, Human
aacucaguguguuucuuaguau

SEQ ID NO: 1017748 - RNA, 22 nt, Human
caguacuuuucuggcuuucuac

SEQ ID NO: 1017749 - RNA, 22 nt, Human
gcagcugccgugagcucacgcc

SEQ ID NO: 1017750 - RNA, 22 nt, Human
caauguguguguuuuucucaac

SEQ ID NO: 1017751 - RNA, 22 nt, Human
cuggagaggccccaagauauuu

SEQ ID NO: 1017752 - RNA, 22 nt, Human
ucugaggcuucagacuguacug

SEQ ID NO: 1017753 - RNA, 22 nt, Human
ccugcugggccugagcaaugag

SEQ ID NO: 1017754 - RNA, 22 nt, Human
acuuguguaacacagaaagaac

SEQ ID NO: 1017755 - RNA, 22 nt, Human
gggcacuguacacugugcaugg

SEQ ID NO: 1017756 - RNA, 22 nt, Human
cuuggcagauccaaaaaugaca

SEQ ID NO: 1017757 - RNA, 22 nt, Human
cccuggcaaaacacucucuuga

SEQ ID NO: 1017758 - RNA, 22 nt, Human
agcaugaaagcauaggacaguc

SEQ ID NO: 1017759 - RNA, 22 nt, Human
aggagcugagggagcgcccuug

SEQ ID NO: 1017760 - RNA, 22 nt, Human
aaaguuagacagcaucauuucu

SEQ ID NO: 1017761 - RNA, 22 nt, Human
uccagugguuugaaaggggugu

SEQ ID NO: 1017762 - RNA, 22 nt, Human
gagaggcuaugagguucugugu

SEQ ID NO: 1017763 - RNA, 23 nt, Human
gaauaguuuuagaaauuggagaa

SEQ ID NO: 1017764 - RNA, 22 nt, Human
gcaggggaguggcaggcccgga

SEQ ID NO: 1017765 - RNA, 22 nt, Human
uaguaucuauuaguaacaagag

SEQ ID NO: 1017766 - RNA, 22 nt, Human
auacuucuuugauguucacagg

SEQ ID NO: 1017767 - RNA, 22 nt, Human
aaaucugggagcagcucggcca

SEQ ID NO: 1017768 - RNA, 22 nt, Human
ccagcagacacacaggcguggg

SEQ ID NO: 1017769 - RNA, 22 nt, Human
gcugggagccccgagccagcgc

SEQ ID NO: 1017770 - RNA, 22 nt, Human
cacaggcuccggccuugcagcc

SEQ ID NO: 1017771 - RNA, 22 nt, Human
aaauuauuacaagcuaguuggc

SEQ ID NO: 1017772 - RNA, 22 nt, Human
caaaugcuacuaauaggcaagu

SEQ ID NO: 1017773 - RNA, 22 nt, Human
accacaggacccaugagucagu

SEQ ID NO: 1017774 - RNA, 19 nt, Human
auagucuuuccaauuauac

SEQ ID NO: 1017775 - RNA, 22 nt, Human
uuaucguacgcuucagaaauuu

SEQ ID NO: 1017776 - RNA, 22 nt, Human
ggaccugcucucccaguucucu

SEQ ID NO: 1017777 - RNA, 22 nt, Human
guuuuccugaaacugauggugu

SEQ ID NO: 1017778 - RNA, 22 nt, Human
uucaaacaaaacuguucccaua

SEQ ID NO: 1017779 - RNA, 22 nt, Human
gacauaauccuccucaccuacu

SEQ ID NO: 1017780 - RNA, 22 nt, Human
ugggggagauuagagcuucuua

SEQ ID NO: 1017781 - RNA, 22 nt, Human
uuuuaaucaugcuucuaugucc

SEQ ID NO: 1017782 - RNA, 22 nt, Human
aggcugccaaagcuucugucuc

SEQ ID NO: 1017783 - RNA, 23 nt, Human
cuguggcugaguccuguuggagu

SEQ ID NO: 1017784 - RNA, 22 nt, Human
uuucuucugagaucagggagaa

SEQ ID NO: 1017785 - RNA, 22 nt, Human
aucagcugaaaaacaggcagca

SEQ ID NO: 1017786 - RNA, 22 nt, Human
gaaaguuuauagguuauauaau

SEQ ID NO: 1017787 - RNA, 22 nt, Human
ucuuccucucuaauugaucaga

SEQ ID NO: 1017788 - RNA, 22 nt, Human
gucugaggaagaugcaggggga

SEQ ID NO: 1017789 - RNA, 22 nt, Human
agucucugccagcuuguccucu

SEQ ID NO: 1017790 - RNA, 22 nt, Human
cacugagcugauagaauuccag

SEQ ID NO: 1017791 - RNA, 23 nt, Human
gcugcagcuguggauguucucag

SEQ ID NO: 1017792 - RNA, 22 nt, Human
gguuggaggugggaauagcuag

SEQ ID NO: 1017793 - RNA, 22 nt, Human
ugggagcaccuugagggcagaa

SEQ ID NO: 1017794 - RNA, 22 nt, Human
gaagcagcugccagagaugucu

SEQ ID NO: 1017795 - RNA, 22 nt, Human
auaaggcagucacuggaauguu

SEQ ID NO: 1017796 - RNA, 22 nt, Human
cauuggaaugcauuugaagaga

SEQ ID NO: 1017797 - RNA, 22 nt, Human
aguugacauccauaacaggaag

SEQ ID NO: 1017798 - RNA, 22 nt, Human
cagugauggauauggagaaguc

SEQ ID NO: 1017799 - RNA, 22 nt, Human
ggagcuguaacgagccauugcu

SEQ ID NO: 1017800 - RNA, 22 nt, Human
cagggacugagauccagacugu

SEQ ID NO: 1017801 - RNA, 22 nt, Human
aaugcacacauuugguacugaa

SEQ ID NO: 1017802 - RNA, 22 nt, Human
auuauaaaccuuugaggguggg

SEQ ID NO: 1017803 - RNA, 22 nt, Human
augcugugucuagcaggaacac

SEQ ID NO: 1017804 - RNA, 22 nt, Human
cugcccugcccaggccuugggc

SEQ ID NO: 1017805 - RNA, 19 nt, Human
uggcagcauugguaccuug

SEQ ID NO: 1017806 - RNA, 22 nt, Human
gaacacaugauuauaaaugcua

SEQ ID NO: 1017807 - RNA, 22 nt, Human
uucagaaugugaccuuauuugg

SEQ ID NO: 1017808 - RNA, 22 nt, Human
cucaggaucgcuugcccuaggg

SEQ ID NO: 1017809 - RNA, 22 nt, Human
guucauuuuacuguaaauagca

SEQ ID NO: 1017810 - RNA, 22 nt, Human
acuggcucagaguuccuagaga

SEQ ID NO: 1017811 - RNA, 22 nt, Human
ccagagccugcugagccccauu

SEQ ID NO: 1017812 - RNA, 22 nt, Human
aacauaauguggccaaagucac

SEQ ID NO: 1017813 - RNA, 22 nt, Human
gcaguguuguuaaaagauuaga

SEQ ID NO: 1017814 - RNA, 22 nt, Human
uuuacauugcauuagguauuau

SEQ ID NO: 1017815 - RNA, 22 nt, Human
uauguacaucguugaauucaaa

SEQ ID NO: 1017816 - RNA, 22 nt, Human
ugcagaagcagagaguugccaa

SEQ ID NO: 1017817 - RNA, 22 nt, Human
uggcucaggccacuucuuuuau

SEQ ID NO: 1017818 - RNA, 22 nt, Human
caagaaauuucuuaagaacuaa

SEQ ID NO: 1017819 - RNA, 22 nt, Human
agcugccacagagccuggccag

SEQ ID NO: 1017820 - RNA, 22 nt, Human
agauggcaggcccugugggggu

SEQ ID NO: 1017821 - RNA, 22 nt, Human
ucucaggcuaccuugcacaagg

SEQ ID NO: 1017822 - RNA, 22 nt, Human
ggcuguggggggagccugcccg

SEQ ID NO: 1017823 - RNA, 22 nt, Human
gaagccaguacugugcucugca

SEQ ID NO: 1017824 - RNA, 22 nt, Human
aggugcuggagucugggcagga

SEQ ID NO: 1017825 - RNA, 22 nt, Human
caggagugucuccacacagcaa

SEQ ID NO: 1017826 - RNA, 23 nt, Human
ggaaagagaggaguugugcauag

SEQ ID NO: 1017827 - RNA, 22 nt, Human
uauuucagcaagaagaaugugg

SEQ ID NO: 1017828 - RNA, 22 nt, Human
aagccaagaguuaacuauuugu

SEQ ID NO: 1017829 - RNA, 22 nt, Human
cuggacuuuggcccaucugcca

SEQ ID NO: 1017830 - RNA, 22 nt, Human
ucauuucuccgaccugcugucc

SEQ ID NO: 1017831 - RNA, 22 nt, Human
aagggcagggaguuugugucua

SEQ ID NO: 1017832 - RNA, 22 nt, Human
cccaagcagggugcagaggcau

SEQ ID NO: 1017833 - RNA, 22 nt, Human
ggcugccuucccugagccccgg

SEQ ID NO: 1017834 - RNA, 22 nt, Human
aucugcuugaguuugaagucag

SEQ ID NO: 1017835 - RNA, 22 nt, Human
cugcucugaagccaggauucug

SEQ ID NO: 1017836 - RNA, 21 nt, Human
cagagguggccugaccucuga

SEQ ID NO: 1017837 - RNA, 22 nt, Human
gcauaugaucacgugugucggu

SEQ ID NO: 1017838 - RNA, 22 nt, Human
agggcugagacuaaggccagau

SEQ ID NO: 1017839 - RNA, 20 nt, Human
aguuuauuccaggagaacug

SEQ ID NO: 1017840 - RNA, 22 nt, Human
agggagcucaguuggaagcggu

SEQ ID NO: 1017841 - RNA, 22 nt, Human
ccaggagucaauaaaggaagcu

SEQ ID NO: 1017842 - RNA, 22 nt, Human
auuaaauuggaucugcauaguu

SEQ ID NO: 1017843 - RNA, 22 nt, Human
uagaaauaaaucugcagcuggg

SEQ ID NO: 1017844 - RNA, 22 nt, Human
augauucagcaauuuuauaucu

SEQ ID NO: 1017845 - RNA, 22 nt, Human
aagcagugcgcucaucuaaggg

SEQ ID NO: 1017846 - RNA, 22 nt, Human
aggcugcucugcgaagucagcu

SEQ ID NO: 1017847 - RNA, 22 nt, Human
agaaauaugcugauuagaugaa

SEQ ID NO: 1017848 - RNA, 20 nt, Human
agagccuggaaaaagacauc

SEQ ID NO: 1017849 - RNA, 22 nt, Human
agcagacaacccagaugaccca

SEQ ID NO: 1017850 - RNA, 21 nt, Human
ccagagccugcugagcccccu

SEQ ID NO: 1017851 - RNA, 22 nt, Human
ucuucaaaaaauauccaucagu

SEQ ID NO: 1017852 - RNA, 22 nt, Human
guauacauagaugaugaacaag

SEQ ID NO: 1017853 - RNA, 20 nt, Human
ucauccaggacaggaguggc

SEQ ID NO: 1017854 - RNA, 22 nt, Human
cugucucuguugccuguaggug

SEQ ID NO: 1017855 - RNA, 22 nt, Human
acucagaaugacugaugcugug

SEQ ID NO: 1017856 - RNA, 22 nt, Human
augguuuguaacccaauacucc

SEQ ID NO: 1017857 - RNA, 22 nt, Human
uucauauaaauggaaucagaau

SEQ ID NO: 1017858 - RNA, 22 nt, Human
ucucagggcgcagugaggcagu

SEQ ID NO: 1017859 - RNA, 22 nt, Human
gggaagaguaacuagcccaugu

SEQ ID NO: 1017860 - RNA, 22 nt, Human
gagaagcaaucaguggccaccc

SEQ ID NO: 1017861 - RNA, 22 nt, Human
acagcacaaucugagucccaga

SEQ ID NO: 1017862 - RNA, 22 nt, Human
agauacaucauuuauaccuuca

SEQ ID NO: 1017863 - RNA, 22 nt, Human
gcucccugacucaguuccugag

SEQ ID NO: 1017864 - RNA, 23 nt, Human
aacaccaaggcucagagagauaa

SEQ ID NO: 1017865 - RNA, 22 nt, Human
ccucuuccacugggccccaucc

SEQ ID NO: 1017866 - RNA, 22 nt, Human
ucagcuuucucagaggccuaac

SEQ ID NO: 1017867 - RNA, 22 nt, Human
uuagggacagcucuguagguga

SEQ ID NO: 1017868 - RNA, 20 nt, Human
ugugugcacacaugacauuc

SEQ ID NO: 1017869 - RNA, 22 nt, Human
gggggcuggacuuucccacaca

SEQ ID NO: 1017870 - RNA, 22 nt, Human
uucacagacuuuccauagauug

SEQ ID NO: 1017871 - RNA, 22 nt, Human
cagggcuccaugcagggacucc

SEQ ID NO: 1017872 - RNA, 22 nt, Human
aguauuucuaguugguucuacu

SEQ ID NO: 1017873 - RNA, 22 nt, Human
uguacaugugucuguauaucuu

SEQ ID NO: 1017874 - RNA, 22 nt, Human
ccucacagggccaggccccuca

SEQ ID NO: 1017875 - RNA, 21 nt, Human
ucuuuccugcccaguugcccu

SEQ ID NO: 1017876 - RNA, 22 nt, Human
uggguagagcaggcuggggcuu

SEQ ID NO: 1017877 - RNA, 22 nt, Human
cagccugcagggcugccuguug

SEQ ID NO: 1017878 - RNA, 22 nt, Human
gcagccacugggagugcuuaua

SEQ ID NO: 1017879 - RNA, 22 nt, Human
uccuugaaaaucuugguuuaga

SEQ ID NO: 1017880 - RNA, 22 nt, Human
ugugccaugaggcucugauaug

SEQ ID NO: 1017881 - RNA, 22 nt, Human
ggcucugcuggauugaggccag

SEQ ID NO: 1017882 - RNA, 22 nt, Human
cacagcagaaaguguaggagga

SEQ ID NO: 1017883 - RNA, 22 nt, Human
ggagcugggacccugucaucug

SEQ ID NO: 1017884 - RNA, 22 nt, Human
aaaguguugauaugugacaucc

SEQ ID NO: 1017885 - RNA, 22 nt, Human
uguggccuccccacuucugggg

SEQ ID NO: 1017886 - RNA, 22 nt, Human
ggagauuuauagcacacuucag

SEQ ID NO: 1017887 - RNA, 22 nt, Human
augcacccagugucuggacuau

SEQ ID NO: 1017888 - RNA, 22 nt, Human
uaugcacaguuacaagaauauc

SEQ ID NO: 1017889 - RNA, 22 nt, Human
agcugccauccgaggugucaga

SEQ ID NO: 1017890 - RNA, 22 nt, Human
gaggcugucuguuagccuggga

SEQ ID NO: 1017891 - RNA, 22 nt, Human
ucugggcugggagcguguggac

SEQ ID NO: 1017892 - RNA, 22 nt, Human
uucuccagaccuugugacuaug

SEQ ID NO: 1017893 - RNA, 22 nt, Human
acagagccuccaggagugcugg

SEQ ID NO: 1017894 - RNA, 22 nt, Human
caggcagcugaggacuuugcua

SEQ ID NO: 1017895 - RNA, 22 nt, Human
uggaagcaucacuucuugccug

SEQ ID NO: 1017896 - RNA, 22 nt, Human
uaggccaggacagagcuuccag

SEQ ID NO: 1017897 - RNA, 22 nt, Human
acuuuuuacaggguguauacca

SEQ ID NO: 1017898 - RNA, 22 nt, Human
gggcacagcugcuacccagugc

SEQ ID NO: 1017899 - RNA, 22 nt, Human
agggcuccgggcaggcgaugga

SEQ ID NO: 1017900 - RNA, 22 nt, Human
ugagccaggcucaagugauccu

SEQ ID NO: 1017901 - RNA, 22 nt, Human
ucucuggaauuuugagagugac

SEQ ID NO: 1017902 - RNA, 22 nt, Human
uggcccugcacccagagcaguu

SEQ ID NO: 1017903 - RNA, 22 nt, Human
augauugcagcccuacagcugu

SEQ ID NO: 1017904 - RNA, 22 nt, Human
gagggcucacugagaaagcagu

SEQ ID NO: 1017905 - RNA, 22 nt, Human
auacagaaaaugaugcagaguu

SEQ ID NO: 1017906 - RNA, 22 nt, Human
gggugcugacuggggccugaaa

SEQ ID NO: 1017907 - RNA, 22 nt, Human
guggagccaggaucuccgcaca

SEQ ID NO: 1017908 - RNA, 22 nt, Human
accaugaugggaagcucagggc

SEQ ID NO: 1017909 - RNA, 20 nt, Human
ccuggcugcauucaggacgg

SEQ ID NO: 1017910 - RNA, 22 nt, Human
agagcaauggcauccagcugau

SEQ ID NO: 1017911 - RNA, 23 nt, Human
cuucucagaagucugugccagga

SEQ ID NO: 1017912 - RNA, 19 nt, Human
ccuuccuccccagggccau

SEQ ID NO: 1017913 - RNA, 22 nt, Human
ucuggagaacuugcaagaggau

SEQ ID NO: 1017914 - RNA, 22 nt, Human
cauuugaaugagauugcuguaa

SEQ ID NO: 1017915 - RNA, 22 nt, Human
gcugccugcucggcuccuggga

SEQ ID NO: 1017916 - RNA, 22 nt, Human
gcucuggagauggagccuugag

SEQ ID NO: 1017917 - RNA, 22 nt, Human
gaaaugcagauucugauucugu

SEQ ID NO: 1017918 - RNA, 22 nt, Human
uaugacauuauaaaggauuauu

SEQ ID NO: 1017919 - RNA, 22 nt, Human
cccaggagguggagcuugcagu

SEQ ID NO: 1017920 - RNA, 22 nt, Human
uggccugguaccacauagauuu

SEQ ID NO: 1017921 - RNA, 22 nt, Human
auuauuauuguugauguuaggg

SEQ ID NO: 1017922 - RNA, 18 nt, Human
acagacaaaauggaaaug

SEQ ID NO: 1017923 - RNA, 22 nt, Human
ugaaaugagagcacagaauaaa

SEQ ID NO: 1017924 - RNA, 22 nt, Human
ugaugcuucacgcugaauaugc

SEQ ID NO: 1017925 - RNA, 21 nt, Human
auuucagagcacacaaguaaa

SEQ ID NO: 1017926 - RNA, 21 nt, Human
gacaggggaagaagcaaggag

SEQ ID NO: 1017927 - RNA, 17 nt, Human
cccugccaccaggaagc

SEQ ID NO: 1017928 - RNA, 22 nt, Human
uguuaacaucuuggacucguga

SEQ ID NO: 1017929 - RNA, 22 nt, Human
gcagcuuucugcaaugucaucc

SEQ ID NO: 1017930 - RNA, 22 nt, Human
agaggcugggaaggguccccgg

SEQ ID NO: 1017931 - RNA, 22 nt, Human
uagaaaagauaacauucugugc

SEQ ID NO: 1017932 - RNA, 22 nt, Human
gaacaguaucaguagugccagu

SEQ ID NO: 1017933 - RNA, 22 nt, Human
ccugcccuagagaugacacaau

SEQ ID NO: 1017934 - RNA, 20 nt, Human
cccuccagcaaccaggacuu

SEQ ID NO: 1017935 - RNA, 22 nt, Human
ugggcagacauugaguuuguuc

SEQ ID NO: 1017936 - RNA, 22 nt, Human
aggcagggucuugcuauguugc

SEQ ID NO: 1017937 - RNA, 21 nt, Human
cagugagguccccagccuagg

SEQ ID NO: 1017938 - RNA, 22 nt, Human
ggcacugauuccauucaugaag

SEQ ID NO: 1017939 - RNA, 20 nt, Human
auacaaagagauugauguau

SEQ ID NO: 1017940 - RNA, 22 nt, Human
gccucugcacuguggcacacca

SEQ ID NO: 1017941 - RNA, 22 nt, Human
ucucagagcaucauuuucuuag

SEQ ID NO: 1017942 - RNA, 22 nt, Human
ugcugccagggcucugcccaca

SEQ ID NO: 1017943 - RNA, 22 nt, Human
uacauucuacuuuuucacuccc

SEQ ID NO: 1017944 - RNA, 22 nt, Human
uuagauaauguagagauaugag

SEQ ID NO: 1017945 - RNA, 22 nt, Human
guagggacaugccauuaucuca

SEQ ID NO: 1017946 - RNA, 22 nt, Human
uuucugugguggguaguucaga

SEQ ID NO: 1017947 - RNA, 22 nt, Human
cccagcaguuguuggugcacau

SEQ ID NO: 1017948 - RNA, 22 nt, Human
ugccugucagggggagugggaa

SEQ ID NO: 1017949 - RNA, 22 nt, Human
ucucagagaggggccgggccuu

SEQ ID NO: 1017950 - RNA, 22 nt, Human
agugugugcaugcauucgugca

SEQ ID NO: 1017951 - RNA, 22 nt, Human
ccacaucucgguccccucuuug

SEQ ID NO: 1017952 - RNA, 22 nt, Human
gccaguggucacugaggaagaa

SEQ ID NO: 1017953 - RNA, 22 nt, Human
cucagcagagaccagggaggaa

SEQ ID NO: 1017954 - RNA, 21 nt, Human
aguguccuugaucuugccuug

SEQ ID NO: 1017955 - RNA, 22 nt, Human
augggaguuuucucugaugcuc

SEQ ID NO: 1017956 - RNA, 22 nt, Human
gccagcucagugccaggccccu

SEQ ID NO: 1017957 - RNA, 22 nt, Human
ugagcuucuuuauuuggccaga

SEQ ID NO: 1017958 - RNA, 22 nt, Human
ucugccuugagguccucagcuc

SEQ ID NO: 1017959 - RNA, 22 nt, Human
gagcagaacaggccggguggga

SEQ ID NO: 1017960 - RNA, 19 nt, Human
ccucccacggauuccuucc

SEQ ID NO: 1017961 - RNA, 22 nt, Human
agugguaacuaaguccugcuua

SEQ ID NO: 1017962 - RNA, 22 nt, Human
gacagacauuuccugauccaau

SEQ ID NO: 1017963 - RNA, 22 nt, Human
gaaaaaugagcugaugucaggg

SEQ ID NO: 1017964 - RNA, 22 nt, Human
ugcauaaagugccauaguauua

SEQ ID NO: 1017965 - RNA, 22 nt, Human
agccugcuucccuuugugcccc

SEQ ID NO: 1017966 - RNA, 22 nt, Human
ccaaggagcaaguuuacaccug

SEQ ID NO: 1017967 - RNA, 22 nt, Human
cuguggcuuucucugccuccuu

SEQ ID NO: 1017968 - RNA, 20 nt, Human
ugcagggcugccucccagcu

SEQ ID NO: 1017969 - RNA, 23 nt, Human
acaagauagggauaaaaagauaa

SEQ ID NO: 1017970 - RNA, 22 nt, Human
gagccugaaauacaggucacug

SEQ ID NO: 1017971 - RNA, 22 nt, Human
ugggcagaucuuugguggcuag

SEQ ID NO: 1017972 - RNA, 22 nt, Human
uugcagcuucgagucuaucugu

SEQ ID NO: 1017973 - RNA, 22 nt, Human
auguccuuccauuuugaucugu

SEQ ID NO: 1017974 - RNA, 22 nt, Human
ggcucugguugaccaugauggc

SEQ ID NO: 1017975 - RNA, 21 nt, Human
agacagagugcagucuacaua

SEQ ID NO: 1017976 - RNA, 17 nt, Human
ggccuguguggcugcag

SEQ ID NO: 1017977 - RNA, 19 nt, Human
gccugagccagccaugcaa

SEQ ID NO: 1017978 - RNA, 22 nt, Human
uggcuagcccuuguggggagag

SEQ ID NO: 1017979 - RNA, 22 nt, Human
ugucugagugugccugggcauu

SEQ ID NO: 1017980 - RNA, 22 nt, Human
aagcagccuggcaugaugcuuu

SEQ ID NO: 1017981 - RNA, 22 nt, Human
auaacaugaccugugcuucaca

SEQ ID NO: 1017982 - RNA, 20 nt, Human
ucccaggcugggcuccagcu

SEQ ID NO: 1017983 - RNA, 22 nt, Human
cuggcagccaagugggauacuc

SEQ ID NO: 1017984 - RNA, 22 nt, Human
guccuggggauuauagaguguu

SEQ ID NO: 1017985 - RNA, 22 nt, Human
cacagcuugggcucugacaaua

SEQ ID NO: 1017986 - RNA, 22 nt, Human
ugaaagcuguccacuaggcugu

SEQ ID NO: 1017987 - RNA, 22 nt, Human
agcaccugucacaagcagaagg

SEQ ID NO: 1017988 - RNA, 22 nt, Human
uauuccagguauucuucaagag

SEQ ID NO: 1017989 - RNA, 22 nt, Human
uccuccuucgggacugcuugac

SEQ ID NO: 1017990 - RNA, 22 nt, Human
uucagugucaauuuuuaaauau

SEQ ID NO: 1017991 - RNA, 22 nt, Human
ugcuuaauauugugauguaaua

SEQ ID NO: 1017992 - RNA, 22 nt, Human
cagggcucaggcucugggauuc

SEQ ID NO: 1017993 - RNA, 20 nt, Human
cccucugcuacacugggagc

SEQ ID NO: 1017994 - RNA, 22 nt, Human
uuaacagauguuuauggagcau

SEQ ID NO: 1017995 - RNA, 22 nt, Human
ccacucugcugugcuccaugau

SEQ ID NO: 1017996 - RNA, 22 nt, Human
agccuccaguagcugaagagac

SEQ ID NO: 1017997 - RNA, 22 nt, Human
uuagaaaucugcugccaugcaa

SEQ ID NO: 1017998 - RNA, 18 nt, Human
uggcucagauggcuuuaa

SEQ ID NO: 1017999 - RNA, 22 nt, Human
auuucucaguguacauuauguu

SEQ ID NO: 1018000 - RNA, 20 nt, Human
gauuucaaagcagaguggcc

SEQ ID NO: 1018001 - RNA, 22 nt, Human
acauuucucccugcaugccugc

SEQ ID NO: 1018002 - RNA, 22 nt, Human
uguaugaaccuuuaauauagug

SEQ ID NO: 1018003 - RNA, 18 nt, Human
gccugcaggcacgggggu

SEQ ID NO: 1018004 - RNA, 22 nt, Human
auggggcugggauucuccucgg

SEQ ID NO: 1018005 - RNA, 22 nt, Human
gaucauuuugaugcccuuuuag

SEQ ID NO: 1018006 - RNA, 22 nt, Human
aaaucaguaaauguucauuaac

SEQ ID NO: 1018007 - RNA, 17 nt, Human
uuccccugaccaagccu

SEQ ID NO: 1018008 - RNA, 22 nt, Human
acagcagcaauagcagugacau

SEQ ID NO: 1018009 - RNA, 22 nt, Human
caguagcacucugucagugaag

SEQ ID NO: 1018010 - RNA, 22 nt, Human
aguccaggucucugagucacaa

SEQ ID NO: 1018011 - RNA, 22 nt, Human
ccagcucugcagggccuggggu

SEQ ID NO: 1018012 - RNA, 22 nt, Human
aggcacugggaauaugcugagg

SEQ ID NO: 1018013 - RNA, 22 nt, Human
ccuuucucauuuuaagcauuag

SEQ ID NO: 1018014 - RNA, 17 nt, Human
gaauuucuuggucaaaa

SEQ ID NO: 1018015 - RNA, 21 nt, Human
ccugagggugguugugaagau

SEQ ID NO: 1018016 - RNA, 22 nt, Human
cucagaguggggcucccugagg

SEQ ID NO: 1018017 - RNA, 22 nt, Human
aaggcacuagcagaauuaguga

SEQ ID NO: 1018018 - RNA, 22 nt, Human
gacagggcaagacucugucuaa

SEQ ID NO: 1018019 - RNA, 18 nt, Human
aggccugggaagcugagg

SEQ ID NO: 1018020 - RNA, 23 nt, Human
ugucauugugacuacagaaccag

SEQ ID NO: 1018021 - RNA, 17 nt, Human
cacccuggcuagucuga

SEQ ID NO: 1018022 - RNA, 22 nt, Human
ccagggugugggcgucggcacg

SEQ ID NO: 1018023 - RNA, 22 nt, Human
agaaaugaagcaggaguuauua

SEQ ID NO: 1018024 - RNA, 22 nt, Human
acugccuugaaagauuguugag

SEQ ID NO: 1018025 - RNA, 23 nt, Human
ugcugggguaguuuguggcacag

SEQ ID NO: 1018026 - RNA, 21 nt, Human
cagaggcaggcucugugugug

SEQ ID NO: 1018027 - RNA, 22 nt, Human
guccucugacucagccuuggga

SEQ ID NO: 1018028 - RNA, 22 nt, Human
caggauggucagaugcauuguc

SEQ ID NO: 1018029 - RNA, 22 nt, Human
ggagugacucacagcugggaca

SEQ ID NO: 1018030 - RNA, 22 nt, Human
gccugggagugcacagugaggu

SEQ ID NO: 1018031 - RNA, 22 nt, Human
uaaaucaguuucucuuauuggu

SEQ ID NO: 1018032 - RNA, 22 nt, Human
cucagaaucugccaaguucagg

SEQ ID NO: 1018033 - RNA, 22 nt, Human
agaguguaauaagggcaagggc

SEQ ID NO: 1018034 - RNA, 22 nt, Human
caggguccaucuuucaucacug

SEQ ID NO: 1018035 - RNA, 22 nt, Human
ggugcagaucuuucucuucagg

SEQ ID NO: 1018036 - RNA, 22 nt, Human
gagagcuguuuaucuucuucaa

SEQ ID NO: 1018037 - RNA, 23 nt, Human
gugugccaagcacugugccagga

SEQ ID NO: 1018038 - RNA, 22 nt, Human
agugauggagcuuccucugcua

SEQ ID NO: 1018039 - RNA, 22 nt, Human
auaaguaggaaaauuugaauau

SEQ ID NO: 1018040 - RNA, 21 nt, Human
gcuccuggugcugcguggcgc

SEQ ID NO: 1018041 - RNA, 22 nt, Human
aaaugcacaauaaaguaaaggc

SEQ ID NO: 1018042 - RNA, 22 nt, Human
uuggaaauggcuguaguuauga

SEQ ID NO: 1018043 - RNA, 22 nt, Human
gggcagugguuacacagcugag

SEQ ID NO: 1018044 - RNA, 22 nt, Human
ggacccugggcuugcuccuggg

SEQ ID NO: 1018045 - RNA, 22 nt, Human
gggcagcugcagggauggugac

SEQ ID NO: 1018046 - RNA, 22 nt, Human
gagcugccuacauugccaagag

SEQ ID NO: 1018047 - RNA, 22 nt, Human
uugcauugcuuggucuucaaga

SEQ ID NO: 1018048 - RNA, 22 nt, Human
ccaccagcuucagcagccgcgg

SEQ ID NO: 1018049 - RNA, 22 nt, Human
gacaggaggcagagcucaggug

SEQ ID NO: 1018050 - RNA, 23 nt, Human
uacauuguggauggaguccuggg

SEQ ID NO: 1018051 - RNA, 22 nt, Human
acaguaaaucaacagaauaucu

SEQ ID NO: 1018052 - RNA, 22 nt, Human
gcagcugggacacugaggccag

SEQ ID NO: 1018053 - RNA, 22 nt, Human
ggagugggcagcacugcccugu

SEQ ID NO: 1018054 - RNA, 22 nt, Human
agugcugucccgacaacugagg

SEQ ID NO: 1018055 - RNA, 22 nt, Human
agcagccauccuuagagaaaga

SEQ ID NO: 1018056 - RNA, 22 nt, Human
cacagggcuaaaugaaggguug

SEQ ID NO: 1018057 - RNA, 22 nt, Human
agugaguggguuacagauggga

SEQ ID NO: 1018058 - RNA, 22 nt, Human
guuuaagaggguuucauuccca

SEQ ID NO: 1018059 - RNA, 22 nt, Human
uccaggcauaagccuugagugu

SEQ ID NO: 1018060 - RNA, 22 nt, Human
uuauuccauuauuucacuuagg

SEQ ID NO: 1018061 - RNA, 22 nt, Human
ccugccagugaagcugacgggc

SEQ ID NO: 1018062 - RNA, 23 nt, Human
cuuuuaacuagaguaucagcugc

SEQ ID NO: 1018063 - RNA, 22 nt, Human
aauaacuuaagaaauuucccca

SEQ ID NO: 1018064 - RNA, 22 nt, Human
ggcuggcagaagugugcuggcu

SEQ ID NO: 1018065 - RNA, 22 nt, Human
auacuguuuugugacuuaucuu

SEQ ID NO: 1018066 - RNA, 22 nt, Human
auguuuauguugggcuauauuu

SEQ ID NO: 1018067 - RNA, 22 nt, Human
aagggaggaggauuuauuguac

SEQ ID NO: 1018068 - RNA, 22 nt, Human
gggugggagucuggcccucaaa

SEQ ID NO: 1018069 - RNA, 21 nt, Human
ucaggggcuguguuuuccauc

SEQ ID NO: 1018070 - RNA, 22 nt, Human
uacauucaacaugucacuaugu

SEQ ID NO: 1018071 - RNA, 22 nt, Human
uugagucaguaauuccauuucu

SEQ ID NO: 1018072 - RNA, 19 nt, Human
cucucacucgccacauccu

SEQ ID NO: 1018073 - RNA, 22 nt, Human
aaaugcagcagcuaauugaaaa

SEQ ID NO: 1018074 - RNA, 22 nt, Human
gggcugcuguagagaacauguu

SEQ ID NO: 1018075 - RNA, 22 nt, Human
ggcaaaaaccgcaauaacuucu

SEQ ID NO: 1018076 - RNA, 22 nt, Human
acauugcugcauucuccuuccc

SEQ ID NO: 1018077 - RNA, 22 nt, Human
uagggaccuuagaauuguaugu

SEQ ID NO: 1018078 - RNA, 18 nt, Human
gagcugccauauuuaguu

SEQ ID NO: 1018079 - RNA, 22 nt, Human
ccagagagauugcuucuaaaga

SEQ ID NO: 1018080 - RNA, 22 nt, Human
gcccucucggcauagcaggggc

SEQ ID NO: 1018081 - RNA, 22 nt, Human
uucacaguggcugugccauuug

SEQ ID NO: 1018082 - RNA, 22 nt, Human
cacccagcauuggcuaagagag

SEQ ID NO: 1018083 - RNA, 22 nt, Human
augucuaaaagauaaaguuuaa

SEQ ID NO: 1018084 - RNA, 18 nt, Human
gggcaucauucacaaagu

SEQ ID NO: 1018085 - RNA, 19 nt, Human
ggcucagggcgcugccgcc

SEQ ID NO: 1018086 - RNA, 20 nt, Human
cugagcgucuaagaggugag

SEQ ID NO: 1018087 - RNA, 22 nt, Human
guuaaauucgaugauggauaaa

SEQ ID NO: 1018088 - RNA, 22 nt, Human
ccaugagcuucaacugacacag

SEQ ID NO: 1018089 - RNA, 22 nt, Human
cagccuucugaaugaacguacu

SEQ ID NO: 1018090 - RNA, 22 nt, Human
uuagacauagaauauugucuag

SEQ ID NO: 1018091 - RNA, 22 nt, Human
aaauccuaaugacaaguuuagu

SEQ ID NO: 1018092 - RNA, 22 nt, Human
aucuucucaagcagcauccugu

SEQ ID NO: 1018093 - RNA, 22 nt, Human
ugucccagggaaggcccagcac

SEQ ID NO: 1018094 - RNA, 18 nt, Human
uggcucugcagccagaug

SEQ ID NO: 1018095 - RNA, 23 nt, Human
ccugucugugcuggguggacaca

SEQ ID NO: 1018096 - RNA, 22 nt, Human
uauauguaagcuauguaagagu

SEQ ID NO: 1018097 - RNA, 22 nt, Human
uauagaagagacaugugcauag

SEQ ID NO: 1018098 - RNA, 22 nt, Human
acagggcagagaggcaggcuug

SEQ ID NO: 1018099 - RNA, 22 nt, Human
caaauucagaaaauugguagag

SEQ ID NO: 1018100 - RNA, 22 nt, Human
ggagccaggggaccuucacaga

SEQ ID NO: 1018101 - RNA, 22 nt, Human
uuagaaaugauuucaccucuuu

SEQ ID NO: 1018102 - RNA, 22 nt, Human
ggguacuuaauauuuacggggu

SEQ ID NO: 1018103 - RNA, 22 nt, Human
agagaagacuuacagccacagu

SEQ ID NO: 1018104 - RNA, 22 nt, Human
uauuucugucagccagauaugg

SEQ ID NO: 1018105 - RNA, 22 nt, Human
aggccugagcagaggaguggac

SEQ ID NO: 1018106 - RNA, 22 nt, Human
guuuauuagaguuuucugucug

SEQ ID NO: 1018107 - RNA, 22 nt, Human
auauuagggucucuaaauucua

SEQ ID NO: 1018108 - RNA, 22 nt, Human
gcugcugguccucagagcucau

SEQ ID NO: 1018109 - RNA, 22 nt, Human
cuggcagcccaaccuagagucu

SEQ ID NO: 1018110 - RNA, 22 nt, Human
acagguggaggcuuuaggaggu

SEQ ID NO: 1018111 - RNA, 19 nt, Human
cgcaggagccgaggugacc

SEQ ID NO: 1018112 - RNA, 22 nt, Human
auguacauuuagaucauuucug

SEQ ID NO: 1018113 - RNA, 22 nt, Human
cugcugugagcacuccagccug

SEQ ID NO: 1018114 - RNA, 22 nt, Human
cagggagcuggcuggcgugagu

SEQ ID NO: 1018115 - RNA, 22 nt, Human
ggucccaggauugguugcgcag

SEQ ID NO: 1018116 - RNA, 22 nt, Human
uguuucaugauugcugucauuu

SEQ ID NO: 1018117 - RNA, 20 nt, Human
uauuucugggcaaccauuua

SEQ ID NO: 1018118 - RNA, 22 nt, Human
cagucccagacauaguaaggga

SEQ ID NO: 1018119 - RNA, 22 nt, Human
gcagcuggaagugacacucugu

SEQ ID NO: 1018120 - RNA, 22 nt, Human
accccagcccugcuucugggag

SEQ ID NO: 1018121 - RNA, 22 nt, Human
ucuugggauugcccugcaguuc

SEQ ID NO: 1018122 - RNA, 22 nt, Human
cacugccuccccaggcuccaca

SEQ ID NO: 1018123 - RNA, 22 nt, Human
cuguagcagugugcucuuuuuc

SEQ ID NO: 1018124 - RNA, 22 nt, Human
cacagggcaggccccaggccuc

SEQ ID NO: 1018125 - RNA, 22 nt, Human
gccaggcagcuagcaaccccug

SEQ ID NO: 1018126 - RNA, 22 nt, Human
ggguggggcccaggaaaucuau

SEQ ID NO: 1018127 - RNA, 22 nt, Human
guacauuggcaacucucuuaga

SEQ ID NO: 1018128 - RNA, 22 nt, Human
ucagaggaccuuacugagaacc

SEQ ID NO: 1018129 - RNA, 22 nt, Human
uguauaaacuuaagcaggaacc

SEQ ID NO: 1018130 - RNA, 22 nt, Human
agccuccaucccaugcacaaag

SEQ ID NO: 1018131 - RNA, 22 nt, Human
gccaggcagagccccgugcagc

SEQ ID NO: 1018132 - RNA, 22 nt, Human
agaaaugacacacaugagacau

SEQ ID NO: 1018133 - RNA, 22 nt, Human
cagagcaugaauaaaaguuaca

SEQ ID NO: 1018134 - RNA, 22 nt, Human
uacauucagcaaaagaaugguu

SEQ ID NO: 1018135 - RNA, 22 nt, Human
uaaguuuucuggaauaacuugg

SEQ ID NO: 1018136 - RNA, 22 nt, Human
gggcucuggaaggugcaccaug

SEQ ID NO: 1018137 - RNA, 22 nt, Human
gcagagcuucuguccuucagga

SEQ ID NO: 1018138 - RNA, 22 nt, Human
aaaugcaauuguauguacucca

SEQ ID NO: 1018139 - RNA, 22 nt, Human
ccuguggcacaugcagggauuc

SEQ ID NO: 1018140 - RNA, 22 nt, Human
gguaugaaaugauuccauguua

SEQ ID NO: 1018141 - RNA, 22 nt, Human
uggcacugcacuuuaagauuua

SEQ ID NO: 1018142 - RNA, 22 nt, Human
uguggccucaaggcugcccuca

SEQ ID NO: 1018143 - RNA, 23 nt, Human
gcccaugcuguugggcccgagca

SEQ ID NO: 1018144 - RNA, 22 nt, Human
aagcagcauaauugcuauuuua

SEQ ID NO: 1018145 - RNA, 22 nt, Human
cagagaccccgcugcccuucug

SEQ ID NO: 1018146 - RNA, 22 nt, Human
gcagcuggacccacacggcuua

SEQ ID NO: 1018147 - RNA, 22 nt, Human
ugguccugagcaccagccugac

SEQ ID NO: 1018148 - RNA, 22 nt, Human
ucuguucagaauuguaacacuc

SEQ ID NO: 1018149 - RNA, 20 nt, Human
gggcuggcgcauggggaaag

SEQ ID NO: 1018150 - RNA, 22 nt, Human
agaggcccucucucuccugaug

SEQ ID NO: 1018151 - RNA, 22 nt, Human
uggaggaugagugugggcucug

SEQ ID NO: 1018152 - RNA, 22 nt, Human
gcugugcacuaccuauacaucc

SEQ ID NO: 1018153 - RNA, 22 nt, Human
uggacucaaguccaaguucacg

SEQ ID NO: 1018154 - RNA, 22 nt, Human
acagcuuuugaaaaauuacugg

SEQ ID NO: 1018155 - RNA, 22 nt, Human
aaggccugcucagcugucugug

SEQ ID NO: 1018156 - RNA, 22 nt, Human
agggccugcaucaggagcuugg

SEQ ID NO: 1018157 - RNA, 22 nt, Human
auaauucagguuuucuggcaca

SEQ ID NO: 1018158 - RNA, 22 nt, Human
ggacaggguaaguacuagugug

SEQ ID NO: 1018159 - RNA, 22 nt, Human
guuaauaaagguauagaaucag

SEQ ID NO: 1018160 - RNA, 22 nt, Human
ggcuucagugagcugagcucac

SEQ ID NO: 1018161 - RNA, 22 nt, Human
aaggucauugguucugaauucu

SEQ ID NO: 1018162 - RNA, 22 nt, Human
gaguuguucaacgugugugaaa

SEQ ID NO: 1018163 - RNA, 17 nt, Human
uuucuccuuccaucuca

SEQ ID NO: 1018164 - RNA, 22 nt, Human
ccucaggauccgcaggugcagu

SEQ ID NO: 1018165 - RNA, 22 nt, Human
aaguaugacauuuaagacaauu

SEQ ID NO: 1018166 - RNA, 22 nt, Human
aaaguggucaccuucucauuuc

SEQ ID NO: 1018167 - RNA, 22 nt, Human
gauauuuugagaaauccuauga

SEQ ID NO: 1018168 - RNA, 22 nt, Human
ucauugucuugauaugauuguc

SEQ ID NO: 1018169 - RNA, 22 nt, Human
ccagucugugugccagccugcg

SEQ ID NO: 1018170 - RNA, 22 nt, Human
ccugcagguccccggaugcgca

SEQ ID NO: 1018171 - RNA, 20 nt, Human
aucuucuuggccagcuugcu

SEQ ID NO: 1018172 - RNA, 22 nt, Human
agcuggagaugcccagcaccgg

SEQ ID NO: 1018173 - RNA, 22 nt, Human
aggucauuccagccauuccccu

SEQ ID NO: 1018174 - RNA, 23 nt, Human
cugucuccugggcuagguggaau

SEQ ID NO: 1018175 - RNA, 22 nt, Human
auaagcauguuagaauauuuga

SEQ ID NO: 1018176 - RNA, 22 nt, Human
auuuaaaugcuuaagaggguuu

SEQ ID NO: 1018177 - RNA, 22 nt, Human
ucauucuugaucacuaguuagu

SEQ ID NO: 1018178 - RNA, 22 nt, Human
cucuucuuuaguccagaccauc

SEQ ID NO: 1018179 - RNA, 19 nt, Human
ugaagcaggcagagaagau

SEQ ID NO: 1018180 - RNA, 22 nt, Human
ucuggcuccugaguccaugcuc

SEQ ID NO: 1018181 - RNA, 22 nt, Human
gagcagggagacaacucuggug

SEQ ID NO: 1018182 - RNA, 22 nt, Human
auccugggaagcugacauugaa

SEQ ID NO: 1018183 - RNA, 22 nt, Human
ugccaaggguaugggcaagaua

SEQ ID NO: 1018184 - RNA, 22 nt, Human
ggcugagcucaggggcagcagg

SEQ ID NO: 1018185 - RNA, 21 nt, Human
uucaaagagugggcauuguca

SEQ ID NO: 1018186 - RNA, 22 nt, Human
ugaagccaucaggaagccagca

SEQ ID NO: 1018187 - RNA, 22 nt, Human
aaggccugggaggccucucuuc

SEQ ID NO: 1018188 - RNA, 22 nt, Human
uuuccuuccaaaugcccgggag

SEQ ID NO: 1018189 - RNA, 22 nt, Human
cugcugcugagagcucagccug

SEQ ID NO: 1018190 - RNA, 22 nt, Human
ggcugccugccuccaagccggg

SEQ ID NO: 1018191 - RNA, 22 nt, Human
ucugaggcuauguucaggcuaa

SEQ ID NO: 1018192 - RNA, 22 nt, Human
acagagauguggaugagggauu

SEQ ID NO: 1018193 - RNA, 22 nt, Human
cucccuggaggugagcuggcac

SEQ ID NO: 1018194 - RNA, 22 nt, Human
aaugaacaggugaaugucagau

SEQ ID NO: 1018195 - RNA, 22 nt, Human
ggcuuuauauuguuugagcaga

SEQ ID NO: 1018196 - RNA, 22 nt, Human
acugaaggcuuucccaagguca

SEQ ID NO: 1018197 - RNA, 22 nt, Human
guuuuuaucuaauagcaguuau

SEQ ID NO: 1018198 - RNA, 22 nt, Human
agagcuggggccagagucaagg

SEQ ID NO: 1018199 - RNA, 22 nt, Human
ggcucacgcaauuaucccggcc

SEQ ID NO: 1018200 - RNA, 21 nt, Human
ugcuuuaugggaaaaauguca

SEQ ID NO: 1018201 - RNA, 22 nt, Human
ccaugagcuuccuauauagggu

SEQ ID NO: 1018202 - RNA, 22 nt, Human
uggagcugaacuuugaggccag

SEQ ID NO: 1018203 - RNA, 22 nt, Human
ugcauaaacuucucugguguga

SEQ ID NO: 1018204 - RNA, 22 nt, Human
ccuccaaguuugacucaggaca

SEQ ID NO: 1018205 - RNA, 22 nt, Human
gacagaguuguugauguaugcu

SEQ ID NO: 1018206 - RNA, 22 nt, Human
agacaucauguuacagauuaag

SEQ ID NO: 1018207 - RNA, 22 nt, Human
uuacaaagagugccagagugug

SEQ ID NO: 1018208 - RNA, 22 nt, Human
agccaaagagaccccauaucca

SEQ ID NO: 1018209 - RNA, 22 nt, Human
ggcugugggccagcuagacccu

SEQ ID NO: 1018210 - RNA, 22 nt, Human
cucuuccucucaugcggucaua

SEQ ID NO: 1018211 - RNA, 20 nt, Human
cagcugccuggcucugggau

SEQ ID NO: 1018212 - RNA, 22 nt, Human
aggcuuccgaguagcugggacu

SEQ ID NO: 1018213 - RNA, 22 nt, Human
uuacaaagcguugagacaagua

SEQ ID NO: 1018214 - RNA, 22 nt, Human
gggagggaggugcugguucacg

SEQ ID NO: 1018215 - RNA, 22 nt, Human
caggggcucugggugaugugag

SEQ ID NO: 1018216 - RNA, 22 nt, Human
ucacuguaucauguugcacuua

SEQ ID NO: 1018217 - RNA, 22 nt, Human
uuuauguacauauccacaagga

SEQ ID NO: 1018218 - RNA, 22 nt, Human
aggggcugacuggaaagugcca

SEQ ID NO: 1018219 - RNA, 22 nt, Human
gccagugguagaggggaggccg

SEQ ID NO: 1018220 - RNA, 22 nt, Human
uguccugggaaugggaugcagu

SEQ ID NO: 1018221 - RNA, 22 nt, Human
aggaaaaagaguugcugccuuc

SEQ ID NO: 1018222 - RNA, 22 nt, Human
ggccuucacgugaccuggcgug

SEQ ID NO: 1018223 - RNA, 22 nt, Human
ucauguuauugacucauaauau

SEQ ID NO: 1018224 - RNA, 22 nt, Human
gauguguuuccaggauuuguuu

SEQ ID NO: 1018225 - RNA, 17 nt, Human
cugucugcgcaugaggu

SEQ ID NO: 1018226 - RNA, 22 nt, Human
ccaggccagagugcaguggcac

SEQ ID NO: 1018227 - RNA, 22 nt, Human
uuuccucugacugcuccccugc

SEQ ID NO: 1018228 - RNA, 22 nt, Human
uuucauuacguguuugacuugu

SEQ ID NO: 1018229 - RNA, 22 nt, Human
cagggagcacugcgagcggcag

SEQ ID NO: 1018230 - RNA, 22 nt, Human
acagccaggaauucuggagaag

SEQ ID NO: 1018231 - RNA, 22 nt, Human
aggccagggucccacacucgca

SEQ ID NO: 1018232 - RNA, 22 nt, Human
aguguuucuggcaaaugaaagu

SEQ ID NO: 1018233 - RNA, 22 nt, Human
gagggcagagucuaaugaugca

SEQ ID NO: 1018234 - RNA, 22 nt, Human
uuuccuaugauauucuaugugu

SEQ ID NO: 1018235 - RNA, 22 nt, Human
uucuggagaucugccuauggga

SEQ ID NO: 1018236 - RNA, 22 nt, Human
uugcagggaccugcagaaagcu

SEQ ID NO: 1018237 - RNA, 22 nt, Human
caaggccaagucucugugaaga

SEQ ID NO: 1018238 - RNA, 22 nt, Human
ucuucacagaugcauauacuuc

SEQ ID NO: 1018239 - RNA, 21 nt, Human
ucagaguguguuacagcaagc

SEQ ID NO: 1018240 - RNA, 19 nt, Human
ccuggguccacucagacua

SEQ ID NO: 1018241 - RNA, 18 nt, Human
ugcucuguuuaaugauuu

SEQ ID NO: 1018242 - RNA, 22 nt, Human
aagguuaaauagguauuuucca

SEQ ID NO: 1018243 - RNA, 22 nt, Human
gggcacuggaaggcucucaggc

SEQ ID NO: 1018244 - RNA, 22 nt, Human
ucucagaguuuuuuuccaggac

SEQ ID NO: 1018245 - RNA, 22 nt, Human
agcuuaggaggaugaugaacau

SEQ ID NO: 1018246 - RNA, 18 nt, Human
aggcuucccaggcaggcc

SEQ ID NO: 1018247 - RNA, 22 nt, Human
uuugggaagaggaaucucugga

SEQ ID NO: 1018248 - RNA, 22 nt, Human
uccuuuuuauaguuagagaaac

SEQ ID NO: 1018249 - RNA, 22 nt, Human
agagcugaaaaagcugacccgg

SEQ ID NO: 1018250 - RNA, 19 nt, Human
acccagagcccuuugcagg

SEQ ID NO: 1018251 - RNA, 22 nt, Human
cagggcacggagaagucacccc

SEQ ID NO: 1018252 - RNA, 22 nt, Human
uccugucugcucacagagcugg

SEQ ID NO: 1018253 - RNA, 22 nt, Human
ucuuuccuagaggcugaugagu

SEQ ID NO: 1018254 - RNA, 22 nt, Human
aggaggccgauuucagaggucg

SEQ ID NO: 1018255 - RNA, 22 nt, Human
cuggcucccagcuuucagggag

SEQ ID NO: 1018256 - RNA, 22 nt, Human
cucuucagauaaaagggauauu

SEQ ID NO: 1018257 - RNA, 23 nt, Human
uggggccaagugaggaagggucu

SEQ ID NO: 1018258 - RNA, 22 nt, Human
ccugucugcagauaucucaggu

SEQ ID NO: 1018259 - RNA, 22 nt, Human
cagggcugaaaucaagguguag

SEQ ID NO: 1018260 - RNA, 22 nt, Human
cuggaagguucuuugugugccu

SEQ ID NO: 1018261 - RNA, 22 nt, Human
gccuccccugcaauuguccuug

SEQ ID NO: 1018262 - RNA, 22 nt, Human
uucugagguccaugcaguacug

SEQ ID NO: 1018263 - RNA, 21 nt, Human
aggucccagguuugggcagca

SEQ ID NO: 1018264 - RNA, 22 nt, Human
gccauuuucugucuuguuuauu

SEQ ID NO: 1018265 - RNA, 22 nt, Human
ugcuccagugagcuggccaucc

SEQ ID NO: 1018266 - RNA, 20 nt, Human
uaacagaaguagaagugggu

SEQ ID NO: 1018267 - RNA, 19 nt, Human
ugcauccaaagccccacca

SEQ ID NO: 1018268 - RNA, 22 nt, Human
ugcagccuugccuccucccagc

SEQ ID NO: 1018269 - RNA, 22 nt, Human
gccuggagacaaggacaaaggg

SEQ ID NO: 1018270 - RNA, 22 nt, Human
aggcucuggcuacuacagagcu

SEQ ID NO: 1018271 - RNA, 22 nt, Human
uuucaguuuaugucuugaauua

SEQ ID NO: 1018272 - RNA, 22 nt, Human
acagugacguuuauuugagacg

SEQ ID NO: 1018273 - RNA, 22 nt, Human
ggcagauggaagaggcuggguc

SEQ ID NO: 1018274 - RNA, 17 nt, Human
ucaggauguagcaguag

SEQ ID NO: 1018275 - RNA, 20 nt, Human
gcugaccccugcugucaugc

SEQ ID NO: 1018276 - RNA, 22 nt, Human
cagcagugugcaggugugcugg

SEQ ID NO: 1018277 - RNA, 22 nt, Human
uacagagaguacagcauccaca

SEQ ID NO: 1018278 - RNA, 18 nt, Human
acauuucuccuucugacc

SEQ ID NO: 1018279 - RNA, 22 nt, Human
agcagcuauuucuuccagagag

SEQ ID NO: 1018280 - RNA, 22 nt, Human
aaagauuugaguucugcuuaua

SEQ ID NO: 1018281 - RNA, 22 nt, Human
aagccagguuccauggaggagc

SEQ ID NO: 1018282 - RNA, 18 nt, Human
gggcacuggggacuggag

SEQ ID NO: 1018283 - RNA, 22 nt, Human
cuccaggcucguccaagaucga

SEQ ID NO: 1018284 - RNA, 22 nt, Human
uccugccuucauacugcuguau

SEQ ID NO: 1018285 - RNA, 22 nt, Human
auggaaagggaagcaaggaaca

SEQ ID NO: 1018286 - RNA, 22 nt, Human
acauuucugcaucucagagcua

SEQ ID NO: 1018287 - RNA, 22 nt, Human
cugagauggaguuucgcucuuc

SEQ ID NO: 1018288 - RNA, 22 nt, Human
uguauuuucugaagauaaucaa

SEQ ID NO: 1018289 - RNA, 22 nt, Human
uguuccaugucuuuguaggacu

SEQ ID NO: 1018290 - RNA, 22 nt, Human
uggaggcauaggccugggcccu

SEQ ID NO: 1018291 - RNA, 22 nt, Human
accacuguaucuccagcacauu

SEQ ID NO: 1018292 - RNA, 22 nt, Human
auucaaguccagcuucucuaca

SEQ ID NO: 1018293 - RNA, 22 nt, Human
caagcagacaguaggccuagaa

SEQ ID NO: 1018294 - RNA, 22 nt, Human
acccagaggcggagguugcagu

SEQ ID NO: 1018295 - RNA, 22 nt, Human
cagugcaguuucccagaugcug

SEQ ID NO: 1018296 - RNA, 22 nt, Human
agcagcugaccagugaguccug

SEQ ID NO: 1018297 - RNA, 22 nt, Human
gcguggugcugcccugcacaca

SEQ ID NO: 1018298 - RNA, 22 nt, Human
acagguggccccgagggagugg

SEQ ID NO: 1018299 - RNA, 22 nt, Human
ucccagcauuaaugccugucag

SEQ ID NO: 1018300 - RNA, 21 nt, Human
agaauaaugguaucauuugcu

SEQ ID NO: 1018301 - RNA, 22 nt, Human
ucugccuggguguggagcagag

SEQ ID NO: 1018302 - RNA, 22 nt, Human
aaugccaguguguugauuccag

SEQ ID NO: 1018303 - RNA, 22 nt, Human
ccacugggcguuucuguccaau

SEQ ID NO: 1018304 - RNA, 22 nt, Human
gggcagugguccaggcuacagc

SEQ ID NO: 1018305 - RNA, 22 nt, Human
caguccagcucaucaguggcac

SEQ ID NO: 1018306 - RNA, 22 nt, Human
ugcagugguguccagguguacu

SEQ ID NO: 1018307 - RNA, 22 nt, Human
acagugcuggcuacaacccugg

SEQ ID NO: 1018308 - RNA, 22 nt, Human
acucugccuuucagcagaugaa

SEQ ID NO: 1018309 - RNA, 22 nt, Human
uuaaguccuugguaauuuucuu

SEQ ID NO: 1018310 - RNA, 22 nt, Human
gcacccagggacuuggcuggcc

SEQ ID NO: 1018311 - RNA, 22 nt, Human
ugucacuucaggaaugcaggga

SEQ ID NO: 1018312 - RNA, 22 nt, Human
agucugcacucagguggagguc

SEQ ID NO: 1018313 - RNA, 22 nt, Human
gcuugggagaggguccccagga

SEQ ID NO: 1018314 - RNA, 22 nt, Human
uugggugcugucauggggcacg

SEQ ID NO: 1018315 - RNA, 22 nt, Human
cuucagggugacgcaggcugca

SEQ ID NO: 1018316 - RNA, 23 nt, Human
ggagccuggcauaugagacgcau

SEQ ID NO: 1018317 - RNA, 22 nt, Human
guaaacaucgacccaacagggg

SEQ ID NO: 1018318 - RNA, 22 nt, Human
uguugaagauaaaguucucauu

SEQ ID NO: 1018319 - RNA, 22 nt, Human
gaggaacccagcugggguugcc

SEQ ID NO: 1018320 - RNA, 22 nt, Human
aaaggccagguuggcugguauu

SEQ ID NO: 1018321 - RNA, 22 nt, Human
ugggcagagaguagaggcaacg

SEQ ID NO: 1018322 - RNA, 22 nt, Human
acagaauuaaugaaaauuacaa

SEQ ID NO: 1018323 - RNA, 20 nt, Human
uuaagaaaagcacauccugc

SEQ ID NO: 1018324 - RNA, 22 nt, Human
augccuguaaucccagugcuuu

SEQ ID NO: 1018325 - RNA, 22 nt, Human
gccaggcagcaggaagccagug

SEQ ID NO: 1018326 - RNA, 22 nt, Human
ggucucagacuggcaggcagug

SEQ ID NO: 1018327 - RNA, 22 nt, Human
uauuauguagaguaaggguuaa

SEQ ID NO: 1018328 - RNA, 22 nt, Human
agcugcucugauaaaccuacuu

SEQ ID NO: 1018329 - RNA, 22 nt, Human
uccucagacuucccuuugugua

SEQ ID NO: 1018330 - RNA, 18 nt, Human
ucagcuuuugaaaaccaa

SEQ ID NO: 1018331 - RNA, 22 nt, Human
ggcuccucucuggccgcucccg

SEQ ID NO: 1018332 - RNA, 21 nt, Human
aaaaagcuggggcaugcaugc

SEQ ID NO: 1018333 - RNA, 22 nt, Human
ggagccugacagugcccagcau

SEQ ID NO: 1018334 - RNA, 20 nt, Human
aggaacuggaagggaggaaa

SEQ ID NO: 1018335 - RNA, 22 nt, Human
ccugucucuuucaaucugagag

SEQ ID NO: 1018336 - RNA, 22 nt, Human
ugagccagcaggccuccagugg

SEQ ID NO: 1018337 - RNA, 22 nt, Human
augcuguguccuagugaaagaa

SEQ ID NO: 1018338 - RNA, 22 nt, Human
caggccuggggcuggcuuccag

SEQ ID NO: 1018339 - RNA, 22 nt, Human
cacaguggcagguguggguugu

SEQ ID NO: 1018340 - RNA, 22 nt, Human
agcccaugcaacaggccuagcg

SEQ ID NO: 1018341 - RNA, 22 nt, Human
uuccgcuggggccgccuggcgg

SEQ ID NO: 1018342 - RNA, 22 nt, Human
accuggcacuacaggcaccugu

SEQ ID NO: 1018343 - RNA, 22 nt, Human
ugccugggguuggcaaacugcu

SEQ ID NO: 1018344 - RNA, 22 nt, Human
uccuuggcuuucuggagcuucu

SEQ ID NO: 1018345 - RNA, 22 nt, Human
ggcugccugaggcagugagaga

SEQ ID NO: 1018346 - RNA, 22 nt, Human
ucuguucaucaucuggacacau

SEQ ID NO: 1018347 - RNA, 22 nt, Human
ucuuuauuuuaugcuugugcaa

SEQ ID NO: 1018348 - RNA, 22 nt, Human
uugcaucuagggcaacccagag

SEQ ID NO: 1018349 - RNA, 22 nt, Human
ggcugccagugagugcagaccg

SEQ ID NO: 1018350 - RNA, 22 nt, Human
cuggguggaaagugcugagaau

SEQ ID NO: 1018351 - RNA, 22 nt, Human
ggcacagggaggcccuggugug

SEQ ID NO: 1018352 - RNA, 22 nt, Human
ugggcuggcccaccacaccucg

SEQ ID NO: 1018353 - RNA, 22 nt, Human
aggagucauaaaugugaacaaa

SEQ ID NO: 1018354 - RNA, 22 nt, Human
gagagcugcaagguagggcggg

SEQ ID NO: 1018355 - RNA, 22 nt, Human
aaauucagcagugaaaugcccc

SEQ ID NO: 1018356 - RNA, 22 nt, Human
ucugagaggcaucugcacuucu

SEQ ID NO: 1018357 - RNA, 22 nt, Human
aaguggacuaauacaaggacua

SEQ ID NO: 1018358 - RNA, 22 nt, Human
uguuacuuaucucacgugaugc

SEQ ID NO: 1018359 - RNA, 22 nt, Human
gcuugaaaauucauagguauuu

SEQ ID NO: 1018360 - RNA, 22 nt, Human
gcugagugauugauauuuuagu

SEQ ID NO: 1018361 - RNA, 22 nt, Human
cacugucuuuugugaagacaau

SEQ ID NO: 1018362 - RNA, 22 nt, Human
ucucagggagggcgagucagcg

SEQ ID NO: 1018363 - RNA, 22 nt, Human
aguggcagagguugacugcagu

SEQ ID NO: 1018364 - RNA, 22 nt, Human
gcaggaugagugaguacauuua

SEQ ID NO: 1018365 - RNA, 22 nt, Human
agagcugaauuuggguggugga

SEQ ID NO: 1018366 - RNA, 22 nt, Human
ccagcuuuccugcgaguugauu

SEQ ID NO: 1018367 - RNA, 22 nt, Human
gccaggcagcagcgaggauggu

SEQ ID NO: 1018368 - RNA, 22 nt, Human
gcugccaguaguuggagcucca

SEQ ID NO: 1018369 - RNA, 22 nt, Human
cauuugaauuguucugugggaa

SEQ ID NO: 1018370 - RNA, 22 nt, Human
aaauuucuaagcagccacuucc

SEQ ID NO: 1018371 - RNA, 22 nt, Human
acucuugucucaacuuuuguau

SEQ ID NO: 1018372 - RNA, 22 nt, Human
cuccucacacccacugcaacca

SEQ ID NO: 1018373 - RNA, 22 nt, Human
uuucuucaauugcuaacaagga

SEQ ID NO: 1018374 - RNA, 19 nt, Human
auacagauguauccaugau

SEQ ID NO: 1018375 - RNA, 22 nt, Human
uuguggaaauacagacuccaag

SEQ ID NO: 1018376 - RNA, 22 nt, Human
ugcugaggucaccuugcugcua

SEQ ID NO: 1018377 - RNA, 22 nt, Human
cauaauuugugguaguggggga

SEQ ID NO: 1018378 - RNA, 22 nt, Human
cuuauguaugcuacuuuguggu

SEQ ID NO: 1018379 - RNA, 22 nt, Human
uccgccaggacugagggcccau

SEQ ID NO: 1018380 - RNA, 22 nt, Human
ugcauacacaugugcacauacg

SEQ ID NO: 1018381 - RNA, 22 nt, Human
aggccuggcuuugguuugcuga

SEQ ID NO: 1018382 - RNA, 23 nt, Human
ugccucugccucccuagucugca

SEQ ID NO: 1018383 - RNA, 22 nt, Human
uuccuuccauagcaaaacaugc

SEQ ID NO: 1018384 - RNA, 22 nt, Human
uccuugaaugaauguucucucc

SEQ ID NO: 1018385 - RNA, 21 nt, Human
aaaugaaugugguagugcaag

SEQ ID NO: 1018386 - RNA, 22 nt, Human
cuggcagcgguuugcagccugg

SEQ ID NO: 1018387 - RNA, 22 nt, Human
agaggcuguuacacucccagau

SEQ ID NO: 1018388 - RNA, 22 nt, Human
ggucacugcucuaaacaaaagu

SEQ ID NO: 1018389 - RNA, 22 nt, Human
uggcagggugccaguugcgagu

SEQ ID NO: 1018390 - RNA, 22 nt, Human
uugaagaggacuuugcagcugu

SEQ ID NO: 1018391 - RNA, 22 nt, Human
ugcuggaggccugacuguguuu

SEQ ID NO: 1018392 - RNA, 22 nt, Human
ccuucugcuggucaucccagug

SEQ ID NO: 1018393 - RNA, 22 nt, Human
gggaccugaggcccugcuccac

SEQ ID NO: 1018394 - RNA, 22 nt, Human
ccugaagaugcuguggccuggu

SEQ ID NO: 1018395 - RNA, 22 nt, Human
gcugucugacuccaaguuggag

SEQ ID NO: 1018396 - RNA, 22 nt, Human
gcugggcaccucucccagauug

SEQ ID NO: 1018397 - RNA, 22 nt, Human
uagcauuucacugaucuucacu

SEQ ID NO: 1018398 - RNA, 22 nt, Human
agauggguaacuggagucugcu

SEQ ID NO: 1018399 - RNA, 22 nt, Human
gagcaggcuugcagagaagggg

SEQ ID NO: 1018400 - RNA, 22 nt, Human
caguuucuacgacuuaagcaca

SEQ ID NO: 1018401 - RNA, 22 nt, Human
ugugugaaggaauauauacuca

SEQ ID NO: 1018402 - RNA, 23 nt, Human
acuuaaaugguucuuuaucucag

SEQ ID NO: 1018403 - RNA, 22 nt, Human
cuuccucccccacacacucacu

SEQ ID NO: 1018404 - RNA, 22 nt, Human
ggcaaggccaggccuccaagac

SEQ ID NO: 1018405 - RNA, 22 nt, Human
caggcagauuugcugcccucca

SEQ ID NO: 1018406 - RNA, 18 nt, Human
cccagcccaccauuucuc

SEQ ID NO: 1018407 - RNA, 22 nt, Human
ugggugggagcacccugucugg

SEQ ID NO: 1018408 - RNA, 22 nt, Human
gcucccaggaagagaagggcca

SEQ ID NO: 1018409 - RNA, 22 nt, Human
ucuuucucucuaaucaagcaca

SEQ ID NO: 1018410 - RNA, 21 nt, Human
uucuuuccccagaggacuaaa

SEQ ID NO: 1018411 - RNA, 22 nt, Human
uuugcauuuccagaguagcaga

SEQ ID NO: 1018412 - RNA, 20 nt, Human
cucaggauugucuagccccu

SEQ ID NO: 1018413 - RNA, 18 nt, Human
gagucuuuguuacugcug

SEQ ID NO: 1018414 - RNA, 21 nt, Human
aaagaacaggcagauguucuu

SEQ ID NO: 1018415 - RNA, 22 nt, Human
aggagcccugcgggaggcagag

SEQ ID NO: 1018416 - RNA, 22 nt, Human
cagaguacugggagaacagaag

SEQ ID NO: 1018417 - RNA, 22 nt, Human
gcugucuuccuugcuccaaggg

SEQ ID NO: 1018418 - RNA, 22 nt, Human
aaagguuugcauggaauuuacc

SEQ ID NO: 1018419 - RNA, 22 nt, Human
uuuggaauauuaaaaugucuca

SEQ ID NO: 1018420 - RNA, 22 nt, Human
ggaggccaugaggcucuaggug

SEQ ID NO: 1018421 - RNA, 22 nt, Human
uuacauuuugggguaaggauaa

SEQ ID NO: 1018422 - RNA, 22 nt, Human
uggaagcuguggcauaacugag

SEQ ID NO: 1018423 - RNA, 22 nt, Human
agaaaugcauuagcacauauag

SEQ ID NO: 1018424 - RNA, 22 nt, Human
cagcagagguuggaacaguucu

SEQ ID NO: 1018425 - RNA, 22 nt, Human
cggggcuguagcacagcugagc

SEQ ID NO: 1018426 - RNA, 22 nt, Human
aaaaguaauugaugcaaucgua

SEQ ID NO: 1018427 - RNA, 21 nt, Human
aaggccugcuuacugcuaguu

SEQ ID NO: 1018428 - RNA, 22 nt, Human
agagccugugggagaugcagcu

SEQ ID NO: 1018429 - RNA, 22 nt, Human
uuauuccauucaguucaacaag

SEQ ID NO: 1018430 - RNA, 22 nt, Human
gcccaugcacuuucugugaugg

SEQ ID NO: 1018431 - RNA, 22 nt, Human
cauuuagaaacuguuuuuaaca

SEQ ID NO: 1018432 - RNA, 22 nt, Human
gagcuuugcuggaagccugggg

SEQ ID NO: 1018433 - RNA, 22 nt, Human
cacauaauugaacgugaugagu

SEQ ID NO: 1018434 - RNA, 22 nt, Human
gcccucagaugggaaaggaggg

SEQ ID NO: 1018435 - RNA, 22 nt, Human
gcucucugggugugucuagaua

SEQ ID NO: 1018436 - RNA, 22 nt, Human
gcacccagaggucagcagugcu

SEQ ID NO: 1018437 - RNA, 22 nt, Human
acuggcagagguuggacaccau

SEQ ID NO: 1018438 - RNA, 22 nt, Human
cgggcagauugggaagguucau

SEQ ID NO: 1018439 - RNA, 22 nt, Human
guuauaaaugacugcaaaaguu

SEQ ID NO: 1018440 - RNA, 22 nt, Human
gcugcagcuguaggacacaauu

SEQ ID NO: 1018441 - RNA, 22 nt, Human
ucaccuuagcuagaggaagaga

SEQ ID NO: 1018442 - RNA, 22 nt, Human
gggcccuggacguggcggcaga

SEQ ID NO: 1018443 - RNA, 22 nt, Human
ugaagcaggaucguuugcuuca

SEQ ID NO: 1018444 - RNA, 22 nt, Human
auucacagaauaguuuuaccag

SEQ ID NO: 1018445 - RNA, 22 nt, Human
ggcauggcuggguucuggugag

SEQ ID NO: 1018446 - RNA, 22 nt, Human
ccacugaaggucaacauagagc

SEQ ID NO: 1018447 - RNA, 22 nt, Human
gugaaggacuagcauggagggc

SEQ ID NO: 1018448 - RNA, 22 nt, Human
auauuaggugcucaauacaugc

SEQ ID NO: 1018449 - RNA, 22 nt, Human
cauuuguuuagaagucuuuaua

SEQ ID NO: 1018450 - RNA, 20 nt, Human
gaggcucugggcauggcgcc

SEQ ID NO: 1018451 - RNA, 22 nt, Human
gagcagcuguccccaaagcuuc

SEQ ID NO: 1018452 - RNA, 22 nt, Human
guacaguuuucaguguucacug

SEQ ID NO: 1018453 - RNA, 22 nt, Human
uuuuucaucugauugauaacuc

SEQ ID NO: 1018454 - RNA, 22 nt, Human
ucagagugaccuuacauggucu

SEQ ID NO: 1018455 - RNA, 22 nt, Human
uuggaaggagucaaccagcuga

SEQ ID NO: 1018456 - RNA, 22 nt, Human
uaaggccaaacuauuauaguuc

SEQ ID NO: 1018457 - RNA, 20 nt, Human
ugugcccaauguccagguuc

SEQ ID NO: 1018458 - RNA, 22 nt, Human
agauauguuuguauauauuugu

SEQ ID NO: 1018459 - RNA, 22 nt, Human
ccucagggacuccaugcugcag

SEQ ID NO: 1018460 - RNA, 22 nt, Human
uuuuuauaacucuuuugugaca

SEQ ID NO: 1018461 - RNA, 22 nt, Human
gaaugcagauggcugguguaug

SEQ ID NO: 1018462 - RNA, 22 nt, Human
caaaugcagucccuuuguugcu

SEQ ID NO: 1018463 - RNA, 22 nt, Human
agcaccuguggcucaugcucgu

SEQ ID NO: 1018464 - RNA, 20 nt, Human
agacaaaaugacuucaugca

SEQ ID NO: 1018465 - RNA, 22 nt, Human
gcagcaggcacggucucgacau

SEQ ID NO: 1018466 - RNA, 20 nt, Human
ccugggcuccaggagccccg

SEQ ID NO: 1018467 - RNA, 22 nt, Human
uuuccucuuugugacacagcug

SEQ ID NO: 1018468 - RNA, 18 nt, Human
agaaggagcuaugggcag

SEQ ID NO: 1018469 - RNA, 22 nt, Human
ggccugucucacccccgggugc

SEQ ID NO: 1018470 - RNA, 22 nt, Human
caguccaggccuggaggagcca

SEQ ID NO: 1018471 - RNA, 22 nt, Human
caggagugcagguggugaggca

SEQ ID NO: 1018472 - RNA, 22 nt, Human
gaggccacaguccugaggcauc

SEQ ID NO: 1018473 - RNA, 22 nt, Human
gcuuugaagucugugucuuuug

SEQ ID NO: 1018474 - RNA, 20 nt, Human
cagcaggcuauggggcaccc

SEQ ID NO: 1018475 - RNA, 22 nt, Human
ggcugucugugguggagcguug

SEQ ID NO: 1018476 - RNA, 20 nt, Human
acugccuugguucaguaggu

SEQ ID NO: 1018477 - RNA, 22 nt, Human
acagucuacuugagcuuguaua

SEQ ID NO: 1018478 - RNA, 22 nt, Human
uauuucagacacugaucuugca

SEQ ID NO: 1018479 - RNA, 22 nt, Human
aauguguagggugccuguuuuu

SEQ ID NO: 1018480 - RNA, 18 nt, Human
agccuggaggguugaagu

SEQ ID NO: 1018481 - RNA, 22 nt, Human
cugucugucaaguucaucucca

SEQ ID NO: 1018482 - RNA, 22 nt, Human
uggcagagaauaaaucuugacu

SEQ ID NO: 1018483 - RNA, 22 nt, Human
cauuaugugggaaaauguucuu

SEQ ID NO: 1018484 - RNA, 22 nt, Human
agugcuuuagcauccaacuguc

SEQ ID NO: 1018485 - RNA, 22 nt, Human
uggcuucugggacuugugagca

SEQ ID NO: 1018486 - RNA, 22 nt, Human
agccuggcccugcugaacucug

SEQ ID NO: 1018487 - RNA, 22 nt, Human
cuggaaggucuguccccacugc

SEQ ID NO: 1018488 - RNA, 22 nt, Human
ucucagaguuugaaucuggagu

SEQ ID NO: 1018489 - RNA, 22 nt, Human
ugagaauuuucaguuucacuuu

SEQ ID NO: 1018490 - RNA, 22 nt, Human
uagaaucuaguucauucauuug

SEQ ID NO: 1018491 - RNA, 22 nt, Human
cugggagcaagaggcugcaaau

SEQ ID NO: 1018492 - RNA, 22 nt, Human
aggcuuccuggaggaagaggua

SEQ ID NO: 1018493 - RNA, 22 nt, Human
gcagggcacagacagugccaag

SEQ ID NO: 1018494 - RNA, 22 nt, Human
ggucccaggcucccucuugucc

SEQ ID NO: 1018495 - RNA, 22 nt, Human
uaacuuucuucauaugugaacc

SEQ ID NO: 1018496 - RNA, 17 nt, Human
uugggagagaaagguau

SEQ ID NO: 1018497 - RNA, 22 nt, Human
agguggaacguucaggugcuag

SEQ ID NO: 1018498 - RNA, 22 nt, Human
ucccacugcuuugcucugcuca

SEQ ID NO: 1018499 - RNA, 22 nt, Human
cuggucugagggcucuugaggc

SEQ ID NO: 1018500 - RNA, 22 nt, Human
cauucacaucuuguuccaucac

SEQ ID NO: 1018501 - RNA, 22 nt, Human
cagggccucauccucagagauu

SEQ ID NO: 1018502 - RNA, 22 nt, Human
gcugugcagguccccacugccu

SEQ ID NO: 1018503 - RNA, 22 nt, Human
gucugucaucugagauggagug

SEQ ID NO: 1018504 - RNA, 22 nt, Human
ucagcaauaugauaggcuuugu

SEQ ID NO: 1018505 - RNA, 19 nt, Human
uccuuugaauaucaguuga

SEQ ID NO: 1018506 - RNA, 22 nt, Human
ucauaaaucauacuccauuugc

SEQ ID NO: 1018507 - RNA, 22 nt, Human
ucucgacagccuggcacagugg

SEQ ID NO: 1018508 - RNA, 22 nt, Human
ggagccugugcccaagcccaga

SEQ ID NO: 1018509 - RNA, 22 nt, Human
gcucccuguucucagccaugau

SEQ ID NO: 1018510 - RNA, 22 nt, Human
aaagaacaaaugauauaugguu

SEQ ID NO: 1018511 - RNA, 22 nt, Human
uuucuguagugugguauguagg

SEQ ID NO: 1018512 - RNA, 22 nt, Human
cagcagguauguuuguucagca

SEQ ID NO: 1018513 - RNA, 22 nt, Human
gaggccagaaugagcugaaugc

SEQ ID NO: 1018514 - RNA, 22 nt, Human
cugccucugguuuuggucccug

SEQ ID NO: 1018515 - RNA, 22 nt, Human
ucacuuauaaaaugcaagaucu

SEQ ID NO: 1018516 - RNA, 22 nt, Human
cuuaauuucaaacugcuaguga

SEQ ID NO: 1018517 - RNA, 22 nt, Human
aaugaaugaaccacauauaaca

SEQ ID NO: 1018518 - RNA, 22 nt, Human
aggagcugacuuguaaagcauu

SEQ ID NO: 1018519 - RNA, 22 nt, Human
ccccagcacuuggaguggggag

SEQ ID NO: 1018520 - RNA, 22 nt, Human
acuguugucaggcugcuuugga

SEQ ID NO: 1018521 - RNA, 22 nt, Human
uugcucugacuggagugcagug

SEQ ID NO: 1018522 - RNA, 22 nt, Human
cccaggaucaccuggucaaggg

SEQ ID NO: 1018523 - RNA, 22 nt, Human
ccagcugcuugggaaaaugucu

SEQ ID NO: 1018524 - RNA, 22 nt, Human
auauaauuguucugaaguguuu

SEQ ID NO: 1018525 - RNA, 22 nt, Human
uaaggccaggcuguggucggca

SEQ ID NO: 1018526 - RNA, 22 nt, Human
ugaggcaggaguucaggcugcg

SEQ ID NO: 1018527 - RNA, 22 nt, Human
guacccagaggcaugaucccag

SEQ ID NO: 1018528 - RNA, 22 nt, Human
aggcuuuaaguggccuacagcu

SEQ ID NO: 1018529 - RNA, 22 nt, Human
uggucuuuaagguagcugucau

SEQ ID NO: 1018530 - RNA, 21 nt, Human
ugcaggaaagugcugcgaccc

SEQ ID NO: 1018531 - RNA, 22 nt, Human
cuucugagcagaccuccugggg

SEQ ID NO: 1018532 - RNA, 22 nt, Human
aaauuucuguuguuuugagcca

SEQ ID NO: 1018533 - RNA, 22 nt, Human
ggccgggcaggucucagccagc

SEQ ID NO: 1018534 - RNA, 22 nt, Human
ggguggaguagaaagaugaauu

SEQ ID NO: 1018535 - RNA, 22 nt, Human
aggcccugagcauccgagggca

SEQ ID NO: 1018536 - RNA, 22 nt, Human
uucuucucagggucccacaugg

SEQ ID NO: 1018537 - RNA, 22 nt, Human
ugcacauucacuuagguauugu

SEQ ID NO: 1018538 - RNA, 22 nt, Human
uauuaaauuauggauuuaggag

SEQ ID NO: 1018539 - RNA, 22 nt, Human
aaaaauagcuucucuugucccu

SEQ ID NO: 1018540 - RNA, 22 nt, Human
ucauuucucccggccaaaaacu

SEQ ID NO: 1018541 - RNA, 22 nt, Human
auucaaauuaaguuaauucagc

SEQ ID NO: 1018542 - RNA, 22 nt, Human
gagugcagaugaacagaagauu

SEQ ID NO: 1018543 - RNA, 22 nt, Human
agacuucuuugugagcauuuuc

SEQ ID NO: 1018544 - RNA, 22 nt, Human
uuaaaaccaucagcuguaagau

SEQ ID NO: 1018545 - RNA, 22 nt, Human
gagggguguggagccaucaguu

SEQ ID NO: 1018546 - RNA, 22 nt, Human
aaaaugagauacaguuugaaag

SEQ ID NO: 1018547 - RNA, 22 nt, Human
gaaggccucacucugcagcaua

SEQ ID NO: 1018548 - RNA, 22 nt, Human
cugcccugggauggucugugcg

SEQ ID NO: 1018549 - RNA, 22 nt, Human
agcagcauguugggaugugaaa

SEQ ID NO: 1018550 - RNA, 22 nt, Human
ugacaaaacugcaauuacuuuu

SEQ ID NO: 1018551 - RNA, 22 nt, Human
augggaggcagcagagcccagc

SEQ ID NO: 1018552 - RNA, 22 nt, Human
gucccucugugucccugcaguc

SEQ ID NO: 1018553 - RNA, 20 nt, Human
ugcagcugcaggaggguggg

SEQ ID NO: 1018554 - RNA, 22 nt, Human
ggcacugacacuagcauggcac

SEQ ID NO: 1018555 - RNA, 22 nt, Human
cuacauuuuaauaagcugcuua

SEQ ID NO: 1018556 - RNA, 22 nt, Human
uugaaucucuugaaucucuguu

SEQ ID NO: 1018557 - RNA, 22 nt, Human
caaacugagcaucagaaaguuu

SEQ ID NO: 1018558 - RNA, 22 nt, Human
gaggugggaugugugugcuacu

SEQ ID NO: 1018559 - RNA, 22 nt, Human
cugggcuggagugcaauggcgc

SEQ ID NO: 1018560 - RNA, 22 nt, Human
uccugcugagcgucugucauuu

SEQ ID NO: 1018561 - RNA, 18 nt, Human
acucaggaaaugaugaca

SEQ ID NO: 1018562 - RNA, 22 nt, Human
agaggucauaucucagaagaga

SEQ ID NO: 1018563 - RNA, 22 nt, Human
acagagcugggugcccccugga

SEQ ID NO: 1018564 - RNA, 22 nt, Human
ucuuuccaaggacucuguagca

SEQ ID NO: 1018565 - RNA, 20 nt, Human
acagaaagagagaaugucag

SEQ ID NO: 1018566 - RNA, 22 nt, Human
cuguccuugcuggccagguaug

SEQ ID NO: 1018567 - RNA, 22 nt, Human
agucccagcuucccccaugcag

SEQ ID NO: 1018568 - RNA, 22 nt, Human
caggaggcuccuagggcucugu

SEQ ID NO: 1018569 - RNA, 22 nt, Human
caugaaaaugucaaguucugcu

SEQ ID NO: 1018570 - RNA, 22 nt, Human
cagagcagugaggaguugugua

SEQ ID NO: 1018571 - RNA, 22 nt, Human
uggcagggucuugcuguguugc

SEQ ID NO: 1018572 - RNA, 19 nt, Human
cugcugggugcugagggag

SEQ ID NO: 1018573 - RNA, 21 nt, Human
agcuuguguguaucacagugu

SEQ ID NO: 1018574 - RNA, 22 nt, Human
uccucaggagagcuccuaugcc

SEQ ID NO: 1018575 - RNA, 22 nt, Human
ggagugggaacaaugacauggu

SEQ ID NO: 1018576 - RNA, 22 nt, Human
gcagagaccccgcagugaggcc

SEQ ID NO: 1018577 - RNA, 22 nt, Human
uggagcagcuaagccucugaga

SEQ ID NO: 1018578 - RNA, 22 nt, Human
uccaggcaaagccuuguagacg

SEQ ID NO: 1018579 - RNA, 22 nt, Human
gagcagggccacuucuguaccu

SEQ ID NO: 1018580 - RNA, 22 nt, Human
ugcacagugaccccuggugacu

SEQ ID NO: 1018581 - RNA, 22 nt, Human
agccacagagguugaugugguu

SEQ ID NO: 1018582 - RNA, 22 nt, Human
gcuggccuugugucugaggaag

SEQ ID NO: 1018583 - RNA, 22 nt, Human
gcugcucucucccuaaguuggg

SEQ ID NO: 1018584 - RNA, 22 nt, Human
uuacauuuuaguuaaccuguga

SEQ ID NO: 1018585 - RNA, 22 nt, Human
gcuucuggaggagcugggcuga

SEQ ID NO: 1018586 - RNA, 22 nt, Human
ucauccaggaaaagauuuggaa

SEQ ID NO: 1018587 - RNA, 21 nt, Human
uucaaaaugguguguuugucu

SEQ ID NO: 1018588 - RNA, 22 nt, Human
agggcagcacaaggcauggacu

SEQ ID NO: 1018589 - RNA, 22 nt, Human
ugagagugauugguucgaaugu

SEQ ID NO: 1018590 - RNA, 22 nt, Human
ucucaccaaagccuugaccaua

SEQ ID NO: 1018591 - RNA, 20 nt, Human
cguaaggcaagugcugcauc

SEQ ID NO: 1018592 - RNA, 23 nt, Human
ugaguucucaucuuggcuucuau

SEQ ID NO: 1018593 - RNA, 22 nt, Human
gcuccuggucuggagcuucaag

SEQ ID NO: 1018594 - RNA, 22 nt, Human
aggccagcuguuacuagagcca

SEQ ID NO: 1018595 - RNA, 22 nt, Human
acagcagcauaaacugacuaag

SEQ ID NO: 1018596 - RNA, 22 nt, Human
gcucaggaccgaggggugggaa

SEQ ID NO: 1018597 - RNA, 22 nt, Human
ugaaacauugcacuguaugaau

SEQ ID NO: 1018598 - RNA, 22 nt, Human
ccagagccuaagaucugauccu

SEQ ID NO: 1018599 - RNA, 22 nt, Human
auggcacugaccucccuuguaa

SEQ ID NO: 1018600 - RNA, 22 nt, Human
caggccucagagaguggcgggg

SEQ ID NO: 1018601 - RNA, 22 nt, Human
gcacagagggcagugagccucu

SEQ ID NO: 1018602 - RNA, 21 nt, Human
gggagcuggaaacugggugac

SEQ ID NO: 1018603 - RNA, 22 nt, Human
auccaaagauggaaagaacuuu

SEQ ID NO: 1018604 - RNA, 22 nt, Human
agucucugagguucagaugccu

SEQ ID NO: 1018605 - RNA, 22 nt, Human
uuaauaaaguaugaauuggaaa

SEQ ID NO: 1018606 - RNA, 22 nt, Human
uuauuuucagcuaggaaagcca

SEQ ID NO: 1018607 - RNA, 20 nt, Human
gagauggcuaagugcugaac

SEQ ID NO: 1018608 - RNA, 22 nt, Human
cuccaggguuccccgauccacu

SEQ ID NO: 1018609 - RNA, 22 nt, Human
agccauggcgccacuagaggga

SEQ ID NO: 1018610 - RNA, 22 nt, Human
aaacaugaauagauauuaaaca

SEQ ID NO: 1018611 - RNA, 22 nt, Human
cuucaguucuaaaguagaaugu

SEQ ID NO: 1018612 - RNA, 22 nt, Human
cugcuguguugccagugucacc

SEQ ID NO: 1018613 - RNA, 22 nt, Human
aaaagguagauucuccuucuau

SEQ ID NO: 1018614 - RNA, 22 nt, Human
ucagcuuuccugcagcuaaggg

SEQ ID NO: 1018615 - RNA, 21 nt, Human
gugcuuuuccuuaauguucuu

SEQ ID NO: 1018616 - RNA, 22 nt, Human
aggauccuuuuucugcuguuug

SEQ ID NO: 1018617 - RNA, 19 nt, Human
gcacugaagaguuggucac

SEQ ID NO: 1018618 - RNA, 22 nt, Human
aggcuuccucgugccuuagaua

SEQ ID NO: 1018619 - RNA, 22 nt, Human
uguaacaguaagccugugagcu

SEQ ID NO: 1018620 - RNA, 22 nt, Human
gggccugggaacuugcauuuag

SEQ ID NO: 1018621 - RNA, 22 nt, Human
cuucaagauauuucuagaauca

SEQ ID NO: 1018622 - RNA, 22 nt, Human
aguucucagcuuaguaugcugu

SEQ ID NO: 1018623 - RNA, 22 nt, Human
guaggcagucucucaggugauc

SEQ ID NO: 1018624 - RNA, 22 nt, Human
cacagcuuguuuagugacucac

SEQ ID NO: 1018625 - RNA, 22 nt, Human
auuuucauggcuucugcucagu

SEQ ID NO: 1018626 - RNA, 22 nt, Human
acagaaauauagaagguaggaa

SEQ ID NO: 1018627 - RNA, 22 nt, Human
ccuggccugcucggcucuuaag

SEQ ID NO: 1018628 - RNA, 22 nt, Human
gucuggaguggggccugagaau

SEQ ID NO: 1018629 - RNA, 22 nt, Human
agggaucaaaaaauguacaugc

SEQ ID NO: 1018630 - RNA, 22 nt, Human
uccagccaagggagguuacuag

SEQ ID NO: 1018631 - RNA, 22 nt, Human
aauuagggagccaucauaaggu

SEQ ID NO: 1018632 - RNA, 22 nt, Human
ucagcaggcgguuccuuguggg

SEQ ID NO: 1018633 - RNA, 22 nt, Human
gguuggggcgagcuggaggccc

SEQ ID NO: 1018634 - RNA, 22 nt, Human
agugucauuuuguccaucuucu

SEQ ID NO: 1018635 - RNA, 22 nt, Human
gaagagcugacagugucauccu

SEQ ID NO: 1018636 - RNA, 22 nt, Human
cugcaggguuuuucaaggacaa

SEQ ID NO: 1018637 - RNA, 22 nt, Human
guggccuggaguuugauguagg

SEQ ID NO: 1018638 - RNA, 22 nt, Human
ugggagcaagcuacuuagggaa

SEQ ID NO: 1018639 - RNA, 22 nt, Human
gccugcuggauguggccaggcc

SEQ ID NO: 1018640 - RNA, 22 nt, Human
uguucucacuggaugcuucaca

SEQ ID NO: 1018641 - RNA, 22 nt, Human
acacauuucuaaauuuuuaccg

SEQ ID NO: 1018642 - RNA, 22 nt, Human
ucccagagcagaugugcuaaag

SEQ ID NO: 1018643 - RNA, 22 nt, Human
uggcagagcaaaaagauagaau

SEQ ID NO: 1018644 - RNA, 23 nt, Human
ugcaugugaauucauacuuguuu

SEQ ID NO: 1018645 - RNA, 22 nt, Human
cagcauggcuugaguguuuccu

SEQ ID NO: 1018646 - RNA, 22 nt, Human
uacagcauguccuuagcaaggc

SEQ ID NO: 1018647 - RNA, 22 nt, Human
gccugggugaauuugauccuaa

SEQ ID NO: 1018648 - RNA, 22 nt, Human
ucaauauauuccauguuuucuc

SEQ ID NO: 1018649 - RNA, 22 nt, Human
cagggucuuauaaggccaauuu

SEQ ID NO: 1018650 - RNA, 22 nt, Human
gagcugugaaaagugccugggg

SEQ ID NO: 1018651 - RNA, 22 nt, Human
aaaaaugaauucuucaguggca

SEQ ID NO: 1018652 - RNA, 22 nt, Human
aucuaagauguauugagcacuu

SEQ ID NO: 1018653 - RNA, 22 nt, Human
aguaugaauugcuuugccugua

SEQ ID NO: 1018654 - RNA, 22 nt, Human
augaacacauguacacauuucu

SEQ ID NO: 1018655 - RNA, 22 nt, Human
ggaggccaaggcaggcggauca

SEQ ID NO: 1018656 - RNA, 22 nt, Human
auuucagaugaccaaauggaaa

SEQ ID NO: 1018657 - RNA, 22 nt, Human
uuuuuaagcuccuuugauguca

SEQ ID NO: 1018658 - RNA, 22 nt, Human
uaugcacauuaucuaauccauu

SEQ ID NO: 1018659 - RNA, 22 nt, Human
cagcugaguuuccaagucugcc

SEQ ID NO: 1018660 - RNA, 22 nt, Human
ccucuucugcuucaggagcacu

SEQ ID NO: 1018661 - RNA, 20 nt, Human
aggaagccaaaggcugucuu

SEQ ID NO: 1018662 - RNA, 22 nt, Human
agcuggccuucggugucacugg

SEQ ID NO: 1018663 - RNA, 22 nt, Human
ccacagagacagagcccagggu

SEQ ID NO: 1018664 - RNA, 22 nt, Human
ucuacagacagagcagguggga

SEQ ID NO: 1018665 - RNA, 22 nt, Human
guggccucuguuggcuccuagg

SEQ ID NO: 1018666 - RNA, 22 nt, Human
guccuggggauacagaagugaa

SEQ ID NO: 1018667 - RNA, 22 nt, Human
agccaaggcagcuagagcucug

SEQ ID NO: 1018668 - RNA, 19 nt, Human
uuggaaggagccagagugg

SEQ ID NO: 1018669 - RNA, 21 nt, Human
aaucauacaaaacaugucagg

SEQ ID NO: 1018670 - RNA, 22 nt, Human
gacucguucauaguuccaauuu

SEQ ID NO: 1018671 - RNA, 19 nt, Human
ggcugggucuggcagguuc

SEQ ID NO: 1018672 - RNA, 22 nt, Human
ugggcaagucacuucugucuuu

SEQ ID NO: 1018673 - RNA, 22 nt, Human
uaacacaugucugggaugugaa

SEQ ID NO: 1018674 - RNA, 22 nt, Human
ucagggaccccucugaguggag

SEQ ID NO: 1018675 - RNA, 20 nt, Human
uagggcucauuaugaucucc

SEQ ID NO: 1018676 - RNA, 22 nt, Human
caagccugucucaccagugcua

SEQ ID NO: 1018677 - RNA, 22 nt, Human
agacaggcagaggcugcagagg

SEQ ID NO: 1018678 - RNA, 21 nt, Human
uucucagagucuauuacaguu

SEQ ID NO: 1018679 - RNA, 22 nt, Human
uagaaaugugauaauagcuuaa

SEQ ID NO: 1018680 - RNA, 22 nt, Human
ggcuguccuuggccaaggcacu

SEQ ID NO: 1018681 - RNA, 22 nt, Human
cagcaugcaaguccagaugugg

SEQ ID NO: 1018682 - RNA, 22 nt, Human
agggaggagaauggacuccuuc

SEQ ID NO: 1018683 - RNA, 22 nt, Human
ugcaugcauaaauguacacaca

SEQ ID NO: 1018684 - RNA, 22 nt, Human
uucuucaguuugguaaauguaa

SEQ ID NO: 1018685 - RNA, 22 nt, Human
cuuccagguccuucuugagaag

SEQ ID NO: 1018686 - RNA, 22 nt, Human
gaggaggcuggcgccgccugcc

SEQ ID NO: 1018687 - RNA, 22 nt, Human
cagaggcauauaauugcugggg

SEQ ID NO: 1018688 - RNA, 20 nt, Human
acaggagaucugaggaaagg

SEQ ID NO: 1018689 - RNA, 22 nt, Human
cauucacaaagcugauugaugg

SEQ ID NO: 1018690 - RNA, 19 nt, Human
ucucagaggaaaaauugcu

SEQ ID NO: 1018691 - RNA, 22 nt, Human
guuagaaacacauucuuauuga

SEQ ID NO: 1018692 - RNA, 22 nt, Human
gugauugcccagcaccauuguu

SEQ ID NO: 1018693 - RNA, 22 nt, Human
gcagagcugucuaagucacuuc

SEQ ID NO: 1018694 - RNA, 22 nt, Human
gggagagagagcucauguugaa

SEQ ID NO: 1018695 - RNA, 22 nt, Human
uccaguggcaccuuggcccuca

SEQ ID NO: 1018696 - RNA, 22 nt, Human
gccagcagguggagagaucaag

SEQ ID NO: 1018697 - RNA, 22 nt, Human
gaaaggugccccauaggcagga

SEQ ID NO: 1018698 - RNA, 22 nt, Human
ugggccacaagccaugggacca

SEQ ID NO: 1018699 - RNA, 22 nt, Human
uucucuuauucuggauaugcag

SEQ ID NO: 1018700 - RNA, 22 nt, Human
agagaacacgugcaucugcaau

SEQ ID NO: 1018701 - RNA, 22 nt, Human
augggggccugaacaggcaaaa

SEQ ID NO: 1018702 - RNA, 22 nt, Human
auuuccucaugaucauaaugca

SEQ ID NO: 1018703 - RNA, 22 nt, Human
ugggaccugcuccuggaaugag

SEQ ID NO: 1018704 - RNA, 22 nt, Human
gcugugugacugagagccuggc

SEQ ID NO: 1018705 - RNA, 18 nt, Human
cuguucuagaacuccugu

SEQ ID NO: 1018706 - RNA, 22 nt, Human
uggggacauagccagucuggcu

SEQ ID NO: 1018707 - RNA, 22 nt, Human
ugaaggcuguuggauggggaag

SEQ ID NO: 1018708 - RNA, 23 nt, Human
aaacaugcagcacaugaaugcua

SEQ ID NO: 1018709 - RNA, 22 nt, Human
caggucagagucccccuguccu

SEQ ID NO: 1018710 - RNA, 22 nt, Human
cuuggggcagugcuuggcacau

SEQ ID NO: 1018711 - RNA, 21 nt, Human
gccagggaagagaguuggcug

SEQ ID NO: 1018712 - RNA, 22 nt, Human
cugaaugucgaucagcuugggu

SEQ ID NO: 1018713 - RNA, 22 nt, Human
cacucugaugguuucuguucaa

SEQ ID NO: 1018714 - RNA, 22 nt, Human
acagcuuuucaauucugcugag

SEQ ID NO: 1018715 - RNA, 22 nt, Human
gaugcacagugacccugccagu

SEQ ID NO: 1018716 - RNA, 22 nt, Human
aggcucaggcaggaauggcgga

SEQ ID NO: 1018717 - RNA, 22 nt, Human
ccagcuuuuccucucauugcuu

SEQ ID NO: 1018718 - RNA, 22 nt, Human
agcugccagcaaguuucaaaca

SEQ ID NO: 1018719 - RNA, 22 nt, Human
caggaggcaucauggagcggac

SEQ ID NO: 1018720 - RNA, 22 nt, Human
ccaggccucaccugcccaccua

SEQ ID NO: 1018721 - RNA, 22 nt, Human
gaguuauucuagguccuuugua

SEQ ID NO: 1018722 - RNA, 22 nt, Human
ugccaggaggaggugggacaga

SEQ ID NO: 1018723 - RNA, 23 nt, Human
uccugagaugagacagugcugcc

SEQ ID NO: 1018724 - RNA, 23 nt, Human
uggcagagacccagaaucuacau

SEQ ID NO: 1018725 - RNA, 22 nt, Human
aggcccaguagugcugccuuua

SEQ ID NO: 1018726 - RNA, 22 nt, Human
ggcugcuuuaucggcugcugaa

SEQ ID NO: 1018727 - RNA, 22 nt, Human
gaggaguguauuccacaccacu

SEQ ID NO: 1018728 - RNA, 22 nt, Human
auucucaaacaagugguuugau

SEQ ID NO: 1018729 - RNA, 17 nt, Human
acagagcacaucaagau

SEQ ID NO: 1018730 - RNA, 22 nt, Human
ggucagagggugggcugccugu

SEQ ID NO: 1018731 - RNA, 22 nt, Human
ucuucccuaaucaccaucuuca

SEQ ID NO: 1018732 - RNA, 20 nt, Human
cugugcuuuggaaccuggaa

SEQ ID NO: 1018733 - RNA, 22 nt, Human
ccccuuccacagugcuuccuaa

SEQ ID NO: 1018734 - RNA, 22 nt, Human
gccuucugauaucucuuggcau

SEQ ID NO: 1018735 - RNA, 22 nt, Human
caaauaucuuuggcaaagagaa

SEQ ID NO: 1018736 - RNA, 22 nt, Human
cuugaaagcacuuaguaaauua

SEQ ID NO: 1018737 - RNA, 20 nt, Human
ugcugucguguuuucugcuu

SEQ ID NO: 1018738 - RNA, 22 nt, Human
uggcucagucuggguugacuga

SEQ ID NO: 1018739 - RNA, 22 nt, Human
cucaggauagauuguccucuca

SEQ ID NO: 1018740 - RNA, 22 nt, Human
agcuguccuggcucaggcugug

SEQ ID NO: 1018741 - RNA, 22 nt, Human
aaauucuaugucaauguuuauu

SEQ ID NO: 1018742 - RNA, 22 nt, Human
cagcagagacgguaagcagaac

SEQ ID NO: 1018743 - RNA, 22 nt, Human
aaaauugaagugaucaggaacu

SEQ ID NO: 1018744 - RNA, 22 nt, Human
ucuggcucugaauucacuucug

SEQ ID NO: 1018745 - RNA, 22 nt, Human
aagugacaaaaggguauccaaa

SEQ ID NO: 1018746 - RNA, 22 nt, Human
cuggcuggccggagcgaggcgg

SEQ ID NO: 1018747 - RNA, 22 nt, Human
ugcuguguggaugugaagaauc

SEQ ID NO: 1018748 - RNA, 22 nt, Human
ucauugcauuuauucacuggca

SEQ ID NO: 1018749 - RNA, 22 nt, Human
uucauuccuucccuaagcaacu

SEQ ID NO: 1018750 - RNA, 22 nt, Human
gugucccaggccucuggaauua

SEQ ID NO: 1018751 - RNA, 22 nt, Human
ccaaguacagauuccuccacug

SEQ ID NO: 1018752 - RNA, 22 nt, Human
gcagaggcuccauuuuacagau

SEQ ID NO: 1018753 - RNA, 22 nt, Human
gaggcuggcagaaaagcacagg

SEQ ID NO: 1018754 - RNA, 22 nt, Human
aaguucaagagugacauauuag

SEQ ID NO: 1018755 - RNA, 22 nt, Human
ggugggcaggucacucugccuc

SEQ ID NO: 1018756 - RNA, 22 nt, Human
ggcccagcugugcuuccagccc

SEQ ID NO: 1018757 - RNA, 22 nt, Human
gcaaguuauuuccauuuaaagc

SEQ ID NO: 1018758 - RNA, 22 nt, Human
agaaauguuacaguuguuauuu

SEQ ID NO: 1018759 - RNA, 22 nt, Human
aucagagauggcuccagugcuc

SEQ ID NO: 1018760 - RNA, 22 nt, Human
ucccaaggugcucggcaacagg

SEQ ID NO: 1018761 - RNA, 22 nt, Human
accugcaggcacaggugugcgc

SEQ ID NO: 1018762 - RNA, 17 nt, Human
ugagaaguaggcaucau

SEQ ID NO: 1018763 - RNA, 22 nt, Human
ccucagcucuucccugugcaca

SEQ ID NO: 1018764 - RNA, 22 nt, Human
cagggcuccccgcaccgcagcc

SEQ ID NO: 1018765 - RNA, 22 nt, Human
uccaugaggaccaaauucguag

SEQ ID NO: 1018766 - RNA, 22 nt, Human
augucaaaucaguuuuaucaga

SEQ ID NO: 1018767 - RNA, 22 nt, Human
gaccugccugagcugccucugc

SEQ ID NO: 1018768 - RNA, 22 nt, Human
cuccugggaauuuaguugugag

SEQ ID NO: 1018769 - RNA, 22 nt, Human
agcugcuguggggcucggccug

SEQ ID NO: 1018770 - RNA, 22 nt, Human
gcuccugggcucuaccuugcua

SEQ ID NO: 1018771 - RNA, 21 nt, Human
gggcuggacaugguggcucau

SEQ ID NO: 1018772 - RNA, 21 nt, Human
ugggaccuagcuuugcacagg

SEQ ID NO: 1018773 - RNA, 22 nt, Human
aaggucauuuuuuccucuguug

SEQ ID NO: 1018774 - RNA, 22 nt, Human
cuggcaggagcauucacagagg

SEQ ID NO: 1018775 - RNA, 22 nt, Human
cagacagacagccguggccacc

SEQ ID NO: 1018776 - RNA, 20 nt, Human
uggcccaguggggcagggug

SEQ ID NO: 1018777 - RNA, 19 nt, Human
agcagcuggagguggagug

SEQ ID NO: 1018778 - RNA, 22 nt, Human
uaugagcuuccaguguugcaug

SEQ ID NO: 1018779 - RNA, 22 nt, Human
ccaggagcaacuugaaggcaag

SEQ ID NO: 1018780 - RNA, 22 nt, Human
uauuuaguuaucuuucauaaaa

SEQ ID NO: 1018781 - RNA, 21 nt, Human
ccugggagaauuggguguggc

SEQ ID NO: 1018782 - RNA, 22 nt, Human
agagugggugaucucuguuguc

SEQ ID NO: 1018783 - RNA, 22 nt, Human
accuuucaaaguggcuaucacu

SEQ ID NO: 1018784 - RNA, 22 nt, Human
gcugggcuucucaaugcugccu

SEQ ID NO: 1018785 - RNA, 22 nt, Human
caguguuccaggcggcagugaa

SEQ ID NO: 1018786 - RNA, 22 nt, Human
agaaaauuagauuuuacugugu

SEQ ID NO: 1018787 - RNA, 22 nt, Human
agcuuuaucagaggagucucua

SEQ ID NO: 1018788 - RNA, 22 nt, Human
ugauuuccuagcugacaugaaa

SEQ ID NO: 1018789 - RNA, 22 nt, Human
cagcagggggcagcgcagauca

SEQ ID NO: 1018790 - RNA, 22 nt, Human
guccucuguagggcugggccac

SEQ ID NO: 1018791 - RNA, 22 nt, Human
cccuuucccuucuggcucaggg

SEQ ID NO: 1018792 - RNA, 22 nt, Human
gagguacagaguguuccaaugu

SEQ ID NO: 1018793 - RNA, 22 nt, Human
gagagggccgggggccagcucc

SEQ ID NO: 1018794 - RNA, 22 nt, Human
ggacacaguggaagacagcuug

SEQ ID NO: 1018795 - RNA, 22 nt, Human
uugaauaggacucagcagugau

SEQ ID NO: 1018796 - RNA, 22 nt, Human
auguuauaguuauaaaaugagg

SEQ ID NO: 1018797 - RNA, 22 nt, Human
aggcccuguaagguguggagau

SEQ ID NO: 1018798 - RNA, 22 nt, Human
gagauuucuuuugaugccuguc

SEQ ID NO: 1018799 - RNA, 22 nt, Human
gaagucuucauucucucugaga

SEQ ID NO: 1018800 - RNA, 22 nt, Human
agaagccaacagggcaggagag

SEQ ID NO: 1018801 - RNA, 22 nt, Human
acauguaaaaggaacaugcaug

SEQ ID NO: 1018802 - RNA, 22 nt, Human
cuauuagguuggugcaaaagua

SEQ ID NO: 1018803 - RNA, 22 nt, Human
gccagcugguaggcaccuagcc

SEQ ID NO: 1018804 - RNA, 22 nt, Human
agcugccugggcuuguacaccu

SEQ ID NO: 1018805 - RNA, 22 nt, Human
ucuucuucccaucccucaaaug

SEQ ID NO: 1018806 - RNA, 22 nt, Human
gugccugugcggacucagggaa

SEQ ID NO: 1018807 - RNA, 22 nt, Human
uuuaacacuaguuucuuuaacu

SEQ ID NO: 1018808 - RNA, 22 nt, Human
aucucauaacucauuugaagac

SEQ ID NO: 1018809 - RNA, 22 nt, Human
acaagagauuaucuacagauga

SEQ ID NO: 1018810 - RNA, 22 nt, Human
uuggcaguagugguaguacauu

SEQ ID NO: 1018811 - RNA, 22 nt, Human
gagcucagcacuaaaaucaugu

SEQ ID NO: 1018812 - RNA, 22 nt, Human
gcccaucaucacuguggaggcu

SEQ ID NO: 1018813 - RNA, 22 nt, Human
uagaaauguuagauguauugag

SEQ ID NO: 1018814 - RNA, 22 nt, Human
guggauggacaugggcaagagg

SEQ ID NO: 1018815 - RNA, 22 nt, Human
gaugcugaagugaagugaucuu

SEQ ID NO: 1018816 - RNA, 22 nt, Human
ucacaauauuuaucuuccaauu

SEQ ID NO: 1018817 - RNA, 22 nt, Human
cauuucugggagacaugcuaga

SEQ ID NO: 1018818 - RNA, 22 nt, Human
aguuauaaucugcuacugauau

SEQ ID NO: 1018819 - RNA, 22 nt, Human
agcagggcagcugaugcgcacg

SEQ ID NO: 1018820 - RNA, 22 nt, Human
uccaguggugguuugaagggca

SEQ ID NO: 1018821 - RNA, 22 nt, Human
gcugagcugaggcagggcuggg

SEQ ID NO: 1018822 - RNA, 22 nt, Human
uagccucucuccuccacaaccu

SEQ ID NO: 1018823 - RNA, 22 nt, Human
agauaacuuuuggguauucaug

SEQ ID NO: 1018824 - RNA, 22 nt, Human
uucuucuccgaggagggcuggu

SEQ ID NO: 1018825 - RNA, 20 nt, Human
cugggcagguguuugaucuc

SEQ ID NO: 1018826 - RNA, 22 nt, Human
aaaggucaagcuggacucaggu

SEQ ID NO: 1018827 - RNA, 22 nt, Human
uguguaaagcuuguuccagaaa

SEQ ID NO: 1018828 - RNA, 22 nt, Human
aauaaucucccuuuuuguaugu

SEQ ID NO: 1018829 - RNA, 22 nt, Human
cucaggagaugacagaagguau

SEQ ID NO: 1018830 - RNA, 22 nt, Human
agccaggaaugcaugcucugcu

SEQ ID NO: 1018831 - RNA, 22 nt, Human
aggccuggcaugagaccugaga

SEQ ID NO: 1018832 - RNA, 22 nt, Human
aguccagaccccggcagcuggu

SEQ ID NO: 1018833 - RNA, 22 nt, Human
aggcacuggguaauuaguagcu

SEQ ID NO: 1018834 - RNA, 22 nt, Human
cuggcccagucucagaguguca

SEQ ID NO: 1018835 - RNA, 22 nt, Human
uggagcaggacugcugcccuca

SEQ ID NO: 1018836 - RNA, 22 nt, Human
uccaggcaugguguaauuuugc

SEQ ID NO: 1018837 - RNA, 23 nt, Human
cuuugccacccagagccugacag

SEQ ID NO: 1018838 - RNA, 22 nt, Human
ccuggcugaaccaaugaagugg

SEQ ID NO: 1018839 - RNA, 22 nt, Human
auggcaguuguaugggcuguau

SEQ ID NO: 1018840 - RNA, 22 nt, Human
agaggagcugggaggcccucgu

SEQ ID NO: 1018841 - RNA, 22 nt, Human
uucacaggugacuggggauaac

SEQ ID NO: 1018842 - RNA, 18 nt, Human
uccugccugugccccagg

SEQ ID NO: 1018843 - RNA, 22 nt, Human
uugucuuaaauggauggacaau

SEQ ID NO: 1018844 - RNA, 22 nt, Human
cuggccucaccucagacuuacu

SEQ ID NO: 1018845 - RNA, 22 nt, Human
uggccuuccuggugacucauga

SEQ ID NO: 1018846 - RNA, 21 nt, Human
gcaaggcuuuuguguuuccca

SEQ ID NO: 1018847 - RNA, 22 nt, Human
ucugggugaugaaaugcacugu

SEQ ID NO: 1018848 - RNA, 22 nt, Human
ggggaugguagaccggugacgu

SEQ ID NO: 1018849 - RNA, 22 nt, Human
gucaggauuugaacucaggucu

SEQ ID NO: 1018850 - RNA, 19 nt, Human
caugcugaccugcuguggu

SEQ ID NO: 1018851 - RNA, 22 nt, Human
ugggccugggagggcagacgcu

SEQ ID NO: 1018852 - RNA, 22 nt, Human
agaauuguaagcaauuugauua

SEQ ID NO: 1018853 - RNA, 22 nt, Human
guaagggauuugaacauagguu

SEQ ID NO: 1018854 - RNA, 22 nt, Human
uguggcuuaagaaugccuuuaa

SEQ ID NO: 1018855 - RNA, 22 nt, Human
gcuuugaagacuuuuccagggu

SEQ ID NO: 1018856 - RNA, 22 nt, Human
uguccucuuccagugcuccuuc

SEQ ID NO: 1018857 - RNA, 22 nt, Human
uucaagauggcaccagugagug

SEQ ID NO: 1018858 - RNA, 22 nt, Human
ugagcugggcugggcugagcug

SEQ ID NO: 1018859 - RNA, 22 nt, Human
aagagagaacucccuucgccag

SEQ ID NO: 1018860 - RNA, 22 nt, Human
gugugccaggaacuggcugcug

SEQ ID NO: 1018861 - RNA, 22 nt, Human
aauuucuccaagaaugcuuaga

SEQ ID NO: 1018862 - RNA, 22 nt, Human
ucccaggaauugaagccagugu

SEQ ID NO: 1018863 - RNA, 22 nt, Human
aagugaaacauguaucucuuua

SEQ ID NO: 1018864 - RNA, 22 nt, Human
aagcugaggcccauggcaaggu

SEQ ID NO: 1018865 - RNA, 22 nt, Human
gcaggggcugcugggaacucgg

SEQ ID NO: 1018866 - RNA, 22 nt, Human
aucacauuguuagcauagacug

SEQ ID NO: 1018867 - RNA, 22 nt, Human
gugccugggcaugagcuuguug

SEQ ID NO: 1018868 - RNA, 22 nt, Human
ugagggaggcccuuugagcaga

SEQ ID NO: 1018869 - RNA, 22 nt, Human
cucuccuccaacagcccugccg

SEQ ID NO: 1018870 - RNA, 22 nt, Human
caaaguauauuggauugaaugg

SEQ ID NO: 1018871 - RNA, 22 nt, Human
cagggcagugaagaacacacgu

SEQ ID NO: 1018872 - RNA, 22 nt, Human
cuuucacagcugugcuuaugau

SEQ ID NO: 1018873 - RNA, 22 nt, Human
agaccaagugcaggugccacua

SEQ ID NO: 1018874 - RNA, 22 nt, Human
ggaagagggaaccacgacugua

SEQ ID NO: 1018875 - RNA, 22 nt, Human
agagccugucaauuguaaagag

SEQ ID NO: 1018876 - RNA, 22 nt, Human
uucauucauuacgugccaggca

SEQ ID NO: 1018877 - RNA, 22 nt, Human
cugcagggcccgccugagcccu

SEQ ID NO: 1018878 - RNA, 22 nt, Human
gugggcaaggucccugccagcu

SEQ ID NO: 1018879 - RNA, 22 nt, Human
gaaugugucacccugucccaug

SEQ ID NO: 1018880 - RNA, 22 nt, Human
ggucccagcuggucacugucag

SEQ ID NO: 1018881 - RNA, 22 nt, Human
uagaaaucagguuuuuagaaag

SEQ ID NO: 1018882 - RNA, 22 nt, Human
ucauuacaguguuuauaugucu

SEQ ID NO: 1018883 - RNA, 22 nt, Human
ugggcagagucauacaggagac

SEQ ID NO: 1018884 - RNA, 22 nt, Human
agagccugucugccuuucuacc

SEQ ID NO: 1018885 - RNA, 22 nt, Human
agccaagcugaucuccugcuga

SEQ ID NO: 1018886 - RNA, 22 nt, Human
gcagcagaugcuuucauggaca

SEQ ID NO: 1018887 - RNA, 23 nt, Human
acaaaugcccauacaucuaguuc

SEQ ID NO: 1018888 - RNA, 22 nt, Human
ugucuccucauacugucauauu

SEQ ID NO: 1018889 - RNA, 22 nt, Human
aucccaugagaccacguuggcu

SEQ ID NO: 1018890 - RNA, 17 nt, Human
uucaaagcuuaucaagg

SEQ ID NO: 1018891 - RNA, 22 nt, Human
uuugcagugucagcuucugugu

SEQ ID NO: 1018892 - RNA, 22 nt, Human
agcagcucacaggauuccugaa

SEQ ID NO: 1018893 - RNA, 22 nt, Human
guagcuuaugaaaugugagggg

SEQ ID NO: 1018894 - RNA, 22 nt, Human
cagaagagaugaaauaguauua

SEQ ID NO: 1018895 - RNA, 22 nt, Human
cuucuaggcuucucagggggca

SEQ ID NO: 1018896 - RNA, 23 nt, Human
ucccagccucuucucuugcauac

SEQ ID NO: 1018897 - RNA, 22 nt, Human
uuccagauuucuacacaagacc

SEQ ID NO: 1018898 - RNA, 22 nt, Human
cagcccuggugccaagguuccc

SEQ ID NO: 1018899 - RNA, 22 nt, Human
ccagugugggcccggccuccuc

SEQ ID NO: 1018900 - RNA, 22 nt, Human
gcacagggcccugugcguaggu

SEQ ID NO: 1018901 - RNA, 22 nt, Human
acugugugggccgcucacuggg

SEQ ID NO: 1018902 - RNA, 22 nt, Human
ucuguucaucucaugggagaau

SEQ ID NO: 1018903 - RNA, 22 nt, Human
cagagacagggcagggagugug

SEQ ID NO: 1018904 - RNA, 22 nt, Human
cagggagaggcaucauagggaa

SEQ ID NO: 1018905 - RNA, 22 nt, Human
uguggucucguuauguugccca

SEQ ID NO: 1018906 - RNA, 22 nt, Human
gcccaggagguugggcugugca

SEQ ID NO: 1018907 - RNA, 22 nt, Human
ggauaagaaaauuguaauaacu

SEQ ID NO: 1018908 - RNA, 22 nt, Human
ccugccagcccgcguucaugcc

SEQ ID NO: 1018909 - RNA, 21 nt, Human
agcugcuccagggagcucagg

SEQ ID NO: 1018910 - RNA, 22 nt, Human
aaauguauugcauaggauauuu

SEQ ID NO: 1018911 - RNA, 22 nt, Human
cagacuugacggcagcugcuuu

SEQ ID NO: 1018912 - RNA, 22 nt, Human
acagccaggagccaugggcagg

SEQ ID NO: 1018913 - RNA, 22 nt, Human
cagaagcauuccagcaaauagu

SEQ ID NO: 1018914 - RNA, 22 nt, Human
gccaggcuggucuugaacuccu

SEQ ID NO: 1018915 - RNA, 22 nt, Human
caauaugcaagcuauuaaguau

SEQ ID NO: 1018916 - RNA, 22 nt, Human
ucuacugcacuggugucucauc

SEQ ID NO: 1018917 - RNA, 22 nt, Human
uauauuuaaauccagguugaaa

SEQ ID NO: 1018918 - RNA, 22 nt, Human
ucauuucccuccuacaaagagg

SEQ ID NO: 1018919 - RNA, 22 nt, Human
cacacaggaugaagcagcagaa

SEQ ID NO: 1018920 - RNA, 22 nt, Human
uggcccugaggggcugugcccc

SEQ ID NO: 1018921 - RNA, 20 nt, Human
ggagcugcccugggcuggag

SEQ ID NO: 1018922 - RNA, 22 nt, Human
gagcucaggagcaucagaagaa

SEQ ID NO: 1018923 - RNA, 22 nt, Human
cugucaguaggcucccaucauu

SEQ ID NO: 1018924 - RNA, 22 nt, Human
uccagccaagccuugguagcug

SEQ ID NO: 1018925 - RNA, 22 nt, Human
caguggguggcuaaguggcuga

SEQ ID NO: 1018926 - RNA, 22 nt, Human
uaucuuuagaggaagagaaucu

SEQ ID NO: 1018927 - RNA, 22 nt, Human
uggcucuggcgugaagcccaga

SEQ ID NO: 1018928 - RNA, 22 nt, Human
gacucagugauuugacaugccu

SEQ ID NO: 1018929 - RNA, 22 nt, Human
auaaggcaucucucaguuagca

SEQ ID NO: 1018930 - RNA, 22 nt, Human
ggcacugaaguggguguugggu

SEQ ID NO: 1018931 - RNA, 22 nt, Human
ucuucuuccucauuuauacaua

SEQ ID NO: 1018932 - RNA, 22 nt, Human
aggaggcuguggagcacuccau

SEQ ID NO: 1018933 - RNA, 22 nt, Human
ggggcugggauuugaacccagg

SEQ ID NO: 1018934 - RNA, 22 nt, Human
ggccauggaccccgagcugacc

SEQ ID NO: 1018935 - RNA, 22 nt, Human
uugcugaauugaauccuuuggu

SEQ ID NO: 1018936 - RNA, 22 nt, Human
guuuucaaggggauuuaacuga

SEQ ID NO: 1018937 - RNA, 22 nt, Human
cucugagcccgcugcagcccca

SEQ ID NO: 1018938 - RNA, 22 nt, Human
gagauucuguagucaggcaucu

SEQ ID NO: 1018939 - RNA, 22 nt, Human
gggcucugguacuuccuggcuc

SEQ ID NO: 1018940 - RNA, 22 nt, Human
ugcacccucaucagucaaaugg

SEQ ID NO: 1018941 - RNA, 22 nt, Human
aaggcacuuuucuaaagaccuu

SEQ ID NO: 1018942 - RNA, 22 nt, Human
gcagauggugggggaggaguac

SEQ ID NO: 1018943 - RNA, 22 nt, Human
uuguuuguaugcugagaagaau

SEQ ID NO: 1018944 - RNA, 21 nt, Human
cugugcuucuuccuaagccag

SEQ ID NO: 1018945 - RNA, 22 nt, Human
guuugcauguguacuuaauugg

SEQ ID NO: 1018946 - RNA, 22 nt, Human
gaggaaccacucugagaagcca

SEQ ID NO: 1018947 - RNA, 22 nt, Human
acaggugggcuuaagagucggc

SEQ ID NO: 1018948 - RNA, 18 nt, Human
gugacagcugcuagcuca

SEQ ID NO: 1018949 - RNA, 22 nt, Human
ccugggaagagcugacaggagg

SEQ ID NO: 1018950 - RNA, 22 nt, Human
ugcuggccgugagcucucggga

SEQ ID NO: 1018951 - RNA, 22 nt, Human
gagagaagggggauaugagccu

SEQ ID NO: 1018952 - RNA, 22 nt, Human
uuucauugucuacauaugacau

SEQ ID NO: 1018953 - RNA, 22 nt, Human
ccuggcuccugccucugcaggg

SEQ ID NO: 1018954 - RNA, 22 nt, Human
uaacacaugguucugucaggaa

SEQ ID NO: 1018955 - RNA, 22 nt, Human
gugccagcaguuauggugauuu

SEQ ID NO: 1018956 - RNA, 22 nt, Human
cuucagaagaaaagcagugugu

SEQ ID NO: 1018957 - RNA, 22 nt, Human
ucacauuuuauaucucugguuu

SEQ ID NO: 1018958 - RNA, 22 nt, Human
gcugcugugaauuuuuuaaaug

SEQ ID NO: 1018959 - RNA, 22 nt, Human
aggcuucccaagcagcugcaaa

SEQ ID NO: 1018960 - RNA, 22 nt, Human
agcaauauuuaaagguuugcaa

SEQ ID NO: 1018961 - RNA, 22 nt, Human
ugcaggggcuugucugggccug

SEQ ID NO: 1018962 - RNA, 22 nt, Human
guggcugcagagccagcaagcu

SEQ ID NO: 1018963 - RNA, 22 nt, Human
ucuaggagcaugaagggaaggc

SEQ ID NO: 1018964 - RNA, 22 nt, Human
gucagugucuuaacagagauua

SEQ ID NO: 1018965 - RNA, 22 nt, Human
uggaaggagcuaaggaccuggg

SEQ ID NO: 1018966 - RNA, 22 nt, Human
caguuuuuagauuaguuggugg

SEQ ID NO: 1018967 - RNA, 22 nt, Human
aggcagagaaaaaccagauaug

SEQ ID NO: 1018968 - RNA, 22 nt, Human
ugugcccaucccucuggagugu

SEQ ID NO: 1018969 - RNA, 22 nt, Human
guccucagagugggcagguccu

SEQ ID NO: 1018970 - RNA, 22 nt, Human
uguaugaagccagaaucuguuu

SEQ ID NO: 1018971 - RNA, 22 nt, Human
gcguaaggccucuggucucgga

SEQ ID NO: 1018972 - RNA, 22 nt, Human
ccuguucagagcuaagcaucau

SEQ ID NO: 1018973 - RNA, 22 nt, Human
uaucuguucaauggaagaugac

SEQ ID NO: 1018974 - RNA, 22 nt, Human
uuucaguucaguuuauuauauc

SEQ ID NO: 1018975 - RNA, 22 nt, Human
ucagagugaggcccagcaaucu

SEQ ID NO: 1018976 - RNA, 22 nt, Human
acuuucuccagaaaaccaagga

SEQ ID NO: 1018977 - RNA, 18 nt, Human
ccugccagucuggagcag

SEQ ID NO: 1018978 - RNA, 22 nt, Human
gauuucuuugcaagcuguguuc

SEQ ID NO: 1018979 - RNA, 22 nt, Human
ccuuuuucccuggagggacagc

SEQ ID NO: 1018980 - RNA, 22 nt, Human
uugauacaggccuucuagauga

SEQ ID NO: 1018981 - RNA, 22 nt, Human
gcagagugggagcccagggcug

SEQ ID NO: 1018982 - RNA, 22 nt, Human
ugagcuucaaaauaugugaauc

SEQ ID NO: 1018983 - RNA, 22 nt, Human
cacaggugcuccucggggagcu

SEQ ID NO: 1018984 - RNA, 22 nt, Human
gccucgaggcugagaaggcaca

SEQ ID NO: 1018985 - RNA, 22 nt, Human
ugcaccauacccauuccccucu

SEQ ID NO: 1018986 - RNA, 22 nt, Human
ugcucuggggagcuccucugcg

SEQ ID NO: 1018987 - RNA, 22 nt, Human
ugugugacccccagugaagccu

SEQ ID NO: 1018988 - RNA, 22 nt, Human
gagagcugggggacuguggaug

SEQ ID NO: 1018989 - RNA, 22 nt, Human
ugacagaaauaguucuuaauuu

SEQ ID NO: 1018990 - RNA, 22 nt, Human
uuugcuuguucaagauuucugu

SEQ ID NO: 1018991 - RNA, 22 nt, Human
cagggccagagagggcuggcug

SEQ ID NO: 1018992 - RNA, 22 nt, Human
guggguggaucaccugagguca

SEQ ID NO: 1018993 - RNA, 22 nt, Human
ccagcacugcucucagacugag

SEQ ID NO: 1018994 - RNA, 22 nt, Human
ugagcccagagaucugagcuau

SEQ ID NO: 1018995 - RNA, 22 nt, Human
ugugaaauucuugaaaugcaca

SEQ ID NO: 1018996 - RNA, 17 nt, Human
uccaggcagcaacugag

SEQ ID NO: 1018997 - RNA, 22 nt, Human
uuugaaauuaagauauugucca

SEQ ID NO: 1018998 - RNA, 22 nt, Human
ugggcagacgcuguuggaaggc

SEQ ID NO: 1018999 - RNA, 22 nt, Human
uccaucagauucccuccugaga

SEQ ID NO: 1019000 - RNA, 22 nt, Human
gccaggggacgcggagcgacga

SEQ ID NO: 1019001 - RNA, 22 nt, Human
caguacuuugcaucauuccacu

SEQ ID NO: 1019002 - RNA, 22 nt, Human
acugccaggauggcacuagagg

SEQ ID NO: 1019003 - RNA, 22 nt, Human
auuagcugaccucuaaggagcc

SEQ ID NO: 1019004 - RNA, 22 nt, Human
aauaugcauguauacaugugua

SEQ ID NO: 1019005 - RNA, 22 nt, Human
ggaggccuagccagcuccaguu

SEQ ID NO: 1019006 - RNA, 22 nt, Human
gcucucuguuauuaagaucuuu

SEQ ID NO: 1019007 - RNA, 19 nt, Human
uuagaaacuguugacacug

SEQ ID NO: 1019008 - RNA, 22 nt, Human
gucccagaggcuuuggccacag

SEQ ID NO: 1019009 - RNA, 22 nt, Human
auagaacagaaacagaugcaca

SEQ ID NO: 1019010 - RNA, 22 nt, Human
agaagcugccuacaugaccagc

SEQ ID NO: 1019011 - RNA, 22 nt, Human
cagcuggcccuuugguagccuu

SEQ ID NO: 1019012 - RNA, 18 nt, Human
ucucugaauauuuuaugu

SEQ ID NO: 1019013 - RNA, 22 nt, Human
auguuuccgugagcauccuuga

SEQ ID NO: 1019014 - RNA, 22 nt, Human
augcccaaugucacaauuuuug

SEQ ID NO: 1019015 - RNA, 22 nt, Human
acaggcaggcuucggccagagc

SEQ ID NO: 1019016 - RNA, 22 nt, Human
gcauggcagugaggauggugcu

SEQ ID NO: 1019017 - RNA, 18 nt, Human
uccagagcuacuguggug

SEQ ID NO: 1019018 - RNA, 22 nt, Human
cugcaggggccucgagcacagg

SEQ ID NO: 1019019 - RNA, 22 nt, Human
ugcaugcugcacacaugcguag

SEQ ID NO: 1019020 - RNA, 22 nt, Human
uacauaauaaggggcauggugu

SEQ ID NO: 1019021 - RNA, 21 nt, Human
uuuuuucuugcgugaggccug

SEQ ID NO: 1019022 - RNA, 22 nt, Human
gcugucacucaccaggccugca

SEQ ID NO: 1019023 - RNA, 22 nt, Human
cuggcaggaaguuagaugguaa

SEQ ID NO: 1019024 - RNA, 22 nt, Human
ucagaagacuacuaggacacau

SEQ ID NO: 1019025 - RNA, 22 nt, Human
uggagccagagcgcagccuggg

SEQ ID NO: 1019026 - RNA, 22 nt, Human
gccugcugaaccucaugcaguc

SEQ ID NO: 1019027 - RNA, 22 nt, Human
gagugucugaauuagagcacaa

SEQ ID NO: 1019028 - RNA, 16 nt, Human
cagaguguaaacagga

SEQ ID NO: 1019029 - RNA, 22 nt, Human
cauuuccagcuccugcaucaug

SEQ ID NO: 1019030 - RNA, 22 nt, Human
aggccuguuccuuccugggcac

SEQ ID NO: 1019031 - RNA, 22 nt, Human
cgggcagaucacacagggcuug

SEQ ID NO: 1019032 - RNA, 22 nt, Human
gacagggccgcagauggagacu

SEQ ID NO: 1019033 - RNA, 22 nt, Human
ucaggcugugggcacuggccau

SEQ ID NO: 1019034 - RNA, 22 nt, Human
cuguucucuggcgguggcuguu

SEQ ID NO: 1019035 - RNA, 22 nt, Human
agucacccuccaacucuccacu

SEQ ID NO: 1019036 - RNA, 22 nt, Human
ugaaggaagaauaggcaguguu

SEQ ID NO: 1019037 - RNA, 22 nt, Human
uauccuuguacuauaguauuua

SEQ ID NO: 1019038 - RNA, 22 nt, Human
gagaggugaauguggaugccac

SEQ ID NO: 1019039 - RNA, 19 nt, Human
acagaaauguaagugagac

SEQ ID NO: 1019040 - RNA, 22 nt, Human
gagcagugguugaacagaggca

SEQ ID NO: 1019041 - RNA, 22 nt, Human
ugaaccagagucuccagugguu

SEQ ID NO: 1019042 - RNA, 22 nt, Human
gcagccacuaguuuuccuguuu

SEQ ID NO: 1019043 - RNA, 22 nt, Human
cugucuccagggcaggugcagg

SEQ ID NO: 1019044 - RNA, 23 nt, Human
agcuucauugaccuccgcagggg

SEQ ID NO: 1019045 - RNA, 20 nt, Human
aucuggcucagauccugcag

SEQ ID NO: 1019046 - RNA, 20 nt, Human
uccuggccuucucgggcagu

SEQ ID NO: 1019047 - RNA, 22 nt, Human
uaaugaauaaacuugagaguca

SEQ ID NO: 1019048 - RNA, 22 nt, Human
ccucagcugcuucccuggagcc

SEQ ID NO: 1019049 - RNA, 22 nt, Human
auaagagcuagucuuuuccuug

SEQ ID NO: 1019050 - RNA, 22 nt, Human
gcucugcucuaacauuccugac

SEQ ID NO: 1019051 - RNA, 22 nt, Human
caucacagauguuguguggagu

SEQ ID NO: 1019052 - RNA, 22 nt, Human
ggugcagaggagccagcugggg

SEQ ID NO: 1019053 - RNA, 22 nt, Human
ggagccugugggaugagaugug

SEQ ID NO: 1019054 - RNA, 22 nt, Human
cugggacccugcccuguggccu

SEQ ID NO: 1019055 - RNA, 22 nt, Human
cuguuaaucugcuugcaugaug

SEQ ID NO: 1019056 - RNA, 22 nt, Human
ugcucacugaacucuugcuguc

SEQ ID NO: 1019057 - RNA, 22 nt, Human
agaaaacuugucacagcucuca

SEQ ID NO: 1019058 - RNA, 22 nt, Human
ccuggcagguggcgcccucggc

SEQ ID NO: 1019059 - RNA, 22 nt, Human
ccagagaggccaaggucguggu

SEQ ID NO: 1019060 - RNA, 22 nt, Human
aacaguaacgagauguccuaac

SEQ ID NO: 1019061 - RNA, 22 nt, Human
gcaucuuucuguccauucagca

SEQ ID NO: 1019062 - RNA, 22 nt, Human
gccaggcucucagugacugccc

SEQ ID NO: 1019063 - RNA, 22 nt, Human
uucaugugaucacagauuguaa

SEQ ID NO: 1019064 - RNA, 22 nt, Human
uccuucagggggccgccugcac

SEQ ID NO: 1019065 - RNA, 22 nt, Human
cagguccccuccccuaccaggc

SEQ ID NO: 1019066 - RNA, 22 nt, Human
ugcuggggcucugaccacucca

SEQ ID NO: 1019067 - RNA, 22 nt, Human
uagagcugaguugacuccauuu

SEQ ID NO: 1019068 - RNA, 20 nt, Human
aggcagagcgcacuuuuaga

SEQ ID NO: 1019069 - RNA, 22 nt, Human
aaggaagggaaauagugauguc

SEQ ID NO: 1019070 - RNA, 22 nt, Human
agcuagaauguuccuuuucauu

SEQ ID NO: 1019071 - RNA, 22 nt, Human
aagucacacuagacaacugagg

SEQ ID NO: 1019072 - RNA, 22 nt, Human
gcagagccgugaauggauuuca

SEQ ID NO: 1019073 - RNA, 22 nt, Human
aaagguuaagguguucaagaaa

SEQ ID NO: 1019074 - RNA, 22 nt, Human
guuucacagucugcagaauuuu

SEQ ID NO: 1019075 - RNA, 20 nt, Human
aagggcagagggaacagacu

SEQ ID NO: 1019076 - RNA, 22 nt, Human
auguagaauggugauuggcagg

SEQ ID NO: 1019077 - RNA, 22 nt, Human
uggcacugaaaaaggagagguu

SEQ ID NO: 1019078 - RNA, 22 nt, Human
agggaaggaaaagcugucgcuu

SEQ ID NO: 1019079 - RNA, 22 nt, Human
ucugcuguaaagaauuucugcc

SEQ ID NO: 1019080 - RNA, 22 nt, Human
ucccagaggacuguuggugcua

SEQ ID NO: 1019081 - RNA, 22 nt, Human
gccagguggcugagcagcugca

SEQ ID NO: 1019082 - RNA, 22 nt, Human
gccacaggcacuuaagggcugg

SEQ ID NO: 1019083 - RNA, 22 nt, Human
acccaggguagagugcaguggc

SEQ ID NO: 1019084 - RNA, 22 nt, Human
gcuggagguagggagguccugu

SEQ ID NO: 1019085 - RNA, 22 nt, Human
aggcagaggagaaugaucuucc

SEQ ID NO: 1019086 - RNA, 22 nt, Human
ucaguguaaguuauguagaugu

SEQ ID NO: 1019087 - RNA, 22 nt, Human
ugggaccuguuacauugaguua

SEQ ID NO: 1019088 - RNA, 22 nt, Human
uagcuuuaaaaaucaucaaagc

SEQ ID NO: 1019089 - RNA, 19 nt, Human
gcagccaggugcucuaccu

SEQ ID NO: 1019090 - RNA, 22 nt, Human
ucucucagucagaugcuaaaga

SEQ ID NO: 1019091 - RNA, 22 nt, Human
aggaugaauaacugaaauggug

SEQ ID NO: 1019092 - RNA, 22 nt, Human
cugagccaaccacagcaggagc

SEQ ID NO: 1019093 - RNA, 22 nt, Human
ucccagaguucaaugggaaggu

SEQ ID NO: 1019094 - RNA, 22 nt, Human
ggggaccuuuccauuucugaga

SEQ ID NO: 1019095 - RNA, 22 nt, Human
ucaucucaaaacccaaggggca

SEQ ID NO: 1019096 - RNA, 22 nt, Human
aucauucuaguccuuauggucu

SEQ ID NO: 1019097 - RNA, 22 nt, Human
agaauaugaucggaauacagau

SEQ ID NO: 1019098 - RNA, 20 nt, Human
ccaggccugggccugcucua

SEQ ID NO: 1019099 - RNA, 22 nt, Human
cugccgaguacagccauagaaa

SEQ ID NO: 1019100 - RNA, 22 nt, Human
gccaggcagauaugugagcuua

SEQ ID NO: 1019101 - RNA, 22 nt, Human
acuuccugcuaugagcuucugu

SEQ ID NO: 1019102 - RNA, 22 nt, Human
aggcuguggugcugaaggaggg

SEQ ID NO: 1019103 - RNA, 22 nt, Human
agcaggcuuucaagagucuucu

SEQ ID NO: 1019104 - RNA, 22 nt, Human
ccuguguggccaggcuggaguc

SEQ ID NO: 1019105 - RNA, 22 nt, Human
ugagccugcugucgcuggaccc

SEQ ID NO: 1019106 - RNA, 22 nt, Human
ccugauggagcccugcugcaug

SEQ ID NO: 1019107 - RNA, 22 nt, Human
aucccuggacggcgccucccca

SEQ ID NO: 1019108 - RNA, 22 nt, Human
uuuauuauagugguggggacug

SEQ ID NO: 1019109 - RNA, 21 nt, Human
ugucagagcuuguaggacauu

SEQ ID NO: 1019110 - RNA, 22 nt, Human
cugggccuagaggaagcugaca

SEQ ID NO: 1019111 - RNA, 18 nt, Human
aaggcuucaaagaguaga

SEQ ID NO: 1019112 - RNA, 20 nt, Human
ucacauccucucccaacaug

SEQ ID NO: 1019113 - RNA, 22 nt, Human
ccagagaguaucauggagagua

SEQ ID NO: 1019114 - RNA, 22 nt, Human
cagugauguuucugcaucagag

SEQ ID NO: 1019115 - RNA, 22 nt, Human
ugugaaaagggcuuuguacaaa

SEQ ID NO: 1019116 - RNA, 22 nt, Human
auguagagcaguguuguccaau

SEQ ID NO: 1019117 - RNA, 20 nt, Human
ugcucugucuaaaacuuccc

SEQ ID NO: 1019118 - RNA, 22 nt, Human
agagcagguggcaacucuggga

SEQ ID NO: 1019119 - RNA, 22 nt, Human
ggucauuguucuuuucugugau

SEQ ID NO: 1019120 - RNA, 22 nt, Human
uaacagaaaggcucaggugcuc

SEQ ID NO: 1019121 - RNA, 22 nt, Human
uugguuuacuaggauucaaauu

SEQ ID NO: 1019122 - RNA, 22 nt, Human
caaagguauucucauuuuggaa

SEQ ID NO: 1019123 - RNA, 22 nt, Human
cagccagcuucagauccaagcc

SEQ ID NO: 1019124 - RNA, 22 nt, Human
cuuccuguugucacagucugcg

SEQ ID NO: 1019125 - RNA, 22 nt, Human
cccugcagacgucuugaugccu

SEQ ID NO: 1019126 - RNA, 23 nt, Human
uggcucugagagguucagaugcu

SEQ ID NO: 1019127 - RNA, 22 nt, Human
uagagcuauuuagagcauuuua

SEQ ID NO: 1019128 - RNA, 22 nt, Human
aauccugugugacucuggggag

SEQ ID NO: 1019129 - RNA, 22 nt, Human
uuuccauauucugcgucugcca

SEQ ID NO: 1019130 - RNA, 22 nt, Human
uuacuuuguucucaagauaugu

SEQ ID NO: 1019131 - RNA, 22 nt, Human
cugggcaguuuauucaguucug

SEQ ID NO: 1019132 - RNA, 22 nt, Human
gugguaauagagcuccaaacua

SEQ ID NO: 1019133 - RNA, 22 nt, Human
caaauagugucacauugugagg

SEQ ID NO: 1019134 - RNA, 23 nt, Human
aaccagauaaauggcuccagggc

SEQ ID NO: 1019135 - RNA, 22 nt, Human
cagccugcuagggcaaugccuu

SEQ ID NO: 1019136 - RNA, 22 nt, Human
cucuggaguucuucaagcuacu

SEQ ID NO: 1019137 - RNA, 22 nt, Human
cuggcugccacuucagggucuu

SEQ ID NO: 1019138 - RNA, 22 nt, Human
ucagaaaugaucguuauucauu

SEQ ID NO: 1019139 - RNA, 22 nt, Human
ucaucaguuuagaaaaaauaug

SEQ ID NO: 1019140 - RNA, 22 nt, Human
uucugucauuuagcauugucau

SEQ ID NO: 1019141 - RNA, 22 nt, Human
gcuggagauaguaggauccaua

SEQ ID NO: 1019142 - RNA, 22 nt, Human
uaauuauucuagucacauagca

SEQ ID NO: 1019143 - RNA, 22 nt, Human
aguuaaagucugaaauagagaa

SEQ ID NO: 1019144 - RNA, 20 nt, Human
agaggcuuccuugggaggag

SEQ ID NO: 1019145 - RNA, 22 nt, Human
acuuaaaaacagauccagcagg

SEQ ID NO: 1019146 - RNA, 22 nt, Human
uaaggccaauuacauauguuca

SEQ ID NO: 1019147 - RNA, 22 nt, Human
ugcagaggugaaagacuagcaa

SEQ ID NO: 1019148 - RNA, 22 nt, Human
cagccagcuggcacugugagua

SEQ ID NO: 1019149 - RNA, 22 nt, Human
auguagcaugaggcacugugcc

SEQ ID NO: 1019150 - RNA, 22 nt, Human
aauguucagaggacaauauaaa

SEQ ID NO: 1019151 - RNA, 22 nt, Human
acaaaugugucuaauugugccu

SEQ ID NO: 1019152 - RNA, 22 nt, Human
gaggccuguagucauggaugua

SEQ ID NO: 1019153 - RNA, 21 nt, Human
ggagcugcaggagccgaaggc

SEQ ID NO: 1019154 - RNA, 22 nt, Human
gcaggcuccaggccggccccuu

SEQ ID NO: 1019155 - RNA, 22 nt, Human
ccacagggcacagacaggaagc

SEQ ID NO: 1019156 - RNA, 21 nt, Human
aaugcauuaacauaaagcuga

SEQ ID NO: 1019157 - RNA, 19 nt, Human
gcuuuuuguugucaaaggu

SEQ ID NO: 1019158 - RNA, 22 nt, Human
ugauuucauaguauauacauga

SEQ ID NO: 1019159 - RNA, 22 nt, Human
aggcucagaggugagcaucugc

SEQ ID NO: 1019160 - RNA, 23 nt, Human
cauuucugggagauuuauaaaau

SEQ ID NO: 1019161 - RNA, 22 nt, Human
ugaaauguuugaagaccacuga

SEQ ID NO: 1019162 - RNA, 23 nt, Human
agaauuguaaauagaauauaccu

SEQ ID NO: 1019163 - RNA, 22 nt, Human
cccaggcaggagugugguggcu

SEQ ID NO: 1019164 - RNA, 22 nt, Human
aggcaguuguugcugagcagcu

SEQ ID NO: 1019165 - RNA, 22 nt, Human
aggcagcaugcucugcuucuac

SEQ ID NO: 1019166 - RNA, 22 nt, Human
uucuucuucuggcugcaccugg

SEQ ID NO: 1019167 - RNA, 22 nt, Human
caggggcuguggcacauggugu

SEQ ID NO: 1019168 - RNA, 22 nt, Human
ugggacagggaaucugaucccc

SEQ ID NO: 1019169 - RNA, 22 nt, Human
gccagggcaggggagcaucugc

SEQ ID NO: 1019170 - RNA, 22 nt, Human
aaggcuuucagcuaacuugauu

SEQ ID NO: 1019171 - RNA, 22 nt, Human
cacuuagucucaccaguucagu

SEQ ID NO: 1019172 - RNA, 19 nt, Human
ugagugggccccugcagac

SEQ ID NO: 1019173 - RNA, 22 nt, Human
uaaacagaaagcagauguacuu

SEQ ID NO: 1019174 - RNA, 22 nt, Human
uugauuccuugaaauauccuug

SEQ ID NO: 1019175 - RNA, 22 nt, Human
cagagccaggccugcccucuuu

SEQ ID NO: 1019176 - RNA, 20 nt, Human
acaaaauagguacuggguag

SEQ ID NO: 1019177 - RNA, 22 nt, Human
uuguuauaaagacuaaauaugu

SEQ ID NO: 1019178 - RNA, 22 nt, Human
gggcuggaggagauccagaggc

SEQ ID NO: 1019179 - RNA, 22 nt, Human
aucacauugccagugauuaccc

SEQ ID NO: 1019180 - RNA, 22 nt, Human
ugcagcucugaacagucaugaa

SEQ ID NO: 1019181 - RNA, 22 nt, Human
uuucaguuuuugcucgauguau

SEQ ID NO: 1019182 - RNA, 22 nt, Human
agcugguaugaacaggauagga

SEQ ID NO: 1019183 - RNA, 22 nt, Human
aggcacugaagugguaaaugua

SEQ ID NO: 1019184 - RNA, 22 nt, Human
caugaagcuugaagcaguccac

SEQ ID NO: 1019185 - RNA, 22 nt, Human
aaggcugaggagggccugcagg

SEQ ID NO: 1019186 - RNA, 22 nt, Human
augucccuugucugugaugucu

SEQ ID NO: 1019187 - RNA, 19 nt, Human
acucaagucuaaugaaauc

SEQ ID NO: 1019188 - RNA, 18 nt, Human
cuuguucuucucuuggcg

SEQ ID NO: 1019189 - RNA, 22 nt, Human
agccugucugucuccaaagcug

SEQ ID NO: 1019190 - RNA, 22 nt, Human
gcugugcagccaagugccucug

SEQ ID NO: 1019191 - RNA, 22 nt, Human
cugccuguuagucuagcaguua

SEQ ID NO: 1019192 - RNA, 22 nt, Human
uuagccauugucagcacauggc

SEQ ID NO: 1019193 - RNA, 22 nt, Human
ucagcuuuuaaaaacaagaagu

SEQ ID NO: 1019194 - RNA, 22 nt, Human
ucuuuuggguucuuaugauuua

SEQ ID NO: 1019195 - RNA, 22 nt, Human
gcuguuccugcuuagaggucgg

SEQ ID NO: 1019196 - RNA, 22 nt, Human
auuugcuugugcuaugaaaguu

SEQ ID NO: 1019197 - RNA, 22 nt, Human
gcucccugaaaagaacaaaguc

SEQ ID NO: 1019198 - RNA, 22 nt, Human
cagacaggaauucuggcguggu

SEQ ID NO: 1019199 - RNA, 19 nt, Human
guaagggcuaauggacuau

SEQ ID NO: 1019200 - RNA, 22 nt, Human
cauugcaccacauugcaucccu

SEQ ID NO: 1019201 - RNA, 22 nt, Human
auagucuuagucuauaguuuug

SEQ ID NO: 1019202 - RNA, 22 nt, Human
agcaccugcuugugacuaggga

SEQ ID NO: 1019203 - RNA, 22 nt, Human
cuucaugcugauauccucgaug

SEQ ID NO: 1019204 - RNA, 19 nt, Human
agcagccaucgaccaugga

SEQ ID NO: 1019205 - RNA, 22 nt, Human
cugucacacugauaucaggcuu

SEQ ID NO: 1019206 - RNA, 22 nt, Human
acuuccuguuaugugugccucu

SEQ ID NO: 1019207 - RNA, 22 nt, Human
ggguccagaguugaagagguua

SEQ ID NO: 1019208 - RNA, 22 nt, Human
agggcuccaggggcugggugac

SEQ ID NO: 1019209 - RNA, 22 nt, Human
ucuccucuauuucuguauguau

SEQ ID NO: 1019210 - RNA, 20 nt, Human
ggguggaguugcggucugug

SEQ ID NO: 1019211 - RNA, 22 nt, Human
uagaaaguaaaucaguuuuauu

SEQ ID NO: 1019212 - RNA, 20 nt, Human
agcaguaggaccucugggcc

SEQ ID NO: 1019213 - RNA, 22 nt, Human
cucccugggcagauguggcucu

SEQ ID NO: 1019214 - RNA, 22 nt, Human
augcugugauuguagaaauauu

SEQ ID NO: 1019215 - RNA, 22 nt, Human
ugucagaacucuauugaugucc

SEQ ID NO: 1019216 - RNA, 21 nt, Human
gcagaggcacggcaccaaggg

SEQ ID NO: 1019217 - RNA, 22 nt, Human
aauguaugcugugguaucuucu

SEQ ID NO: 1019218 - RNA, 22 nt, Human
aggcucugguuggcaaguaaag

SEQ ID NO: 1019219 - RNA, 22 nt, Human
agagcugagaauguggcuuccu

SEQ ID NO: 1019220 - RNA, 22 nt, Human
uguucaaaugaucuucuuaaau

SEQ ID NO: 1019221 - RNA, 22 nt, Human
uuccauaaucaccuuauucuuu

SEQ ID NO: 1019222 - RNA, 22 nt, Human
acagcuuuaucucagggaucag

SEQ ID NO: 1019223 - RNA, 22 nt, Human
ugaugaaaauaugauucugagg

SEQ ID NO: 1019224 - RNA, 22 nt, Human
caaaguuaugaaugauaagauu

SEQ ID NO: 1019225 - RNA, 22 nt, Human
ccucccucuguuagagcugucu

SEQ ID NO: 1019226 - RNA, 21 nt, Human
uuucugaaggcaacaucuauc

SEQ ID NO: 1019227 - RNA, 22 nt, Human
ucuagaauuuugccauauagcu

SEQ ID NO: 1019228 - RNA, 21 nt, Human
gccauuguuuucuaccuggag

SEQ ID NO: 1019229 - RNA, 23 nt, Human
ugagcugguauuguccaucucca

SEQ ID NO: 1019230 - RNA, 22 nt, Human
ucauugcagacuaacaaucuca

SEQ ID NO: 1019231 - RNA, 22 nt, Human
agccuggaggaggaguugagca

SEQ ID NO: 1019232 - RNA, 22 nt, Human
ggggcugguggugguuucucca

SEQ ID NO: 1019233 - RNA, 16 nt, Human
uguuagcugugcauua

SEQ ID NO: 1019234 - RNA, 19 nt, Human
gcuuuggagggagguucua

SEQ ID NO: 1019235 - RNA, 21 nt, Human
gggaaauuaggauugcucauc

SEQ ID NO: 1019236 - RNA, 22 nt, Human
cuggcaguguccagcucgugau

SEQ ID NO: 1019237 - RNA, 22 nt, Human
ccuggaaggcaggcauggauug

SEQ ID NO: 1019238 - RNA, 22 nt, Human
uucagaaguagcuaagcaguca

SEQ ID NO: 1019239 - RNA, 22 nt, Human
uggcccugccacucacugcuga

SEQ ID NO: 1019240 - RNA, 22 nt, Human
caaggaaacaugaaaugcauug

SEQ ID NO: 1019241 - RNA, 22 nt, Human
caggguggaagcuguagagugg

SEQ ID NO: 1019242 - RNA, 22 nt, Human
cucuguccuugcacaguuccua

SEQ ID NO: 1019243 - RNA, 20 nt, Human
cccuaggaacgcagcaggag

SEQ ID NO: 1019244 - RNA, 22 nt, Human
gcuguggcuguacagagaccau

SEQ ID NO: 1019245 - RNA, 22 nt, Human
ggcagcuguggacgucgucauu

SEQ ID NO: 1019246 - RNA, 23 nt, Human
cugcuguguuggucucgauggga

SEQ ID NO: 1019247 - RNA, 22 nt, Human
ucagcuccucaugcaggggaua

SEQ ID NO: 1019248 - RNA, 16 nt, Human
agaggccuugaggaag

SEQ ID NO: 1019249 - RNA, 20 nt, Human
ccucaguguccuggacuggg

SEQ ID NO: 1019250 - RNA, 22 nt, Human
uccaggcagagcaacaaaauau

SEQ ID NO: 1019251 - RNA, 22 nt, Human
cagcucuguaaauuccuucauc

SEQ ID NO: 1019252 - RNA, 22 nt, Human
aucaaaguaggcauauguuuuu

SEQ ID NO: 1019253 - RNA, 22 nt, Human
ugcccaggaucuggcgaugcuc

SEQ ID NO: 1019254 - RNA, 22 nt, Human
gguggggucacgacagagggaa

SEQ ID NO: 1019255 - RNA, 22 nt, Human
ucauugcaccccagucccagcu

SEQ ID NO: 1019256 - RNA, 22 nt, Human
ucaacagaagugauagcuauua

SEQ ID NO: 1019257 - RNA, 21 nt, Human
gcagcaguguucuagaauacu

SEQ ID NO: 1019258 - RNA, 22 nt, Human
ggcucagguuuccuucccagcu

SEQ ID NO: 1019259 - RNA, 22 nt, Human
uuguaaauaguaguaagaugcc

SEQ ID NO: 1019260 - RNA, 22 nt, Human
gacagccaugcacuucugcugu

SEQ ID NO: 1019261 - RNA, 22 nt, Human
augaaacacacacgcgcauacu

SEQ ID NO: 1019262 - RNA, 18 nt, Human
ucacagugcucuugccua

SEQ ID NO: 1019263 - RNA, 22 nt, Human
auguucuguuuuguaauucaua

SEQ ID NO: 1019264 - RNA, 22 nt, Human
auuuuacuacuccaauuaauga

SEQ ID NO: 1019265 - RNA, 22 nt, Human
ugagccugaguucaaggcugca

SEQ ID NO: 1019266 - RNA, 22 nt, Human
agucccuucucaaagugugcgg

SEQ ID NO: 1019267 - RNA, 22 nt, Human
gcacccaggcuugggcagcaac

SEQ ID NO: 1019268 - RNA, 22 nt, Human
cacagguguucuugcagugaaa

SEQ ID NO: 1019269 - RNA, 22 nt, Human
ugacaugcuuguuuuccuugaa

SEQ ID NO: 1019270 - RNA, 22 nt, Human
cugcugugugcuuacuuggguu

SEQ ID NO: 1019271 - RNA, 21 nt, Human
agcuggcagauauggugucug

SEQ ID NO: 1019272 - RNA, 20 nt, Human
aggcucagcugagcucuugg

SEQ ID NO: 1019273 - RNA, 22 nt, Human
cuugcuggugguguuuucuaug

SEQ ID NO: 1019274 - RNA, 22 nt, Human
aucuuucagggccauuuguauu

SEQ ID NO: 1019275 - RNA, 22 nt, Human
ggccucugccccagccacaccu

SEQ ID NO: 1019276 - RNA, 22 nt, Human
ggaggccaaggcagguggauca

SEQ ID NO: 1019277 - RNA, 22 nt, Human
ggccugagcucuggggaggcaa

SEQ ID NO: 1019278 - RNA, 22 nt, Human
gcugcucugugacagccuccgg

SEQ ID NO: 1019279 - RNA, 22 nt, Human
auucucuuuguauaacaucuug

SEQ ID NO: 1019280 - RNA, 22 nt, Human
uggaggagaauuuauggucgaa

SEQ ID NO: 1019281 - RNA, 20 nt, Human
ggggcccaagcccucuugcc

SEQ ID NO: 1019282 - RNA, 20 nt, Human
cucuccucacccgugucagg

SEQ ID NO: 1019283 - RNA, 18 nt, Human
aggcccuggccucgaaca

SEQ ID NO: 1019284 - RNA, 22 nt, Human
caacuuuaugauugguuuguca

SEQ ID NO: 1019285 - RNA, 22 nt, Human
guccucugggcuuugagcaguc

SEQ ID NO: 1019286 - RNA, 22 nt, Human
acauuucucaucuaguagagua

SEQ ID NO: 1019287 - RNA, 22 nt, Human
gcacugggaaugagggcagcuu

SEQ ID NO: 1019288 - RNA, 22 nt, Human
cuuaaauucuuaaugcccucau

SEQ ID NO: 1019289 - RNA, 22 nt, Human
augcaguauaaaucauuucugg

SEQ ID NO: 1019290 - RNA, 22 nt, Human
ggcagugaaugaaacagaggcu

SEQ ID NO: 1019291 - RNA, 21 nt, Human
ggagauggguaucgccugggc

SEQ ID NO: 1019292 - RNA, 22 nt, Human
uucuaguguccuuggacuugcu

SEQ ID NO: 1019293 - RNA, 22 nt, Human
gcagagcuccccaagacaccaa

SEQ ID NO: 1019294 - RNA, 22 nt, Human
ggcugcuggcauugagguaggu

SEQ ID NO: 1019295 - RNA, 22 nt, Human
gagaaagauguaggcugggagg

SEQ ID NO: 1019296 - RNA, 22 nt, Human
ucugccugccagucugguccuc

SEQ ID NO: 1019297 - RNA, 22 nt, Human
caaaagcaguucuaucugaguu

SEQ ID NO: 1019298 - RNA, 22 nt, Human
uuagccauuuuauacaagugua

SEQ ID NO: 1019299 - RNA, 22 nt, Human
aaauuucaguuaccuuuacguu

SEQ ID NO: 1019300 - RNA, 22 nt, Human
agcugggucuugggccaggaga

SEQ ID NO: 1019301 - RNA, 22 nt, Human
auuuaucaccaguuagcugacu

SEQ ID NO: 1019302 - RNA, 22 nt, Human
cuuuucaugagucuguuauggg

SEQ ID NO: 1019303 - RNA, 22 nt, Human
cagcagcaaaucuagaagagga

SEQ ID NO: 1019304 - RNA, 20 nt, Human
gcauugaguauagacagaug

SEQ ID NO: 1019305 - RNA, 22 nt, Human
gggccuguguguucaggagccu

SEQ ID NO: 1019306 - RNA, 22 nt, Human
uugaggagucaggggcacggaa

SEQ ID NO: 1019307 - RNA, 22 nt, Human
cuugcacacauguacaugugua

SEQ ID NO: 1019308 - RNA, 22 nt, Human
gugccuggagcuaauguguaua

SEQ ID NO: 1019309 - RNA, 22 nt, Human
gggccucugugcagaggggccu

SEQ ID NO: 1019310 - RNA, 20 nt, Human
uguuucuuuuaaugagcggc

SEQ ID NO: 1019311 - RNA, 22 nt, Human
cccagcuccagagccagaaaca

SEQ ID NO: 1019312 - RNA, 22 nt, Human
cacauuuaauccuuuauaagua

SEQ ID NO: 1019313 - RNA, 22 nt, Human
uguguacuugaaagggcagguc

SEQ ID NO: 1019314 - RNA, 22 nt, Human
acugggagucaugaggaaggag

SEQ ID NO: 1019315 - RNA, 22 nt, Human
aggugcagcaugaguccaacgg

SEQ ID NO: 1019316 - RNA, 21 nt, Human
agggaaagaaaaugagcuaau

SEQ ID NO: 1019317 - RNA, 22 nt, Human
uuaugcuaguauaguccuuaga

SEQ ID NO: 1019318 - RNA, 22 nt, Human
gcucagagauguucaguagcuu

SEQ ID NO: 1019319 - RNA, 21 nt, Human
agagagaaggccauauggucc

SEQ ID NO: 1019320 - RNA, 22 nt, Human
uuucacuagaacguucuuguuu

SEQ ID NO: 1019321 - RNA, 22 nt, Human
ccacagccauuccagggaggcu

SEQ ID NO: 1019322 - RNA, 22 nt, Human
ucuuuacaucacaauuguaugg

SEQ ID NO: 1019323 - RNA, 22 nt, Human
acagguggagugguuagcaggc

SEQ ID NO: 1019324 - RNA, 22 nt, Human
ugggaggaaugucacugagcca

SEQ ID NO: 1019325 - RNA, 22 nt, Human
cacagggccuugugugacugca

SEQ ID NO: 1019326 - RNA, 22 nt, Human
ugccugucuuaauaucuggaaa

SEQ ID NO: 1019327 - RNA, 22 nt, Human
aagggcugaaagaccuugggca

SEQ ID NO: 1019328 - RNA, 16 nt, Human
ccuuucucugccuucc

SEQ ID NO: 1019329 - RNA, 22 nt, Human
cugcuuccauaaauaaugugcu

SEQ ID NO: 1019330 - RNA, 22 nt, Human
aggagagagcugagcuuugcug

SEQ ID NO: 1019331 - RNA, 23 nt, Human
agagcaucaugaugcuaagucug

SEQ ID NO: 1019332 - RNA, 22 nt, Human
gugugucccuccucuccugagu

SEQ ID NO: 1019333 - RNA, 19 nt, Human
gccucugcuggggacaggc

SEQ ID NO: 1019334 - RNA, 22 nt, Human
uccaggcagucauuaaucucua

SEQ ID NO: 1019335 - RNA, 22 nt, Human
ccugggagaacugcuggguugg

SEQ ID NO: 1019336 - RNA, 22 nt, Human
gcuccuucaggugguagcuguu

SEQ ID NO: 1019337 - RNA, 22 nt, Human
caggcacugugcaagggucucg

SEQ ID NO: 1019338 - RNA, 18 nt, Human
aggcacagagcauacaua

SEQ ID NO: 1019339 - RNA, 22 nt, Human
uagagcaguuggcagcuguauu

SEQ ID NO: 1019340 - RNA, 22 nt, Human
aggaagcccuugucauuucugu

SEQ ID NO: 1019341 - RNA, 22 nt, Human
aaaugcaccuugcugugagacu

SEQ ID NO: 1019342 - RNA, 22 nt, Human
aucaguuuaacugucaagagcc

SEQ ID NO: 1019343 - RNA, 22 nt, Human
ggcuucucucuucacauggcuu

SEQ ID NO: 1019344 - RNA, 22 nt, Human
uucaggaucaaguugccaguag

SEQ ID NO: 1019345 - RNA, 22 nt, Human
caguguuugcuuaaguuauaug

SEQ ID NO: 1019346 - RNA, 20 nt, Human
cucucuggaaggugggagcc

SEQ ID NO: 1019347 - RNA, 22 nt, Human
acucugaggagugacuagaggu

SEQ ID NO: 1019348 - RNA, 22 nt, Human
uaacacacugaaggugagaugg

SEQ ID NO: 1019349 - RNA, 22 nt, Human
ugcauggacucaucagacaaga

SEQ ID NO: 1019350 - RNA, 23 nt, Human
ugcagagggacugaagccagcuu

SEQ ID NO: 1019351 - RNA, 22 nt, Human
aaguuauaucaucucauugacg

SEQ ID NO: 1019352 - RNA, 22 nt, Human
ccuggggagaagagcuuccccc

SEQ ID NO: 1019353 - RNA, 22 nt, Human
gcaggcucuucuuucugcccag

SEQ ID NO: 1019354 - RNA, 22 nt, Human
cugccucuauucacugaggcag

SEQ ID NO: 1019355 - RNA, 22 nt, Human
uaagaacagugucugucucaca

SEQ ID NO: 1019356 - RNA, 22 nt, Human
cuguggagcuuguggcaguggg

SEQ ID NO: 1019357 - RNA, 23 nt, Human
ucuggcuccauccuuggggaucc

SEQ ID NO: 1019358 - RNA, 22 nt, Human
uggcuucaucugcagcacugcc

SEQ ID NO: 1019359 - RNA, 22 nt, Human
guuuucugauuagcaaaucuga

SEQ ID NO: 1019360 - RNA, 22 nt, Human
caggguggggcuggcuaucaaa

SEQ ID NO: 1019361 - RNA, 22 nt, Human
uagggcaguuauaacauuagug

SEQ ID NO: 1019362 - RNA, 22 nt, Human
agcccugggaggccagcuugua

SEQ ID NO: 1019363 - RNA, 22 nt, Human
ucugcuguauuagguugaacug

SEQ ID NO: 1019364 - RNA, 22 nt, Human
ccagucccaucucugucgcuua

SEQ ID NO: 1019365 - RNA, 17 nt, Human
ucaggcugugccuggua

SEQ ID NO: 1019366 - RNA, 22 nt, Human
gaacagcuucuugggagcuggg

SEQ ID NO: 1019367 - RNA, 22 nt, Human
agaaauguauucuguauguuuu

SEQ ID NO: 1019368 - RNA, 22 nt, Human
uggccuuggacagagcgcuccu

SEQ ID NO: 1019369 - RNA, 22 nt, Human
ucuucaucucagauuaacagga

SEQ ID NO: 1019370 - RNA, 22 nt, Human
guggcucucgccagccugcggg

SEQ ID NO: 1019371 - RNA, 22 nt, Human
ucuuaaaaguaugccaauugga

SEQ ID NO: 1019372 - RNA, 22 nt, Human
uacaaagugugcccaugcugag

SEQ ID NO: 1019373 - RNA, 22 nt, Human
cucagggcaguauggcugagag

SEQ ID NO: 1019374 - RNA, 22 nt, Human
auccugugcaaugacugcaucu

SEQ ID NO: 1019375 - RNA, 22 nt, Human
aaaguguggcacaagucacauc

SEQ ID NO: 1019376 - RNA, 23 nt, Human
uugauuucaaaugcagagaacac

SEQ ID NO: 1019377 - RNA, 22 nt, Human
guuguauagagggcaugaaucu

SEQ ID NO: 1019378 - RNA, 22 nt, Human
uccucaggcugccuggaagacu

SEQ ID NO: 1019379 - RNA, 22 nt, Human
uauuuguugaguuguuaugucu

SEQ ID NO: 1019380 - RNA, 22 nt, Human
ugcuuccuauccacacaaugcc

SEQ ID NO: 1019381 - RNA, 22 nt, Human
ugcuauugugaacagugccaca

SEQ ID NO: 1019382 - RNA, 18 nt, Human
uguuccaaggaaggaauc

SEQ ID NO: 1019383 - RNA, 22 nt, Human
agauuuauguggucacacucag

SEQ ID NO: 1019384 - RNA, 22 nt, Human
uauggaaagcucuuuuugauug

SEQ ID NO: 1019385 - RNA, 22 nt, Human
uuccauuguuucugucuucacu

SEQ ID NO: 1019386 - RNA, 22 nt, Human
uucaauucaauucuaaauauau

SEQ ID NO: 1019387 - RNA, 22 nt, Human
cacccagcagcacuuaagacua

SEQ ID NO: 1019388 - RNA, 22 nt, Human
cuggcagcaguuaugaaacaau

SEQ ID NO: 1019389 - RNA, 22 nt, Human
guggcuucacauggcauuuggc

SEQ ID NO: 1019390 - RNA, 22 nt, Human
agugcuguaacaacuuauuugg

SEQ ID NO: 1019391 - RNA, 22 nt, Human
aaggcgacacaggcagcaggcc

SEQ ID NO: 1019392 - RNA, 22 nt, Human
acucugccccgaguucugggaa

SEQ ID NO: 1019393 - RNA, 22 nt, Human
gcagugcugaucccauggcaga

SEQ ID NO: 1019394 - RNA, 22 nt, Human
cauauguauuucucauaauuag

SEQ ID NO: 1019395 - RNA, 22 nt, Human
aauaauuauuugagagcagacc

SEQ ID NO: 1019396 - RNA, 22 nt, Human
gucagaggaauggaugagugau

SEQ ID NO: 1019397 - RNA, 22 nt, Human
ugcucuggagggugaagcuuuu

SEQ ID NO: 1019398 - RNA, 22 nt, Human
uccucaggaugugggguagaau

SEQ ID NO: 1019399 - RNA, 21 nt, Human
acagaacuguauagugauaaa

SEQ ID NO: 1019400 - RNA, 22 nt, Human
ccaggagcaggagcuggacaga

SEQ ID NO: 1019401 - RNA, 22 nt, Human
cucuguccacagguuugucccu

SEQ ID NO: 1019402 - RNA, 22 nt, Human
gaaaucugcccagugcacuggu

SEQ ID NO: 1019403 - RNA, 22 nt, Human
ggggcagaguagcuggggugug

SEQ ID NO: 1019404 - RNA, 22 nt, Human
cucugagcuccuggaagcgugc

SEQ ID NO: 1019405 - RNA, 22 nt, Human
auucagcaaugagcuuggauuu

SEQ ID NO: 1019406 - RNA, 22 nt, Human
caguggcgugaucucugcucac

SEQ ID NO: 1019407 - RNA, 22 nt, Human
ugggcagaaugugggauccaga

SEQ ID NO: 1019408 - RNA, 22 nt, Human
uguggccuggaaggggcugcuc

SEQ ID NO: 1019409 - RNA, 22 nt, Human
ugggagucagacagccugagau

SEQ ID NO: 1019410 - RNA, 22 nt, Human
aaaaagguugauccagauuagg

SEQ ID NO: 1019411 - RNA, 22 nt, Human
gcagaggccaggccaccagcaa

SEQ ID NO: 1019412 - RNA, 22 nt, Human
cuggguggcagagccugcagug

SEQ ID NO: 1019413 - RNA, 17 nt, Human
ucagcaggggccaagcu

SEQ ID NO: 1019414 - RNA, 22 nt, Human
ggagacagugguagggccuaag

SEQ ID NO: 1019415 - RNA, 22 nt, Human
uuuuggucagguuggucucgaa

SEQ ID NO: 1019416 - RNA, 22 nt, Human
ggggaccuaggcucugucucuu

SEQ ID NO: 1019417 - RNA, 21 nt, Human
ugacugaggcuucuucacaca

SEQ ID NO: 1019418 - RNA, 22 nt, Human
gucaaaaaguagucauuucugu

SEQ ID NO: 1019419 - RNA, 22 nt, Human
guauuaggaggaacacaggccu

SEQ ID NO: 1019420 - RNA, 22 nt, Human
uuugggaaacuuaggggucaga

SEQ ID NO: 1019421 - RNA, 17 nt, Human
uuucaucugggaccacc

SEQ ID NO: 1019422 - RNA, 22 nt, Human
ccagagcuccagggcuacagaa

SEQ ID NO: 1019423 - RNA, 20 nt, Human
ccuccaggcacacccaugug

SEQ ID NO: 1019424 - RNA, 22 nt, Human
cucugagagcggucuguggcuu

SEQ ID NO: 1019425 - RNA, 22 nt, Human
ccaggguguagggauuccagau

SEQ ID NO: 1019426 - RNA, 22 nt, Human
ucagugaucuaaggguauggcc

SEQ ID NO: 1019427 - RNA, 22 nt, Human
ucagaagcaggagugugcacaa

SEQ ID NO: 1019428 - RNA, 22 nt, Human
ugugccuggaucucugugacaa

SEQ ID NO: 1019429 - RNA, 22 nt, Human
uagcaguggaaucuuuugucca

SEQ ID NO: 1019430 - RNA, 22 nt, Human
uuuccuaguucuaagaaaugua

SEQ ID NO: 1019431 - RNA, 22 nt, Human
gagaaggggugauguggguaau

SEQ ID NO: 1019432 - RNA, 23 nt, Human
cuuucauugugguuucacagagc

SEQ ID NO: 1019433 - RNA, 22 nt, Human
gaggaaccaaaucagcuugcac

SEQ ID NO: 1019434 - RNA, 22 nt, Human
uacuaaauaguuuaauuccuca

SEQ ID NO: 1019435 - RNA, 22 nt, Human
caggaucccuggccuccgccca

SEQ ID NO: 1019436 - RNA, 22 nt, Human
uccuucaguuaucacaguacug

SEQ ID NO: 1019437 - RNA, 22 nt, Human
aucagagauuguaguaugugca

SEQ ID NO: 1019438 - RNA, 22 nt, Human
cagagccauccaggugccuguu

SEQ ID NO: 1019439 - RNA, 22 nt, Human
cucuccagccacagaagcugcu

SEQ ID NO: 1019440 - RNA, 22 nt, Human
uaauaguuucauaaugugcuuc

SEQ ID NO: 1019441 - RNA, 22 nt, Human
cuggcagcauggagccugugcu

SEQ ID NO: 1019442 - RNA, 22 nt, Human
uauuuccugcauggugauguaa

SEQ ID NO: 1019443 - RNA, 22 nt, Human
acagaggcugcgcuugggaacg

SEQ ID NO: 1019444 - RNA, 22 nt, Human
cucagagaaaaggagcaagggu

SEQ ID NO: 1019445 - RNA, 23 nt, Human
uuucauaugguguggaugaagaa

SEQ ID NO: 1019446 - RNA, 22 nt, Human
gcagagcucuguucuuaucucc

SEQ ID NO: 1019447 - RNA, 22 nt, Human
ugcugccauggucgcugguguc

SEQ ID NO: 1019448 - RNA, 22 nt, Human
uccuggccugucuggaguagcu

SEQ ID NO: 1019449 - RNA, 22 nt, Human
ccucaggggucacugugaggag

SEQ ID NO: 1019450 - RNA, 22 nt, Human
ugccuucaaucaggauggucuc

SEQ ID NO: 1019451 - RNA, 22 nt, Human
gcccagcugcacccuggugggu

SEQ ID NO: 1019452 - RNA, 22 nt, Human
uccaggaggguuuucugccuuc

SEQ ID NO: 1019453 - RNA, 22 nt, Human
uucaaucauuuuuacauagucc

SEQ ID NO: 1019454 - RNA, 22 nt, Human
agguacagcaauauaagagguc

SEQ ID NO: 1019455 - RNA, 22 nt, Human
cagggcucgcucuugcccuucg

SEQ ID NO: 1019456 - RNA, 22 nt, Human
ggaccagagaagugagcaccug

SEQ ID NO: 1019457 - RNA, 22 nt, Human
auucaguucuaaggucagugcc

SEQ ID NO: 1019458 - RNA, 22 nt, Human
auguccaggaucuauccccaga

SEQ ID NO: 1019459 - RNA, 23 nt, Human
cuugcagggcuggaggcuuagaa

SEQ ID NO: 1019460 - RNA, 20 nt, Human
agcuggagaagggcccuucc

SEQ ID NO: 1019461 - RNA, 22 nt, Human
cagcaugguuggguucugggga

SEQ ID NO: 1019462 - RNA, 21 nt, Human
gcagcagaggcuugacagaca

SEQ ID NO: 1019463 - RNA, 22 nt, Human
ccugggugucaugggcagcugg

SEQ ID NO: 1019464 - RNA, 23 nt, Human
acaguuauagcugugaauaacau

SEQ ID NO: 1019465 - RNA, 22 nt, Human
gcauuuaaauuugaacuucaga

SEQ ID NO: 1019466 - RNA, 22 nt, Human
ucugugcucuucucaguaucac

SEQ ID NO: 1019467 - RNA, 22 nt, Human
caugucuguguacacaugcaca

SEQ ID NO: 1019468 - RNA, 20 nt, Human
cugcaggguuagaggcucca

SEQ ID NO: 1019469 - RNA, 22 nt, Human
gaaaaugugccuuuggguauug

SEQ ID NO: 1019470 - RNA, 22 nt, Human
auuugucucugcacuuuacuca

SEQ ID NO: 1019471 - RNA, 22 nt, Human
ugaugcugcugggaguggugcu

SEQ ID NO: 1019472 - RNA, 22 nt, Human
ccauccugcauugcuauucaga

SEQ ID NO: 1019473 - RNA, 22 nt, Human
cuccucuggaaauuccucugcc

SEQ ID NO: 1019474 - RNA, 22 nt, Human
auacuguuucucuucuacauga

SEQ ID NO: 1019475 - RNA, 22 nt, Human
cuuaggaacgcucugccuagug

SEQ ID NO: 1019476 - RNA, 22 nt, Human
uuauuccaguaaucucuguaau

SEQ ID NO: 1019477 - RNA, 22 nt, Human
auaugcacauacauacauaggu

SEQ ID NO: 1019478 - RNA, 22 nt, Human
ucccagagacagagccuccucc

SEQ ID NO: 1019479 - RNA, 22 nt, Human
ucuguucagaagaggugaaagu

SEQ ID NO: 1019480 - RNA, 19 nt, Human
ugucucagugucccuuccu

SEQ ID NO: 1019481 - RNA, 22 nt, Human
uugaagcaaauucugugcagua

SEQ ID NO: 1019482 - RNA, 22 nt, Human
acacaugcauaagccuucccuu

SEQ ID NO: 1019483 - RNA, 22 nt, Human
auaugcauuuaccuggcauaua

SEQ ID NO: 1019484 - RNA, 22 nt, Human
acaaggcugaacagugaagccg

SEQ ID NO: 1019485 - RNA, 22 nt, Human
uagaaaugauuuugaugcuuca

SEQ ID NO: 1019486 - RNA, 22 nt, Human
acaugcauacacguacauaccu

SEQ ID NO: 1019487 - RNA, 22 nt, Human
agauuucagaugcucggcaguu

SEQ ID NO: 1019488 - RNA, 22 nt, Human
uagucccauuuugagguauuug

SEQ ID NO: 1019489 - RNA, 22 nt, Human
gucaccagucccagcuccugaa

SEQ ID NO: 1019490 - RNA, 23 nt, Human
ucagucuucccugucaguaauag

SEQ ID NO: 1019491 - RNA, 22 nt, Human
cugguucauccccuuccaggaa

SEQ ID NO: 1019492 - RNA, 22 nt, Human
uaaauuuacccaaggaacaugu

SEQ ID NO: 1019493 - RNA, 22 nt, Human
uucaacuauuaugaauaaaauu

SEQ ID NO: 1019494 - RNA, 22 nt, Human
ggucaggggcugcucuacagag

SEQ ID NO: 1019495 - RNA, 22 nt, Human
agggaccuugauggguuuggga

SEQ ID NO: 1019496 - RNA, 22 nt, Human
gugucaugcacacucaguguug

SEQ ID NO: 1019497 - RNA, 22 nt, Human
gcuggguggaucggaggcucug

SEQ ID NO: 1019498 - RNA, 22 nt, Human
ccagcagcagcguccaaggaga

SEQ ID NO: 1019499 - RNA, 20 nt, Human
ugcuuccuggccacugcggg

SEQ ID NO: 1019500 - RNA, 22 nt, Human
gaaggaaaggucucaugccuuu

SEQ ID NO: 1019501 - RNA, 23 nt, Human
ggccucuguguucugcccacaug

SEQ ID NO: 1019502 - RNA, 22 nt, Human
ccagcuggugggucuuucucug

SEQ ID NO: 1019503 - RNA, 22 nt, Human
augcaucauggaaaacucaguu

SEQ ID NO: 1019504 - RNA, 22 nt, Human
agagccugaggccaggaaaaug

SEQ ID NO: 1019505 - RNA, 21 nt, Human
cagaggccucaugcucugugc

SEQ ID NO: 1019506 - RNA, 22 nt, Human
ugagccugggagauggaggcug

SEQ ID NO: 1019507 - RNA, 22 nt, Human
ucucuucacaugcuugcuccaa

SEQ ID NO: 1019508 - RNA, 22 nt, Human
agauauuuguaucuugcuauug

SEQ ID NO: 1019509 - RNA, 22 nt, Human
gaauuucuggacccuuugagaa

SEQ ID NO: 1019510 - RNA, 22 nt, Human
uggcagaaguacacaagcaugc

SEQ ID NO: 1019511 - RNA, 22 nt, Human
ucagccagguaauguggagaug

SEQ ID NO: 1019512 - RNA, 22 nt, Human
cugcuggccuagcccauccucu

SEQ ID NO: 1019513 - RNA, 22 nt, Human
uggccuugagagaucaaaaggu

SEQ ID NO: 1019514 - RNA, 22 nt, Human
cagaaauguacugacaugcagu

SEQ ID NO: 1019515 - RNA, 22 nt, Human
cccuuccucccaggcuucugug

SEQ ID NO: 1019516 - RNA, 22 nt, Human
aggcuccuuguucaucauccau

SEQ ID NO: 1019517 - RNA, 22 nt, Human
uuuauuuauccuucuggauugc

SEQ ID NO: 1019518 - RNA, 22 nt, Human
aguuucuuuagauagaaaguuc

SEQ ID NO: 1019519 - RNA, 22 nt, Human
uaagacaugguugaucuagugu

SEQ ID NO: 1019520 - RNA, 22 nt, Human
uguggccuccuguuccugggua

SEQ ID NO: 1019521 - RNA, 20 nt, Human
ucugugcaccugcuacaagg

SEQ ID NO: 1019522 - RNA, 22 nt, Human
uuuccuaagguagugauaauuu

SEQ ID NO: 1019523 - RNA, 22 nt, Human
aucaguuucuaccauguggaau

SEQ ID NO: 1019524 - RNA, 22 nt, Human
caggccuggcugcagcucgccu

SEQ ID NO: 1019525 - RNA, 22 nt, Human
uccagcucuaacaugcugggcc

SEQ ID NO: 1019526 - RNA, 23 nt, Human
acacauuuuucccguucugaggu

SEQ ID NO: 1019527 - RNA, 17 nt, Human
aggagucucagaugagc

SEQ ID NO: 1019528 - RNA, 22 nt, Human
ugaggcagcaauuguauuguau

SEQ ID NO: 1019529 - RNA, 22 nt, Human
acauuucucauaggagagccac

SEQ ID NO: 1019530 - RNA, 23 nt, Human
ugcagcugccucuggcgggccgg

SEQ ID NO: 1019531 - RNA, 21 nt, Human
uccaggaguggcugggcaggg

SEQ ID NO: 1019532 - RNA, 22 nt, Human
aggaggccgcugaugggcuccc

SEQ ID NO: 1019533 - RNA, 22 nt, Human
ucuucagagacucugagccccu

SEQ ID NO: 1019534 - RNA, 23 nt, Human
ucuguacaauugagaagagaaca

SEQ ID NO: 1019535 - RNA, 22 nt, Human
uuugaaaauuagacacaggcua

SEQ ID NO: 1019536 - RNA, 22 nt, Human
agucaauucuuuucaacucaag

SEQ ID NO: 1019537 - RNA, 22 nt, Human
aucaauucuuaggaaaauagcu

SEQ ID NO: 1019538 - RNA, 22 nt, Human
ggcucaggccagaccacgacuc

SEQ ID NO: 1019539 - RNA, 22 nt, Human
uuucacaaguaaaguccuaagu

SEQ ID NO: 1019540 - RNA, 22 nt, Human
auucuucaguauguguggauug

SEQ ID NO: 1019541 - RNA, 22 nt, Human
agccccugggaguagcugcugc

SEQ ID NO: 1019542 - RNA, 22 nt, Human
cacauggccuguguggccagac

SEQ ID NO: 1019543 - RNA, 22 nt, Human
agagcauccaucggccaggacc

SEQ ID NO: 1019544 - RNA, 22 nt, Human
ugcugccacauuuaaagagggg

SEQ ID NO: 1019545 - RNA, 22 nt, Human
gcccagaaguugaggcugcagu

SEQ ID NO: 1019546 - RNA, 22 nt, Human
agggaccucuucuugcagcuga

SEQ ID NO: 1019547 - RNA, 22 nt, Human
ccucagaggugaacaucagugc

SEQ ID NO: 1019548 - RNA, 22 nt, Human
gugcaggggaucagguugcagc

SEQ ID NO: 1019549 - RNA, 22 nt, Human
gcugccacucugagcuugcuuc

SEQ ID NO: 1019550 - RNA, 22 nt, Human
gcccaggcuggagugcaguagc

SEQ ID NO: 1019551 - RNA, 23 nt, Human
ucaguuuuggcuguucaguguug

SEQ ID NO: 1019552 - RNA, 22 nt, Human
agauuuagacugccuuaaucau

SEQ ID NO: 1019553 - RNA, 22 nt, Human
cucaagacugaucgcaguggaa

SEQ ID NO: 1019554 - RNA, 22 nt, Human
aaggcuuuaugugaccaaaaga

SEQ ID NO: 1019555 - RNA, 22 nt, Human
auacacauauguguguauaugu

SEQ ID NO: 1019556 - RNA, 22 nt, Human
ccuccugggccuugcucuguga

SEQ ID NO: 1019557 - RNA, 22 nt, Human
cugagggugcuauucuugccuu

SEQ ID NO: 1019558 - RNA, 22 nt, Human
ugaaaucuuauacuuugguagu

SEQ ID NO: 1019559 - RNA, 22 nt, Human
ccuuggcccuagccucaggcaa

SEQ ID NO: 1019560 - RNA, 22 nt, Human
ucacauuucugauuauaccaaa

SEQ ID NO: 1019561 - RNA, 22 nt, Human
guguggcugccagccaagaggc

SEQ ID NO: 1019562 - RNA, 22 nt, Human
acagacagauuuugucugaugu

SEQ ID NO: 1019563 - RNA, 22 nt, Human
aauugcuaaagauuauguuuuc

SEQ ID NO: 1019564 - RNA, 23 nt, Human
cagaggcaucggauucaacauca

SEQ ID NO: 1019565 - RNA, 22 nt, Human
auacuuacuuuucuucagacua

SEQ ID NO: 1019566 - RNA, 22 nt, Human
uuucaaauggagucgugaaaug

SEQ ID NO: 1019567 - RNA, 22 nt, Human
uaacagaauuugcuaaacuccg

SEQ ID NO: 1019568 - RNA, 22 nt, Human
uuuacacaaaagauagcacacc

SEQ ID NO: 1019569 - RNA, 20 nt, Human
cccugcagccaugggagugg

SEQ ID NO: 1019570 - RNA, 22 nt, Human
agauacauagcugugagcacac

SEQ ID NO: 1019571 - RNA, 22 nt, Human
cugcccugagucaugccagaug

SEQ ID NO: 1019572 - RNA, 22 nt, Human
uauguacaugauuucauuugcu

SEQ ID NO: 1019573 - RNA, 22 nt, Human
aaacagcaggaacaucuugcca

SEQ ID NO: 1019574 - RNA, 22 nt, Human
uacuuucuagcucuccccaguu

SEQ ID NO: 1019575 - RNA, 22 nt, Human
uggcucaguuugggggauugaa

SEQ ID NO: 1019576 - RNA, 23 nt, Human
gagggcucugagugcuugggcca

SEQ ID NO: 1019577 - RNA, 22 nt, Human
aucaggaucacagaaacuuuua

SEQ ID NO: 1019578 - RNA, 22 nt, Human
accauuuuggguauuuucagag

SEQ ID NO: 1019579 - RNA, 22 nt, Human
ugcugaaauuagaacauugagg

SEQ ID NO: 1019580 - RNA, 23 nt, Human
cacaccaggagccgucugggcca

SEQ ID NO: 1019581 - RNA, 22 nt, Human
ccaggcuggagugcaauggugc

SEQ ID NO: 1019582 - RNA, 22 nt, Human
uaacacauauuugcaguaagca

SEQ ID NO: 1019583 - RNA, 22 nt, Human
ccuggccucagccuagggcuga

SEQ ID NO: 1019584 - RNA, 22 nt, Human
gcacagggcaacaggucuguua

SEQ ID NO: 1019585 - RNA, 20 nt, Human
agcaggaaugaugcuuucau

SEQ ID NO: 1019586 - RNA, 22 nt, Human
gagagcugauagaugagcuacu

SEQ ID NO: 1019587 - RNA, 22 nt, Human
ugaguagcggcuauguguaacu

SEQ ID NO: 1019588 - RNA, 22 nt, Human
ggagcugcuuugaucugaagaa

SEQ ID NO: 1019589 - RNA, 22 nt, Human
gucucagggacugcuucugggg

SEQ ID NO: 1019590 - RNA, 22 nt, Human
ugggcugcuuccucagcugaga

SEQ ID NO: 1019591 - RNA, 22 nt, Human
ccacagggccuuuccugcuggc

SEQ ID NO: 1019592 - RNA, 22 nt, Human
ugagggcugcuuccagagcuag

SEQ ID NO: 1019593 - RNA, 22 nt, Human
augaacugcaguauaaacuugg

SEQ ID NO: 1019594 - RNA, 23 nt, Human
uccagcagagccuuccaggaggg

SEQ ID NO: 1019595 - RNA, 22 nt, Human
gccagggaaacugcagaccagc

SEQ ID NO: 1019596 - RNA, 22 nt, Human
acacagggggcauucuaggagu

SEQ ID NO: 1019597 - RNA, 22 nt, Human
uuuccuuccuugcuagccugag

SEQ ID NO: 1019598 - RNA, 22 nt, Human
uucucagaauugacugggagca

SEQ ID NO: 1019599 - RNA, 22 nt, Human
gcugagagugagcacuggauau

SEQ ID NO: 1019600 - RNA, 22 nt, Human
guuucauuuacaucuguaggua

SEQ ID NO: 1019601 - RNA, 22 nt, Human
aggagucauugagagggguccu

SEQ ID NO: 1019602 - RNA, 22 nt, Human
ggcagggugccuggcuccuguu

SEQ ID NO: 1019603 - RNA, 22 nt, Human
ucuuaaagagcgcaauuugagg

SEQ ID NO: 1019604 - RNA, 22 nt, Human
augcccugugguucaugugaga

SEQ ID NO: 1019605 - RNA, 22 nt, Human
ucuguggcacgauugcacugca

SEQ ID NO: 1019606 - RNA, 22 nt, Human
cuguacaaguccuucaucaggg

SEQ ID NO: 1019607 - RNA, 23 nt, Human
agacccagagacuggcucugcuc

SEQ ID NO: 1019608 - RNA, 22 nt, Human
ggccagggggcuucagacucca

SEQ ID NO: 1019609 - RNA, 22 nt, Human
gcagguggauuaucagaagugc

SEQ ID NO: 1019610 - RNA, 22 nt, Human
ccagaggcuggcagccagcuga

SEQ ID NO: 1019611 - RNA, 23 nt, Human
agucaguguaaguuuggaaugca

SEQ ID NO: 1019612 - RNA, 21 nt, Human
acagccugucaucucaugguc

SEQ ID NO: 1019613 - RNA, 22 nt, Human
agucccagcucagaaccacuag

SEQ ID NO: 1019614 - RNA, 22 nt, Human
uggcuucuugggaugggucauu

SEQ ID NO: 1019615 - RNA, 22 nt, Human
ucucuuucuauugcaccaugcu

SEQ ID NO: 1019616 - RNA, 22 nt, Human
gaucuucuagcagaaguaauuu

SEQ ID NO: 1019617 - RNA, 22 nt, Human
uuccugaugcacacagucauuu

SEQ ID NO: 1019618 - RNA, 22 nt, Human
uuauuuaaaagugguaagauuc

SEQ ID NO: 1019619 - RNA, 22 nt, Human
gguauaaaugaucagaucgcug

SEQ ID NO: 1019620 - RNA, 22 nt, Human
agucuucagagaaauuaacucu

SEQ ID NO: 1019621 - RNA, 22 nt, Human
cucuccagaucugcugagccag

SEQ ID NO: 1019622 - RNA, 18 nt, Human
ccagagcuggcuccucgc

SEQ ID NO: 1019623 - RNA, 22 nt, Human
gcccugggauuggguggaggcu

SEQ ID NO: 1019624 - RNA, 22 nt, Human
acauuucuuccuaauuaucccu

SEQ ID NO: 1019625 - RNA, 22 nt, Human
uggcccugacuuggaggccuga

SEQ ID NO: 1019626 - RNA, 22 nt, Human
agauuucagguuggggcagaag

SEQ ID NO: 1019627 - RNA, 22 nt, Human
ugccuggaaggcccaugggaag

SEQ ID NO: 1019628 - RNA, 22 nt, Human
augaggcaguacacacaaagcc

SEQ ID NO: 1019629 - RNA, 21 nt, Human
gggugggaggacacagcaggc

SEQ ID NO: 1019630 - RNA, 22 nt, Human
uuuauuuauaagccacuugcug

SEQ ID NO: 1019631 - RNA, 22 nt, Human
ggcuuuauuaagcaggguaagu

SEQ ID NO: 1019632 - RNA, 22 nt, Human
uuaugggagcaauuggggaggu

SEQ ID NO: 1019633 - RNA, 21 nt, Human
ugcaggagucugugagucagg

SEQ ID NO: 1019634 - RNA, 22 nt, Human
ucuggagcuggcagggcccugg

SEQ ID NO: 1019635 - RNA, 22 nt, Human
acucagaguuugcguuccauac

SEQ ID NO: 1019636 - RNA, 22 nt, Human
ccauggaguuccucuggucuau

SEQ ID NO: 1019637 - RNA, 22 nt, Human
uggaccugcuggaugggcaggu

SEQ ID NO: 1019638 - RNA, 22 nt, Human
ccaaggcaggggaucaaaguuu

SEQ ID NO: 1019639 - RNA, 22 nt, Human
ucuggcuuucauuuguuuaaag

SEQ ID NO: 1019640 - RNA, 22 nt, Human
aaugucugagucucuguauccc

SEQ ID NO: 1019641 - RNA, 22 nt, Human
uuugaaagaauuuauguacuuu

SEQ ID NO: 1019642 - RNA, 22 nt, Human
cuccaguaucuguaggaaaagg

SEQ ID NO: 1019643 - RNA, 22 nt, Human
ucucucagaggaagaggcagug

SEQ ID NO: 1019644 - RNA, 21 nt, Human
ggcuccugcuuugugaggggc

SEQ ID NO: 1019645 - RNA, 22 nt, Human
ccucuccuugcacccgucccgc

SEQ ID NO: 1019646 - RNA, 22 nt, Human
aagcugccauagaacgagaggu

SEQ ID NO: 1019647 - RNA, 22 nt, Human
ucauugcaguugaguuguguua

SEQ ID NO: 1019648 - RNA, 22 nt, Human
uucuucuugaaacuuuagguug

SEQ ID NO: 1019649 - RNA, 22 nt, Human
cuucuugcaauuuucaucuuau

SEQ ID NO: 1019650 - RNA, 22 nt, Human
ccugccagcauggcuuaucucc

SEQ ID NO: 1019651 - RNA, 22 nt, Human
gagccagcuacauggucugcaa

SEQ ID NO: 1019652 - RNA, 22 nt, Human
aggucagaagugccagggaauu

SEQ ID NO: 1019653 - RNA, 22 nt, Human
agugaaauuccuggucuuuguu

SEQ ID NO: 1019654 - RNA, 22 nt, Human
cacauacaaugguguuauuugg

SEQ ID NO: 1019655 - RNA, 22 nt, Human
ggagccuggucagguuggcucc

SEQ ID NO: 1019656 - RNA, 21 nt, Human
caggaaaagcggaagucuagc

SEQ ID NO: 1019657 - RNA, 22 nt, Human
gggaugucacugugccuggcac

SEQ ID NO: 1019658 - RNA, 22 nt, Human
cugagccaguagucagggacaa

SEQ ID NO: 1019659 - RNA, 19 nt, Human
accuugggcaagugccuuc

SEQ ID NO: 1019660 - RNA, 22 nt, Human
augcacuugcguguuugcaaau

SEQ ID NO: 1019661 - RNA, 22 nt, Human
acagaaauaacuuuuuauguuu

SEQ ID NO: 1019662 - RNA, 22 nt, Human
ccaucagcuccaguaucuucug

SEQ ID NO: 1019663 - RNA, 22 nt, Human
aucuacagcugucugcacagua

SEQ ID NO: 1019664 - RNA, 19 nt, Human
agaaguuagacauugcaau

SEQ ID NO: 1019665 - RNA, 22 nt, Human
ucacaugcucaccuaagccaca

SEQ ID NO: 1019666 - RNA, 22 nt, Human
aaacaugagcauuucuguuuaa

SEQ ID NO: 1019667 - RNA, 22 nt, Human
uggagcaggugccaggugugug

SEQ ID NO: 1019668 - RNA, 22 nt, Human
aggggagcuaacaccagagccc

SEQ ID NO: 1019669 - RNA, 23 nt, Human
agccacuucuaucuugcuccugg

SEQ ID NO: 1019670 - RNA, 22 nt, Human
ggcuuucuaugaacucaaaggc

SEQ ID NO: 1019671 - RNA, 22 nt, Human
uggcucagauaauucaaggggc

SEQ ID NO: 1019672 - RNA, 22 nt, Human
gcugucacucuccggccuuccc

SEQ ID NO: 1019673 - RNA, 22 nt, Human
agcugccauggccugaauuuac

SEQ ID NO: 1019674 - RNA, 22 nt, Human
cccagcagaccgcugugauggc

SEQ ID NO: 1019675 - RNA, 22 nt, Human
agcuuuaucacaauauuggcua

SEQ ID NO: 1019676 - RNA, 20 nt, Human
aucaggauucuugcuuuguu

SEQ ID NO: 1019677 - RNA, 22 nt, Human
uaguccauuuucacacugcuga

SEQ ID NO: 1019678 - RNA, 22 nt, Human
cacucaggcugugucaggagga

SEQ ID NO: 1019679 - RNA, 22 nt, Human
gggcagccucggugccugcugc

SEQ ID NO: 1019680 - RNA, 22 nt, Human
aguuuuaugcaguguucugaua

SEQ ID NO: 1019681 - RNA, 22 nt, Human
aaggcacuugcccagagcugca

SEQ ID NO: 1019682 - RNA, 22 nt, Human
accauguuggccaagcuggucu

SEQ ID NO: 1019683 - RNA, 22 nt, Human
ccugccaggacauugcuugaag

SEQ ID NO: 1019684 - RNA, 22 nt, Human
gaggaagcagggcuuggcugag

SEQ ID NO: 1019685 - RNA, 22 nt, Human
gcacagaaguaaaauacaaguc

SEQ ID NO: 1019686 - RNA, 22 nt, Human
uuucaauguaugucuuucugag

SEQ ID NO: 1019687 - RNA, 23 nt, Human
uguaugaauaugccacaguuuaa

SEQ ID NO: 1019688 - RNA, 22 nt, Human
cugucaccuguucacugcagca

SEQ ID NO: 1019689 - RNA, 17 nt, Human
uucaaugauuaaugcau

SEQ ID NO: 1019690 - RNA, 22 nt, Human
ucagagcuuaucucuugcugga

SEQ ID NO: 1019691 - RNA, 22 nt, Human
aacuagaacgucuaguugcugg

SEQ ID NO: 1019692 - RNA, 22 nt, Human
uucauucccaagaguaaacaua

SEQ ID NO: 1019693 - RNA, 22 nt, Human
cccuggagggacagcugcucua

SEQ ID NO: 1019694 - RNA, 22 nt, Human
uguuguuuucucauggagaaua

SEQ ID NO: 1019695 - RNA, 22 nt, Human
gcugucugagaacaugguggaa

SEQ ID NO: 1019696 - RNA, 22 nt, Human
accaggcacucuuguggcagug

SEQ ID NO: 1019697 - RNA, 22 nt, Human
aaugggagguaguaugggaggu

SEQ ID NO: 1019698 - RNA, 22 nt, Human
ugauugacuuuagaauagcacu

SEQ ID NO: 1019699 - RNA, 22 nt, Human
cagcuuggaggaggaucuaaga

SEQ ID NO: 1019700 - RNA, 22 nt, Human
ucaggauguuaauauagcauua

SEQ ID NO: 1019701 - RNA, 23 nt, Human
ucucaggacacacaugucuauca

SEQ ID NO: 1019702 - RNA, 22 nt, Human
agaggaugauuuuaaggacacu

SEQ ID NO: 1019703 - RNA, 19 nt, Human
ugcccaggccagguugggc

SEQ ID NO: 1019704 - RNA, 22 nt, Human
cugcccugugaggguccuuggg

SEQ ID NO: 1019705 - RNA, 22 nt, Human
cccuggagggauuucucaauca

SEQ ID NO: 1019706 - RNA, 22 nt, Human
uccaugugccaaggggcagagg

SEQ ID NO: 1019707 - RNA, 22 nt, Human
aucuacccacugaacacaauau

SEQ ID NO: 1019708 - RNA, 22 nt, Human
uuuucuuauggugaagcacaaa

SEQ ID NO: 1019709 - RNA, 22 nt, Human
guuucauuaccugacccaugag

SEQ ID NO: 1019710 - RNA, 23 nt, Human
uuacaguaggaguuggaaaacca

SEQ ID NO: 1019711 - RNA, 22 nt, Human
ggcucuggcaaggggaggcuac

SEQ ID NO: 1019712 - RNA, 22 nt, Human
cacugcuucuggaggaauuugg

SEQ ID NO: 1019713 - RNA, 22 nt, Human
ccagaagucaggaaugagucuu

SEQ ID NO: 1019714 - RNA, 22 nt, Human
acaaaugccauauauaaauucu

SEQ ID NO: 1019715 - RNA, 20 nt, Human
ccagacagcaccugccuggu

SEQ ID NO: 1019716 - RNA, 22 nt, Human
ggcuggcauccagggaaaucca

SEQ ID NO: 1019717 - RNA, 22 nt, Human
auaacagagagcuacugaacug

SEQ ID NO: 1019718 - RNA, 22 nt, Human
cuugcugugugguguucucaga

SEQ ID NO: 1019719 - RNA, 22 nt, Human
gagccuggacaucucaggccca

SEQ ID NO: 1019720 - RNA, 21 nt, Human
ggcauggcaccucugggcagg

SEQ ID NO: 1019721 - RNA, 22 nt, Human
ucaggaugguguggaggaaaua

SEQ ID NO: 1019722 - RNA, 22 nt, Human
cauguacauucuguagauggag

SEQ ID NO: 1019723 - RNA, 22 nt, Human
gagccugagugcugccuccccu

SEQ ID NO: 1019724 - RNA, 22 nt, Human
gccagggaacccaagggccuca

SEQ ID NO: 1019725 - RNA, 22 nt, Human
uaugcacacauguaugcaugug

SEQ ID NO: 1019726 - RNA, 22 nt, Human
auaugucgcuacaucauuagau

SEQ ID NO: 1019727 - RNA, 22 nt, Human
auaaauaucacuguugucccuc

SEQ ID NO: 1019728 - RNA, 22 nt, Human
agccagccgggggaccacagug

SEQ ID NO: 1019729 - RNA, 22 nt, Human
uugauagguuuuauguauaguu

SEQ ID NO: 1019730 - RNA, 22 nt, Human
cagcuccugggccaucuccuag

SEQ ID NO: 1019731 - RNA, 22 nt, Human
cuuguagaauugaaauggucuc

SEQ ID NO: 1019732 - RNA, 22 nt, Human
cccaggaggcagaaguugcagu

SEQ ID NO: 1019733 - RNA, 22 nt, Human
ccaaaugcuccacugacuuugg

SEQ ID NO: 1019734 - RNA, 22 nt, Human
ucuggcagggguucugcacuug

SEQ ID NO: 1019735 - RNA, 22 nt, Human
ugcaggagcagagauggcugga

SEQ ID NO: 1019736 - RNA, 22 nt, Human
ugagguggcuagggaggcacuc

SEQ ID NO: 1019737 - RNA, 22 nt, Human
aguuugaaaguauugacagaag

SEQ ID NO: 1019738 - RNA, 22 nt, Human
uguaccuuuuucugugcaugcu

SEQ ID NO: 1019739 - RNA, 23 nt, Human
auugaugacuugauuacacuuuu

SEQ ID NO: 1019740 - RNA, 22 nt, Human
aucuggcugacuuugugggaca

SEQ ID NO: 1019741 - RNA, 22 nt, Human
cugcaucacagcaggaggcaca

SEQ ID NO: 1019742 - RNA, 22 nt, Human
gugacucacacaggccugggcu

SEQ ID NO: 1019743 - RNA, 22 nt, Human
ugccagggugucaggagagcua

SEQ ID NO: 1019744 - RNA, 22 nt, Human
agaaaaggauugauggaucaga

SEQ ID NO: 1019745 - RNA, 22 nt, Human
ccaccuccaccuauugccagcc

SEQ ID NO: 1019746 - RNA, 22 nt, Human
cagcuuuagagaaaacauauuu

SEQ ID NO: 1019747 - RNA, 19 nt, Human
cuugcugggugguuucugc

SEQ ID NO: 1019748 - RNA, 22 nt, Human
cauaccuuucucaagcacaugu

SEQ ID NO: 1019749 - RNA, 22 nt, Human
uucuccagagggcucugcagga

SEQ ID NO: 1019750 - RNA, 22 nt, Human
ccagugcuucuuugcuagcugg

SEQ ID NO: 1019751 - RNA, 22 nt, Human
aggaguggaauuacuggguucu

SEQ ID NO: 1019752 - RNA, 22 nt, Human
gcugucacauuuggagcacugg

SEQ ID NO: 1019753 - RNA, 22 nt, Human
gccuggucucuuucaugucagu

SEQ ID NO: 1019754 - RNA, 22 nt, Human
ucagcuuucucuucuaucgaua

SEQ ID NO: 1019755 - RNA, 22 nt, Human
gcugucugucuucacaucucgc

SEQ ID NO: 1019756 - RNA, 21 nt, Human
uaaagaagaugaaugugauca

SEQ ID NO: 1019757 - RNA, 22 nt, Human
ggcucagggaaugaggaagaau

SEQ ID NO: 1019758 - RNA, 22 nt, Human
gguggcagucuuaagagaucuu

SEQ ID NO: 1019759 - RNA, 22 nt, Human
ucauuuguugaacuuuagugcg

SEQ ID NO: 1019760 - RNA, 22 nt, Human
gacaaaggaucagagguuggga

SEQ ID NO: 1019761 - RNA, 22 nt, Human
guggcacuaaauacagcauuuc

SEQ ID NO: 1019762 - RNA, 22 nt, Human
cuggcuuucauuucaagcacgu

SEQ ID NO: 1019763 - RNA, 22 nt, Human
ucccagagaaagucaaggucuu

SEQ ID NO: 1019764 - RNA, 22 nt, Human
aacugcauucagaaagcucacu

SEQ ID NO: 1019765 - RNA, 23 nt, Human
cccauuuucauguuaacuccugg

SEQ ID NO: 1019766 - RNA, 22 nt, Human
uucacagggccacuggcaggag

SEQ ID NO: 1019767 - RNA, 22 nt, Human
aagggcucccaacucaucuuuu

SEQ ID NO: 1019768 - RNA, 22 nt, Human
uuggcaguagucucggcuaccc

SEQ ID NO: 1019769 - RNA, 22 nt, Human
auguguacaaccaagcacuaaa

SEQ ID NO: 1019770 - RNA, 22 nt, Human
agcuggggcugcagagaacagg

SEQ ID NO: 1019771 - RNA, 22 nt, Human
cuacauuucccagcugccuucc

SEQ ID NO: 1019772 - RNA, 22 nt, Human
cacagaguggaggcuuggccug

SEQ ID NO: 1019773 - RNA, 22 nt, Human
uuguaacaaucugucauaaaug

SEQ ID NO: 1019774 - RNA, 22 nt, Human
gcacugugcuagaagccagggg

SEQ ID NO: 1019775 - RNA, 22 nt, Human
ucacuguugaccuggaaguggg

SEQ ID NO: 1019776 - RNA, 22 nt, Human
ucaaaugcaggucuggucuugg

SEQ ID NO: 1019777 - RNA, 22 nt, Human
ggcuggcaagucagugcugaug

SEQ ID NO: 1019778 - RNA, 22 nt, Human
ugagcacaaguuugcaugugug

SEQ ID NO: 1019779 - RNA, 22 nt, Human
gagggacagcuaaagagaaauu

SEQ ID NO: 1019780 - RNA, 21 nt, Human
ugccagggauuuacagagccu

SEQ ID NO: 1019781 - RNA, 22 nt, Human
guugaaagaucauguggcugcc

SEQ ID NO: 1019782 - RNA, 22 nt, Human
ucugugcaggaagucauuauga

SEQ ID NO: 1019783 - RNA, 22 nt, Human
uaaagguaugucuuaaucaaac

SEQ ID NO: 1019784 - RNA, 22 nt, Human
uggggcuguggauucucacgaa

SEQ ID NO: 1019785 - RNA, 22 nt, Human
gggaguguugagcgcccugcca

SEQ ID NO: 1019786 - RNA, 22 nt, Human
ccuggagcgcgggucaagcugg

SEQ ID NO: 1019787 - RNA, 22 nt, Human
uuauuagguuuacauaaagguu

SEQ ID NO: 1019788 - RNA, 22 nt, Human
cagccagaaccuaggaugagcu

SEQ ID NO: 1019789 - RNA, 22 nt, Human
uucagagaagcaaaggcagauu

SEQ ID NO: 1019790 - RNA, 22 nt, Human
cugggcuguaauguggcacuga

SEQ ID NO: 1019791 - RNA, 22 nt, Human
uuccaggacuggguguuugaag

SEQ ID NO: 1019792 - RNA, 22 nt, Human
acauuucuauagugcaucuguu

SEQ ID NO: 1019793 - RNA, 22 nt, Human
ugucaagucucugaaugaaaug

SEQ ID NO: 1019794 - RNA, 22 nt, Human
aaaggccacugcaagggaaggu

SEQ ID NO: 1019795 - RNA, 23 nt, Human
gggcuccagucucugcucaguug

SEQ ID NO: 1019796 - RNA, 22 nt, Human
uccagaguacggaagagucauc

SEQ ID NO: 1019797 - RNA, 22 nt, Human
ugggcuggcguggagaguuuag

SEQ ID NO: 1019798 - RNA, 22 nt, Human
ggcugcugcccaccccugcaug

SEQ ID NO: 1019799 - RNA, 22 nt, Human
gauuuccuaauguggaucucug

SEQ ID NO: 1019800 - RNA, 17 nt, Human
ucuggccuuccugaacu

SEQ ID NO: 1019801 - RNA, 22 nt, Human
cuucagagugcagaagauuggg

SEQ ID NO: 1019802 - RNA, 22 nt, Human
ucuggccuauuucugucagauc

SEQ ID NO: 1019803 - RNA, 22 nt, Human
gcucuggaagcaucugagagga

SEQ ID NO: 1019804 - RNA, 22 nt, Human
ucuuacauauagcaugaguaca

SEQ ID NO: 1019805 - RNA, 22 nt, Human
gcaaagcugggugugaaugcac

SEQ ID NO: 1019806 - RNA, 22 nt, Human
gggaccugccaaggccacccag

SEQ ID NO: 1019807 - RNA, 23 nt, Human
uuucuguuggguauauauccaag

SEQ ID NO: 1019808 - RNA, 22 nt, Human
acgcagaagggccuggcgugcc

SEQ ID NO: 1019809 - RNA, 22 nt, Human
aggccucagugaucaucaucag

SEQ ID NO: 1019810 - RNA, 22 nt, Human
cuggcuggcaaguagaacacaa

SEQ ID NO: 1019811 - RNA, 22 nt, Human
ggauggagguucucagaugcuc

SEQ ID NO: 1019812 - RNA, 22 nt, Human
accaaggagaaggugcaagcuu

SEQ ID NO: 1019813 - RNA, 20 nt, Human
uaugaguauuacuuucagga

SEQ ID NO: 1019814 - RNA, 18 nt, Human
caugucugcgccacaagg

SEQ ID NO: 1019815 - RNA, 22 nt, Human
ccuggaagauucaccacuacca

SEQ ID NO: 1019816 - RNA, 22 nt, Human
aagagcuggaguuugcagcccu

SEQ ID NO: 1019817 - RNA, 22 nt, Human
cucugcaggggaggcaugcacu

SEQ ID NO: 1019818 - RNA, 22 nt, Human
aggcacugauucucagaguuac

SEQ ID NO: 1019819 - RNA, 22 nt, Human
gugccucagcaccgccugcagc

SEQ ID NO: 1019820 - RNA, 22 nt, Human
caaauguauaaauguacuuucu

SEQ ID NO: 1019821 - RNA, 22 nt, Human
agagcagcacguuguccccaca

SEQ ID NO: 1019822 - RNA, 19 nt, Human
ugagaaggcaguggggagc

SEQ ID NO: 1019823 - RNA, 23 nt, Human
cucugcaggagagugggcagggc

SEQ ID NO: 1019824 - RNA, 22 nt, Human
cuuugcauacaauuuuuagaaa

SEQ ID NO: 1019825 - RNA, 22 nt, Human
uggggaggacgggcgccuuccu

SEQ ID NO: 1019826 - RNA, 22 nt, Human
augggguggaguccgggcagcg

SEQ ID NO: 1019827 - RNA, 22 nt, Human
gcaggagagucugugccagguu

SEQ ID NO: 1019828 - RNA, 22 nt, Human
aagcuuuagagaugaguuccuu

SEQ ID NO: 1019829 - RNA, 22 nt, Human
gaaggcugaugacagauucugc

SEQ ID NO: 1019830 - RNA, 22 nt, Human
gugugcagaagacacaagacau

SEQ ID NO: 1019831 - RNA, 18 nt, Human
ucagagguacagaaaagu

SEQ ID NO: 1019832 - RNA, 22 nt, Human
gccugcagggcccuuguggguc

SEQ ID NO: 1019833 - RNA, 22 nt, Human
ggcucagaccucccagcuccag

SEQ ID NO: 1019834 - RNA, 22 nt, Human
caguacuuugaagauauuuuag

SEQ ID NO: 1019835 - RNA, 22 nt, Human
gggcugccaagccugccugccu

SEQ ID NO: 1019836 - RNA, 22 nt, Human
ggcuguagguuggugcuggaca

SEQ ID NO: 1019837 - RNA, 22 nt, Human
aaauaauguuaggccuuugcuc

SEQ ID NO: 1019838 - RNA, 22 nt, Human
uuucuaggcacagugucuuccc

SEQ ID NO: 1019839 - RNA, 22 nt, Human
auccuugagccaaugacugauu

SEQ ID NO: 1019840 - RNA, 22 nt, Human
cuucaggauuuaggaagaugaa

SEQ ID NO: 1019841 - RNA, 22 nt, Human
gagcugcuggcuccucagguua

SEQ ID NO: 1019842 - RNA, 22 nt, Human
uccgcccgcacguauggagugg

SEQ ID NO: 1019843 - RNA, 22 nt, Human
gacccagcuuaagucacauguu

SEQ ID NO: 1019844 - RNA, 22 nt, Human
uggcagaggaaaaagucacugg

SEQ ID NO: 1019845 - RNA, 22 nt, Human
auggcugggaugggguagagaa

SEQ ID NO: 1019846 - RNA, 23 nt, Human
agggcccaagccuggacagcagg

SEQ ID NO: 1019847 - RNA, 22 nt, Human
gaggcucagagggagcaugguc

SEQ ID NO: 1019848 - RNA, 22 nt, Human
aggccagcaagaaagagagucu

SEQ ID NO: 1019849 - RNA, 22 nt, Human
ucugcucuguggcuucagcuaa

SEQ ID NO: 1019850 - RNA, 20 nt, Human
cuccagggaacagacuggag

SEQ ID NO: 1019851 - RNA, 22 nt, Human
gggauggcucaaaggagucagg

SEQ ID NO: 1019852 - RNA, 22 nt, Human
cagagcugucauuugccaguga

SEQ ID NO: 1019853 - RNA, 22 nt, Human
acaagauagcuuagaagauuca

SEQ ID NO: 1019854 - RNA, 22 nt, Human
uguauguguauguacauaugca

SEQ ID NO: 1019855 - RNA, 22 nt, Human
gaggggcagagguagagaacaa

SEQ ID NO: 1019856 - RNA, 22 nt, Human
gucaggaugacaagugcuuuca

SEQ ID NO: 1019857 - RNA, 22 nt, Human
uagugaaacaguuaucaaucug

SEQ ID NO: 1019858 - RNA, 22 nt, Human
ggccagugugcaggucagagau

SEQ ID NO: 1019859 - RNA, 22 nt, Human
uaaaugcaguacaaauuguucu

SEQ ID NO: 1019860 - RNA, 22 nt, Human
caggcagcagccacucugguau

SEQ ID NO: 1019861 - RNA, 20 nt, Human
cccugagaccagagagcagc

SEQ ID NO: 1019862 - RNA, 22 nt, Human
cccagggcccuggacagcuaca

SEQ ID NO: 1019863 - RNA, 22 nt, Human
uaaggcacccauguucauacag

SEQ ID NO: 1019864 - RNA, 22 nt, Human
ccugagagcagcuuccugcuua

SEQ ID NO: 1019865 - RNA, 22 nt, Human
gcacugaaaauguuggauucca

SEQ ID NO: 1019866 - RNA, 22 nt, Human
aggagcagcccacuccuguccu

SEQ ID NO: 1019867 - RNA, 19 nt, Human
agccacagaacuugcagga

SEQ ID NO: 1019868 - RNA, 22 nt, Human
cucacugucuguacuagcugau

SEQ ID NO: 1019869 - RNA, 22 nt, Human
auggggagagaagggcugagcu

SEQ ID NO: 1019870 - RNA, 22 nt, Human
gcugccugguuucucagcugca

SEQ ID NO: 1019871 - RNA, 22 nt, Human
cuggcuccuccaaggccuggag

SEQ ID NO: 1019872 - RNA, 22 nt, Human
ucugucugagggagugacauuu

SEQ ID NO: 1019873 - RNA, 23 nt, Human
acagaggcuuaaaugaguggcag

SEQ ID NO: 1019874 - RNA, 22 nt, Human
gcaggcaguuugcuuuucccuc

SEQ ID NO: 1019875 - RNA, 22 nt, Human
gcaaguacaaacgcaucggcug

SEQ ID NO: 1019876 - RNA, 22 nt, Human
aggcaugugacccuggacucag

SEQ ID NO: 1019877 - RNA, 23 nt, Human
cuggggcuuucaaaucugggcag

SEQ ID NO: 1019878 - RNA, 22 nt, Human
ucucuucuauuugagacuauuu

SEQ ID NO: 1019879 - RNA, 22 nt, Human
ucccagagugugggcaucaagg

SEQ ID NO: 1019880 - RNA, 22 nt, Human
cauuugaaauaguucauucuug

SEQ ID NO: 1019881 - RNA, 19 nt, Human
uggcuuccaucucucucau

SEQ ID NO: 1019882 - RNA, 22 nt, Human
cagucacauugcccugcauuua

SEQ ID NO: 1019883 - RNA, 22 nt, Human
agguggcuccucccauggcugg

SEQ ID NO: 1019884 - RNA, 22 nt, Human
ggggcagaaagcccacagagug

SEQ ID NO: 1019885 - RNA, 22 nt, Human
auuguacaugcagugagucauc

SEQ ID NO: 1019886 - RNA, 22 nt, Human
uccuggaggcaaaugaagacuc

SEQ ID NO: 1019887 - RNA, 22 nt, Human
ucccagagguugagucacuuau

SEQ ID NO: 1019888 - RNA, 22 nt, Human
cagagccagcaguggggacagg

SEQ ID NO: 1019889 - RNA, 22 nt, Human
aguuauuacucuuuaacauauu

SEQ ID NO: 1019890 - RNA, 22 nt, Human
aaaagcucuuucugcuguagau

SEQ ID NO: 1019891 - RNA, 20 nt, Human
guauuaggagguaaauguaa

SEQ ID NO: 1019892 - RNA, 22 nt, Human
cacauguaguaagcaggcaaug

SEQ ID NO: 1019893 - RNA, 22 nt, Human
aggaggugacagccugcaucug

SEQ ID NO: 1019894 - RNA, 22 nt, Human
aucagagaaauggagggcgcuu

SEQ ID NO: 1019895 - RNA, 22 nt, Human
uugcugugucauuuguuuaauc

SEQ ID NO: 1019896 - RNA, 22 nt, Human
uuucaugagauuccuccacauc

SEQ ID NO: 1019897 - RNA, 22 nt, Human
guuccauaucacagcagacgaa

SEQ ID NO: 1019898 - RNA, 22 nt, Human
ugcuagaauuagguuaaacaaa

SEQ ID NO: 1019899 - RNA, 22 nt, Human
aagcuuuaaggaauuuuaugga

SEQ ID NO: 1019900 - RNA, 22 nt, Human
uggagcuggaauuucugggccu

SEQ ID NO: 1019901 - RNA, 22 nt, Human
gugugccaacaaaagacagugc

SEQ ID NO: 1019902 - RNA, 22 nt, Human
agcagcucuuaacaaagcaugg

SEQ ID NO: 1019903 - RNA, 22 nt, Human
ugaaacacugcgauaaaauccu

SEQ ID NO: 1019904 - RNA, 22 nt, Human
acaggacaggcugggcuagacu

SEQ ID NO: 1019905 - RNA, 22 nt, Human
ggcagcacugcagcuuguuggg

SEQ ID NO: 1019906 - RNA, 22 nt, Human
uggagcagggcaucacugugcg

SEQ ID NO: 1019907 - RNA, 21 nt, Human
gccugcaguuuugaagcccuu

SEQ ID NO: 1019908 - RNA, 22 nt, Human
ucagggacauuuagacacugau

SEQ ID NO: 1019909 - RNA, 22 nt, Human
cauggccuugagugacugcacu

SEQ ID NO: 1019910 - RNA, 22 nt, Human
aguaaaauuucugcugaggaga

SEQ ID NO: 1019911 - RNA, 22 nt, Human
uauuggugggggcagagagaga

SEQ ID NO: 1019912 - RNA, 22 nt, Human
gcugcucugcuguguaagcagg

SEQ ID NO: 1019913 - RNA, 22 nt, Human
cuugccuucuguuccuauagaa

SEQ ID NO: 1019914 - RNA, 22 nt, Human
agcagagucugugugcacuuua

SEQ ID NO: 1019915 - RNA, 22 nt, Human
cucacugcccugaaguuggguu

SEQ ID NO: 1019916 - RNA, 22 nt, Human
uagucuuuugagaaguauaucu

SEQ ID NO: 1019917 - RNA, 22 nt, Human
uacauauguaaacauguauaaa

SEQ ID NO: 1019918 - RNA, 22 nt, Human
acagcagcuggguucccaccau

SEQ ID NO: 1019919 - RNA, 22 nt, Human
cucccuggaggcccagaccugg

SEQ ID NO: 1019920 - RNA, 22 nt, Human
cauuaggguaauugaacacuua

SEQ ID NO: 1019921 - RNA, 22 nt, Human
ugaaucaguauaaauucucaaa

SEQ ID NO: 1019922 - RNA, 22 nt, Human
ucauugaacgaagagcuccauu

SEQ ID NO: 1019923 - RNA, 17 nt, Human
acagggcagaaacagcu

SEQ ID NO: 1019924 - RNA, 22 nt, Human
ggaggccaaagugugggcggcu

SEQ ID NO: 1019925 - RNA, 22 nt, Human
uucacuuaacaucauaucauga

SEQ ID NO: 1019926 - RNA, 22 nt, Human
aguuauucauuuauucuguaca

SEQ ID NO: 1019927 - RNA, 22 nt, Human
aguuauuucaguaacauaauag

SEQ ID NO: 1019928 - RNA, 22 nt, Human
uccucuggcccagcugccucug

SEQ ID NO: 1019929 - RNA, 22 nt, Human
uuaaaaugcagauucugauuca

SEQ ID NO: 1019930 - RNA, 22 nt, Human
ucucagaguuccucuggagucc

SEQ ID NO: 1019931 - RNA, 22 nt, Human
ucaggcagaugcagggauggau

SEQ ID NO: 1019932 - RNA, 22 nt, Human
aagcaauagcaacaacuuuaca

SEQ ID NO: 1019933 - RNA, 22 nt, Human
ugaggugaccgcagaugggaag

SEQ ID NO: 1019934 - RNA, 22 nt, Human
uuguaacagguacuaaauaacu

SEQ ID NO: 1019935 - RNA, 21 nt, Human
cucaggauggcggccuggugg

SEQ ID NO: 1019936 - RNA, 18 nt, Human
ucagagagaauaguaauu

SEQ ID NO: 1019937 - RNA, 22 nt, Human
ugcauguguguguauuuauaaa

SEQ ID NO: 1019938 - RNA, 22 nt, Human
cagggacccuacuagcucacac

SEQ ID NO: 1019939 - RNA, 22 nt, Human
agggacccauagagagaccagu

SEQ ID NO: 1019940 - RNA, 22 nt, Human
uggccuuggcagugagaagagu

SEQ ID NO: 1019941 - RNA, 21 nt, Human
acagcagggcuggcaugacag

SEQ ID NO: 1019942 - RNA, 22 nt, Human
agggcagcagcccauggcucug

SEQ ID NO: 1019943 - RNA, 22 nt, Human
cauguacacucauguaacuaua

SEQ ID NO: 1019944 - RNA, 22 nt, Human
aaauguaguauguugcauguau

SEQ ID NO: 1019945 - RNA, 22 nt, Human
accucuggccuucaggcaucau

SEQ ID NO: 1019946 - RNA, 22 nt, Human
uuuaagauucaguaaggcaaac

SEQ ID NO: 1019947 - RNA, 22 nt, Human
cagcuuggcuuccgcuuuacug

SEQ ID NO: 1019948 - RNA, 22 nt, Human
ugucugugaccucuuaggcaag

SEQ ID NO: 1019949 - RNA, 22 nt, Human
auucauuuagguauucacuuac

SEQ ID NO: 1019950 - RNA, 22 nt, Human
gacaggggucccucugggcugu

SEQ ID NO: 1019951 - RNA, 22 nt, Human
acauuuaaccaaacuguuuaau

SEQ ID NO: 1019952 - RNA, 22 nt, Human
acacagggaggaggugcugugc

SEQ ID NO: 1019953 - RNA, 22 nt, Human
cuucuggaggacacuggcccca

SEQ ID NO: 1019954 - RNA, 22 nt, Human
cuggcagucacggccaugugcu

SEQ ID NO: 1019955 - RNA, 22 nt, Human
aucaggauagugguuaccuggg

SEQ ID NO: 1019956 - RNA, 22 nt, Human
cugagccaaggggacagugaca

SEQ ID NO: 1019957 - RNA, 22 nt, Human
gcuggggucugugaggagggcu

SEQ ID NO: 1019958 - RNA, 22 nt, Human
ucucugaagauauuuauuauua

SEQ ID NO: 1019959 - RNA, 22 nt, Human
ucacaaaagcuuuugaauuugg

SEQ ID NO: 1019960 - RNA, 19 nt, Human
acauauguggauauacaug

SEQ ID NO: 1019961 - RNA, 22 nt, Human
uaggcacuggggaggcagcaug

SEQ ID NO: 1019962 - RNA, 22 nt, Human
aguccagggcucucugugggau

SEQ ID NO: 1019963 - RNA, 22 nt, Human
gaagagcugcaguuuccugggc

SEQ ID NO: 1019964 - RNA, 22 nt, Human
cagaggcagacccuccagggcg

SEQ ID NO: 1019965 - RNA, 22 nt, Human
cauguuuucuaggcuuucacaa

SEQ ID NO: 1019966 - RNA, 22 nt, Human
uacuuuagaaggaaauaaguuc

SEQ ID NO: 1019967 - RNA, 22 nt, Human
ggcauccaaauaccaagaugua

SEQ ID NO: 1019968 - RNA, 22 nt, Human
cuguccuguagcuccaucaguc

SEQ ID NO: 1019969 - RNA, 22 nt, Human
ugcugcuguauccuuaguguca

SEQ ID NO: 1019970 - RNA, 22 nt, Human
gcugugcagucuuuggugugcc

SEQ ID NO: 1019971 - RNA, 22 nt, Human
cucuggccagagccugcgggaa

SEQ ID NO: 1019972 - RNA, 22 nt, Human
uggagcccagacacuggcauug

SEQ ID NO: 1019973 - RNA, 22 nt, Human
agguaaaauagauaguauuucu

SEQ ID NO: 1019974 - RNA, 22 nt, Human
uaagacauuugaaaugugaucc

SEQ ID NO: 1019975 - RNA, 22 nt, Human
caggguggcacucagcgcaucu

SEQ ID NO: 1019976 - RNA, 22 nt, Human
ugugaugguucacugggcauga

SEQ ID NO: 1019977 - RNA, 22 nt, Human
aucauuacuccuguaaaauugu

SEQ ID NO: 1019978 - RNA, 22 nt, Human
gcauugaguccacucugucuuu

SEQ ID NO: 1019979 - RNA, 22 nt, Human
gcuggccauauauuuugcuguu

SEQ ID NO: 1019980 - RNA, 22 nt, Human
cagggacccgcacagguagcau

SEQ ID NO: 1019981 - RNA, 22 nt, Human
uucugucagcgucagaaauucu

SEQ ID NO: 1019982 - RNA, 22 nt, Human
uguggccaccagagcugcuauu

SEQ ID NO: 1019983 - RNA, 22 nt, Human
aucagcaaaaaugccuucagaa

SEQ ID NO: 1019984 - RNA, 22 nt, Human
uauuccagugugaucuuuguag

SEQ ID NO: 1019985 - RNA, 22 nt, Human
uuauguaauuuguuugcucuuc

SEQ ID NO: 1019986 - RNA, 18 nt, Human
ucugggcuucccgaggcu

SEQ ID NO: 1019987 - RNA, 22 nt, Human
caaauguguaaggaaguguuag

SEQ ID NO: 1019988 - RNA, 22 nt, Human
ugaaguuauauauguugaaaau

SEQ ID NO: 1019989 - RNA, 22 nt, Human
uccuauugguagacauuucugu

SEQ ID NO: 1019990 - RNA, 22 nt, Human
ucauuucuauugcuacugucug

SEQ ID NO: 1019991 - RNA, 22 nt, Human
ugaguuuugucuugcuagaagu

SEQ ID NO: 1019992 - RNA, 22 nt, Human
uauauucaaugauuaguaucag

SEQ ID NO: 1019993 - RNA, 22 nt, Human
ggagggcugccagguggagcgg

SEQ ID NO: 1019994 - RNA, 22 nt, Human
ggaaagagcuaaaagggugaga

SEQ ID NO: 1019995 - RNA, 22 nt, Human
cugggugaguugaugaaggaga

SEQ ID NO: 1019996 - RNA, 22 nt, Human
uagaaaugaauguuuaaaaguc

SEQ ID NO: 1019997 - RNA, 22 nt, Human
uaugugaauacagcaguggaug

SEQ ID NO: 1019998 - RNA, 22 nt, Human
caggccucuauggucagcugag

SEQ ID NO: 1019999 - RNA, 22 nt, Human
gagggauggugugagaggcuca

SEQ ID NO: 1020000 - RNA, 22 nt, Human
uagggcagcugcaucaggcacu

SEQ ID NO: 1020001 - RNA, 22 nt, Human
cagaaguaagauuacugugaga

SEQ ID NO: 1020002 - RNA, 22 nt, Human
agggagacacaugaggaaguca

SEQ ID NO: 1020003 - RNA, 22 nt, Human
auaaaauuugcuacuguuaaau

SEQ ID NO: 1020004 - RNA, 19 nt, Human
cucugccucccuccugggu

SEQ ID NO: 1020005 - RNA, 22 nt, Human
gucccuuggcucacaaacagcu

SEQ ID NO: 1020006 - RNA, 21 nt, Human
cauuucuauugaugagaaaag

SEQ ID NO: 1020007 - RNA, 22 nt, Human
ccagagaccagaacauggggau

SEQ ID NO: 1020008 - RNA, 22 nt, Human
uuucagaaagcaucaucaaagu

SEQ ID NO: 1020009 - RNA, 22 nt, Human
agaaauguuguggguuuuguua

SEQ ID NO: 1020010 - RNA, 22 nt, Human
uuuccucuuccgagggggaggc

SEQ ID NO: 1020011 - RNA, 22 nt, Human
ucuauaaauuaugcagucucag

SEQ ID NO: 1020012 - RNA, 22 nt, Human
ccugcaggggagagacuucuag

SEQ ID NO: 1020013 - RNA, 22 nt, Human
gcuggggaggcagcagagaaca

SEQ ID NO: 1020014 - RNA, 22 nt, Human
uucugucuguaaacuucucaau

SEQ ID NO: 1020015 - RNA, 22 nt, Human
acacaguaugaaaagucuaguu

SEQ ID NO: 1020016 - RNA, 22 nt, Human
caggcagcgcucguggccuggc

SEQ ID NO: 1020017 - RNA, 22 nt, Human
cagucucucugaaguauuaaga

SEQ ID NO: 1020018 - RNA, 22 nt, Human
cugaaaauguuacacaggaaga

SEQ ID NO: 1020019 - RNA, 22 nt, Human
agccuucagcaguucaggugcc

SEQ ID NO: 1020020 - RNA, 22 nt, Human
cccaugagaccugguuuaaggc

SEQ ID NO: 1020021 - RNA, 22 nt, Human
cagcccagccgagggccuggcu

SEQ ID NO: 1020022 - RNA, 22 nt, Human
uggcacauagaaaaggaucaau

SEQ ID NO: 1020023 - RNA, 22 nt, Human
caggcaccccaggugagcacug

SEQ ID NO: 1020024 - RNA, 21 nt, Human
ggccucugucauccugggaag

SEQ ID NO: 1020025 - RNA, 22 nt, Human
uccucugcuggaagggcaagag

SEQ ID NO: 1020026 - RNA, 22 nt, Human
agagauaugaguaguugugaca

SEQ ID NO: 1020027 - RNA, 22 nt, Human
auucacaguuuccucauauucu

SEQ ID NO: 1020028 - RNA, 22 nt, Human
caggguggaauggaaugcuggc

SEQ ID NO: 1020029 - RNA, 22 nt, Human
cggggcugcgcucuuccugccg

SEQ ID NO: 1020030 - RNA, 19 nt, Human
ccagagacauuggcaucuu

SEQ ID NO: 1020031 - RNA, 22 nt, Human
auggccuggccagagcucugcu

SEQ ID NO: 1020032 - RNA, 22 nt, Human
guccucugggcagcugccccac

SEQ ID NO: 1020033 - RNA, 22 nt, Human
uacauucuggaaaggcacagac

SEQ ID NO: 1020034 - RNA, 21 nt, Human
cacugcagccuugaccugggc

SEQ ID NO: 1020035 - RNA, 22 nt, Human
cagagcauuaaaaccagcucug

SEQ ID NO: 1020036 - RNA, 22 nt, Human
cugcuuccaugcaauggcaguc

SEQ ID NO: 1020037 - RNA, 22 nt, Human
gaaaugcauggaucuuggcaga

SEQ ID NO: 1020038 - RNA, 22 nt, Human
acagauauaugauuguguaaau

SEQ ID NO: 1020039 - RNA, 22 nt, Human
gccccuggcuggccagcuccuc

SEQ ID NO: 1020040 - RNA, 22 nt, Human
ggcggggguccaggagccugca

SEQ ID NO: 1020041 - RNA, 22 nt, Human
cagucuucuaaccuagcagccu

SEQ ID NO: 1020042 - RNA, 22 nt, Human
uacaaaguuuucuuggauugag

SEQ ID NO: 1020043 - RNA, 22 nt, Human
cuucucagaucucagcuuugag

SEQ ID NO: 1020044 - RNA, 20 nt, Human
cccagagccauagccagaca

SEQ ID NO: 1020045 - RNA, 22 nt, Human
aucuggcuugacuuugcgacuu

SEQ ID NO: 1020046 - RNA, 22 nt, Human
acagcagccugcagcccugugu

SEQ ID NO: 1020047 - RNA, 22 nt, Human
aggaagccugcaggugacugcu

SEQ ID NO: 1020048 - RNA, 20 nt, Human
acugugaaugcugaauuagc

SEQ ID NO: 1020049 - RNA, 22 nt, Human
caaaggcaguuacugaaugaag

SEQ ID NO: 1020050 - RNA, 22 nt, Human
cuuauuauaaaauccuguuuga

SEQ ID NO: 1020051 - RNA, 22 nt, Human
caggagacaauggcuguggggc

SEQ ID NO: 1020052 - RNA, 22 nt, Human
ucuaugaaaagucuauucauuc

SEQ ID NO: 1020053 - RNA, 22 nt, Human
cagcagagcauuugguaggagg

SEQ ID NO: 1020054 - RNA, 22 nt, Human
auuuccauacacccauuucuga

SEQ ID NO: 1020055 - RNA, 22 nt, Human
agugagggaugaagaacugcgg

SEQ ID NO: 1020056 - RNA, 22 nt, Human
uacaguagacaauguuaguaug

SEQ ID NO: 1020057 - RNA, 22 nt, Human
uggagcugagaaguggagcucu

SEQ ID NO: 1020058 - RNA, 22 nt, Human
gagggaccccaggcuggcccuu

SEQ ID NO: 1020059 - RNA, 22 nt, Human
ugaagggggagauauaugugug

SEQ ID NO: 1020060 - RNA, 22 nt, Human
cauuuuaagaugaccugguuuc

SEQ ID NO: 1020061 - RNA, 22 nt, Human
agcuuccuguugagagagggag

SEQ ID NO: 1020062 - RNA, 19 nt, Human
agcagccauagacaauaug

SEQ ID NO: 1020063 - RNA, 22 nt, Human
ccagggugagaaaaggcuggau

SEQ ID NO: 1020064 - RNA, 22 nt, Human
aaagaacaaauuagcuguuuua

SEQ ID NO: 1020065 - RNA, 22 nt, Human
auaaguucagguaaagaaauca

SEQ ID NO: 1020066 - RNA, 22 nt, Human
guggggggacguuggucacuuu

SEQ ID NO: 1020067 - RNA, 22 nt, Human
ugagaaagugggugccuagcaa

SEQ ID NO: 1020068 - RNA, 22 nt, Human
ugggcucugcaucagugcccau

SEQ ID NO: 1020069 - RNA, 22 nt, Human
agucuucacucuucacuacuau

SEQ ID NO: 1020070 - RNA, 22 nt, Human
uagacagauuucuuguuagaca

SEQ ID NO: 1020071 - RNA, 17 nt, Human
gagauggguggaucacc

SEQ ID NO: 1020072 - RNA, 22 nt, Human
ugcugccaaaugcgagcucugu

SEQ ID NO: 1020073 - RNA, 23 nt, Human
cagcccuuccugcauguuuuugu

SEQ ID NO: 1020074 - RNA, 22 nt, Human
ugcagaagauggucugagcacc

SEQ ID NO: 1020075 - RNA, 22 nt, Human
aacaaaugauaccaguucucaa

SEQ ID NO: 1020076 - RNA, 22 nt, Human
ccuugcauauauuauaucuuug

SEQ ID NO: 1020077 - RNA, 22 nt, Human
ccuggcagcuaagugcuuugag

SEQ ID NO: 1020078 - RNA, 22 nt, Human
gugccaaaagcuauaauuuggu

SEQ ID NO: 1020079 - RNA, 22 nt, Human
ugucagugguagacccagaggu

SEQ ID NO: 1020080 - RNA, 22 nt, Human
gggacuggcacagggcugggag

SEQ ID NO: 1020081 - RNA, 21 nt, Human
aaugugugcuauuuaucuuuu

SEQ ID NO: 1020082 - RNA, 22 nt, Human
uuuaauuuucugggcccagcag

SEQ ID NO: 1020083 - RNA, 22 nt, Human
ugguuuauuucucugaaagguu

SEQ ID NO: 1020084 - RNA, 22 nt, Human
auuuauuaccucggaguuucug

SEQ ID NO: 1020085 - RNA, 22 nt, Human
aggcucuggacagugaggaguu

SEQ ID NO: 1020086 - RNA, 22 nt, Human
uuaucauugucgcagucuaauu

SEQ ID NO: 1020087 - RNA, 22 nt, Human
uggcucagccauucguguugcc

SEQ ID NO: 1020088 - RNA, 21 nt, Human
uagggcucucugugucaggug

SEQ ID NO: 1020089 - RNA, 22 nt, Human
acagaauugauggaaaucucag

SEQ ID NO: 1020090 - RNA, 22 nt, Human
ccugggaguggcacucacagca

SEQ ID NO: 1020091 - RNA, 22 nt, Human
uucuuugcccuuaaugaaauaa

SEQ ID NO: 1020092 - RNA, 22 nt, Human
agagaggcgaguuaccugugcu

SEQ ID NO: 1020093 - RNA, 22 nt, Human
aaguugaagcaugaaccaaggu

SEQ ID NO: 1020094 - RNA, 22 nt, Human
gcagcagagcuuuguccuggcu

SEQ ID NO: 1020095 - RNA, 22 nt, Human
auagaaauggcagcuggugcua

SEQ ID NO: 1020096 - RNA, 22 nt, Human
gagagugucgggggccccagga

SEQ ID NO: 1020097 - RNA, 22 nt, Human
ccagagugacgugaagugugaa

SEQ ID NO: 1020098 - RNA, 22 nt, Human
aagaauucacugguagagucaa

SEQ ID NO: 1020099 - RNA, 22 nt, Human
acagauauaaacuauaguagug

SEQ ID NO: 1020100 - RNA, 22 nt, Human
cgugucaucugagccuugggcg

SEQ ID NO: 1020101 - RNA, 22 nt, Human
uugaggagcacuagucagguau

SEQ ID NO: 1020102 - RNA, 22 nt, Human
ugugaagcuggauccuggagcu

SEQ ID NO: 1020103 - RNA, 22 nt, Human
gagccaggguuugaaacuagac

SEQ ID NO: 1020104 - RNA, 23 nt, Human
aucagucuugguagcugugccca

SEQ ID NO: 1020105 - RNA, 22 nt, Human
aaaaugacauuccagugauauu

SEQ ID NO: 1020106 - RNA, 23 nt, Human
acugagccagggccugggucagc

SEQ ID NO: 1020107 - RNA, 22 nt, Human
uucucauucugacucaguguag

SEQ ID NO: 1020108 - RNA, 22 nt, Human
ccagggcuggugggagaugcug

SEQ ID NO: 1020109 - RNA, 22 nt, Human
guuuauuauucaacuucauguu

SEQ ID NO: 1020110 - RNA, 22 nt, Human
ugguccagacauuucugaggua

SEQ ID NO: 1020111 - RNA, 22 nt, Human
ucacagggcauuauggcuccag

SEQ ID NO: 1020112 - RNA, 22 nt, Human
auggcuggcauccaggugggcu

SEQ ID NO: 1020113 - RNA, 22 nt, Human
uaacagaagaugaaacuucuuu

SEQ ID NO: 1020114 - RNA, 22 nt, Human
ccugccugacagagaagguuca

SEQ ID NO: 1020115 - RNA, 22 nt, Human
gccucugcaugcucagcaccca

SEQ ID NO: 1020116 - RNA, 22 nt, Human
gcacaauuauuuaugcaguaug

SEQ ID NO: 1020117 - RNA, 22 nt, Human
cuccucagacuuuccuuguccg

SEQ ID NO: 1020118 - RNA, 22 nt, Human
gcuccugucuuggggcacuggc

SEQ ID NO: 1020119 - RNA, 22 nt, Human
uaaggcacuucaauguuuagaa

SEQ ID NO: 1020120 - RNA, 22 nt, Human
auacaaauuuauagaugcauuu

SEQ ID NO: 1020121 - RNA, 22 nt, Human
aucuggcuuuuacugaauugcu

SEQ ID NO: 1020122 - RNA, 22 nt, Human
aacucaguuacauauuagaaua

SEQ ID NO: 1020123 - RNA, 23 nt, Human
gcagagcugcccuauugccuugg

SEQ ID NO: 1020124 - RNA, 22 nt, Human
ucuugggauagugucucauggc

SEQ ID NO: 1020125 - RNA, 22 nt, Human
uccaugagaacccuuggagaua

SEQ ID NO: 1020126 - RNA, 22 nt, Human
caggacauugauccauuggcac

SEQ ID NO: 1020127 - RNA, 22 nt, Human
gccagggaggcuguaggguccu

SEQ ID NO: 1020128 - RNA, 22 nt, Human
cucagcagcagggaagagguca

SEQ ID NO: 1020129 - RNA, 22 nt, Human
gaacagaauuaccgaagaucug

SEQ ID NO: 1020130 - RNA, 20 nt, Human
ucagggcaugggacagcccc

SEQ ID NO: 1020131 - RNA, 22 nt, Human
aaguucaaguaguguuacaugg

SEQ ID NO: 1020132 - RNA, 22 nt, Human
auuuugaaaccaaguuauuucc

SEQ ID NO: 1020133 - RNA, 22 nt, Human
uagcagcuuaaguaauuagaau

SEQ ID NO: 1020134 - RNA, 22 nt, Human
cuuugcaauagaggcacacaug

SEQ ID NO: 1020135 - RNA, 22 nt, Human
caggccugugaguugaggcccc

SEQ ID NO: 1020136 - RNA, 22 nt, Human
augcugugucaggaauuugaua

SEQ ID NO: 1020137 - RNA, 22 nt, Human
gccaggcagccacccucugcga

SEQ ID NO: 1020138 - RNA, 22 nt, Human
ggcuucuuccugugaacauguu

SEQ ID NO: 1020139 - RNA, 22 nt, Human
uucuucuucauuucugacgaug

SEQ ID NO: 1020140 - RNA, 22 nt, Human
cagagagagugggguguggauu

SEQ ID NO: 1020141 - RNA, 19 nt, Human
ccaggccucuggggccugu

SEQ ID NO: 1020142 - RNA, 22 nt, Human
ggcugugccucaaggcuacuca

SEQ ID NO: 1020143 - RNA, 22 nt, Human
ugguggcuucugaggauggcga

SEQ ID NO: 1020144 - RNA, 22 nt, Human
cuggaaggcucugcugccuguc

SEQ ID NO: 1020145 - RNA, 22 nt, Human
ugcacacacgcggcacaucugu

SEQ ID NO: 1020146 - RNA, 22 nt, Human
cagggccaugaggcacaggguc

SEQ ID NO: 1020147 - RNA, 22 nt, Human
uucuuuaaaauagugagaaaga

SEQ ID NO: 1020148 - RNA, 22 nt, Human
ccugcagaaaggguccccagga

SEQ ID NO: 1020149 - RNA, 22 nt, Human
uuuggaauuggaaagugcugug

SEQ ID NO: 1020150 - RNA, 23 nt, Human
ucugcucugaaguucggcugagc

SEQ ID NO: 1020151 - RNA, 22 nt, Human
agggccucuaccauccaagguu

SEQ ID NO: 1020152 - RNA, 22 nt, Human
aggcuucuuagauuggcuggag

SEQ ID NO: 1020153 - RNA, 22 nt, Human
gccuaggagacaagcgugaaag

SEQ ID NO: 1020154 - RNA, 22 nt, Human
gccaggcaggccacgcuguguu

SEQ ID NO: 1020155 - RNA, 22 nt, Human
gugucccaauguucaggacggc

SEQ ID NO: 1020156 - RNA, 22 nt, Human
auucuguauuucuaauaagauc

SEQ ID NO: 1020157 - RNA, 22 nt, Human
agugcuuuauguuguugugcaa

SEQ ID NO: 1020158 - RNA, 22 nt, Human
guucuucaucauuaacacucug

SEQ ID NO: 1020159 - RNA, 22 nt, Human
uuaugauuugccacagauuggu

SEQ ID NO: 1020160 - RNA, 22 nt, Human
cgcugccaggauccccugccgg

SEQ ID NO: 1020161 - RNA, 22 nt, Human
ccucagggucugaggagaccgu

SEQ ID NO: 1020162 - RNA, 22 nt, Human
augcagagacagauguggcaug

SEQ ID NO: 1020163 - RNA, 22 nt, Human
uugucugugaaauggaaauagu

SEQ ID NO: 1020164 - RNA, 22 nt, Human
ucuguucaugaaauaucuuuuu

SEQ ID NO: 1020165 - RNA, 22 nt, Human
ugaagcaaacgcuucuguuccu

SEQ ID NO: 1020166 - RNA, 22 nt, Human
ccagguggacggcgaguacagg

SEQ ID NO: 1020167 - RNA, 22 nt, Human
uuuuaucaaucauuaagacauu

SEQ ID NO: 1020168 - RNA, 22 nt, Human
cagcugccccuccagggcuggg

SEQ ID NO: 1020169 - RNA, 22 nt, Human
cuuaaauuggaugaguuaaguu

SEQ ID NO: 1020170 - RNA, 22 nt, Human
agcaggcuccuuccuucucugg

SEQ ID NO: 1020171 - RNA, 19 nt, Human
ugggcagcucccucugucc

SEQ ID NO: 1020172 - RNA, 21 nt, Human
gcaggggauagaaauggucug

SEQ ID NO: 1020173 - RNA, 22 nt, Human
cagacaugauguaagcagaggc

SEQ ID NO: 1020174 - RNA, 22 nt, Human
cuggccacuggagguggcaccc

SEQ ID NO: 1020175 - RNA, 22 nt, Human
auuucaguguuuuaagaguuca

SEQ ID NO: 1020176 - RNA, 22 nt, Human
acccagccuacaaagcucaccu

SEQ ID NO: 1020177 - RNA, 22 nt, Human
ccacagagagugucagccuuug

SEQ ID NO: 1020178 - RNA, 22 nt, Human
cagcuggguuuaguggggugug

SEQ ID NO: 1020179 - RNA, 22 nt, Human
ugccacccagccaggaguggga

SEQ ID NO: 1020180 - RNA, 22 nt, Human
ccugucugagccagggugggca

SEQ ID NO: 1020181 - RNA, 19 nt, Human
uggcagaggcaguuuguac

SEQ ID NO: 1020182 - RNA, 22 nt, Human
ugugcagcuaguccuggacuug

SEQ ID NO: 1020183 - RNA, 22 nt, Human
cauggggagacaccuagggaaa

SEQ ID NO: 1020184 - RNA, 22 nt, Human
uaucuaaaggauuuaauuuagu

SEQ ID NO: 1020185 - RNA, 22 nt, Human
uggcucaguuucugcccagcug

SEQ ID NO: 1020186 - RNA, 22 nt, Human
ugggauggagccugaguauagu

SEQ ID NO: 1020187 - RNA, 22 nt, Human
augaacuuauuucugaacuuuu

SEQ ID NO: 1020188 - RNA, 22 nt, Human
auaugagagaggaaagauuuua

SEQ ID NO: 1020189 - RNA, 22 nt, Human
acagugucuccugguacccagu

SEQ ID NO: 1020190 - RNA, 20 nt, Human
agcccuguuuccuggagaga

SEQ ID NO: 1020191 - RNA, 22 nt, Human
cgacccuacagacagugcugag

SEQ ID NO: 1020192 - RNA, 17 nt, Human
agugaaauuuacauugc

SEQ ID NO: 1020193 - RNA, 22 nt, Human
uagcugucaccagaaauggcca

SEQ ID NO: 1020194 - RNA, 22 nt, Human
uuuucauuguuccucgagcauu

SEQ ID NO: 1020195 - RNA, 22 nt, Human
ucuucacaccgggcagcaggaa

SEQ ID NO: 1020196 - RNA, 22 nt, Human
gucccagggaagaaggcagcac

SEQ ID NO: 1020197 - RNA, 22 nt, Human
aagucauugguagcuugauagg

SEQ ID NO: 1020198 - RNA, 22 nt, Human
gacacagagauaggccuguguu

SEQ ID NO: 1020199 - RNA, 21 nt, Human
uccuccuucaaguccuggccu

SEQ ID NO: 1020200 - RNA, 20 nt, Human
cagagccaagagcagcaucu

SEQ ID NO: 1020201 - RNA, 22 nt, Human
gaucuguuucauucacagucug

SEQ ID NO: 1020202 - RNA, 22 nt, Human
cagggagcuggugccagccgac

SEQ ID NO: 1020203 - RNA, 22 nt, Human
gcugccuuuugcuccucccacc

SEQ ID NO: 1020204 - RNA, 22 nt, Human
aaggccaucuacuuacggaauu

SEQ ID NO: 1020205 - RNA, 23 nt, Human
cccagcagauuguaaagugucca

SEQ ID NO: 1020206 - RNA, 22 nt, Human
gaagagcuauguccagggagca

SEQ ID NO: 1020207 - RNA, 19 nt, Human
uugguggugguuuugguuc

SEQ ID NO: 1020208 - RNA, 22 nt, Human
ccugagggaggguauaggcugu

SEQ ID NO: 1020209 - RNA, 22 nt, Human
ugccagcuccgaggagcugcag

SEQ ID NO: 1020210 - RNA, 21 nt, Human
agggccugugcucuccagguc

SEQ ID NO: 1020211 - RNA, 22 nt, Human
ucaucaaagucaaagaaugacu

SEQ ID NO: 1020212 - RNA, 22 nt, Human
ggugaaggaggaagcugaugga

SEQ ID NO: 1020213 - RNA, 22 nt, Human
cugugucccccucagccaggug

SEQ ID NO: 1020214 - RNA, 18 nt, Human
acugugguuuauguguag

SEQ ID NO: 1020215 - RNA, 22 nt, Human
uucaggagcuggcugcgaagga

SEQ ID NO: 1020216 - RNA, 22 nt, Human
ccugucugcaugagugagcaua

SEQ ID NO: 1020217 - RNA, 22 nt, Human
uacaaaguaauguauaauaucg

SEQ ID NO: 1020218 - RNA, 22 nt, Human
cgagaguggacagggcgcagcu

SEQ ID NO: 1020219 - RNA, 22 nt, Human
uaaguucaguuggucgaaguag

SEQ ID NO: 1020220 - RNA, 22 nt, Human
aaugaaauguagcuuauccaua

SEQ ID NO: 1020221 - RNA, 22 nt, Human
cagguaggauggaagggcucaa

SEQ ID NO: 1020222 - RNA, 22 nt, Human
ccagucccgcaugguccagaau

SEQ ID NO: 1020223 - RNA, 22 nt, Human
ugcugccuuugggaccuggccu

SEQ ID NO: 1020224 - RNA, 22 nt, Human
ggccuugggaggagggucagaa

SEQ ID NO: 1020225 - RNA, 22 nt, Human
gaaucauuggaaccacauccaa

SEQ ID NO: 1020226 - RNA, 22 nt, Human
aaggcaguuaauuuggcuagaa

SEQ ID NO: 1020227 - RNA, 22 nt, Human
ugccucugugugcaggugagca

SEQ ID NO: 1020228 - RNA, 22 nt, Human
ggaaggaggggcaaagcaguuc

SEQ ID NO: 1020229 - RNA, 22 nt, Human
gggagcuggagcuggaagacuc

SEQ ID NO: 1020230 - RNA, 19 nt, Human
uggcuucuguuuucauguu

SEQ ID NO: 1020231 - RNA, 22 nt, Human
gaggccaggagugcuguaaguu

SEQ ID NO: 1020232 - RNA, 22 nt, Human
uauuugcaacauaaaacucuga

SEQ ID NO: 1020233 - RNA, 22 nt, Human
cccaggcuggauuucgguggca

SEQ ID NO: 1020234 - RNA, 22 nt, Human
caagcuccuuacauccacaggg

SEQ ID NO: 1020235 - RNA, 22 nt, Human
ggcugaaacagauuucaagaca

SEQ ID NO: 1020236 - RNA, 22 nt, Human
ugcagggcccuugggguugaac

SEQ ID NO: 1020237 - RNA, 22 nt, Human
caaagugcuggaauuacaggug

SEQ ID NO: 1020238 - RNA, 22 nt, Human
gucaggaugcuauuguuauuaa

SEQ ID NO: 1020239 - RNA, 22 nt, Human
augggaggaaggaggcccuuga

SEQ ID NO: 1020240 - RNA, 22 nt, Human
ggggcacacuuuugguagauau

SEQ ID NO: 1020241 - RNA, 22 nt, Human
gccaggcuguuuuuauuacugu

SEQ ID NO: 1020242 - RNA, 22 nt, Human
gcucccagcauugcuucccagg

SEQ ID NO: 1020243 - RNA, 20 nt, Human
aguaccuuuuguauguuacc

SEQ ID NO: 1020244 - RNA, 22 nt, Human
aggguggccaugagggagagau

SEQ ID NO: 1020245 - RNA, 19 nt, Human
acacagggaucagaggguu

SEQ ID NO: 1020246 - RNA, 22 nt, Human
gcagagccaggcuggggcaggu

SEQ ID NO: 1020247 - RNA, 19 nt, Human
gcaugcuugguggcuucug

SEQ ID NO: 1020248 - RNA, 22 nt, Human
cuagcaucagaugagaagcugu

SEQ ID NO: 1020249 - RNA, 17 nt, Human
ggagagugggaauggcc

SEQ ID NO: 1020250 - RNA, 22 nt, Human
uggcaguggcucagagugcaga

SEQ ID NO: 1020251 - RNA, 22 nt, Human
gccuucugcgcucgugucuccg

SEQ ID NO: 1020252 - RNA, 20 nt, Human
ugccagggccagcagaggcu

SEQ ID NO: 1020253 - RNA, 22 nt, Human
uacuuugucauucuaaccuucc

SEQ ID NO: 1020254 - RNA, 22 nt, Human
uacaugcaugucacagaaugaa

SEQ ID NO: 1020255 - RNA, 23 nt, Human
ccagcccuccaccagcucuaggc

SEQ ID NO: 1020256 - RNA, 22 nt, Human
agcucacagaaauccugcagga

SEQ ID NO: 1020257 - RNA, 21 nt, Human
uuguucuuccagaagcaaagu

SEQ ID NO: 1020258 - RNA, 21 nt, Human
uugaagcaaggguggcucuga

SEQ ID NO: 1020259 - RNA, 20 nt, Human
aaacauucauguacaaguga

SEQ ID NO: 1020260 - RNA, 22 nt, Human
auuuguuccacacauauuuacu

SEQ ID NO: 1020261 - RNA, 22 nt, Human
uccaggcaguuuuccagguugu

SEQ ID NO: 1020262 - RNA, 22 nt, Human
cuggccugaucucaugcugucc

SEQ ID NO: 1020263 - RNA, 20 nt, Human
gccugagcuauugccaggau

SEQ ID NO: 1020264 - RNA, 22 nt, Human
cuguggugagcaacugacugaa

SEQ ID NO: 1020265 - RNA, 22 nt, Human
cccagcuucugagggggccuug

SEQ ID NO: 1020266 - RNA, 22 nt, Human
aaagaguucuaugaucuuucca

SEQ ID NO: 1020267 - RNA, 22 nt, Human
acaaagucacaauaauuaaccu

SEQ ID NO: 1020268 - RNA, 22 nt, Human
gcccugagacugagcauggguu

SEQ ID NO: 1020269 - RNA, 22 nt, Human
auccuuggaugugucuuuuugu

SEQ ID NO: 1020270 - RNA, 22 nt, Human
gcucagagauggggaaugaaaa

SEQ ID NO: 1020271 - RNA, 22 nt, Human
ucucacucauuuccuaggucuu

SEQ ID NO: 1020272 - RNA, 22 nt, Human
uuuaaauuauaguuaaugucug

SEQ ID NO: 1020273 - RNA, 22 nt, Human
gguagcagggcugugagucaga

SEQ ID NO: 1020274 - RNA, 22 nt, Human
agggacagaugaaugacugagu

SEQ ID NO: 1020275 - RNA, 22 nt, Human
cuguagccaguuuggccucacc

SEQ ID NO: 1020276 - RNA, 22 nt, Human
uugaagcaggaaaauuucuauu

SEQ ID NO: 1020277 - RNA, 22 nt, Human
caaaguuaucaacugcaacauu

SEQ ID NO: 1020278 - RNA, 22 nt, Human
aaggcugagggcuguaccuggc

SEQ ID NO: 1020279 - RNA, 22 nt, Human
gucuucaauagagccucaauuu

SEQ ID NO: 1020280 - RNA, 22 nt, Human
gccagcuggagacuggcagggg

SEQ ID NO: 1020281 - RNA, 22 nt, Human
ucucuucuuguguuuuccugcc

SEQ ID NO: 1020282 - RNA, 19 nt, Human
aaaagucuauucaauuaca

SEQ ID NO: 1020283 - RNA, 22 nt, Human
uccagagguauguagagaguau

SEQ ID NO: 1020284 - RNA, 23 nt, Human
ccacagagcugccaauuccugug

SEQ ID NO: 1020285 - RNA, 22 nt, Human
caggauggccccggggcugugc

SEQ ID NO: 1020286 - RNA, 22 nt, Human
ucuucagauaaagggagaguau

SEQ ID NO: 1020287 - RNA, 22 nt, Human
gagcuuccauggacgccaucug

SEQ ID NO: 1020288 - RNA, 23 nt, Human
agggguggucaguacccgcagug

SEQ ID NO: 1020289 - RNA, 22 nt, Human
aauguguagcauuuaaugcagu

SEQ ID NO: 1020290 - RNA, 22 nt, Human
ugggcagacugagcccuguccc

SEQ ID NO: 1020291 - RNA, 20 nt, Human
ggcucugcuugugagcagcc

SEQ ID NO: 1020292 - RNA, 20 nt, Human
cacagcuugccuuuuaugac

SEQ ID NO: 1020293 - RNA, 22 nt, Human
uugcauuuccuguacuguuuga

SEQ ID NO: 1020294 - RNA, 22 nt, Human
ucuguggauuuuaguguucaug

SEQ ID NO: 1020295 - RNA, 22 nt, Human
caaagucagccagcuaguaggu

SEQ ID NO: 1020296 - RNA, 19 nt, Human
caguggccuggaggucucu

SEQ ID NO: 1020297 - RNA, 22 nt, Human
aagcuggcaugucaccugagaa

SEQ ID NO: 1020298 - RNA, 22 nt, Human
gugauuuucuccuccuagaagu

SEQ ID NO: 1020299 - RNA, 21 nt, Human
gcagccacagccaccaagcua

SEQ ID NO: 1020300 - RNA, 22 nt, Human
cccugggcaagcccuauuuucc

SEQ ID NO: 1020301 - RNA, 22 nt, Human
uggagcccagggugagaaggag

SEQ ID NO: 1020302 - RNA, 22 nt, Human
aagcugccacacggugaguacu

SEQ ID NO: 1020303 - RNA, 22 nt, Human
acagcuuuuaugggaccagcca

SEQ ID NO: 1020304 - RNA, 21 nt, Human
ccugagccuguuuauccagaa

SEQ ID NO: 1020305 - RNA, 22 nt, Human
cugugcuugacagugggaagca

SEQ ID NO: 1020306 - RNA, 22 nt, Human
cagagccacuuggagaugagaa

SEQ ID NO: 1020307 - RNA, 22 nt, Human
uauguacaguccuuaacuuaaa

SEQ ID NO: 1020308 - RNA, 22 nt, Human
cugcuuuggcucagugacauca

SEQ ID NO: 1020309 - RNA, 22 nt, Human
cugggaaauggcuucgagcuca

SEQ ID NO: 1020310 - RNA, 22 nt, Human
gcaucuaaacuugcaucauugu

SEQ ID NO: 1020311 - RNA, 22 nt, Human
agugcugucaguuuuauagaua

SEQ ID NO: 1020312 - RNA, 22 nt, Human
aggagccaagauggggcaagua

SEQ ID NO: 1020313 - RNA, 22 nt, Human
agcugguggauuaugcuguaca

SEQ ID NO: 1020314 - RNA, 22 nt, Human
aagcugccuuccaugugaggaa

SEQ ID NO: 1020315 - RNA, 22 nt, Human
uuugggcaguagauguaucacu

SEQ ID NO: 1020316 - RNA, 22 nt, Human
uacagucuuuggaaagagauag

SEQ ID NO: 1020317 - RNA, 22 nt, Human
ucauauaacuggauauuuucaa

SEQ ID NO: 1020318 - RNA, 22 nt, Human
guacauuucucuuguucuuauu

SEQ ID NO: 1020319 - RNA, 22 nt, Human
ggcccaucucuugcucuggguu

SEQ ID NO: 1020320 - RNA, 22 nt, Human
gcucccagggaccgcagggcag

SEQ ID NO: 1020321 - RNA, 22 nt, Human
aggccugggcaagaaggggcgu

SEQ ID NO: 1020322 - RNA, 22 nt, Human
aguucacauuccgagguacugg

SEQ ID NO: 1020323 - RNA, 22 nt, Human
cagguacauucguagacccauu

SEQ ID NO: 1020324 - RNA, 22 nt, Human
ugcagaagacacaagguaacgu

SEQ ID NO: 1020325 - RNA, 22 nt, Human
ggcaaaaaccauaauuacuuuu

SEQ ID NO: 1020326 - RNA, 22 nt, Human
cugggcucagcccaugcugucc

SEQ ID NO: 1020327 - RNA, 22 nt, Human
aaguguagauuauggagugucu

SEQ ID NO: 1020328 - RNA, 22 nt, Human
agccagugcaacagcagugaag

SEQ ID NO: 1020329 - RNA, 22 nt, Human
uccucuggcucuuucccuagga

SEQ ID NO: 1020330 - RNA, 22 nt, Human
agcucccagggcugggcaaguu

SEQ ID NO: 1020331 - RNA, 22 nt, Human
uguuauugagguuacuuauaag

SEQ ID NO: 1020332 - RNA, 22 nt, Human
ucuuugcaaauguuauuaucuu

SEQ ID NO: 1020333 - RNA, 22 nt, Human
uguagaaagcucuucugaaauc

SEQ ID NO: 1020334 - RNA, 22 nt, Human
agggcgacaauggagagcguuu

SEQ ID NO: 1020335 - RNA, 22 nt, Human
ucugucaccgagggcauccaaa

SEQ ID NO: 1020336 - RNA, 22 nt, Human
gaggccaaguuggagaccaggu

SEQ ID NO: 1020337 - RNA, 19 nt, Human
ccugugugggguagagauc

SEQ ID NO: 1020338 - RNA, 22 nt, Human
cuggagccccaggcugugcaga

SEQ ID NO: 1020339 - RNA, 22 nt, Human
cacaugaguccugccagguaug

SEQ ID NO: 1020340 - RNA, 22 nt, Human
ucuuugaauucaaacuguucaa

SEQ ID NO: 1020341 - RNA, 22 nt, Human
cuggcccuucucuugcuuccug

SEQ ID NO: 1020342 - RNA, 22 nt, Human
acagagcaauucuuggguguuu

SEQ ID NO: 1020343 - RNA, 22 nt, Human
ugagaguauuuuggcauuauca

SEQ ID NO: 1020344 - RNA, 22 nt, Human
ucaaaguccuugcuuuuucugu

SEQ ID NO: 1020345 - RNA, 22 nt, Human
ccuguguguaggccaggggagu

SEQ ID NO: 1020346 - RNA, 23 nt, Human
aaggucacagaacuuagcaagcc

SEQ ID NO: 1020347 - RNA, 22 nt, Human
augacucuuagcuaaagguaag

SEQ ID NO: 1020348 - RNA, 22 nt, Human
agcagccagagucugaacauua

SEQ ID NO: 1020349 - RNA, 22 nt, Human
aaggcuuuuguuccuauuuagu

SEQ ID NO: 1020350 - RNA, 22 nt, Human
uagaucugauacaauucaucug

SEQ ID NO: 1020351 - RNA, 22 nt, Human
gagagcuguguucauucuacca

SEQ ID NO: 1020352 - RNA, 22 nt, Human
cugaaggauguguggugggagu

SEQ ID NO: 1020353 - RNA, 22 nt, Human
ugauuuccaugaagcugaaggc

SEQ ID NO: 1020354 - RNA, 22 nt, Human
agggugcagaaggagccuagga

SEQ ID NO: 1020355 - RNA, 22 nt, Human
uacaaaugaguuguaugaacca

SEQ ID NO: 1020356 - RNA, 22 nt, Human
ggagcuguuggcagcuaucuug

SEQ ID NO: 1020357 - RNA, 22 nt, Human
gaggcagaaguugcagugagca

SEQ ID NO: 1020358 - RNA, 22 nt, Human
ucucucagggggaaggcugaag

SEQ ID NO: 1020359 - RNA, 19 nt, Human
cugccuguuauggagagaa

SEQ ID NO: 1020360 - RNA, 22 nt, Human
ggccuggagaaggcccagggag

SEQ ID NO: 1020361 - RNA, 23 nt, Human
uggccuggagagaaaagaugagu

SEQ ID NO: 1020362 - RNA, 22 nt, Human
ccagcauggcaccugagaugag

SEQ ID NO: 1020363 - RNA, 20 nt, Human
cagcucugggaaagaggcca

SEQ ID NO: 1020364 - RNA, 22 nt, Human
gugcagagaaaugagaagucga

SEQ ID NO: 1020365 - RNA, 22 nt, Human
auuucaguagaaaaucuugauu

SEQ ID NO: 1020366 - RNA, 19 nt, Human
ugucucugaaagaugagcu

SEQ ID NO: 1020367 - RNA, 21 nt, Human
cuacuuaaguaggggauuagg

SEQ ID NO: 1020368 - RNA, 22 nt, Human
uguaugcuuguguauaauauaa

SEQ ID NO: 1020369 - RNA, 22 nt, Human
aauaacuucaguucuuacauua

SEQ ID NO: 1020370 - RNA, 22 nt, Human
ccucuggcuguaccacuggcac

SEQ ID NO: 1020371 - RNA, 22 nt, Human
cacagcagagggagccauugaa

SEQ ID NO: 1020372 - RNA, 22 nt, Human
gggcugacaguuuccccugaaa

SEQ ID NO: 1020373 - RNA, 22 nt, Human
gcugagagcggccagcugggaa

SEQ ID NO: 1020374 - RNA, 22 nt, Human
agcuggcauacuuugcuaggaa

SEQ ID NO: 1020375 - RNA, 22 nt, Human
agcaccuucacaggcucucagg

SEQ ID NO: 1020376 - RNA, 21 nt, Human
ugcugaugucagagaagcaag

SEQ ID NO: 1020377 - RNA, 22 nt, Human
agcagggcuucugugccugugc

SEQ ID NO: 1020378 - RNA, 21 nt, Human
ggcagaaguagcauggacggg

SEQ ID NO: 1020379 - RNA, 21 nt, Human
ucucuggaguuagcagagaga

SEQ ID NO: 1020380 - RNA, 22 nt, Human
cugagagcagggacuugagcca

SEQ ID NO: 1020381 - RNA, 22 nt, Human
uuugaagugggcauuagaaccu

SEQ ID NO: 1020382 - RNA, 22 nt, Human
gauuucaaccuaacaguaugac

SEQ ID NO: 1020383 - RNA, 22 nt, Human
cccaggcagggacgugcucugg

SEQ ID NO: 1020384 - RNA, 22 nt, Human
uggcucagucauggaugaguaa

SEQ ID NO: 1020385 - RNA, 22 nt, Human
uauucugugugauauguaaaug

SEQ ID NO: 1020386 - RNA, 22 nt, Human
gggaaccagccgcuuccgccuc

SEQ ID NO: 1020387 - RNA, 22 nt, Human
agagccuggggauuggcaaggg

SEQ ID NO: 1020388 - RNA, 22 nt, Human
cagccugcauuuguaucuguau

SEQ ID NO: 1020389 - RNA, 22 nt, Human
gcugggcagccuggccgcugcc

SEQ ID NO: 1020390 - RNA, 22 nt, Human
ucgagucauguucucccauuaa

SEQ ID NO: 1020391 - RNA, 22 nt, Human
cagagcuggagcuugaauggag

SEQ ID NO: 1020392 - RNA, 22 nt, Human
cugggccagauccagccucaca

SEQ ID NO: 1020393 - RNA, 22 nt, Human
agaaaugacaagacugaucagg

SEQ ID NO: 1020394 - RNA, 22 nt, Human
cagcugugaauugucuuaucua

SEQ ID NO: 1020395 - RNA, 22 nt, Human
ggccucagugggccgcugcagg

SEQ ID NO: 1020396 - RNA, 20 nt, Human
uggccuuggggagcucacac

SEQ ID NO: 1020397 - RNA, 20 nt, Human
uucuuucaucuacacguugu

SEQ ID NO: 1020398 - RNA, 22 nt, Human
gcugccaguguggcaugaugca

SEQ ID NO: 1020399 - RNA, 23 nt, Human
ccuccugggcacaggccugaugg

SEQ ID NO: 1020400 - RNA, 22 nt, Human
guauuaggagguggagccuuug

SEQ ID NO: 1020401 - RNA, 21 nt, Human
agagaagaggacuuucucaca

SEQ ID NO: 1020402 - RNA, 22 nt, Human
cuugcaggcagggccuccugga

SEQ ID NO: 1020403 - RNA, 22 nt, Human
uuaagucauuucugauuauaga

SEQ ID NO: 1020404 - RNA, 22 nt, Human
ugaggcagcuuuuucugugugu

SEQ ID NO: 1020405 - RNA, 22 nt, Human
aaugaugguauugaugagcuaa

SEQ ID NO: 1020406 - RNA, 22 nt, Human
aaucuuagguuuggcuucaucu

SEQ ID NO: 1020407 - RNA, 22 nt, Human
ugcuggggguucagaugaguaa

SEQ ID NO: 1020408 - RNA, 22 nt, Human
ucagccuggcaggauggccugg

SEQ ID NO: 1020409 - RNA, 22 nt, Human
cuuagaaauuguuacucauuca

SEQ ID NO: 1020410 - RNA, 22 nt, Human
ccucuggcaacuucacagccca

SEQ ID NO: 1020411 - RNA, 22 nt, Human
cauuuacagugagaguuuuuac

SEQ ID NO: 1020412 - RNA, 22 nt, Human
aaugcagugagccauuaaaugg

SEQ ID NO: 1020413 - RNA, 22 nt, Human
ugcaauaacccaguaucuguga

SEQ ID NO: 1020414 - RNA, 23 nt, Human
ugggccuggccucccaguccagc

SEQ ID NO: 1020415 - RNA, 22 nt, Human
cucuggagcaccgggcuaucca

SEQ ID NO: 1020416 - RNA, 23 nt, Human
uggcagugaucaaaagcuuacau

SEQ ID NO: 1020417 - RNA, 22 nt, Human
uucugggagagaaagggccuug

SEQ ID NO: 1020418 - RNA, 22 nt, Human
uccagggagagccgcugcucca

SEQ ID NO: 1020419 - RNA, 22 nt, Human
gcuucgggguccaagcgcgugu

SEQ ID NO: 1020420 - RNA, 22 nt, Human
gccuggcccagggcucuuguug

SEQ ID NO: 1020421 - RNA, 22 nt, Human
cucaggauguacuacagaaggc

SEQ ID NO: 1020422 - RNA, 19 nt, Human
ccuuggaguuccaggugga

SEQ ID NO: 1020423 - RNA, 22 nt, Human
uguaugaauauguuggggaggu

SEQ ID NO: 1020424 - RNA, 22 nt, Human
aaagcaaugaugguagacacgu

SEQ ID NO: 1020425 - RNA, 19 nt, Human
ccugucugucuucagcuag

SEQ ID NO: 1020426 - RNA, 22 nt, Human
ccacagggugucaucagcuuga

SEQ ID NO: 1020427 - RNA, 22 nt, Human
gccugucugcagggcugucauu

SEQ ID NO: 1020428 - RNA, 20 nt, Human
gacaucauguacacauugcc

SEQ ID NO: 1020429 - RNA, 19 nt, Human
uccaaaggacccaccucca

SEQ ID NO: 1020430 - RNA, 22 nt, Human
aggcccuguuaugagccacugu

SEQ ID NO: 1020431 - RNA, 22 nt, Human
ccuccaggcugaauaucuagaa

SEQ ID NO: 1020432 - RNA, 22 nt, Human
ugcaagggcuuagggggcugug

SEQ ID NO: 1020433 - RNA, 22 nt, Human
gcaccugggacccagaggcacc

SEQ ID NO: 1020434 - RNA, 22 nt, Human
uggccuguggcuuaaggucugu

SEQ ID NO: 1020435 - RNA, 22 nt, Human
gcucucugguuccagucaggaa

SEQ ID NO: 1020436 - RNA, 19 nt, Human
auggaaaaugccagacuga

SEQ ID NO: 1020437 - RNA, 22 nt, Human
cugccucuauaggaguccacca

SEQ ID NO: 1020438 - RNA, 22 nt, Human
auuuaugauuagccuauuguug

SEQ ID NO: 1020439 - RNA, 22 nt, Human
agggcagagaaauguaguugag

SEQ ID NO: 1020440 - RNA, 22 nt, Human
uagugauuaaaggcagaauguu

SEQ ID NO: 1020441 - RNA, 22 nt, Human
agggcuccuccccggccuccac

SEQ ID NO: 1020442 - RNA, 20 nt, Human
gcuguucacauuauuaguag

SEQ ID NO: 1020443 - RNA, 22 nt, Human
aaauaguucagcuuguaaaccc

SEQ ID NO: 1020444 - RNA, 22 nt, Human
gugccagcucuccccacaucug

SEQ ID NO: 1020445 - RNA, 22 nt, Human
ccuuccaggagucucugcaggu

SEQ ID NO: 1020446 - RNA, 22 nt, Human
gaauuguagagggaacagaagc

SEQ ID NO: 1020447 - RNA, 23 nt, Human
aggagaagagauuuccacaugca

SEQ ID NO: 1020448 - RNA, 20 nt, Human
caggcacacucauuccugcu

SEQ ID NO: 1020449 - RNA, 22 nt, Human
uaaaagcucuucuguugaguua

SEQ ID NO: 1020450 - RNA, 22 nt, Human
uuucuguaaguggcaaauaaug

SEQ ID NO: 1020451 - RNA, 21 nt, Human
ucuuccuccacagcgugccac

SEQ ID NO: 1020452 - RNA, 22 nt, Human
ugccaggggaccuagggauguc

SEQ ID NO: 1020453 - RNA, 23 nt, Human
uugucugugcuuuuccaguugcu

SEQ ID NO: 1020454 - RNA, 22 nt, Human
gagagugaaggcuucccagcaa

SEQ ID NO: 1020455 - RNA, 22 nt, Human
cuuaauuuaagccuagaaugca

SEQ ID NO: 1020456 - RNA, 22 nt, Human
ggaggugguggcagugacaauu

SEQ ID NO: 1020457 - RNA, 22 nt, Human
uucucuucaucucaguaaaugu

SEQ ID NO: 1020458 - RNA, 22 nt, Human
agcugccuguccuaggccauca

SEQ ID NO: 1020459 - RNA, 22 nt, Human
agaggccagcagugccuaucug

SEQ ID NO: 1020460 - RNA, 22 nt, Human
acuggcaguuugagaaugcauu

SEQ ID NO: 1020461 - RNA, 22 nt, Human
ccugcagcuccggauuucuggg

SEQ ID NO: 1020462 - RNA, 22 nt, Human
gagauuggccuggcuugccaac

SEQ ID NO: 1020463 - RNA, 22 nt, Human
agcugggaggugggcagugaga

SEQ ID NO: 1020464 - RNA, 22 nt, Human
ucagcuggagaugagaaccgaa

SEQ ID NO: 1020465 - RNA, 22 nt, Human
cugggaggugcagcaaaaauca

SEQ ID NO: 1020466 - RNA, 22 nt, Human
ccagaggcuggguucaccucag

SEQ ID NO: 1020467 - RNA, 22 nt, Human
uagccgcuuaauuauuugguga

SEQ ID NO: 1020468 - RNA, 18 nt, Human
uggcagagugucuguucu

SEQ ID NO: 1020469 - RNA, 17 nt, Human
gcuguaguuugauaaga

SEQ ID NO: 1020470 - RNA, 21 nt, Human
aguucauacugaguaacaaaa

SEQ ID NO: 1020471 - RNA, 22 nt, Human
gcauguuuugcaacaagugacc

SEQ ID NO: 1020472 - RNA, 22 nt, Human
gcagagccugacgggauuuuuc

SEQ ID NO: 1020473 - RNA, 22 nt, Human
uguauuuuuagaccuuuagacc

SEQ ID NO: 1020474 - RNA, 22 nt, Human
cuggcucagacagcugugcagu

SEQ ID NO: 1020475 - RNA, 22 nt, Human
acagacagggcaccugccuccu

SEQ ID NO: 1020476 - RNA, 22 nt, Human
uggcagagaaccugggcuuugu

SEQ ID NO: 1020477 - RNA, 22 nt, Human
uuccaugugaguacacugugau

SEQ ID NO: 1020478 - RNA, 22 nt, Human
gccaugcuugguaugcugugag

SEQ ID NO: 1020479 - RNA, 22 nt, Human
uaaagguaacaugaacugcuuu

SEQ ID NO: 1020480 - RNA, 22 nt, Human
cugaaggagguagagugacaua

SEQ ID NO: 1020481 - RNA, 22 nt, Human
ugcugucuguuuacuggcuaua

SEQ ID NO: 1020482 - RNA, 22 nt, Human
acaaggaggucuggggggcccu

SEQ ID NO: 1020483 - RNA, 22 nt, Human
ccacagaguuacaaaacaguca

SEQ ID NO: 1020484 - RNA, 22 nt, Human
auggacaggcugagcuuccuca

SEQ ID NO: 1020485 - RNA, 22 nt, Human
cagagcuggcggugagaagaca

SEQ ID NO: 1020486 - RNA, 22 nt, Human
ugagacaguucugcagcugggu

SEQ ID NO: 1020487 - RNA, 22 nt, Human
ugagagugaaaugucacauguc

SEQ ID NO: 1020488 - RNA, 22 nt, Human
ugggccuggguuccuccugggc

SEQ ID NO: 1020489 - RNA, 22 nt, Human
aaugugguuaacccauuuaaga

SEQ ID NO: 1020490 - RNA, 22 nt, Human
cagcugccugucuggaggcaau

SEQ ID NO: 1020491 - RNA, 17 nt, Human
gaaagguccuagaaauc

SEQ ID NO: 1020492 - RNA, 22 nt, Human
ugccugugguuccaguuuuuuc

SEQ ID NO: 1020493 - RNA, 23 nt, Human
uccaggcacgcauuucuucuagc

SEQ ID NO: 1020494 - RNA, 22 nt, Human
ugaagcccugugucagcuucca

SEQ ID NO: 1020495 - RNA, 22 nt, Human
cucccaagauaaauaaggcagu

SEQ ID NO: 1020496 - RNA, 22 nt, Human
gugggccuugcagggugcaggg

SEQ ID NO: 1020497 - RNA, 21 nt, Human
agcagaacagucgagcacugc

SEQ ID NO: 1020498 - RNA, 22 nt, Human
agauuucaauggauauugcaag

SEQ ID NO: 1020499 - RNA, 22 nt, Human
cagucacauggaugauggauag

SEQ ID NO: 1020500 - RNA, 22 nt, Human
gccugaugagcuuccagcugag

SEQ ID NO: 1020501 - RNA, 22 nt, Human
cuuccuucugaagcauagaagc

SEQ ID NO: 1020502 - RNA, 22 nt, Human
uaagugcaauguuuuacuuaaa

SEQ ID NO: 1020503 - RNA, 22 nt, Human
caguauuuguucccuaucaaug

SEQ ID NO: 1020504 - RNA, 22 nt, Human
uauacaaugaguacauucuggg

SEQ ID NO: 1020505 - RNA, 22 nt, Human
ucagcugccucucccuggaaga

SEQ ID NO: 1020506 - RNA, 22 nt, Human
ugggcuggcugaacuucaaccu

SEQ ID NO: 1020507 - RNA, 20 nt, Human
gcaaaauaggcucuguuggu

SEQ ID NO: 1020508 - RNA, 22 nt, Human
uguacaguauauuucaaagcca

SEQ ID NO: 1020509 - RNA, 22 nt, Human
ugcuuuauggauuuguguccug

SEQ ID NO: 1020510 - RNA, 22 nt, Human
cugucuguucagauucauuacu

SEQ ID NO: 1020511 - RNA, 20 nt, Human
aaagucuuaugguuaauuuu

SEQ ID NO: 1020512 - RNA, 22 nt, Human
acauuguauaaugauuaucaca

SEQ ID NO: 1020513 - RNA, 19 nt, Human
uggagacugagagugagca

SEQ ID NO: 1020514 - RNA, 19 nt, Human
uaaaaugucuguggucagu

SEQ ID NO: 1020515 - RNA, 22 nt, Human
acaggccuuggcaggcauguga

SEQ ID NO: 1020516 - RNA, 22 nt, Human
guuguuuuuguucucuauagcu

SEQ ID NO: 1020517 - RNA, 22 nt, Human
cccagcucugcagaccugcccu

SEQ ID NO: 1020518 - RNA, 22 nt, Human
agcagggcagguaaggaucaga

SEQ ID NO: 1020519 - RNA, 22 nt, Human
cucuuaaagaauguuccagcug

SEQ ID NO: 1020520 - RNA, 22 nt, Human
gcucugaggcugggagcacucu

SEQ ID NO: 1020521 - RNA, 22 nt, Human
aaaugucuuucuucugcuacgu

SEQ ID NO: 1020522 - RNA, 22 nt, Human
ggaggcuccacugcucuuccug

SEQ ID NO: 1020523 - RNA, 22 nt, Human
ggccucugguucguggugaccu

SEQ ID NO: 1020524 - RNA, 22 nt, Human
gaaggccaguuuugagauaggu

SEQ ID NO: 1020525 - RNA, 18 nt, Human
uccauuguucuacuguga

SEQ ID NO: 1020526 - RNA, 22 nt, Human
uuagaaaauuugcuucuuugga

SEQ ID NO: 1020527 - RNA, 22 nt, Human
uccacagaauguaagauccaca

SEQ ID NO: 1020528 - RNA, 22 nt, Human
gccugcagaggugcugcuagcu

SEQ ID NO: 1020529 - RNA, 22 nt, Human
augacagaggagugcaggugau

SEQ ID NO: 1020530 - RNA, 22 nt, Human
uauguguacaucugguugagca

SEQ ID NO: 1020531 - RNA, 22 nt, Human
agcagcuucuuucacuccugga

SEQ ID NO: 1020532 - RNA, 22 nt, Human
ucuuugcaacucccauuuccau

SEQ ID NO: 1020533 - RNA, 22 nt, Human
acccaggagcaggcugggcagu

SEQ ID NO: 1020534 - RNA, 22 nt, Human
acaaagugcacaagaugagaac

SEQ ID NO: 1020535 - RNA, 22 nt, Human
uguagaaauuaguaagaucaac

SEQ ID NO: 1020536 - RNA, 22 nt, Human
accuggccauccagcuggcauc

SEQ ID NO: 1020537 - RNA, 22 nt, Human
auagauauuugaguuguuucca

SEQ ID NO: 1020538 - RNA, 22 nt, Human
uggcagggugggcuucagcccc

SEQ ID NO: 1020539 - RNA, 18 nt, Human
gugagcagagagcaucac

SEQ ID NO: 1020540 - RNA, 18 nt, Human
gaaaggagagacaguagg

SEQ ID NO: 1020541 - RNA, 22 nt, Human
aucaaguuuucuuaguugacug

SEQ ID NO: 1020542 - RNA, 22 nt, Human
agguuuucagcuguauccugag

SEQ ID NO: 1020543 - RNA, 22 nt, Human
aaaugugcuugugaucagcugu

SEQ ID NO: 1020544 - RNA, 22 nt, Human
caaaguccauaguuuacaauag

SEQ ID NO: 1020545 - RNA, 20 nt, Human
cuguaucagguuacaaagua

SEQ ID NO: 1020546 - RNA, 22 nt, Human
caggcugccgugaagcaggccu

SEQ ID NO: 1020547 - RNA, 22 nt, Human
uuuccucuaaacgcauuugcuu

SEQ ID NO: 1020548 - RNA, 23 nt, Human
aagcuuccuucacgucuccuggg

SEQ ID NO: 1020549 - RNA, 22 nt, Human
caugcugugugguuagaacugu

SEQ ID NO: 1020550 - RNA, 17 nt, Human
aauagcugcucagagag

SEQ ID NO: 1020551 - RNA, 22 nt, Human
ccauaagguuuggggccaugca

SEQ ID NO: 1020552 - RNA, 22 nt, Human
cacugaaauauuaauaucuuau

SEQ ID NO: 1020553 - RNA, 22 nt, Human
cugggaguguucuaggucacau

SEQ ID NO: 1020554 - RNA, 22 nt, Human
caguggagagacuuuuacucuu

SEQ ID NO: 1020555 - RNA, 22 nt, Human
agcagcuggugagcaagcucag

SEQ ID NO: 1020556 - RNA, 22 nt, Human
uuuguagaggguaauugacaga

SEQ ID NO: 1020557 - RNA, 22 nt, Human
cuacuucugugaugaaacuaca

SEQ ID NO: 1020558 - RNA, 22 nt, Human
uccugccuagcaggugaccuau

SEQ ID NO: 1020559 - RNA, 22 nt, Human
uggcagcagggccccuggagga

SEQ ID NO: 1020560 - RNA, 22 nt, Human
uaaccauauuuuccauuaaguu

SEQ ID NO: 1020561 - RNA, 17 nt, Human
uucaagauauugaaaug

SEQ ID NO: 1020562 - RNA, 22 nt, Human
ucaaaugcacguagagaaaaua

SEQ ID NO: 1020563 - RNA, 22 nt, Human
ugaauccagagcuauuucgucc

SEQ ID NO: 1020564 - RNA, 22 nt, Human
ugugacaugugucaucuuuucu

SEQ ID NO: 1020565 - RNA, 22 nt, Human
aauuuagaauucgcuagcuaau

SEQ ID NO: 1020566 - RNA, 22 nt, Human
agcugaaggcuagaacagcugg

SEQ ID NO: 1020567 - RNA, 22 nt, Human
aguauuucugcucaugaaagag

SEQ ID NO: 1020568 - RNA, 22 nt, Human
uccuuagagacaagaccaguuu

SEQ ID NO: 1020569 - RNA, 22 nt, Human
uuggagguuugaaaauaugugu

SEQ ID NO: 1020570 - RNA, 22 nt, Human
cugcugugccucuuuucacgug

SEQ ID NO: 1020571 - RNA, 20 nt, Human
acagaauaugcugguugugg

SEQ ID NO: 1020572 - RNA, 22 nt, Human
caguggguccuaaguacaguuc

SEQ ID NO: 1020573 - RNA, 22 nt, Human
ucucuucuagcuucuugugguu

SEQ ID NO: 1020574 - RNA, 22 nt, Human
augugaggcagcacggagauua

SEQ ID NO: 1020575 - RNA, 22 nt, Human
ucugagaguagagcugccucuu

SEQ ID NO: 1020576 - RNA, 22 nt, Human
agcugcuguccuaggcacugua

SEQ ID NO: 1020577 - RNA, 22 nt, Human
guggcugcuguccucucugguu

SEQ ID NO: 1020578 - RNA, 22 nt, Human
ucccagaguuuccuguguccca

SEQ ID NO: 1020579 - RNA, 22 nt, Human
agacaucaaugaucagagguag

SEQ ID NO: 1020580 - RNA, 22 nt, Human
uccuucaguucaauuaguccgu

SEQ ID NO: 1020581 - RNA, 22 nt, Human
ggccaccuuccaguugccugca

SEQ ID NO: 1020582 - RNA, 22 nt, Human
uucuuacagaguuuacagagcc

SEQ ID NO: 1020583 - RNA, 22 nt, Human
aaagcaguauauugguaguugu

SEQ ID NO: 1020584 - RNA, 22 nt, Human
cccaggcacauccacucuguga

SEQ ID NO: 1020585 - RNA, 22 nt, Human
aucauuucccuuuagaucacaa

SEQ ID NO: 1020586 - RNA, 22 nt, Human
gggcugggauugcuugcuguga

SEQ ID NO: 1020587 - RNA, 17 nt, Human
uuugaaaggaugucagu

SEQ ID NO: 1020588 - RNA, 22 nt, Human
ggagaggugaauggcugcucua

SEQ ID NO: 1020589 - RNA, 22 nt, Human
ugagaggccccagcucuuggcc

SEQ ID NO: 1020590 - RNA, 22 nt, Human
ggccugcuccgggggcugagcu

SEQ ID NO: 1020591 - RNA, 20 nt, Human
ccugucuggagacaaagaga

SEQ ID NO: 1020592 - RNA, 22 nt, Human
uuuccucugcugccauugcccc

SEQ ID NO: 1020593 - RNA, 22 nt, Human
ucagguggcuucggggaguggc

SEQ ID NO: 1020594 - RNA, 22 nt, Human
ugcaggagaaaguacggagcgu

SEQ ID NO: 1020595 - RNA, 22 nt, Human
aauguguauacuggcaauuaag

SEQ ID NO: 1020596 - RNA, 22 nt, Human
uuucucuguucucuaacuguaa

SEQ ID NO: 1020597 - RNA, 22 nt, Human
cagcagcugcgugcccaggccg

SEQ ID NO: 1020598 - RNA, 23 nt, Human
accaugaugggagugcaaauaag

SEQ ID NO: 1020599 - RNA, 22 nt, Human
uccagucauuuccauuguuccc

SEQ ID NO: 1020600 - RNA, 22 nt, Human
aagaauuauugcaauacuagau

SEQ ID NO: 1020601 - RNA, 22 nt, Human
aggaagccaugguggacgucua

SEQ ID NO: 1020602 - RNA, 21 nt, Human
ggccucugccuugccccacuc

SEQ ID NO: 1020603 - RNA, 22 nt, Human
uccagggcuggguuggcucagc

SEQ ID NO: 1020604 - RNA, 22 nt, Human
uuuuaucuucauuccuaucuac

SEQ ID NO: 1020605 - RNA, 22 nt, Human
aagggcucugggcuacgcacug

SEQ ID NO: 1020606 - RNA, 22 nt, Human
gcagcccaauggacugagacag

SEQ ID NO: 1020607 - RNA, 22 nt, Human
cucuggagugcagccugguggc

SEQ ID NO: 1020608 - RNA, 22 nt, Human
cagaagucacccucagaauaac

SEQ ID NO: 1020609 - RNA, 22 nt, Human
uccugcagucugcacucugccu

SEQ ID NO: 1020610 - RNA, 22 nt, Human
caggugggagcgaggagcuacu

SEQ ID NO: 1020611 - RNA, 22 nt, Human
ggcuccuguggcaagacagcuu

SEQ ID NO: 1020612 - RNA, 21 nt, Human
agaaaauggcguuuuagauuu

SEQ ID NO: 1020613 - RNA, 22 nt, Human
ugcuggcuggccuggccuggac

SEQ ID NO: 1020614 - RNA, 22 nt, Human
uuagcucagaaaauuuaaacuu

SEQ ID NO: 1020615 - RNA, 22 nt, Human
gccugaggaaugcuccugacuu

SEQ ID NO: 1020616 - RNA, 22 nt, Human
uucucagagcacugcugacaaa

SEQ ID NO: 1020617 - RNA, 22 nt, Human
aauguguauaugaacauacagg

SEQ ID NO: 1020618 - RNA, 22 nt, Human
ucccaggcuaggccucugcguu

SEQ ID NO: 1020619 - RNA, 22 nt, Human
aggcacugaauauccaguaaaa

SEQ ID NO: 1020620 - RNA, 22 nt, Human
uauuauuaaauggcagaauuuu

SEQ ID NO: 1020621 - RNA, 22 nt, Human
gcagggucugaggccacagagg

SEQ ID NO: 1020622 - RNA, 22 nt, Human
guuuuuccuugcugaggacccg

SEQ ID NO: 1020623 - RNA, 23 nt, Human
gccucugcucugcguuggggacu

SEQ ID NO: 1020624 - RNA, 22 nt, Human
uccugcagcugauaaauacagu

SEQ ID NO: 1020625 - RNA, 22 nt, Human
auggcagccuguggacagucaa

SEQ ID NO: 1020626 - RNA, 22 nt, Human
caggaaagagcugccaggcagg

SEQ ID NO: 1020627 - RNA, 23 nt, Human
uuugaaguugacugccuuccaga

SEQ ID NO: 1020628 - RNA, 22 nt, Human
uuuauugacccaaagcgagagu

SEQ ID NO: 1020629 - RNA, 22 nt, Human
gagaccaggaaguacagcagcc

SEQ ID NO: 1020630 - RNA, 22 nt, Human
ccugucaguugcugucagggau

SEQ ID NO: 1020631 - RNA, 22 nt, Human
aagauuuccuggauguaauucc

SEQ ID NO: 1020632 - RNA, 22 nt, Human
cuggagccggaccagggacggu

SEQ ID NO: 1020633 - RNA, 22 nt, Human
gcagaagcagcagaugggcgca

SEQ ID NO: 1020634 - RNA, 22 nt, Human
cucuggccgcagcucagcucug

SEQ ID NO: 1020635 - RNA, 22 nt, Human
gcagcuuugucacggagugucg

SEQ ID NO: 1020636 - RNA, 22 nt, Human
uguuacacagcagaauagcaag

SEQ ID NO: 1020637 - RNA, 22 nt, Human
aguguugucaaacggcucagca

SEQ ID NO: 1020638 - RNA, 22 nt, Human
aucuggcucuuccuggaguucc

SEQ ID NO: 1020639 - RNA, 22 nt, Human
aagccaggcugcacuugcuggg

SEQ ID NO: 1020640 - RNA, 22 nt, Human
aggaaucccgcaccagcugcug

SEQ ID NO: 1020641 - RNA, 22 nt, Human
uguauuuugugaggaucacucu

SEQ ID NO: 1020642 - RNA, 22 nt, Human
ccagcagcuguggcuuugccuc

SEQ ID NO: 1020643 - RNA, 22 nt, Human
ccuucucuacuccugaugcaug

SEQ ID NO: 1020644 - RNA, 22 nt, Human
cuggcaggucucgcugacgugu

SEQ ID NO: 1020645 - RNA, 22 nt, Human
ugggcagauuaaugcaguggcu

SEQ ID NO: 1020646 - RNA, 22 nt, Human
aggaggcugguucaggccauau

SEQ ID NO: 1020647 - RNA, 22 nt, Human
augcccgauaccuaguuaacuc

SEQ ID NO: 1020648 - RNA, 18 nt, Human
uggacaggguggagaaaa

SEQ ID NO: 1020649 - RNA, 22 nt, Human
agccuccuggaguuucugggau

SEQ ID NO: 1020650 - RNA, 22 nt, Human
ugucccagacacaguaugcgcu

SEQ ID NO: 1020651 - RNA, 22 nt, Human
ugauuaacugucuauuaaucau

SEQ ID NO: 1020652 - RNA, 22 nt, Human
auguucuuucagccagugcauc

SEQ ID NO: 1020653 - RNA, 22 nt, Human
guaguuuucugaaaauuacuuu

SEQ ID NO: 1020654 - RNA, 22 nt, Human
guggcugcuacagagcuggagg

SEQ ID NO: 1020655 - RNA, 22 nt, Human
cccugccucugaagcugcucag

SEQ ID NO: 1020656 - RNA, 22 nt, Human
uuauuucauguaaaauuuaugu

SEQ ID NO: 1020657 - RNA, 22 nt, Human
ugcaugcagcuggugauaagaa

SEQ ID NO: 1020658 - RNA, 22 nt, Human
aagcgccacgagaagcuggacc

SEQ ID NO: 1020659 - RNA, 22 nt, Human
agaagugccauacuguggucca

SEQ ID NO: 1020660 - RNA, 22 nt, Human
gcucugggauuaccagccuuag

SEQ ID NO: 1020661 - RNA, 22 nt, Human
agcagcucugagaggccagcac

SEQ ID NO: 1020662 - RNA, 22 nt, Human
agcugcucuuugaaggacacuu

SEQ ID NO: 1020663 - RNA, 22 nt, Human
cccugcagugugaccucaccua

SEQ ID NO: 1020664 - RNA, 22 nt, Human
gcacagggcugccaggcggcuu

SEQ ID NO: 1020665 - RNA, 22 nt, Human
aagggcagaauagagaagaugg

SEQ ID NO: 1020666 - RNA, 22 nt, Human
gcugucccaugguugcaagaug

SEQ ID NO: 1020667 - RNA, 22 nt, Human
uccaggcauaaugcccaguggu

SEQ ID NO: 1020668 - RNA, 22 nt, Human
gccuggcacauugcaguggauu

SEQ ID NO: 1020669 - RNA, 22 nt, Human
ccucugcaccauagccuucagc

SEQ ID NO: 1020670 - RNA, 22 nt, Human
cuuugaagagauuacugugcuc

SEQ ID NO: 1020671 - RNA, 22 nt, Human
caggcauggugagaacucagcc

SEQ ID NO: 1020672 - RNA, 22 nt, Human
uagugaaauuuaugcacagcua

SEQ ID NO: 1020673 - RNA, 22 nt, Human
cugcugugcagacagacucucu

SEQ ID NO: 1020674 - RNA, 22 nt, Human
cagcauggacccaucgcugagu

SEQ ID NO: 1020675 - RNA, 22 nt, Human
cuuguauuccccuaucucuaaa

SEQ ID NO: 1020676 - RNA, 22 nt, Human
gagcagcuuaugucaagccaga

SEQ ID NO: 1020677 - RNA, 22 nt, Human
uccaaauucuagggccuugguu

SEQ ID NO: 1020678 - RNA, 22 nt, Human
uaauuucacugauaugaaguca

SEQ ID NO: 1020679 - RNA, 22 nt, Human
cuggaaugccucccugucagag

SEQ ID NO: 1020680 - RNA, 22 nt, Human
cugcugagaaaagacugaggga

SEQ ID NO: 1020681 - RNA, 22 nt, Human
uggucaguugcaucagagaagu

SEQ ID NO: 1020682 - RNA, 22 nt, Human
agcuucuggaagccuggcagca

SEQ ID NO: 1020683 - RNA, 22 nt, Human
ggccaggcuggucucagacuuc

SEQ ID NO: 1020684 - RNA, 22 nt, Human
cagcuguggcugccacugcucc

SEQ ID NO: 1020685 - RNA, 22 nt, Human
cccaggcugauguucagcgggu

SEQ ID NO: 1020686 - RNA, 22 nt, Human
cagggccagccauccugcuggg

SEQ ID NO: 1020687 - RNA, 22 nt, Human
cucagagagggcaccagggcca

SEQ ID NO: 1020688 - RNA, 21 nt, Human
uagcuuuaauauucccacauu

SEQ ID NO: 1020689 - RNA, 22 nt, Human
uuauccaaacuggugaaucauu

SEQ ID NO: 1020690 - RNA, 22 nt, Human
aaauuucuggaagugucagagu

SEQ ID NO: 1020691 - RNA, 22 nt, Human
aagauuuccuucaguagagcua

SEQ ID NO: 1020692 - RNA, 17 nt, Human
acagaggcaggagugga

SEQ ID NO: 1020693 - RNA, 22 nt, Human
ccugccugcaaaaugggacaag

SEQ ID NO: 1020694 - RNA, 22 nt, Human
ccugggcagguguggcuucccc

SEQ ID NO: 1020695 - RNA, 22 nt, Human
ucuggagcaacagagcaggaca

SEQ ID NO: 1020696 - RNA, 22 nt, Human
caaaguccuagaacagugcuug

SEQ ID NO: 1020697 - RNA, 22 nt, Human
gccucacugcagccccaggaag

SEQ ID NO: 1020698 - RNA, 22 nt, Human
ggccucugaggacagccuuggc

SEQ ID NO: 1020699 - RNA, 22 nt, Human
auucucaauggcuacuuucaua

SEQ ID NO: 1020700 - RNA, 22 nt, Human
auaucuuuuagagcaagcuugu

SEQ ID NO: 1020701 - RNA, 22 nt, Human
uuuugagauggugucucgcucc

SEQ ID NO: 1020702 - RNA, 22 nt, Human
uagggcucuggugggcucuguu

SEQ ID NO: 1020703 - RNA, 22 nt, Human
uccaggcauguggccaguacuc

SEQ ID NO: 1020704 - RNA, 22 nt, Human
uuccuguauuuugcgaauuuuc

SEQ ID NO: 1020705 - RNA, 23 nt, Human
cagagcugauuaaacuuaaucuc

SEQ ID NO: 1020706 - RNA, 22 nt, Human
caugaagcacagcucucuuuuu

SEQ ID NO: 1020707 - RNA, 18 nt, Human
ucagcuggggcugcagcc

SEQ ID NO: 1020708 - RNA, 22 nt, Human
acccugggcuuggccugcucag

SEQ ID NO: 1020709 - RNA, 22 nt, Human
ugucacauugaauaugauuuau

SEQ ID NO: 1020710 - RNA, 22 nt, Human
ugucacauguguggcauuuuuc

SEQ ID NO: 1020711 - RNA, 22 nt, Human
uuccaggacaagauguuucagg

SEQ ID NO: 1020712 - RNA, 22 nt, Human
gaccauuucuaggaaucagacu

SEQ ID NO: 1020713 - RNA, 19 nt, Human
uggcuccugccugccuucu

SEQ ID NO: 1020714 - RNA, 22 nt, Human
uaaaugaagaaauggagauugu

SEQ ID NO: 1020715 - RNA, 22 nt, Human
auuacaguaacagcuacaaugc

SEQ ID NO: 1020716 - RNA, 22 nt, Human
cagacagcugcuuucuugcugu

SEQ ID NO: 1020717 - RNA, 22 nt, Human
aagccuuccugagugcaaggcc

SEQ ID NO: 1020718 - RNA, 22 nt, Human
cacagggcuuugauggcugagu

SEQ ID NO: 1020719 - RNA, 22 nt, Human
cuucccacuaguaucacagagc

SEQ ID NO: 1020720 - RNA, 22 nt, Human
aucucagacauguuguccauga

SEQ ID NO: 1020721 - RNA, 22 nt, Human
accugagaaugggggcaugugu

SEQ ID NO: 1020722 - RNA, 22 nt, Human
cacccaggacaggccagaugug

SEQ ID NO: 1020723 - RNA, 22 nt, Human
aagcuuuaugacuuggagacag

SEQ ID NO: 1020724 - RNA, 22 nt, Human
ucucaggaaauaggauuugagu

SEQ ID NO: 1020725 - RNA, 22 nt, Human
gcaguggcuaggagucuggcgu

SEQ ID NO: 1020726 - RNA, 19 nt, Human
agggccugagcagauguug

SEQ ID NO: 1020727 - RNA, 22 nt, Human
aaucuguucuacucuauucaga

SEQ ID NO: 1020728 - RNA, 22 nt, Human
cugaggcaugaaugugggcuuu

SEQ ID NO: 1020729 - RNA, 19 nt, Human
cacacccaugcuugccaag

SEQ ID NO: 1020730 - RNA, 20 nt, Human
uucauucauuccacaacuuc

SEQ ID NO: 1020731 - RNA, 22 nt, Human
uuccagaauuuuguucugcuug

SEQ ID NO: 1020732 - RNA, 22 nt, Human
aggcccugcuuuccagagcuca

SEQ ID NO: 1020733 - RNA, 22 nt, Human
uuccaugacaccgagggaaguc

SEQ ID NO: 1020734 - RNA, 22 nt, Human
cuuccuggccauugccauggca

SEQ ID NO: 1020735 - RNA, 22 nt, Human
aaaggccacacagagcagggag

SEQ ID NO: 1020736 - RNA, 22 nt, Human
cagcaggcccaggugcugguga

SEQ ID NO: 1020737 - RNA, 22 nt, Human
caggccaggcugcauuugcccc

SEQ ID NO: 1020738 - RNA, 23 nt, Human
acacaauagaguacuauucagcc

SEQ ID NO: 1020739 - RNA, 22 nt, Human
uuuuuauaugaaggauagugcg

SEQ ID NO: 1020740 - RNA, 22 nt, Human
caagccucagaaucuucuccau

SEQ ID NO: 1020741 - RNA, 22 nt, Human
ucucagaguuuagagcugagcc

SEQ ID NO: 1020742 - RNA, 22 nt, Human
agggccagcugaugagaaugag

SEQ ID NO: 1020743 - RNA, 22 nt, Human
ucagugugaggucuuccacccg

SEQ ID NO: 1020744 - RNA, 20 nt, Human
aggagaugauccagagucag

SEQ ID NO: 1020745 - RNA, 22 nt, Human
ugucuuuauauauuuggaaaau

SEQ ID NO: 1020746 - RNA, 22 nt, Human
uauuucuucgggauucaagcua

SEQ ID NO: 1020747 - RNA, 22 nt, Human
uugaacauuggcaauuucauau

SEQ ID NO: 1020748 - RNA, 22 nt, Human
cugcugcaggaugggcacucug

SEQ ID NO: 1020749 - RNA, 22 nt, Human
agccagcuggagaccacuguuu

SEQ ID NO: 1020750 - RNA, 22 nt, Human
caggcucccacccuccugcagc

SEQ ID NO: 1020751 - RNA, 19 nt, Human
agcaaauauaauaguguuc

SEQ ID NO: 1020752 - RNA, 22 nt, Human
ugcucccaggcauucucuguug

SEQ ID NO: 1020753 - RNA, 22 nt, Human
aaaguauucuugacuguuuuuc

SEQ ID NO: 1020754 - RNA, 22 nt, Human
aagaaauuaaugugccauuacu

SEQ ID NO: 1020755 - RNA, 20 nt, Human
aagcacauuucuacaauaau

SEQ ID NO: 1020756 - RNA, 22 nt, Human
agcugccaaguuggaguagcaa

SEQ ID NO: 1020757 - RNA, 22 nt, Human
agcucccauuaucuucugaaac

SEQ ID NO: 1020758 - RNA, 22 nt, Human
ggcacugauaauguccucucuc

SEQ ID NO: 1020759 - RNA, 22 nt, Human
cagaggcugaugugggaugggc

SEQ ID NO: 1020760 - RNA, 22 nt, Human
ugccaggcuaaguggaggacuu

SEQ ID NO: 1020761 - RNA, 23 nt, Human
ggcugagacuacaggcgcuugcc

SEQ ID NO: 1020762 - RNA, 22 nt, Human
aauauccacacugugucccugc

SEQ ID NO: 1020763 - RNA, 22 nt, Human
ucuggcaggcaaucggcucugg

SEQ ID NO: 1020764 - RNA, 22 nt, Human
uuaauuaaauucaugagcauug

SEQ ID NO: 1020765 - RNA, 22 nt, Human
cuguguggacugguugaggccc

SEQ ID NO: 1020766 - RNA, 22 nt, Human
aagaagaugguuaacuuucagu

SEQ ID NO: 1020767 - RNA, 22 nt, Human
ccucaggauacaggagccacag

SEQ ID NO: 1020768 - RNA, 22 nt, Human
aguggcagagcaggugcuggaa

SEQ ID NO: 1020769 - RNA, 22 nt, Human
aggaccagccuccaggucucuu

SEQ ID NO: 1020770 - RNA, 22 nt, Human
cuguguuugaugagaagccacc

SEQ ID NO: 1020771 - RNA, 22 nt, Human
acugggagagcgaccagauucu

SEQ ID NO: 1020772 - RNA, 21 nt, Human
aucuuuauuacgcagagaaga

SEQ ID NO: 1020773 - RNA, 22 nt, Human
agucuucccugugccagagugu

SEQ ID NO: 1020774 - RNA, 22 nt, Human
accugccucagugcagcuggau

SEQ ID NO: 1020775 - RNA, 22 nt, Human
cuggcucaguucuugguuuuca

SEQ ID NO: 1020776 - RNA, 21 nt, Human
ugcagaggcacaaacaagccc

SEQ ID NO: 1020777 - RNA, 22 nt, Human
agggaugguggagguugcaagu

SEQ ID NO: 1020778 - RNA, 22 nt, Human
agggugcauguuugcaagagug

SEQ ID NO: 1020779 - RNA, 22 nt, Human
ccacaaguuucagcacccagag

SEQ ID NO: 1020780 - RNA, 22 nt, Human
cagcagugaugugugaggguuc

SEQ ID NO: 1020781 - RNA, 22 nt, Human
auuguucaaagugcuuugcaug

SEQ ID NO: 1020782 - RNA, 22 nt, Human
uuacaaagagaaguuguagaau

SEQ ID NO: 1020783 - RNA, 22 nt, Human
cugcuuugcauagcugccagag

SEQ ID NO: 1020784 - RNA, 22 nt, Human
gggaccuggcgagggucacaca

SEQ ID NO: 1020785 - RNA, 22 nt, Human
aaaguguggagauugaacuaaa

SEQ ID NO: 1020786 - RNA, 22 nt, Human
aucaggauguuuggcugucaua

SEQ ID NO: 1020787 - RNA, 16 nt, Human
uggaaggggucuccgg

SEQ ID NO: 1020788 - RNA, 22 nt, Human
uuccaugaagggcagccucuca

SEQ ID NO: 1020789 - RNA, 22 nt, Human
aaguucaaggcagguccugagg

SEQ ID NO: 1020790 - RNA, 22 nt, Human
aggcagccagauggcagccugc

SEQ ID NO: 1020791 - RNA, 22 nt, Human
cucuccuugcagauggcugccu

SEQ ID NO: 1020792 - RNA, 22 nt, Human
acuguucacccagcacuagcag

SEQ ID NO: 1020793 - RNA, 22 nt, Human
acagguggggaggcugagguuc

SEQ ID NO: 1020794 - RNA, 22 nt, Human
ccugcaguuuguugugaccccg

SEQ ID NO: 1020795 - RNA, 22 nt, Human
uauguacaccggggaagguggg

SEQ ID NO: 1020796 - RNA, 22 nt, Human
gcagugggcaacaagagcugga

SEQ ID NO: 1020797 - RNA, 22 nt, Human
ucauuuugggguuugucaucuu

SEQ ID NO: 1020798 - RNA, 22 nt, Human
ggugaaggucuacugugugcca

SEQ ID NO: 1020799 - RNA, 22 nt, Human
gugucccaaagauuagaaauca

SEQ ID NO: 1020800 - RNA, 22 nt, Human
aaguuuaagguggaaguggugg

SEQ ID NO: 1020801 - RNA, 22 nt, Human
ugaaucauggauaaauagcuua

SEQ ID NO: 1020802 - RNA, 22 nt, Human
gggcuccaccuagggacacugg

SEQ ID NO: 1020803 - RNA, 22 nt, Human
ugggacacccucacgccugcac

SEQ ID NO: 1020804 - RNA, 22 nt, Human
cagggcuguggcuuugugcugu

SEQ ID NO: 1020805 - RNA, 22 nt, Human
aaugcacaugccacauguggua

SEQ ID NO: 1020806 - RNA, 22 nt, Human
aaaauaacuucuacuauuugca

SEQ ID NO: 1020807 - RNA, 21 nt, Human
uggccaaacuggagcauuuga

SEQ ID NO: 1020808 - RNA, 22 nt, Human
cccaggccagaacuugguugcu

SEQ ID NO: 1020809 - RNA, 22 nt, Human
uuauuccaauuucuccuacaaa

SEQ ID NO: 1020810 - RNA, 22 nt, Human
ugugcuucaucacuucucaguu

SEQ ID NO: 1020811 - RNA, 22 nt, Human
cacugaguucccugacauuuca

SEQ ID NO: 1020812 - RNA, 22 nt, Human
cuaaaauuaucaagauaauucc

SEQ ID NO: 1020813 - RNA, 22 nt, Human
agguggagacccagagaaggcg

SEQ ID NO: 1020814 - RNA, 22 nt, Human
ucucagagaaaugugucaccau

SEQ ID NO: 1020815 - RNA, 22 nt, Human
cucugugggggagaggcagcug

SEQ ID NO: 1020816 - RNA, 17 nt, Human
ccagguggaaucgugga

SEQ ID NO: 1020817 - RNA, 22 nt, Human
uugcauaaaagaguauaucuua

SEQ ID NO: 1020818 - RNA, 22 nt, Human
aaugauuuccccuacacagaag

SEQ ID NO: 1020819 - RNA, 22 nt, Human
caugcuuugggucagaaaugcc

SEQ ID NO: 1020820 - RNA, 22 nt, Human
ugaaggaauggaggaucagagc

SEQ ID NO: 1020821 - RNA, 22 nt, Human
cuccuuccugguuagcaccuua

SEQ ID NO: 1020822 - RNA, 22 nt, Human
ccagcccuucccaacuggccag

SEQ ID NO: 1020823 - RNA, 22 nt, Human
caagagcugugaccucauucac

SEQ ID NO: 1020824 - RNA, 22 nt, Human
cagcucaaguuucccaggucag

SEQ ID NO: 1020825 - RNA, 22 nt, Human
uuuauuuaaagucguguguuaa

SEQ ID NO: 1020826 - RNA, 22 nt, Human
ugugccuggcauucugggcuuc

SEQ ID NO: 1020827 - RNA, 21 nt, Human
ucagcagcaucugccuagagu

SEQ ID NO: 1020828 - RNA, 22 nt, Human
uguucagagacagaaauucuaa

SEQ ID NO: 1020829 - RNA, 22 nt, Human
ugaaguuguuaagguugccauu

SEQ ID NO: 1020830 - RNA, 22 nt, Human
uucuuccucagcagggcugccu

SEQ ID NO: 1020831 - RNA, 22 nt, Human
ggccucgcggcuucugguggcu

SEQ ID NO: 1020832 - RNA, 22 nt, Human
uuugaaugcaggacauacagaa

SEQ ID NO: 1020833 - RNA, 22 nt, Human
cugggagcaccauacuuguuuc

SEQ ID NO: 1020834 - RNA, 22 nt, Human
guuuucauuacugcugugauuu

SEQ ID NO: 1020835 - RNA, 22 nt, Human
aggcagcagccacaaggccuga

SEQ ID NO: 1020836 - RNA, 23 nt, Human
agaugaggcuucuccauguuggu

SEQ ID NO: 1020837 - RNA, 22 nt, Human
aauaauuuugagagccuggaaa

SEQ ID NO: 1020838 - RNA, 22 nt, Human
ugcagcauuauucacaguagcc

SEQ ID NO: 1020839 - RNA, 22 nt, Human
uagcugucagcaaucaaguggu

SEQ ID NO: 1020840 - RNA, 22 nt, Human
ugggcacacugaaucugcuauu

SEQ ID NO: 1020841 - RNA, 22 nt, Human
caaauucucaagguuuauccca

SEQ ID NO: 1020842 - RNA, 22 nt, Human
gguggccaggccagcucuggcc

SEQ ID NO: 1020843 - RNA, 22 nt, Human
gcagguggcagaggugggaucu

SEQ ID NO: 1020844 - RNA, 19 nt, Human
gaucuuugccaauuuaagc

SEQ ID NO: 1020845 - RNA, 22 nt, Human
cucccaggggaacuaucaagua

SEQ ID NO: 1020846 - RNA, 22 nt, Human
aaagccuucaaguagauguaag

SEQ ID NO: 1020847 - RNA, 22 nt, Human
ccuggaugauccaugucaugga

SEQ ID NO: 1020848 - RNA, 22 nt, Human
agaggugacauaggagaggcuc

SEQ ID NO: 1020849 - RNA, 22 nt, Human
aacaucuacuaagugccaggca

SEQ ID NO: 1020850 - RNA, 22 nt, Human
ccugccugauuccaggauggcu

SEQ ID NO: 1020851 - RNA, 22 nt, Human
uagaaacucaggauacucuucc

SEQ ID NO: 1020852 - RNA, 22 nt, Human
cugagcauggccgguccauggu

SEQ ID NO: 1020853 - RNA, 22 nt, Human
agaccgagaaguucuccaggcc

SEQ ID NO: 1020854 - RNA, 22 nt, Human
gagccuggccuccugccucagc

SEQ ID NO: 1020855 - RNA, 22 nt, Human
ucagagugggagaaugugccaa

SEQ ID NO: 1020856 - RNA, 22 nt, Human
cugcugugccuuaaaaugcaag

SEQ ID NO: 1020857 - RNA, 22 nt, Human
cgccugggaguccacaccugcu

SEQ ID NO: 1020858 - RNA, 22 nt, Human
ucuuuauuuaagucuguuguaa

SEQ ID NO: 1020859 - RNA, 18 nt, Human
gggcaagcggcugucacc

SEQ ID NO: 1020860 - RNA, 21 nt, Human
gugguuauuuucauuagcauc

SEQ ID NO: 1020861 - RNA, 22 nt, Human
ccucagggaaugggaggcuggg

SEQ ID NO: 1020862 - RNA, 22 nt, Human
auuauguaacugugguucagca

SEQ ID NO: 1020863 - RNA, 22 nt, Human
uggcuggcaaggcuggagucag

SEQ ID NO: 1020864 - RNA, 22 nt, Human
caggcugggaacgccacccgcu

SEQ ID NO: 1020865 - RNA, 22 nt, Human
uucaggauuguguuuuuccuga

SEQ ID NO: 1020866 - RNA, 23 nt, Human
gccuucagcucgggaaggcuccc

SEQ ID NO: 1020867 - RNA, 22 nt, Human
gggcagcaucaggaggggcuuu

SEQ ID NO: 1020868 - RNA, 22 nt, Human
ggagcugggaauuggaucaucu

SEQ ID NO: 1020869 - RNA, 22 nt, Human
aaggccugggaguacugggaca

SEQ ID NO: 1020870 - RNA, 22 nt, Human
ugcagggaaugcuugcagcaug

SEQ ID NO: 1020871 - RNA, 22 nt, Human
cagcuggaucccugcagaacuu

SEQ ID NO: 1020872 - RNA, 22 nt, Human
accugagcaugccaggagagug

SEQ ID NO: 1020873 - RNA, 22 nt, Human
agcccagaggcugggcgugcau

SEQ ID NO: 1020874 - RNA, 22 nt, Human
aaaguguaaaagcauguuaggg

SEQ ID NO: 1020875 - RNA, 22 nt, Human
ugcccugucuaagcugucagua

SEQ ID NO: 1020876 - RNA, 20 nt, Human
uuucaagucagcaauucuca

SEQ ID NO: 1020877 - RNA, 22 nt, Human
ggagcagcacugauuagcgguu

SEQ ID NO: 1020878 - RNA, 22 nt, Human
agauuuagugguggaauuuugg

SEQ ID NO: 1020879 - RNA, 22 nt, Human
cagggcuccccagagagccucu

SEQ ID NO: 1020880 - RNA, 17 nt, Human
acucaggaucugggagu

SEQ ID NO: 1020881 - RNA, 22 nt, Human
ucugagcuacgaugccugucac

SEQ ID NO: 1020882 - RNA, 22 nt, Human
ugccuggguucccaccccaaag

SEQ ID NO: 1020883 - RNA, 22 nt, Human
acacugaauaauugagaguuga

SEQ ID NO: 1020884 - RNA, 22 nt, Human
ucuggccacccgaggccccugc

SEQ ID NO: 1020885 - RNA, 22 nt, Human
ccucaggaaaugaauaaauggc

SEQ ID NO: 1020886 - RNA, 19 nt, Human
uaaggccaaaaguaagugu

SEQ ID NO: 1020887 - RNA, 22 nt, Human
cugaaggagaaggccacuguuc

SEQ ID NO: 1020888 - RNA, 21 nt, Human
ugccaggccugagcugggguc

SEQ ID NO: 1020889 - RNA, 22 nt, Human
ugcugcuguuuccuacaucuca

SEQ ID NO: 1020890 - RNA, 22 nt, Human
gguucacacuaagcuuaagugg

SEQ ID NO: 1020891 - RNA, 22 nt, Human
gccugcaggcuguaguuuguga

SEQ ID NO: 1020892 - RNA, 22 nt, Human
aauuuccagaucagaugacuca

SEQ ID NO: 1020893 - RNA, 22 nt, Human
acaaauaugguacucggagaaa

SEQ ID NO: 1020894 - RNA, 22 nt, Human
gugcauuugacgaauacucacu

SEQ ID NO: 1020895 - RNA, 22 nt, Human
auuuccagcagcauauuugucu

SEQ ID NO: 1020896 - RNA, 22 nt, Human
cuacauuaaauuggcuuacuua

SEQ ID NO: 1020897 - RNA, 22 nt, Human
ggcugcuguacugaugucaguu

SEQ ID NO: 1020898 - RNA, 22 nt, Human
gacccaggguggucaccugaaa

SEQ ID NO: 1020899 - RNA, 22 nt, Human
aggcacaggccucagcacccag

SEQ ID NO: 1020900 - RNA, 22 nt, Human
gccaggcauuuauugauugaau

SEQ ID NO: 1020901 - RNA, 22 nt, Human
cagcucugggugacaggagggc

SEQ ID NO: 1020902 - RNA, 23 nt, Human
uggcucagcuaguuuuccauuuc

SEQ ID NO: 1020903 - RNA, 22 nt, Human
ucauuauuuuggacuggagugu

SEQ ID NO: 1020904 - RNA, 22 nt, Human
cacugggcguguccugggugag

SEQ ID NO: 1020905 - RNA, 22 nt, Human
gaggccaaucaauagggcaaua

SEQ ID NO: 1020906 - RNA, 22 nt, Human
cugccugugccaaugcuccuuu

SEQ ID NO: 1020907 - RNA, 22 nt, Human
accaucagucacauguagagaa

SEQ ID NO: 1020908 - RNA, 22 nt, Human
aggcucugaaggagaaccuguu

SEQ ID NO: 1020909 - RNA, 22 nt, Human
aauacuauguagccaaaauaau

SEQ ID NO: 1020910 - RNA, 18 nt, Human
cagucccaaaccuuagga

SEQ ID NO: 1020911 - RNA, 22 nt, Human
guggcugcagcccagcggcacg

SEQ ID NO: 1020912 - RNA, 22 nt, Human
gccuggugcuaugagggccagc

SEQ ID NO: 1020913 - RNA, 22 nt, Human
cagggaguuuuuguuccucuag

SEQ ID NO: 1020914 - RNA, 22 nt, Human
acagaggccccgugggagagcc

SEQ ID NO: 1020915 - RNA, 18 nt, Human
cuuuaugugcagagcuuu

SEQ ID NO: 1020916 - RNA, 22 nt, Human
uuccucucgcucuccggggccc

SEQ ID NO: 1020917 - RNA, 22 nt, Human
guucacaagaguuacagacaga

SEQ ID NO: 1020918 - RNA, 19 nt, Human
gggcuuggggcugaagccu

SEQ ID NO: 1020919 - RNA, 21 nt, Human
ccccugggagcccugucagua

SEQ ID NO: 1020920 - RNA, 22 nt, Human
uccugccugcaaucccagcacu

SEQ ID NO: 1020921 - RNA, 22 nt, Human
uaauaucuacuucauagaguuu

SEQ ID NO: 1020922 - RNA, 22 nt, Human
cugaaugaggaaaagagugagg

SEQ ID NO: 1020923 - RNA, 22 nt, Human
gcagaggggaagcugaggaauu

SEQ ID NO: 1020924 - RNA, 21 nt, Human
acaggcuuuagaaaaugacuc

SEQ ID NO: 1020925 - RNA, 22 nt, Human
ccacugucuuuuccaggcugaa

SEQ ID NO: 1020926 - RNA, 22 nt, Human
uucauacaaugggauauuauga

SEQ ID NO: 1020927 - RNA, 23 nt, Human
ucguugaauagcaauagcacaac

SEQ ID NO: 1020928 - RNA, 22 nt, Human
aguacagaccugucucuuccug

SEQ ID NO: 1020929 - RNA, 22 nt, Human
auacuaaaguauagaacuuagu

SEQ ID NO: 1020930 - RNA, 22 nt, Human
guccucuggaagaugaguucuu

SEQ ID NO: 1020931 - RNA, 22 nt, Human
cagggcagggccacacccccug

SEQ ID NO: 1020932 - RNA, 22 nt, Human
ucccugggguaacauuagaggg

SEQ ID NO: 1020933 - RNA, 22 nt, Human
cagagccaggguugcaccccug

SEQ ID NO: 1020934 - RNA, 22 nt, Human
uacauaaugagcuaguuaaguu

SEQ ID NO: 1020935 - RNA, 22 nt, Human
ugggagcagcuuugcgagggag

SEQ ID NO: 1020936 - RNA, 22 nt, Human
acagagagcugugauugaguua

SEQ ID NO: 1020937 - RNA, 21 nt, Human
aucauucuggaaaauucaagc

SEQ ID NO: 1020938 - RNA, 22 nt, Human
auuaauuuccaggcacugugcu

SEQ ID NO: 1020939 - RNA, 22 nt, Human
acagaauugaaaguauaaucug

SEQ ID NO: 1020940 - RNA, 22 nt, Human
ccugcagggaaucgaggcagaa

SEQ ID NO: 1020941 - RNA, 22 nt, Human
agggcagcuagcuguagaaaga

SEQ ID NO: 1020942 - RNA, 19 nt, Human
cagcucaguuugauucucu

SEQ ID NO: 1020943 - RNA, 22 nt, Human
ugaccugcguaggugguuucug

SEQ ID NO: 1020944 - RNA, 22 nt, Human
ggcucagguuuaaagugcuuua

SEQ ID NO: 1020945 - RNA, 22 nt, Human
uccuggagccacggagcuuuca

SEQ ID NO: 1020946 - RNA, 22 nt, Human
cugucccucaucaccucugggu

SEQ ID NO: 1020947 - RNA, 22 nt, Human
aucuacagugcacaggacagcc

SEQ ID NO: 1020948 - RNA, 22 nt, Human
ggcaucuguccaucucuccagc

SEQ ID NO: 1020949 - RNA, 22 nt, Human
uauucacagcugccgcacucag

SEQ ID NO: 1020950 - RNA, 22 nt, Human
auucaaguggcugcuauguuaa

SEQ ID NO: 1020951 - RNA, 22 nt, Human
ucuucauuccguagauauuuau

SEQ ID NO: 1020952 - RNA, 22 nt, Human
acaaagucucuaauaaucuucu

SEQ ID NO: 1020953 - RNA, 22 nt, Human
agggcccuagggaaugagacau

SEQ ID NO: 1020954 - RNA, 22 nt, Human
cugaagagcucuccuguccccu

SEQ ID NO: 1020955 - RNA, 22 nt, Human
caaaguuuaaaguagauuucag

SEQ ID NO: 1020956 - RNA, 22 nt, Human
uaggcacugguuguggauaguu

SEQ ID NO: 1020957 - RNA, 19 nt, Human
uccugcagguggcuugcag

SEQ ID NO: 1020958 - RNA, 22 nt, Human
acaaagcuagagaagagaauug

SEQ ID NO: 1020959 - RNA, 21 nt, Human
agcaccuuacagcuauaaugg

SEQ ID NO: 1020960 - RNA, 22 nt, Human
aguaccaugcuuccugacuggu

SEQ ID NO: 1020961 - RNA, 22 nt, Human
ucaguuuuuguuugccagauag

SEQ ID NO: 1020962 - RNA, 21 nt, Human
acuguucaucuguucagaagc

SEQ ID NO: 1020963 - RNA, 22 nt, Human
acuggaaaacacuacuacaugc

SEQ ID NO: 1020964 - RNA, 23 nt, Human
ucaggauauugugugccaaggug

SEQ ID NO: 1020965 - RNA, 22 nt, Human
cagaaauguuuauauguggugu

SEQ ID NO: 1020966 - RNA, 22 nt, Human
gccaaaucacagggccaaaagc

SEQ ID NO: 1020967 - RNA, 22 nt, Human
guaaaugugcuucuuuuaacuu

SEQ ID NO: 1020968 - RNA, 22 nt, Human
gauugaaacauaggcagucgag

SEQ ID NO: 1020969 - RNA, 22 nt, Human
ccacagggcucuaggcgcuucc

SEQ ID NO: 1020970 - RNA, 22 nt, Human
cccuguacagucucuguggcac

SEQ ID NO: 1020971 - RNA, 22 nt, Human
gagcagugacuggagcaugaga

SEQ ID NO: 1020972 - RNA, 22 nt, Human
auguagaauuccuucuacuuug

SEQ ID NO: 1020973 - RNA, 22 nt, Human
auguuagaaucucugaaugugg

SEQ ID NO: 1020974 - RNA, 22 nt, Human
gacaggguacgggcuaggcaca

SEQ ID NO: 1020975 - RNA, 21 nt, Human
ggagucauuagucauuuccuu

SEQ ID NO: 1020976 - RNA, 22 nt, Human
auaaaacuuauuagaauugugu

SEQ ID NO: 1020977 - RNA, 22 nt, Human
ucaguuuucucaucugugaaau

SEQ ID NO: 1020978 - RNA, 22 nt, Human
ucacacagguuugcaaugauuu

SEQ ID NO: 1020979 - RNA, 20 nt, Human
uauuuguauuugggaaaguu

SEQ ID NO: 1020980 - RNA, 22 nt, Human
cagcugccacaccucuuucucu

SEQ ID NO: 1020981 - RNA, 22 nt, Human
gcaggguauaauacuuagguga

SEQ ID NO: 1020982 - RNA, 22 nt, Human
aauuuccaaauuucugucacac

SEQ ID NO: 1020983 - RNA, 22 nt, Human
uuuuugaaggcugaugugauua

SEQ ID NO: 1020984 - RNA, 22 nt, Human
gcaaauacauguugagcaccua

SEQ ID NO: 1020985 - RNA, 22 nt, Human
accugcaguggccacuccuaau

SEQ ID NO: 1020986 - RNA, 22 nt, Human
uucauucugggcucuaaggaac

SEQ ID NO: 1020987 - RNA, 20 nt, Human
accucugcaucaauccuuug

SEQ ID NO: 1020988 - RNA, 19 nt, Human
aggcagcacccaguccuug

SEQ ID NO: 1020989 - RNA, 22 nt, Human
gaggcagaggaagguggucucu

SEQ ID NO: 1020990 - RNA, 22 nt, Human
uaaguuuuaagcaaucugauaa

SEQ ID NO: 1020991 - RNA, 22 nt, Human
gugggccucuugaggguggcua

SEQ ID NO: 1020992 - RNA, 22 nt, Human
cucuuuccaggguaccccaggu

SEQ ID NO: 1020993 - RNA, 22 nt, Human
cacccaggcuagagugcagugg

SEQ ID NO: 1020994 - RNA, 22 nt, Human
cccaggagguagagguugcagu

SEQ ID NO: 1020995 - RNA, 22 nt, Human
cuggacagaaaaggccacugga

SEQ ID NO: 1020996 - RNA, 19 nt, Human
gagcagcugcacccauuga

SEQ ID NO: 1020997 - RNA, 22 nt, Human
uccaugagggacacuggaugcu

SEQ ID NO: 1020998 - RNA, 22 nt, Human
auguucaaacuuuuuacacacc

SEQ ID NO: 1020999 - RNA, 22 nt, Human
agacuuugagcucuuagagaag

SEQ ID NO: 1021000 - RNA, 22 nt, Human
uaugaagaaguucugugaaaug

SEQ ID NO: 1021001 - RNA, 22 nt, Human
gagacugauggggcucccagaa

SEQ ID NO: 1021002 - RNA, 22 nt, Human
cccaccccuggacaggugagug

SEQ ID NO: 1021003 - RNA, 20 nt, Human
auguccagugacuggaccau

SEQ ID NO: 1021004 - RNA, 22 nt, Human
cugcuuuagacaacugcuggga

SEQ ID NO: 1021005 - RNA, 22 nt, Human
cagggacaugacuggucucugu

SEQ ID NO: 1021006 - RNA, 22 nt, Human
uucccaggcugugcuaccagag

SEQ ID NO: 1021007 - RNA, 18 nt, Human
gucacuguguuucugagc

SEQ ID NO: 1021008 - RNA, 22 nt, Human
acucugcuuauugcugcaggca

SEQ ID NO: 1021009 - RNA, 22 nt, Human
gccuggcacucacugaagaggc

SEQ ID NO: 1021010 - RNA, 22 nt, Human
ugaugggaggugcugcaggacc

SEQ ID NO: 1021011 - RNA, 22 nt, Human
augaagauaagaccaggcugga

SEQ ID NO: 1021012 - RNA, 22 nt, Human
cucuucuuauggccguggcuga

SEQ ID NO: 1021013 - RNA, 22 nt, Human
acuguacacgugucauuuacag

SEQ ID NO: 1021014 - RNA, 22 nt, Human
cagaguguggcaucuuccaacu

SEQ ID NO: 1021015 - RNA, 22 nt, Human
aggagaaagacuggacagccaa

SEQ ID NO: 1021016 - RNA, 23 nt, Human
uugcacauuggagcuggucuucu

SEQ ID NO: 1021017 - RNA, 22 nt, Human
cauuucugugacacuuccaucu

SEQ ID NO: 1021018 - RNA, 22 nt, Human
uggcucugagacacaggcucuc

SEQ ID NO: 1021019 - RNA, 22 nt, Human
cugggguggauggguccaaguu

SEQ ID NO: 1021020 - RNA, 22 nt, Human
uaauaguugugacuuuguaaag

SEQ ID NO: 1021021 - RNA, 22 nt, Human
uucaggauccccuugaugggcu

SEQ ID NO: 1021022 - RNA, 22 nt, Human
cagaggcucaccagccuuucac

SEQ ID NO: 1021023 - RNA, 22 nt, Human
cugggggcaauggucagagugu

SEQ ID NO: 1021024 - RNA, 22 nt, Human
ggaugcaggaguugaagaagga

SEQ ID NO: 1021025 - RNA, 22 nt, Human
ugggcucugugccagguuggug

SEQ ID NO: 1021026 - RNA, 22 nt, Human
ggcucuggugaggguaggagau

SEQ ID NO: 1021027 - RNA, 22 nt, Human
cccagcuccaagggacagcgaa

SEQ ID NO: 1021028 - RNA, 22 nt, Human
aucuggcucucucauuuacaaa

SEQ ID NO: 1021029 - RNA, 19 nt, Human
auuccucaaggacagaaau

SEQ ID NO: 1021030 - RNA, 22 nt, Human
uaauuauaacaguuacaucuua

SEQ ID NO: 1021031 - RNA, 22 nt, Human
cccucagcuccacccucagcag

SEQ ID NO: 1021032 - RNA, 22 nt, Human
ucacuuagauggggaucaucac

SEQ ID NO: 1021033 - RNA, 21 nt, Human
gagcugggcgaggcuccgggg

SEQ ID NO: 1021034 - RNA, 22 nt, Human
ugugugccugagccgugccugg

SEQ ID NO: 1021035 - RNA, 22 nt, Human
ucugggaguuucugugggagcu

SEQ ID NO: 1021036 - RNA, 22 nt, Human
gagaagguggaccugaaggagc

SEQ ID NO: 1021037 - RNA, 22 nt, Human
cuuagaaaugcagauucucagg

SEQ ID NO: 1021038 - RNA, 23 nt, Human
gggagccauggguggucauggag

SEQ ID NO: 1021039 - RNA, 21 nt, Human
auacacauacacauaaaugug

SEQ ID NO: 1021040 - RNA, 22 nt, Human
aaaugucuuugaguauuucugc

SEQ ID NO: 1021041 - RNA, 21 nt, Human
cuguuucuugugaagugacac

SEQ ID NO: 1021042 - RNA, 22 nt, Human
cucugggcuuguugaccugcac

SEQ ID NO: 1021043 - RNA, 22 nt, Human
uggcuccuaucaaggagugggu

SEQ ID NO: 1021044 - RNA, 22 nt, Human
caggggcaggugugagaucauc

SEQ ID NO: 1021045 - RNA, 22 nt, Human
cccucugcucaggugcauaggc

SEQ ID NO: 1021046 - RNA, 22 nt, Human
aguacauuuauuaaugguaaaa

SEQ ID NO: 1021047 - RNA, 22 nt, Human
acagagccaaaaggacauagua

SEQ ID NO: 1021048 - RNA, 22 nt, Human
aaugcacagcguuccaugcuug

SEQ ID NO: 1021049 - RNA, 22 nt, Human
aagauacauaaagguagagucu

SEQ ID NO: 1021050 - RNA, 22 nt, Human
ugcugccagagagacagggacu

SEQ ID NO: 1021051 - RNA, 22 nt, Human
gucccagggaugcagacaugag

SEQ ID NO: 1021052 - RNA, 22 nt, Human
ugcaguggugguaaagaugcuc

SEQ ID NO: 1021053 - RNA, 22 nt, Human
cucaggacccgguccagguggg

SEQ ID NO: 1021054 - RNA, 22 nt, Human
gcagggacgccagggacagcaa

SEQ ID NO: 1021055 - RNA, 22 nt, Human
gacaguuuuuaauccuuucaug

SEQ ID NO: 1021056 - RNA, 19 nt, Human
ugucacugucauggcccag

SEQ ID NO: 1021057 - RNA, 22 nt, Human
acugggaggcaucuggagcuga

SEQ ID NO: 1021058 - RNA, 22 nt, Human
ugaguacucggagugcuuugga

SEQ ID NO: 1021059 - RNA, 22 nt, Human
cccaggaugaucgagaguggga

SEQ ID NO: 1021060 - RNA, 22 nt, Human
ugucccagguccuagaugacca

SEQ ID NO: 1021061 - RNA, 22 nt, Human
gccaaagcagucuugccucugc

SEQ ID NO: 1021062 - RNA, 22 nt, Human
aaaugcacagaaaggaugugga

SEQ ID NO: 1021063 - RNA, 23 nt, Human
ugggcaucuccucugugccaggc

SEQ ID NO: 1021064 - RNA, 21 nt, Human
ugcauaaagaaauacaaauac

SEQ ID NO: 1021065 - RNA, 22 nt, Human
cagcuauuuucucauuaaggau

SEQ ID NO: 1021066 - RNA, 22 nt, Human
cugcugugcuuguggccacccg

SEQ ID NO: 1021067 - RNA, 22 nt, Human
uagggcucgggcacaggacagg

SEQ ID NO: 1021068 - RNA, 17 nt, Human
aaaauucuguaaagagg

SEQ ID NO: 1021069 - RNA, 22 nt, Human
agucucugcugguugugccuau

SEQ ID NO: 1021070 - RNA, 22 nt, Human
ucugguaaccuuuaucccuccu

SEQ ID NO: 1021071 - RNA, 22 nt, Human
auguccaguuucuacacacaua

SEQ ID NO: 1021072 - RNA, 22 nt, Human
ugaagcugugggcaguggagcc

SEQ ID NO: 1021073 - RNA, 22 nt, Human
ccaaggagcucauauucuuguu

SEQ ID NO: 1021074 - RNA, 22 nt, Human
cacagggcaccaguuggccauc

SEQ ID NO: 1021075 - RNA, 22 nt, Human
agcugguuagcaaucuaaguga

SEQ ID NO: 1021076 - RNA, 22 nt, Human
cagagcagucuggagauccagc

SEQ ID NO: 1021077 - RNA, 22 nt, Human
gacagguggggaaacuaaggua

SEQ ID NO: 1021078 - RNA, 22 nt, Human
cauugcacuuuggguccaggac

SEQ ID NO: 1021079 - RNA, 22 nt, Human
aagcccagcugaaagcauuuuu

SEQ ID NO: 1021080 - RNA, 22 nt, Human
aaauuucaguuggaaugagcuc

SEQ ID NO: 1021081 - RNA, 22 nt, Human
ccaggauggggagcagauagaa

SEQ ID NO: 1021082 - RNA, 22 nt, Human
cagaggcagccgggggagaacg

SEQ ID NO: 1021083 - RNA, 22 nt, Human
aaagccagagcaagcugucaca

SEQ ID NO: 1021084 - RNA, 22 nt, Human
uuauuucauugauuucuaagac

SEQ ID NO: 1021085 - RNA, 22 nt, Human
gcagggcagcuuagucccuguc

SEQ ID NO: 1021086 - RNA, 22 nt, Human
uguaagauauucagcuuauuga

SEQ ID NO: 1021087 - RNA, 22 nt, Human
aggagcugggcugcugcuggga

SEQ ID NO: 1021088 - RNA, 22 nt, Human
gcugccagcuuuccuuggcuga

SEQ ID NO: 1021089 - RNA, 22 nt, Human
gccuucugauugcuggacugac

SEQ ID NO: 1021090 - RNA, 20 nt, Human
gacauucauaguuauuacca

SEQ ID NO: 1021091 - RNA, 19 nt, Human
aguagcagaaagugcagug

SEQ ID NO: 1021092 - RNA, 22 nt, Human
guaacacagaaaugaaauucca

SEQ ID NO: 1021093 - RNA, 22 nt, Human
cacauuugaaggaauuagcauu

SEQ ID NO: 1021094 - RNA, 22 nt, Human
aagcagccucauuugugguaag

SEQ ID NO: 1021095 - RNA, 22 nt, Human
ggggcggggcucugagaagcau

SEQ ID NO: 1021096 - RNA, 22 nt, Human
ucuaaccuuugaaacugcuuuc

SEQ ID NO: 1021097 - RNA, 22 nt, Human
accuggcaugaagcaugccuua

SEQ ID NO: 1021098 - RNA, 22 nt, Human
gaggcccucuugccacaaugaa

SEQ ID NO: 1021099 - RNA, 22 nt, Human
uccuggagcuuccuucauggua

SEQ ID NO: 1021100 - RNA, 19 nt, Human
gagggcucauuugaacaau

SEQ ID NO: 1021101 - RNA, 22 nt, Human
gagaggcugacuggcuguccug

SEQ ID NO: 1021102 - RNA, 22 nt, Human
acagggcagguggcuacugguc

SEQ ID NO: 1021103 - RNA, 22 nt, Human
ucaguuuucucauuuaugagau

SEQ ID NO: 1021104 - RNA, 22 nt, Human
ugcugccaccccucaccagagc

SEQ ID NO: 1021105 - RNA, 22 nt, Human
gaggaguggaguugcuggguug

SEQ ID NO: 1021106 - RNA, 20 nt, Human
uccuugaaagugggguauau

SEQ ID NO: 1021107 - RNA, 22 nt, Human
cucugagcagaggccguggcua

SEQ ID NO: 1021108 - RNA, 22 nt, Human
ucugggaauuuauuggcacuuu

SEQ ID NO: 1021109 - RNA, 22 nt, Human
ggcagaggagcuggaaacaugg

SEQ ID NO: 1021110 - RNA, 22 nt, Human
cuuuuccacugagccucacaaa

SEQ ID NO: 1021111 - RNA, 22 nt, Human
gaaauuuauuaucuacaucauu

SEQ ID NO: 1021112 - RNA, 22 nt, Human
agcagggcaaagucaggcuaac

SEQ ID NO: 1021113 - RNA, 22 nt, Human
gcccaggaggucaaguagcuau

SEQ ID NO: 1021114 - RNA, 22 nt, Human
gccuucugugcuccuggccuuu

SEQ ID NO: 1021115 - RNA, 22 nt, Human
acagugugugcuuucccuuacg

SEQ ID NO: 1021116 - RNA, 22 nt, Human
ggcugaguugagaggauuacuu

SEQ ID NO: 1021117 - RNA, 22 nt, Human
ccucugggugggaggccgggcg

SEQ ID NO: 1021118 - RNA, 21 nt, Human
ucccagagugcuugggacugc

SEQ ID NO: 1021119 - RNA, 22 nt, Human
cuuguggcccauggcuuccugc

SEQ ID NO: 1021120 - RNA, 22 nt, Human
uggagccauaacccuuucguac

SEQ ID NO: 1021121 - RNA, 22 nt, Human
ucgugucagaucagagguuccu

SEQ ID NO: 1021122 - RNA, 22 nt, Human
ucuucaauuagauuuaccaauu

SEQ ID NO: 1021123 - RNA, 22 nt, Human
cugcugugucagaguccagggg

SEQ ID NO: 1021124 - RNA, 22 nt, Human
guguacaugagaaaucaacuuu

SEQ ID NO: 1021125 - RNA, 22 nt, Human
ugauugaacugagcuucaagau

SEQ ID NO: 1021126 - RNA, 22 nt, Human
aaaaacuguaauuacuuuugca

SEQ ID NO: 1021127 - RNA, 22 nt, Human
agcaggaguguccccuggcugu

SEQ ID NO: 1021128 - RNA, 22 nt, Human
gaaaggccauuucugaggguuu

SEQ ID NO: 1021129 - RNA, 21 nt, Human
uccauaagagaccaucuccua

SEQ ID NO: 1021130 - RNA, 22 nt, Human
ugccuggguguaaagggccaac

SEQ ID NO: 1021131 - RNA, 22 nt, Human
ucacgagaggcacagaauagag

SEQ ID NO: 1021132 - RNA, 23 nt, Human
agcagggccagaauacuugcugu

SEQ ID NO: 1021133 - RNA, 22 nt, Human
ugcucuggaguggcuugugcac

SEQ ID NO: 1021134 - RNA, 22 nt, Human
uucauucuuauuugugaucugg

SEQ ID NO: 1021135 - RNA, 22 nt, Human
ucucaggaagugauauugagac

SEQ ID NO: 1021136 - RNA, 22 nt, Human
gcauguguuauuuuauguauga

SEQ ID NO: 1021137 - RNA, 22 nt, Human
cagaccagaaggaagccgacaa

SEQ ID NO: 1021138 - RNA, 22 nt, Human
acauuucacuguucacagcagg

SEQ ID NO: 1021139 - RNA, 22 nt, Human
cagagcagagugauuguucugg

SEQ ID NO: 1021140 - RNA, 22 nt, Human
acagagcuguacuacuuacuga

SEQ ID NO: 1021141 - RNA, 22 nt, Human
uuaaaugaggcugauguagauu

SEQ ID NO: 1021142 - RNA, 20 nt, Human
gggagucuggaugaaagaug

SEQ ID NO: 1021143 - RNA, 22 nt, Human
aacagaaaucauuuagggcucu

SEQ ID NO: 1021144 - RNA, 22 nt, Human
aauguuguuuuucugcaugucu

SEQ ID NO: 1021145 - RNA, 22 nt, Human
ucuuccaagguugcacacuauc

SEQ ID NO: 1021146 - RNA, 20 nt, Human
gcugccuguuucuguaagua

SEQ ID NO: 1021147 - RNA, 22 nt, Human
cccaggaggcagagcuugcagu

SEQ ID NO: 1021148 - RNA, 17 nt, Human
uccuucagggccucaca

SEQ ID NO: 1021149 - RNA, 22 nt, Human
ccagugcacagccaggcaggug

SEQ ID NO: 1021150 - RNA, 22 nt, Human
uugacaagaaucguugccuugg

SEQ ID NO: 1021151 - RNA, 22 nt, Human
gccucuggucccucaugcugug

SEQ ID NO: 1021152 - RNA, 22 nt, Human
ugaccugcagucaagaggggaa

SEQ ID NO: 1021153 - RNA, 17 nt, Human
uccaggcauaucuccua

SEQ ID NO: 1021154 - RNA, 22 nt, Human
aagaagagaaaugugcugcugg

SEQ ID NO: 1021155 - RNA, 22 nt, Human
uucaugaaacuuaacuguuggg

SEQ ID NO: 1021156 - RNA, 15 nt, Human
uucaggauaugacuc

SEQ ID NO: 1021157 - RNA, 22 nt, Human
ucucacugggucacagcagagg

SEQ ID NO: 1021158 - RNA, 22 nt, Human
ugcucugguccucccucggcgc

SEQ ID NO: 1021159 - RNA, 22 nt, Human
guuuucaauuauaagauggcuu

SEQ ID NO: 1021160 - RNA, 22 nt, Human
aggcucugugacaaucaagcug

SEQ ID NO: 1021161 - RNA, 22 nt, Human
acagaguagcucaagaagauug

SEQ ID NO: 1021162 - RNA, 22 nt, Human
acuuuggaucugauguaaucag

SEQ ID NO: 1021163 - RNA, 22 nt, Human
gagucacaaagccuuucuuauu

SEQ ID NO: 1021164 - RNA, 21 nt, Human
gagccuucccucugcccuuuc

SEQ ID NO: 1021165 - RNA, 20 nt, Human
uccugagauuuaagggguuc

SEQ ID NO: 1021166 - RNA, 22 nt, Human
uucugucagaagcuagcuccug

SEQ ID NO: 1021167 - RNA, 19 nt, Human
ucccuggcgccucucgggc

SEQ ID NO: 1021168 - RNA, 22 nt, Human
acuugaauuauauuucuagaga

SEQ ID NO: 1021169 - RNA, 22 nt, Human
uuauuuaauuuucucacucaga

SEQ ID NO: 1021170 - RNA, 22 nt, Human
gcucaggaucccaggggugugc

SEQ ID NO: 1021171 - RNA, 22 nt, Human
uagcagggguagauagagugug

SEQ ID NO: 1021172 - RNA, 22 nt, Human
gauuucaaggaguuuucacagu

SEQ ID NO: 1021173 - RNA, 22 nt, Human
uguaggacauguacuuguaaca

SEQ ID NO: 1021174 - RNA, 22 nt, Human
aaccaggacaauuuugaaagua

SEQ ID NO: 1021175 - RNA, 18 nt, Human
ccagaggcccgggcaggc

SEQ ID NO: 1021176 - RNA, 22 nt, Human
ugucuagggagcugcucaggcu

SEQ ID NO: 1021177 - RNA, 22 nt, Human
gcugggcaccggagagacccca

SEQ ID NO: 1021178 - RNA, 22 nt, Human
ggggagugacgcagggccauag

SEQ ID NO: 1021179 - RNA, 22 nt, Human
gcaguggggaaugcuggggaga

SEQ ID NO: 1021180 - RNA, 21 nt, Human
uggccaaaaccauauuauuaa

SEQ ID NO: 1021181 - RNA, 22 nt, Human
ggccugugagcccuugcaugua

SEQ ID NO: 1021182 - RNA, 22 nt, Human
cauuuguaguuaaaaaugucuc

SEQ ID NO: 1021183 - RNA, 22 nt, Human
uuuuauuaucuuugaaugggac

SEQ ID NO: 1021184 - RNA, 22 nt, Human
auucugucuuuuuauacaucua

SEQ ID NO: 1021185 - RNA, 22 nt, Human
guggcucuaggugagcauggag

SEQ ID NO: 1021186 - RNA, 22 nt, Human
cuggugccauucuguggccuag

SEQ ID NO: 1021187 - RNA, 22 nt, Human
caucacuguccaaaguucaguu

SEQ ID NO: 1021188 - RNA, 18 nt, Human
agcagcugugccacacug

SEQ ID NO: 1021189 - RNA, 22 nt, Human
uuugacaucuaagaauucuuac

SEQ ID NO: 1021190 - RNA, 22 nt, Human
uccagccaccaccuugauugcc

SEQ ID NO: 1021191 - RNA, 22 nt, Human
accugcaggggugcucucuggg

SEQ ID NO: 1021192 - RNA, 22 nt, Human
ucuucauuuuacaggcagaccu

SEQ ID NO: 1021193 - RNA, 22 nt, Human
uggaaagaugaagauguuuaag

SEQ ID NO: 1021194 - RNA, 22 nt, Human
uugcuauuuugagagucauagu

SEQ ID NO: 1021195 - RNA, 18 nt, Human
gggaagaggaucuggccc

SEQ ID NO: 1021196 - RNA, 22 nt, Human
gccuggagugcaguggcgugau

SEQ ID NO: 1021197 - RNA, 22 nt, Human
augcacagcagugaguucagug

SEQ ID NO: 1021198 - RNA, 22 nt, Human
guagcccaccuggggagggcga

SEQ ID NO: 1021199 - RNA, 22 nt, Human
gcaggggcuaaggacacagaga

SEQ ID NO: 1021200 - RNA, 20 nt, Human
auccaugagagucuggauuc

SEQ ID NO: 1021201 - RNA, 22 nt, Human
uccagugguaguaaagaggucu

SEQ ID NO: 1021202 - RNA, 22 nt, Human
aaggcaguuugggccaccaucu

SEQ ID NO: 1021203 - RNA, 22 nt, Human
gaaggccauugcguccugggau

SEQ ID NO: 1021204 - RNA, 22 nt, Human
uugagaagaggcuuuguaggaa

SEQ ID NO: 1021205 - RNA, 22 nt, Human
uuuugcuuuuguaacacagugu

SEQ ID NO: 1021206 - RNA, 20 nt, Human
agcuucuucugucuaauuuu

SEQ ID NO: 1021207 - RNA, 22 nt, Human
uggcucagcaagacauugaccu

SEQ ID NO: 1021208 - RNA, 22 nt, Human
uuucauugcagagucugugugc

SEQ ID NO: 1021209 - RNA, 22 nt, Human
agcuguguggugucugacagcu

SEQ ID NO: 1021210 - RNA, 22 nt, Human
cugaggucaauuaaucaacaac

SEQ ID NO: 1021211 - RNA, 22 nt, Human
gcagagccccucaagccagccu

SEQ ID NO: 1021212 - RNA, 22 nt, Human
auggacagugugaagcagauag

SEQ ID NO: 1021213 - RNA, 22 nt, Human
uuaagacaguguauuuguuuuc

SEQ ID NO: 1021214 - RNA, 22 nt, Human
cugugcuuccaggauggcagcu

SEQ ID NO: 1021215 - RNA, 22 nt, Human
acacaggagauauguaauggcu

SEQ ID NO: 1021216 - RNA, 22 nt, Human
ugccaggcgugguggugcgcac

SEQ ID NO: 1021217 - RNA, 19 nt, Human
acuuugcaugugugucuaa

SEQ ID NO: 1021218 - RNA, 22 nt, Human
aaaaguuaccucuguaauauaa

SEQ ID NO: 1021219 - RNA, 22 nt, Human
caaaugcaugagaaauaagagg

SEQ ID NO: 1021220 - RNA, 23 nt, Human
cuggccuccgacacuggccaaga

SEQ ID NO: 1021221 - RNA, 20 nt, Human
ccugaggguuuguguucuuu

SEQ ID NO: 1021222 - RNA, 22 nt, Human
uauuaguagcuugaaauuggug

SEQ ID NO: 1021223 - RNA, 22 nt, Human
agcugccugcuuaugagcucca

SEQ ID NO: 1021224 - RNA, 22 nt, Human
uucacauuauaaucaguucugc

SEQ ID NO: 1021225 - RNA, 22 nt, Human
cucugauuuccuuauucuguca

SEQ ID NO: 1021226 - RNA, 22 nt, Human
gagcugucuggggacucugggu

SEQ ID NO: 1021227 - RNA, 22 nt, Human
aggcugaggcagguggaucauu

SEQ ID NO: 1021228 - RNA, 22 nt, Human
uaggcacuagacaugguuacca

SEQ ID NO: 1021229 - RNA, 22 nt, Human
gccagcugaagcccugguggaa

SEQ ID NO: 1021230 - RNA, 22 nt, Human
uggccuggaaaaaugcagaugg

SEQ ID NO: 1021231 - RNA, 22 nt, Human
caaagugcugagauuacaggua

SEQ ID NO: 1021232 - RNA, 22 nt, Human
auaugcauguacgugugcacaa

SEQ ID NO: 1021233 - RNA, 22 nt, Human
cuuugaaaggaagccacacagc

SEQ ID NO: 1021234 - RNA, 22 nt, Human
cauuuguuaauuacuauuaucu

SEQ ID NO: 1021235 - RNA, 22 nt, Human
cagcugccugcaacacaagcuu

SEQ ID NO: 1021236 - RNA, 22 nt, Human
ucugaaagaagggcagucuuuu

SEQ ID NO: 1021237 - RNA, 22 nt, Human
ggagccugcgggagcucccauu

SEQ ID NO: 1021238 - RNA, 22 nt, Human
aguggugcugcgcgcggagcuc

SEQ ID NO: 1021239 - RNA, 20 nt, Human
gcauccagacacccagcugc

SEQ ID NO: 1021240 - RNA, 22 nt, Human
acagagcucccagccaucuccu

SEQ ID NO: 1021241 - RNA, 22 nt, Human
gcugcucugaaaaugacuguug

SEQ ID NO: 1021242 - RNA, 22 nt, Human
uauuccaguccuauccucuuuu

SEQ ID NO: 1021243 - RNA, 22 nt, Human
ugucaugcccaggagcaaggua

SEQ ID NO: 1021244 - RNA, 22 nt, Human
cagccagcugaauguaccauga

SEQ ID NO: 1021245 - RNA, 22 nt, Human
uugcauuugaucuuggguucuc

SEQ ID NO: 1021246 - RNA, 22 nt, Human
cuguggaaaauuuguauguaau

SEQ ID NO: 1021247 - RNA, 22 nt, Human
caggcacugugccucgcucccu

SEQ ID NO: 1021248 - RNA, 21 nt, Human
agcagccauuucacagagacu

SEQ ID NO: 1021249 - RNA, 22 nt, Human
uucaaugaggauagaacuggau

SEQ ID NO: 1021250 - RNA, 22 nt, Human
auguaugauauuuccaguauca

SEQ ID NO: 1021251 - RNA, 22 nt, Human
uuugaaaggagcuuuauccaga

SEQ ID NO: 1021252 - RNA, 22 nt, Human
gccuggagaagauggaacuagc

SEQ ID NO: 1021253 - RNA, 22 nt, Human
ugcacuggggucccagcgcacg

SEQ ID NO: 1021254 - RNA, 22 nt, Human
gcuguggucugugagcuccaaa

SEQ ID NO: 1021255 - RNA, 22 nt, Human
ggcaggagcucuccaguuugcc

SEQ ID NO: 1021256 - RNA, 22 nt, Human
gagaaccucuccacaagucugg

SEQ ID NO: 1021257 - RNA, 22 nt, Human
uugaaagucacaauggcauuaa

SEQ ID NO: 1021258 - RNA, 22 nt, Human
ggggcagagagaaggaagcuug

SEQ ID NO: 1021259 - RNA, 22 nt, Human
uugucugaaagaucauuacauu

SEQ ID NO: 1021260 - RNA, 22 nt, Human
gucccuaguggaaagacaugau

SEQ ID NO: 1021261 - RNA, 22 nt, Human
cccaggcaguagaaagaagagg

SEQ ID NO: 1021262 - RNA, 22 nt, Human
ucccagccuuccagucugguuu

SEQ ID NO: 1021263 - RNA, 22 nt, Human
uagaaaucuacuuagacuuucu

SEQ ID NO: 1021264 - RNA, 22 nt, Human
cagaaggcuuuguggaguagac

SEQ ID NO: 1021265 - RNA, 22 nt, Human
ccauuugucaccucugcacucc

SEQ ID NO: 1021266 - RNA, 22 nt, Human
caacagaaggaagcagggucag

SEQ ID NO: 1021267 - RNA, 22 nt, Human
aaaguguugggauuacaggugu

SEQ ID NO: 1021268 - RNA, 22 nt, Human
uuagaaauacaagugagguuga

SEQ ID NO: 1021269 - RNA, 22 nt, Human
uucauagugauuguucagauag

SEQ ID NO: 1021270 - RNA, 22 nt, Human
cugaggcuuggaggggucuggu

SEQ ID NO: 1021271 - RNA, 22 nt, Human
auccuugaaugacucugcccuc

SEQ ID NO: 1021272 - RNA, 22 nt, Human
cugccugcugccuguggagggu

SEQ ID NO: 1021273 - RNA, 22 nt, Human
cacaagacuuauuuguguagaa

SEQ ID NO: 1021274 - RNA, 22 nt, Human
augcuacauuuugguuuauaaa

SEQ ID NO: 1021275 - RNA, 22 nt, Human
uuuauuuggcauccagggagaa

SEQ ID NO: 1021276 - RNA, 22 nt, Human
gcccgcagagaucuuuaacaaa

SEQ ID NO: 1021277 - RNA, 22 nt, Human
acacugaagagcacuuucaaag

SEQ ID NO: 1021278 - RNA, 23 nt, Human
uauuagggccaggacuggcaaau

SEQ ID NO: 1021279 - RNA, 20 nt, Human
uggagccaaggugugucugg

SEQ ID NO: 1021280 - RNA, 22 nt, Human
cagccacguagcccuuggccgu

SEQ ID NO: 1021281 - RNA, 22 nt, Human
uuccagcaggcagacaggagau

SEQ ID NO: 1021282 - RNA, 22 nt, Human
caguguuuaaucauugugaauu

SEQ ID NO: 1021283 - RNA, 22 nt, Human
gagcuuuacuucugacuggugc

SEQ ID NO: 1021284 - RNA, 22 nt, Human
uuccuuccgggcaccaggcacu

SEQ ID NO: 1021285 - RNA, 22 nt, Human
uggcucuggugcgggcuccugc

SEQ ID NO: 1021286 - RNA, 20 nt, Human
acagccagaggaggcagaca

SEQ ID NO: 1021287 - RNA, 22 nt, Human
caggggccggcuguccgugccc

SEQ ID NO: 1021288 - RNA, 22 nt, Human
cuccaggccauggcugcggagg

SEQ ID NO: 1021289 - RNA, 22 nt, Human
cuuucacauaauugaccuugaa

SEQ ID NO: 1021290 - RNA, 22 nt, Human
uauuuccauguuagaacuaagu

SEQ ID NO: 1021291 - RNA, 22 nt, Human
ggccauggugguuugagcaccu

SEQ ID NO: 1021292 - RNA, 23 nt, Human
auggaagucacuguuuucuuguc

SEQ ID NO: 1021293 - RNA, 20 nt, Human
uguugauuggugucaucuca

SEQ ID NO: 1021294 - RNA, 22 nt, Human
accucaggauguggacacagaa

SEQ ID NO: 1021295 - RNA, 22 nt, Human
agaauccucuucaguaaauucu

SEQ ID NO: 1021296 - RNA, 22 nt, Human
cucaucugauaaaucacucuua

SEQ ID NO: 1021297 - RNA, 22 nt, Human
uuuucacacaaggugauaaguu

SEQ ID NO: 1021298 - RNA, 22 nt, Human
agaaucucuacucaaguacuug

SEQ ID NO: 1021299 - RNA, 17 nt, Human
aucuggcugcuucuaga

SEQ ID NO: 1021300 - RNA, 22 nt, Human
cagcuugggaguuugguuuuau

SEQ ID NO: 1021301 - RNA, 22 nt, Human
gcugucagugaggugagacaug

SEQ ID NO: 1021302 - RNA, 22 nt, Human
ccagccaggcauugcaaacuga

SEQ ID NO: 1021303 - RNA, 22 nt, Human
gagcaggccagcaauggaaggg

SEQ ID NO: 1021304 - RNA, 18 nt, Human
gcugccugcauuccucac

SEQ ID NO: 1021305 - RNA, 22 nt, Human
cauguacaaaaggcaaaugccu

SEQ ID NO: 1021306 - RNA, 22 nt, Human
uuucacaaguuucaggauucug

SEQ ID NO: 1021307 - RNA, 22 nt, Human
gccuggagggcucuagagaggc

SEQ ID NO: 1021308 - RNA, 22 nt, Human
cugggagaucuccugagggcag

SEQ ID NO: 1021309 - RNA, 22 nt, Human
ugcagccauuuucugccaaugc

SEQ ID NO: 1021310 - RNA, 22 nt, Human
ucaaauaccagcuuuuccagaa

SEQ ID NO: 1021311 - RNA, 21 nt, Human
gcacagcaugaguguuggcau

SEQ ID NO: 1021312 - RNA, 22 nt, Human
gccuuccugcagcucugagcgu

SEQ ID NO: 1021313 - RNA, 22 nt, Human
aggucauuuccuuagaggcaga

SEQ ID NO: 1021314 - RNA, 22 nt, Human
cuggcagguuuggugucuggug

SEQ ID NO: 1021315 - RNA, 22 nt, Human
uccugggcuguggccccgggca

SEQ ID NO: 1021316 - RNA, 22 nt, Human
ggucacaggggagaagagugau

SEQ ID NO: 1021317 - RNA, 22 nt, Human
gggccaugagagguucaucaac

SEQ ID NO: 1021318 - RNA, 22 nt, Human
ccaggcugcagucaaggggcau

SEQ ID NO: 1021319 - RNA, 22 nt, Human
gaaguucaggugggaauugagc

SEQ ID NO: 1021320 - RNA, 22 nt, Human
aacuuucagaauccuaugcauu

SEQ ID NO: 1021321 - RNA, 22 nt, Human
ugaaaugaucaguuugguuacu

SEQ ID NO: 1021322 - RNA, 22 nt, Human
accagagcuggcagaguaucaa

SEQ ID NO: 1021323 - RNA, 22 nt, Human
uguucuuucaguuagacacagu

SEQ ID NO: 1021324 - RNA, 22 nt, Human
uagaauucaagauucaacaggc

SEQ ID NO: 1021325 - RNA, 22 nt, Human
gugcugugcgcuuuuucuguau

SEQ ID NO: 1021326 - RNA, 22 nt, Human
uuacauaacgguaugaaaaaug

SEQ ID NO: 1021327 - RNA, 22 nt, Human
accuuuuuucagaacucuaaag

SEQ ID NO: 1021328 - RNA, 22 nt, Human
caggauggugugagugugagga

SEQ ID NO: 1021329 - RNA, 22 nt, Human
uaaugcaguacugauauaaaca

SEQ ID NO: 1021330 - RNA, 22 nt, Human
ccaaaguccacaguuuacauua

SEQ ID NO: 1021331 - RNA, 19 nt, Human
ccuuugaaucaggacacuu

SEQ ID NO: 1021332 - RNA, 22 nt, Human
ugcuagaagauagcuagaagau

SEQ ID NO: 1021333 - RNA, 22 nt, Human
auccuugacacacuccaguacu

SEQ ID NO: 1021334 - RNA, 21 nt, Human
ucagaacaauuccaugccucc

SEQ ID NO: 1021335 - RNA, 22 nt, Human
gggcucucaugaguguguggua

SEQ ID NO: 1021336 - RNA, 22 nt, Human
gcugccugaucauacaccaggg

SEQ ID NO: 1021337 - RNA, 22 nt, Human
agugccaggagcaaggagcucc

SEQ ID NO: 1021338 - RNA, 17 nt, Human
uguagcuucuccuucuc

SEQ ID NO: 1021339 - RNA, 22 nt, Human
ggcugccugggagcccuccucu

SEQ ID NO: 1021340 - RNA, 22 nt, Human
auacauguucguguacauguuc

SEQ ID NO: 1021341 - RNA, 22 nt, Human
cggcagcuccgcgccguaggac

SEQ ID NO: 1021342 - RNA, 23 nt, Human
ccuucagaagaaguaacaggggc

SEQ ID NO: 1021343 - RNA, 22 nt, Human
cuaguccacuguccugccucca

SEQ ID NO: 1021344 - RNA, 22 nt, Human
cuaugaaaggauuuggaguugu

SEQ ID NO: 1021345 - RNA, 22 nt, Human
uugcaaaggggaauaaagcaau

SEQ ID NO: 1021346 - RNA, 22 nt, Human
ccugcagcuguaggagaaggcg

SEQ ID NO: 1021347 - RNA, 22 nt, Human
agaaaguucacugguauauuuu

SEQ ID NO: 1021348 - RNA, 20 nt, Human
ucacaucuggcagcugauga

SEQ ID NO: 1021349 - RNA, 22 nt, Human
ggugggugagcccugggagcug

SEQ ID NO: 1021350 - RNA, 22 nt, Human
cuggcucaugugaugagggcaa

SEQ ID NO: 1021351 - RNA, 22 nt, Human
uuugcauuacuugacuuuaguu

SEQ ID NO: 1021352 - RNA, 22 nt, Human
agguaacacuacuuaguauacu

SEQ ID NO: 1021353 - RNA, 22 nt, Human
cacaucagguagaccuacagag

SEQ ID NO: 1021354 - RNA, 22 nt, Human
agcagagccagaauuggaccag

SEQ ID NO: 1021355 - RNA, 22 nt, Human
gcaggagccacuucagggaugc

SEQ ID NO: 1021356 - RNA, 22 nt, Human
aaauguguuucuuugugaaugg

SEQ ID NO: 1021357 - RNA, 22 nt, Human
gagcuguccgccccugggccga

SEQ ID NO: 1021358 - RNA, 22 nt, Human
cccagagcugagucugauauau

SEQ ID NO: 1021359 - RNA, 22 nt, Human
aauguugagcuugaaaguaggu

SEQ ID NO: 1021360 - RNA, 22 nt, Human
gaggcugcuuugaugacaggag

SEQ ID NO: 1021361 - RNA, 22 nt, Human
caagauaagaucauuuacacua

SEQ ID NO: 1021362 - RNA, 22 nt, Human
uugauguacagaauuguucaca

SEQ ID NO: 1021363 - RNA, 22 nt, Human
caaggccaagguuuugugaacu

SEQ ID NO: 1021364 - RNA, 22 nt, Human
cucagaguccccacaucugggu

SEQ ID NO: 1021365 - RNA, 22 nt, Human
uccuggagagugggcgagcaca

SEQ ID NO: 1021366 - RNA, 22 nt, Human
uauaaaguuucgaaagauguau

SEQ ID NO: 1021367 - RNA, 22 nt, Human
augauguuaccaguacuuagag

SEQ ID NO: 1021368 - RNA, 22 nt, Human
cacugcuuucacaguuuguucc

SEQ ID NO: 1021369 - RNA, 22 nt, Human
cuucuugcugggggccucagug

SEQ ID NO: 1021370 - RNA, 23 nt, Human
ucuccuccuagauacagucaugg

SEQ ID NO: 1021371 - RNA, 22 nt, Human
caggggcucccugggugccagu

SEQ ID NO: 1021372 - RNA, 22 nt, Human
uguaggauuuucaccagaccuu

SEQ ID NO: 1021373 - RNA, 22 nt, Human
acugaguguaggacuuugaguu

SEQ ID NO: 1021374 - RNA, 22 nt, Human
ugcagggaaagggcacugggcu

SEQ ID NO: 1021375 - RNA, 22 nt, Human
aggcagagcuggguuuugaaau

SEQ ID NO: 1021376 - RNA, 22 nt, Human
uagggcuauaagagaauaagac

SEQ ID NO: 1021377 - RNA, 22 nt, Human
aucuuucuauuucuaaaaacua

SEQ ID NO: 1021378 - RNA, 19 nt, Human
caguggagauuggaggagg

SEQ ID NO: 1021379 - RNA, 21 nt, Human
auggagccuaagaguggaggu

SEQ ID NO: 1021380 - RNA, 22 nt, Human
gggcugcugcccaggaggcacc

SEQ ID NO: 1021381 - RNA, 22 nt, Human
aggggcuggaguucgagguuac

SEQ ID NO: 1021382 - RNA, 23 nt, Human
uagaaugucauucaaugauaugg

SEQ ID NO: 1021383 - RNA, 22 nt, Human
cuuaagauuugagauaccuaau

SEQ ID NO: 1021384 - RNA, 19 nt, Human
agucucaguguacagaggc

SEQ ID NO: 1021385 - RNA, 22 nt, Human
gcucaggaaggcucaaccagga

SEQ ID NO: 1021386 - RNA, 19 nt, Human
guuuuucccagacgaggca

SEQ ID NO: 1021387 - RNA, 22 nt, Human
acagggccagccugggaccugg

SEQ ID NO: 1021388 - RNA, 22 nt, Human
uuuucaguuccaucucugcucu

SEQ ID NO: 1021389 - RNA, 22 nt, Human
agggcucugagcuggaccaccu

SEQ ID NO: 1021390 - RNA, 22 nt, Human
aagaauguggguggauaugaug

SEQ ID NO: 1021391 - RNA, 23 nt, Human
caggcaggaugaggacuacacuc

SEQ ID NO: 1021392 - RNA, 22 nt, Human
uugggguguuggauggagcaag

SEQ ID NO: 1021393 - RNA, 22 nt, Human
agaaaucucaguaucucaggga

SEQ ID NO: 1021394 - RNA, 22 nt, Human
gcaggccagcugugcagauggg

SEQ ID NO: 1021395 - RNA, 22 nt, Human
uacacuuuuuacuacagauucu

SEQ ID NO: 1021396 - RNA, 18 nt, Human
cagcagagacauucaaaa

SEQ ID NO: 1021397 - RNA, 22 nt, Human
accaggcagcaccaaagccggu

SEQ ID NO: 1021398 - RNA, 22 nt, Human
uagggaggcuacuucuuguagg

SEQ ID NO: 1021399 - RNA, 21 nt, Human
gccugccugcgugacccucuu

SEQ ID NO: 1021400 - RNA, 22 nt, Human
agagaggcugggcguagggcuu

SEQ ID NO: 1021401 - RNA, 22 nt, Human
ccugccuggcugucagcagagc

SEQ ID NO: 1021402 - RNA, 22 nt, Human
gaaaagagaacaucugaggauc

SEQ ID NO: 1021403 - RNA, 22 nt, Human
ggccuagggaguggccaugccu

SEQ ID NO: 1021404 - RNA, 22 nt, Human
agggcugcuauguugauucaga

SEQ ID NO: 1021405 - RNA, 22 nt, Human
cgcugccaggucaccaggggua

SEQ ID NO: 1021406 - RNA, 22 nt, Human
gagggggcgugcaaggcuccgc

SEQ ID NO: 1021407 - RNA, 22 nt, Human
ugcagagggacagccacagcuc

SEQ ID NO: 1021408 - RNA, 17 nt, Human
agcagcuggguugaucu

SEQ ID NO: 1021409 - RNA, 20 nt, Human
ucccaggcuccacccuagac

SEQ ID NO: 1021410 - RNA, 22 nt, Human
cccugcagagaccacugaccuu

SEQ ID NO: 1021411 - RNA, 22 nt, Human
auaaaugauucagcaggaaaua

SEQ ID NO: 1021412 - RNA, 22 nt, Human
cagcccagcagggucuggcccu

SEQ ID NO: 1021413 - RNA, 22 nt, Human
ugggauggcauccugggccuug

SEQ ID NO: 1021414 - RNA, 22 nt, Human
agggaagagcuugcaagaaacc

SEQ ID NO: 1021415 - RNA, 22 nt, Human
ucagguguuagaagaaauuuca

SEQ ID NO: 1021416 - RNA, 22 nt, Human
cucuucaauagauuguugaggg

SEQ ID NO: 1021417 - RNA, 22 nt, Human
uuccaggagacuuccagaaaua

SEQ ID NO: 1021418 - RNA, 22 nt, Human
cacagggcagugauuguccaca

SEQ ID NO: 1021419 - RNA, 22 nt, Human
aaaaugaggucaauauccuuuu

SEQ ID NO: 1021420 - RNA, 22 nt, Human
cuguggcuaugguguacauacu

SEQ ID NO: 1021421 - RNA, 22 nt, Human
uggaagggagugacagucagag

SEQ ID NO: 1021422 - RNA, 22 nt, Human
auuaaaagcuucccaagaguua

SEQ ID NO: 1021423 - RNA, 22 nt, Human
agcaggugacccaagcaggcug

SEQ ID NO: 1021424 - RNA, 22 nt, Human
auuuuccucaagccucuggaag

SEQ ID NO: 1021425 - RNA, 22 nt, Human
guggcugguuuccugcaugcaa

SEQ ID NO: 1021426 - RNA, 22 nt, Human
auaagaaacauuauucuuucca

SEQ ID NO: 1021427 - RNA, 22 nt, Human
cagcagaggaaagcaaaucuaa

SEQ ID NO: 1021428 - RNA, 22 nt, Human
caggugggcuugggagaacacu

SEQ ID NO: 1021429 - RNA, 22 nt, Human
ggcugccugcuccuccugcacg

SEQ ID NO: 1021430 - RNA, 22 nt, Human
aauacugucuuucacagauauu

SEQ ID NO: 1021431 - RNA, 22 nt, Human
cagaguccuggacacagagaca

SEQ ID NO: 1021432 - RNA, 22 nt, Human
gcucaggacuggaggagcgggg

SEQ ID NO: 1021433 - RNA, 21 nt, Human
gagacagacuuucguccccug

SEQ ID NO: 1021434 - RNA, 22 nt, Human
acaaacuaccuacagauguuca

SEQ ID NO: 1021435 - RNA, 22 nt, Human
uauguacagggauagaacuuga

SEQ ID NO: 1021436 - RNA, 22 nt, Human
agggcccuaaggaaggcacaca

SEQ ID NO: 1021437 - RNA, 21 nt, Human
agccuguugguuuacugcuca

SEQ ID NO: 1021438 - RNA, 22 nt, Human
agccagcugccuuucacaucug

SEQ ID NO: 1021439 - RNA, 22 nt, Human
cucaugucuucacccauucuaa

SEQ ID NO: 1021440 - RNA, 23 nt, Human
gguggcaggaguggaugcugagc

SEQ ID NO: 1021441 - RNA, 21 nt, Human
cucaggcauuugaggagaguc

SEQ ID NO: 1021442 - RNA, 22 nt, Human
uuuuccuucugauacuccauuu

SEQ ID NO: 1021443 - RNA, 22 nt, Human
uagggcuauucugaguaauaau

SEQ ID NO: 1021444 - RNA, 22 nt, Human
aguguggcugcguagggcucuc

SEQ ID NO: 1021445 - RNA, 22 nt, Human
auccaggguguggagagagcuc

SEQ ID NO: 1021446 - RNA, 21 nt, Human
uuacuuuugcagcaaccuaau

SEQ ID NO: 1021447 - RNA, 22 nt, Human
uccuggaggcaaaugagcacau

SEQ ID NO: 1021448 - RNA, 22 nt, Human
cucagcagugacaagagaguau

SEQ ID NO: 1021449 - RNA, 22 nt, Human
uucuaccuacccucugcauaca

SEQ ID NO: 1021450 - RNA, 23 nt, Human
ucugggcaccuuguugacaugau

SEQ ID NO: 1021451 - RNA, 22 nt, Human
gcugggagcaaguacucaucuu

SEQ ID NO: 1021452 - RNA, 22 nt, Human
agagccuggacuuuucugagcc

SEQ ID NO: 1021453 - RNA, 22 nt, Human
cugaagcaaaggaucgagcuaa

SEQ ID NO: 1021454 - RNA, 22 nt, Human
uuugcauuuguucaaguauuga

SEQ ID NO: 1021455 - RNA, 22 nt, Human
cugacucagcagcugaugaucc

SEQ ID NO: 1021456 - RNA, 22 nt, Human
ugggugggagcgcccugucugg

SEQ ID NO: 1021457 - RNA, 23 nt, Human
uggcagcuguguaagagaaagca

SEQ ID NO: 1021458 - RNA, 22 nt, Human
gcaggagucacugacuuggucc

SEQ ID NO: 1021459 - RNA, 22 nt, Human
gcuggcagggugguugagagag

SEQ ID NO: 1021460 - RNA, 22 nt, Human
uggcccugcugggucagagcug

SEQ ID NO: 1021461 - RNA, 22 nt, Human
gcugggaguuacugucuccuuu

SEQ ID NO: 1021462 - RNA, 22 nt, Human
aaguuugagagccuuuaguaua

SEQ ID NO: 1021463 - RNA, 22 nt, Human
gagugagggcagcaggggcugc

SEQ ID NO: 1021464 - RNA, 21 nt, Human
gagugcagcaagguagagucu

SEQ ID NO: 1021465 - RNA, 22 nt, Human
guugaaugaaucauucuaugua

SEQ ID NO: 1021466 - RNA, 22 nt, Human
cccagaggugcuucagaggugc

SEQ ID NO: 1021467 - RNA, 22 nt, Human
cacugcaguuccccagugcgca

SEQ ID NO: 1021468 - RNA, 19 nt, Human
ggcugucucggcccagcca

SEQ ID NO: 1021469 - RNA, 22 nt, Human
caguugcuggaugugcagcucu

SEQ ID NO: 1021470 - RNA, 22 nt, Human
uuuccuaggagauugaucacau

SEQ ID NO: 1021471 - RNA, 22 nt, Human
aaggccagccugagagcuaaca

SEQ ID NO: 1021472 - RNA, 22 nt, Human
ggugccaggcuguagucagggu

SEQ ID NO: 1021473 - RNA, 22 nt, Human
ugggcugcugagaaugagagag

SEQ ID NO: 1021474 - RNA, 17 nt, Human
ggccuugggcugcucuu

SEQ ID NO: 1021475 - RNA, 21 nt, Human
ccuucucuugcuucagcuuca

SEQ ID NO: 1021476 - RNA, 22 nt, Human
auuuauuaugggauuuggcaca

SEQ ID NO: 1021477 - RNA, 22 nt, Human
ugcucucucaggccuggcccac

SEQ ID NO: 1021478 - RNA, 22 nt, Human
uuacaaagaguguucuuuucca

SEQ ID NO: 1021479 - RNA, 22 nt, Human
uggccuggaagagaggucgagg

SEQ ID NO: 1021480 - RNA, 22 nt, Human
agccccuuccaguucucagauc

SEQ ID NO: 1021481 - RNA, 22 nt, Human
aaacagcuaauggccaggaaua

SEQ ID NO: 1021482 - RNA, 19 nt, Human
acagaaauuaguuauuuuc

SEQ ID NO: 1021483 - RNA, 22 nt, Human
caaauaguaugagcaaugauuc

SEQ ID NO: 1021484 - RNA, 22 nt, Human
uguguacacaaugauugcagag

SEQ ID NO: 1021485 - RNA, 22 nt, Human
gacauucacaguuuccgauggu

SEQ ID NO: 1021486 - RNA, 22 nt, Human
uggcugaaucugcagcaggaag

SEQ ID NO: 1021487 - RNA, 23 nt, Human
aggagccaggaaccagcuucccc

SEQ ID NO: 1021488 - RNA, 20 nt, Human
ugugaaagcaguagaaugac

SEQ ID NO: 1021489 - RNA, 22 nt, Human
ucagggcucaccagccucugcc

SEQ ID NO: 1021490 - RNA, 23 nt, Human
gccuggccaccccagggcugcuu

SEQ ID NO: 1021491 - RNA, 22 nt, Human
ccugggagugucagacuugcuu

SEQ ID NO: 1021492 - RNA, 22 nt, Human
aagacaauuugauacuaguugc

SEQ ID NO: 1021493 - RNA, 22 nt, Human
cugugaggcccugggugcugga

SEQ ID NO: 1021494 - RNA, 22 nt, Human
uagagcuggaaaacugcaggua

SEQ ID NO: 1021495 - RNA, 22 nt, Human
aagacauuacuggaaucugacu

SEQ ID NO: 1021496 - RNA, 22 nt, Human
ucagauggguuuugaaggaugu

SEQ ID NO: 1021497 - RNA, 21 nt, Human
uggccucccacacuuccaugg

SEQ ID NO: 1021498 - RNA, 22 nt, Human
ugguggcuguugcagaacugag

SEQ ID NO: 1021499 - RNA, 20 nt, Human
guggccuguccuguuguggg

SEQ ID NO: 1021500 - RNA, 22 nt, Human
gccccagguugccugucccagg

SEQ ID NO: 1021501 - RNA, 22 nt, Human
uuauuagcugggcuucagggug

SEQ ID NO: 1021502 - RNA, 22 nt, Human
ggcagcuccaaaaggaaacacu

SEQ ID NO: 1021503 - RNA, 22 nt, Human
uaaugucagcauaguuuauuuu

SEQ ID NO: 1021504 - RNA, 22 nt, Human
ucagggcacaggccuguggguu

SEQ ID NO: 1021505 - RNA, 22 nt, Human
aaucuucacagaaaaaugucug

SEQ ID NO: 1021506 - RNA, 19 nt, Human
ugaagcagcaaacucucag

SEQ ID NO: 1021507 - RNA, 22 nt, Human
gaggggcuugaggcccugaugg

SEQ ID NO: 1021508 - RNA, 22 nt, Human
guugggaagcagauggaugagc

SEQ ID NO: 1021509 - RNA, 21 nt, Human
acagauuuuauaucucugcug

SEQ ID NO: 1021510 - RNA, 22 nt, Human
agcacaggcuuuggugugaggg

SEQ ID NO: 1021511 - RNA, 22 nt, Human
gcacuugggcagagacgcacag

SEQ ID NO: 1021512 - RNA, 22 nt, Human
aguggcagaagucacuggguag

SEQ ID NO: 1021513 - RNA, 22 nt, Human
gcucccaggaugaggagccagg

SEQ ID NO: 1021514 - RNA, 22 nt, Human
aacaaaugaccugauuucuucc

SEQ ID NO: 1021515 - RNA, 22 nt, Human
gggacccugggaggcuggcgca

SEQ ID NO: 1021516 - RNA, 22 nt, Human
agggagcaugggugaagcaggc

SEQ ID NO: 1021517 - RNA, 22 nt, Human
acagucuugagcaucagccaga

SEQ ID NO: 1021518 - RNA, 22 nt, Human
cuggcaggaagaggaaagguca

SEQ ID NO: 1021519 - RNA, 22 nt, Human
ucaugaacaucucaaauaacca

SEQ ID NO: 1021520 - RNA, 22 nt, Human
aggagacauaacuaugaugaga

SEQ ID NO: 1021521 - RNA, 22 nt, Human
uccuugaagcuuguaucuaaua

SEQ ID NO: 1021522 - RNA, 22 nt, Human
uuuccucuccaccaggaggucu

SEQ ID NO: 1021523 - RNA, 22 nt, Human
uuccaugagcucugaguucaca

SEQ ID NO: 1021524 - RNA, 22 nt, Human
aauggcugggaguguauuuugg

SEQ ID NO: 1021525 - RNA, 22 nt, Human
guuuuucuuugugugaagacaa

SEQ ID NO: 1021526 - RNA, 22 nt, Human
uggagacugugcuaagggaguu

SEQ ID NO: 1021527 - RNA, 21 nt, Human
uucugggaaaugagcuggggc

SEQ ID NO: 1021528 - RNA, 22 nt, Human
ucucugggugauggcagggcac

SEQ ID NO: 1021529 - RNA, 22 nt, Human
ccucgcggcacucgggccggau

SEQ ID NO: 1021530 - RNA, 22 nt, Human
acuugcugguggcauuuacagu

SEQ ID NO: 1021531 - RNA, 22 nt, Human
gagcugccuguugcauagcaac

SEQ ID NO: 1021532 - RNA, 22 nt, Human
aggugagguuugggagguguca

SEQ ID NO: 1021533 - RNA, 22 nt, Human
uagacagauuuaaaggaaugga

SEQ ID NO: 1021534 - RNA, 22 nt, Human
agaaaucaauaucuauauguug

SEQ ID NO: 1021535 - RNA, 22 nt, Human
ggcagcaguaggagcuaaucuu

SEQ ID NO: 1021536 - RNA, 23 nt, Human
cagaccuggcagucauccucaac

SEQ ID NO: 1021537 - RNA, 22 nt, Human
gagcccucucuguaggcaagua

SEQ ID NO: 1021538 - RNA, 22 nt, Human
acacagaaccucauagccucuc

SEQ ID NO: 1021539 - RNA, 22 nt, Human
agauacauuguucuaagcauug

SEQ ID NO: 1021540 - RNA, 22 nt, Human
augauuucuauauaaacuuaaa

SEQ ID NO: 1021541 - RNA, 22 nt, Human
uaaggccaaguucauauacaac

SEQ ID NO: 1021542 - RNA, 22 nt, Human
aagccagcauuuucccauuccu

SEQ ID NO: 1021543 - RNA, 22 nt, Human
aggagcuggguuccuuuggugg

SEQ ID NO: 1021544 - RNA, 22 nt, Human
ucagaggugguaaaggacagca

SEQ ID NO: 1021545 - RNA, 22 nt, Human
guugcacaguuccucaagcagg

SEQ ID NO: 1021546 - RNA, 22 nt, Human
cugccugggccggccacccucu

SEQ ID NO: 1021547 - RNA, 22 nt, Human
gaggccuggaccagccacagag

SEQ ID NO: 1021548 - RNA, 22 nt, Human
accaucagucauugucaguggg

SEQ ID NO: 1021549 - RNA, 22 nt, Human
agggucuguggaugcaucuggg

SEQ ID NO: 1021550 - RNA, 22 nt, Human
ugacaguuaagguauacauuca

SEQ ID NO: 1021551 - RNA, 19 nt, Human
cugcagggaugugcagagu

SEQ ID NO: 1021552 - RNA, 22 nt, Human
ggugcccaccugucuuccugga

SEQ ID NO: 1021553 - RNA, 22 nt, Human
uggggacacagagguucguugg

SEQ ID NO: 1021554 - RNA, 20 nt, Human
uuguuucugcuauuuucuaa

SEQ ID NO: 1021555 - RNA, 22 nt, Human
cuaauacucauuucuguaacuc

SEQ ID NO: 1021556 - RNA, 22 nt, Human
guccucugggagccuugagccu

SEQ ID NO: 1021557 - RNA, 22 nt, Human
uguuuuaagagcgcacuuuaua

SEQ ID NO: 1021558 - RNA, 22 nt, Human
agagcuuauaucuuggccaucc

SEQ ID NO: 1021559 - RNA, 22 nt, Human
ucacagugagccaugucagaga

SEQ ID NO: 1021560 - RNA, 22 nt, Human
uaaacauggauucugaucacag

SEQ ID NO: 1021561 - RNA, 22 nt, Human
aacuagaaccacuuguauuucc

SEQ ID NO: 1021562 - RNA, 22 nt, Human
ucgagcucuggagccaaggaug

SEQ ID NO: 1021563 - RNA, 22 nt, Human
ucuuuccucugagcuccuguag

SEQ ID NO: 1021564 - RNA, 22 nt, Human
ucccagcagagccagcaagccg

SEQ ID NO: 1021565 - RNA, 22 nt, Human
gcugccucuguagcuuuggacc

SEQ ID NO: 1021566 - RNA, 23 nt, Human
cauccaggagcugagucugacug

SEQ ID NO: 1021567 - RNA, 22 nt, Human
ugcaauaaguuguguuaucacu

SEQ ID NO: 1021568 - RNA, 21 nt, Human
acccuggguucuccauacccu

SEQ ID NO: 1021569 - RNA, 22 nt, Human
cuggagcugcuguccuugggug

SEQ ID NO: 1021570 - RNA, 22 nt, Human
gcagccuguuguaccagccugu

SEQ ID NO: 1021571 - RNA, 22 nt, Human
gagcugggcacacgccacuuga

SEQ ID NO: 1021572 - RNA, 22 nt, Human
cugagggcaugaacauuccaua

SEQ ID NO: 1021573 - RNA, 22 nt, Human
cuuucaaugugccugccuuggg

SEQ ID NO: 1021574 - RNA, 22 nt, Human
cuuguaauuauaauguacuguu

SEQ ID NO: 1021575 - RNA, 22 nt, Human
uccaggcauuggagagauaaug

SEQ ID NO: 1021576 - RNA, 22 nt, Human
uaaagaacacagggaauagcac

SEQ ID NO: 1021577 - RNA, 22 nt, Human
cucccaagggguaagggagcug

SEQ ID NO: 1021578 - RNA, 22 nt, Human
uguacaguguagucaugagguu

SEQ ID NO: 1021579 - RNA, 22 nt, Human
uacaaagcuguauagccugguc

SEQ ID NO: 1021580 - RNA, 20 nt, Human
cacaggccuugugagcagac

SEQ ID NO: 1021581 - RNA, 20 nt, Human
aacagggggcugcagagggc

SEQ ID NO: 1021582 - RNA, 22 nt, Human
ucagcagggcugugguguggcu

SEQ ID NO: 1021583 - RNA, 22 nt, Human
gcuggcagguccaagauagagc

SEQ ID NO: 1021584 - RNA, 22 nt, Human
accuuaaaacugacacauggag

SEQ ID NO: 1021585 - RNA, 22 nt, Human
uugcuagcugguguaugcauug

SEQ ID NO: 1021586 - RNA, 22 nt, Human
ucuggcucggauuugucuagca

SEQ ID NO: 1021587 - RNA, 22 nt, Human
acauuugucuucuuucagauua

SEQ ID NO: 1021588 - RNA, 21 nt, Human
agcaggaggcagucacagcuc

SEQ ID NO: 1021589 - RNA, 22 nt, Human
cugggaggcccacguugggaag

SEQ ID NO: 1021590 - RNA, 22 nt, Human
cuggcagcugugugaagaacug

SEQ ID NO: 1021591 - RNA, 22 nt, Human
ugucccaggccucauguugcca

SEQ ID NO: 1021592 - RNA, 22 nt, Human
gcauuucugugcauacacauga

SEQ ID NO: 1021593 - RNA, 22 nt, Human
caguaugucuacuggacaaagu

SEQ ID NO: 1021594 - RNA, 22 nt, Human
uuugaaguucccccauaucaga

SEQ ID NO: 1021595 - RNA, 22 nt, Human
agcucccagaagccagagucgg

SEQ ID NO: 1021596 - RNA, 23 nt, Human
agcacacuuguacaaugcccuag

SEQ ID NO: 1021597 - RNA, 22 nt, Human
aaggagaguacaggaguuggua

SEQ ID NO: 1021598 - RNA, 22 nt, Human
aaaauuauggaguaucccaaag

SEQ ID NO: 1021599 - RNA, 22 nt, Human
acuuucuaggucucaguccuuu

SEQ ID NO: 1021600 - RNA, 22 nt, Human
gccugcagugagugcagaaggu

SEQ ID NO: 1021601 - RNA, 22 nt, Human
agccaucauuucugucacuggc

SEQ ID NO: 1021602 - RNA, 22 nt, Human
ucccugggagaugaugaugagg

SEQ ID NO: 1021603 - RNA, 22 nt, Human
caggagcaaggagcagugggau

SEQ ID NO: 1021604 - RNA, 22 nt, Human
gugagcagaacagguggcuucu

SEQ ID NO: 1021605 - RNA, 20 nt, Human
ucugugugccaucaccuaac

SEQ ID NO: 1021606 - RNA, 22 nt, Human
aagccucuggggccucaucugu

SEQ ID NO: 1021607 - RNA, 22 nt, Human
accaggcagcacuuuccuugca

SEQ ID NO: 1021608 - RNA, 22 nt, Human
gagcugccagacaugggaauga

SEQ ID NO: 1021609 - RNA, 22 nt, Human
acauuuguaugcguuuuuacug

SEQ ID NO: 1021610 - RNA, 22 nt, Human
agcugggaugauaaccucaguc

SEQ ID NO: 1021611 - RNA, 22 nt, Human
uucuucaaauagcagggaguca

SEQ ID NO: 1021612 - RNA, 21 nt, Human
uagaaaucagcuggugccucu

SEQ ID NO: 1021613 - RNA, 22 nt, Human
acauuucuucccuuuagcagaa

SEQ ID NO: 1021614 - RNA, 22 nt, Human
uugcauuugacaaauuauuuaa

SEQ ID NO: 1021615 - RNA, 22 nt, Human
agauuucccacuccauguauug

SEQ ID NO: 1021616 - RNA, 22 nt, Human
uggcccugaggacccagugugg

SEQ ID NO: 1021617 - RNA, 23 nt, Human
ugcugggcagagcuggugcugag

SEQ ID NO: 1021618 - RNA, 22 nt, Human
gcugccuugaacuuggccuggg

SEQ ID NO: 1021619 - RNA, 22 nt, Human
agaaaucaugacuaagagcagu

SEQ ID NO: 1021620 - RNA, 22 nt, Human
cccuugggguggagguugcagu

SEQ ID NO: 1021621 - RNA, 22 nt, Human
cauugcacagcccuguggugau

SEQ ID NO: 1021622 - RNA, 21 nt, Human
uuucugucucugccacuaguu

SEQ ID NO: 1021623 - RNA, 22 nt, Human
uccaagaagucaucuaaacugu

SEQ ID NO: 1021624 - RNA, 22 nt, Human
cccagcugcaccucuauggccu

SEQ ID NO: 1021625 - RNA, 18 nt, Human
gcuggcugcacuucugcu

SEQ ID NO: 1021626 - RNA, 22 nt, Human
cagggccagcgucucgggcuau

SEQ ID NO: 1021627 - RNA, 22 nt, Human
cagcuccagcccaggcagcucc

SEQ ID NO: 1021628 - RNA, 20 nt, Human
ucauuucuugggguuccaag

SEQ ID NO: 1021629 - RNA, 22 nt, Human
auggaagguccuacagagcgca

SEQ ID NO: 1021630 - RNA, 22 nt, Human
augguacaaaauguauaaaguc

SEQ ID NO: 1021631 - RNA, 22 nt, Human
ccuggagcucacugggagccgg

SEQ ID NO: 1021632 - RNA, 22 nt, Human
gcagggacaaggcagguguucu

SEQ ID NO: 1021633 - RNA, 22 nt, Human
agaaaucagaacccugaaguuc

SEQ ID NO: 1021634 - RNA, 22 nt, Human
cugaaggauucaaaauggcagg

SEQ ID NO: 1021635 - RNA, 22 nt, Human
auuacaaaagaagggagaaggu

SEQ ID NO: 1021636 - RNA, 22 nt, Human
agguuuauguuuggugcaggag

SEQ ID NO: 1021637 - RNA, 22 nt, Human
ugaaaaggaguccuuguuuuca

SEQ ID NO: 1021638 - RNA, 22 nt, Human
ucucugucugagccuggcagac

SEQ ID NO: 1021639 - RNA, 20 nt, Human
ccagcuuucccugcagcauc

SEQ ID NO: 1021640 - RNA, 22 nt, Human
agcuggcccucgagagccaauu

SEQ ID NO: 1021641 - RNA, 22 nt, Human
cuggagcccugaaugggcagga

SEQ ID NO: 1021642 - RNA, 21 nt, Human
gaugaagcaaucuuucuguug

SEQ ID NO: 1021643 - RNA, 22 nt, Human
cuguucacacacuuguacucuc

SEQ ID NO: 1021644 - RNA, 22 nt, Human
cagaccuggaaaacaggcuugc

SEQ ID NO: 1021645 - RNA, 22 nt, Human
cauucauuuacuuucaacagcu

SEQ ID NO: 1021646 - RNA, 22 nt, Human
caggccugugacaccgugucug

SEQ ID NO: 1021647 - RNA, 22 nt, Human
aaauugugcucacacugauauu

SEQ ID NO: 1021648 - RNA, 22 nt, Human
aucuggcuuuuaccccacggcc

SEQ ID NO: 1021649 - RNA, 22 nt, Human
cccucugccugcgcccuggugu

SEQ ID NO: 1021650 - RNA, 22 nt, Human
gagagcugggaaagccguggag

SEQ ID NO: 1021651 - RNA, 21 nt, Human
ugauuuccaucuuaaaauaaa

SEQ ID NO: 1021652 - RNA, 22 nt, Human
auaauaacaccugaauaggaaa

SEQ ID NO: 1021653 - RNA, 22 nt, Human
aaagauuauggcauugaaauac

SEQ ID NO: 1021654 - RNA, 22 nt, Human
ucaaaguagggguaagccaggc

SEQ ID NO: 1021655 - RNA, 22 nt, Human
uggcaccugaacuuagaggugu

SEQ ID NO: 1021656 - RNA, 22 nt, Human
uugaaguuguaguucagugaag

SEQ ID NO: 1021657 - RNA, 22 nt, Human
cuagggacagaaagaggguaga

SEQ ID NO: 1021658 - RNA, 22 nt, Human
uuaugcaacaggugagcagaca

SEQ ID NO: 1021659 - RNA, 22 nt, Human
gaucuguuauaaucucuuuuau

SEQ ID NO: 1021660 - RNA, 22 nt, Human
aucugcuuccugggcuccauga

SEQ ID NO: 1021661 - RNA, 22 nt, Human
uaugauuuguagacauuugauu

SEQ ID NO: 1021662 - RNA, 22 nt, Human
ugcugaugaguccuucuaucgc

SEQ ID NO: 1021663 - RNA, 22 nt, Human
aaauuaguacauugcaaagucc

SEQ ID NO: 1021664 - RNA, 22 nt, Human
ucuuccagcaaugugaaaucac

SEQ ID NO: 1021665 - RNA, 22 nt, Human
uguagaaagaauauguuucaua

SEQ ID NO: 1021666 - RNA, 22 nt, Human
caggguuucaccauguuagcag

SEQ ID NO: 1021667 - RNA, 22 nt, Human
uaggaaauggcucaguuacugc

SEQ ID NO: 1021668 - RNA, 21 nt, Human
aagagcugucaggaaggcugc

SEQ ID NO: 1021669 - RNA, 22 nt, Human
agcugagcugcagaugacugua

SEQ ID NO: 1021670 - RNA, 22 nt, Human
ucacaggcuccagggccuggau

SEQ ID NO: 1021671 - RNA, 22 nt, Human
gcagugguggagcuuacauauc

SEQ ID NO: 1021672 - RNA, 22 nt, Human
uugauaaaaugauaucuucuuu

SEQ ID NO: 1021673 - RNA, 22 nt, Human
cagaauuuuucgaauguacugu

SEQ ID NO: 1021674 - RNA, 22 nt, Human
aaauugcauuuuaaagguagau

SEQ ID NO: 1021675 - RNA, 22 nt, Human
ucagagugaggcgucaacauga

SEQ ID NO: 1021676 - RNA, 22 nt, Human
ugucccauggacacaacuucuu

SEQ ID NO: 1021677 - RNA, 22 nt, Human
agaaaauauucauugagaggcu

SEQ ID NO: 1021678 - RNA, 22 nt, Human
ucugaggcccugcaggcagugu

SEQ ID NO: 1021679 - RNA, 20 nt, Human
aagaaacuugaaaguacaag

SEQ ID NO: 1021680 - RNA, 22 nt, Human
gagagcugggcuuugggugaag

SEQ ID NO: 1021681 - RNA, 22 nt, Human
ggcugccuccucgagacaggau

SEQ ID NO: 1021682 - RNA, 22 nt, Human
ucaggacagccagggugcagac

SEQ ID NO: 1021683 - RNA, 22 nt, Human
cuucuucauguauugauagucu

SEQ ID NO: 1021684 - RNA, 22 nt, Human
caagagcuggguggcaagcuag

SEQ ID NO: 1021685 - RNA, 23 nt, Human
aacaauagguuuuggcagaauag

SEQ ID NO: 1021686 - RNA, 22 nt, Human
ggcuccuggcaucuggugggua

SEQ ID NO: 1021687 - RNA, 17 nt, Human
ccugggaggaguuauga

SEQ ID NO: 1021688 - RNA, 21 nt, Human
aaagugguaaggauuauuuug

SEQ ID NO: 1021689 - RNA, 22 nt, Human
cagggcaguaacgggaacaucu

SEQ ID NO: 1021690 - RNA, 22 nt, Human
agcagcucuguuuaccuggagg

SEQ ID NO: 1021691 - RNA, 20 nt, Human
ugaaaaggucaggagacaug

SEQ ID NO: 1021692 - RNA, 22 nt, Human
augugguugaagaauuacaucu

SEQ ID NO: 1021693 - RNA, 22 nt, Human
ggacuccucuagaaguugaggc

SEQ ID NO: 1021694 - RNA, 21 nt, Human
ucucugggcccuccugugggg

SEQ ID NO: 1021695 - RNA, 22 nt, Human
acuacuuugggccauuuguuua

SEQ ID NO: 1021696 - RNA, 22 nt, Human
aaauuauucucauguguuucuu

SEQ ID NO: 1021697 - RNA, 22 nt, Human
aguaaaaauugaggugcaaaau

SEQ ID NO: 1021698 - RNA, 22 nt, Human
auaugcacacucugcccacaga

SEQ ID NO: 1021699 - RNA, 22 nt, Human
ucucaagaucucaagauggccc

SEQ ID NO: 1021700 - RNA, 19 nt, Human
acuggcagcuguagucugu

SEQ ID NO: 1021701 - RNA, 22 nt, Human
uuggaaaaacacgauagugguu

SEQ ID NO: 1021702 - RNA, 22 nt, Human
ggagaagggacagacucagcuu

SEQ ID NO: 1021703 - RNA, 22 nt, Human
uuguuuuggagaugagcuaaaa

SEQ ID NO: 1021704 - RNA, 22 nt, Human
ucagugcagaauagugaugcau

SEQ ID NO: 1021705 - RNA, 22 nt, Human
ucaagagaaggggaaauagacu

SEQ ID NO: 1021706 - RNA, 22 nt, Human
agggacacugaugagaaauucu

SEQ ID NO: 1021707 - RNA, 20 nt, Human
accauaauguuaauuacaaa

SEQ ID NO: 1021708 - RNA, 22 nt, Human
gagcuggugugugcccgagcac

SEQ ID NO: 1021709 - RNA, 22 nt, Human
caggccugauacacugaacucu

SEQ ID NO: 1021710 - RNA, 22 nt, Human
cccagcucuuuuagcggcaucu

SEQ ID NO: 1021711 - RNA, 22 nt, Human
guggcagagguuccucagugug

SEQ ID NO: 1021712 - RNA, 22 nt, Human
ugugccugucacccucagagag

SEQ ID NO: 1021713 - RNA, 22 nt, Human
agggagaacaguugcagcagac

SEQ ID NO: 1021714 - RNA, 22 nt, Human
auucaguuaaaaacuguacuuc

SEQ ID NO: 1021715 - RNA, 22 nt, Human
aagggcagcugacagaugcuua

SEQ ID NO: 1021716 - RNA, 22 nt, Human
aacugcauuugcauaaguccau

SEQ ID NO: 1021717 - RNA, 22 nt, Human
ggcagcaugagccuggugaauu

SEQ ID NO: 1021718 - RNA, 22 nt, Human
gccucugcugcaagccugguug

SEQ ID NO: 1021719 - RNA, 22 nt, Human
ugauuucccuguagccucugaa

SEQ ID NO: 1021720 - RNA, 22 nt, Human
uucacauuaucaggauuguuuc

SEQ ID NO: 1021721 - RNA, 22 nt, Human
agacaaauggaguaugagcaac

SEQ ID NO: 1021722 - RNA, 21 nt, Human
ccuccaggugauuccgugcuc

SEQ ID NO: 1021723 - RNA, 22 nt, Human
agcagcugguaggaguggccac

SEQ ID NO: 1021724 - RNA, 22 nt, Human
ugggcccaagagagucuccaac

SEQ ID NO: 1021725 - RNA, 22 nt, Human
aggguauguuuuuaucuacugu

SEQ ID NO: 1021726 - RNA, 22 nt, Human
aguaauaauuuauauuagggag

SEQ ID NO: 1021727 - RNA, 22 nt, Human
caguagcaggcacucagcacgu

SEQ ID NO: 1021728 - RNA, 22 nt, Human
ugcuuuauggagcccaucucau

SEQ ID NO: 1021729 - RNA, 22 nt, Human
uggccuggcugcccugucugga

SEQ ID NO: 1021730 - RNA, 22 nt, Human
aaacagcuggucucaaauguuc

SEQ ID NO: 1021731 - RNA, 22 nt, Human
ccagggcugcugugggacucca

SEQ ID NO: 1021732 - RNA, 23 nt, Human
aggugcagcccuggaccugcccc

SEQ ID NO: 1021733 - RNA, 22 nt, Human
auuuagcaaaaaaugaugaagc

SEQ ID NO: 1021734 - RNA, 22 nt, Human
uauucacaggcacgaaauauug

SEQ ID NO: 1021735 - RNA, 22 nt, Human
ggaggaugagcuacgaggagcu

SEQ ID NO: 1021736 - RNA, 22 nt, Human
uggccaggggaguuccccucca

SEQ ID NO: 1021737 - RNA, 22 nt, Human
agucccagcuacucaagaggcu

SEQ ID NO: 1021738 - RNA, 19 nt, Human
gcugcucugggucucaucu

SEQ ID NO: 1021739 - RNA, 22 nt, Human
uacauguuuacuccaagucagg

SEQ ID NO: 1021740 - RNA, 22 nt, Human
gaugauggacaaagcauuggug

SEQ ID NO: 1021741 - RNA, 22 nt, Human
aggaaaaucgagucuggaggca

SEQ ID NO: 1021742 - RNA, 23 nt, Human
uuuggacuugugacucuucuccu

SEQ ID NO: 1021743 - RNA, 22 nt, Human
gccagggagucugggccacaga

SEQ ID NO: 1021744 - RNA, 22 nt, Human
ggcugcugaguuggccaggaga

SEQ ID NO: 1021745 - RNA, 22 nt, Human
uagagcauuuagaggggcagga

SEQ ID NO: 1021746 - RNA, 22 nt, Human
ugagcuuccucccugcauccau

SEQ ID NO: 1021747 - RNA, 22 nt, Human
uuugcagcaaggagagagcauu

SEQ ID NO: 1021748 - RNA, 22 nt, Human
uagcugccaaaagggugggcua

SEQ ID NO: 1021749 - RNA, 22 nt, Human
gcaguggcuaagcucgcaugca

SEQ ID NO: 1021750 - RNA, 22 nt, Human
aauucuauguucuugaguaaga

SEQ ID NO: 1021751 - RNA, 22 nt, Human
uugcauuuaaguagauguuaca

SEQ ID NO: 1021752 - RNA, 22 nt, Human
gggcugugagaguggggcugcu

SEQ ID NO: 1021753 - RNA, 18 nt, Human
agacccucuaagggcagu

SEQ ID NO: 1021754 - RNA, 23 nt, Human
gcagaggagcaagcuggacacca

SEQ ID NO: 1021755 - RNA, 22 nt, Human
uugccaggagcucaucugaggg

SEQ ID NO: 1021756 - RNA, 22 nt, Human
ucuggcucugacacuacuguua

SEQ ID NO: 1021757 - RNA, 22 nt, Human
gucuucuuguuuugaaggaaau

SEQ ID NO: 1021758 - RNA, 22 nt, Human
caggguggcccuguggucucau

SEQ ID NO: 1021759 - RNA, 22 nt, Human
agaaaugaagagagucaagguu

SEQ ID NO: 1021760 - RNA, 22 nt, Human
ggcaggagaauggcgugaacuc

SEQ ID NO: 1021761 - RNA, 22 nt, Human
gcagcuguguaaugagcccaca

SEQ ID NO: 1021762 - RNA, 22 nt, Human
uucaagauccagcacaacagug

SEQ ID NO: 1021763 - RNA, 20 nt, Human
uccugggguaagccaugguc

SEQ ID NO: 1021764 - RNA, 20 nt, Human
ugcagaagaacguucugguu

SEQ ID NO: 1021765 - RNA, 22 nt, Human
aggggagaguuaaugugaaugu

SEQ ID NO: 1021766 - RNA, 22 nt, Human
uggcuggcuagugggcaggauu

SEQ ID NO: 1021767 - RNA, 22 nt, Human
uaugacauugcuuuuuagaacu

SEQ ID NO: 1021768 - RNA, 22 nt, Human
aagucagagcaacugagacauu

SEQ ID NO: 1021769 - RNA, 22 nt, Human
gaggccuggcugucagucccca

SEQ ID NO: 1021770 - RNA, 22 nt, Human
uuucuacauucaaaaacuacca

SEQ ID NO: 1021771 - RNA, 22 nt, Human
acuuaaaaagaaucuuuucacg

SEQ ID NO: 1021772 - RNA, 22 nt, Human
uggggcuggcuauugucucccu

SEQ ID NO: 1021773 - RNA, 22 nt, Human
uagcucuucaaucacugucucc

SEQ ID NO: 1021774 - RNA, 22 nt, Human
ccagggugugagaaggaaguag

SEQ ID NO: 1021775 - RNA, 22 nt, Human
cuccagggaaaggggcguccgc

SEQ ID NO: 1021776 - RNA, 22 nt, Human
cugcugcucgaccagucccagg

SEQ ID NO: 1021777 - RNA, 22 nt, Human
gaugagggccugguggcugugc

SEQ ID NO: 1021778 - RNA, 22 nt, Human
ggaagagagggcugggccucaa

SEQ ID NO: 1021779 - RNA, 22 nt, Human
uccagggagauacuggcugcca

SEQ ID NO: 1021780 - RNA, 22 nt, Human
ugccagcaguagcaguaggcca

SEQ ID NO: 1021781 - RNA, 22 nt, Human
aggagugcaaauaguccagaga

SEQ ID NO: 1021782 - RNA, 22 nt, Human
aagcugcagacccccugucuca

SEQ ID NO: 1021783 - RNA, 22 nt, Human
cuuaaagaaauugaggagagga

SEQ ID NO: 1021784 - RNA, 23 nt, Human
uccugcagauaagcugguugaca

SEQ ID NO: 1021785 - RNA, 22 nt, Human
augcuuuuccaggagaaauaua

SEQ ID NO: 1021786 - RNA, 22 nt, Human
agcugucuccagauacaggauu

SEQ ID NO: 1021787 - RNA, 22 nt, Human
acacacaacucauuguguaaua

SEQ ID NO: 1021788 - RNA, 22 nt, Human
caggugccgggaaugcagcaau

SEQ ID NO: 1021789 - RNA, 22 nt, Human
aagcccaguuucacacugagac

SEQ ID NO: 1021790 - RNA, 22 nt, Human
cccuggagcuagucugagcaga

SEQ ID NO: 1021791 - RNA, 22 nt, Human
gagcugugagggacacauugcu

SEQ ID NO: 1021792 - RNA, 22 nt, Human
aagauuauuuaagacaggaacc

SEQ ID NO: 1021793 - RNA, 22 nt, Human
uggcagcauuuuuuccagaaca

SEQ ID NO: 1021794 - RNA, 22 nt, Human
uugggagcuggaagcaaggccu

SEQ ID NO: 1021795 - RNA, 22 nt, Human
ccaaaguccauaguuuacauaa

SEQ ID NO: 1021796 - RNA, 22 nt, Human
ugugcuucuugcagcuccugua

SEQ ID NO: 1021797 - RNA, 22 nt, Human
ucccaaggccaggcaucuagaa

SEQ ID NO: 1021798 - RNA, 22 nt, Human
gcagagcugggucuguauccaa

SEQ ID NO: 1021799 - RNA, 22 nt, Human
agggcagcauugccuuucucca

SEQ ID NO: 1021800 - RNA, 22 nt, Human
gugucauuaaccaccaugcaaa

SEQ ID NO: 1021801 - RNA, 22 nt, Human
ugcacauuaguguuugagaugc

SEQ ID NO: 1021802 - RNA, 17 nt, Human
gcagccagugcagcagg

SEQ ID NO: 1021803 - RNA, 22 nt, Human
gaggcccugaagacagcugggg

SEQ ID NO: 1021804 - RNA, 22 nt, Human
uccuucaaagcuccuagugagc

SEQ ID NO: 1021805 - RNA, 22 nt, Human
aagucauuaucucuucuaaucu

SEQ ID NO: 1021806 - RNA, 22 nt, Human
cucugucacuucuccagcugag

SEQ ID NO: 1021807 - RNA, 22 nt, Human
agggcaguucaacuucauagug

SEQ ID NO: 1021808 - RNA, 17 nt, Human
gcauccaguaacaugcc

SEQ ID NO: 1021809 - RNA, 22 nt, Human
aacuuaaacccacucauguaga

SEQ ID NO: 1021810 - RNA, 22 nt, Human
gguugccggggcaggacuggaa

SEQ ID NO: 1021811 - RNA, 22 nt, Human
ggcacagggagccgcaguugca

SEQ ID NO: 1021812 - RNA, 22 nt, Human
aggcugaggcagguggaucacu

SEQ ID NO: 1021813 - RNA, 22 nt, Human
agcuggcagcucucagggguac

SEQ ID NO: 1021814 - RNA, 19 nt, Human
gagcccucuccauggccac

SEQ ID NO: 1021815 - RNA, 22 nt, Human
ggggauggaauguaguagugau

SEQ ID NO: 1021816 - RNA, 22 nt, Human
cccaucacagacacuggguuau

SEQ ID NO: 1021817 - RNA, 22 nt, Human
ugacucuguaccugucugccuu

SEQ ID NO: 1021818 - RNA, 22 nt, Human
ccagggcauguccaagacuuag

SEQ ID NO: 1021819 - RNA, 22 nt, Human
gagcugagccuggguggaccgc

SEQ ID NO: 1021820 - RNA, 22 nt, Human
augaaauaucuugaagaaauuc

SEQ ID NO: 1021821 - RNA, 20 nt, Human
gagggcucguggauggauaa

SEQ ID NO: 1021822 - RNA, 22 nt, Human
acagagauggcacagagaaggu

SEQ ID NO: 1021823 - RNA, 17 nt, Human
ggcugcugugcuggugc

SEQ ID NO: 1021824 - RNA, 22 nt, Human
cccccuggcaggcuggccucuc

SEQ ID NO: 1021825 - RNA, 18 nt, Human
agggucagugucacuggc

SEQ ID NO: 1021826 - RNA, 22 nt, Human
ugagugaggaagcgguggagga

SEQ ID NO: 1021827 - RNA, 22 nt, Human
ccaggccucuggcugcuuaguc

SEQ ID NO: 1021828 - RNA, 22 nt, Human
ccugugcccucagccuggcucu

SEQ ID NO: 1021829 - RNA, 22 nt, Human
ucugggcuuuacacugugcuua

SEQ ID NO: 1021830 - RNA, 22 nt, Human
auguauguuaguguauuaucua

SEQ ID NO: 1021831 - RNA, 22 nt, Human
ugcaggugugguuccucagcca

SEQ ID NO: 1021832 - RNA, 22 nt, Human
uggcagaaguucacuaguagcu

SEQ ID NO: 1021833 - RNA, 22 nt, Human
ugggccacggggguggagagcu

SEQ ID NO: 1021834 - RNA, 22 nt, Human
uccagggaaggugugaggcugg

SEQ ID NO: 1021835 - RNA, 22 nt, Human
gucuuguuugggauguggaugg

SEQ ID NO: 1021836 - RNA, 20 nt, Human
agguccugggacuggcagag

SEQ ID NO: 1021837 - RNA, 22 nt, Human
uugcacuccagcccgagcaaca

SEQ ID NO: 1021838 - RNA, 22 nt, Human
gcucugggugaacuuggagcaa

SEQ ID NO: 1021839 - RNA, 22 nt, Human
agcuggcuccagaaggagucgu

SEQ ID NO: 1021840 - RNA, 22 nt, Human
aaucaguuaggguguuaaugag

SEQ ID NO: 1021841 - RNA, 22 nt, Human
gaggucagucagaccaggguuu

SEQ ID NO: 1021842 - RNA, 22 nt, Human
gcuggcugaggucuagcucuuu

SEQ ID NO: 1021843 - RNA, 22 nt, Human
auaauguagguauguguauuua

SEQ ID NO: 1021844 - RNA, 22 nt, Human
ugauguucuguauaucauauag

SEQ ID NO: 1021845 - RNA, 22 nt, Human
cuggccugaggucggcuguagg

SEQ ID NO: 1021846 - RNA, 23 nt, Human
aaguaacagggauaauagcaguu

SEQ ID NO: 1021847 - RNA, 22 nt, Human
cugcucuaauaucagauagacu

SEQ ID NO: 1021848 - RNA, 22 nt, Human
ucuggagcgaggucccugucug

SEQ ID NO: 1021849 - RNA, 22 nt, Human
aggagccaggaaaccugcucug

SEQ ID NO: 1021850 - RNA, 22 nt, Human
caggagccccaggcugacaaua

SEQ ID NO: 1021851 - RNA, 22 nt, Human
accaaggagacaaagguguauu

SEQ ID NO: 1021852 - RNA, 22 nt, Human
auaaacagcuccauuuagugcc

SEQ ID NO: 1021853 - RNA, 22 nt, Human
acaggacauguaccaggugguc

SEQ ID NO: 1021854 - RNA, 22 nt, Human
uccaaagggaagcgcuuucugu

SEQ ID NO: 1021855 - RNA, 22 nt, Human
caggaggaaaugugacccugcu

SEQ ID NO: 1021856 - RNA, 22 nt, Human
aagauuucugcuccugagagaa

SEQ ID NO: 1021857 - RNA, 22 nt, Human
cuagggaccucagcuccuggag

SEQ ID NO: 1021858 - RNA, 22 nt, Human
cagauccacccuuguagugaca

SEQ ID NO: 1021859 - RNA, 22 nt, Human
gagguagcaugcuggaagggac

SEQ ID NO: 1021860 - RNA, 22 nt, Human
gcccaggaguucaagucuagug

SEQ ID NO: 1021861 - RNA, 20 nt, Human
caccaggcgcucugagaaca

SEQ ID NO: 1021862 - RNA, 22 nt, Human
cugggagcggcugucacugguu

SEQ ID NO: 1021863 - RNA, 22 nt, Human
uuuccaagagcuuauuucugaa

SEQ ID NO: 1021864 - RNA, 22 nt, Human
ugccuggguccaggccaagccu

SEQ ID NO: 1021865 - RNA, 22 nt, Human
uaauuucaauagcuugcauaau

SEQ ID NO: 1021866 - RNA, 22 nt, Human
uguuaaucaaucaacaguauua

SEQ ID NO: 1021867 - RNA, 22 nt, Human
uggcagcauguuauguaaggaa

SEQ ID NO: 1021868 - RNA, 22 nt, Human
uguaugaagguuuaccugcugu

SEQ ID NO: 1021869 - RNA, 22 nt, Human
gauuuauuuuuaaucagcaggg

SEQ ID NO: 1021870 - RNA, 20 nt, Human
uauuugaaauggccaagugu

SEQ ID NO: 1021871 - RNA, 23 nt, Human
uggagcugacagucagagggagg

SEQ ID NO: 1021872 - RNA, 22 nt, Human
gcaaggcugagcacauuugcau

SEQ ID NO: 1021873 - RNA, 22 nt, Human
agcugcuaugacaacaccagcc

SEQ ID NO: 1021874 - RNA, 22 nt, Human
aaacacaucauucaugucguca

SEQ ID NO: 1021875 - RNA, 22 nt, Human
cugggaugucuauagaacacuu

SEQ ID NO: 1021876 - RNA, 22 nt, Human
aauaguguuguucacucaggag

SEQ ID NO: 1021877 - RNA, 22 nt, Human
gggcccagcgugguuccaucug

SEQ ID NO: 1021878 - RNA, 22 nt, Human
acugucugcuggccccugguua

SEQ ID NO: 1021879 - RNA, 22 nt, Human
uugauacauagcacaguuuagg

SEQ ID NO: 1021880 - RNA, 22 nt, Human
gccagguggucuggcuccagag

SEQ ID NO: 1021881 - RNA, 22 nt, Human
auaucauucugauguauaucuu

SEQ ID NO: 1021882 - RNA, 22 nt, Human
gagagcuggauucuggauaggu

SEQ ID NO: 1021883 - RNA, 22 nt, Human
cgcaccacugaauuccagccug

SEQ ID NO: 1021884 - RNA, 22 nt, Human
agguccagcuguugcagccucc

SEQ ID NO: 1021885 - RNA, 22 nt, Human
cauguuaaugaauuuuugcagu

SEQ ID NO: 1021886 - RNA, 22 nt, Human
ggccaggagcaagccaggcucu

SEQ ID NO: 1021887 - RNA, 22 nt, Human
accaucagagcacaguccgugc

SEQ ID NO: 1021888 - RNA, 22 nt, Human
gucugcugcagagcauggcuuu

SEQ ID NO: 1021889 - RNA, 22 nt, Human
aauguacaaaagucagccaacu

SEQ ID NO: 1021890 - RNA, 22 nt, Human
guccugggaaggaagccaggga

SEQ ID NO: 1021891 - RNA, 22 nt, Human
uggcagaguuggagguggaaga

SEQ ID NO: 1021892 - RNA, 22 nt, Human
aacuuuaaggcuauaaauuaug

SEQ ID NO: 1021893 - RNA, 22 nt, Human
aacuucuugguccugagcuguu

SEQ ID NO: 1021894 - RNA, 22 nt, Human
cugagcugggaguagagacucu

SEQ ID NO: 1021895 - RNA, 19 nt, Human
ggaagagaggaaaggugga

SEQ ID NO: 1021896 - RNA, 23 nt, Human
uggccugcagaguuucugcuggg

SEQ ID NO: 1021897 - RNA, 22 nt, Human
aagacuuucucccaaauccuca

SEQ ID NO: 1021898 - RNA, 22 nt, Human
aguggcagagcugugucuugaa

SEQ ID NO: 1021899 - RNA, 19 nt, Human
aggcagaggcuuggcuagc

SEQ ID NO: 1021900 - RNA, 22 nt, Human
gccucugcaucuucgccgcacu

SEQ ID NO: 1021901 - RNA, 22 nt, Human
agccucucugaugugacagcua

SEQ ID NO: 1021902 - RNA, 22 nt, Human
cacccagcuuuugcauccuccg

SEQ ID NO: 1021903 - RNA, 22 nt, Human
ucugagagcuguagaagccuau

SEQ ID NO: 1021904 - RNA, 22 nt, Human
cagagccauuauggagacuugc

SEQ ID NO: 1021905 - RNA, 22 nt, Human
ggccugcuggcuccagcgcccg

SEQ ID NO: 1021906 - RNA, 22 nt, Human
gucaaauauacuaagagguaaa

SEQ ID NO: 1021907 - RNA, 22 nt, Human
uugguuuagagagugugguuac

SEQ ID NO: 1021908 - RNA, 22 nt, Human
ggcugggcuccgggagcaugcg

SEQ ID NO: 1021909 - RNA, 22 nt, Human
gggaaggagguggcuugaagug

SEQ ID NO: 1021910 - RNA, 22 nt, Human
agcagagccugggcuaggggug

SEQ ID NO: 1021911 - RNA, 22 nt, Human
gggcuggugaggcugcccugca

SEQ ID NO: 1021912 - RNA, 22 nt, Human
cugaugcuauaagccacagugg

SEQ ID NO: 1021913 - RNA, 22 nt, Human
uaggagcuaaaauauuuuauau

SEQ ID NO: 1021914 - RNA, 21 nt, Human
acagcauguuuguguguuugc

SEQ ID NO: 1021915 - RNA, 22 nt, Human
ggcucugggucuguggggagcg

SEQ ID NO: 1021916 - RNA, 22 nt, Human
ucuacuauguuucuuaaauaga

SEQ ID NO: 1021917 - RNA, 22 nt, Human
acugucaccaucagagcgggaa

SEQ ID NO: 1021918 - RNA, 22 nt, Human
gcauggcauuaacaagauggaa

SEQ ID NO: 1021919 - RNA, 22 nt, Human
gagcaccucaauuugcuauuug

SEQ ID NO: 1021920 - RNA, 22 nt, Human
ugggccacuugaaaguggaugu

SEQ ID NO: 1021921 - RNA, 22 nt, Human
agaaacugaauuauuucugagg

SEQ ID NO: 1021922 - RNA, 22 nt, Human
caaugugugcuuacaggccagu

SEQ ID NO: 1021923 - RNA, 22 nt, Human
ugcucagggacaauggagaggg

SEQ ID NO: 1021924 - RNA, 19 nt, Human
uugaaauuguuugauaugg

SEQ ID NO: 1021925 - RNA, 22 nt, Human
caacacauugaagcuaugauga

SEQ ID NO: 1021926 - RNA, 22 nt, Human
ccagcugaggcagccacacagg

SEQ ID NO: 1021927 - RNA, 22 nt, Human
cagagaaacucagauagcugau

SEQ ID NO: 1021928 - RNA, 22 nt, Human
cagagcugcucaugguggccag

SEQ ID NO: 1021929 - RNA, 20 nt, Human
ccagagcugauggcugcccg

SEQ ID NO: 1021930 - RNA, 22 nt, Human
gaauuugaaaagugaugggaau

SEQ ID NO: 1021931 - RNA, 18 nt, Human
ccuggagcuccacagcaa

SEQ ID NO: 1021932 - RNA, 22 nt, Human
cuaaucaucuuucucuuaaagc

SEQ ID NO: 1021933 - RNA, 22 nt, Human
uacuuccuguuuccaugucugu

SEQ ID NO: 1021934 - RNA, 22 nt, Human
guacuuccagccaagugagaca

SEQ ID NO: 1021935 - RNA, 22 nt, Human
ugggcagcuuccacuuaguuag

SEQ ID NO: 1021936 - RNA, 22 nt, Human
cuggccaggcuugggacagaca

SEQ ID NO: 1021937 - RNA, 22 nt, Human
ucaccagggcuccagccagccu

SEQ ID NO: 1021938 - RNA, 22 nt, Human
ucaggggaaaucucucagcgaa

SEQ ID NO: 1021939 - RNA, 22 nt, Human
uggcccuguguccugcugccag

SEQ ID NO: 1021940 - RNA, 22 nt, Human
guccaggucuggacccugagcc

SEQ ID NO: 1021941 - RNA, 22 nt, Human
gggagcugaauggcaauggaga

SEQ ID NO: 1021942 - RNA, 22 nt, Human
gaaggcuggcuuucugagagca

SEQ ID NO: 1021943 - RNA, 22 nt, Human
cugagaggcacaaggcauuucg

SEQ ID NO: 1021944 - RNA, 22 nt, Human
auguaauuugcccucaaguuaa

SEQ ID NO: 1021945 - RNA, 22 nt, Human
aggcacugaaagguggccagag

SEQ ID NO: 1021946 - RNA, 22 nt, Human
ucuuugcaugugcuucuuggcc

SEQ ID NO: 1021947 - RNA, 22 nt, Human
augauugaaaaugacauugcca

SEQ ID NO: 1021948 - RNA, 22 nt, Human
ucuguucaagacugaggugaca

SEQ ID NO: 1021949 - RNA, 20 nt, Human
cucaggauacugcaaaguug

SEQ ID NO: 1021950 - RNA, 22 nt, Human
aaaugcauguagaauaauagag

SEQ ID NO: 1021951 - RNA, 22 nt, Human
guccucaguaagagggccucug

SEQ ID NO: 1021952 - RNA, 22 nt, Human
auuguacaaugccuggaacauu

SEQ ID NO: 1021953 - RNA, 23 nt, Human
gugagcagcccacuaggaaugcc

SEQ ID NO: 1021954 - RNA, 22 nt, Human
aaagcucuuuuccaaguauuga

SEQ ID NO: 1021955 - RNA, 22 nt, Human
uucuuuugggaauuacguaugc

SEQ ID NO: 1021956 - RNA, 22 nt, Human
ucuggcaggucaaucauucuuu

SEQ ID NO: 1021957 - RNA, 22 nt, Human
ugugaaaagcguguguucuagg

SEQ ID NO: 1021958 - RNA, 20 nt, Human
ggggcugcaugcagagaaga

SEQ ID NO: 1021959 - RNA, 22 nt, Human
uacauuugcuuugauuuucagc

SEQ ID NO: 1021960 - RNA, 22 nt, Human
ugggugcaugugagcacgugca

SEQ ID NO: 1021961 - RNA, 22 nt, Human
agcaugcacaugacuggcuuaa

SEQ ID NO: 1021962 - RNA, 22 nt, Human
gucauuccuuauguugauucag

SEQ ID NO: 1021963 - RNA, 22 nt, Human
gcuuuauguaaguccaaaggca

SEQ ID NO: 1021964 - RNA, 22 nt, Human
ggcaggcaggucuucauggccc

SEQ ID NO: 1021965 - RNA, 22 nt, Human
ugcagagguguugcugagauaa

SEQ ID NO: 1021966 - RNA, 22 nt, Human
gaggccacgguuuuccuugggg

SEQ ID NO: 1021967 - RNA, 23 nt, Human
gugcugugagccccuuggccucc

SEQ ID NO: 1021968 - RNA, 22 nt, Human
ccagccuuacugcccuucagug

SEQ ID NO: 1021969 - RNA, 22 nt, Human
ucuucaaagaauuuuaguaauu

SEQ ID NO: 1021970 - RNA, 22 nt, Human
gaggcaggguguugauuacaga

SEQ ID NO: 1021971 - RNA, 22 nt, Human
cagccaucccagccugugguuc

SEQ ID NO: 1021972 - RNA, 22 nt, Human
agccucuggcccuagacugcuu

SEQ ID NO: 1021973 - RNA, 22 nt, Human
uccuugaaaagaaugucuccau

SEQ ID NO: 1021974 - RNA, 22 nt, Human
gcagcuuucuuuuugcaugucu

SEQ ID NO: 1021975 - RNA, 22 nt, Human
acagggcauuuccucuaugugu

SEQ ID NO: 1021976 - RNA, 18 nt, Human
augggaggggccaagaga

SEQ ID NO: 1021977 - RNA, 22 nt, Human
ggcucaggagaggggcuaaaag

SEQ ID NO: 1021978 - RNA, 22 nt, Human
gccuuugccugcgacguggcug

SEQ ID NO: 1021979 - RNA, 22 nt, Human
ucuggagcuggagggcaaggca

SEQ ID NO: 1021980 - RNA, 22 nt, Human
ucauccaguaccauggaaggca

SEQ ID NO: 1021981 - RNA, 18 nt, Human
uuccaugauuccuuucac

SEQ ID NO: 1021982 - RNA, 22 nt, Human
agagauucauguuuacuguagg

SEQ ID NO: 1021983 - RNA, 22 nt, Human
cagagaaaaaauccugcucuca

SEQ ID NO: 1021984 - RNA, 22 nt, Human
agcugcucucacuggacgccug

SEQ ID NO: 1021985 - RNA, 22 nt, Human
uugugcauuucucugagugugu

SEQ ID NO: 1021986 - RNA, 22 nt, Human
cacugaaggcugcagcucagcc

SEQ ID NO: 1021987 - RNA, 22 nt, Human
cauaauuuuccaugguuugcua

SEQ ID NO: 1021988 - RNA, 22 nt, Human
uacuuacagagcuuauaaguua

SEQ ID NO: 1021989 - RNA, 22 nt, Human
auacaucuaugccuuucugaca

SEQ ID NO: 1021990 - RNA, 22 nt, Human
uugaccauaccuccaggcaguu

SEQ ID NO: 1021991 - RNA, 22 nt, Human
ucaagcaggguagcaagcuggu

SEQ ID NO: 1021992 - RNA, 22 nt, Human
ccagcagccaccuucucgaaau

SEQ ID NO: 1021993 - RNA, 22 nt, Human
uucacauugugcagauuauggu

SEQ ID NO: 1021994 - RNA, 22 nt, Human
gcagagaaaguuuuguccucag

SEQ ID NO: 1021995 - RNA, 19 nt, Human
auguaugaggucuucugcu

SEQ ID NO: 1021996 - RNA, 22 nt, Human
uuuacagagaauguacauaaag

SEQ ID NO: 1021997 - RNA, 22 nt, Human
cauugcugugggcauuugcugc

SEQ ID NO: 1021998 - RNA, 22 nt, Human
auguuacauaguccuuauuugu

SEQ ID NO: 1021999 - RNA, 22 nt, Human
cugugccuggggggcagagcug

SEQ ID NO: 1022000 - RNA, 22 nt, Human
agaagauuuagguugacgcuau

SEQ ID NO: 1022001 - RNA, 22 nt, Human
aagggcugccagggggugccag

SEQ ID NO: 1022002 - RNA, 22 nt, Human
cauuugaugacucaacucauaa

SEQ ID NO: 1022003 - RNA, 22 nt, Human
acuguacuguguauuguagaau

SEQ ID NO: 1022004 - RNA, 22 nt, Human
ccaggccugauugggaaucuug

SEQ ID NO: 1022005 - RNA, 20 nt, Human
ugcguguguauuuauuuucu

SEQ ID NO: 1022006 - RNA, 22 nt, Human
uggccgggccgggcgccuccac

SEQ ID NO: 1022007 - RNA, 22 nt, Human
accucugcaguagggcugugcc

SEQ ID NO: 1022008 - RNA, 22 nt, Human
gccucucucuacccaguaugau

SEQ ID NO: 1022009 - RNA, 22 nt, Human
agagcagccugugaugaugcac

SEQ ID NO: 1022010 - RNA, 22 nt, Human
gucaggauuauaauccccaugg

SEQ ID NO: 1022011 - RNA, 22 nt, Human
gccagcagcccagaaggacuuu

SEQ ID NO: 1022012 - RNA, 22 nt, Human
acauuguuugagaauacagaug

SEQ ID NO: 1022013 - RNA, 22 nt, Human
uccagcagcccgaaggcccauc

SEQ ID NO: 1022014 - RNA, 22 nt, Human
uugaacaguccuaagagacccu

SEQ ID NO: 1022015 - RNA, 19 nt, Human
cugagagaugcuucacaca

SEQ ID NO: 1022016 - RNA, 19 nt, Human
cauaauacaguggaucuga

SEQ ID NO: 1022017 - RNA, 22 nt, Human
aggaaaaaccuguuaaugguag

SEQ ID NO: 1022018 - RNA, 22 nt, Human
uuucuuguaagauguuuauuaa

SEQ ID NO: 1022019 - RNA, 22 nt, Human
ccuccaggauaagucagggccu

SEQ ID NO: 1022020 - RNA, 22 nt, Human
gcagcuuuaaacauuggaaaua

SEQ ID NO: 1022021 - RNA, 22 nt, Human
aggcucugggaagcagugaguu

SEQ ID NO: 1022022 - RNA, 22 nt, Human
uguacaaagguacuuugauguu

SEQ ID NO: 1022023 - RNA, 22 nt, Human
ccacagagacaggguccuugcu

SEQ ID NO: 1022024 - RNA, 19 nt, Human
gcuucccaccagccagccc

SEQ ID NO: 1022025 - RNA, 22 nt, Human
caggugggagcggagacugauu

SEQ ID NO: 1022026 - RNA, 17 nt, Human
gcucccugaggacagcu

SEQ ID NO: 1022027 - RNA, 22 nt, Human
ggcuuucuagaucuagcucugu

SEQ ID NO: 1022028 - RNA, 22 nt, Human
agggggcccuugcaggugagcg

SEQ ID NO: 1022029 - RNA, 22 nt, Human
guauucauauuaaacauaucaa

SEQ ID NO: 1022030 - RNA, 22 nt, Human
ugcccaaguccuccaccgaggu

SEQ ID NO: 1022031 - RNA, 22 nt, Human
ucauuuuucacacagggucacc

SEQ ID NO: 1022032 - RNA, 22 nt, Human
ggguuccuccaguuccuagagc

SEQ ID NO: 1022033 - RNA, 22 nt, Human
cccccagccagcagugcucagc

SEQ ID NO: 1022034 - RNA, 22 nt, Human
ugcauuccuccaccuccugcac

SEQ ID NO: 1022035 - RNA, 22 nt, Human
cuggaggcacccuuagagaggc

SEQ ID NO: 1022036 - RNA, 18 nt, Human
uucacaggaaaugucuuu

SEQ ID NO: 1022037 - RNA, 22 nt, Human
uuucuucucacccaggacagag

SEQ ID NO: 1022038 - RNA, 22 nt, Human
agcagccauagauagcaugcaa

SEQ ID NO: 1022039 - RNA, 22 nt, Human
acugagcugcaagucagggagg

SEQ ID NO: 1022040 - RNA, 22 nt, Human
gccgaagcugccgucugguccu

SEQ ID NO: 1022041 - RNA, 22 nt, Human
caggaguggugugagggacucc

SEQ ID NO: 1022042 - RNA, 22 nt, Human
caguagcagggauuauuuuagg

SEQ ID NO: 1022043 - RNA, 22 nt, Human
cagcuccugccugggcagcugu

SEQ ID NO: 1022044 - RNA, 22 nt, Human
ugucucugagaugacucccacc

SEQ ID NO: 1022045 - RNA, 22 nt, Human
uuagggcuuuucugaauaggcc

SEQ ID NO: 1022046 - RNA, 22 nt, Human
ucagccugcuccaagugcugcc

SEQ ID NO: 1022047 - RNA, 22 nt, Human
aaagauuuaugaaguucaauua

SEQ ID NO: 1022048 - RNA, 20 nt, Human
ugcagcugguuucacaggga

SEQ ID NO: 1022049 - RNA, 20 nt, Human
uguauauuuucugguguaaa

SEQ ID NO: 1022050 - RNA, 22 nt, Human
acagcuggaggucugugagcac

SEQ ID NO: 1022051 - RNA, 22 nt, Human
gcucccugccuacacggaccuu

SEQ ID NO: 1022052 - RNA, 22 nt, Human
caccaggcuggagugcagaggu

SEQ ID NO: 1022053 - RNA, 22 nt, Human
cuggggcccaucgagggcugag

SEQ ID NO: 1022054 - RNA, 22 nt, Human
agggagcugcucugcuuccgug

SEQ ID NO: 1022055 - RNA, 22 nt, Human
uggaggaaguggcuggccagaa

SEQ ID NO: 1022056 - RNA, 22 nt, Human
agaauguagucuuggagauuua

SEQ ID NO: 1022057 - RNA, 22 nt, Human
uggcucaguuccaucaucugga

SEQ ID NO: 1022058 - RNA, 22 nt, Human
ugauggcuaucccuggaagggc

SEQ ID NO: 1022059 - RNA, 22 nt, Human
aggcaagggggcgccaccuucc

SEQ ID NO: 1022060 - RNA, 22 nt, Human
cugggacagcugagacaggaga

SEQ ID NO: 1022061 - RNA, 22 nt, Human
cacccuggcuggaggugcagug

SEQ ID NO: 1022062 - RNA, 22 nt, Human
ugcagggaaucuguggcuggac

SEQ ID NO: 1022063 - RNA, 22 nt, Human
cccuaggguuuggccagagccc

SEQ ID NO: 1022064 - RNA, 22 nt, Human
acacagccaggguaguaaggcu

SEQ ID NO: 1022065 - RNA, 22 nt, Human
agugcuuugguauagaacuauu

SEQ ID NO: 1022066 - RNA, 21 nt, Human
uagcacuucgcuguaauuggg

SEQ ID NO: 1022067 - RNA, 22 nt, Human
caggaaugaggucguaaguguc

SEQ ID NO: 1022068 - RNA, 22 nt, Human
agucccagacuccaguuuucug

SEQ ID NO: 1022069 - RNA, 19 nt, Human
gccagcagaaugaugaggc

SEQ ID NO: 1022070 - RNA, 22 nt, Human
uggcagggccuaccccaauauc

SEQ ID NO: 1022071 - RNA, 21 nt, Human
ucacuuauaauguauuugcug

SEQ ID NO: 1022072 - RNA, 22 nt, Human
acagauguacacucauauauaa

SEQ ID NO: 1022073 - RNA, 22 nt, Human
auucuuaauugccaugcuguau

SEQ ID NO: 1022074 - RNA, 22 nt, Human
acagaggccucggccugcccag

SEQ ID NO: 1022075 - RNA, 22 nt, Human
cucucugcuguauccuuaggcu

SEQ ID NO: 1022076 - RNA, 22 nt, Human
uggcagcaauuugugauguuga

SEQ ID NO: 1022077 - RNA, 22 nt, Human
uuucuagggcucuugucuucug

SEQ ID NO: 1022078 - RNA, 22 nt, Human
ucagagcuaaggggagagcaaa

SEQ ID NO: 1022079 - RNA, 22 nt, Human
agccucugauggcucccaagga

SEQ ID NO: 1022080 - RNA, 22 nt, Human
ucaccgccuugcccggccgggc

SEQ ID NO: 1022081 - RNA, 18 nt, Human
ggcugagguugacuagaa

SEQ ID NO: 1022082 - RNA, 22 nt, Human
uuucuucauagaccuugucuug

SEQ ID NO: 1022083 - RNA, 22 nt, Human
ugugaaaggagccauagacagu

SEQ ID NO: 1022084 - RNA, 22 nt, Human
gagagcuguaauagucaugucu

SEQ ID NO: 1022085 - RNA, 22 nt, Human
caggccucaggggcucaggcug

SEQ ID NO: 1022086 - RNA, 22 nt, Human
aaugaucuggcucaggauauca

SEQ ID NO: 1022087 - RNA, 22 nt, Human
uaacagaaauauuuccagguga

SEQ ID NO: 1022088 - RNA, 22 nt, Human
gggcugcuuauacugaugauaa

SEQ ID NO: 1022089 - RNA, 22 nt, Human
ucugucucaaguucuugcacuc

SEQ ID NO: 1022090 - RNA, 22 nt, Human
agggaaaggcugaugcuguggg

SEQ ID NO: 1022091 - RNA, 22 nt, Human
cccagcauggagugaggacuca

SEQ ID NO: 1022092 - RNA, 22 nt, Human
gggcagcucucacagcagccaa

SEQ ID NO: 1022093 - RNA, 22 nt, Human
cugacuguaauucuguucuuaa

SEQ ID NO: 1022094 - RNA, 22 nt, Human
uugcauuugagaaaguucuccu

SEQ ID NO: 1022095 - RNA, 22 nt, Human
gagccuggggacccuccugagu

SEQ ID NO: 1022096 - RNA, 19 nt, Human
ugccuggcaccagcuccac

SEQ ID NO: 1022097 - RNA, 22 nt, Human
gguuauauaauucagugcuuuc

SEQ ID NO: 1022098 - RNA, 22 nt, Human
uacccagcuucaagucaggacu

SEQ ID NO: 1022099 - RNA, 22 nt, Human
ugggcuguggagcaccuuugca

SEQ ID NO: 1022100 - RNA, 22 nt, Human
uuguaacacuuuucuauuaaua

SEQ ID NO: 1022101 - RNA, 22 nt, Human
uuguuaaaaugcauauucuggu

SEQ ID NO: 1022102 - RNA, 21 nt, Human
ugggcagauggcaguguggcu

SEQ ID NO: 1022103 - RNA, 22 nt, Human
ucaagagagugcugcuuggggu

SEQ ID NO: 1022104 - RNA, 22 nt, Human
uggcucagagccuugagagcug

SEQ ID NO: 1022105 - RNA, 22 nt, Human
gagcuuuaggagaaggagguca

SEQ ID NO: 1022106 - RNA, 22 nt, Human
uuuuccuguccaggcaauuauu

SEQ ID NO: 1022107 - RNA, 22 nt, Human
auauucuuccaaaacaucauuu

SEQ ID NO: 1022108 - RNA, 20 nt, Human
cccuggccuguuucaugccc

SEQ ID NO: 1022109 - RNA, 22 nt, Human
gagggucccgagcccugucaga

SEQ ID NO: 1022110 - RNA, 22 nt, Human
ccugccugguguaagucuaagg

SEQ ID NO: 1022111 - RNA, 22 nt, Human
ggaggccaaggcagguggaucg

SEQ ID NO: 1022112 - RNA, 22 nt, Human
gauggggaugagaagugagcag

SEQ ID NO: 1022113 - RNA, 19 nt, Human
acagaagcauagaaaagga

SEQ ID NO: 1022114 - RNA, 22 nt, Human
gcugauuauuacaugucugugg

SEQ ID NO: 1022115 - RNA, 22 nt, Human
cuggaagaggaagccagcugga

SEQ ID NO: 1022116 - RNA, 22 nt, Human
cauuucuguucucuuccuguac

SEQ ID NO: 1022117 - RNA, 23 nt, Human
aggaacugaggccuagggaggua

SEQ ID NO: 1022118 - RNA, 22 nt, Human
uacucagagucauugcccuucu

SEQ ID NO: 1022119 - RNA, 22 nt, Human
acagggcagugucuugaaaaau

SEQ ID NO: 1022120 - RNA, 22 nt, Human
agagaaaagaguucaggcuuug

SEQ ID NO: 1022121 - RNA, 23 nt, Human
ccucagcauggcaggagcccagc

SEQ ID NO: 1022122 - RNA, 22 nt, Human
aaauugugagcuauagaucuag

SEQ ID NO: 1022123 - RNA, 22 nt, Human
ucagagagaaauaguuuuugac

SEQ ID NO: 1022124 - RNA, 22 nt, Human
uuucauggcuaggacuagagug

SEQ ID NO: 1022125 - RNA, 22 nt, Human
ucagagaguuagugucuuagcu

SEQ ID NO: 1022126 - RNA, 22 nt, Human
guugaaagagcauggacuugaa

SEQ ID NO: 1022127 - RNA, 22 nt, Human
uccagcagaccaucaaggcuca

SEQ ID NO: 1022128 - RNA, 22 nt, Human
aucuucaaagggauguccaugg

SEQ ID NO: 1022129 - RNA, 22 nt, Human
uggcagcagccauggaaggccc

SEQ ID NO: 1022130 - RNA, 22 nt, Human
ggcucaggggccaggccugucc

SEQ ID NO: 1022131 - RNA, 22 nt, Human
acugcagggcauccuggccaag

SEQ ID NO: 1022132 - RNA, 22 nt, Human
gggaccugccauugcucacagg

SEQ ID NO: 1022133 - RNA, 22 nt, Human
uggcucaggcuugaaaauagau

SEQ ID NO: 1022134 - RNA, 22 nt, Human
ggaggcucugcuccguguguuc

SEQ ID NO: 1022135 - RNA, 22 nt, Human
uugcacagaugagggugaugcu

SEQ ID NO: 1022136 - RNA, 22 nt, Human
cuggguggcuguccagccagcc

SEQ ID NO: 1022137 - RNA, 22 nt, Human
uggugcugacaguucugagugc

SEQ ID NO: 1022138 - RNA, 22 nt, Human
uuccauuuauucuuguccagau

SEQ ID NO: 1022139 - RNA, 21 nt, Human
agacaguaacucuucuacucc

SEQ ID NO: 1022140 - RNA, 22 nt, Human
caguguccucagccagcagcua

SEQ ID NO: 1022141 - RNA, 22 nt, Human
uguggcugucuguucuccuagg

SEQ ID NO: 1022142 - RNA, 20 nt, Human
uccaggcagcucagaguguc

SEQ ID NO: 1022143 - RNA, 22 nt, Human
uggccggggcugauggacagug

SEQ ID NO: 1022144 - RNA, 22 nt, Human
auugcuguacacuucuagaucu

SEQ ID NO: 1022145 - RNA, 19 nt, Human
ugcugcuguccuugcaggg

SEQ ID NO: 1022146 - RNA, 22 nt, Human
guauucuugguuaucaaaauac

SEQ ID NO: 1022147 - RNA, 22 nt, Human
ugaauggucacugagcaucugu

SEQ ID NO: 1022148 - RNA, 22 nt, Human
auccagucaaaauuaguaaggu

SEQ ID NO: 1022149 - RNA, 22 nt, Human
cacaagucuguggucuccaaca

SEQ ID NO: 1022150 - RNA, 22 nt, Human
uuugacaggacuaacauauggc

SEQ ID NO: 1022151 - RNA, 22 nt, Human
ggagcugcuccuucagccaagu

SEQ ID NO: 1022152 - RNA, 22 nt, Human
cugccaggacugacgucuucag

SEQ ID NO: 1022153 - RNA, 22 nt, Human
gcuggagccaagcugcucuugg

SEQ ID NO: 1022154 - RNA, 22 nt, Human
ugcucuucggggccacugcuug

SEQ ID NO: 1022155 - RNA, 22 nt, Human
auaguacacauccuacaauguu

SEQ ID NO: 1022156 - RNA, 23 nt, Human
uuacuuuugcaccaaccuaauau

SEQ ID NO: 1022157 - RNA, 22 nt, Human
uuugcauuuguuuagaaccuga

SEQ ID NO: 1022158 - RNA, 22 nt, Human
agaccaagaaaggaugaggauc

SEQ ID NO: 1022159 - RNA, 23 nt, Human
uggugccucagaagcagugggcu

SEQ ID NO: 1022160 - RNA, 22 nt, Human
aagcacuuagaagagugccugc

SEQ ID NO: 1022161 - RNA, 22 nt, Human
agaggcccucucugcucagucu

SEQ ID NO: 1022162 - RNA, 22 nt, Human
gugguuuugccauuacaaguaa

SEQ ID NO: 1022163 - RNA, 22 nt, Human
gcugcagcccggcgcgccugag

SEQ ID NO: 1022164 - RNA, 22 nt, Human
cuguaguugaugauuucugaua

SEQ ID NO: 1022165 - RNA, 22 nt, Human
cagggccuuuuagcaucuucuc

SEQ ID NO: 1022166 - RNA, 22 nt, Human
aauuagggaaaacauuugcuuu

SEQ ID NO: 1022167 - RNA, 22 nt, Human
uuugacauuauccuguuacugg

SEQ ID NO: 1022168 - RNA, 22 nt, Human
acugggccggugcagaguaguu

SEQ ID NO: 1022169 - RNA, 22 nt, Human
caagugucuauaucagugcuug

SEQ ID NO: 1022170 - RNA, 22 nt, Human
uuccauauuuguguggcaaaag

SEQ ID NO: 1022171 - RNA, 22 nt, Human
uggcucagcugucacagccugg

SEQ ID NO: 1022172 - RNA, 22 nt, Human
gaauuguacgcuuuacauaggu

SEQ ID NO: 1022173 - RNA, 22 nt, Human
cugccugugcaugcagucagaa

SEQ ID NO: 1022174 - RNA, 22 nt, Human
aguuuauguagaauuggcaaua

SEQ ID NO: 1022175 - RNA, 22 nt, Human
cuggcugcgucugcucugacag

SEQ ID NO: 1022176 - RNA, 22 nt, Human
gcacagcaauuucuauaagcuc

SEQ ID NO: 1022177 - RNA, 22 nt, Human
cuggagccagccagggcccucu

SEQ ID NO: 1022178 - RNA, 22 nt, Human
uggcucagcgguggcagcagac

SEQ ID NO: 1022179 - RNA, 20 nt, Human
gugcauuucaccuguacugu

SEQ ID NO: 1022180 - RNA, 22 nt, Human
ucuuuccuuagaauaauucuuu

SEQ ID NO: 1022181 - RNA, 21 nt, Human
gagcucucaggcaagaagcag

SEQ ID NO: 1022182 - RNA, 22 nt, Human
ugucccaggcugaaguacagug

SEQ ID NO: 1022183 - RNA, 22 nt, Human
ggcugucucugugacugccacc

SEQ ID NO: 1022184 - RNA, 22 nt, Human
gccagcugcaucuccugggcug

SEQ ID NO: 1022185 - RNA, 22 nt, Human
agaagccauugaagcagaccuc

SEQ ID NO: 1022186 - RNA, 23 nt, Human
ugcagggcaaguuagagacccca

SEQ ID NO: 1022187 - RNA, 22 nt, Human
agcccccaaaagugcuuaugau

SEQ ID NO: 1022188 - RNA, 22 nt, Human
cccugcagagagugcuuuugug

SEQ ID NO: 1022189 - RNA, 22 nt, Human
aaagagcuucauuuccauuuau

SEQ ID NO: 1022190 - RNA, 22 nt, Human
agggggcaggagagaccugcug

SEQ ID NO: 1022191 - RNA, 22 nt, Human
uagggcagccuuauagcuccca

SEQ ID NO: 1022192 - RNA, 22 nt, Human
ugcagcuccucuggcugccuga

SEQ ID NO: 1022193 - RNA, 22 nt, Human
acauuugaggauguuaagaaug

SEQ ID NO: 1022194 - RNA, 22 nt, Human
gucaggaugggcagccaaacua

SEQ ID NO: 1022195 - RNA, 22 nt, Human
uuauuaggaaaaggucagaugu

SEQ ID NO: 1022196 - RNA, 22 nt, Human
ugaaacuuauaagaauaugaau

SEQ ID NO: 1022197 - RNA, 20 nt, Human
gugugaagcccucaggagga

SEQ ID NO: 1022198 - RNA, 22 nt, Human
cucaggauauugggcuggagca

SEQ ID NO: 1022199 - RNA, 22 nt, Human
uugcauugaaugcacauuuuua

SEQ ID NO: 1022200 - RNA, 22 nt, Human
uaaaaguggauaagcuguagga

SEQ ID NO: 1022201 - RNA, 22 nt, Human
aacaguaucuuuuaucagaaau

SEQ ID NO: 1022202 - RNA, 22 nt, Human
ucacaaauagcuauauuaagga

SEQ ID NO: 1022203 - RNA, 22 nt, Human
agauaugugcgucuuagauuga

SEQ ID NO: 1022204 - RNA, 22 nt, Human
auguaagguucagaguauguga

SEQ ID NO: 1022205 - RNA, 22 nt, Human
cugcucugagaggcucuuccua

SEQ ID NO: 1022206 - RNA, 22 nt, Human
uaacacauuuuccucauacgga

SEQ ID NO: 1022207 - RNA, 20 nt, Human
cccaggagugagcagcuuua

SEQ ID NO: 1022208 - RNA, 22 nt, Human
ggcugagcaauuuugaugacau

SEQ ID NO: 1022209 - RNA, 17 nt, Human
ucuguucaugcauaccu

SEQ ID NO: 1022210 - RNA, 22 nt, Human
agagcugaggauccagcugagc

SEQ ID NO: 1022211 - RNA, 21 nt, Human
uuugaaagugggugauucuuu

SEQ ID NO: 1022212 - RNA, 22 nt, Human
agccucugcuuaugcaaaggua

SEQ ID NO: 1022213 - RNA, 22 nt, Human
agaagaaacugucggggauauu

SEQ ID NO: 1022214 - RNA, 22 nt, Human
auaccuuuuagacauguaguug

SEQ ID NO: 1022215 - RNA, 22 nt, Human
agagggcauuaacucugucuug

SEQ ID NO: 1022216 - RNA, 22 nt, Human
cuucuccucugaguccugggag

SEQ ID NO: 1022217 - RNA, 22 nt, Human
agcaguggccuggggcucugug

SEQ ID NO: 1022218 - RNA, 22 nt, Human
aggccugagguuccugugcuca

SEQ ID NO: 1022219 - RNA, 22 nt, Human
cccagccugucuuucccaauga

SEQ ID NO: 1022220 - RNA, 22 nt, Human
gcuguucaaaagccacaguuac

SEQ ID NO: 1022221 - RNA, 22 nt, Human
aaauguguuucgaaaacuggug

SEQ ID NO: 1022222 - RNA, 22 nt, Human
ucugaggcauaaccuguucugc

SEQ ID NO: 1022223 - RNA, 22 nt, Human
uguauaaaccauggacagcuuu

SEQ ID NO: 1022224 - RNA, 22 nt, Human
cagguaagagacggauuggccc

SEQ ID NO: 1022225 - RNA, 22 nt, Human
gcagcugcagguggucccaugc

SEQ ID NO: 1022226 - RNA, 22 nt, Human
ugcuggcucaguuugcagacuc

SEQ ID NO: 1022227 - RNA, 22 nt, Human
aaagcugcugccaaucaggcuu

SEQ ID NO: 1022228 - RNA, 18 nt, Human
aguaguggguuuagcuuc

SEQ ID NO: 1022229 - RNA, 22 nt, Human
acagauugaucuugagaauuau

SEQ ID NO: 1022230 - RNA, 22 nt, Human
guguaugaggggagaauguuuu

SEQ ID NO: 1022231 - RNA, 22 nt, Human
aguuacuugagacguuuaugaa

SEQ ID NO: 1022232 - RNA, 22 nt, Human
cauaauaucuccgauuacuugc

SEQ ID NO: 1022233 - RNA, 22 nt, Human
uccuucagcuuauuucuuagga

SEQ ID NO: 1022234 - RNA, 20 nt, Human
uccaagggcagcagaaucag

SEQ ID NO: 1022235 - RNA, 22 nt, Human
aggccuguuggcgugggcucua

SEQ ID NO: 1022236 - RNA, 22 nt, Human
gccaggcuggugcaaggauauu

SEQ ID NO: 1022237 - RNA, 22 nt, Human
cuuugaaaacuuaaauaacagc

SEQ ID NO: 1022238 - RNA, 22 nt, Human
aaucuucuuucuuaacaguaca

SEQ ID NO: 1022239 - RNA, 19 nt, Human
ucaucucacagggccuggc

SEQ ID NO: 1022240 - RNA, 20 nt, Human
cagagcugggauuugaacac

SEQ ID NO: 1022241 - RNA, 22 nt, Human
ccugccugcaccuucucugggg

SEQ ID NO: 1022242 - RNA, 22 nt, Human
gugcugucguggaacugggcug

SEQ ID NO: 1022243 - RNA, 22 nt, Human
agaugguuuugucuuuaugauu

SEQ ID NO: 1022244 - RNA, 22 nt, Human
ugaagcagaggggucuugagcu

SEQ ID NO: 1022245 - RNA, 22 nt, Human
cauugcuuccuaugucccuucu

SEQ ID NO: 1022246 - RNA, 22 nt, Human
aucugccuggcuccaggugagc

SEQ ID NO: 1022247 - RNA, 22 nt, Human
aaagauuucagaagccugugcc

SEQ ID NO: 1022248 - RNA, 22 nt, Human
ugcagggagcucuggggugcag

SEQ ID NO: 1022249 - RNA, 22 nt, Human
ucuggccuacuggaguccauga

SEQ ID NO: 1022250 - RNA, 22 nt, Human
uucuucaauuuuccauauacug

SEQ ID NO: 1022251 - RNA, 22 nt, Human
ugugggcucccccucacucugu

SEQ ID NO: 1022252 - RNA, 22 nt, Human
cagcugcccaagccccagaugu

SEQ ID NO: 1022253 - RNA, 23 nt, Human
ccagccucugggucuucauccag

SEQ ID NO: 1022254 - RNA, 20 nt, Human
uaagaacaagacuaggaagc

SEQ ID NO: 1022255 - RNA, 19 nt, Human
cugggagguguucagagaa

SEQ ID NO: 1022256 - RNA, 22 nt, Human
uucuggagagaaaccuuacaaa

SEQ ID NO: 1022257 - RNA, 22 nt, Human
uggagcagagaugguggccuuc

SEQ ID NO: 1022258 - RNA, 22 nt, Human
ucacaucucccuggaggacaca

SEQ ID NO: 1022259 - RNA, 22 nt, Human
aauacauauggaauuccauguu

SEQ ID NO: 1022260 - RNA, 22 nt, Human
cagcacugcuucgcagccaggg

SEQ ID NO: 1022261 - RNA, 22 nt, Human
aguuauaugugaaaacacguau

SEQ ID NO: 1022262 - RNA, 22 nt, Human
agcaguccaacugagguggcau

SEQ ID NO: 1022263 - RNA, 22 nt, Human
gacacauagaucuaucucacuc

SEQ ID NO: 1022264 - RNA, 22 nt, Human
ucccaggguccucuucuggaau

SEQ ID NO: 1022265 - RNA, 22 nt, Human
guucuucaguaaaauuaaaugu

SEQ ID NO: 1022266 - RNA, 22 nt, Human
caggcugcagaggccuuucaug

SEQ ID NO: 1022267 - RNA, 22 nt, Human
caggucccgccccgggcugacc

SEQ ID NO: 1022268 - RNA, 22 nt, Human
ggggcuguuuuuggaauggcug

SEQ ID NO: 1022269 - RNA, 19 nt, Human
uucauucuuucuacuuacc

SEQ ID NO: 1022270 - RNA, 22 nt, Human
aaagaauagccuuuguccaaau

SEQ ID NO: 1022271 - RNA, 22 nt, Human
cagaagcagugagagaugugca

SEQ ID NO: 1022272 - RNA, 22 nt, Human
aaaugugucaguuucauucucu

SEQ ID NO: 1022273 - RNA, 22 nt, Human
auuucucagcacuuccuaucuc

SEQ ID NO: 1022274 - RNA, 20 nt, Human
cuuagaaauuuuuacccugg

SEQ ID NO: 1022275 - RNA, 22 nt, Human
cagcauuuaucuuguagcagga

SEQ ID NO: 1022276 - RNA, 22 nt, Human
ggucucuguugccuccaucaag

SEQ ID NO: 1022277 - RNA, 22 nt, Human
ucagcuuuggucacauugaguu

SEQ ID NO: 1022278 - RNA, 22 nt, Human
ucaguagcagaaagcaaugagu

SEQ ID NO: 1022279 - RNA, 22 nt, Human
ggcagcucugaugaugcucugg

SEQ ID NO: 1022280 - RNA, 22 nt, Human
gagaggcugaaaucacaggagc

SEQ ID NO: 1022281 - RNA, 22 nt, Human
cugugcuggagaugggccagag

SEQ ID NO: 1022282 - RNA, 22 nt, Human
acuuccuggcguagcugacauu

SEQ ID NO: 1022283 - RNA, 22 nt, Human
ugaccaaaggugguuuauuugg

SEQ ID NO: 1022284 - RNA, 22 nt, Human
cugggaggacaacuuggagcuc

SEQ ID NO: 1022285 - RNA, 18 nt, Human
ucugucucuguccuugcu

SEQ ID NO: 1022286 - RNA, 22 nt, Human
ugcaugugcccacucuggcuua

SEQ ID NO: 1022287 - RNA, 22 nt, Human
gguggccugcccugaucccugg

SEQ ID NO: 1022288 - RNA, 22 nt, Human
aaauuauuaugccccucuauaa

SEQ ID NO: 1022289 - RNA, 22 nt, Human
ugaaaugauaucugauaacaaa

SEQ ID NO: 1022290 - RNA, 20 nt, Human
accuuucaaaugauucagca

SEQ ID NO: 1022291 - RNA, 22 nt, Human
agaaaacauuacauaggugugu

SEQ ID NO: 1022292 - RNA, 22 nt, Human
cucagaagccuucagucuuggc

SEQ ID NO: 1022293 - RNA, 22 nt, Human
ugcagggcuacaggacuacaac

SEQ ID NO: 1022294 - RNA, 22 nt, Human
acaugauuaaaagauuuuaaag

SEQ ID NO: 1022295 - RNA, 22 nt, Human
uugacacagaucaauauucaac

SEQ ID NO: 1022296 - RNA, 22 nt, Human
agaguggggaagguguugagaa

SEQ ID NO: 1022297 - RNA, 22 nt, Human
ugaagcaggaaccagcagcauu

SEQ ID NO: 1022298 - RNA, 22 nt, Human
aagacauugucauuuuauaauu

SEQ ID NO: 1022299 - RNA, 22 nt, Human
gcaggcaggagcccaacugccu

SEQ ID NO: 1022300 - RNA, 22 nt, Human
agcugcucuugggugacuucaa

SEQ ID NO: 1022301 - RNA, 22 nt, Human
gugauaaaauucaaauagcucu

SEQ ID NO: 1022302 - RNA, 22 nt, Human
cggggcugcucguccuccugug

SEQ ID NO: 1022303 - RNA, 22 nt, Human
gccagcagccacagaagucacu

SEQ ID NO: 1022304 - RNA, 22 nt, Human
aauuucagaccauuugcaauua

SEQ ID NO: 1022305 - RNA, 22 nt, Human
uuccaagagcuuuaauuguuga

SEQ ID NO: 1022306 - RNA, 22 nt, Human
caaaugaagaaccuucucaccu

SEQ ID NO: 1022307 - RNA, 22 nt, Human
ucaagagauugaauaauaacug

SEQ ID NO: 1022308 - RNA, 22 nt, Human
agggcagccaugagccuucagg

SEQ ID NO: 1022309 - RNA, 22 nt, Human
agaaauguggaucguuuuaaaa

SEQ ID NO: 1022310 - RNA, 22 nt, Human
uucugucaaacucacaggccga

SEQ ID NO: 1022311 - RNA, 17 nt, Human
cuggagccaagagggcc

SEQ ID NO: 1022312 - RNA, 22 nt, Human
caggaggaacaagagguucugg

SEQ ID NO: 1022313 - RNA, 22 nt, Human
ugggccuccaauuccagcggga

SEQ ID NO: 1022314 - RNA, 23 nt, Human
gcugagguacauuuacaggaaga

SEQ ID NO: 1022315 - RNA, 22 nt, Human
uuccauaaugagauucccagcc

SEQ ID NO: 1022316 - RNA, 22 nt, Human
ccagcugcugugcagggaggcu

SEQ ID NO: 1022317 - RNA, 22 nt, Human
cagcugccuguauuguccucau

SEQ ID NO: 1022318 - RNA, 20 nt, Human
aagcaauauagugcaaaugu

SEQ ID NO: 1022319 - RNA, 22 nt, Human
gagacauggcaaaagcacuggu

SEQ ID NO: 1022320 - RNA, 22 nt, Human
agaggccuccgaaaggugggcu

SEQ ID NO: 1022321 - RNA, 22 nt, Human
cuugaauccaaaugggagauga

SEQ ID NO: 1022322 - RNA, 22 nt, Human
cuugaaagauuuggccucugug

SEQ ID NO: 1022323 - RNA, 22 nt, Human
agggcacaagacucugagcccc

SEQ ID NO: 1022324 - RNA, 22 nt, Human
aagcacaaugaacaucuuagau

SEQ ID NO: 1022325 - RNA, 22 nt, Human
aucuuccuucacuuucucccac

SEQ ID NO: 1022326 - RNA, 22 nt, Human
gccaggugcauggcugagucuc

SEQ ID NO: 1022327 - RNA, 22 nt, Human
agugggaggcggcugacgggcg

SEQ ID NO: 1022328 - RNA, 22 nt, Human
uucuaacucuguuauguguuuc

SEQ ID NO: 1022329 - RNA, 22 nt, Human
gcaggaguguggugggacaucc

SEQ ID NO: 1022330 - RNA, 22 nt, Human
cugggccucaaucucagaguuu

SEQ ID NO: 1022331 - RNA, 22 nt, Human
ucagggcaagucucagaagguu

SEQ ID NO: 1022332 - RNA, 22 nt, Human
cacauuucuaggaaauuaaaug

SEQ ID NO: 1022333 - RNA, 22 nt, Human
gaccucagugaauggucaugua

SEQ ID NO: 1022334 - RNA, 22 nt, Human
uagugcuuuaaguuuacagaga

SEQ ID NO: 1022335 - RNA, 22 nt, Human
aaugagcugcugcuguuccacc

SEQ ID NO: 1022336 - RNA, 22 nt, Human
ugggacugcucuugcugggguc

SEQ ID NO: 1022337 - RNA, 22 nt, Human
ucagaacagaagaaggaacacg

SEQ ID NO: 1022338 - RNA, 22 nt, Human
ugaagcagagugaaggugaauu

SEQ ID NO: 1022339 - RNA, 22 nt, Human
uccaggcaucuguauuuuuuaa

SEQ ID NO: 1022340 - RNA, 22 nt, Human
cugcuguggaugcaggaccuca

SEQ ID NO: 1022341 - RNA, 22 nt, Human
agggaaaguaagcauuucauua

SEQ ID NO: 1022342 - RNA, 22 nt, Human
ugcuucuggaaacaguggcugu

SEQ ID NO: 1022343 - RNA, 22 nt, Human
aucaguuuaaaugggcuguugg

SEQ ID NO: 1022344 - RNA, 22 nt, Human
uuauuagggugguuuauguucu

SEQ ID NO: 1022345 - RNA, 18 nt, Human
cucucuggucuggauccc

SEQ ID NO: 1022346 - RNA, 19 nt, Human
agggagaauuccaagagga

SEQ ID NO: 1022347 - RNA, 22 nt, Human
uucuguuuuagaaauaaguagu

SEQ ID NO: 1022348 - RNA, 22 nt, Human
cagcugucuaaguugagcagga

SEQ ID NO: 1022349 - RNA, 22 nt, Human
uacaguaaccuuauuugucauu

SEQ ID NO: 1022350 - RNA, 22 nt, Human
cagagcuggccugugauuuuug

SEQ ID NO: 1022351 - RNA, 22 nt, Human
gggcuccaacggugagcaugga

SEQ ID NO: 1022352 - RNA, 22 nt, Human
ggcuccugaaagacuaugggaa

SEQ ID NO: 1022353 - RNA, 22 nt, Human
agccagaggccagccugccuca

SEQ ID NO: 1022354 - RNA, 22 nt, Human
caggacagagcccagacugugu

SEQ ID NO: 1022355 - RNA, 22 nt, Human
aaacagcugucauuguuuuaaa

SEQ ID NO: 1022356 - RNA, 22 nt, Human
cuccagggcagcauggcagugg

SEQ ID NO: 1022357 - RNA, 22 nt, Human
uucuuguaauuuggagaaauga

SEQ ID NO: 1022358 - RNA, 22 nt, Human
uuuccuuccagguuccuaaggc

SEQ ID NO: 1022359 - RNA, 22 nt, Human
ccagcuccaggacugggagcug

SEQ ID NO: 1022360 - RNA, 21 nt, Human
gacaaagugaagcaggcagga

SEQ ID NO: 1022361 - RNA, 22 nt, Human
cacauuuaaagguugaagcuga

SEQ ID NO: 1022362 - RNA, 22 nt, Human
ggagacaguauggcuuguagcu

SEQ ID NO: 1022363 - RNA, 22 nt, Human
cagggcagggagcuuagaauga

SEQ ID NO: 1022364 - RNA, 22 nt, Human
ugaaugauacagaauuauguag

SEQ ID NO: 1022365 - RNA, 22 nt, Human
uauuuucuggacagucuugcuu

SEQ ID NO: 1022366 - RNA, 23 nt, Human
uugcuucugugcaauucaguacu

SEQ ID NO: 1022367 - RNA, 21 nt, Human
acagacagggccagugucccc

SEQ ID NO: 1022368 - RNA, 21 nt, Human
aauaaaacaguuggugucaau

SEQ ID NO: 1022369 - RNA, 22 nt, Human
cuggcagcuucaggacacucgg

SEQ ID NO: 1022370 - RNA, 22 nt, Human
gcagggcagccacaggcccccu

SEQ ID NO: 1022371 - RNA, 22 nt, Human
gcucucuggaggccauggacag

SEQ ID NO: 1022372 - RNA, 22 nt, Human
cuuccugcauugugccagaguu

SEQ ID NO: 1022373 - RNA, 22 nt, Human
uauuuccaaaagccuauuauga

SEQ ID NO: 1022374 - RNA, 22 nt, Human
cagagccccucagcucucuccc

SEQ ID NO: 1022375 - RNA, 22 nt, Human
aaaugcacacaccaggaaacua

SEQ ID NO: 1022376 - RNA, 22 nt, Human
uaugaacucuggagucugagug

SEQ ID NO: 1022377 - RNA, 22 nt, Human
cugugcccuggccaggccucuc

SEQ ID NO: 1022378 - RNA, 22 nt, Human
ucacaggagggagagacaccca

SEQ ID NO: 1022379 - RNA, 22 nt, Human
ugcuuuaucugacuuggcgcug

SEQ ID NO: 1022380 - RNA, 22 nt, Human
uccacugcagcuucugauggaa

SEQ ID NO: 1022381 - RNA, 22 nt, Human
gcuggagcugaguucccugggc

SEQ ID NO: 1022382 - RNA, 22 nt, Human
gccacccccaaguagguggucu

SEQ ID NO: 1022383 - RNA, 19 nt, Human
guggccugcgcugggugcg

SEQ ID NO: 1022384 - RNA, 22 nt, Human
uggcacugggaugcuacuguua

SEQ ID NO: 1022385 - RNA, 22 nt, Human
augcugagugagugaaacccag

SEQ ID NO: 1022386 - RNA, 22 nt, Human
uaaguucaagucuuggauauaa

SEQ ID NO: 1022387 - RNA, 22 nt, Human
uagauauggccgucuguuuuaa

SEQ ID NO: 1022388 - RNA, 22 nt, Human
aaggcaggaugcggacccaucu

SEQ ID NO: 1022389 - RNA, 22 nt, Human
agcuggcagucauccuagugag

SEQ ID NO: 1022390 - RNA, 22 nt, Human
agucuugcauuuucugaagaug

SEQ ID NO: 1022391 - RNA, 22 nt, Human
ugcucugcaagcaggagcaaga

SEQ ID NO: 1022392 - RNA, 22 nt, Human
gcagagaggaaugaagccaucc

SEQ ID NO: 1022393 - RNA, 22 nt, Human
gcugccacuuggucaugucaug

SEQ ID NO: 1022394 - RNA, 22 nt, Human
aaggcagcaccgccuccugaaa

SEQ ID NO: 1022395 - RNA, 22 nt, Human
cacugccugugagcugugugcc

SEQ ID NO: 1022396 - RNA, 22 nt, Human
ucuggcucuguguccccaccca

SEQ ID NO: 1022397 - RNA, 22 nt, Human
auuagggaaacugacuugucuc

SEQ ID NO: 1022398 - RNA, 22 nt, Human
ugcagggccuucuagaccaugg

SEQ ID NO: 1022399 - RNA, 22 nt, Human
cugcuguggguuaagacacugu

SEQ ID NO: 1022400 - RNA, 22 nt, Human
uuucucaguuacuagcuguggu

SEQ ID NO: 1022401 - RNA, 22 nt, Human
ucaaggugcugugcugugcuag

SEQ ID NO: 1022402 - RNA, 22 nt, Human
uccaguucuaggucacucucug

SEQ ID NO: 1022403 - RNA, 22 nt, Human
aaaguuguaauggaagaaaugc

SEQ ID NO: 1022404 - RNA, 22 nt, Human
caagauggacauaaggagagaa

SEQ ID NO: 1022405 - RNA, 22 nt, Human
accuuucacgguaucagacauc

SEQ ID NO: 1022406 - RNA, 22 nt, Human
cacugaagcuuucauucucuug

SEQ ID NO: 1022407 - RNA, 22 nt, Human
gcugguaggaagugcuccugcc

SEQ ID NO: 1022408 - RNA, 22 nt, Human
uagaauaugugguaggaucugg

SEQ ID NO: 1022409 - RNA, 22 nt, Human
auaaaguuuaaaagucaauagu

SEQ ID NO: 1022410 - RNA, 18 nt, Human
cuguccaguagacucugc

SEQ ID NO: 1022411 - RNA, 22 nt, Human
uuauuauuuuguguacagcaaa

SEQ ID NO: 1022412 - RNA, 22 nt, Human
cuacauuuuucaccgagccucu

SEQ ID NO: 1022413 - RNA, 22 nt, Human
ucucuucuugauuuucacugga

SEQ ID NO: 1022414 - RNA, 22 nt, Human
cagggccagcgcccaggcccag

SEQ ID NO: 1022415 - RNA, 22 nt, Human
uaaggcacgcauaagagggggc

SEQ ID NO: 1022416 - RNA, 22 nt, Human
ucuggcuccacaccucacugca

SEQ ID NO: 1022417 - RNA, 22 nt, Human
cugcaggaauucaaagugagcu

SEQ ID NO: 1022418 - RNA, 22 nt, Human
aacuacauuguccuuucugaag

SEQ ID NO: 1022419 - RNA, 22 nt, Human
gagauuggauuuaauggccaaa

SEQ ID NO: 1022420 - RNA, 22 nt, Human
agcagggcugcagugugucuuu

SEQ ID NO: 1022421 - RNA, 22 nt, Human
cagggcuggauccuccagacuc

SEQ ID NO: 1022422 - RNA, 22 nt, Human
gggcuucucccuaaggacucug

SEQ ID NO: 1022423 - RNA, 22 nt, Human
cagcuggcuggucagugcacaa

SEQ ID NO: 1022424 - RNA, 20 nt, Human
uguucacaguaguugcugcu

SEQ ID NO: 1022425 - RNA, 22 nt, Human
auacaacuuuaucuguaaugag

SEQ ID NO: 1022426 - RNA, 22 nt, Human
gcugagaguguaggauguuuac

SEQ ID NO: 1022427 - RNA, 22 nt, Human
uaugacuuauuucaucaguucu

SEQ ID NO: 1022428 - RNA, 22 nt, Human
cagggcucuucaucacacagua

SEQ ID NO: 1022429 - RNA, 20 nt, Human
uggcuccucuuggcuguggc

SEQ ID NO: 1022430 - RNA, 22 nt, Human
ucucaggccccugaguuucucu

SEQ ID NO: 1022431 - RNA, 22 nt, Human
ggugauuuucgaguuucauguu

SEQ ID NO: 1022432 - RNA, 20 nt, Human
gccuguccugagugucaugg

SEQ ID NO: 1022433 - RNA, 22 nt, Human
ugucacagggauaccauggggc

SEQ ID NO: 1022434 - RNA, 22 nt, Human
gugccuuccccgguggucuguu

SEQ ID NO: 1022435 - RNA, 22 nt, Human
ggcugcucuucuuggcgaccuc

SEQ ID NO: 1022436 - RNA, 22 nt, Human
ugguccagaugccuuggcuuua

SEQ ID NO: 1022437 - RNA, 22 nt, Human
augauauuugcaaugugcuugc

SEQ ID NO: 1022438 - RNA, 22 nt, Human
cugagccaaaaagcagagcuug

SEQ ID NO: 1022439 - RNA, 22 nt, Human
ccucauggccuugagcugaggg

SEQ ID NO: 1022440 - RNA, 22 nt, Human
uguguacaggccuugcuagacu

SEQ ID NO: 1022441 - RNA, 22 nt, Human
uucaaaggcaggauagcagcug

SEQ ID NO: 1022442 - RNA, 23 nt, Human
ccuggcuggauucucugcauuca

SEQ ID NO: 1022443 - RNA, 22 nt, Human
ggcagcugugaagugccucaca

SEQ ID NO: 1022444 - RNA, 22 nt, Human
ucuacccagagcuaugaccuga

SEQ ID NO: 1022445 - RNA, 22 nt, Human
cucuucuugccugaugaggcag

SEQ ID NO: 1022446 - RNA, 22 nt, Human
ggcagcuccucaaaaaauuaaa

SEQ ID NO: 1022447 - RNA, 22 nt, Human
gaaaucugaaucuucuguuggu

SEQ ID NO: 1022448 - RNA, 22 nt, Human
agacuucucaguuuuauuagua

SEQ ID NO: 1022449 - RNA, 22 nt, Human
cuggcuucugggccagggcaga

SEQ ID NO: 1022450 - RNA, 22 nt, Human
aggagcuggaguccaggcaagu

SEQ ID NO: 1022451 - RNA, 23 nt, Human
ugggaccuguuugcccacagaug

SEQ ID NO: 1022452 - RNA, 22 nt, Human
uuugaauguuuuagguacuuaa

SEQ ID NO: 1022453 - RNA, 22 nt, Human
accaggcagagcugggccuuaa

SEQ ID NO: 1022454 - RNA, 22 nt, Human
agcacaggaccaaggaagcugu

SEQ ID NO: 1022455 - RNA, 20 nt, Human
ccucaggaugagggugagca

SEQ ID NO: 1022456 - RNA, 18 nt, Human
cggcagagugcuucuagc

SEQ ID NO: 1022457 - RNA, 22 nt, Human
agcuugccucuuaaucaccuca

SEQ ID NO: 1022458 - RNA, 22 nt, Human
cugaggucuagacaccccaggg

SEQ ID NO: 1022459 - RNA, 22 nt, Human
cugggccugguagggcuugaaa

SEQ ID NO: 1022460 - RNA, 22 nt, Human
guuguuuugcaggauccuuaca

SEQ ID NO: 1022461 - RNA, 22 nt, Human
cccaggacucuucacugcagcc

SEQ ID NO: 1022462 - RNA, 22 nt, Human
ugcagggacaggcucuggggau

SEQ ID NO: 1022463 - RNA, 22 nt, Human
aaauaguuuagcucucauuuca

SEQ ID NO: 1022464 - RNA, 21 nt, Human
agaaaaacacgauauaagccc

SEQ ID NO: 1022465 - RNA, 22 nt, Human
agccacagcccacaggacucuu

SEQ ID NO: 1022466 - RNA, 22 nt, Human
agggcugcaccggggcuucgcg

SEQ ID NO: 1022467 - RNA, 22 nt, Human
auguaauaggguaacauaacau

SEQ ID NO: 1022468 - RNA, 22 nt, Human
ucaaugauuagaguuuagugug

SEQ ID NO: 1022469 - RNA, 22 nt, Human
aaguuauuuccucgugacugaa

SEQ ID NO: 1022470 - RNA, 22 nt, Human
ccugggagugcacagguuucgu

SEQ ID NO: 1022471 - RNA, 22 nt, Human
agagcugccgagcuggggccau

SEQ ID NO: 1022472 - RNA, 20 nt, Human
ggcagcaggaguuuccucuu

SEQ ID NO: 1022473 - RNA, 22 nt, Human
cacugcuuuuuuggcuauguac

SEQ ID NO: 1022474 - RNA, 18 nt, Human
ucagagagcagcuuuauu

SEQ ID NO: 1022475 - RNA, 22 nt, Human
augaagucuagcaagcauugaa

SEQ ID NO: 1022476 - RNA, 18 nt, Human
ucauuuguuuugcaugaa

SEQ ID NO: 1022477 - RNA, 20 nt, Human
gggcaguggcgcuaucucag

SEQ ID NO: 1022478 - RNA, 22 nt, Human
agagugaaguaauuguuaggau

SEQ ID NO: 1022479 - RNA, 22 nt, Human
gcagcuuucuaagcuuuauugc

SEQ ID NO: 1022480 - RNA, 22 nt, Human
accugcagcugagaaaaugacu

SEQ ID NO: 1022481 - RNA, 22 nt, Human
agaaaucauucccaaacccaua

SEQ ID NO: 1022482 - RNA, 22 nt, Human
gguuuauuaaugugaacuguau

SEQ ID NO: 1022483 - RNA, 22 nt, Human
agccagggauggcagugcccag

SEQ ID NO: 1022484 - RNA, 22 nt, Human
ccuuagagaguacugggcugcc

SEQ ID NO: 1022485 - RNA, 22 nt, Human
caggccucccggugcacacuga

SEQ ID NO: 1022486 - RNA, 22 nt, Human
ggcugccucugaugugcagacg

SEQ ID NO: 1022487 - RNA, 22 nt, Human
uacauauagacaguuacucuag

SEQ ID NO: 1022488 - RNA, 19 nt, Human
ggacacagaaagcugcauu

SEQ ID NO: 1022489 - RNA, 22 nt, Human
cugagagccuccuguuggcuag

SEQ ID NO: 1022490 - RNA, 22 nt, Human
acuccagggcuccaucccuugu

SEQ ID NO: 1022491 - RNA, 22 nt, Human
aaagcuaugaggcaugcauuuc

SEQ ID NO: 1022492 - RNA, 22 nt, Human
cccugcagccggccagcucauu

SEQ ID NO: 1022493 - RNA, 22 nt, Human
gugucccagcagcacauuggcu

SEQ ID NO: 1022494 - RNA, 22 nt, Human
uuucacaagacagcuacuguug

SEQ ID NO: 1022495 - RNA, 21 nt, Human
ugggggagaauugguugcuuu

SEQ ID NO: 1022496 - RNA, 22 nt, Human
caugugucaaaugauguagcug

SEQ ID NO: 1022497 - RNA, 22 nt, Human
acauaccauacauggugagaug

SEQ ID NO: 1022498 - RNA, 22 nt, Human
ucaggcagagcuguggagcucu

SEQ ID NO: 1022499 - RNA, 17 nt, Human
auuuccucagggcugag

SEQ ID NO: 1022500 - RNA, 22 nt, Human
uccagggacacagaguccuucu

SEQ ID NO: 1022501 - RNA, 22 nt, Human
aagcccagaugugagaacugag

SEQ ID NO: 1022502 - RNA, 22 nt, Human
ugaggaggucagagucuggcug

SEQ ID NO: 1022503 - RNA, 22 nt, Human
acaauucucucauaucuuauua

SEQ ID NO: 1022504 - RNA, 22 nt, Human
gccccagcucugccacaacuag

SEQ ID NO: 1022505 - RNA, 22 nt, Human
auuugcuuaucuccacaguugu

SEQ ID NO: 1022506 - RNA, 19 nt, Human
cagaguccuugaccagucc

SEQ ID NO: 1022507 - RNA, 22 nt, Human
gcuggggagggcgucaaggcca

SEQ ID NO: 1022508 - RNA, 22 nt, Human
uccagcagguuggucaggugca

SEQ ID NO: 1022509 - RNA, 22 nt, Human
cagucccaggguugguucagcu

SEQ ID NO: 1022510 - RNA, 22 nt, Human
cacagcagaaauaugaaggcag

SEQ ID NO: 1022511 - RNA, 22 nt, Human
ucuucacauggaacaugaagcu

SEQ ID NO: 1022512 - RNA, 22 nt, Human
ccagagacgucggucagggcgc

SEQ ID NO: 1022513 - RNA, 22 nt, Human
ccagcuggagcucgcagauagg

SEQ ID NO: 1022514 - RNA, 22 nt, Human
uaagacacaugcguacaagaua

SEQ ID NO: 1022515 - RNA, 21 nt, Human
guguuuccuguuuauggcuug

SEQ ID NO: 1022516 - RNA, 22 nt, Human
ugggggacugcacuggcgucag

SEQ ID NO: 1022517 - RNA, 22 nt, Human
uuuguacauauauaaaaucugu

SEQ ID NO: 1022518 - RNA, 22 nt, Human
gaggcuguuagggccugaggua

SEQ ID NO: 1022519 - RNA, 22 nt, Human
ugaggcucaaggucugguggag

SEQ ID NO: 1022520 - RNA, 20 nt, Human
uacagaaacaggacuuuugg

SEQ ID NO: 1022521 - RNA, 22 nt, Human
ccuggcagcccagagcgccgcu

SEQ ID NO: 1022522 - RNA, 22 nt, Human
caagagcuggagaggcagucua

SEQ ID NO: 1022523 - RNA, 22 nt, Human
uacaucauaauaauacuuagaa

SEQ ID NO: 1022524 - RNA, 22 nt, Human
ugaggccagucucaucacaggc

SEQ ID NO: 1022525 - RNA, 18 nt, Human
acauacauucugucugca

SEQ ID NO: 1022526 - RNA, 22 nt, Human
caggcagcguccugcuuccugu

SEQ ID NO: 1022527 - RNA, 22 nt, Human
cuggcuuccucaggagcagugg

SEQ ID NO: 1022528 - RNA, 22 nt, Human
cacaaaugguuguagacauuaa

SEQ ID NO: 1022529 - RNA, 22 nt, Human
caggcccugggcaggaucagcc

SEQ ID NO: 1022530 - RNA, 19 nt, Human
uuuacucuccaaggugagu

SEQ ID NO: 1022531 - RNA, 20 nt, Human
agacccuguguccuguggcc

SEQ ID NO: 1022532 - RNA, 22 nt, Human
aaaugcacaggagaaccaauuc

SEQ ID NO: 1022533 - RNA, 22 nt, Human
auuauuauauagggaaaguccc

SEQ ID NO: 1022534 - RNA, 22 nt, Human
gacuucuauuaauaccucuacu

SEQ ID NO: 1022535 - RNA, 22 nt, Human
cugggcacacagugacucugca

SEQ ID NO: 1022536 - RNA, 22 nt, Human
ucugccagugguuuggcccuga

SEQ ID NO: 1022537 - RNA, 22 nt, Human
ugggccugggcuccuguccucu

SEQ ID NO: 1022538 - RNA, 22 nt, Human
uuagccaugugggaaaaacagc

SEQ ID NO: 1022539 - RNA, 22 nt, Human
ucaaacuagccugacugguauu

SEQ ID NO: 1022540 - RNA, 22 nt, Human
uggggaagggcacccuggagac

SEQ ID NO: 1022541 - RNA, 22 nt, Human
caggaacacaaugagucucaaa

SEQ ID NO: 1022542 - RNA, 22 nt, Human
gccuggagaggaagccggugga

SEQ ID NO: 1022543 - RNA, 22 nt, Human
guuccaggcaagugggauagga

SEQ ID NO: 1022544 - RNA, 22 nt, Human
guggcuucugcggugugcgcag

SEQ ID NO: 1022545 - RNA, 22 nt, Human
acagugcuaaacacuucuugaa

SEQ ID NO: 1022546 - RNA, 22 nt, Human
ucagcuuucucaaagaagcugg

SEQ ID NO: 1022547 - RNA, 22 nt, Human
uuagccaugcccuagaagagga

SEQ ID NO: 1022548 - RNA, 22 nt, Human
gcacugggaaugugagcagcug

SEQ ID NO: 1022549 - RNA, 23 nt, Human
ccuggcagcaaacgaggagguua

SEQ ID NO: 1022550 - RNA, 22 nt, Human
cagagcugggcauggugaaagg

SEQ ID NO: 1022551 - RNA, 22 nt, Human
uggucucugacucugaagaccc

SEQ ID NO: 1022552 - RNA, 17 nt, Human
uuccucucacauuuuuu

SEQ ID NO: 1022553 - RNA, 22 nt, Human
cugcccuggcagccuaccaugg

SEQ ID NO: 1022554 - RNA, 22 nt, Human
gcagcuggucuggccuagagua

SEQ ID NO: 1022555 - RNA, 22 nt, Human
aaagcagggaugaggcuagagg

SEQ ID NO: 1022556 - RNA, 21 nt, Human
uagagaaaagaagcuguuccu

SEQ ID NO: 1022557 - RNA, 22 nt, Human
gcccuggaaucucuccauggga

SEQ ID NO: 1022558 - RNA, 20 nt, Human
gcagcugcccccagucccug

SEQ ID NO: 1022559 - RNA, 22 nt, Human
cuggggcugcgguggaggagcc

SEQ ID NO: 1022560 - RNA, 22 nt, Human
ccuuggaggacugcugcuucuu

SEQ ID NO: 1022561 - RNA, 22 nt, Human
auacauguaacugcauuguaau

SEQ ID NO: 1022562 - RNA, 20 nt, Human
uguuccaugacuauuuggau

SEQ ID NO: 1022563 - RNA, 22 nt, Human
ccugccugaaggucagccaccc

SEQ ID NO: 1022564 - RNA, 21 nt, Human
cgggcuggccgggcccucacc

SEQ ID NO: 1022565 - RNA, 22 nt, Human
gaggacagugugaucugccagc

SEQ ID NO: 1022566 - RNA, 22 nt, Human
uagggcucugagaguucagccu

SEQ ID NO: 1022567 - RNA, 22 nt, Human
cugauuccugauucaugcucuu

SEQ ID NO: 1022568 - RNA, 22 nt, Human
ugggacagugugccuugcuccu

SEQ ID NO: 1022569 - RNA, 20 nt, Human
cagagaccugucuucacaga

SEQ ID NO: 1022570 - RNA, 22 nt, Human
cucccagagagcaggugggccg

SEQ ID NO: 1022571 - RNA, 22 nt, Human
gccuggagcucaugugggcauu

SEQ ID NO: 1022572 - RNA, 22 nt, Human
gccucugcucucagguagccuc

SEQ ID NO: 1022573 - RNA, 22 nt, Human
ccugggagagucuguggucucc

SEQ ID NO: 1022574 - RNA, 18 nt, Human
gcuuuauuucuuggggaa

SEQ ID NO: 1022575 - RNA, 17 nt, Human
ccaggugggaggugggg

SEQ ID NO: 1022576 - RNA, 20 nt, Human
auuucaguguuugcaauuuc

SEQ ID NO: 1022577 - RNA, 19 nt, Human
gggcuucugggaucaagag

SEQ ID NO: 1022578 - RNA, 21 nt, Human
ucaaagcacauauuugcacau

SEQ ID NO: 1022579 - RNA, 22 nt, Human
ccuuucucuggcagcaggacag

SEQ ID NO: 1022580 - RNA, 22 nt, Human
agcuggaggggccagcaggugu

SEQ ID NO: 1022581 - RNA, 22 nt, Human
cuggccagaguuggagggugug

SEQ ID NO: 1022582 - RNA, 22 nt, Human
ccuggagggcgccgcacagucc

SEQ ID NO: 1022583 - RNA, 21 nt, Human
ucacuagugccuucugucauu

SEQ ID NO: 1022584 - RNA, 22 nt, Human
gcagacagcauguugggcuauu

SEQ ID NO: 1022585 - RNA, 22 nt, Human
acaugauuggacuccuuccccu

SEQ ID NO: 1022586 - RNA, 22 nt, Human
caguacuucuuggaaacuggau

SEQ ID NO: 1022587 - RNA, 22 nt, Human
gugcucuggcuggucucccggu

SEQ ID NO: 1022588 - RNA, 22 nt, Human
acaguacauaauccugagucug

SEQ ID NO: 1022589 - RNA, 22 nt, Human
cuggcaguggggccucaguguu

SEQ ID NO: 1022590 - RNA, 22 nt, Human
ugcaguggaggccgugagacag

SEQ ID NO: 1022591 - RNA, 22 nt, Human
cuguccuguggaccugaggacg

SEQ ID NO: 1022592 - RNA, 22 nt, Human
agguauagaauugaaaggguuu

SEQ ID NO: 1022593 - RNA, 22 nt, Human
cugcucuguuaauuaaacuuug

SEQ ID NO: 1022594 - RNA, 22 nt, Human
cagagagggcggcccuggcuuc

SEQ ID NO: 1022595 - RNA, 22 nt, Human
gagcaacaguuuaugguuuuuc

SEQ ID NO: 1022596 - RNA, 23 nt, Human
ugggccuggaaagccuuagagag

SEQ ID NO: 1022597 - RNA, 20 nt, Human
cagauggcacgucagggcau

SEQ ID NO: 1022598 - RNA, 22 nt, Human
cucuuaguaaugccaugaagca

SEQ ID NO: 1022599 - RNA, 19 nt, Human
guagggacagugguucuga

SEQ ID NO: 1022600 - RNA, 22 nt, Human
gccugcuggaggagccucaggg

SEQ ID NO: 1022601 - RNA, 22 nt, Human
gacagagaggcugagcaguaca

SEQ ID NO: 1022602 - RNA, 23 nt, Human
uuucaaauuacucugcagaugac

SEQ ID NO: 1022603 - RNA, 22 nt, Human
acagcagcuaaccccugggcca

SEQ ID NO: 1022604 - RNA, 22 nt, Human
uggcccugaaucaaggccagca

SEQ ID NO: 1022605 - RNA, 22 nt, Human
ucagggcauggcugcacuuggc

SEQ ID NO: 1022606 - RNA, 22 nt, Human
ucuuuccuaggugauaugcaau

SEQ ID NO: 1022607 - RNA, 22 nt, Human
agccagcuggugggucagcugg

SEQ ID NO: 1022608 - RNA, 20 nt, Human
gaggcugcggacugcuggac

SEQ ID NO: 1022609 - RNA, 22 nt, Human
uguugauuaguguuuagacuua

SEQ ID NO: 1022610 - RNA, 16 nt, Human
ccaccugcagcucuca

SEQ ID NO: 1022611 - RNA, 20 nt, Human
ucagccagcuaacaugggga

SEQ ID NO: 1022612 - RNA, 22 nt, Human
cugcaggcugagcgccugccgg

SEQ ID NO: 1022613 - RNA, 22 nt, Human
uuguaauuugcaaauguauugu

SEQ ID NO: 1022614 - RNA, 22 nt, Human
uccuucaagaugccacagcuuu

SEQ ID NO: 1022615 - RNA, 22 nt, Human
ccugcuggccaguggagggcug

SEQ ID NO: 1022616 - RNA, 22 nt, Human
cagcaauauacacagucuaugg

SEQ ID NO: 1022617 - RNA, 22 nt, Human
uucaaaauuguucuaagcucug

SEQ ID NO: 1022618 - RNA, 22 nt, Human
acucaagauagggaaaguacaa

SEQ ID NO: 1022619 - RNA, 22 nt, Human
aaauauagugacacuuauaguc

SEQ ID NO: 1022620 - RNA, 22 nt, Human
ucuugggaagcccauuuccacc

SEQ ID NO: 1022621 - RNA, 22 nt, Human
aguauacauauauuagccuucg

SEQ ID NO: 1022622 - RNA, 18 nt, Human
ccauuucaugauuauuac

SEQ ID NO: 1022623 - RNA, 22 nt, Human
ccagcagcucccucaggguccg

SEQ ID NO: 1022624 - RNA, 20 nt, Human
gagcagcuguuugcauugca

SEQ ID NO: 1022625 - RNA, 22 nt, Human
uacugcaugguggaguggagcu

SEQ ID NO: 1022626 - RNA, 22 nt, Human
uauguacauggagagcaauuga

SEQ ID NO: 1022627 - RNA, 22 nt, Human
cugcccuguuuggacagcccgg

SEQ ID NO: 1022628 - RNA, 20 nt, Human
auguaaaauuauaaggcuga

SEQ ID NO: 1022629 - RNA, 23 nt, Human
ggggccugcaccggucugcgcgg

SEQ ID NO: 1022630 - RNA, 22 nt, Human
cauugcacgggcgucugucugu

SEQ ID NO: 1022631 - RNA, 22 nt, Human
uacuuuuugucucuuugaaugu

SEQ ID NO: 1022632 - RNA, 22 nt, Human
cacccagcacagagggaggcga

SEQ ID NO: 1022633 - RNA, 22 nt, Human
cagagcugcuucccaguuugug

SEQ ID NO: 1022634 - RNA, 22 nt, Human
acaaagucugaaaccugaggca

SEQ ID NO: 1022635 - RNA, 22 nt, Human
auuauuaggacuacugggguug

SEQ ID NO: 1022636 - RNA, 22 nt, Human
agcuagaaguacagccauauga

SEQ ID NO: 1022637 - RNA, 22 nt, Human
cagcuuguuuuauuuggggacc

SEQ ID NO: 1022638 - RNA, 20 nt, Human
uccaagcccuccuuccauuc

SEQ ID NO: 1022639 - RNA, 22 nt, Human
gcagcaggcuuuucauaccuug

SEQ ID NO: 1022640 - RNA, 22 nt, Human
uggcagaguaggauggcccugu

SEQ ID NO: 1022641 - RNA, 22 nt, Human
cucuucaaaagucuaauccuua

SEQ ID NO: 1022642 - RNA, 22 nt, Human
uugaagcacaaugucuuuuauc

SEQ ID NO: 1022643 - RNA, 22 nt, Human
gccuggagagcacugugcgcuu

SEQ ID NO: 1022644 - RNA, 22 nt, Human
aaagagcuaacauugccgagau

SEQ ID NO: 1022645 - RNA, 21 nt, Human
ucugagagcaacugcccuuua

SEQ ID NO: 1022646 - RNA, 22 nt, Human
uccuugaagagugggcggucga

SEQ ID NO: 1022647 - RNA, 22 nt, Human
uuagauaaauugcaacuugauu

SEQ ID NO: 1022648 - RNA, 22 nt, Human
aggccuuaccauagcuguagca

SEQ ID NO: 1022649 - RNA, 22 nt, Human
gggcagggguagcauuccaagu

SEQ ID NO: 1022650 - RNA, 22 nt, Human
uggcagcuguguccagguagaa

SEQ ID NO: 1022651 - RNA, 22 nt, Human
gugacagucaaagacaugacuu

SEQ ID NO: 1022652 - RNA, 22 nt, Human
aauacugccugugagguaacuc

SEQ ID NO: 1022653 - RNA, 22 nt, Human
aaaguuugucacuuggcuagaa

SEQ ID NO: 1022654 - RNA, 22 nt, Human
uuugacagauccuuaacucagc

SEQ ID NO: 1022655 - RNA, 22 nt, Human
aacaaauguaaaaugcagaugc

SEQ ID NO: 1022656 - RNA, 22 nt, Human
cugagcugcucccgcugcagcg

SEQ ID NO: 1022657 - RNA, 22 nt, Human
uucaucaauguguuuaauaaug

SEQ ID NO: 1022658 - RNA, 22 nt, Human
uuaaauuuuagaaacagacucu

SEQ ID NO: 1022659 - RNA, 22 nt, Human
ucagcaaugugauacugugcaa

SEQ ID NO: 1022660 - RNA, 22 nt, Human
aacaaauggggccuuguaugaa

SEQ ID NO: 1022661 - RNA, 22 nt, Human
ggaaagagcccagcagugcuug

SEQ ID NO: 1022662 - RNA, 22 nt, Human
ucucuucuaacacuagaaauuc

SEQ ID NO: 1022663 - RNA, 22 nt, Human
ccugaggcuuaaucugucccaa

SEQ ID NO: 1022664 - RNA, 22 nt, Human
cacucaggguacaauggagggc

SEQ ID NO: 1022665 - RNA, 22 nt, Human
auuuggcaacauuaauugaauc

SEQ ID NO: 1022666 - RNA, 22 nt, Human
ucauuucaaguucugacagcua

SEQ ID NO: 1022667 - RNA, 22 nt, Human
agggcccauagaucgucagcuu

SEQ ID NO: 1022668 - RNA, 18 nt, Human
uggcucuggacuugcucc

SEQ ID NO: 1022669 - RNA, 22 nt, Human
auugaaagcauggauuuggauu

SEQ ID NO: 1022670 - RNA, 22 nt, Human
ucucagagaugucaagagucua

SEQ ID NO: 1022671 - RNA, 22 nt, Human
cagagguagaaggcaugcagug

SEQ ID NO: 1022672 - RNA, 22 nt, Human
ccagaggaaaaauaucucccua

SEQ ID NO: 1022673 - RNA, 20 nt, Human
uucacagaggacucagguca

SEQ ID NO: 1022674 - RNA, 22 nt, Human
agcaggguuccaggaguugcag

SEQ ID NO: 1022675 - RNA, 22 nt, Human
aacaggagaguaaauauaugau

SEQ ID NO: 1022676 - RNA, 22 nt, Human
ugcaucuguucagagcugucga

SEQ ID NO: 1022677 - RNA, 22 nt, Human
gcuggggcugggcugaggaaga

SEQ ID NO: 1022678 - RNA, 22 nt, Human
acuaaagaagccaaaguuuucu

SEQ ID NO: 1022679 - RNA, 22 nt, Human
agcaaagucaguggaaccaucc

SEQ ID NO: 1022680 - RNA, 22 nt, Human
caggccagugugcuucccaggc

SEQ ID NO: 1022681 - RNA, 22 nt, Human
ggaagagccuggggugucaggc

SEQ ID NO: 1022682 - RNA, 22 nt, Human
cacagcuggugcacuagcucug

SEQ ID NO: 1022683 - RNA, 22 nt, Human
uuauucagauuggcuacaggau

SEQ ID NO: 1022684 - RNA, 22 nt, Human
aaaugucuaucuggcauauucc

SEQ ID NO: 1022685 - RNA, 22 nt, Human
ucugucugcgcuugcccuggug

SEQ ID NO: 1022686 - RNA, 21 nt, Human
gauuugcagaaacuagacagg

SEQ ID NO: 1022687 - RNA, 22 nt, Human
aagagagagcauucuucuguua

SEQ ID NO: 1022688 - RNA, 23 nt, Human
agcagccagagauccucggcccu

SEQ ID NO: 1022689 - RNA, 22 nt, Human
ugucacauaggcaaaauguuuu

SEQ ID NO: 1022690 - RNA, 22 nt, Human
gaggcagagucacaaagagucu

SEQ ID NO: 1022691 - RNA, 22 nt, Human
uguuaggguccugugcaggggc

SEQ ID NO: 1022692 - RNA, 22 nt, Human
ggggcagcucccgagggcagga

SEQ ID NO: 1022693 - RNA, 22 nt, Human
ucacugaagacugggcucuaaa

SEQ ID NO: 1022694 - RNA, 22 nt, Human
auccagagacccaaggacagaa

SEQ ID NO: 1022695 - RNA, 22 nt, Human
uucugucacuuaggaggucaua

SEQ ID NO: 1022696 - RNA, 22 nt, Human
cugcugugugaccauggacagg

SEQ ID NO: 1022697 - RNA, 22 nt, Human
aaugcuagugugauauguaagg

SEQ ID NO: 1022698 - RNA, 22 nt, Human
gagcagugggaaggaacagggu

SEQ ID NO: 1022699 - RNA, 22 nt, Human
gagcagcugcagugcagacccu

SEQ ID NO: 1022700 - RNA, 22 nt, Human
ugcccacauggugccauggcca

SEQ ID NO: 1022701 - RNA, 22 nt, Human
cagggccauuggcguggcuguc

SEQ ID NO: 1022702 - RNA, 22 nt, Human
gcuuccucgcugggcagaggca

SEQ ID NO: 1022703 - RNA, 22 nt, Human
agcugcuccuuuccugcaggcg

SEQ ID NO: 1022704 - RNA, 22 nt, Human
cucaggauggaagccuacagga

SEQ ID NO: 1022705 - RNA, 22 nt, Human
aaggacuccaauucuuucaucu

SEQ ID NO: 1022706 - RNA, 22 nt, Human
gcugcucuugaggggcucacug

SEQ ID NO: 1022707 - RNA, 22 nt, Human
agucccagugagaugagccacg

SEQ ID NO: 1022708 - RNA, 22 nt, Human
ucucugcucugugccucaguuu

SEQ ID NO: 1022709 - RNA, 22 nt, Human
ccagagagggcgccaccuggag

SEQ ID NO: 1022710 - RNA, 22 nt, Human
caggcugcggucggcucugguc

SEQ ID NO: 1022711 - RNA, 22 nt, Human
ccucagagguguggcaucucug

SEQ ID NO: 1022712 - RNA, 22 nt, Human
acagauuuuaaaugacacuccc

SEQ ID NO: 1022713 - RNA, 22 nt, Human
gcagcguggggacaggagcuca

SEQ ID NO: 1022714 - RNA, 23 nt, Human
agaugaaagcuucccaucacagu

SEQ ID NO: 1022715 - RNA, 22 nt, Human
aaauauagcaauuaugccuacu

SEQ ID NO: 1022716 - RNA, 22 nt, Human
ugucucugccagcuagcagaau

SEQ ID NO: 1022717 - RNA, 22 nt, Human
ugggaauggaugcuaagugcua

SEQ ID NO: 1022718 - RNA, 22 nt, Human
guggcagcaaaauccugcauuc

SEQ ID NO: 1022719 - RNA, 22 nt, Human
cacugaagguaggaccaaggcu

SEQ ID NO: 1022720 - RNA, 22 nt, Human
gaaggagggugcggaucugagc

SEQ ID NO: 1022721 - RNA, 22 nt, Human
ccuccagcugccucagucucuu

SEQ ID NO: 1022722 - RNA, 22 nt, Human
uuaaacauuuauggaggcagca

SEQ ID NO: 1022723 - RNA, 22 nt, Human
cuuauaaaguccaucugaacaa

SEQ ID NO: 1022724 - RNA, 23 nt, Human
agccagggcacugguggagauug

SEQ ID NO: 1022725 - RNA, 22 nt, Human
guggccuuuccugaagaaauga

SEQ ID NO: 1022726 - RNA, 22 nt, Human
ccccaccugugcgucugccgca

SEQ ID NO: 1022727 - RNA, 22 nt, Human
uggccugggucacaccaggguc

SEQ ID NO: 1022728 - RNA, 22 nt, Human
cgccaggcuugguagcucaugc

SEQ ID NO: 1022729 - RNA, 22 nt, Human
ucucagaguuuacggggcugaa

SEQ ID NO: 1022730 - RNA, 22 nt, Human
ugguaaagaaggcuagaucuga

SEQ ID NO: 1022731 - RNA, 22 nt, Human
uauuuccaagcugaauccaaug

SEQ ID NO: 1022732 - RNA, 19 nt, Human
ccucuccgcccaccagccc

SEQ ID NO: 1022733 - RNA, 22 nt, Human
guguaaggugaaaucaacaaau

SEQ ID NO: 1022734 - RNA, 22 nt, Human
ggcagcugcaaaucugcucugu

SEQ ID NO: 1022735 - RNA, 22 nt, Human
cauacuuugggauaagagugga

SEQ ID NO: 1022736 - RNA, 22 nt, Human
aucuccaggcauuucaagagac

SEQ ID NO: 1022737 - RNA, 22 nt, Human
auggcaggcccagguguucauu

SEQ ID NO: 1022738 - RNA, 22 nt, Human
agccagcaugaagacagaggcc

SEQ ID NO: 1022739 - RNA, 22 nt, Human
accauccugaaaccuucaugcu

SEQ ID NO: 1022740 - RNA, 22 nt, Human
uuguuuucacagcuuugcccgg

SEQ ID NO: 1022741 - RNA, 22 nt, Human
uuauccaagcagaagcugcaca

SEQ ID NO: 1022742 - RNA, 22 nt, Human
uggcuggggccugaauccugca

SEQ ID NO: 1022743 - RNA, 22 nt, Human
cagagccugccaccuuucuccc

SEQ ID NO: 1022744 - RNA, 22 nt, Human
ugcauuguuuagaacucuuugg

SEQ ID NO: 1022745 - RNA, 22 nt, Human
ucucagagggaaacaugaguga

SEQ ID NO: 1022746 - RNA, 22 nt, Human
cucagagaaccuaagcggagga

SEQ ID NO: 1022747 - RNA, 22 nt, Human
uuaacagacauauauauuugua

SEQ ID NO: 1022748 - RNA, 22 nt, Human
acugucuccucaucaugccugg

SEQ ID NO: 1022749 - RNA, 22 nt, Human
ggccaggaagggaagaucagca

SEQ ID NO: 1022750 - RNA, 22 nt, Human
ccagagagaguacugggcucug

SEQ ID NO: 1022751 - RNA, 22 nt, Human
acagguggcuuauuggcugauu

SEQ ID NO: 1022752 - RNA, 22 nt, Human
uggugcuguggaggggcagaag

SEQ ID NO: 1022753 - RNA, 22 nt, Human
agcuggguggagggcccacggu

SEQ ID NO: 1022754 - RNA, 22 nt, Human
cagcaauaguguguuuguuuca

SEQ ID NO: 1022755 - RNA, 22 nt, Human
uagugcuuuaggccugaguguc

SEQ ID NO: 1022756 - RNA, 22 nt, Human
gggcauggugaugugcaccugu

SEQ ID NO: 1022757 - RNA, 21 nt, Human
ugauccuuucccccauguugc

SEQ ID NO: 1022758 - RNA, 22 nt, Human
gggaaggagccugcuugcuaga

SEQ ID NO: 1022759 - RNA, 22 nt, Human
acuauaaaaggauaaaccagaa

SEQ ID NO: 1022760 - RNA, 22 nt, Human
gaaggaaaucugugauuuaugc

SEQ ID NO: 1022761 - RNA, 22 nt, Human
ucagggcagaauccaaagaauu

SEQ ID NO: 1022762 - RNA, 22 nt, Human
gcugcagcaagcccuccagggg

SEQ ID NO: 1022763 - RNA, 22 nt, Human
uguaaauaaugcauguaaauca

SEQ ID NO: 1022764 - RNA, 22 nt, Human
ucagagagguuaaauaucuugu

SEQ ID NO: 1022765 - RNA, 22 nt, Human
uggaggaugccauccaggauac

SEQ ID NO: 1022766 - RNA, 22 nt, Human
aaacacauuuuaggaaaaucua

SEQ ID NO: 1022767 - RNA, 22 nt, Human
cccaggcagaauuaguguuuca

SEQ ID NO: 1022768 - RNA, 22 nt, Human
cagaguguuucuuugggugggu

SEQ ID NO: 1022769 - RNA, 22 nt, Human
gcugaaggaggcucugguacua

SEQ ID NO: 1022770 - RNA, 22 nt, Human
ucauuauccuaguaucuugaau

SEQ ID NO: 1022771 - RNA, 22 nt, Human
cugcugagguccuugcucagac

SEQ ID NO: 1022772 - RNA, 22 nt, Human
cuggcucaauuuguacugcugu

SEQ ID NO: 1022773 - RNA, 22 nt, Human
ggcagccauacucagaccuggg

SEQ ID NO: 1022774 - RNA, 22 nt, Human
uccaggccacugcagaggcucu

SEQ ID NO: 1022775 - RNA, 22 nt, Human
agcauggggcuccgcaaugaac

SEQ ID NO: 1022776 - RNA, 22 nt, Human
gucugucuguuguugagaagca

SEQ ID NO: 1022777 - RNA, 22 nt, Human
gaaaggucuuccggucuuccag

SEQ ID NO: 1022778 - RNA, 22 nt, Human
ugaaaaaccucaguccgcuuua

SEQ ID NO: 1022779 - RNA, 22 nt, Human
ugcuagaauuugcagaagcaua

SEQ ID NO: 1022780 - RNA, 22 nt, Human
ugaaaugaaugugauucgauag

SEQ ID NO: 1022781 - RNA, 22 nt, Human
ucuuugcacugugcaagcagaa

SEQ ID NO: 1022782 - RNA, 22 nt, Human
cauuauguucaguagcuuaaaa

SEQ ID NO: 1022783 - RNA, 22 nt, Human
ccuccagggcagacggggagca

SEQ ID NO: 1022784 - RNA, 22 nt, Human
cacuccagccucagugacagag

SEQ ID NO: 1022785 - RNA, 22 nt, Human
agacccagaaagcagcugcauu

SEQ ID NO: 1022786 - RNA, 22 nt, Human
cugggagcuagcucugagcuga

SEQ ID NO: 1022787 - RNA, 22 nt, Human
aauuuuaaucaguggugcugag

SEQ ID NO: 1022788 - RNA, 21 nt, Human
ccugggccaaauucccuggac

SEQ ID NO: 1022789 - RNA, 22 nt, Human
aaggccagaguacuagaggcug

SEQ ID NO: 1022790 - RNA, 22 nt, Human
ucugccugcaguguggcagggc

SEQ ID NO: 1022791 - RNA, 22 nt, Human
agggcagcacagcugugcuccu

SEQ ID NO: 1022792 - RNA, 22 nt, Human
gugauuccuauuaguacaugca

SEQ ID NO: 1022793 - RNA, 22 nt, Human
ucaguuaacaacuauuuauuga

SEQ ID NO: 1022794 - RNA, 22 nt, Human
gugggggcaggcagugcuagga

SEQ ID NO: 1022795 - RNA, 22 nt, Human
ccuggggcucaagauggcgccg

SEQ ID NO: 1022796 - RNA, 22 nt, Human
agggcuccaggggaccaucagu

SEQ ID NO: 1022797 - RNA, 22 nt, Human
ggucauugucagagccuguacu

SEQ ID NO: 1022798 - RNA, 22 nt, Human
gcucccacaaccuucuugcucc

SEQ ID NO: 1022799 - RNA, 19 nt, Human
ggcucucccuugagagagc

SEQ ID NO: 1022800 - RNA, 22 nt, Human
augcugugaaaaagaaggcuga

SEQ ID NO: 1022801 - RNA, 22 nt, Human
acuuccuguguuggucuugcug

SEQ ID NO: 1022802 - RNA, 22 nt, Human
acucugggccccagguggagcu

SEQ ID NO: 1022803 - RNA, 22 nt, Human
aacaugauggggaagaacaaga

SEQ ID NO: 1022804 - RNA, 22 nt, Human
gccuggaguggacuuggccccu

SEQ ID NO: 1022805 - RNA, 22 nt, Human
agcugagagguggcaagcugua

SEQ ID NO: 1022806 - RNA, 22 nt, Human
cucuuuccucagccacagucua

SEQ ID NO: 1022807 - RNA, 23 nt, Human
cagcugaagcagccugggcugga

SEQ ID NO: 1022808 - RNA, 20 nt, Human
caggaugauuggacacgaug

SEQ ID NO: 1022809 - RNA, 22 nt, Human
cugcuuuguguggucccuccag

SEQ ID NO: 1022810 - RNA, 22 nt, Human
caggcuggagugcaguugugca

SEQ ID NO: 1022811 - RNA, 22 nt, Human
uguccauggauagagcugcucg

SEQ ID NO: 1022812 - RNA, 22 nt, Human
agcaguggagcgagauguuuaa

SEQ ID NO: 1022813 - RNA, 22 nt, Human
cucuggcuucuaccuugcaguu

SEQ ID NO: 1022814 - RNA, 22 nt, Human
gcuggcugggucccugagaggc

SEQ ID NO: 1022815 - RNA, 22 nt, Human
agcugccauccuguucagcacc

SEQ ID NO: 1022816 - RNA, 22 nt, Human
uacaaagagguaauugcauaua

SEQ ID NO: 1022817 - RNA, 22 nt, Human
gagaagcaauuuccaacugugc

SEQ ID NO: 1022818 - RNA, 22 nt, Human
ucagaagcauguggggagccug

SEQ ID NO: 1022819 - RNA, 22 nt, Human
aggacuuagaacauuauguacu

SEQ ID NO: 1022820 - RNA, 22 nt, Human
uugcuucaguagcucuuuaaag

SEQ ID NO: 1022821 - RNA, 22 nt, Human
agggcagcagcuccuccuagcu

SEQ ID NO: 1022822 - RNA, 22 nt, Human
gugggagcugcggaggccuggg

SEQ ID NO: 1022823 - RNA, 22 nt, Human
cuucucuucccagggacacagg

SEQ ID NO: 1022824 - RNA, 22 nt, Human
cagaguguuagcgcugguuggg

SEQ ID NO: 1022825 - RNA, 22 nt, Human
guugacagcuggugagcugcua

SEQ ID NO: 1022826 - RNA, 22 nt, Human
cugucccagauguucucagcac

SEQ ID NO: 1022827 - RNA, 22 nt, Human
agaugagggguagaaaggacuu

SEQ ID NO: 1022828 - RNA, 22 nt, Human
uggccugccccgagauccuggc

SEQ ID NO: 1022829 - RNA, 22 nt, Human
auucauuugcuauuguguaugg

SEQ ID NO: 1022830 - RNA, 22 nt, Human
cagaagaaaguggggagacaag

SEQ ID NO: 1022831 - RNA, 22 nt, Human
uauuucaugugcaccauaauuc

SEQ ID NO: 1022832 - RNA, 22 nt, Human
ccaaggagcaaggcucaacaag

SEQ ID NO: 1022833 - RNA, 22 nt, Human
cccagcaggucggugcugccug

SEQ ID NO: 1022834 - RNA, 22 nt, Human
gucccacaccuugaggggucuu

SEQ ID NO: 1022835 - RNA, 19 nt, Human
uugcauuguaguuggacug

SEQ ID NO: 1022836 - RNA, 22 nt, Human
gacagcaggagaucaugauaga

SEQ ID NO: 1022837 - RNA, 22 nt, Human
cuuaaauuuucaucuacaagaa

SEQ ID NO: 1022838 - RNA, 22 nt, Human
augauacaucuucaugucagug

SEQ ID NO: 1022839 - RNA, 22 nt, Human
uauugaugcuuggauugggcca

SEQ ID NO: 1022840 - RNA, 22 nt, Human
ugcauguguuugccacagugag

SEQ ID NO: 1022841 - RNA, 22 nt, Human
aauauguuccacuuaaagcugg

SEQ ID NO: 1022842 - RNA, 22 nt, Human
uuuucuuacugucugugauccu

SEQ ID NO: 1022843 - RNA, 22 nt, Human
ugucuuuagaaagaagcagaca

SEQ ID NO: 1022844 - RNA, 22 nt, Human
uucccucuccuacucaggaaag

SEQ ID NO: 1022845 - RNA, 22 nt, Human
ucagagaacacagaggugaugu

SEQ ID NO: 1022846 - RNA, 18 nt, Human
aaagaaggauuggagagc

SEQ ID NO: 1022847 - RNA, 22 nt, Human
agcagcuggggccugugacgau

SEQ ID NO: 1022848 - RNA, 22 nt, Human
uugcaucuaccauaucaaagau

SEQ ID NO: 1022849 - RNA, 22 nt, Human
aauauucaaguuauucuuucuu

SEQ ID NO: 1022850 - RNA, 22 nt, Human
ggcagagacuggguuggcagag

SEQ ID NO: 1022851 - RNA, 22 nt, Human
acccagcaugacaccugcacau

SEQ ID NO: 1022852 - RNA, 22 nt, Human
ucagcuuucuauguugcuaaac

SEQ ID NO: 1022853 - RNA, 22 nt, Human
ccagagccggauugugaagugc

SEQ ID NO: 1022854 - RNA, 22 nt, Human
ugccagggcugcuacuggcuga

SEQ ID NO: 1022855 - RNA, 22 nt, Human
acacacagguaaaggagccugg

SEQ ID NO: 1022856 - RNA, 20 nt, Human
cuucuucauuaacccuacug

SEQ ID NO: 1022857 - RNA, 22 nt, Human
ccuguggcugccacuuggguga

SEQ ID NO: 1022858 - RNA, 22 nt, Human
ugcugcucucagccaccaggaa

SEQ ID NO: 1022859 - RNA, 19 nt, Human
agcagagcagggccguggg

SEQ ID NO: 1022860 - RNA, 22 nt, Human
uggcagaguucgcugugccuuu

SEQ ID NO: 1022861 - RNA, 23 nt, Human
ucacaggggccagcgcucugugg

SEQ ID NO: 1022862 - RNA, 19 nt, Human
agcuccugggcucugggcc

SEQ ID NO: 1022863 - RNA, 22 nt, Human
gcucugcugaagccccuugcau

SEQ ID NO: 1022864 - RNA, 22 nt, Human
gagggcagugaauuuugaagcu

SEQ ID NO: 1022865 - RNA, 22 nt, Human
agccaggaauuggacaacacau

SEQ ID NO: 1022866 - RNA, 22 nt, Human
cuuucagagguuacucaggaaa

SEQ ID NO: 1022867 - RNA, 22 nt, Human
ugggcagagucguggggaauag

SEQ ID NO: 1022868 - RNA, 22 nt, Human
ucagucuuugcuuaugacaaua

SEQ ID NO: 1022869 - RNA, 22 nt, Human
cagagugagggccugcaccugc

SEQ ID NO: 1022870 - RNA, 22 nt, Human
ggcugcucugccuuccagcugg

SEQ ID NO: 1022871 - RNA, 22 nt, Human
ggcacugggcaccggcugaggg

SEQ ID NO: 1022872 - RNA, 22 nt, Human
agguaagggucacaguucauau

SEQ ID NO: 1022873 - RNA, 22 nt, Human
agcuaccuggcuuaucacuguc

SEQ ID NO: 1022874 - RNA, 22 nt, Human
ugccucugggugaccaaggagc

SEQ ID NO: 1022875 - RNA, 22 nt, Human
uagcauuucccaaaugcauuug

SEQ ID NO: 1022876 - RNA, 22 nt, Human
uggcucugucacugugagcuau

SEQ ID NO: 1022877 - RNA, 22 nt, Human
gagagaagaaagccaugguccu

SEQ ID NO: 1022878 - RNA, 22 nt, Human
cugagggcccugaagcuuggca

SEQ ID NO: 1022879 - RNA, 22 nt, Human
uuauucagucugucuagggagu

SEQ ID NO: 1022880 - RNA, 22 nt, Human
gccauccucugagcacuaggca

SEQ ID NO: 1022881 - RNA, 22 nt, Human
ugccugggccuucccaccucug

SEQ ID NO: 1022882 - RNA, 22 nt, Human
ugugaaagcaagucuaguucuc

SEQ ID NO: 1022883 - RNA, 22 nt, Human
agucucagccacacagaccuau

SEQ ID NO: 1022884 - RNA, 22 nt, Human
agacaaagacagcaucucaggu

SEQ ID NO: 1022885 - RNA, 22 nt, Human
cagagcagcagagcuuccaugg

SEQ ID NO: 1022886 - RNA, 22 nt, Human
aagucuguuugagugucacacu

SEQ ID NO: 1022887 - RNA, 22 nt, Human
ggguccagcgacagcaggcuca

SEQ ID NO: 1022888 - RNA, 22 nt, Human
cugguccuugacgcgugggagg

SEQ ID NO: 1022889 - RNA, 22 nt, Human
gugccugccccacuccucagca

SEQ ID NO: 1022890 - RNA, 22 nt, Human
caccugcaaggagcuuucauuu

SEQ ID NO: 1022891 - RNA, 20 nt, Human
cccaggcagagcuagcggca

SEQ ID NO: 1022892 - RNA, 22 nt, Human
aucaggauuacacggggaugcu

SEQ ID NO: 1022893 - RNA, 22 nt, Human
gcugucugucucugugacuuaa

SEQ ID NO: 1022894 - RNA, 22 nt, Human
aaggcaguaaaaucuaccuugc

SEQ ID NO: 1022895 - RNA, 20 nt, Human
uccagggcuagggagcucau

SEQ ID NO: 1022896 - RNA, 22 nt, Human
acauacuuuuuaaaagauugcu

SEQ ID NO: 1022897 - RNA, 22 nt, Human
gugcuuuuaaaggcaauuagua

SEQ ID NO: 1022898 - RNA, 18 nt, Human
gcagcuuuugauucaccc

SEQ ID NO: 1022899 - RNA, 22 nt, Human
guguaugaacgaaagaauggau

SEQ ID NO: 1022900 - RNA, 22 nt, Human
gcugggagaggcccugaaguga

SEQ ID NO: 1022901 - RNA, 22 nt, Human
gugaaaucugaggcccaugaug

SEQ ID NO: 1022902 - RNA, 22 nt, Human
agaagcuuccuacauuguucuu

SEQ ID NO: 1022903 - RNA, 21 nt, Human
agcugggccucagccugcagu

SEQ ID NO: 1022904 - RNA, 22 nt, Human
uggcagcacuugaacuugagcc

SEQ ID NO: 1022905 - RNA, 22 nt, Human
cuaucauuuuacaugguuggug

SEQ ID NO: 1022906 - RNA, 22 nt, Human
cccaggcacagauuaucccaau

SEQ ID NO: 1022907 - RNA, 22 nt, Human
gccagcuggagugagagugggc

SEQ ID NO: 1022908 - RNA, 22 nt, Human
cagagacaguuucacagggucu

SEQ ID NO: 1022909 - RNA, 18 nt, Human
aaguaacagaagagcaca

SEQ ID NO: 1022910 - RNA, 22 nt, Human
ugccugggccucugaggaaggc

SEQ ID NO: 1022911 - RNA, 22 nt, Human
uggacagguugaguaggaggag

SEQ ID NO: 1022912 - RNA, 22 nt, Human
gggcuuggcacaugggcucagc

SEQ ID NO: 1022913 - RNA, 22 nt, Human
uugaagauggaucgccacucuc

SEQ ID NO: 1022914 - RNA, 22 nt, Human
uguguucuggaaagcucacuga

SEQ ID NO: 1022915 - RNA, 22 nt, Human
cuacauuuguucuauagcuuuu

SEQ ID NO: 1022916 - RNA, 20 nt, Human
ggcagcucacuacuuucugu

SEQ ID NO: 1022917 - RNA, 22 nt, Human
ccagcuuucugggugguuucug

SEQ ID NO: 1022918 - RNA, 22 nt, Human
ugcuggguagaaguauuagucu

SEQ ID NO: 1022919 - RNA, 22 nt, Human
cuucuuuccuuccuccaguggc

SEQ ID NO: 1022920 - RNA, 22 nt, Human
agagccugcaucuagccucaga

SEQ ID NO: 1022921 - RNA, 22 nt, Human
agcuuccuuggcgcugaggccu

SEQ ID NO: 1022922 - RNA, 19 nt, Human
ugggccugcaucugggucu

SEQ ID NO: 1022923 - RNA, 16 nt, Human
gccuggaguggcaggg

SEQ ID NO: 1022924 - RNA, 22 nt, Human
uugaauuauaagugugucuacu

SEQ ID NO: 1022925 - RNA, 22 nt, Human
uuuuccucugcagagcaguuag

SEQ ID NO: 1022926 - RNA, 22 nt, Human
ggccucggcccacugcugcggu

SEQ ID NO: 1022927 - RNA, 22 nt, Human
uuucacagguacaaacacuccu

SEQ ID NO: 1022928 - RNA, 22 nt, Human
cugcugccggcgagccucccuu

SEQ ID NO: 1022929 - RNA, 22 nt, Human
ucacagcaaaagugugcagagc

SEQ ID NO: 1022930 - RNA, 22 nt, Human
gcugggcagccccuacagagag

SEQ ID NO: 1022931 - RNA, 22 nt, Human
uccuggauucugcccugaaggc

SEQ ID NO: 1022932 - RNA, 22 nt, Human
cuguguccugcgucaagccaau

SEQ ID NO: 1022933 - RNA, 19 nt, Human
acuuucuccaggaccuguu

SEQ ID NO: 1022934 - RNA, 22 nt, Human
auguuuccagguucuuccuaug

SEQ ID NO: 1022935 - RNA, 22 nt, Human
aguauguagugcaaucagucag

SEQ ID NO: 1022936 - RNA, 22 nt, Human
aaucuggcucagaagaagauga

SEQ ID NO: 1022937 - RNA, 22 nt, Human
agcagcugaucaaagcacuuau

SEQ ID NO: 1022938 - RNA, 19 nt, Human
accaggcuuauggucagug

SEQ ID NO: 1022939 - RNA, 22 nt, Human
gcugucugcugggucgcucagg

SEQ ID NO: 1022940 - RNA, 22 nt, Human
cagaggcucagauggcccuggc

SEQ ID NO: 1022941 - RNA, 22 nt, Human
guugaaagcuuuucauuuaguu

SEQ ID NO: 1022942 - RNA, 22 nt, Human
gcugcucuacccaugcaucugu

SEQ ID NO: 1022943 - RNA, 22 nt, Human
aaauguauccuacuuccugagu

SEQ ID NO: 1022944 - RNA, 22 nt, Human
aggagcagaccguaguccugca

SEQ ID NO: 1022945 - RNA, 22 nt, Human
uagggcucacugagaugaauau

SEQ ID NO: 1022946 - RNA, 17 nt, Human
guccuacccauggucua

SEQ ID NO: 1022947 - RNA, 17 nt, Human
ucagcaaagacaaagga

SEQ ID NO: 1022948 - RNA, 22 nt, Human
accugccuaucagcugccugcu

SEQ ID NO: 1022949 - RNA, 22 nt, Human
aggaccugacauuguguuuucu

SEQ ID NO: 1022950 - RNA, 22 nt, Human
guuccacaaaauguacccaguu

SEQ ID NO: 1022951 - RNA, 22 nt, Human
cccaggaguaagugacauuguu

SEQ ID NO: 1022952 - RNA, 22 nt, Human
ucccagaggucucugcugguuc

SEQ ID NO: 1022953 - RNA, 22 nt, Human
uggagcaagcuggagagaacau

SEQ ID NO: 1022954 - RNA, 22 nt, Human
agagaugaaaaguggagacugg

SEQ ID NO: 1022955 - RNA, 22 nt, Human
ucuggccaacaaaaacuaaguc

SEQ ID NO: 1022956 - RNA, 22 nt, Human
auguaaacaagguuauugucca

SEQ ID NO: 1022957 - RNA, 22 nt, Human
guggccaggacauugccaggca

SEQ ID NO: 1022958 - RNA, 21 nt, Human
aggugcagagccagggaccag

SEQ ID NO: 1022959 - RNA, 22 nt, Human
agaccauagggaccucagguug

SEQ ID NO: 1022960 - RNA, 22 nt, Human
aggcucagcaucugauucauau

SEQ ID NO: 1022961 - RNA, 22 nt, Human
ggucccagcugcucaagaggcu

SEQ ID NO: 1022962 - RNA, 22 nt, Human
gaggcugggaaguccaagacca

SEQ ID NO: 1022963 - RNA, 19 nt, Human
agguggucuaggcuggaga

SEQ ID NO: 1022964 - RNA, 19 nt, Human
aacuagaaagguuuugaga

SEQ ID NO: 1022965 - RNA, 22 nt, Human
uccauuuuagaagaaaauccac

SEQ ID NO: 1022966 - RNA, 22 nt, Human
gccucugcucggacuuugccuc

SEQ ID NO: 1022967 - RNA, 22 nt, Human
aaugucugccugaacuuuauau

SEQ ID NO: 1022968 - RNA, 22 nt, Human
aggcuggaguacaguggcuauu

SEQ ID NO: 1022969 - RNA, 22 nt, Human
ccagggccaguaagauuggcau

SEQ ID NO: 1022970 - RNA, 20 nt, Human
ccugucuccucuuaccuggc

SEQ ID NO: 1022971 - RNA, 22 nt, Human
gcacacaggcaguuuccagcca

SEQ ID NO: 1022972 - RNA, 22 nt, Human
uuuuccuaguaggccuauuaga

SEQ ID NO: 1022973 - RNA, 22 nt, Human
augaagcugaccuugucuugcu

SEQ ID NO: 1022974 - RNA, 22 nt, Human
gcagauggcugagccugcagau

SEQ ID NO: 1022975 - RNA, 22 nt, Human
auaguuugugaaacacagcagu

SEQ ID NO: 1022976 - RNA, 18 nt, Human
ugacucacccugucagug

SEQ ID NO: 1022977 - RNA, 21 nt, Human
agcagagugcuuugacuuugu

SEQ ID NO: 1022978 - RNA, 22 nt, Human
uggcagcagacaucugaggucu

SEQ ID NO: 1022979 - RNA, 22 nt, Human
acacauaagccuaaucaucucc

SEQ ID NO: 1022980 - RNA, 22 nt, Human
uugguuuaggaacuggcuugga

SEQ ID NO: 1022981 - RNA, 22 nt, Human
ugaaagcacaaguucuaacagg

SEQ ID NO: 1022982 - RNA, 22 nt, Human
gccugccuuuguaugacccuga

SEQ ID NO: 1022983 - RNA, 18 nt, Human
agcagagcccaugcauuc

SEQ ID NO: 1022984 - RNA, 22 nt, Human
gauucuuacuucuaagcaagcu

SEQ ID NO: 1022985 - RNA, 22 nt, Human
gcuguucauagaaauggucuca

SEQ ID NO: 1022986 - RNA, 22 nt, Human
ucagugucuugaccugggugug

SEQ ID NO: 1022987 - RNA, 22 nt, Human
uuuuagcacuaagugauaugcu

SEQ ID NO: 1022988 - RNA, 22 nt, Human
acagagguaggacaugagauau

SEQ ID NO: 1022989 - RNA, 22 nt, Human
aaggccugaacaugaggagaug

SEQ ID NO: 1022990 - RNA, 23 nt, Human
uccuucagagccucccuccaagc

SEQ ID NO: 1022991 - RNA, 22 nt, Human
cuggccuagcucucugcuugaa

SEQ ID NO: 1022992 - RNA, 22 nt, Human
agggcagcucucaccucuggcc

SEQ ID NO: 1022993 - RNA, 22 nt, Human
acucucagaggguggcagcaau

SEQ ID NO: 1022994 - RNA, 22 nt, Human
agacccugcaccucucgugggc

SEQ ID NO: 1022995 - RNA, 22 nt, Human
gccuggagacagcagaggcggc

SEQ ID NO: 1022996 - RNA, 19 nt, Human
ucauuguugguuugucggg

SEQ ID NO: 1022997 - RNA, 22 nt, Human
ggcuuuauuuugcaugaaugcu

SEQ ID NO: 1022998 - RNA, 22 nt, Human
gggauggggggaagcguccaug

SEQ ID NO: 1022999 - RNA, 22 nt, Human
cagcugaguuacucugaggucu

SEQ ID NO: 1023000 - RNA, 22 nt, Human
caggcacuucugcugcuugucu

SEQ ID NO: 1023001 - RNA, 22 nt, Human
uucugucaaagacuuuuucagg

SEQ ID NO: 1023002 - RNA, 22 nt, Human
gggagggaagguaccuguguga

SEQ ID NO: 1023003 - RNA, 22 nt, Human
agauggagaaugacaauuaagg

SEQ ID NO: 1023004 - RNA, 22 nt, Human
cuggccacaacuagcccaggac

SEQ ID NO: 1023005 - RNA, 22 nt, Human
ggaugcugggagacagcaggca

SEQ ID NO: 1023006 - RNA, 22 nt, Human
aauguguacaugacagauagaa

SEQ ID NO: 1023007 - RNA, 22 nt, Human
guuggccugaauggucaagagg

SEQ ID NO: 1023008 - RNA, 22 nt, Human
uuccuugaaugagucauggaaa

SEQ ID NO: 1023009 - RNA, 22 nt, Human
uaucuuuaacuugcaguauuua

SEQ ID NO: 1023010 - RNA, 18 nt, Human
ugucauaauauaucaccu

SEQ ID NO: 1023011 - RNA, 20 nt, Human
ccugggguacacuggcaugu

SEQ ID NO: 1023012 - RNA, 22 nt, Human
cuuuuuccagcuucaggguggg

SEQ ID NO: 1023013 - RNA, 22 nt, Human
ucauuuguugcuguuaccugag

SEQ ID NO: 1023014 - RNA, 22 nt, Human
agggccucugacgcccccagcc

SEQ ID NO: 1023015 - RNA, 22 nt, Human
ucucagagauuuuguuucccuu

SEQ ID NO: 1023016 - RNA, 22 nt, Human
cugggccuggcguuccaggcug

SEQ ID NO: 1023017 - RNA, 22 nt, Human
cagaggccaccuguggccacug

SEQ ID NO: 1023018 - RNA, 22 nt, Human
guguguuucagaagccaggugu

SEQ ID NO: 1023019 - RNA, 22 nt, Human
cagcccugagagaaccaucuau

SEQ ID NO: 1023020 - RNA, 22 nt, Human
aaaguucuaaaacucuuuguga

SEQ ID NO: 1023021 - RNA, 22 nt, Human
aaggaguuuggguagucauaca

SEQ ID NO: 1023022 - RNA, 22 nt, Human
uuucuucacaggguauugggug

SEQ ID NO: 1023023 - RNA, 22 nt, Human
cagccagggagggcaaaugaga

SEQ ID NO: 1023024 - RNA, 22 nt, Human
uuuggaaaguugucacuuuaga

SEQ ID NO: 1023025 - RNA, 22 nt, Human
uagcaggguaaauguagaugga

SEQ ID NO: 1023026 - RNA, 22 nt, Human
gugcccugaguggguaggagag

SEQ ID NO: 1023027 - RNA, 19 nt, Human
uugaggggccaggggagau

SEQ ID NO: 1023028 - RNA, 19 nt, Human
aaacacagauuucuuacca

SEQ ID NO: 1023029 - RNA, 22 nt, Human
ggcuccacccugcuuccagaag

SEQ ID NO: 1023030 - RNA, 22 nt, Human
aaggcccuggccccagcuucuu

SEQ ID NO: 1023031 - RNA, 22 nt, Human
agcccuggcccggcugugcuuu

SEQ ID NO: 1023032 - RNA, 18 nt, Human
gcagagugcgucucugug

SEQ ID NO: 1023033 - RNA, 20 nt, Human
gccagcacagggagcaguuc

SEQ ID NO: 1023034 - RNA, 22 nt, Human
cauuuauucucagauccuuguc

SEQ ID NO: 1023035 - RNA, 22 nt, Human
caaauaguuuuucauguauuau

SEQ ID NO: 1023036 - RNA, 22 nt, Human
ugacagggugauuaugagagcu

SEQ ID NO: 1023037 - RNA, 21 nt, Human
ccugugugucugacugggcua

SEQ ID NO: 1023038 - RNA, 22 nt, Human
uggaccugggguggccuccucu

SEQ ID NO: 1023039 - RNA, 22 nt, Human
cucucugguacauagaguuugg

SEQ ID NO: 1023040 - RNA, 22 nt, Human
uuugcauaggauggacauuuua

SEQ ID NO: 1023041 - RNA, 21 nt, Human
ccucuggcuugugcugugccc

SEQ ID NO: 1023042 - RNA, 22 nt, Human
gaggcugcggggaggagccugc

SEQ ID NO: 1023043 - RNA, 22 nt, Human
cccagagcuccgguccugccca

SEQ ID NO: 1023044 - RNA, 22 nt, Human
cugccacuuacuaggcauggug

SEQ ID NO: 1023045 - RNA, 22 nt, Human
ucuuugcaggccaaauuguuaa

SEQ ID NO: 1023046 - RNA, 22 nt, Human
ucccuuaaaacucauguguugu

SEQ ID NO: 1023047 - RNA, 22 nt, Human
aaaacaggugucagcaaacuau

SEQ ID NO: 1023048 - RNA, 22 nt, Human
uagaaaauagggccuguggagc

SEQ ID NO: 1023049 - RNA, 22 nt, Human
ugcaccccauuuuacauuuaca

SEQ ID NO: 1023050 - RNA, 17 nt, Human
cagcugugagagccuua

SEQ ID NO: 1023051 - RNA, 22 nt, Human
aagguacaguuuuaagaauaag

SEQ ID NO: 1023052 - RNA, 22 nt, Human
ggaccuggcaauuugcaucucu

SEQ ID NO: 1023053 - RNA, 22 nt, Human
gaagcagcagcuggggacaguu

SEQ ID NO: 1023054 - RNA, 22 nt, Human
uaaggucauggugaauaauaag

SEQ ID NO: 1023055 - RNA, 22 nt, Human
ucacugucugaaagaaauggcc

SEQ ID NO: 1023056 - RNA, 22 nt, Human
aaggagcucccggcagaccagg

SEQ ID NO: 1023057 - RNA, 22 nt, Human
gaggagcacaugaggcugaggg

SEQ ID NO: 1023058 - RNA, 22 nt, Human
uacauaauugucuuuguccuca

SEQ ID NO: 1023059 - RNA, 22 nt, Human
aagcaaagaguuuaguggguga

SEQ ID NO: 1023060 - RNA, 22 nt, Human
acugcaggagacacagcugcug

SEQ ID NO: 1023061 - RNA, 21 nt, Human
guuuuaagggagaaaaccuag

SEQ ID NO: 1023062 - RNA, 22 nt, Human
aggcacagcacaccuggccccc

SEQ ID NO: 1023063 - RNA, 22 nt, Human
gccaggcuguggggaacuugaa

SEQ ID NO: 1023064 - RNA, 22 nt, Human
cuggcagcucugagucccuucu

SEQ ID NO: 1023065 - RNA, 22 nt, Human
ugcagggagggcccagcaaucu

SEQ ID NO: 1023066 - RNA, 22 nt, Human
agggcuacugccugccuucagg

SEQ ID NO: 1023067 - RNA, 22 nt, Human
aagguacaaaguauuauuuaaa

SEQ ID NO: 1023068 - RNA, 22 nt, Human
cagagacccuaggcaggugaca

SEQ ID NO: 1023069 - RNA, 22 nt, Human
ggcaggagauaaaauauuaguu

SEQ ID NO: 1023070 - RNA, 22 nt, Human
ccagcuggcacuguggcugccc

SEQ ID NO: 1023071 - RNA, 22 nt, Human
cacagaauuaagggagaaauau

SEQ ID NO: 1023072 - RNA, 22 nt, Human
ccacugggggcugcaggcacuc

SEQ ID NO: 1023073 - RNA, 22 nt, Human
aaucuuucccuauuaaaugugg

SEQ ID NO: 1023074 - RNA, 22 nt, Human
uccucagaugcucuuggacgcc

SEQ ID NO: 1023075 - RNA, 22 nt, Human
gggcuggggcucaauaauuugu

SEQ ID NO: 1023076 - RNA, 22 nt, Human
gugcugggauuacaggugugag

SEQ ID NO: 1023077 - RNA, 22 nt, Human
acacuaauuaagcugcuuuacu

SEQ ID NO: 1023078 - RNA, 22 nt, Human
aaaugcacagagccuuagagau

SEQ ID NO: 1023079 - RNA, 22 nt, Human
acuuugcaaugggcagaaccca

SEQ ID NO: 1023080 - RNA, 22 nt, Human
uaccuugggguuuuguugcucu

SEQ ID NO: 1023081 - RNA, 22 nt, Human
ccuuuggguucaaucucggucu

SEQ ID NO: 1023082 - RNA, 22 nt, Human
ugcagggaaaacccaggaugcu

SEQ ID NO: 1023083 - RNA, 23 nt, Human
cugcccugaucuugaucuauugu

SEQ ID NO: 1023084 - RNA, 22 nt, Human
uccuggcccacuaugccagcau

SEQ ID NO: 1023085 - RNA, 22 nt, Human
uggaaauggaucugaugagucu

SEQ ID NO: 1023086 - RNA, 22 nt, Human
auucagagcacuggguagaauu

SEQ ID NO: 1023087 - RNA, 22 nt, Human
cugaggaguuuggguuguucaa

SEQ ID NO: 1023088 - RNA, 18 nt, Human
cagggcuguggggucacu

SEQ ID NO: 1023089 - RNA, 22 nt, Human
uuugaaguaccugguucugacu

SEQ ID NO: 1023090 - RNA, 22 nt, Human
ugcagggcuaagucagagccug

SEQ ID NO: 1023091 - RNA, 22 nt, Human
cuggcugaguuacuccacugag

SEQ ID NO: 1023092 - RNA, 22 nt, Human
gcugagaggcacuaucuccgga

SEQ ID NO: 1023093 - RNA, 22 nt, Human
uuaauacaagcauaugcacaca

SEQ ID NO: 1023094 - RNA, 22 nt, Human
uacuuuggauccuuacaauagc

SEQ ID NO: 1023095 - RNA, 22 nt, Human
cuccucugucuggcccugagcc

SEQ ID NO: 1023096 - RNA, 22 nt, Human
ucugggggcgaccagggacugc

SEQ ID NO: 1023097 - RNA, 22 nt, Human
aagcugcccucauucccagugc

SEQ ID NO: 1023098 - RNA, 22 nt, Human
agacaguguguguauauauggu

SEQ ID NO: 1023099 - RNA, 22 nt, Human
gugggagccauuuccaguaugc

SEQ ID NO: 1023100 - RNA, 22 nt, Human
acuugggaguucuggaagccug

SEQ ID NO: 1023101 - RNA, 22 nt, Human
caucugccuaaguggcccuguu

SEQ ID NO: 1023102 - RNA, 22 nt, Human
gauggcagguaguggucucauc

SEQ ID NO: 1023103 - RNA, 19 nt, Human
acagagcucucugcuucug

SEQ ID NO: 1023104 - RNA, 22 nt, Human
uacauaguuccauuuacaggaa

SEQ ID NO: 1023105 - RNA, 21 nt, Human
ugcucaugcaaugcaugucca

SEQ ID NO: 1023106 - RNA, 22 nt, Human
ggguggcuccuaugggcauagc

SEQ ID NO: 1023107 - RNA, 22 nt, Human
aaauguuucuacuugugagcau

SEQ ID NO: 1023108 - RNA, 22 nt, Human
guacuuccguggacuaauuguu

SEQ ID NO: 1023109 - RNA, 22 nt, Human
gggcugcacagaucuucaaggg

SEQ ID NO: 1023110 - RNA, 22 nt, Human
gucagaggggcagcugccaggc

SEQ ID NO: 1023111 - RNA, 22 nt, Human
ccucauggaccucagacugucc

SEQ ID NO: 1023112 - RNA, 22 nt, Human
gcuaccugagcaagagcuucaa

SEQ ID NO: 1023113 - RNA, 21 nt, Human
gcagcuggucucagagcuugc

SEQ ID NO: 1023114 - RNA, 22 nt, Human
uucacauugguucuugauagcu

SEQ ID NO: 1023115 - RNA, 22 nt, Human
uugugaaacauucauggauuug

SEQ ID NO: 1023116 - RNA, 22 nt, Human
caguagacacauuaauauggaa

SEQ ID NO: 1023117 - RNA, 22 nt, Human
uccagccaugacucggacagug

SEQ ID NO: 1023118 - RNA, 22 nt, Human
gcagagacuccacugucuugug

SEQ ID NO: 1023119 - RNA, 20 nt, Human
gcacugaagguuccagggga

SEQ ID NO: 1023120 - RNA, 23 nt, Human
cagaaaacccagagcucaguccc

SEQ ID NO: 1023121 - RNA, 22 nt, Human
cugagauggaguuuugcucuug

SEQ ID NO: 1023122 - RNA, 22 nt, Human
cagugguuauacuuacuguuuc

SEQ ID NO: 1023123 - RNA, 22 nt, Human
agccacagcgaaccucucuucc

SEQ ID NO: 1023124 - RNA, 22 nt, Human
uggcuggcaguaggcuaguggc

SEQ ID NO: 1023125 - RNA, 22 nt, Human
cugggagaugacucagagcagg

SEQ ID NO: 1023126 - RNA, 22 nt, Human
aggcagugcagaguccucuucu

SEQ ID NO: 1023127 - RNA, 22 nt, Human
acugucucucuagcaguucagg

SEQ ID NO: 1023128 - RNA, 22 nt, Human
uagaacacuugaccacugcucc

SEQ ID NO: 1023129 - RNA, 22 nt, Human
ucugaggccccugggcaggaug

SEQ ID NO: 1023130 - RNA, 22 nt, Human
ccucugggagacugcuacugag

SEQ ID NO: 1023131 - RNA, 22 nt, Human
uaauuccaaguugagacaugca

SEQ ID NO: 1023132 - RNA, 22 nt, Human
auuucagauucagaaauguagg

SEQ ID NO: 1023133 - RNA, 22 nt, Human
acagggcagaaauguugcaucu

SEQ ID NO: 1023134 - RNA, 22 nt, Human
acguuuucagugacugugcuuc

SEQ ID NO: 1023135 - RNA, 22 nt, Human
auugucgcuuauuuaggugcuu

SEQ ID NO: 1023136 - RNA, 22 nt, Human
auaaggcagucccuuaacaagg

SEQ ID NO: 1023137 - RNA, 22 nt, Human
acccuuucuuacucacacgcuc

SEQ ID NO: 1023138 - RNA, 22 nt, Human
uugcauugaaaauauauuuuaa

SEQ ID NO: 1023139 - RNA, 22 nt, Human
cagggugacugcccuggccacu

SEQ ID NO: 1023140 - RNA, 22 nt, Human
ccucccacauugaggacaugcu

SEQ ID NO: 1023141 - RNA, 22 nt, Human
aggaccauccuaagguaggcaa

SEQ ID NO: 1023142 - RNA, 22 nt, Human
ccucaggguggcaucagaucuu

SEQ ID NO: 1023143 - RNA, 21 nt, Human
agagcugggacuugccugaga

SEQ ID NO: 1023144 - RNA, 22 nt, Human
cccaaggccucuccuuggcuug

SEQ ID NO: 1023145 - RNA, 22 nt, Human
aaaaguauuggccaccauuucu

SEQ ID NO: 1023146 - RNA, 21 nt, Human
ugcugccaucaugcagagaug

SEQ ID NO: 1023147 - RNA, 22 nt, Human
gcugguccacucccuggaggcu

SEQ ID NO: 1023148 - RNA, 22 nt, Human
ucuggcucucaacaaauauuua

SEQ ID NO: 1023149 - RNA, 22 nt, Human
ggagccagugcccucuggugga

SEQ ID NO: 1023150 - RNA, 22 nt, Human
ugucauaaaacacaagcuguug

SEQ ID NO: 1023151 - RNA, 22 nt, Human
ugcuuuauaacuuaguuuaugg

SEQ ID NO: 1023152 - RNA, 22 nt, Human
cuccuugguguaguacugagca

SEQ ID NO: 1023153 - RNA, 22 nt, Human
cugaggccuaagacaugaauga

SEQ ID NO: 1023154 - RNA, 22 nt, Human
aacaguaaaaaucauuuaguug

SEQ ID NO: 1023155 - RNA, 22 nt, Human
ucuguucagguuucagagaacu

SEQ ID NO: 1023156 - RNA, 22 nt, Human
agcugcugagagucugccgggc

SEQ ID NO: 1023157 - RNA, 22 nt, Human
ugauuucuuccuugucauuaga

SEQ ID NO: 1023158 - RNA, 18 nt, Human
ugaauagggguuugcaga

SEQ ID NO: 1023159 - RNA, 22 nt, Human
caccagggacaaugcuaggggu

SEQ ID NO: 1023160 - RNA, 22 nt, Human
aagcuuuaugaucucucagcua

SEQ ID NO: 1023161 - RNA, 22 nt, Human
agcuucuggaaggcaaggcuug

SEQ ID NO: 1023162 - RNA, 22 nt, Human
gauaaugaugacaaugacaacc

SEQ ID NO: 1023163 - RNA, 22 nt, Human
guguggcugauugacaugguca

SEQ ID NO: 1023164 - RNA, 22 nt, Human
ccagagcuucggggcggcugua

SEQ ID NO: 1023165 - RNA, 22 nt, Human
uggggcucaccuaggcuggaag

SEQ ID NO: 1023166 - RNA, 22 nt, Human
ggcagagcuugcagugagccga

SEQ ID NO: 1023167 - RNA, 19 nt, Human
ucuaacagaagugucgucc

SEQ ID NO: 1023168 - RNA, 22 nt, Human
acuuucugcaguguuggaaaug

SEQ ID NO: 1023169 - RNA, 22 nt, Human
ggagccagagggaugcaguuga

SEQ ID NO: 1023170 - RNA, 22 nt, Human
gccauuuagggaggcaagguga

SEQ ID NO: 1023171 - RNA, 21 nt, Human
uugaaaguaaauucagcagcu

SEQ ID NO: 1023172 - RNA, 22 nt, Human
uaucuguuggcuccuaguugua

SEQ ID NO: 1023173 - RNA, 22 nt, Human
gcuuuggaugugugccugaggu

SEQ ID NO: 1023174 - RNA, 22 nt, Human
ggacagaggguugacagaguau

SEQ ID NO: 1023175 - RNA, 22 nt, Human
uuuguuagagugugggaggcug

SEQ ID NO: 1023176 - RNA, 22 nt, Human
uugagaagaaauaguuugcaau

SEQ ID NO: 1023177 - RNA, 22 nt, Human
uuuccaauaaagugucauuguu

SEQ ID NO: 1023178 - RNA, 22 nt, Human
agccuggaguucccaggagaag

SEQ ID NO: 1023179 - RNA, 22 nt, Human
uggagggcucuuucaccuggua

SEQ ID NO: 1023180 - RNA, 22 nt, Human
cucaggcccacagcagacccac

SEQ ID NO: 1023181 - RNA, 22 nt, Human
cuauuacauuucuggacauuca

SEQ ID NO: 1023182 - RNA, 22 nt, Human
gcaggggaguggaugauggauu

SEQ ID NO: 1023183 - RNA, 22 nt, Human
uacauuaucuuguuaucuuuca

SEQ ID NO: 1023184 - RNA, 22 nt, Human
agaggucagaacaggaaagugu

SEQ ID NO: 1023185 - RNA, 22 nt, Human
uuucuguauuuaaaagaucugg

SEQ ID NO: 1023186 - RNA, 22 nt, Human
uuaugcuaaaugaaucaaguca

SEQ ID NO: 1023187 - RNA, 18 nt, Human
gcucugcccaggcugccc

SEQ ID NO: 1023188 - RNA, 22 nt, Human
gugcuucucuucacacccaacu

SEQ ID NO: 1023189 - RNA, 22 nt, Human
ccuggagcacagcccaguccca

SEQ ID NO: 1023190 - RNA, 22 nt, Human
ugucucugaggugagggucagc

SEQ ID NO: 1023191 - RNA, 22 nt, Human
uuuuucuuaaauguggguuggc

SEQ ID NO: 1023192 - RNA, 22 nt, Human
auuauucuuaugucaucauggc

SEQ ID NO: 1023193 - RNA, 22 nt, Human
gauggcacacagacauccccgc

SEQ ID NO: 1023194 - RNA, 22 nt, Human
uggcucugucaaacugcacaca

SEQ ID NO: 1023195 - RNA, 22 nt, Human
gugcucuguguauuaggauguc

SEQ ID NO: 1023196 - RNA, 22 nt, Human
cuggcugcaggaaggagugggc

SEQ ID NO: 1023197 - RNA, 22 nt, Human
gcccucugcuggccucaccucg

SEQ ID NO: 1023198 - RNA, 22 nt, Human
gaggggcagaaugugaucaggg

SEQ ID NO: 1023199 - RNA, 22 nt, Human
auuguauuuccagcuugaaugu

SEQ ID NO: 1023200 - RNA, 20 nt, Human
ggagagcagggaagacagua

SEQ ID NO: 1023201 - RNA, 22 nt, Human
ucuuagcauuucauaacaacug

SEQ ID NO: 1023202 - RNA, 22 nt, Human
uggcucagcauucacuggucuu

SEQ ID NO: 1023203 - RNA, 22 nt, Human
ggcagugguuagaaacaugagc

SEQ ID NO: 1023204 - RNA, 22 nt, Human
cagaagcauugacuccuugcuc

SEQ ID NO: 1023205 - RNA, 22 nt, Human
ucaaagucacaacucucuaauu

SEQ ID NO: 1023206 - RNA, 22 nt, Human
uuuguuuagaugguaaaucagu

SEQ ID NO: 1023207 - RNA, 22 nt, Human
uugcauugaucccagcuugggc

SEQ ID NO: 1023208 - RNA, 22 nt, Human
uuaaaauagccagugccccucu

SEQ ID NO: 1023209 - RNA, 22 nt, Human
uuccuggugguggugacagcac

SEQ ID NO: 1023210 - RNA, 22 nt, Human
acuuccugcaaucguccacucc

SEQ ID NO: 1023211 - RNA, 22 nt, Human
auuucucacucacaguccaugu

SEQ ID NO: 1023212 - RNA, 22 nt, Human
ucugucaaaaguuuucaauaaa

SEQ ID NO: 1023213 - RNA, 22 nt, Human
uuauguaccugaauuaguaaag

SEQ ID NO: 1023214 - RNA, 22 nt, Human
ucuguucagcugccucagggua

SEQ ID NO: 1023215 - RNA, 22 nt, Human
acaaaaauuagcugggcauggu

SEQ ID NO: 1023216 - RNA, 22 nt, Human
ucagaggagccaaaguucugag

SEQ ID NO: 1023217 - RNA, 22 nt, Human
uccugcaggccagaggggugag

SEQ ID NO: 1023218 - RNA, 22 nt, Human
cugugcaguaggucagggcugg

SEQ ID NO: 1023219 - RNA, 22 nt, Human
ccagcagagggucuuggccauu

SEQ ID NO: 1023220 - RNA, 22 nt, Human
acacaggggcucggcugggugc

SEQ ID NO: 1023221 - RNA, 22 nt, Human
aaggcuuuugggaauuuucaac

SEQ ID NO: 1023222 - RNA, 22 nt, Human
agggcuggcaucucuaaugcug

SEQ ID NO: 1023223 - RNA, 19 nt, Human
cucagcuguagcucaugug

SEQ ID NO: 1023224 - RNA, 22 nt, Human
gacccaggguauccagagcugc

SEQ ID NO: 1023225 - RNA, 22 nt, Human
aaagguuaguucuuagaagugc

SEQ ID NO: 1023226 - RNA, 22 nt, Human
cagcugccccauaaaucacagu

SEQ ID NO: 1023227 - RNA, 22 nt, Human
uauuuaaaaagaggccagcugg

SEQ ID NO: 1023228 - RNA, 22 nt, Human
agccuggagaggcgccauacac

SEQ ID NO: 1023229 - RNA, 22 nt, Human
cucaggauccaucuccugcccu

SEQ ID NO: 1023230 - RNA, 22 nt, Human
cagaagcaaaugccuugcugag

SEQ ID NO: 1023231 - RNA, 22 nt, Human
gccagagguucaacaacugucu

SEQ ID NO: 1023232 - RNA, 22 nt, Human
cagggugggcacccagccucca

SEQ ID NO: 1023233 - RNA, 22 nt, Human
uacauaugaacuuuauaacuug

SEQ ID NO: 1023234 - RNA, 22 nt, Human
gcuggcuguguuucaucucuga

SEQ ID NO: 1023235 - RNA, 22 nt, Human
agccagcaggugagugcagccu

SEQ ID NO: 1023236 - RNA, 22 nt, Human
guggcccaggcuuggcgcuggc

SEQ ID NO: 1023237 - RNA, 22 nt, Human
ggagccagggaagcugcuuccu

SEQ ID NO: 1023238 - RNA, 22 nt, Human
ucucagagugacaaugagaauu

SEQ ID NO: 1023239 - RNA, 22 nt, Human
uaugagaaaauaaauaucuguu

SEQ ID NO: 1023240 - RNA, 22 nt, Human
ucugggcagcagcagcuaguag

SEQ ID NO: 1023241 - RNA, 22 nt, Human
ucacauuuucauauucucugag

SEQ ID NO: 1023242 - RNA, 16 nt, Human
gagccaggugccuuga

SEQ ID NO: 1023243 - RNA, 22 nt, Human
auucugauaucuuauucuagcu

SEQ ID NO: 1023244 - RNA, 22 nt, Human
guccuggcccacuggcaggcug

SEQ ID NO: 1023245 - RNA, 16 nt, Human
gggagggaguuggugg

SEQ ID NO: 1023246 - RNA, 22 nt, Human
gccuuucaguuccaucaaagga

SEQ ID NO: 1023247 - RNA, 22 nt, Human
ucagcaaugagaacuggcauuu

SEQ ID NO: 1023248 - RNA, 22 nt, Human
acuuggcaaguaucuauaaagu

SEQ ID NO: 1023249 - RNA, 22 nt, Human
uccacauccauugcuugacuuu

SEQ ID NO: 1023250 - RNA, 22 nt, Human
uguuuuaugagccauauaaccu

SEQ ID NO: 1023251 - RNA, 22 nt, Human
cagcuucuggcguggagccuga

SEQ ID NO: 1023252 - RNA, 22 nt, Human
aggcccugaagucggccccuca

SEQ ID NO: 1023253 - RNA, 22 nt, Human
cucacaggagaaagucaugguc

SEQ ID NO: 1023254 - RNA, 22 nt, Human
uuguucaugguuguaaguuuga

SEQ ID NO: 1023255 - RNA, 22 nt, Human
acauuucuuuucaucucuauau

SEQ ID NO: 1023256 - RNA, 22 nt, Human
ggccuugguaaagggaugcaug

SEQ ID NO: 1023257 - RNA, 22 nt, Human
ccaaagugcugagauuacaggu

SEQ ID NO: 1023258 - RNA, 22 nt, Human
cuggaguuagaguagacacuga

SEQ ID NO: 1023259 - RNA, 22 nt, Human
ugaaggccucugguacaugcca

SEQ ID NO: 1023260 - RNA, 22 nt, Human
gagaaaugcaugcaugucauca

SEQ ID NO: 1023261 - RNA, 22 nt, Human
cagagcugauuggauccagaga

SEQ ID NO: 1023262 - RNA, 22 nt, Human
cagggccaccguguuugcugcu

SEQ ID NO: 1023263 - RNA, 18 nt, Human
ggagccagucugucucug

SEQ ID NO: 1023264 - RNA, 22 nt, Human
cugcagagcuaggcugagugaa

SEQ ID NO: 1023265 - RNA, 22 nt, Human
ucagaggaauaaugcugcauuu

SEQ ID NO: 1023266 - RNA, 18 nt, Human
gcagcugacacuggaguu

SEQ ID NO: 1023267 - RNA, 22 nt, Human
aaaugaacaguugcauucucug

SEQ ID NO: 1023268 - RNA, 21 nt, Human
accucaagcaacaaccaaggu

SEQ ID NO: 1023269 - RNA, 22 nt, Human
caugaaaauaacauuguuguga

SEQ ID NO: 1023270 - RNA, 22 nt, Human
uuagaacuuaagaauacugucu

SEQ ID NO: 1023271 - RNA, 22 nt, Human
cagcaguggccaucuguguggu

SEQ ID NO: 1023272 - RNA, 19 nt, Human
cagaccuguccagccugug

SEQ ID NO: 1023273 - RNA, 22 nt, Human
uuggaaauugcaagugauuugc

SEQ ID NO: 1023274 - RNA, 22 nt, Human
auuucacaucuaucucagauuu

SEQ ID NO: 1023275 - RNA, 22 nt, Human
uggcuuccuggacagaugcggu

SEQ ID NO: 1023276 - RNA, 22 nt, Human
cauuugaaauucuuagaacaaa

SEQ ID NO: 1023277 - RNA, 22 nt, Human
auguaugagagauucuuuuauu

SEQ ID NO: 1023278 - RNA, 22 nt, Human
uggagucugugaugcucugggu

SEQ ID NO: 1023279 - RNA, 20 nt, Human
uuugucuguuaaguguuucu

SEQ ID NO: 1023280 - RNA, 22 nt, Human
ccaaggcuucccagagaugcuc

SEQ ID NO: 1023281 - RNA, 22 nt, Human
ugugcccauuccacuugaguac

SEQ ID NO: 1023282 - RNA, 22 nt, Human
ggggugggcgugcagggacacc

SEQ ID NO: 1023283 - RNA, 22 nt, Human
cccaugagguggagguugcagu

SEQ ID NO: 1023284 - RNA, 22 nt, Human
ugcugucugauucagggugauu

SEQ ID NO: 1023285 - RNA, 22 nt, Human
ugcugcacucaccaacagauaa

SEQ ID NO: 1023286 - RNA, 22 nt, Human
acucacuuuccauucaagcacc

SEQ ID NO: 1023287 - RNA, 22 nt, Human
guuuucuuugaaugcuucuaga

SEQ ID NO: 1023288 - RNA, 22 nt, Human
cugagccagcgggcucacuuuu

SEQ ID NO: 1023289 - RNA, 22 nt, Human
uucccucucacuuaaagcuugg

SEQ ID NO: 1023290 - RNA, 22 nt, Human
aucugccugcaguggagguggg

SEQ ID NO: 1023291 - RNA, 22 nt, Human
ugggcagacgggagcuugccuu

SEQ ID NO: 1023292 - RNA, 22 nt, Human
auggaaaggcuguggaaacuua

SEQ ID NO: 1023293 - RNA, 22 nt, Human
cugggcacugcaggguguugag

SEQ ID NO: 1023294 - RNA, 22 nt, Human
ccaaggagaaugacaccaugga

SEQ ID NO: 1023295 - RNA, 22 nt, Human
gcagggaccuugcccacccucc

SEQ ID NO: 1023296 - RNA, 22 nt, Human
aaugaucuacucucauuaucuc

SEQ ID NO: 1023297 - RNA, 22 nt, Human
uggaucucggcaaugcgggacu

SEQ ID NO: 1023298 - RNA, 22 nt, Human
caggccacaaguuggguucaag

SEQ ID NO: 1023299 - RNA, 22 nt, Human
cagaaaauaaaguuucuacgca

SEQ ID NO: 1023300 - RNA, 20 nt, Human
uuucagugguuugugccuag

SEQ ID NO: 1023301 - RNA, 22 nt, Human
caaggccuccugggcccagaga

SEQ ID NO: 1023302 - RNA, 22 nt, Human
aagaauguucauuaaacuguug

SEQ ID NO: 1023303 - RNA, 22 nt, Human
ccaucuccacugucccugucaa

SEQ ID NO: 1023304 - RNA, 22 nt, Human
acucugagcaucccaagucuua

SEQ ID NO: 1023305 - RNA, 22 nt, Human
cuggcuggucaucagcaguacg

SEQ ID NO: 1023306 - RNA, 22 nt, Human
ccacucugauuuuggcuccacu

SEQ ID NO: 1023307 - RNA, 22 nt, Human
uauguuauuuucauacaacaga

SEQ ID NO: 1023308 - RNA, 22 nt, Human
uuuguuuucaaugugucauuca

SEQ ID NO: 1023309 - RNA, 22 nt, Human
cauuacaugguccaggauauau

SEQ ID NO: 1023310 - RNA, 22 nt, Human
gagcuggcaggaggcuccccga

SEQ ID NO: 1023311 - RNA, 22 nt, Human
ucaaugauagacaagaucuaag

SEQ ID NO: 1023312 - RNA, 22 nt, Human
ucagagguaagggcugagagga

SEQ ID NO: 1023313 - RNA, 22 nt, Human
caaaagucuuccuauucucuua

SEQ ID NO: 1023314 - RNA, 22 nt, Human
gaugcacaugugaguauagaag

SEQ ID NO: 1023315 - RNA, 22 nt, Human
augacacuuggugauacuuugu

SEQ ID NO: 1023316 - RNA, 22 nt, Human
auucagcaguuccugcuucagu

SEQ ID NO: 1023317 - RNA, 22 nt, Human
gcucaggagcucuugguggcgc

SEQ ID NO: 1023318 - RNA, 22 nt, Human
aacuagaaaacaagaugcugau

SEQ ID NO: 1023319 - RNA, 22 nt, Human
gccagaaacauacacaucacuu

SEQ ID NO: 1023320 - RNA, 22 nt, Human
ucagcuggcaguucagaggcug

SEQ ID NO: 1023321 - RNA, 21 nt, Human
ugggagagggcucagcuaccc

SEQ ID NO: 1023322 - RNA, 22 nt, Human
uccugagagcagaguccaggug

SEQ ID NO: 1023323 - RNA, 22 nt, Human
gaaauauuucucuugagccccu

SEQ ID NO: 1023324 - RNA, 22 nt, Human
agcagacauaucucaugucaca

SEQ ID NO: 1023325 - RNA, 22 nt, Human
accauguguuuuacacauggua

SEQ ID NO: 1023326 - RNA, 22 nt, Human
gagcugcugguugcuggugccu

SEQ ID NO: 1023327 - RNA, 22 nt, Human
agacaucagcuugugugcaggg

SEQ ID NO: 1023328 - RNA, 22 nt, Human
gccuggugaaaggcagagagcg

SEQ ID NO: 1023329 - RNA, 21 nt, Human
cagacccucuagaggccaccu

SEQ ID NO: 1023330 - RNA, 22 nt, Human
cucacugugccuuuucccaaac

SEQ ID NO: 1023331 - RNA, 18 nt, Human
gacccagcagaugggcuu

SEQ ID NO: 1023332 - RNA, 22 nt, Human
gggagccaaggagagaggccuu

SEQ ID NO: 1023333 - RNA, 19 nt, Human
ugcucaggccaaggagccc

SEQ ID NO: 1023334 - RNA, 23 nt, Human
uccugaggguuucccagccuugg

SEQ ID NO: 1023335 - RNA, 22 nt, Human
gcugcugucagugguggcaguu

SEQ ID NO: 1023336 - RNA, 22 nt, Human
uugcagcagggugaauucacuc

SEQ ID NO: 1023337 - RNA, 22 nt, Human
aaaguuagaaugauaucaacga

SEQ ID NO: 1023338 - RNA, 22 nt, Human
ucagagaggcaauacuguuuaa

SEQ ID NO: 1023339 - RNA, 22 nt, Human
ucagugcacagagauuuuuguu

SEQ ID NO: 1023340 - RNA, 22 nt, Human
ggggaccuggccacccauccuu

SEQ ID NO: 1023341 - RNA, 22 nt, Human
aggaccugacuggcuccugcuu

SEQ ID NO: 1023342 - RNA, 22 nt, Human
cagucccaaggaggaagcaguc

SEQ ID NO: 1023343 - RNA, 22 nt, Human
ggcucuggucagugaggggccu

SEQ ID NO: 1023344 - RNA, 22 nt, Human
aagggagacaguugugugagga

SEQ ID NO: 1023345 - RNA, 22 nt, Human
cagagagcuuagugugcugcau

SEQ ID NO: 1023346 - RNA, 15 nt, Human
aggcacugugggacc

SEQ ID NO: 1023347 - RNA, 22 nt, Human
guuuuccuucucagccauugcc

SEQ ID NO: 1023348 - RNA, 22 nt, Human
uagcaggguccaaugugaggca

SEQ ID NO: 1023349 - RNA, 22 nt, Human
uguuaucugagcaacgucgacg

SEQ ID NO: 1023350 - RNA, 22 nt, Human
agcuuguuaaggaugcauauua

SEQ ID NO: 1023351 - RNA, 22 nt, Human
cuuuaagagaucaccaaucaca

SEQ ID NO: 1023352 - RNA, 22 nt, Human
agccaggauggucucgaucggc

SEQ ID NO: 1023353 - RNA, 22 nt, Human
agaaugcaagauaaacuuuauu

SEQ ID NO: 1023354 - RNA, 22 nt, Human
gcagcagaggcccuacucuuug

SEQ ID NO: 1023355 - RNA, 18 nt, Human
agggaucaucacugcagc

SEQ ID NO: 1023356 - RNA, 22 nt, Human
uggccugggugcugcugacauc

SEQ ID NO: 1023357 - RNA, 22 nt, Human
gcugucagcgcccaaggagcuc

SEQ ID NO: 1023358 - RNA, 20 nt, Human
cccucugcacauggcugugg

SEQ ID NO: 1023359 - RNA, 22 nt, Human
uccaugagcuagcuuuccaaag

SEQ ID NO: 1023360 - RNA, 22 nt, Human
cagggcucaggaaaucagacgu

SEQ ID NO: 1023361 - RNA, 22 nt, Human
aucuuucaguuucauaccaauu

SEQ ID NO: 1023362 - RNA, 21 nt, Human
agcagccauggaugguaugua

SEQ ID NO: 1023363 - RNA, 22 nt, Human
ucagggcaggcgagcagcugcu

SEQ ID NO: 1023364 - RNA, 22 nt, Human
aucacuguguauguauaugcag

SEQ ID NO: 1023365 - RNA, 22 nt, Human
gcaggcaggcuuccuugaacug

SEQ ID NO: 1023366 - RNA, 22 nt, Human
aaauguguguauguacauauau

SEQ ID NO: 1023367 - RNA, 22 nt, Human
uccagggaugguaaugagcagu

SEQ ID NO: 1023368 - RNA, 20 nt, Human
uagauuucauacuucucuuu

SEQ ID NO: 1023369 - RNA, 22 nt, Human
uugcauugggagugaggagacc

SEQ ID NO: 1023370 - RNA, 22 nt, Human
gccagccuucuguggccugcaa

SEQ ID NO: 1023371 - RNA, 20 nt, Human
ucauccaguugguuuauggu

SEQ ID NO: 1023372 - RNA, 19 nt, Human
cccucaggucugagcaguc

SEQ ID NO: 1023373 - RNA, 22 nt, Human
uacauguauugauuucucuucu

SEQ ID NO: 1023374 - RNA, 22 nt, Human
ucagacaguuugcagugugccu

SEQ ID NO: 1023375 - RNA, 22 nt, Human
acuuccuggcugggugaccugg

SEQ ID NO: 1023376 - RNA, 22 nt, Human
gggaaauugugugagaucuuug

SEQ ID NO: 1023377 - RNA, 22 nt, Human
gcaccaggcuuagagccccagg

SEQ ID NO: 1023378 - RNA, 22 nt, Human
uaacacauaucuacaacaugug

SEQ ID NO: 1023379 - RNA, 22 nt, Human
agcagggggaguuagacuagau

SEQ ID NO: 1023380 - RNA, 22 nt, Human
caggcagccuucucgucucaca

SEQ ID NO: 1023381 - RNA, 22 nt, Human
agugacucacuagcucucagug

SEQ ID NO: 1023382 - RNA, 22 nt, Human
ccagucacuggaaaaugggaau

SEQ ID NO: 1023383 - RNA, 22 nt, Human
gugugcccuggcuccagcacca

SEQ ID NO: 1023384 - RNA, 19 nt, Human
ucaaaugccaaugucacag

SEQ ID NO: 1023385 - RNA, 19 nt, Human
aucugccuguuaucacaua

SEQ ID NO: 1023386 - RNA, 22 nt, Human
gcuguucagggcacucaugggc

SEQ ID NO: 1023387 - RNA, 22 nt, Human
gcaaggcugcugccacccaucu

SEQ ID NO: 1023388 - RNA, 22 nt, Human
gaaggccauuagagccugugcc

SEQ ID NO: 1023389 - RNA, 22 nt, Human
ggggaccuucccagagcaguug

SEQ ID NO: 1023390 - RNA, 22 nt, Human
ucaauucaacacaugcacauug

SEQ ID NO: 1023391 - RNA, 22 nt, Human
cugggagauugcuagagaugca

SEQ ID NO: 1023392 - RNA, 22 nt, Human
ggcuccagggaguggagagaag

SEQ ID NO: 1023393 - RNA, 22 nt, Human
uuggaaggcccugccuagcagg

SEQ ID NO: 1023394 - RNA, 22 nt, Human
uguuccaucaguuuuugguuga

SEQ ID NO: 1023395 - RNA, 22 nt, Human
aggaaagggguagguguggacg

SEQ ID NO: 1023396 - RNA, 22 nt, Human
gcagacagccagacugcacugg

SEQ ID NO: 1023397 - RNA, 22 nt, Human
cuggccuggucuggccucucca

SEQ ID NO: 1023398 - RNA, 20 nt, Human
cucuggcuccgcgugaccgc

SEQ ID NO: 1023399 - RNA, 22 nt, Human
acccaggcuggagugcaguagc

SEQ ID NO: 1023400 - RNA, 22 nt, Human
aaacaaacauagguuugaaagu

SEQ ID NO: 1023401 - RNA, 22 nt, Human
ucuuagaaaugaaguucuuucu

SEQ ID NO: 1023402 - RNA, 22 nt, Human
aucuagauuagguauaagagcu

SEQ ID NO: 1023403 - RNA, 22 nt, Human
ggagcuguucaggacugcuuca

SEQ ID NO: 1023404 - RNA, 22 nt, Human
aaacuguauauuuauggcaugu

SEQ ID NO: 1023405 - RNA, 22 nt, Human
ucagcuuucucucgccaucagg

SEQ ID NO: 1023406 - RNA, 22 nt, Human
cagggagaaaucuccaggaggu

SEQ ID NO: 1023407 - RNA, 22 nt, Human
uuuaagagcuaguaugucauuu

SEQ ID NO: 1023408 - RNA, 22 nt, Human
ucuggcuccacuuucuucauuu

SEQ ID NO: 1023409 - RNA, 22 nt, Human
ggcucagagaccugcgaucuga

SEQ ID NO: 1023410 - RNA, 22 nt, Human
gcuggccugcugggcaccaccg

SEQ ID NO: 1023411 - RNA, 22 nt, Human
cuuucucaaugccggaaggcac

SEQ ID NO: 1023412 - RNA, 22 nt, Human
ugugcugguacaugugaggaug

SEQ ID NO: 1023413 - RNA, 22 nt, Human
cccuccagagcuugaccugcug

SEQ ID NO: 1023414 - RNA, 22 nt, Human
acauugaucagccucccaugca

SEQ ID NO: 1023415 - RNA, 22 nt, Human
ccagcuccugggucuuagucag

SEQ ID NO: 1023416 - RNA, 22 nt, Human
guggagccaggggcuguaggua

SEQ ID NO: 1023417 - RNA, 22 nt, Human
ucuggcugcugcgugagugcuu

SEQ ID NO: 1023418 - RNA, 22 nt, Human
acaauguaggauauguacuugu

SEQ ID NO: 1023419 - RNA, 22 nt, Human
ccagggcaugggaagaacugaa

SEQ ID NO: 1023420 - RNA, 22 nt, Human
uccaguggcacuggagacuaga

SEQ ID NO: 1023421 - RNA, 22 nt, Human
ucuccugugcacccucccugug

SEQ ID NO: 1023422 - RNA, 22 nt, Human
cccugccuugggguccacaccg

SEQ ID NO: 1023423 - RNA, 22 nt, Human
ugagaacugaggauuugaauuc

SEQ ID NO: 1023424 - RNA, 22 nt, Human
ccaggccuguguuguguggagg

SEQ ID NO: 1023425 - RNA, 22 nt, Human
ugauuuccucuacuagcaauua

SEQ ID NO: 1023426 - RNA, 22 nt, Human
cagaagcacuaggaggaaacgu

SEQ ID NO: 1023427 - RNA, 22 nt, Human
uuuaauuuuccucuuccuggag

SEQ ID NO: 1023428 - RNA, 22 nt, Human
caggcugggcagccuccccggc

SEQ ID NO: 1023429 - RNA, 22 nt, Human
gagggcuccauuccccgugccc

SEQ ID NO: 1023430 - RNA, 22 nt, Human
acagagcuuaauucaggagcuu

SEQ ID NO: 1023431 - RNA, 22 nt, Human
gccaggcaaauuaaggaaugca

SEQ ID NO: 1023432 - RNA, 22 nt, Human
uuuuauuggagugauaccaagc

SEQ ID NO: 1023433 - RNA, 22 nt, Human
ugcuccauucucuagccagugc

SEQ ID NO: 1023434 - RNA, 22 nt, Human
ugugcagggaagggcaugcuau

SEQ ID NO: 1023435 - RNA, 22 nt, Human
agcuccaggugcaagucauggu

SEQ ID NO: 1023436 - RNA, 22 nt, Human
gcuuuauuuugugagggauuac

SEQ ID NO: 1023437 - RNA, 22 nt, Human
ugaaagguguccaauauuucuc

SEQ ID NO: 1023438 - RNA, 22 nt, Human
aguuuagaguucaaauuaguuc

SEQ ID NO: 1023439 - RNA, 22 nt, Human
uucaugugaauauauuugucuu

SEQ ID NO: 1023440 - RNA, 22 nt, Human
agccaugcaccuuacucuugcu

SEQ ID NO: 1023441 - RNA, 22 nt, Human
uucuggagcuaaaguccacucu

SEQ ID NO: 1023442 - RNA, 22 nt, Human
gcccagcacagcuggaagaguc

SEQ ID NO: 1023443 - RNA, 22 nt, Human
gcagaagggaauaaggagcuuu

SEQ ID NO: 1023444 - RNA, 20 nt, Human
gcagcagacagacaggggac

SEQ ID NO: 1023445 - RNA, 22 nt, Human
ucucaggacuuugggaagcuca

SEQ ID NO: 1023446 - RNA, 22 nt, Human
ugaugaaauguugaggcaguga

SEQ ID NO: 1023447 - RNA, 22 nt, Human
ggcacugagcugccuuggggca

SEQ ID NO: 1023448 - RNA, 22 nt, Human
agauuuccugcacugccuuuga

SEQ ID NO: 1023449 - RNA, 22 nt, Human
ugcauuugucuugucucaugaa

SEQ ID NO: 1023450 - RNA, 22 nt, Human
aucuggcuuggguguggguagc

SEQ ID NO: 1023451 - RNA, 22 nt, Human
augcugagcagagcugacaugc

SEQ ID NO: 1023452 - RNA, 22 nt, Human
guuuauaaggcccaauauuucu

SEQ ID NO: 1023453 - RNA, 23 nt, Human
uaagaacagacaagcauuuacau

SEQ ID NO: 1023454 - RNA, 22 nt, Human
cccaggcacucuuggucauuuu

SEQ ID NO: 1023455 - RNA, 22 nt, Human
aguggggcggacaggaccagga

SEQ ID NO: 1023456 - RNA, 22 nt, Human
ucauuuguaccauuuuuuaaga

SEQ ID NO: 1023457 - RNA, 22 nt, Human
uuuauguaaguggaaugaugcc

SEQ ID NO: 1023458 - RNA, 23 nt, Human
ucuggcucuaugugacagcucuc

SEQ ID NO: 1023459 - RNA, 22 nt, Human
aaaugaugcucacagauuagug

SEQ ID NO: 1023460 - RNA, 22 nt, Human
uuagcuaaacuguaacuagaau

SEQ ID NO: 1023461 - RNA, 22 nt, Human
agagggcugccucagucagcua

SEQ ID NO: 1023462 - RNA, 23 nt, Human
aagaauaaaugacauuaaaggug

SEQ ID NO: 1023463 - RNA, 22 nt, Human
aaagaaauagauggcauuuaaa

SEQ ID NO: 1023464 - RNA, 22 nt, Human
cugggccugggaggccaggucu

SEQ ID NO: 1023465 - RNA, 22 nt, Human
agaguucugcucuucucaguga

SEQ ID NO: 1023466 - RNA, 22 nt, Human
ggccugaggcaauagucagaca

SEQ ID NO: 1023467 - RNA, 22 nt, Human
ggggcagaaguagugccccuga

SEQ ID NO: 1023468 - RNA, 22 nt, Human
gauuucuugauaaguaguguga

SEQ ID NO: 1023469 - RNA, 19 nt, Human
cuguccuuggcugcacugu

SEQ ID NO: 1023470 - RNA, 23 nt, Human
cgcccagccucagugaccugggc

SEQ ID NO: 1023471 - RNA, 22 nt, Human
agcauuuaguuaguaaauguuu

SEQ ID NO: 1023472 - RNA, 22 nt, Human
agggcuccaaggaaguguagcu

SEQ ID NO: 1023473 - RNA, 22 nt, Human
agggccuggaacuggagaccac

SEQ ID NO: 1023474 - RNA, 22 nt, Human
acaauacuauuuucaguauccu

SEQ ID NO: 1023475 - RNA, 20 nt, Human
agguggcuccugcugggggu

SEQ ID NO: 1023476 - RNA, 22 nt, Human
cacugccuggaaggagagacau

SEQ ID NO: 1023477 - RNA, 22 nt, Human
ccugugucagccccugccucca

SEQ ID NO: 1023478 - RNA, 22 nt, Human
agccagccaguucacuaggaaa

SEQ ID NO: 1023479 - RNA, 22 nt, Human
cugcucugugguccaugagaca

SEQ ID NO: 1023480 - RNA, 22 nt, Human
ugauuuccacagucaggggugc

SEQ ID NO: 1023481 - RNA, 22 nt, Human
auugacaagcaguaugucuuag

SEQ ID NO: 1023482 - RNA, 22 nt, Human
ccagagagucgaugggggacac

SEQ ID NO: 1023483 - RNA, 22 nt, Human
uaacacauuuuaagccauuuua

SEQ ID NO: 1023484 - RNA, 22 nt, Human
agcucagggcgaucugucucgg

SEQ ID NO: 1023485 - RNA, 22 nt, Human
gaguuauuaauggcugaguuug

SEQ ID NO: 1023486 - RNA, 22 nt, Human
cuauugaauagcccaaaucauu

SEQ ID NO: 1023487 - RNA, 22 nt, Human
auguagaagcugacagugcugu

SEQ ID NO: 1023488 - RNA, 22 nt, Human
gcugccugaagugucuacacug

SEQ ID NO: 1023489 - RNA, 22 nt, Human
gagcuuuagcugagaccugcuu

SEQ ID NO: 1023490 - RNA, 22 nt, Human
aauuacuuaagagaaacuuuga

SEQ ID NO: 1023491 - RNA, 22 nt, Human
cuggagaggcugggaacagguu

SEQ ID NO: 1023492 - RNA, 22 nt, Human
ccaggagcauuaagagaacaua

SEQ ID NO: 1023493 - RNA, 22 nt, Human
cagagcugcacauucuaugaug

SEQ ID NO: 1023494 - RNA, 22 nt, Human
caggggcucuaaugcaugauca

SEQ ID NO: 1023495 - RNA, 22 nt, Human
agagccugcagcugugaagaaa

SEQ ID NO: 1023496 - RNA, 22 nt, Human
cuggagccccagacagggagag

SEQ ID NO: 1023497 - RNA, 22 nt, Human
agucccagagaggucggggcca

SEQ ID NO: 1023498 - RNA, 22 nt, Human
ucagagagcuggugggcagagg

SEQ ID NO: 1023499 - RNA, 22 nt, Human
ucugaagaacugaguaaacaug

SEQ ID NO: 1023500 - RNA, 22 nt, Human
cguguggucccggcaaggcaag

SEQ ID NO: 1023501 - RNA, 22 nt, Human
gccccagccaaggugacacgaa

SEQ ID NO: 1023502 - RNA, 22 nt, Human
cugugcauugucuugucuguag

SEQ ID NO: 1023503 - RNA, 22 nt, Human
gcugggaagugcaagaucaagg

SEQ ID NO: 1023504 - RNA, 20 nt, Human
cuucuucaguaguuuguucu

SEQ ID NO: 1023505 - RNA, 22 nt, Human
uuugcauaagucauguccagug

SEQ ID NO: 1023506 - RNA, 22 nt, Human
cugggccaucagaggggcugga

SEQ ID NO: 1023507 - RNA, 18 nt, Human
cagaaaucacaccagcac

SEQ ID NO: 1023508 - RNA, 22 nt, Human
augcuuuacaguuuuccaaaca

SEQ ID NO: 1023509 - RNA, 22 nt, Human
ugaacaacugcaaaaaucucca

SEQ ID NO: 1023510 - RNA, 22 nt, Human
ugcugggggugucucaccaggc

SEQ ID NO: 1023511 - RNA, 22 nt, Human
uguguauuaccauuuuacagcu

SEQ ID NO: 1023512 - RNA, 22 nt, Human
cagcuuuccagagaccugcccc

SEQ ID NO: 1023513 - RNA, 22 nt, Human
gcagcaugagcuauacaaagua

SEQ ID NO: 1023514 - RNA, 20 nt, Human
ucugcucagcccucaguggc

SEQ ID NO: 1023515 - RNA, 22 nt, Human
uuucaucuaacacuacauaggg

SEQ ID NO: 1023516 - RNA, 20 nt, Human
agaaucugacccagagagac

SEQ ID NO: 1023517 - RNA, 19 nt, Human
uucuaccuuacuguaggcu

SEQ ID NO: 1023518 - RNA, 22 nt, Human
agcaaggcagucagcuggcugg

SEQ ID NO: 1023519 - RNA, 22 nt, Human
cauggcccucuucuggagcaau

SEQ ID NO: 1023520 - RNA, 22 nt, Human
uaugaacugugagugugauggg

SEQ ID NO: 1023521 - RNA, 22 nt, Human
auaacagaugugaagugcuaau

SEQ ID NO: 1023522 - RNA, 19 nt, Human
ggccccucucacaggaguu

SEQ ID NO: 1023523 - RNA, 22 nt, Human
ucuuccaguguagacaucugcc

SEQ ID NO: 1023524 - RNA, 22 nt, Human
cccagcuaccucugcuaggaga

SEQ ID NO: 1023525 - RNA, 19 nt, Human
ccagcagcuuugauucucu

SEQ ID NO: 1023526 - RNA, 22 nt, Human
uucauuaguucugaagaugucu

SEQ ID NO: 1023527 - RNA, 22 nt, Human
caccaggcugaaccagagggga

SEQ ID NO: 1023528 - RNA, 22 nt, Human
agguggguaucaugagagauua

SEQ ID NO: 1023529 - RNA, 22 nt, Human
cuccuggacauggagcggagga

SEQ ID NO: 1023530 - RNA, 22 nt, Human
acaggcagguccugucccagcu

SEQ ID NO: 1023531 - RNA, 20 nt, Human
ugcuuuaugcuauacuuugu

SEQ ID NO: 1023532 - RNA, 22 nt, Human
uguuucuuuguagauauucuuu

SEQ ID NO: 1023533 - RNA, 22 nt, Human
uggagcaggugcucaggguaau

SEQ ID NO: 1023534 - RNA, 22 nt, Human
gcuguucccauguggggcucag

SEQ ID NO: 1023535 - RNA, 22 nt, Human
ggcuggagacaacguccugccc

SEQ ID NO: 1023536 - RNA, 22 nt, Human
gugcugggcuccaccccagagg

SEQ ID NO: 1023537 - RNA, 22 nt, Human
acuuagaacaggcagaauucca

SEQ ID NO: 1023538 - RNA, 23 nt, Human
uccagggauuaaugaagucaguc

SEQ ID NO: 1023539 - RNA, 22 nt, Human
guuccuauauagccuuaaggau

SEQ ID NO: 1023540 - RNA, 22 nt, Human
ucaugcaaggcugaaacauggu

SEQ ID NO: 1023541 - RNA, 22 nt, Human
ccccuuccaggaagcagaaucg

SEQ ID NO: 1023542 - RNA, 22 nt, Human
agaagcaguuauuuuuugcaca

SEQ ID NO: 1023543 - RNA, 22 nt, Human
uccucaugccgggucucacgcu

SEQ ID NO: 1023544 - RNA, 22 nt, Human
ggcacugggugagggucacugg

SEQ ID NO: 1023545 - RNA, 22 nt, Human
ggguggcacaggugcagagggu

SEQ ID NO: 1023546 - RNA, 22 nt, Human
gaggccugguuugcaugagaau

SEQ ID NO: 1023547 - RNA, 22 nt, Human
uccaggccuaggccaagugauu

SEQ ID NO: 1023548 - RNA, 22 nt, Human
uguuagaaguuaaucacuaauu

SEQ ID NO: 1023549 - RNA, 22 nt, Human
ucucagaggucuucagccucug

SEQ ID NO: 1023550 - RNA, 22 nt, Human
ccauccuaucugaccuacuugu

SEQ ID NO: 1023551 - RNA, 21 nt, Human
uaaggccaagucuauuucugu

SEQ ID NO: 1023552 - RNA, 22 nt, Human
gcccagccuccaagcuccaagg

SEQ ID NO: 1023553 - RNA, 22 nt, Human
guucuguacuccaagcucuucc

SEQ ID NO: 1023554 - RNA, 22 nt, Human
agugugucgagggaggguccag

SEQ ID NO: 1023555 - RNA, 22 nt, Human
acaguuucuccauuuacaccuu

SEQ ID NO: 1023556 - RNA, 22 nt, Human
cuuauuagaaagaaaagacaug

SEQ ID NO: 1023557 - RNA, 19 nt, Human
gucacauuugucucccagg

SEQ ID NO: 1023558 - RNA, 22 nt, Human
acccuggguucccgcagcacca

SEQ ID NO: 1023559 - RNA, 22 nt, Human
ugucaccaguuccaggaaauaa

SEQ ID NO: 1023560 - RNA, 22 nt, Human
ucuuuucaucauuuaauaggua

SEQ ID NO: 1023561 - RNA, 21 nt, Human
ccagagagagggaaguggguu

SEQ ID NO: 1023562 - RNA, 22 nt, Human
cuacauuuggagaguauaggaa

SEQ ID NO: 1023563 - RNA, 23 nt, Human
acagaaaucauuuguaagguacc

SEQ ID NO: 1023564 - RNA, 22 nt, Human
uuaaugcagaaaucaaacugac

SEQ ID NO: 1023565 - RNA, 22 nt, Human
uagaaacauauaggauggcagg

SEQ ID NO: 1023566 - RNA, 19 nt, Human
agcagagcccugaagaucc

SEQ ID NO: 1023567 - RNA, 20 nt, Human
ucacaggggaccaggagcag

SEQ ID NO: 1023568 - RNA, 22 nt, Human
agggcuccgggccaccggccug

SEQ ID NO: 1023569 - RNA, 22 nt, Human
uccaggcaugucccaagccgga

SEQ ID NO: 1023570 - RNA, 22 nt, Human
uggacaggugagugacucaggg

SEQ ID NO: 1023571 - RNA, 20 nt, Human
uuccuguauacaaagaguuc

SEQ ID NO: 1023572 - RNA, 22 nt, Human
auuucuuccucugucaguaacu

SEQ ID NO: 1023573 - RNA, 22 nt, Human
ugggacaguuguccuccacucu

SEQ ID NO: 1023574 - RNA, 22 nt, Human
ugggccugacucaccugccucc

SEQ ID NO: 1023575 - RNA, 23 nt, Human
aguacauucgaaaaauucuguga

SEQ ID NO: 1023576 - RNA, 22 nt, Human
uaacagaaauaguaggugaggg

SEQ ID NO: 1023577 - RNA, 22 nt, Human
uugaauucauuucucauugagu

SEQ ID NO: 1023578 - RNA, 23 nt, Human
acagagaucuugacuuguaugga

SEQ ID NO: 1023579 - RNA, 22 nt, Human
cugcuggggucagagcacuggg

SEQ ID NO: 1023580 - RNA, 22 nt, Human
uucucagauauuuacugagcau

SEQ ID NO: 1023581 - RNA, 22 nt, Human
caguuucuguuuuaaauagcag

SEQ ID NO: 1023582 - RNA, 22 nt, Human
uagauuucgcugcaucucaauc

SEQ ID NO: 1023583 - RNA, 22 nt, Human
ccagccuggguguuagaagaca

SEQ ID NO: 1023584 - RNA, 22 nt, Human
gaagcccagggcguggccgggc

SEQ ID NO: 1023585 - RNA, 22 nt, Human
guuaauuuaguagaguccagau

SEQ ID NO: 1023586 - RNA, 22 nt, Human
agugcacaccuuaguacaaagu

SEQ ID NO: 1023587 - RNA, 22 nt, Human
ucucccagaggaucccagugga

SEQ ID NO: 1023588 - RNA, 22 nt, Human
agacagcugcucgcagagcuau

SEQ ID NO: 1023589 - RNA, 22 nt, Human
uugcuguguaacuccuggccug

SEQ ID NO: 1023590 - RNA, 22 nt, Human
guggagacgggacagaagcuaa

SEQ ID NO: 1023591 - RNA, 22 nt, Human
gacugucauucuagugcccaug

SEQ ID NO: 1023592 - RNA, 22 nt, Human
ugggcugcccugaugguccuca

SEQ ID NO: 1023593 - RNA, 22 nt, Human
ccugccagauccccugagcuga

SEQ ID NO: 1023594 - RNA, 22 nt, Human
uauuugaagauucuucugaugu

SEQ ID NO: 1023595 - RNA, 22 nt, Human
acagagcacugcccugugccgc

SEQ ID NO: 1023596 - RNA, 22 nt, Human
uggcccugacagguccugggca

SEQ ID NO: 1023597 - RNA, 22 nt, Human
agcugauuccacuuuuucccca

SEQ ID NO: 1023598 - RNA, 22 nt, Human
ucucaggagccacagcgggagu

SEQ ID NO: 1023599 - RNA, 22 nt, Human
cucuuaaaaacuugauauauuu

SEQ ID NO: 1023600 - RNA, 22 nt, Human
cccaggcagugugugcaugcgu

SEQ ID NO: 1023601 - RNA, 22 nt, Human
ggaggccuugaggccaggagcu

SEQ ID NO: 1023602 - RNA, 22 nt, Human
gacagcagccacagggagaggg

SEQ ID NO: 1023603 - RNA, 22 nt, Human
cauggcauugcauaacggggcu

SEQ ID NO: 1023604 - RNA, 22 nt, Human
uucugucacagugcugguauca

SEQ ID NO: 1023605 - RNA, 22 nt, Human
cagggcagagccaggauuucaa

SEQ ID NO: 1023606 - RNA, 22 nt, Human
ucaggcuggaaugcaguggggc

SEQ ID NO: 1023607 - RNA, 22 nt, Human
aaaaucugcuuccuuuuacaga

SEQ ID NO: 1023608 - RNA, 22 nt, Human
uccaggcaugucugaguccuuc

SEQ ID NO: 1023609 - RNA, 22 nt, Human
ccacacagucaguuuccaagaa

SEQ ID NO: 1023610 - RNA, 22 nt, Human
ggccucagaccggagcuggcca

SEQ ID NO: 1023611 - RNA, 22 nt, Human
gugccugguuuggggaauguuc

SEQ ID NO: 1023612 - RNA, 22 nt, Human
cuggcccauggugagcucuggg

SEQ ID NO: 1023613 - RNA, 22 nt, Human
uaugaaaugguaguaggaaggg

SEQ ID NO: 1023614 - RNA, 22 nt, Human
ggcagcuggccuccucgcccac

SEQ ID NO: 1023615 - RNA, 22 nt, Human
gcugccugauguccagcaggac

SEQ ID NO: 1023616 - RNA, 22 nt, Human
uggcucagaggggaagugguuu

SEQ ID NO: 1023617 - RNA, 22 nt, Human
ccuggccuccuggccuucucau

SEQ ID NO: 1023618 - RNA, 22 nt, Human
gccuggguuccaugaucuccag

SEQ ID NO: 1023619 - RNA, 22 nt, Human
agggguggagaguguugccagu

SEQ ID NO: 1023620 - RNA, 22 nt, Human
ccaggcucugcgcuggacaugg

SEQ ID NO: 1023621 - RNA, 22 nt, Human
gcuggccagggcugcucgcgga

SEQ ID NO: 1023622 - RNA, 22 nt, Human
auuuuucucuuuccacugagau

SEQ ID NO: 1023623 - RNA, 19 nt, Human
ccaggagcaguggugagcu

SEQ ID NO: 1023624 - RNA, 22 nt, Human
aaagauuuaagaauaauuugug

SEQ ID NO: 1023625 - RNA, 23 nt, Human
agacaguggccgagagguacuag

SEQ ID NO: 1023626 - RNA, 22 nt, Human
aaaggcaggcuuucacaucuca

SEQ ID NO: 1023627 - RNA, 22 nt, Human
uugucuguaaagacggccacca

SEQ ID NO: 1023628 - RNA, 22 nt, Human
gucaaacaaauuaacauaucca

SEQ ID NO: 1023629 - RNA, 22 nt, Human
cagagcuggagggaacccuggc

SEQ ID NO: 1023630 - RNA, 22 nt, Human
uccugcagugugucuccugcac

SEQ ID NO: 1023631 - RNA, 22 nt, Human
gcagagugaggaagagcuucca

SEQ ID NO: 1023632 - RNA, 22 nt, Human
caggggcugagaaggaacgucc

SEQ ID NO: 1023633 - RNA, 22 nt, Human
uuuugagauggagucuugcucu

SEQ ID NO: 1023634 - RNA, 22 nt, Human
ggggcuccagucuucacauuuu

SEQ ID NO: 1023635 - RNA, 20 nt, Human
aagcagaagcugcucucagc

SEQ ID NO: 1023636 - RNA, 22 nt, Human
cuggccucauagccaagcugug

SEQ ID NO: 1023637 - RNA, 22 nt, Human
uggcagcaguggagguagaaag

SEQ ID NO: 1023638 - RNA, 22 nt, Human
caggcagccugagggaucuggg

SEQ ID NO: 1023639 - RNA, 22 nt, Human
ggcugccugaacuuuggggaaa

SEQ ID NO: 1023640 - RNA, 22 nt, Human
gucaugccagcggagcucggga

SEQ ID NO: 1023641 - RNA, 18 nt, Human
ggacaucaucaggugcuu

SEQ ID NO: 1023642 - RNA, 22 nt, Human
ucccaggccauaaaacucagag

SEQ ID NO: 1023643 - RNA, 22 nt, Human
ccagggcagcagaauuggggca

SEQ ID NO: 1023644 - RNA, 22 nt, Human
aagggcucacccaacucacuuc

SEQ ID NO: 1023645 - RNA, 22 nt, Human
agcaggaaguagucuguaagca

SEQ ID NO: 1023646 - RNA, 22 nt, Human
gcagaugguggggcaggaaaau

SEQ ID NO: 1023647 - RNA, 22 nt, Human
cagccucuaagcacagccucuc

SEQ ID NO: 1023648 - RNA, 22 nt, Human
cuggagccacuuuuuauccuuu

SEQ ID NO: 1023649 - RNA, 22 nt, Human
agccaaagaucagugugcaagu

SEQ ID NO: 1023650 - RNA, 22 nt, Human
ucugggaacucugucauuuccc

SEQ ID NO: 1023651 - RNA, 22 nt, Human
ugcccuguuaucuuggaagagu

SEQ ID NO: 1023652 - RNA, 19 nt, Human
ggcauccagaacuaccagu

SEQ ID NO: 1023653 - RNA, 22 nt, Human
cuucccagaccuuagagugcag

SEQ ID NO: 1023654 - RNA, 22 nt, Human
ggagcugggguuggcaucuucc

SEQ ID NO: 1023655 - RNA, 22 nt, Human
aguuucauauuaccaugucacc

SEQ ID NO: 1023656 - RNA, 22 nt, Human
cagcuucuucaguccuggagcu

SEQ ID NO: 1023657 - RNA, 22 nt, Human
gagaaacuuggaguuauucugg

SEQ ID NO: 1023658 - RNA, 22 nt, Human
uccauuuacuauucucauaucg

SEQ ID NO: 1023659 - RNA, 22 nt, Human
uauccaggaggaacucauuuug

SEQ ID NO: 1023660 - RNA, 22 nt, Human
cucaugauguagcgaaugagaa

SEQ ID NO: 1023661 - RNA, 22 nt, Human
gcagaaggucuggcacuucagg

SEQ ID NO: 1023662 - RNA, 22 nt, Human
aggcucugacgucacacguggc

SEQ ID NO: 1023663 - RNA, 21 nt, Human
aggcucccagaaaugggcauc

SEQ ID NO: 1023664 - RNA, 22 nt, Human
gcagggcuguggacacuuuggu

SEQ ID NO: 1023665 - RNA, 22 nt, Human
ugucuguaagguguuuauguua

SEQ ID NO: 1023666 - RNA, 19 nt, Human
ucugaggguccagaugcau

SEQ ID NO: 1023667 - RNA, 22 nt, Human
aacaugcucuguuucuuggaug

SEQ ID NO: 1023668 - RNA, 22 nt, Human
guuuagaacacggaaauacuga

SEQ ID NO: 1023669 - RNA, 22 nt, Human
cauuaucugccauugacaccau

SEQ ID NO: 1023670 - RNA, 22 nt, Human
auuacaaucgagagaaacaaau

SEQ ID NO: 1023671 - RNA, 22 nt, Human
aaucagucauuagcucugaccu

SEQ ID NO: 1023672 - RNA, 22 nt, Human
cugggaggcggagguuguagug

SEQ ID NO: 1023673 - RNA, 15 nt, Human
aaucuggcggcaagu

SEQ ID NO: 1023674 - RNA, 22 nt, Human
agcagcuggguccggcggagca

SEQ ID NO: 1023675 - RNA, 22 nt, Human
cagucccaugagcccagaacau

SEQ ID NO: 1023676 - RNA, 22 nt, Human
aggggccucgcaggaccgcucc

SEQ ID NO: 1023677 - RNA, 22 nt, Human
uguaaucauuacaguacaugga

SEQ ID NO: 1023678 - RNA, 22 nt, Human
auacauguuguaccauauguuu

SEQ ID NO: 1023679 - RNA, 22 nt, Human
ccuugcugcgugcuagcacaga

SEQ ID NO: 1023680 - RNA, 22 nt, Human
gcucuccaaacccuguggcuuu

SEQ ID NO: 1023681 - RNA, 22 nt, Human
aggcccugcccagugccacaag

SEQ ID NO: 1023682 - RNA, 22 nt, Human
uuccaggaauucagcucucagu

SEQ ID NO: 1023683 - RNA, 20 nt, Human
cugugccuaaaccuccgggu

SEQ ID NO: 1023684 - RNA, 22 nt, Human
gcagauggugccaugucuugug

SEQ ID NO: 1023685 - RNA, 22 nt, Human
ugauuucccucaucauaacaga

SEQ ID NO: 1023686 - RNA, 22 nt, Human
gggcugaccccaccccucacuc

SEQ ID NO: 1023687 - RNA, 22 nt, Human
ccacagggucagccacucugca

SEQ ID NO: 1023688 - RNA, 22 nt, Human
guuugauucaagaacaaagagu

SEQ ID NO: 1023689 - RNA, 17 nt, Human
gcugagugcagggaguc

SEQ ID NO: 1023690 - RNA, 22 nt, Human
ccucagggaggccucuguggcu

SEQ ID NO: 1023691 - RNA, 22 nt, Human
agagcuggcugguagcccugau

SEQ ID NO: 1023692 - RNA, 22 nt, Human
ccaaggagaaaugcugugcuuu

SEQ ID NO: 1023693 - RNA, 22 nt, Human
agcaugcugguguucauggcag

SEQ ID NO: 1023694 - RNA, 22 nt, Human
gcuguauuuauuuucuaggguu

SEQ ID NO: 1023695 - RNA, 22 nt, Human
uccauguguuuuccuguccaca

SEQ ID NO: 1023696 - RNA, 22 nt, Human
cccagccucagcuuuacuucca

SEQ ID NO: 1023697 - RNA, 22 nt, Human
uccugggcuugcuccuccagcu

SEQ ID NO: 1023698 - RNA, 22 nt, Human
uuauuuaaaauguagguuggga

SEQ ID NO: 1023699 - RNA, 22 nt, Human
ugcagaaguauuccaggcccca

SEQ ID NO: 1023700 - RNA, 22 nt, Human
ucugcaggacugaggccuguuu

SEQ ID NO: 1023701 - RNA, 22 nt, Human
cucacugugaccucagcagaca

SEQ ID NO: 1023702 - RNA, 21 nt, Human
cagaggcugagagggcaaucu

SEQ ID NO: 1023703 - RNA, 21 nt, Human
ucacagacuggucagugaggc

SEQ ID NO: 1023704 - RNA, 19 nt, Human
uuucaauggcuuagagaaa

SEQ ID NO: 1023705 - RNA, 22 nt, Human
gaaaugcagaaccugagaccau

SEQ ID NO: 1023706 - RNA, 22 nt, Human
gguuucaacuuuugugaggaau

SEQ ID NO: 1023707 - RNA, 18 nt, Human
uggagccagcucuaggau

SEQ ID NO: 1023708 - RNA, 22 nt, Human
ucaccagucuuucuuaccauug

SEQ ID NO: 1023709 - RNA, 22 nt, Human
uggaggcauuuuagguugucac

SEQ ID NO: 1023710 - RNA, 19 nt, Human
uucuccaggcugcagaggg

SEQ ID NO: 1023711 - RNA, 22 nt, Human
ucuggauggucagcucuuccug

SEQ ID NO: 1023712 - RNA, 22 nt, Human
ggcugcugguagggguaggaag

SEQ ID NO: 1023713 - RNA, 22 nt, Human
ccugacucuggccaggccagcu

SEQ ID NO: 1023714 - RNA, 22 nt, Human
uauaucuuauaugugcagguac

SEQ ID NO: 1023715 - RNA, 22 nt, Human
gcagagcaguacucucuugacu

SEQ ID NO: 1023716 - RNA, 22 nt, Human
guguugaugacauuuuagaaac

SEQ ID NO: 1023717 - RNA, 20 nt, Human
cugcagggugagugggcgau

SEQ ID NO: 1023718 - RNA, 22 nt, Human
acuggcagcuguaggaugcaug

SEQ ID NO: 1023719 - RNA, 20 nt, Human
agucucuguagugccugaga

SEQ ID NO: 1023720 - RNA, 22 nt, Human
acaggcuuacaggcugcaagua

SEQ ID NO: 1023721 - RNA, 22 nt, Human
gaagaacacuucaugauucauu

SEQ ID NO: 1023722 - RNA, 22 nt, Human
cccugccuucuuggccuuuaaa

SEQ ID NO: 1023723 - RNA, 22 nt, Human
agagccugaggaugucccagcu

SEQ ID NO: 1023724 - RNA, 22 nt, Human
gagggcagagacagugauucac

SEQ ID NO: 1023725 - RNA, 22 nt, Human
gaagccaagugcaaaugccuua

SEQ ID NO: 1023726 - RNA, 22 nt, Human
acuucucuucauagguggcaau

SEQ ID NO: 1023727 - RNA, 22 nt, Human
cugcuuuguaaaauagacauaa

SEQ ID NO: 1023728 - RNA, 22 nt, Human
caaaggcaacauauacuuguuu

SEQ ID NO: 1023729 - RNA, 22 nt, Human
guucucucugcuuccaagaugg

SEQ ID NO: 1023730 - RNA, 22 nt, Human
uacauggguagguuaagucaua

SEQ ID NO: 1023731 - RNA, 22 nt, Human
gcuggcagagacaagaagacua

SEQ ID NO: 1023732 - RNA, 22 nt, Human
uacaaagugagcaaccucuuuu

SEQ ID NO: 1023733 - RNA, 22 nt, Human
acagcuuuucugauagauccug

SEQ ID NO: 1023734 - RNA, 22 nt, Human
uaacacaugguuaguacacaau

SEQ ID NO: 1023735 - RNA, 22 nt, Human
ucuggcccagccccugagguca

SEQ ID NO: 1023736 - RNA, 22 nt, Human
uauauuaacacccacuugccuc

SEQ ID NO: 1023737 - RNA, 22 nt, Human
uguacaguaggaacuuguuauu

SEQ ID NO: 1023738 - RNA, 22 nt, Human
cuggcuugcagcucaucauaaa

SEQ ID NO: 1023739 - RNA, 22 nt, Human
uugagaagaauguguugaguuu

SEQ ID NO: 1023740 - RNA, 22 nt, Human
agaagccaauucugugugaguc

SEQ ID NO: 1023741 - RNA, 22 nt, Human
cucccuggcuuuguccugaggc

SEQ ID NO: 1023742 - RNA, 22 nt, Human
gcagugcuaaguagcuggccca

SEQ ID NO: 1023743 - RNA, 22 nt, Human
agucaaagcuacaggcauuuga

SEQ ID NO: 1023744 - RNA, 22 nt, Human
cuucuggggauggagcccagaa

SEQ ID NO: 1023745 - RNA, 21 nt, Human
ccuuuacaauuuugcauuccu

SEQ ID NO: 1023746 - RNA, 22 nt, Human
acaguuugcccugacauucucc

SEQ ID NO: 1023747 - RNA, 22 nt, Human
gaauacauuggaaaucagaaua

SEQ ID NO: 1023748 - RNA, 22 nt, Human
aguggggaagagcaugggcccu

SEQ ID NO: 1023749 - RNA, 22 nt, Human
aaaggccacacugcucuuucuc

SEQ ID NO: 1023750 - RNA, 22 nt, Human
ucugggagguggcagggugcau

SEQ ID NO: 1023751 - RNA, 22 nt, Human
cagugaggcucugcugagcggu

SEQ ID NO: 1023752 - RNA, 22 nt, Human
uguuuuucaaauauugcucugu

SEQ ID NO: 1023753 - RNA, 21 nt, Human
agcagaggcagaauguaugca

SEQ ID NO: 1023754 - RNA, 22 nt, Human
ccuggcugguggcagcgacaag

SEQ ID NO: 1023755 - RNA, 22 nt, Human
uuucuauaugaggagcuaaagu

SEQ ID NO: 1023756 - RNA, 22 nt, Human
cauucauuuaugaaauaucuau

SEQ ID NO: 1023757 - RNA, 22 nt, Human
uggaaagucucuuuugacugua

SEQ ID NO: 1023758 - RNA, 22 nt, Human
cagaguggcagucccaggccca

SEQ ID NO: 1023759 - RNA, 22 nt, Human
guauuagggccaaaggcaggaa

SEQ ID NO: 1023760 - RNA, 22 nt, Human
gggcuggcaucgguugcugaga

SEQ ID NO: 1023761 - RNA, 22 nt, Human
acugcuuuucuaagauucugug

SEQ ID NO: 1023762 - RNA, 22 nt, Human
agagccagcaagugaauaguga

SEQ ID NO: 1023763 - RNA, 20 nt, Human
cugagcccccagccugcagg

SEQ ID NO: 1023764 - RNA, 22 nt, Human
acccagagcugggcuuggcaaa

SEQ ID NO: 1023765 - RNA, 22 nt, Human
cagagggcucggcggccgcucc

SEQ ID NO: 1023766 - RNA, 22 nt, Human
ugaaaugauguacaagaaggca

SEQ ID NO: 1023767 - RNA, 22 nt, Human
aaggcucuuggagugaaugcag

SEQ ID NO: 1023768 - RNA, 22 nt, Human
uagagcuggaauuugcagcaag

SEQ ID NO: 1023769 - RNA, 22 nt, Human
ugcuuccuucccguucuucucc

SEQ ID NO: 1023770 - RNA, 22 nt, Human
aaguguuaaaagauuaaaugcu

SEQ ID NO: 1023771 - RNA, 22 nt, Human
uuuauuauucucuggagaaugu

SEQ ID NO: 1023772 - RNA, 22 nt, Human
gcucucuggguggugggcaaca

SEQ ID NO: 1023773 - RNA, 22 nt, Human
ccaaagugcugggguuacaggc

SEQ ID NO: 1023774 - RNA, 22 nt, Human
gguccccguggaggcuggagcg

SEQ ID NO: 1023775 - RNA, 22 nt, Human
cugggcacuuuggggagccuac

SEQ ID NO: 1023776 - RNA, 22 nt, Human
gcugugagccgcugcugagcau

SEQ ID NO: 1023777 - RNA, 21 nt, Human
aacugcuggucuuuucugucu

SEQ ID NO: 1023778 - RNA, 22 nt, Human
ggcugcagcggauuggggauug

SEQ ID NO: 1023779 - RNA, 22 nt, Human
cuuauguacacacauauauugu

SEQ ID NO: 1023780 - RNA, 22 nt, Human
ugcagggcuuccucuuggaguu

SEQ ID NO: 1023781 - RNA, 22 nt, Human
aaguugagaugucauaggagac

SEQ ID NO: 1023782 - RNA, 22 nt, Human
aggcugcuggcaggcguggacg

SEQ ID NO: 1023783 - RNA, 22 nt, Human
uccuuccugcaggccaaguccu

SEQ ID NO: 1023784 - RNA, 22 nt, Human
augcucugggcaggagcccugg

SEQ ID NO: 1023785 - RNA, 22 nt, Human
acaguguguucugggaccucca

SEQ ID NO: 1023786 - RNA, 22 nt, Human
aguuuuucuccccuggcuucau

SEQ ID NO: 1023787 - RNA, 22 nt, Human
cuggcugcaggaugaggcugcc

SEQ ID NO: 1023788 - RNA, 22 nt, Human
aaaagacaucuauuucaggcag

SEQ ID NO: 1023789 - RNA, 22 nt, Human
agguaaagacugcaaggagaau

SEQ ID NO: 1023790 - RNA, 22 nt, Human
ugcagaaggaggaggaaaucca

SEQ ID NO: 1023791 - RNA, 22 nt, Human
gaaggagagggucaaggauaau

SEQ ID NO: 1023792 - RNA, 22 nt, Human
cauucugugauucuaaaucccu

SEQ ID NO: 1023793 - RNA, 22 nt, Human
cagcagggcccccgggugcgcc

SEQ ID NO: 1023794 - RNA, 22 nt, Human
gucugucacucaggggcuggag

SEQ ID NO: 1023795 - RNA, 22 nt, Human
ccugagagcauuccacacugaa

SEQ ID NO: 1023796 - RNA, 22 nt, Human
uauugacaauuugugaaacuau

SEQ ID NO: 1023797 - RNA, 22 nt, Human
cugagauggccacugggucuca

SEQ ID NO: 1023798 - RNA, 22 nt, Human
uccagccaugcaugacaaucac

SEQ ID NO: 1023799 - RNA, 22 nt, Human
aauguguacuuuuucaugcuca

SEQ ID NO: 1023800 - RNA, 22 nt, Human
ucuguccucuuugaagcugcuc

SEQ ID NO: 1023801 - RNA, 22 nt, Human
aggcucugaugcaagcccaggg

SEQ ID NO: 1023802 - RNA, 21 nt, Human
cucuugugucagagccagagg

SEQ ID NO: 1023803 - RNA, 21 nt, Human
gcccucaggggaggauggccu

SEQ ID NO: 1023804 - RNA, 22 nt, Human
agagcugcaccuaugcagaccu

SEQ ID NO: 1023805 - RNA, 22 nt, Human
aggagccaugagugacaucaca

SEQ ID NO: 1023806 - RNA, 22 nt, Human
agggcucccgcgguguccggga

SEQ ID NO: 1023807 - RNA, 22 nt, Human
agacagugauguaagcaggagu

SEQ ID NO: 1023808 - RNA, 22 nt, Human
ggcuggccucaggguccucgcu

SEQ ID NO: 1023809 - RNA, 22 nt, Human
cugccugcaugcugccauagcu

SEQ ID NO: 1023810 - RNA, 22 nt, Human
ugcagaggaccauuguccugga

SEQ ID NO: 1023811 - RNA, 22 nt, Human
aaaggccaagcaugagguggac

SEQ ID NO: 1023812 - RNA, 22 nt, Human
cacagcauaaugaaauauacuu

SEQ ID NO: 1023813 - RNA, 22 nt, Human
uucaugaaaguguaucuugugg

SEQ ID NO: 1023814 - RNA, 22 nt, Human
cagggccaguucucgcagcagu

SEQ ID NO: 1023815 - RNA, 19 nt, Human
acacagggcuagaguuaca

SEQ ID NO: 1023816 - RNA, 23 nt, Human
uguugaaguaacuguuacauaga

SEQ ID NO: 1023817 - RNA, 22 nt, Human
uguuugaauuuugcuaacgugu

SEQ ID NO: 1023818 - RNA, 22 nt, Human
cacccagccuucacacaggagu

SEQ ID NO: 1023819 - RNA, 22 nt, Human
agccuggaauuaaggaaaugca

SEQ ID NO: 1023820 - RNA, 22 nt, Human
ucauugcagaaauaaaggugaa

SEQ ID NO: 1023821 - RNA, 22 nt, Human
uuggcagucucagucagauggc

SEQ ID NO: 1023822 - RNA, 22 nt, Human
ugcugaaacaauaacauacugg

SEQ ID NO: 1023823 - RNA, 17 nt, Human
ucuuuccugccaugcuc

SEQ ID NO: 1023824 - RNA, 22 nt, Human
cugccugugugugccugcagaa

SEQ ID NO: 1023825 - RNA, 22 nt, Human
ucaggcugguggucagauggcu

SEQ ID NO: 1023826 - RNA, 22 nt, Human
caguauguacucuuaucaugua

SEQ ID NO: 1023827 - RNA, 22 nt, Human
uucuuuggggaauauucugguu

SEQ ID NO: 1023828 - RNA, 22 nt, Human
gucucagaccacccucuuuggc

SEQ ID NO: 1023829 - RNA, 22 nt, Human
uuuaaauuuguguuuagagggu

SEQ ID NO: 1023830 - RNA, 22 nt, Human
uucuucuuuccuauaauuaauu

SEQ ID NO: 1023831 - RNA, 22 nt, Human
guggcccucugauagggucagg

SEQ ID NO: 1023832 - RNA, 19 nt, Human
gcuguauuaaagauacaug

SEQ ID NO: 1023833 - RNA, 22 nt, Human
ugccugaugcaggaguaucaga

SEQ ID NO: 1023834 - RNA, 22 nt, Human
caguguuuguauagaauaugca

SEQ ID NO: 1023835 - RNA, 22 nt, Human
aauaauuuuagcucagaguugu

SEQ ID NO: 1023836 - RNA, 22 nt, Human
uggcagucuggguuggcaguua

SEQ ID NO: 1023837 - RNA, 22 nt, Human
caggagcccguugcuccggcgg

SEQ ID NO: 1023838 - RNA, 22 nt, Human
cuuagcaugugguguccuugua

SEQ ID NO: 1023839 - RNA, 20 nt, Human
ggcacuggaagcacacagga

SEQ ID NO: 1023840 - RNA, 22 nt, Human
aaaaucaguacacuuuauuuug

SEQ ID NO: 1023841 - RNA, 22 nt, Human
uccugucagugaggcagaugaa

SEQ ID NO: 1023842 - RNA, 22 nt, Human
agugggcagugcgcucggaugc

SEQ ID NO: 1023843 - RNA, 22 nt, Human
agggcagagacaugcuuccuga

SEQ ID NO: 1023844 - RNA, 22 nt, Human
uguuuguucccucucuuuccug

SEQ ID NO: 1023845 - RNA, 22 nt, Human
auguuucaaugcacuuuagccu

SEQ ID NO: 1023846 - RNA, 19 nt, Human
cuggcagccugucuguguc

SEQ ID NO: 1023847 - RNA, 22 nt, Human
auuuaguguguauugcuauuau

SEQ ID NO: 1023848 - RNA, 22 nt, Human
agugaaaugauaguguaaauac

SEQ ID NO: 1023849 - RNA, 22 nt, Human
gcagcuccuggcacaguuuuuu

SEQ ID NO: 1023850 - RNA, 22 nt, Human
gccuggaggggacagucucugg

SEQ ID NO: 1023851 - RNA, 22 nt, Human
cuagggacugggaccuuaguua

SEQ ID NO: 1023852 - RNA, 20 nt, Human
cagccuccacucacucagcu

SEQ ID NO: 1023853 - RNA, 22 nt, Human
cugccugcuucugagccagagg

SEQ ID NO: 1023854 - RNA, 22 nt, Human
ugagagucucagaccuccuggu

SEQ ID NO: 1023855 - RNA, 22 nt, Human
ugaaugauguauaauauugaga

SEQ ID NO: 1023856 - RNA, 22 nt, Human
uggccacccagcugacgccuuc

SEQ ID NO: 1023857 - RNA, 22 nt, Human
aaaagggacuacucucagcucc

SEQ ID NO: 1023858 - RNA, 22 nt, Human
uuacauuagacccacuuucaug

SEQ ID NO: 1023859 - RNA, 22 nt, Human
gcucagagggaacaaggggcug

SEQ ID NO: 1023860 - RNA, 22 nt, Human
guggccuggcgagcuggcgcgg

SEQ ID NO: 1023861 - RNA, 22 nt, Human
cagagccaggucuaggagucuc

SEQ ID NO: 1023862 - RNA, 22 nt, Human
caguggcuguuucuggaaggca

SEQ ID NO: 1023863 - RNA, 22 nt, Human
agucucugucguagaucagcgu

SEQ ID NO: 1023864 - RNA, 22 nt, Human
acagggccucagcugauucugg

SEQ ID NO: 1023865 - RNA, 22 nt, Human
uccaggcauuccagccauucca

SEQ ID NO: 1023866 - RNA, 22 nt, Human
aggugaguugguaggaaguuug

SEQ ID NO: 1023867 - RNA, 22 nt, Human
ucaaagucauggcaggcucaga

SEQ ID NO: 1023868 - RNA, 22 nt, Human
cuggcagcuuagcacucugguu

SEQ ID NO: 1023869 - RNA, 22 nt, Human
ggcucugcugguaagaugccuc

SEQ ID NO: 1023870 - RNA, 22 nt, Human
gagcacaggcuuugguggacac

SEQ ID NO: 1023871 - RNA, 22 nt, Human
cucuggacagcaggugcugugg

SEQ ID NO: 1023872 - RNA, 22 nt, Human
acagcugggugcugcucagagc

SEQ ID NO: 1023873 - RNA, 22 nt, Human
cucuguccuaugcuugauagaa

SEQ ID NO: 1023874 - RNA, 22 nt, Human
ugggcugcagggguugagagcu

SEQ ID NO: 1023875 - RNA, 22 nt, Human
ccuggcugcuuucacuauggag

SEQ ID NO: 1023876 - RNA, 22 nt, Human
gcuaugcaggagccuaaugaca

SEQ ID NO: 1023877 - RNA, 22 nt, Human
agcaaucaccaccucuauauuu

SEQ ID NO: 1023878 - RNA, 22 nt, Human
cugggccuagcaacagaggagu

SEQ ID NO: 1023879 - RNA, 22 nt, Human
cgucuuccucuuacgaugcgcu

SEQ ID NO: 1023880 - RNA, 22 nt, Human
ucucaggguuuccugggggcug

SEQ ID NO: 1023881 - RNA, 22 nt, Human
ggagcugugcagugacuacaga

SEQ ID NO: 1023882 - RNA, 22 nt, Human
guguuuccuaguuuaaugaaug

SEQ ID NO: 1023883 - RNA, 21 nt, Human
cagagcagcguucugcugugg

SEQ ID NO: 1023884 - RNA, 22 nt, Human
ugaaggccagcucuuuaucagc

SEQ ID NO: 1023885 - RNA, 22 nt, Human
gagcucccaggccccagcaagg

SEQ ID NO: 1023886 - RNA, 22 nt, Human
uauuccuauuucuaaacauaug

SEQ ID NO: 1023887 - RNA, 22 nt, Human
uuuagaguugaguauucauugg

SEQ ID NO: 1023888 - RNA, 22 nt, Human
cagggcaguaccgcccucuggc

SEQ ID NO: 1023889 - RNA, 22 nt, Human
uuugucaucccuuuugaaacug

SEQ ID NO: 1023890 - RNA, 22 nt, Human
uuacacaacaucuguauuauua

SEQ ID NO: 1023891 - RNA, 21 nt, Human
guuuucaugauagagucugua

SEQ ID NO: 1023892 - RNA, 22 nt, Human
aagaaugucguugguauuuuaa

SEQ ID NO: 1023893 - RNA, 22 nt, Human
gaucaaaagcuggguucuaaaa

SEQ ID NO: 1023894 - RNA, 22 nt, Human
cucaggauagcugcgcagccug

SEQ ID NO: 1023895 - RNA, 22 nt, Human
aguguacauguuuacagcaucu

SEQ ID NO: 1023896 - RNA, 21 nt, Human
ccagcuuucccaagucccuuu

SEQ ID NO: 1023897 - RNA, 22 nt, Human
ucucaggggauucacuggcacc

SEQ ID NO: 1023898 - RNA, 22 nt, Human
uccucagacacccugcuggcuu

SEQ ID NO: 1023899 - RNA, 22 nt, Human
agagaauuuuaaaagccuugaa

SEQ ID NO: 1023900 - RNA, 22 nt, Human
cuauugaaaguguacaauucaa

SEQ ID NO: 1023901 - RNA, 22 nt, Human
gcccaggccggagagcagugcu

SEQ ID NO: 1023902 - RNA, 22 nt, Human
caacauuucaaggucuuuagga

SEQ ID NO: 1023903 - RNA, 22 nt, Human
ccuggaggagcgcugaccagcu

SEQ ID NO: 1023904 - RNA, 22 nt, Human
acuggcaguagagggagcgcau

SEQ ID NO: 1023905 - RNA, 22 nt, Human
uuggcacugugccuggcacauu

SEQ ID NO: 1023906 - RNA, 22 nt, Human
cggcuggguucggcugcaggcc

SEQ ID NO: 1023907 - RNA, 22 nt, Human
cuucauuaaccaaaaugcaaua

SEQ ID NO: 1023908 - RNA, 18 nt, Human
uucagcagcagacacacu

SEQ ID NO: 1023909 - RNA, 22 nt, Human
uuuuagauaguuuaacugcacu

SEQ ID NO: 1023910 - RNA, 22 nt, Human
cuccuucccuucaaguguuccu

SEQ ID NO: 1023911 - RNA, 22 nt, Human
uuuucauugagcaccugaguaa

SEQ ID NO: 1023912 - RNA, 22 nt, Human
cugaaggaagcagguggccugu

SEQ ID NO: 1023913 - RNA, 22 nt, Human
gggcugugcugaguaggaggug

SEQ ID NO: 1023914 - RNA, 21 nt, Human
uauuucuuugacucucucccu

SEQ ID NO: 1023915 - RNA, 22 nt, Human
cugggcugcaucaaagaggcau

SEQ ID NO: 1023916 - RNA, 22 nt, Human
uucuucuuaauguccugggaac

SEQ ID NO: 1023917 - RNA, 22 nt, Human
aacaucagaauauccauguugg

SEQ ID NO: 1023918 - RNA, 22 nt, Human
gaguggagcaaaagagguagau

SEQ ID NO: 1023919 - RNA, 22 nt, Human
aggcucaguuugguuuccauug

SEQ ID NO: 1023920 - RNA, 22 nt, Human
aagaaauuaaggaaugcaacga

SEQ ID NO: 1023921 - RNA, 22 nt, Human
uccaggccaauguagcaggccc

SEQ ID NO: 1023922 - RNA, 22 nt, Human
auuugaauggcuuaacacaacg

SEQ ID NO: 1023923 - RNA, 22 nt, Human
cuccaggagcugugucuuucuu

SEQ ID NO: 1023924 - RNA, 22 nt, Human
augggaugaacuugaucugcuu

SEQ ID NO: 1023925 - RNA, 22 nt, Human
gcacugggaagaaugagccugu

SEQ ID NO: 1023926 - RNA, 22 nt, Human
gggagcugagggaccucugugg

SEQ ID NO: 1023927 - RNA, 23 nt, Human
aucaagauaauccagaugaccua

SEQ ID NO: 1023928 - RNA, 22 nt, Human
gcucucagguacaaagcugugu

SEQ ID NO: 1023929 - RNA, 22 nt, Human
ggccucugcccucacuccuguc

SEQ ID NO: 1023930 - RNA, 22 nt, Human
ugggggcauggaccagccuggc

SEQ ID NO: 1023931 - RNA, 22 nt, Human
gaaggcaggcuucugauuaggu

SEQ ID NO: 1023932 - RNA, 22 nt, Human
augcuucagugcuaccuucaaa

SEQ ID NO: 1023933 - RNA, 22 nt, Human
guuagggaucaggaacaagagc

SEQ ID NO: 1023934 - RNA, 22 nt, Human
cagcauuuggugaucaucuuaa

SEQ ID NO: 1023935 - RNA, 22 nt, Human
cggcagcaaaggaagccagguc

SEQ ID NO: 1023936 - RNA, 22 nt, Human
ucaggaugguccuuuaugagaa

SEQ ID NO: 1023937 - RNA, 22 nt, Human
uucugugaaucuuuuuucccac

SEQ ID NO: 1023938 - RNA, 17 nt, Human
gccuggcccagccuggc

SEQ ID NO: 1023939 - RNA, 22 nt, Human
uuucuucagagagagcuuuccc

SEQ ID NO: 1023940 - RNA, 22 nt, Human
guggugcauccuugaguaagcu

SEQ ID NO: 1023941 - RNA, 22 nt, Human
ugggcagaggcucugaagucca

SEQ ID NO: 1023942 - RNA, 22 nt, Human
agagcugcaauuucauguggug

SEQ ID NO: 1023943 - RNA, 22 nt, Human
cuggaagggucuacuuagcaga

SEQ ID NO: 1023944 - RNA, 22 nt, Human
cagcuuuuuagaaucuagggca

SEQ ID NO: 1023945 - RNA, 22 nt, Human
aaaagucugcucucauuucaga

SEQ ID NO: 1023946 - RNA, 22 nt, Human
cucucccagucaggcucaggau

SEQ ID NO: 1023947 - RNA, 22 nt, Human
ccugggcaacauagugagaccc

SEQ ID NO: 1023948 - RNA, 22 nt, Human
uacaaaaguaauuacgguuuuu

SEQ ID NO: 1023949 - RNA, 22 nt, Human
auauucguggucaaguaaggcc

SEQ ID NO: 1023950 - RNA, 22 nt, Human
agaggaugguugaggaagaccu

SEQ ID NO: 1023951 - RNA, 22 nt, Human
uguaugaaguuacugagccucu

SEQ ID NO: 1023952 - RNA, 23 nt, Human
uugaaggagaaagcuuucuuggu

SEQ ID NO: 1023953 - RNA, 22 nt, Human
agccagcagggcuuagaggaca

SEQ ID NO: 1023954 - RNA, 22 nt, Human
aaaguguaaggaauuuaaguaa

SEQ ID NO: 1023955 - RNA, 22 nt, Human
uccaggcaaaaggaacugcuug

SEQ ID NO: 1023956 - RNA, 22 nt, Human
cccugcagaucagugagaacuu

SEQ ID NO: 1023957 - RNA, 22 nt, Human
cagggccaagccccuuuggcug

SEQ ID NO: 1023958 - RNA, 22 nt, Human
ugcuuggccuacuuguccuuug

SEQ ID NO: 1023959 - RNA, 22 nt, Human
ggcucaggacacagugguuuag

SEQ ID NO: 1023960 - RNA, 18 nt, Human
cagaagcaggcagugcag

SEQ ID NO: 1023961 - RNA, 22 nt, Human
cuccaguggcaaguccgggcgg

SEQ ID NO: 1023962 - RNA, 22 nt, Human
gcccggcagucacacacccagg

SEQ ID NO: 1023963 - RNA, 21 nt, Human
ucugucucuccacugcccugc

SEQ ID NO: 1023964 - RNA, 22 nt, Human
aggggaggagcuuuucuugccu

SEQ ID NO: 1023965 - RNA, 22 nt, Human
gccuggagcccaguguggggcu

SEQ ID NO: 1023966 - RNA, 22 nt, Human
gcugcagcuuuaggauccagug

SEQ ID NO: 1023967 - RNA, 22 nt, Human
ugcucagacaagcugaacagua

SEQ ID NO: 1023968 - RNA, 22 nt, Human
ccaggcucugucuggucagaag

SEQ ID NO: 1023969 - RNA, 22 nt, Human
uaacacauaagcugagaccaug

SEQ ID NO: 1023970 - RNA, 22 nt, Human
uuugcaaauauguguuucuauu

SEQ ID NO: 1023971 - RNA, 19 nt, Human
ggagccuggagcacgugcc

SEQ ID NO: 1023972 - RNA, 21 nt, Human
aaugaaguggcuauuuugagg

SEQ ID NO: 1023973 - RNA, 22 nt, Human
ucaagagaagugcuccacagua

SEQ ID NO: 1023974 - RNA, 22 nt, Human
aaaugguguuucuaaugcuaga

SEQ ID NO: 1023975 - RNA, 21 nt, Human
acagagcauaaugguguggca

SEQ ID NO: 1023976 - RNA, 22 nt, Human
gucacacucagaaugacuagag

SEQ ID NO: 1023977 - RNA, 22 nt, Human
cccagacuccucuggcuggugg

SEQ ID NO: 1023978 - RNA, 22 nt, Human
gugccuggcaugcgccggugcu

SEQ ID NO: 1023979 - RNA, 22 nt, Human
uucagucagugacuaagcaguu

SEQ ID NO: 1023980 - RNA, 22 nt, Human
uagcacaucuggcgcuuauagg

SEQ ID NO: 1023981 - RNA, 22 nt, Human
agggccugcucuaucacucuca

SEQ ID NO: 1023982 - RNA, 22 nt, Human
uaggccaguggcagguugugug

SEQ ID NO: 1023983 - RNA, 21 nt, Human
uggcucuggguaggagagugc

SEQ ID NO: 1023984 - RNA, 22 nt, Human
uaaauguauaggcacuaaaccu

SEQ ID NO: 1023985 - RNA, 22 nt, Human
gagcauuugguuauaguaauuu

SEQ ID NO: 1023986 - RNA, 21 nt, Human
agugaaauugcaucagaggga

SEQ ID NO: 1023987 - RNA, 22 nt, Human
uaagaacaguguuucaucucua

SEQ ID NO: 1023988 - RNA, 22 nt, Human
uccuuuccagccucaccucagc

SEQ ID NO: 1023989 - RNA, 22 nt, Human
uauucacaguugauuuacaguu

SEQ ID NO: 1023990 - RNA, 22 nt, Human
cugggccuuggauugacacugu

SEQ ID NO: 1023991 - RNA, 22 nt, Human
augcuuccaaggcuaagacaag

SEQ ID NO: 1023992 - RNA, 22 nt, Human
uaggcaggugugcacugcccac

SEQ ID NO: 1023993 - RNA, 21 nt, Human
aggagggcacaaggccaggaa

SEQ ID NO: 1023994 - RNA, 22 nt, Human
ucucugaguauccugaacugcc

SEQ ID NO: 1023995 - RNA, 22 nt, Human
uuaacagagugccuggcaugua

SEQ ID NO: 1023996 - RNA, 22 nt, Human
ucacugcagagaccucuaguca

SEQ ID NO: 1023997 - RNA, 22 nt, Human
acagggcaugugcaagagacau

SEQ ID NO: 1023998 - RNA, 23 nt, Human
aucuguucaucugacacagauuc

SEQ ID NO: 1023999 - RNA, 22 nt, Human
agcaacagcccugagguucaug

SEQ ID NO: 1024000 - RNA, 22 nt, Human
ucugcagcgugcaggcuggugc

SEQ ID NO: 1024001 - RNA, 22 nt, Human
uucagcagucguccaggaaaag

SEQ ID NO: 1024002 - RNA, 22 nt, Human
uaaaucucacuggguauauugg

SEQ ID NO: 1024003 - RNA, 22 nt, Human
cacugaaggcuaggauuagaug

SEQ ID NO: 1024004 - RNA, 22 nt, Human
aggccucacauugggcuucaag

SEQ ID NO: 1024005 - RNA, 22 nt, Human
ccugggcaggaugggcccggug

SEQ ID NO: 1024006 - RNA, 20 nt, Human
ggcagagggccugggagaag

SEQ ID NO: 1024007 - RNA, 22 nt, Human
cagcagcuacuuggagcagcag

SEQ ID NO: 1024008 - RNA, 22 nt, Human
gaccauuugcuaguaaauugca

SEQ ID NO: 1024009 - RNA, 22 nt, Human
agcaguggcugaagauguuccu

SEQ ID NO: 1024010 - RNA, 22 nt, Human
ucccucagggugcaguugcuuu

SEQ ID NO: 1024011 - RNA, 22 nt, Human
uacaaaguuugggguccucaaa

SEQ ID NO: 1024012 - RNA, 22 nt, Human
cuaucuuucgauucuagcuuaa

SEQ ID NO: 1024013 - RNA, 22 nt, Human
cagagcaguaaaucuggggcac

SEQ ID NO: 1024014 - RNA, 22 nt, Human
agcaggagcccuuaucaccagg

SEQ ID NO: 1024015 - RNA, 22 nt, Human
uuagaaaacauaagugguaaag

SEQ ID NO: 1024016 - RNA, 22 nt, Human
agugcuuuccuucuugugacau

SEQ ID NO: 1024017 - RNA, 21 nt, Human
agaagccuggguggagguggg

SEQ ID NO: 1024018 - RNA, 17 nt, Human
gguguauggggagggaa

SEQ ID NO: 1024019 - RNA, 22 nt, Human
cucugagagagcuggugagcac

SEQ ID NO: 1024020 - RNA, 17 nt, Human
agguauaaaaugguagc

SEQ ID NO: 1024021 - RNA, 22 nt, Human
cagagcucagagcagggcacuc

SEQ ID NO: 1024022 - RNA, 22 nt, Human
cuugucugugucggauaaaacu

SEQ ID NO: 1024023 - RNA, 22 nt, Human
cacguuuuaugacagaagaagc

SEQ ID NO: 1024024 - RNA, 19 nt, Human
cccucuugcacaaagcaaa

SEQ ID NO: 1024025 - RNA, 22 nt, Human
aguacuucagaggcugcccagg

SEQ ID NO: 1024026 - RNA, 22 nt, Human
agcugcuacugcucugccagag

SEQ ID NO: 1024027 - RNA, 22 nt, Human
cccagggacagaugggcagcua

SEQ ID NO: 1024028 - RNA, 22 nt, Human
gaaaugugcagaauguguuaga

SEQ ID NO: 1024029 - RNA, 22 nt, Human
gugugaaagcuuguccucugua

SEQ ID NO: 1024030 - RNA, 22 nt, Human
cugcagagcauaaaucugaaua

SEQ ID NO: 1024031 - RNA, 22 nt, Human
cagagggcucuuggcugccugc

SEQ ID NO: 1024032 - RNA, 22 nt, Human
gcaggcagagaaggaacauuua

SEQ ID NO: 1024033 - RNA, 22 nt, Human
uuauuuauggcacuguuggugg

SEQ ID NO: 1024034 - RNA, 22 nt, Human
acaacauucuuaaauacacuga

SEQ ID NO: 1024035 - RNA, 22 nt, Human
uagcuuuagugaaaaauaucag

SEQ ID NO: 1024036 - RNA, 22 nt, Human
ucuccuggucaccucagaaguc

SEQ ID NO: 1024037 - RNA, 22 nt, Human
ccugucugcggaggaguggaag

SEQ ID NO: 1024038 - RNA, 22 nt, Human
aaaagguuuugaguacaaauau

SEQ ID NO: 1024039 - RNA, 22 nt, Human
cagcucugugcaggccugggga

SEQ ID NO: 1024040 - RNA, 22 nt, Human
cacagcuuccauuagaaugaga

SEQ ID NO: 1024041 - RNA, 18 nt, Human
agcagcugucagaaugcc

SEQ ID NO: 1024042 - RNA, 22 nt, Human
uccugcagccauuagaggucaa

SEQ ID NO: 1024043 - RNA, 22 nt, Human
caguagccacuagacacaugua

SEQ ID NO: 1024044 - RNA, 22 nt, Human
aucuuguuauaagagauaaugg

SEQ ID NO: 1024045 - RNA, 22 nt, Human
aggucaaggccaaaagaguggu

SEQ ID NO: 1024046 - RNA, 20 nt, Human
uccaggagaacugggagccg

SEQ ID NO: 1024047 - RNA, 22 nt, Human
ugggaggacuugugggcuucau

SEQ ID NO: 1024048 - RNA, 22 nt, Human
ucuuagaaauuccccaguggcu

SEQ ID NO: 1024049 - RNA, 22 nt, Human
ggaggccagggacccagucagc

SEQ ID NO: 1024050 - RNA, 22 nt, Human
uaaugcacaugacugaacuauu

SEQ ID NO: 1024051 - RNA, 22 nt, Human
uccagggaugccagccauguug

SEQ ID NO: 1024052 - RNA, 22 nt, Human
gaaauguguuguucauuucuaa

SEQ ID NO: 1024053 - RNA, 22 nt, Human
uaucaauacauguuaucagugu

SEQ ID NO: 1024054 - RNA, 22 nt, Human
guucacauccuugugaggauuu

SEQ ID NO: 1024055 - RNA, 22 nt, Human
aaccugcauguuucuaaaagca

SEQ ID NO: 1024056 - RNA, 18 nt, Human
gcccugguggagcuggug

SEQ ID NO: 1024057 - RNA, 22 nt, Human
cuacuucuaaguacauggugau

SEQ ID NO: 1024058 - RNA, 22 nt, Human
agaaauguacgauguuaugcag

SEQ ID NO: 1024059 - RNA, 22 nt, Human
cucugcaugccuugcucagaca

SEQ ID NO: 1024060 - RNA, 22 nt, Human
ucagaaauuuucucaguaguuc

SEQ ID NO: 1024061 - RNA, 22 nt, Human
agauuccagaucccaaaaauga

SEQ ID NO: 1024062 - RNA, 22 nt, Human
gaggcaggcccugaaugaguca

SEQ ID NO: 1024063 - RNA, 22 nt, Human
cuacaaugacagaauugaguag

SEQ ID NO: 1024064 - RNA, 22 nt, Human
cagcagccuacaaugcacagaa

SEQ ID NO: 1024065 - RNA, 23 nt, Human
cagguggcuccacgagggguggg

SEQ ID NO: 1024066 - RNA, 22 nt, Human
agugaccaaucaugguuagauu

SEQ ID NO: 1024067 - RNA, 21 nt, Human
ugcuggaaaaagugguucuag

SEQ ID NO: 1024068 - RNA, 22 nt, Human
auaaacaguaaaugugagcagu

SEQ ID NO: 1024069 - RNA, 22 nt, Human
uucugucaugcucauguaauug

SEQ ID NO: 1024070 - RNA, 22 nt, Human
cagcugcccaggccaccuggag

SEQ ID NO: 1024071 - RNA, 22 nt, Human
ccucuucugagugagacucccu

SEQ ID NO: 1024072 - RNA, 22 nt, Human
uccguauuugacuauugcaccg

SEQ ID NO: 1024073 - RNA, 22 nt, Human
guguacauagaauugugcuuug

SEQ ID NO: 1024074 - RNA, 22 nt, Human
uuuugaaagggugauuuggcuu

SEQ ID NO: 1024075 - RNA, 22 nt, Human
ugugacagaucuuuaaauaaug

SEQ ID NO: 1024076 - RNA, 22 nt, Human
ggcuggucacaccacugcaggg

SEQ ID NO: 1024077 - RNA, 22 nt, Human
gggcugcugccaccagguggau

SEQ ID NO: 1024078 - RNA, 18 nt, Human
ccuggcagccaugcgcgc

SEQ ID NO: 1024079 - RNA, 22 nt, Human
cugggagaggaaccucgagggu

SEQ ID NO: 1024080 - RNA, 22 nt, Human
gauuucuucauuuguggugaau

SEQ ID NO: 1024081 - RNA, 22 nt, Human
ugggaguguucuuggcuugcuu

SEQ ID NO: 1024082 - RNA, 22 nt, Human
gcucugucaacagcuagcugug

SEQ ID NO: 1024083 - RNA, 22 nt, Human
guuuuauaauugcuucauaaga

SEQ ID NO: 1024084 - RNA, 22 nt, Human
augggcuguccuaguccagccc

SEQ ID NO: 1024085 - RNA, 22 nt, Human
ccacagaaaguugucuagagua

SEQ ID NO: 1024086 - RNA, 22 nt, Human
augggaggcaggcucagaaccg

SEQ ID NO: 1024087 - RNA, 22 nt, Human
ccaaugauggugcccacgauga

SEQ ID NO: 1024088 - RNA, 22 nt, Human
gagauggggucagcugggacau

SEQ ID NO: 1024089 - RNA, 17 nt, Human
gcugcagcgguaggcag

SEQ ID NO: 1024090 - RNA, 21 nt, Human
acugggagaacgagccuuucc

SEQ ID NO: 1024091 - RNA, 22 nt, Human
gccuccuggccuuugcuccuca

SEQ ID NO: 1024092 - RNA, 22 nt, Human
gguuugcaugugauguugggca

SEQ ID NO: 1024093 - RNA, 22 nt, Human
cagggcucagaagacagaccuc

SEQ ID NO: 1024094 - RNA, 22 nt, Human
ugcuggcccaugaagacgcagu

SEQ ID NO: 1024095 - RNA, 19 nt, Human
ccagagcccgccagauggg

SEQ ID NO: 1024096 - RNA, 22 nt, Human
gcucugggcugcccucuggaca

SEQ ID NO: 1024097 - RNA, 22 nt, Human
aaaaaugugaccacaggguguu

SEQ ID NO: 1024098 - RNA, 22 nt, Human
uucauguauuuaucauguaaau

SEQ ID NO: 1024099 - RNA, 22 nt, Human
aagcaccuggguuauaucuuag

SEQ ID NO: 1024100 - RNA, 22 nt, Human
ugaggcacuccaggaugcuguu

SEQ ID NO: 1024101 - RNA, 22 nt, Human
uggccugggcaugaagcaucgu

SEQ ID NO: 1024102 - RNA, 22 nt, Human
gcaaaaaaugcuuguugcuuag

SEQ ID NO: 1024103 - RNA, 20 nt, Human
augugaaagaucaguugucu

SEQ ID NO: 1024104 - RNA, 22 nt, Human
uggccuggcucacagugagauu

SEQ ID NO: 1024105 - RNA, 22 nt, Human
agaugcugugucuguucccuug

SEQ ID NO: 1024106 - RNA, 22 nt, Human
aucuggcuauugacauguuaua

SEQ ID NO: 1024107 - RNA, 22 nt, Human
gagguggccucaagcagucuuc

SEQ ID NO: 1024108 - RNA, 22 nt, Human
ugaggcaggagguugagaacug

SEQ ID NO: 1024109 - RNA, 22 nt, Human
guacucucuugaaggccuuucu

SEQ ID NO: 1024110 - RNA, 22 nt, Human
gaggcccuccagcugucagcug

SEQ ID NO: 1024111 - RNA, 22 nt, Human
uggcugggcccccaccugccuc

SEQ ID NO: 1024112 - RNA, 22 nt, Human
uucucugaguacguuucagugu

SEQ ID NO: 1024113 - RNA, 22 nt, Human
ggaggccaaggagggcggauca

SEQ ID NO: 1024114 - RNA, 22 nt, Human
gauucacucauauuuuacguuu

SEQ ID NO: 1024115 - RNA, 22 nt, Human
uucaauucugcucugaucuuag

SEQ ID NO: 1024116 - RNA, 22 nt, Human
ggagucagccugucagagugua

SEQ ID NO: 1024117 - RNA, 22 nt, Human
aggcacugugcagucccaagca

SEQ ID NO: 1024118 - RNA, 22 nt, Human
ccagacccugcucuggggcucu

SEQ ID NO: 1024119 - RNA, 22 nt, Human
gcagauggcagcccaggcuggg

SEQ ID NO: 1024120 - RNA, 22 nt, Human
ucuggcucuaacuaggcaucag

SEQ ID NO: 1024121 - RNA, 22 nt, Human
ggcccacuugaaauggagcuca

SEQ ID NO: 1024122 - RNA, 17 nt, Human
agcugaaauugcugaag

SEQ ID NO: 1024123 - RNA, 22 nt, Human
uccuucagcuacucaguuucca

SEQ ID NO: 1024124 - RNA, 22 nt, Human
aggcacugacucaagggagcca

SEQ ID NO: 1024125 - RNA, 22 nt, Human
uuucaaauagaaucuuuccaaa

SEQ ID NO: 1024126 - RNA, 22 nt, Human
acugugcaaugaguaauaaacu

SEQ ID NO: 1024127 - RNA, 22 nt, Human
gucuucuuuucagucugcuugu

SEQ ID NO: 1024128 - RNA, 20 nt, Human
ugaaggccauuuguuccaga

SEQ ID NO: 1024129 - RNA, 22 nt, Human
uucaaugagcccaagaacguga

SEQ ID NO: 1024130 - RNA, 22 nt, Human
gcacuuggauauacaaaugaag

SEQ ID NO: 1024131 - RNA, 22 nt, Human
ggacacagauaaucacacagau

SEQ ID NO: 1024132 - RNA, 22 nt, Human
ccacagggauaggaauggggcu

SEQ ID NO: 1024133 - RNA, 22 nt, Human
cacagaggacuguagcggggag

SEQ ID NO: 1024134 - RNA, 22 nt, Human
cacacaggagagugcuggaggu

SEQ ID NO: 1024135 - RNA, 22 nt, Human
augccagucaaagaagaugaca

SEQ ID NO: 1024136 - RNA, 22 nt, Human
aggauccuguauggagaagcug

SEQ ID NO: 1024137 - RNA, 22 nt, Human
gaaggaagucauuagugcagac

SEQ ID NO: 1024138 - RNA, 22 nt, Human
gagggcucuacucaccacccug

SEQ ID NO: 1024139 - RNA, 23 nt, Human
acuuuauugaccccaggucaguu

SEQ ID NO: 1024140 - RNA, 22 nt, Human
cacaucagggcugcuugggggu

SEQ ID NO: 1024141 - RNA, 22 nt, Human
aaaugcauugguuucuacuugu

SEQ ID NO: 1024142 - RNA, 22 nt, Human
acagcuuuguguuaaugggaag

SEQ ID NO: 1024143 - RNA, 22 nt, Human
uuucacaucagagguagauuag

SEQ ID NO: 1024144 - RNA, 22 nt, Human
uagcagcucacagccucccauu

SEQ ID NO: 1024145 - RNA, 22 nt, Human
aaugcacaugucuuggccucac

SEQ ID NO: 1024146 - RNA, 22 nt, Human
uuuagggaaauugaggguuaag

SEQ ID NO: 1024147 - RNA, 22 nt, Human
aaauaauuauagcgagucuauc

SEQ ID NO: 1024148 - RNA, 22 nt, Human
aacccagccguguagcugccgc

SEQ ID NO: 1024149 - RNA, 22 nt, Human
ggagccuguggcugcuugaagc

SEQ ID NO: 1024150 - RNA, 22 nt, Human
cagagcaucgcgcagagagccu

SEQ ID NO: 1024151 - RNA, 22 nt, Human
acacagggcggaaagcaugaga

SEQ ID NO: 1024152 - RNA, 22 nt, Human
cuggccugcugggugagguccu

SEQ ID NO: 1024153 - RNA, 22 nt, Human
cugcuguguuucugcuagaaaa

SEQ ID NO: 1024154 - RNA, 17 nt, Human
ggccuuggggccucagu

SEQ ID NO: 1024155 - RNA, 22 nt, Human
uggggugguaauacaccguucu

SEQ ID NO: 1024156 - RNA, 22 nt, Human
gcuccucugucaaaugagagug

SEQ ID NO: 1024157 - RNA, 22 nt, Human
cagggugccucccgcucgccgg

SEQ ID NO: 1024158 - RNA, 22 nt, Human
ucacaguaaaagcauggaagag

SEQ ID NO: 1024159 - RNA, 22 nt, Human
uugaaauggaagugaaaauucu

SEQ ID NO: 1024160 - RNA, 22 nt, Human
ucacaguaucacacaaggauua

SEQ ID NO: 1024161 - RNA, 22 nt, Human
uuuucauuuacauuagggaaga

SEQ ID NO: 1024162 - RNA, 21 nt, Human
gcucccugcucagcuccuggg

SEQ ID NO: 1024163 - RNA, 22 nt, Human
agaggcuccuucacucuggcac

SEQ ID NO: 1024164 - RNA, 22 nt, Human
uaaagcaggccacauaugugau

SEQ ID NO: 1024165 - RNA, 17 nt, Human
uccuggcucugccacug

SEQ ID NO: 1024166 - RNA, 22 nt, Human
uggcacaugguaagacucagua

SEQ ID NO: 1024167 - RNA, 22 nt, Human
gcuguauuuaacaacuggcuca

SEQ ID NO: 1024168 - RNA, 22 nt, Human
uagcagggaagaugaucagaau

SEQ ID NO: 1024169 - RNA, 18 nt, Human
uugcuuuguaagcuugca

SEQ ID NO: 1024170 - RNA, 19 nt, Human
acaaaugauguugcacuga

SEQ ID NO: 1024171 - RNA, 22 nt, Human
ucccaggcuggcaggcagcagu

SEQ ID NO: 1024172 - RNA, 22 nt, Human
gaauguaauagucaguagaaca

SEQ ID NO: 1024173 - RNA, 22 nt, Human
agccuggacagcuacggagaac

SEQ ID NO: 1024174 - RNA, 22 nt, Human
aagacaagcaucaaaucaggca

SEQ ID NO: 1024175 - RNA, 22 nt, Human
cagagggcacaugguuuccuca

SEQ ID NO: 1024176 - RNA, 22 nt, Human
agggaccucauguaaguggauu

SEQ ID NO: 1024177 - RNA, 22 nt, Human
cucugggcacauuuuccaggac

SEQ ID NO: 1024178 - RNA, 22 nt, Human
uccuguaguugcuaaguuuguu

SEQ ID NO: 1024179 - RNA, 22 nt, Human
cagugcugggcagaggagagcg

SEQ ID NO: 1024180 - RNA, 22 nt, Human
ggcucaggccuguaauccuagc

SEQ ID NO: 1024181 - RNA, 22 nt, Human
ucagaggacgcacuaggguugu

SEQ ID NO: 1024182 - RNA, 22 nt, Human
gcagggccuuagcagcggcugc

SEQ ID NO: 1024183 - RNA, 22 nt, Human
uuuccucacuucaugagaguuu

SEQ ID NO: 1024184 - RNA, 22 nt, Human
acuuugcagagccagaagagaa

SEQ ID NO: 1024185 - RNA, 22 nt, Human
caggaccccauauucacugaac

SEQ ID NO: 1024186 - RNA, 22 nt, Human
uuauuauaaugagggauaaaaa

SEQ ID NO: 1024187 - RNA, 22 nt, Human
ggagccugggcauuaguaauuu

SEQ ID NO: 1024188 - RNA, 22 nt, Human
caggccuggcccccggcacacc

SEQ ID NO: 1024189 - RNA, 22 nt, Human
ugggcugcccaagguggccaug

SEQ ID NO: 1024190 - RNA, 22 nt, Human
aagauuucuuacuuauugaugc

SEQ ID NO: 1024191 - RNA, 22 nt, Human
ucaaaugcggucauggcuuuua

SEQ ID NO: 1024192 - RNA, 22 nt, Human
gauuucuguaacacuucagaua

SEQ ID NO: 1024193 - RNA, 22 nt, Human
gguucacacuuucaugauuuca

SEQ ID NO: 1024194 - RNA, 22 nt, Human
uuucauugaugggugauagaaa

SEQ ID NO: 1024195 - RNA, 22 nt, Human
cuccucccucuuugccacacau

SEQ ID NO: 1024196 - RNA, 22 nt, Human
agcugcugagccaggcugaugu

SEQ ID NO: 1024197 - RNA, 22 nt, Human
gugcuuccccaagccacagccu

SEQ ID NO: 1024198 - RNA, 22 nt, Human
ggcaguggaggacccugugucu

SEQ ID NO: 1024199 - RNA, 22 nt, Human
gggugggaucuguggagccuca

SEQ ID NO: 1024200 - RNA, 22 nt, Human
cagaaagaccugggcucaagag

SEQ ID NO: 1024201 - RNA, 22 nt, Human
ugcuucugggcaaaugugugug

SEQ ID NO: 1024202 - RNA, 22 nt, Human
ugagaaccaugaaaagcuguca

SEQ ID NO: 1024203 - RNA, 21 nt, Human
cuggacugaggagacagucgc

SEQ ID NO: 1024204 - RNA, 22 nt, Human
aaggcacugcuuugcugcgccc

SEQ ID NO: 1024205 - RNA, 20 nt, Human
auuccauaguuggcacuuuu

SEQ ID NO: 1024206 - RNA, 22 nt, Human
aggcucagauccuuguguccug

SEQ ID NO: 1024207 - RNA, 22 nt, Human
ugcuaucucuauauccauuuau

SEQ ID NO: 1024208 - RNA, 22 nt, Human
acaggagugaaucuggcacuua

SEQ ID NO: 1024209 - RNA, 22 nt, Human
ggagccuggcaaugcugcgucc

SEQ ID NO: 1024210 - RNA, 22 nt, Human
gucaggggccaugggccaagga

SEQ ID NO: 1024211 - RNA, 22 nt, Human
aaagccuugggauuugugauca

SEQ ID NO: 1024212 - RNA, 22 nt, Human
ucuggcucuuugggugauugua

SEQ ID NO: 1024213 - RNA, 22 nt, Human
ggcuggaaguccaagaucaagg

SEQ ID NO: 1024214 - RNA, 21 nt, Human
ccaccaggucuucugcucggg

SEQ ID NO: 1024215 - RNA, 22 nt, Human
uuuccagguauuaauacuguau

SEQ ID NO: 1024216 - RNA, 23 nt, Human
gagugcagaauagacaugcagug

SEQ ID NO: 1024217 - RNA, 22 nt, Human
cagcugaguguuggcauguuca

SEQ ID NO: 1024218 - RNA, 22 nt, Human
cacagaggaaaggcaguuggua

SEQ ID NO: 1024219 - RNA, 22 nt, Human
auguuagaaggaauguuaaaag

SEQ ID NO: 1024220 - RNA, 22 nt, Human
aaggcucucugauggcagcagu

SEQ ID NO: 1024221 - RNA, 22 nt, Human
acagccuguguaccagcuggga

SEQ ID NO: 1024222 - RNA, 22 nt, Human
aaugcacauaaauauggucuua

SEQ ID NO: 1024223 - RNA, 22 nt, Human
ucccggcgcugggagguggguc

SEQ ID NO: 1024224 - RNA, 22 nt, Human
uucugaaagccaauucauugaa

SEQ ID NO: 1024225 - RNA, 22 nt, Human
uuagagucaaaauggcauguua

SEQ ID NO: 1024226 - RNA, 22 nt, Human
uuccagagcaguuuucagauca

SEQ ID NO: 1024227 - RNA, 22 nt, Human
aaguucaaggaagccuccaguu

SEQ ID NO: 1024228 - RNA, 20 nt, Human
aaaguguaagcauauaauua

SEQ ID NO: 1024229 - RNA, 19 nt, Human
agcuggggcgguguguguu

SEQ ID NO: 1024230 - RNA, 22 nt, Human
uuggcagugucugcaaaaugga

SEQ ID NO: 1024231 - RNA, 22 nt, Human
cuggcucauccagguguugcuc

SEQ ID NO: 1024232 - RNA, 22 nt, Human
cuuuggcaaggguuuuaauugu

SEQ ID NO: 1024233 - RNA, 22 nt, Human
uuuucucuuguuaauguacuga

SEQ ID NO: 1024234 - RNA, 22 nt, Human
cagcugccaugacauguccugc

SEQ ID NO: 1024235 - RNA, 22 nt, Human
cgucccaguuccagccgcgcug

SEQ ID NO: 1024236 - RNA, 22 nt, Human
gcugcuuccuuuccugcugacc

SEQ ID NO: 1024237 - RNA, 22 nt, Human
ccuggccucuccgaguaaccug

SEQ ID NO: 1024238 - RNA, 22 nt, Human
auguuauuuuggaaaauacaaa

SEQ ID NO: 1024239 - RNA, 22 nt, Human
uucuucaaacaaaaguggcaug

SEQ ID NO: 1024240 - RNA, 22 nt, Human
aagggcaggagaagacggauau

SEQ ID NO: 1024241 - RNA, 22 nt, Human
aaacauuugcaacucgguuugg

SEQ ID NO: 1024242 - RNA, 22 nt, Human
uccuccaggucuaggguggcuu

SEQ ID NO: 1024243 - RNA, 23 nt, Human
uuucacaaugagcauuacagaau

SEQ ID NO: 1024244 - RNA, 22 nt, Human
gcucagagcuugaaguuccacu

SEQ ID NO: 1024245 - RNA, 22 nt, Human
ugcugccacaaauucagcugcc

SEQ ID NO: 1024246 - RNA, 22 nt, Human
cuccagugagcgcggggcaugg

SEQ ID NO: 1024247 - RNA, 22 nt, Human
gugcauugcgaugcagacgacc

SEQ ID NO: 1024248 - RNA, 22 nt, Human
caugagauaauuuuucuccagu

SEQ ID NO: 1024249 - RNA, 22 nt, Human
aggcugcagaacagucaggugc

SEQ ID NO: 1024250 - RNA, 19 nt, Human
gcagccaccgcggcggccg

SEQ ID NO: 1024251 - RNA, 22 nt, Human
cagggcucugccuugagggaug

SEQ ID NO: 1024252 - RNA, 22 nt, Human
cuggccugagaaugcuacccuu

SEQ ID NO: 1024253 - RNA, 22 nt, Human
gugcaugugucuuuauaguaga

SEQ ID NO: 1024254 - RNA, 22 nt, Human
cagcaggcccagaguuucaugg

SEQ ID NO: 1024255 - RNA, 22 nt, Human
ugcugaaagucccaaaucucau

SEQ ID NO: 1024256 - RNA, 18 nt, Human
acugugugaauuagcucc

SEQ ID NO: 1024257 - RNA, 22 nt, Human
cugggagcugucaggagcgugu

SEQ ID NO: 1024258 - RNA, 22 nt, Human
gugaggggaguaaagccauguu

SEQ ID NO: 1024259 - RNA, 22 nt, Human
cacuggggugggccugguagag

SEQ ID NO: 1024260 - RNA, 22 nt, Human
uccucagaauggauggcagggg

SEQ ID NO: 1024261 - RNA, 22 nt, Human
ucucagaguaauucuuuaaggu

SEQ ID NO: 1024262 - RNA, 22 nt, Human
uguuugaacugaauaacauagu

SEQ ID NO: 1024263 - RNA, 22 nt, Human
acuguucacuagugaggguuga

SEQ ID NO: 1024264 - RNA, 22 nt, Human
uccuggaguugugcagugcaca

SEQ ID NO: 1024265 - RNA, 22 nt, Human
agcugucugucuccugaggaga

SEQ ID NO: 1024266 - RNA, 18 nt, Human
cugcugcaggcacucagg

SEQ ID NO: 1024267 - RNA, 22 nt, Human
uagcugccuagacagcuauagc

SEQ ID NO: 1024268 - RNA, 22 nt, Human
cuuccucccggcccaugcucug

SEQ ID NO: 1024269 - RNA, 22 nt, Human
cagggacaauggcagagccuga

SEQ ID NO: 1024270 - RNA, 22 nt, Human
uaguacuuaucucugucauugu

SEQ ID NO: 1024271 - RNA, 22 nt, Human
ugaagcagauggucuggucauu

SEQ ID NO: 1024272 - RNA, 22 nt, Human
gccucugcugacaagauggaca

SEQ ID NO: 1024273 - RNA, 22 nt, Human
cuugaaucuucugaguauuugc

SEQ ID NO: 1024274 - RNA, 22 nt, Human
cccugcagaaccacagacaaac

SEQ ID NO: 1024275 - RNA, 22 nt, Human
agccagggagguggagguugca

SEQ ID NO: 1024276 - RNA, 18 nt, Human
guuaauuuugaaguucau

SEQ ID NO: 1024277 - RNA, 22 nt, Human
aucaguuucacuugcuugcaaa

SEQ ID NO: 1024278 - RNA, 22 nt, Human
aaggagagguuguccguguugu

SEQ ID NO: 1024279 - RNA, 22 nt, Human
ucuggccauggcaagccgagug

SEQ ID NO: 1024280 - RNA, 22 nt, Human
uuagcauuucaguacacauguu

SEQ ID NO: 1024281 - RNA, 22 nt, Human
ugggggucaggaugaggccuug

SEQ ID NO: 1024282 - RNA, 19 nt, Human
ggcuggcaagugacagugu

SEQ ID NO: 1024283 - RNA, 22 nt, Human
cugagguggaacagaggugaag

SEQ ID NO: 1024284 - RNA, 22 nt, Human
gaggcaggcacuguuaucagca

SEQ ID NO: 1024285 - RNA, 23 nt, Human
aagcugccuucgcaguuggucug

SEQ ID NO: 1024286 - RNA, 22 nt, Human
agcuuccugaugcaagagggcu

SEQ ID NO: 1024287 - RNA, 22 nt, Human
uaaggcacccuucugaguagag

SEQ ID NO: 1024288 - RNA, 22 nt, Human
augauguugauaaauuacuuua

SEQ ID NO: 1024289 - RNA, 22 nt, Human
caggaaagaaaugagaacacca

SEQ ID NO: 1024290 - RNA, 22 nt, Human
ccaggcaggcagcguucucagg

SEQ ID NO: 1024291 - RNA, 22 nt, Human
agaacagcaguuaugguucauu

SEQ ID NO: 1024292 - RNA, 22 nt, Human
ucuguucaguugauguaguuuu

SEQ ID NO: 1024293 - RNA, 22 nt, Human
agggauggaagcucgucugcaa

SEQ ID NO: 1024294 - RNA, 22 nt, Human
aaggaaagacauauaaaugacu

SEQ ID NO: 1024295 - RNA, 22 nt, Human
aagauuucucuccuggaaagca

SEQ ID NO: 1024296 - RNA, 22 nt, Human
cucuucuugcuagacugagugc

SEQ ID NO: 1024297 - RNA, 22 nt, Human
ucuuuggaucccaacuggcugg

SEQ ID NO: 1024298 - RNA, 22 nt, Human
gcuccuggcuccaggcagccaa

SEQ ID NO: 1024299 - RNA, 22 nt, Human
ugcugcucuguaaagugaugag

SEQ ID NO: 1024300 - RNA, 22 nt, Human
agagcugagcaccaagcauggu

SEQ ID NO: 1024301 - RNA, 22 nt, Human
cacacacaguuuuguauucugu

SEQ ID NO: 1024302 - RNA, 22 nt, Human
gccucccuggcccacagcagcg

SEQ ID NO: 1024303 - RNA, 22 nt, Human
uaaucuguguaccuucaucgga

SEQ ID NO: 1024304 - RNA, 20 nt, Human
ccagguggugccuggagagg

SEQ ID NO: 1024305 - RNA, 22 nt, Human
cuggccuuggugcuugcagaca

SEQ ID NO: 1024306 - RNA, 20 nt, Human
ucucaggccccaguuuucuu

SEQ ID NO: 1024307 - RNA, 21 nt, Human
aaaaugugagcgugaugcuua

SEQ ID NO: 1024308 - RNA, 22 nt, Human
acacccagagcgccagugccga

SEQ ID NO: 1024309 - RNA, 22 nt, Human
acugggccuggauuggcguguc

SEQ ID NO: 1024310 - RNA, 22 nt, Human
agguagagcuccaguagaaaau

SEQ ID NO: 1024311 - RNA, 21 nt, Human
gcagggacaaagcuucaggag

SEQ ID NO: 1024312 - RNA, 22 nt, Human
ugcagauucaaaugaaaugcaa

SEQ ID NO: 1024313 - RNA, 23 nt, Human
cagugcagggcaacucagacucc

SEQ ID NO: 1024314 - RNA, 22 nt, Human
auuucagcccaguaugagcccc

SEQ ID NO: 1024315 - RNA, 22 nt, Human
cucuuccuacagucugcuaugc

SEQ ID NO: 1024316 - RNA, 22 nt, Human
ccagagagcuacaaggcauaaa

SEQ ID NO: 1024317 - RNA, 22 nt, Human
agaacagaagggaggaaggccu

SEQ ID NO: 1024318 - RNA, 22 nt, Human
gccugcagccucagagaauuuu

SEQ ID NO: 1024319 - RNA, 22 nt, Human
aacccuggggcagcugcuaggg

SEQ ID NO: 1024320 - RNA, 22 nt, Human
uuggcugagagaggaaaagggc

SEQ ID NO: 1024321 - RNA, 22 nt, Human
augugaaagagguguucagugg

SEQ ID NO: 1024322 - RNA, 22 nt, Human
gagguuagaggucagugcaguc

SEQ ID NO: 1024323 - RNA, 22 nt, Human
ugcugucccuaagucucuucaa

SEQ ID NO: 1024324 - RNA, 22 nt, Human
agagugggccucugagucccag

SEQ ID NO: 1024325 - RNA, 22 nt, Human
ugcagugguugagagcccagac

SEQ ID NO: 1024326 - RNA, 22 nt, Human
aucauucuauuguugagcugcc

SEQ ID NO: 1024327 - RNA, 22 nt, Human
uucucugaaggccaugcucacu

SEQ ID NO: 1024328 - RNA, 22 nt, Human
aggccagagaggggaccagccu

SEQ ID NO: 1024329 - RNA, 22 nt, Human
caguggguaggaaaggcucuuc

SEQ ID NO: 1024330 - RNA, 22 nt, Human
acauuuaaauaccuauguuucu

SEQ ID NO: 1024331 - RNA, 22 nt, Human
uaaaugcaagugcuccugggag

SEQ ID NO: 1024332 - RNA, 22 nt, Human
caugaguuuuuuaguucaugca

SEQ ID NO: 1024333 - RNA, 22 nt, Human
aagggcucuguugccauuucag

SEQ ID NO: 1024334 - RNA, 22 nt, Human
ucccagagacaucauuucuccg

SEQ ID NO: 1024335 - RNA, 22 nt, Human
gaaguuuauuucaaucuauuca

SEQ ID NO: 1024336 - RNA, 19 nt, Human
ucuggcuccugccaggcug

SEQ ID NO: 1024337 - RNA, 22 nt, Human
aggccagaaaugucagggagug

SEQ ID NO: 1024338 - RNA, 22 nt, Human
caagaaaugggauuugacugcc

SEQ ID NO: 1024339 - RNA, 22 nt, Human
guggcugcucgggcuccggccc

SEQ ID NO: 1024340 - RNA, 22 nt, Human
cuuggcugucuauaggaaagag

SEQ ID NO: 1024341 - RNA, 22 nt, Human
acagaggaaggcugagcugccc

SEQ ID NO: 1024342 - RNA, 22 nt, Human
uccuucagggcugaccacaggc

SEQ ID NO: 1024343 - RNA, 22 nt, Human
aucaggaugaagcuguagcgaa

SEQ ID NO: 1024344 - RNA, 22 nt, Human
uccugcagacauuuacaccuuu

SEQ ID NO: 1024345 - RNA, 22 nt, Human
gggacagcuguagugcuuggcu

SEQ ID NO: 1024346 - RNA, 22 nt, Human
agcuagaauauugaucugaaau

SEQ ID NO: 1024347 - RNA, 22 nt, Human
augcagcaguuuacaaagcaau

SEQ ID NO: 1024348 - RNA, 22 nt, Human
acccaggagguggaggcugcag

SEQ ID NO: 1024349 - RNA, 22 nt, Human
uaucuguuguaguacagaugau

SEQ ID NO: 1024350 - RNA, 22 nt, Human
cuuauguaaaacggaaagggaa

SEQ ID NO: 1024351 - RNA, 22 nt, Human
agucucugcacaguaagaagca

SEQ ID NO: 1024352 - RNA, 22 nt, Human
uaaggccaccguuauagaacca

SEQ ID NO: 1024353 - RNA, 22 nt, Human
ucauuugugugagugauuugac

SEQ ID NO: 1024354 - RNA, 22 nt, Human
cccagacucaucccugggagcu

SEQ ID NO: 1024355 - RNA, 22 nt, Human
acacaaauuguaggauaauugc

SEQ ID NO: 1024356 - RNA, 22 nt, Human
cagggugccuguccucagcaaa

SEQ ID NO: 1024357 - RNA, 22 nt, Human
caggagcucucaucgucagggc

SEQ ID NO: 1024358 - RNA, 22 nt, Human
guuuaagaaaauucauguuguu

SEQ ID NO: 1024359 - RNA, 22 nt, Human
caggccuccacuccacgcagac

SEQ ID NO: 1024360 - RNA, 22 nt, Human
ccacccuuggguucggaggccg

SEQ ID NO: 1024361 - RNA, 22 nt, Human
caggcuggagugaguguagugg

SEQ ID NO: 1024362 - RNA, 22 nt, Human
gcugcccugugguccagcaggu

SEQ ID NO: 1024363 - RNA, 22 nt, Human
aggccuccuggcuccaggccuu

SEQ ID NO: 1024364 - RNA, 22 nt, Human
auuuccaggagaaaggauuuua

SEQ ID NO: 1024365 - RNA, 22 nt, Human
ccauaaucuggcuuugagagag

SEQ ID NO: 1024366 - RNA, 22 nt, Human
uauccagggaguuuuagggcuu

SEQ ID NO: 1024367 - RNA, 22 nt, Human
acauuucuaguuguucaucucc

SEQ ID NO: 1024368 - RNA, 22 nt, Human
gcuggcaggguucucacugaaa

SEQ ID NO: 1024369 - RNA, 22 nt, Human
ucucucuucaacccuuaacuag

SEQ ID NO: 1024370 - RNA, 22 nt, Human
uagcugccagaccauucuuacu

SEQ ID NO: 1024371 - RNA, 22 nt, Human
ucagccacuacccaccuuaaca

SEQ ID NO: 1024372 - RNA, 22 nt, Human
gcuggccacacugcugauggag

SEQ ID NO: 1024373 - RNA, 22 nt, Human
uuuucaguaaugucuacauaau

SEQ ID NO: 1024374 - RNA, 22 nt, Human
augucccagcugagagacaacu

SEQ ID NO: 1024375 - RNA, 22 nt, Human
uccaggcaggguuaaggguccu

SEQ ID NO: 1024376 - RNA, 22 nt, Human
uuuccucauuuaucugcuggga

SEQ ID NO: 1024377 - RNA, 22 nt, Human
ggagccuugggcgcucucccau

SEQ ID NO: 1024378 - RNA, 22 nt, Human
ugucuucaucuccaugcacaga

SEQ ID NO: 1024379 - RNA, 22 nt, Human
auucuucauguugaagcuguca

SEQ ID NO: 1024380 - RNA, 22 nt, Human
acuguucaagcaaaugacauug

SEQ ID NO: 1024381 - RNA, 22 nt, Human
cuggccugggagcugcuagcgu

SEQ ID NO: 1024382 - RNA, 22 nt, Human
uccuggagggaggcggugcuac

SEQ ID NO: 1024383 - RNA, 22 nt, Human
cccaggcuggagugcaauggug

SEQ ID NO: 1024384 - RNA, 22 nt, Human
guaauugacucagcucuguuca

SEQ ID NO: 1024385 - RNA, 22 nt, Human
ugcuugugagaguuuuuucaga

SEQ ID NO: 1024386 - RNA, 22 nt, Human
uuugucauaucacacaauuuug

SEQ ID NO: 1024387 - RNA, 21 nt, Human
uggcagaguugaguaguuaug

SEQ ID NO: 1024388 - RNA, 22 nt, Human
caggaccuggaaugcuugugaa

SEQ ID NO: 1024389 - RNA, 22 nt, Human
uauuucuuucagguauguguug

SEQ ID NO: 1024390 - RNA, 21 nt, Human
agcaacucugacuagaugagg

SEQ ID NO: 1024391 - RNA, 22 nt, Human
ccaggacucaguggggaaaggg

SEQ ID NO: 1024392 - RNA, 22 nt, Human
aggcacuggucuaccccuuagu

SEQ ID NO: 1024393 - RNA, 22 nt, Human
uggcuggggccacaguuuuccu

SEQ ID NO: 1024394 - RNA, 22 nt, Human
auguaaggcugccuaugacacu

SEQ ID NO: 1024395 - RNA, 22 nt, Human
aggccugaaguguggagugggg

SEQ ID NO: 1024396 - RNA, 22 nt, Human
gggaccuggggacuccuuguuc

SEQ ID NO: 1024397 - RNA, 22 nt, Human
aaauauacuagaugaugaccca

SEQ ID NO: 1024398 - RNA, 22 nt, Human
gaaaugcaggcuuggauucagc

SEQ ID NO: 1024399 - RNA, 22 nt, Human
gaacccaggcuuuugaggcugu

SEQ ID NO: 1024400 - RNA, 22 nt, Human
uggcucugugcuucuaguaucu

SEQ ID NO: 1024401 - RNA, 19 nt, Human
aauguaguguuaugucaac

SEQ ID NO: 1024402 - RNA, 22 nt, Human
ugugggcaggcccgggucugag

SEQ ID NO: 1024403 - RNA, 22 nt, Human
cacugcaggucugagauggggg

SEQ ID NO: 1024404 - RNA, 22 nt, Human
auacaaagacaaaucucaaucu

SEQ ID NO: 1024405 - RNA, 22 nt, Human
auuuagaaauuccaaaaguauu

SEQ ID NO: 1024406 - RNA, 22 nt, Human
auuuuacuuugugaauauugac

SEQ ID NO: 1024407 - RNA, 22 nt, Human
auguacauuuguaguaauauca

SEQ ID NO: 1024408 - RNA, 22 nt, Human
uacaauauguggccuuuuguga

SEQ ID NO: 1024409 - RNA, 19 nt, Human
guugaaaguaggugagggu

SEQ ID NO: 1024410 - RNA, 22 nt, Human
acaagcaugggcuuugacauca

SEQ ID NO: 1024411 - RNA, 22 nt, Human
gucuauauauugcuugaauaau

SEQ ID NO: 1024412 - RNA, 22 nt, Human
ucaguucugcuagaaaaacagu

SEQ ID NO: 1024413 - RNA, 22 nt, Human
ccugaagagcacucuagaguug

SEQ ID NO: 1024414 - RNA, 22 nt, Human
auggccugggcccgcuucagau

SEQ ID NO: 1024415 - RNA, 22 nt, Human
agcugccuggagucauuuccug

SEQ ID NO: 1024416 - RNA, 22 nt, Human
ucaaacuguuuacagugagaua

SEQ ID NO: 1024417 - RNA, 22 nt, Human
agccaggaagaaggucacacca

SEQ ID NO: 1024418 - RNA, 22 nt, Human
ugaaaugauuauaugguguuug

SEQ ID NO: 1024419 - RNA, 22 nt, Human
gcuguucauuagaaauagaaug

SEQ ID NO: 1024420 - RNA, 22 nt, Human
cagcuucugagcaagccagggg

SEQ ID NO: 1024421 - RNA, 22 nt, Human
auggauaagucaaagaguaucc

SEQ ID NO: 1024422 - RNA, 22 nt, Human
uuaaacagagucugaaauguaa

SEQ ID NO: 1024423 - RNA, 22 nt, Human
uuguuuuggaagaacuuacucu

SEQ ID NO: 1024424 - RNA, 22 nt, Human
ccaggcagagugcuccagaaag

SEQ ID NO: 1024425 - RNA, 21 nt, Human
auucugaguugucagucuuca

SEQ ID NO: 1024426 - RNA, 22 nt, Human
cugcugagcccuggcacaggug

SEQ ID NO: 1024427 - RNA, 22 nt, Human
uggcccugugugcaggcugcac

SEQ ID NO: 1024428 - RNA, 22 nt, Human
ccucaggcuuacgggcaaugga

SEQ ID NO: 1024429 - RNA, 22 nt, Human
auuugcuuuuacuauguuaaaa

SEQ ID NO: 1024430 - RNA, 22 nt, Human
ucugggcucuuaguguacccuc

SEQ ID NO: 1024431 - RNA, 23 nt, Human
auaaggcauaaagguacauugga

SEQ ID NO: 1024432 - RNA, 21 nt, Human
ucucugugucuuuaagcugga

SEQ ID NO: 1024433 - RNA, 22 nt, Human
augggaggaugcucgggugcuc

SEQ ID NO: 1024434 - RNA, 22 nt, Human
cugaaggagcauagucaguuuu

SEQ ID NO: 1024435 - RNA, 22 nt, Human
uguguccuucugggagucccag

SEQ ID NO: 1024436 - RNA, 22 nt, Human
gaggaccacagaugagccugca

SEQ ID NO: 1024437 - RNA, 22 nt, Human
ucagcagugcagggugaggcag

SEQ ID NO: 1024438 - RNA, 19 nt, Human
aagggcugggcaccucacu

SEQ ID NO: 1024439 - RNA, 22 nt, Human
agagagcauggcacagaggggu

SEQ ID NO: 1024440 - RNA, 22 nt, Human
guauuuucaagagcaguaguau

SEQ ID NO: 1024441 - RNA, 22 nt, Human
aaaugguaagacaacacauuau

SEQ ID NO: 1024442 - RNA, 20 nt, Human
uaguauuugcauaaggauag

SEQ ID NO: 1024443 - RNA, 22 nt, Human
augugaaauagcuggauaugaa

SEQ ID NO: 1024444 - RNA, 22 nt, Human
gggauggggucaacauguaccu

SEQ ID NO: 1024445 - RNA, 22 nt, Human
gccaccucggcuuucucugcuc

SEQ ID NO: 1024446 - RNA, 22 nt, Human
ucaggauccauagacucccaaa

SEQ ID NO: 1024447 - RNA, 22 nt, Human
cugccucucagccugaccgcca

SEQ ID NO: 1024448 - RNA, 22 nt, Human
aguguuucucagaagggccuau

SEQ ID NO: 1024449 - RNA, 17 nt, Human
ucuguucaagugagagg

SEQ ID NO: 1024450 - RNA, 22 nt, Human
ugccugccaugcagaaagcuga

SEQ ID NO: 1024451 - RNA, 22 nt, Human
ggucccaggcugcgggcuggug

SEQ ID NO: 1024452 - RNA, 22 nt, Human
ccauuguaaagaguauacuuug

SEQ ID NO: 1024453 - RNA, 22 nt, Human
agcagcugcagagggcuccccc

SEQ ID NO: 1024454 - RNA, 22 nt, Human
gagggcucugaaaggaggucac

SEQ ID NO: 1024455 - RNA, 22 nt, Human
cuauuaggcuuccauuucaugc

SEQ ID NO: 1024456 - RNA, 19 nt, Human
aucuuacagagcagaguac

SEQ ID NO: 1024457 - RNA, 22 nt, Human
cagggacauugguggccagguu

SEQ ID NO: 1024458 - RNA, 22 nt, Human
uacuuccagcaaucugcauauu

SEQ ID NO: 1024459 - RNA, 22 nt, Human
aaaugucuuuaucucauguaac

SEQ ID NO: 1024460 - RNA, 22 nt, Human
uugcucagcacuggagccagcu

SEQ ID NO: 1024461 - RNA, 22 nt, Human
cugcaguguucuggaaugcauu

SEQ ID NO: 1024462 - RNA, 22 nt, Human
aucugacaaccuauugacuuga

SEQ ID NO: 1024463 - RNA, 22 nt, Human
gcagaagucagaccaucugaau

SEQ ID NO: 1024464 - RNA, 22 nt, Human
gaguggggucugggcaucaguc

SEQ ID NO: 1024465 - RNA, 22 nt, Human
ucgggcucgcucuccuagcgga

SEQ ID NO: 1024466 - RNA, 22 nt, Human
acaugcauucucuaaaagcaaa

SEQ ID NO: 1024467 - RNA, 22 nt, Human
agcuggguguguaucagauaaa

SEQ ID NO: 1024468 - RNA, 22 nt, Human
gugcuaggauuacaggcauggg

SEQ ID NO: 1024469 - RNA, 22 nt, Human
aaauuuaagaagugugugcgug

SEQ ID NO: 1024470 - RNA, 22 nt, Human
uggcccucagucuugcuccugc

SEQ ID NO: 1024471 - RNA, 22 nt, Human
ccucugcucugguccaugugcu

SEQ ID NO: 1024472 - RNA, 22 nt, Human
cauuagggacugaggaauaagg

SEQ ID NO: 1024473 - RNA, 22 nt, Human
ucaguuuucucaucuguaauuu

SEQ ID NO: 1024474 - RNA, 22 nt, Human
ucucaagcuuguugguauguuu

SEQ ID NO: 1024475 - RNA, 22 nt, Human
uugaaaggugaacaugaugcac

SEQ ID NO: 1024476 - RNA, 22 nt, Human
caugccaguuuugagaugcacc

SEQ ID NO: 1024477 - RNA, 17 nt, Human
ccucccacaccgcccug

SEQ ID NO: 1024478 - RNA, 22 nt, Human
gucaccaggucugaugcagcca

SEQ ID NO: 1024479 - RNA, 22 nt, Human
gcuucucuggccugcagggcau

SEQ ID NO: 1024480 - RNA, 22 nt, Human
uggcucugaccagguagaggag

SEQ ID NO: 1024481 - RNA, 21 nt, Human
cccagggaagccgcagucacc

SEQ ID NO: 1024482 - RNA, 22 nt, Human
ccugggcucuauccugacccag

SEQ ID NO: 1024483 - RNA, 22 nt, Human
uuuacucuugcuacacaacugu

SEQ ID NO: 1024484 - RNA, 22 nt, Human
agguauaagaagauuauuuaua

SEQ ID NO: 1024485 - RNA, 22 nt, Human
gaggcagcaugguaccuuggag

SEQ ID NO: 1024486 - RNA, 22 nt, Human
aucagcaagacuaggggaauac

SEQ ID NO: 1024487 - RNA, 22 nt, Human
ucuccucucuuaccugguacaa

SEQ ID NO: 1024488 - RNA, 22 nt, Human
guggcugcagagggcacagcau

SEQ ID NO: 1024489 - RNA, 22 nt, Human
gcucuggacuggggccugagaa

SEQ ID NO: 1024490 - RNA, 20 nt, Human
acugcuucuuucucugaccu

SEQ ID NO: 1024491 - RNA, 22 nt, Human
cugagcugguggaagcaugcag

SEQ ID NO: 1024492 - RNA, 17 nt, Human
cucuccuuccucugagg

SEQ ID NO: 1024493 - RNA, 22 nt, Human
uauauauucuuaaguaguguag

SEQ ID NO: 1024494 - RNA, 23 nt, Human
auuugagaaaguauuuuuaagac

SEQ ID NO: 1024495 - RNA, 22 nt, Human
caccugcagggggagucaagag

SEQ ID NO: 1024496 - RNA, 22 nt, Human
ucagggcaucaucaugaauaua

SEQ ID NO: 1024497 - RNA, 22 nt, Human
gcagggacugugaucucacaga

SEQ ID NO: 1024498 - RNA, 22 nt, Human
gagucaguaauggauaugucau

SEQ ID NO: 1024499 - RNA, 23 nt, Human
ggccuguguuuugucugaaguac

SEQ ID NO: 1024500 - RNA, 22 nt, Human
aguguuucccaguaggaugaaa

SEQ ID NO: 1024501 - RNA, 22 nt, Human
agcagccacccagcugcucauu

SEQ ID NO: 1024502 - RNA, 22 nt, Human
uauaauuuaucaugucacaguu

SEQ ID NO: 1024503 - RNA, 22 nt, Human
ccaggccuuccaguacgcagaa

SEQ ID NO: 1024504 - RNA, 22 nt, Human
uugugcaauuuaaaaucuuccu

SEQ ID NO: 1024505 - RNA, 22 nt, Human
uaaaucuccuguuuuucaucua

SEQ ID NO: 1024506 - RNA, 22 nt, Human
aaggccaacuaggaugagcuag

SEQ ID NO: 1024507 - RNA, 22 nt, Human
acacaaguucuaaagauugcgc

SEQ ID NO: 1024508 - RNA, 22 nt, Human
agcugcccugggucuugcugcu

SEQ ID NO: 1024509 - RNA, 22 nt, Human
uagaaauguugguauuaacauu

SEQ ID NO: 1024510 - RNA, 22 nt, Human
aaaguauuugugauuuuuacca

SEQ ID NO: 1024511 - RNA, 22 nt, Human
caguuucuuaucuucaaaauug

SEQ ID NO: 1024512 - RNA, 22 nt, Human
ucaugccacuuacaaaauaaug

SEQ ID NO: 1024513 - RNA, 22 nt, Human
uuucuuucaauucuccuaaugc

SEQ ID NO: 1024514 - RNA, 22 nt, Human
ucacaguuauagucuguagaau

SEQ ID NO: 1024515 - RNA, 22 nt, Human
ucccaggauguuggcggcaggu

SEQ ID NO: 1024516 - RNA, 22 nt, Human
aggccagaaauuuggaguaugu

SEQ ID NO: 1024517 - RNA, 22 nt, Human
gagacaaaaguuggagugcaag

SEQ ID NO: 1024518 - RNA, 22 nt, Human
uuucauaauacuguacaugaaa

SEQ ID NO: 1024519 - RNA, 22 nt, Human
gcccucucuucugcagccucca

SEQ ID NO: 1024520 - RNA, 19 nt, Human
uguguaaagucugugguca

SEQ ID NO: 1024521 - RNA, 22 nt, Human
ccaaaauguuugaaugcaugug

SEQ ID NO: 1024522 - RNA, 22 nt, Human
ccagcccuguaaggaugaggca

SEQ ID NO: 1024523 - RNA, 18 nt, Human
uuccauaauguauguaac

SEQ ID NO: 1024524 - RNA, 22 nt, Human
agcucucaagauaagaaagaac

SEQ ID NO: 1024525 - RNA, 22 nt, Human
uauuuuguuaauaauccagucc

SEQ ID NO: 1024526 - RNA, 22 nt, Human
gcagggaccagggccagaucca

SEQ ID NO: 1024527 - RNA, 22 nt, Human
ccugggcuugcaucugugcugg

SEQ ID NO: 1024528 - RNA, 21 nt, Human
uaacacauuuugguacuuugg

SEQ ID NO: 1024529 - RNA, 19 nt, Human
augagcuggcauuucaggu

SEQ ID NO: 1024530 - RNA, 22 nt, Human
ccagaaaaugcagaacauagaa

SEQ ID NO: 1024531 - RNA, 20 nt, Human
auacacauauucuugcaacu

SEQ ID NO: 1024532 - RNA, 22 nt, Human
agcagcugagccccagcuguga

SEQ ID NO: 1024533 - RNA, 20 nt, Human
caguccaaucagaggccacc

SEQ ID NO: 1024534 - RNA, 22 nt, Human
uuccucagcuggccugauuggg

SEQ ID NO: 1024535 - RNA, 22 nt, Human
uggcaguccccugugccuggaa

SEQ ID NO: 1024536 - RNA, 22 nt, Human
uggucucuucuuccaagauggc

SEQ ID NO: 1024537 - RNA, 22 nt, Human
gaugaaaaucuugagaugucga

SEQ ID NO: 1024538 - RNA, 22 nt, Human
caggggcucugagauugucuaa

SEQ ID NO: 1024539 - RNA, 22 nt, Human
uggccuccccuaacagccucuu

SEQ ID NO: 1024540 - RNA, 22 nt, Human
agaugaaagauuuuuauagaga

SEQ ID NO: 1024541 - RNA, 22 nt, Human
aucugccugagucuagguuuuc

SEQ ID NO: 1024542 - RNA, 22 nt, Human
augguuuguguggcccagauga

SEQ ID NO: 1024543 - RNA, 17 nt, Human
aggccucccuccaggcc

SEQ ID NO: 1024544 - RNA, 22 nt, Human
gcugcaggcauuuuccugggca

SEQ ID NO: 1024545 - RNA, 22 nt, Human
aaagaugucauacacauuaaga

SEQ ID NO: 1024546 - RNA, 22 nt, Human
agcugagcuaguaguuccagug

SEQ ID NO: 1024547 - RNA, 22 nt, Human
ggccuggcauggggacuaaggg

SEQ ID NO: 1024548 - RNA, 22 nt, Human
acugcagccuagggaccacagu

SEQ ID NO: 1024549 - RNA, 22 nt, Human
aaaguuaguuucuuauaugucu

SEQ ID NO: 1024550 - RNA, 19 nt, Human
ccaggccugcgggcguugg

SEQ ID NO: 1024551 - RNA, 22 nt, Human
agggaguguaaauggugcucag

SEQ ID NO: 1024552 - RNA, 22 nt, Human
agccugagccccauccagcuga

SEQ ID NO: 1024553 - RNA, 22 nt, Human
cuggcagcgcagcaugaagucg

SEQ ID NO: 1024554 - RNA, 22 nt, Human
auguuuuugagauacaaacaga

SEQ ID NO: 1024555 - RNA, 22 nt, Human
cugagcuuggccaggaaugaau

SEQ ID NO: 1024556 - RNA, 22 nt, Human
uggcagagucaucacaucugga

SEQ ID NO: 1024557 - RNA, 22 nt, Human
ugcccacaggaagacaccagcg

SEQ ID NO: 1024558 - RNA, 22 nt, Human
uggaagggggaagacagcucug

SEQ ID NO: 1024559 - RNA, 22 nt, Human
uuccaggggcagcagugauggu

SEQ ID NO: 1024560 - RNA, 22 nt, Human
ccuggcuuccuggagcucacaa

SEQ ID NO: 1024561 - RNA, 18 nt, Human
acaaauguagugucuuaa

SEQ ID NO: 1024562 - RNA, 22 nt, Human
ucccaggaaaacacucgaggac

SEQ ID NO: 1024563 - RNA, 22 nt, Human
uucugaggcacuggcucuccca

SEQ ID NO: 1024564 - RNA, 22 nt, Human
cacucuccagcacaccccauuu

SEQ ID NO: 1024565 - RNA, 22 nt, Human
cccagccaaggugcugguguug

SEQ ID NO: 1024566 - RNA, 22 nt, Human
ccaggagguggagauugcagug

SEQ ID NO: 1024567 - RNA, 22 nt, Human
ugggcacuguagcuggugcugg

SEQ ID NO: 1024568 - RNA, 22 nt, Human
uggcucagugacauuccuccca

SEQ ID NO: 1024569 - RNA, 22 nt, Human
uuguacaaguauuaugugaaca

SEQ ID NO: 1024570 - RNA, 22 nt, Human
aaguccagcucuaaauaucuga

SEQ ID NO: 1024571 - RNA, 22 nt, Human
agccccucuguggcucugccuc

SEQ ID NO: 1024572 - RNA, 22 nt, Human
ucuggagauaagacagacagau

SEQ ID NO: 1024573 - RNA, 22 nt, Human
gaguuauuggguggaaagguag

SEQ ID NO: 1024574 - RNA, 22 nt, Human
agcuccugcacccagccuugag

SEQ ID NO: 1024575 - RNA, 21 nt, Human
ugguggagugugcugagcaug

SEQ ID NO: 1024576 - RNA, 22 nt, Human
guucagggagggacagaugaag

SEQ ID NO: 1024577 - RNA, 23 nt, Human
auguuauuauuagcagucuugcc

SEQ ID NO: 1024578 - RNA, 22 nt, Human
ucccagaguauuagcaauugcu

SEQ ID NO: 1024579 - RNA, 21 nt, Human
agucuguuaggaugacucuga

SEQ ID NO: 1024580 - RNA, 22 nt, Human
ucccagagaagagcuggaugga

SEQ ID NO: 1024581 - RNA, 22 nt, Human
gagcugccugugugccaugaug

SEQ ID NO: 1024582 - RNA, 22 nt, Human
ggcccuguuagagcucccacaa

SEQ ID NO: 1024583 - RNA, 22 nt, Human
gcccugugcgacucuagagguu

SEQ ID NO: 1024584 - RNA, 22 nt, Human
auugaggcagcauaguucaggg

SEQ ID NO: 1024585 - RNA, 22 nt, Human
aucuggcucauucagggaacgg

SEQ ID NO: 1024586 - RNA, 22 nt, Human
uggcagagcccagacuccaguc

SEQ ID NO: 1024587 - RNA, 22 nt, Human
auggggugaccaugagcauuua

SEQ ID NO: 1024588 - RNA, 22 nt, Human
cagggcccaggccacuggguug

SEQ ID NO: 1024589 - RNA, 22 nt, Human
gcagacuguaucaaugucagua

SEQ ID NO: 1024590 - RNA, 18 nt, Human
agcagaauucuaggguuc

SEQ ID NO: 1024591 - RNA, 20 nt, Human
ccugccuguguuugugauga

SEQ ID NO: 1024592 - RNA, 22 nt, Human
acauuucucagguaagucauuu

SEQ ID NO: 1024593 - RNA, 22 nt, Human
aaugaugguuucaucacuugaa

SEQ ID NO: 1024594 - RNA, 22 nt, Human
ucacaggcuugugaacauugca

SEQ ID NO: 1024595 - RNA, 22 nt, Human
acaggcucuggggcaggauggc

SEQ ID NO: 1024596 - RNA, 22 nt, Human
cugcagggaccacaagcagguu

SEQ ID NO: 1024597 - RNA, 22 nt, Human
cugugccaggcccagcugacuu

SEQ ID NO: 1024598 - RNA, 22 nt, Human
cugcagggagaggggacagccu

SEQ ID NO: 1024599 - RNA, 22 nt, Human
ggcuucauggaggaggugaguc

SEQ ID NO: 1024600 - RNA, 22 nt, Human
uggcagcagggaggccaguguu

SEQ ID NO: 1024601 - RNA, 23 nt, Human
guaaaauacgcagugcaguguga

SEQ ID NO: 1024602 - RNA, 20 nt, Human
ucacuaguaaccaucugcuu

SEQ ID NO: 1024603 - RNA, 20 nt, Human
cuucuucagccuaugcuuca

SEQ ID NO: 1024604 - RNA, 22 nt, Human
uugugaaauguuucaaaauagu

SEQ ID NO: 1024605 - RNA, 22 nt, Human
cauuuguaauacugacuugcag

SEQ ID NO: 1024606 - RNA, 22 nt, Human
auucuucauuuacuguuacuug

SEQ ID NO: 1024607 - RNA, 22 nt, Human
cagauggcagggcagcucugca

SEQ ID NO: 1024608 - RNA, 22 nt, Human
uuaugacauaugaguacaagua

SEQ ID NO: 1024609 - RNA, 22 nt, Human
gaggcacugagagugggggaug

SEQ ID NO: 1024610 - RNA, 22 nt, Human
gccuuccuuacaccugcucagc

SEQ ID NO: 1024611 - RNA, 22 nt, Human
uaaaugugagugaugcggugaa

SEQ ID NO: 1024612 - RNA, 21 nt, Human
gcucuuggaaggggcucagcu

SEQ ID NO: 1024613 - RNA, 23 nt, Human
ucugucacuuucugcuguggagu

SEQ ID NO: 1024614 - RNA, 22 nt, Human
gucuggaggaggaagaaggcac

SEQ ID NO: 1024615 - RNA, 22 nt, Human
cauccaggcaccacaaccagcu

SEQ ID NO: 1024616 - RNA, 22 nt, Human
agccuucauaaucuugggcuuu

SEQ ID NO: 1024617 - RNA, 23 nt, Human
aucaaaguggaaaucaauuaucu

SEQ ID NO: 1024618 - RNA, 22 nt, Human
accugagccuagggagguugag

SEQ ID NO: 1024619 - RNA, 22 nt, Human
uuuagaaauucaucuauggccu

SEQ ID NO: 1024620 - RNA, 22 nt, Human
gauacaaauucaugucugaauu

SEQ ID NO: 1024621 - RNA, 22 nt, Human
acugugcuuucucuggaggcau

SEQ ID NO: 1024622 - RNA, 22 nt, Human
agagccaggaucuguuuugggg

SEQ ID NO: 1024623 - RNA, 22 nt, Human
auaaggcagaaaugauucuagu

SEQ ID NO: 1024624 - RNA, 22 nt, Human
agccuggcacugccccauccau

SEQ ID NO: 1024625 - RNA, 22 nt, Human
aggcugcuuucauggccgcccc

SEQ ID NO: 1024626 - RNA, 22 nt, Human
uucauugugauucuuggcuagc

SEQ ID NO: 1024627 - RNA, 22 nt, Human
uauagagguggaaacugagguu

SEQ ID NO: 1024628 - RNA, 22 nt, Human
cagcaggcguugggagaaagac

SEQ ID NO: 1024629 - RNA, 22 nt, Human
aaaauacuguggaguguugaaa

SEQ ID NO: 1024630 - RNA, 22 nt, Human
auggauaauggugauaguugca

SEQ ID NO: 1024631 - RNA, 22 nt, Human
gcugauguuuaguugauguuac

SEQ ID NO: 1024632 - RNA, 22 nt, Human
uguuuuaaagccauugccuuuc

SEQ ID NO: 1024633 - RNA, 22 nt, Human
ugcauguuaagaaaauauugag

SEQ ID NO: 1024634 - RNA, 22 nt, Human
auguaugaagcuuuguuuggga

SEQ ID NO: 1024635 - RNA, 22 nt, Human
gaaaucugcuucuugcauagua

SEQ ID NO: 1024636 - RNA, 22 nt, Human
aaauaguuguuuggaucaauaa

SEQ ID NO: 1024637 - RNA, 22 nt, Human
aaaauuauagaucuagugccug

SEQ ID NO: 1024638 - RNA, 22 nt, Human
agcaggagagcagugcgugguc

SEQ ID NO: 1024639 - RNA, 22 nt, Human
gcugcucuccauggccgugagu

SEQ ID NO: 1024640 - RNA, 22 nt, Human
cagaggcucuuccucacugccc

SEQ ID NO: 1024641 - RNA, 20 nt, Human
ccagcauguacacaugugga

SEQ ID NO: 1024642 - RNA, 22 nt, Human
uaaaugugucuuuuuaaggccu

SEQ ID NO: 1024643 - RNA, 22 nt, Human
uguacaaugccagggaacacca

SEQ ID NO: 1024644 - RNA, 22 nt, Human
ucagccucucugaguccagacc

SEQ ID NO: 1024645 - RNA, 22 nt, Human
agcucccagucuccucuccaug

SEQ ID NO: 1024646 - RNA, 18 nt, Human
aaaaugcaggcgacaugg

SEQ ID NO: 1024647 - RNA, 23 nt, Human
ucagggacaugaugugucauauc

SEQ ID NO: 1024648 - RNA, 19 nt, Human
gagguggguccccgcagcc

SEQ ID NO: 1024649 - RNA, 22 nt, Human
aggagccaagcagaacuaagga

SEQ ID NO: 1024650 - RNA, 22 nt, Human
ugcugcacaauuggaaaguauc

SEQ ID NO: 1024651 - RNA, 19 nt, Human
caagugaagccugggaugg

SEQ ID NO: 1024652 - RNA, 22 nt, Human
cuggagcccaggccuggugucu

SEQ ID NO: 1024653 - RNA, 22 nt, Human
ucaaucacguguuccauguucu

SEQ ID NO: 1024654 - RNA, 22 nt, Human
agccuggauccuaggcucagcu

SEQ ID NO: 1024655 - RNA, 20 nt, Human
uggagcuguaaucuugucug

SEQ ID NO: 1024656 - RNA, 18 nt, Human
cagauccaggcagcuauu

SEQ ID NO: 1024657 - RNA, 22 nt, Human
cacaugaagagagucuaguaau

SEQ ID NO: 1024658 - RNA, 17 nt, Human
uccaugagacaugaaga

SEQ ID NO: 1024659 - RNA, 22 nt, Human
cagcuggccugaucccuguggc

SEQ ID NO: 1024660 - RNA, 22 nt, Human
cccaggucugugccagcucuga

SEQ ID NO: 1024661 - RNA, 22 nt, Human
ccuaagaauuaaugaauacacc

SEQ ID NO: 1024662 - RNA, 22 nt, Human
uggccugaauuauggcagaucu

SEQ ID NO: 1024663 - RNA, 22 nt, Human
aauagcucacugauuucucuuu

SEQ ID NO: 1024664 - RNA, 22 nt, Human
aaauccuaccaagaaauucccu

SEQ ID NO: 1024665 - RNA, 22 nt, Human
cagagcugcagauugaaggcau

SEQ ID NO: 1024666 - RNA, 22 nt, Human
agaugcugcuccacaggccagg

SEQ ID NO: 1024667 - RNA, 22 nt, Human
uccugggcugugugccacucug

SEQ ID NO: 1024668 - RNA, 22 nt, Human
aaaauuauucauggcuuuugga

SEQ ID NO: 1024669 - RNA, 22 nt, Human
cccaugagauucugaauuuggc

SEQ ID NO: 1024670 - RNA, 22 nt, Human
cccugcagaucuaggguccuuc

SEQ ID NO: 1024671 - RNA, 22 nt, Human
gccugugcuuaacugacgugag

SEQ ID NO: 1024672 - RNA, 22 nt, Human
gggccuggugcuucugacuccu

SEQ ID NO: 1024673 - RNA, 22 nt, Human
ugaggcagaaauuccuguuuuc

SEQ ID NO: 1024674 - RNA, 22 nt, Human
aggucauuacaauuaucauuuu

SEQ ID NO: 1024675 - RNA, 22 nt, Human
cccuguggaggaggagagcagu

SEQ ID NO: 1024676 - RNA, 22 nt, Human
ugcuuaaacccugaucaugugu

SEQ ID NO: 1024677 - RNA, 22 nt, Human
uccugcagagucccacugauuu

SEQ ID NO: 1024678 - RNA, 22 nt, Human
gcagccacuuugcaaccaagag

SEQ ID NO: 1024679 - RNA, 22 nt, Human
ucagaguguggugagaugugca

SEQ ID NO: 1024680 - RNA, 22 nt, Human
aagcagcagaccugauuuugaa

SEQ ID NO: 1024681 - RNA, 22 nt, Human
ucccagccuuucuuuucugcug

SEQ ID NO: 1024682 - RNA, 22 nt, Human
gcucccaguucccaaagugacc

SEQ ID NO: 1024683 - RNA, 22 nt, Human
uuacaagcagcuacauaucaca

SEQ ID NO: 1024684 - RNA, 22 nt, Human
cuccagggggcauccacacagc

SEQ ID NO: 1024685 - RNA, 22 nt, Human
ucuacugugguccuuguaacca

SEQ ID NO: 1024686 - RNA, 22 nt, Human
auuauuaggugcucucugacaa

SEQ ID NO: 1024687 - RNA, 22 nt, Human
cugaagcaaaugaaacagcucu

SEQ ID NO: 1024688 - RNA, 19 nt, Human
cuggugcuugagugaguca

SEQ ID NO: 1024689 - RNA, 22 nt, Human
ucacuuaaaaauucuaguuaug

SEQ ID NO: 1024690 - RNA, 22 nt, Human
aggagcagaauuuaaugugcag

SEQ ID NO: 1024691 - RNA, 22 nt, Human
agggaagaaaauccaucgcugc

SEQ ID NO: 1024692 - RNA, 22 nt, Human
aaaucaguuaagaugaggccau

SEQ ID NO: 1024693 - RNA, 22 nt, Human
agagugaaguucaucgugcagc

SEQ ID NO: 1024694 - RNA, 22 nt, Human
acauuuuuuagagucccacauu

SEQ ID NO: 1024695 - RNA, 22 nt, Human
ugaaagguagcuggccucauag

SEQ ID NO: 1024696 - RNA, 22 nt, Human
cagcugagaccagaaugcaggu

SEQ ID NO: 1024697 - RNA, 22 nt, Human
gggcucugggauucagagcaag

SEQ ID NO: 1024698 - RNA, 22 nt, Human
cugcuuugauuagaagaguaca

SEQ ID NO: 1024699 - RNA, 22 nt, Human
ccugucugcaugaucccugcca

SEQ ID NO: 1024700 - RNA, 22 nt, Human
gaaaacuaacggaaaaguuagg

SEQ ID NO: 1024701 - RNA, 22 nt, Human
auauuaggcaaggagauuauuu

SEQ ID NO: 1024702 - RNA, 22 nt, Human
gcagagguggcaucugggcucu

SEQ ID NO: 1024703 - RNA, 22 nt, Human
gagccaagggcgugcuggagag

SEQ ID NO: 1024704 - RNA, 22 nt, Human
gggagucugggcuagacuccuu

SEQ ID NO: 1024705 - RNA, 22 nt, Human
ggagcuggcuacagagaacucc

SEQ ID NO: 1024706 - RNA, 22 nt, Human
agcugagcacauucaaacaggu

SEQ ID NO: 1024707 - RNA, 22 nt, Human
acagcagcuugcgugucugguc

SEQ ID NO: 1024708 - RNA, 22 nt, Human
ggcaugggccgaggugccuccu

SEQ ID NO: 1024709 - RNA, 22 nt, Human
agcagggcuuugcagacuuggg

SEQ ID NO: 1024710 - RNA, 22 nt, Human
uugaagagugccuuccagacau

SEQ ID NO: 1024711 - RNA, 22 nt, Human
ugggugaggaugaugaggcagc

SEQ ID NO: 1024712 - RNA, 21 nt, Human
gcagagccggggcgagaaggc

SEQ ID NO: 1024713 - RNA, 22 nt, Human
cuggagcauccaugcccagggu

SEQ ID NO: 1024714 - RNA, 22 nt, Human
guagcuuauuagggauaauagu

SEQ ID NO: 1024715 - RNA, 22 nt, Human
ugaacaaacugcauucuucacu

SEQ ID NO: 1024716 - RNA, 22 nt, Human
cagcagcuggugagacacagcc

SEQ ID NO: 1024717 - RNA, 22 nt, Human
aaagaggaaccaagagcacgug

SEQ ID NO: 1024718 - RNA, 22 nt, Human
uucucagagcucacuguaguaa

SEQ ID NO: 1024719 - RNA, 22 nt, Human
cuuucuuauaccugucagggcc

SEQ ID NO: 1024720 - RNA, 22 nt, Human
ggcuucugccacgagagggaag

SEQ ID NO: 1024721 - RNA, 22 nt, Human
uauugucuguccgggucaaagc

SEQ ID NO: 1024722 - RNA, 22 nt, Human
gccuggagcagacgugucccgg

SEQ ID NO: 1024723 - RNA, 22 nt, Human
acacugcucacuucuucccuug

SEQ ID NO: 1024724 - RNA, 23 nt, Human
acagcugcaccuggccgccuggc

SEQ ID NO: 1024725 - RNA, 22 nt, Human
aggaaagcucccaguagggcuc

SEQ ID NO: 1024726 - RNA, 22 nt, Human
uagagcuguaucaaagagccuu

SEQ ID NO: 1024727 - RNA, 22 nt, Human
uuaaacaguguuucaugugggg

SEQ ID NO: 1024728 - RNA, 22 nt, Human
ucuggccugaaaguccaugcuu

SEQ ID NO: 1024729 - RNA, 22 nt, Human
gccuuccuuuuaccaccagcca

SEQ ID NO: 1024730 - RNA, 22 nt, Human
aagaaaugcagaaaugugcugg

SEQ ID NO: 1024731 - RNA, 22 nt, Human
gauccuugcacuugacuuggca

SEQ ID NO: 1024732 - RNA, 22 nt, Human
aggcaggcucaggcccaugcuu

SEQ ID NO: 1024733 - RNA, 22 nt, Human
acugcccucccaucuauugcaa

SEQ ID NO: 1024734 - RNA, 22 nt, Human
gcugagagcaaagcaugucuag

SEQ ID NO: 1024735 - RNA, 19 nt, Human
uagaaugcccacuuaaaaa

SEQ ID NO: 1024736 - RNA, 22 nt, Human
uauggcauuguuggugaugaua

SEQ ID NO: 1024737 - RNA, 22 nt, Human
ggacuucuaagugccagacacu

SEQ ID NO: 1024738 - RNA, 22 nt, Human
caggcugaggcaguaggguuug

SEQ ID NO: 1024739 - RNA, 22 nt, Human
cucagaagaacaaaggcucuac

SEQ ID NO: 1024740 - RNA, 22 nt, Human
uguggaaaauuggaacguuccu

SEQ ID NO: 1024741 - RNA, 22 nt, Human
aagggcuggccacauucugggu

SEQ ID NO: 1024742 - RNA, 21 nt, Human
ucagggcagugggagguuccu

SEQ ID NO: 1024743 - RNA, 22 nt, Human
gauacauuuuaucuccuaacag

SEQ ID NO: 1024744 - RNA, 22 nt, Human
uuaaauuagucaagcuucucug

SEQ ID NO: 1024745 - RNA, 22 nt, Human
ucacauuuuaucuauuuuaagu

SEQ ID NO: 1024746 - RNA, 22 nt, Human
aagaacaguguccugggacucg

SEQ ID NO: 1024747 - RNA, 22 nt, Human
aauaguauuuauuuggaaaaag

SEQ ID NO: 1024748 - RNA, 22 nt, Human
agagagccugaguggcagcuau

SEQ ID NO: 1024749 - RNA, 22 nt, Human
agguauuauuagcaucucuauu

SEQ ID NO: 1024750 - RNA, 22 nt, Human
uucacaauaggagcaugcaaau

SEQ ID NO: 1024751 - RNA, 22 nt, Human
cugggaggcaccgcgucgugcu

SEQ ID NO: 1024752 - RNA, 22 nt, Human
uugccuugauucuucucaugug

SEQ ID NO: 1024753 - RNA, 22 nt, Human
uagcuguguaagcuugguaaga

SEQ ID NO: 1024754 - RNA, 22 nt, Human
gccaggcucagcagucaaccug

SEQ ID NO: 1024755 - RNA, 22 nt, Human
uaggcagggauuaggguugauu

SEQ ID NO: 1024756 - RNA, 22 nt, Human
cagccaggcccccgagucguug

SEQ ID NO: 1024757 - RNA, 22 nt, Human
aucaaaguucguaacugauaac

SEQ ID NO: 1024758 - RNA, 22 nt, Human
aaaguucaugguguuauagaaa

SEQ ID NO: 1024759 - RNA, 18 nt, Human
ucuuggaguaaugaucaa

SEQ ID NO: 1024760 - RNA, 22 nt, Human
aggccugggacgggagccguga

SEQ ID NO: 1024761 - RNA, 21 nt, Human
guggcccugguguggcugcac

SEQ ID NO: 1024762 - RNA, 22 nt, Human
uggcugugucaucauagcugug

SEQ ID NO: 1024763 - RNA, 22 nt, Human
cagcugccuucugcgggaaguc

SEQ ID NO: 1024764 - RNA, 22 nt, Human
uggccugucuuguugugcuaga

SEQ ID NO: 1024765 - RNA, 22 nt, Human
gugcagugagcagugcagcacc

SEQ ID NO: 1024766 - RNA, 20 nt, Human
agcauuugaaauaugacuau

SEQ ID NO: 1024767 - RNA, 22 nt, Human
gcugcagcucgccuuccggccu

SEQ ID NO: 1024768 - RNA, 22 nt, Human
acacaggaagucagcacugaug

SEQ ID NO: 1024769 - RNA, 22 nt, Human
ugcauugcaguuaacucaguau

SEQ ID NO: 1024770 - RNA, 21 nt, Human
gggcagaggggccuccugggu

SEQ ID NO: 1024771 - RNA, 22 nt, Human
ccuguccuccaagagcacaucu

SEQ ID NO: 1024772 - RNA, 22 nt, Human
aacauacauauuucagugucca

SEQ ID NO: 1024773 - RNA, 22 nt, Human
aauuuuaagcauaugacugguu

SEQ ID NO: 1024774 - RNA, 22 nt, Human
ccagugcuuccaggaauacggu

SEQ ID NO: 1024775 - RNA, 22 nt, Human
ucccagagcccaaguuggagag

SEQ ID NO: 1024776 - RNA, 22 nt, Human
uucucagauccaucagaagucc

SEQ ID NO: 1024777 - RNA, 22 nt, Human
ucugcaggccucgacaaggcca

SEQ ID NO: 1024778 - RNA, 22 nt, Human
cucugagaggugagaagcagca

SEQ ID NO: 1024779 - RNA, 17 nt, Human
uauguaguacuuauaaa

SEQ ID NO: 1024780 - RNA, 22 nt, Human
aggagacaucuaacuguagguu

SEQ ID NO: 1024781 - RNA, 22 nt, Human
ucagagcuuuggagaccaggaa

SEQ ID NO: 1024782 - RNA, 22 nt, Human
ugcuuuauguuaucagaagggu

SEQ ID NO: 1024783 - RNA, 22 nt, Human
agcugaguuaauucaucacuua

SEQ ID NO: 1024784 - RNA, 17 nt, Human
guccugggaggagagag

SEQ ID NO: 1024785 - RNA, 22 nt, Human
gcugucaccaaagcaggcacug

SEQ ID NO: 1024786 - RNA, 22 nt, Human
uggcucagcgcggccuggucuu

SEQ ID NO: 1024787 - RNA, 22 nt, Human
ggauccuucuuugaccucacag

SEQ ID NO: 1024788 - RNA, 22 nt, Human
cuuccaaagcacuuuauggacc

SEQ ID NO: 1024789 - RNA, 22 nt, Human
gggcucagccccauugaaccag

SEQ ID NO: 1024790 - RNA, 22 nt, Human
acugugugaaacaucaaugugu

SEQ ID NO: 1024791 - RNA, 22 nt, Human
uggcugaaggaagauucuucua

SEQ ID NO: 1024792 - RNA, 22 nt, Human
gccaccagugggggccugggca

SEQ ID NO: 1024793 - RNA, 22 nt, Human
cugccuggggaaugugaggauu

SEQ ID NO: 1024794 - RNA, 22 nt, Human
ccuggcugucguuuugugaaau

SEQ ID NO: 1024795 - RNA, 22 nt, Human
uguaggccuauguccagcaauu

SEQ ID NO: 1024796 - RNA, 22 nt, Human
cagcugaacauguagagcaucu

SEQ ID NO: 1024797 - RNA, 22 nt, Human
gcagcaaucuucacagugucau

SEQ ID NO: 1024798 - RNA, 22 nt, Human
ccgggcgggggcucucgucacc

SEQ ID NO: 1024799 - RNA, 22 nt, Human
gggcacugaaugccaagcuagg

SEQ ID NO: 1024800 - RNA, 22 nt, Human
ugaccuuauuugaaaauagaga

SEQ ID NO: 1024801 - RNA, 22 nt, Human
cagcauggggcuuggagucagc

SEQ ID NO: 1024802 - RNA, 22 nt, Human
ggcagccauggacacuggcuag

SEQ ID NO: 1024803 - RNA, 22 nt, Human
uuccaggauggcaauaaugaau

SEQ ID NO: 1024804 - RNA, 22 nt, Human
ucugggaaccagugcggcuggg

SEQ ID NO: 1024805 - RNA, 22 nt, Human
ucccagggucaguggugaggcc

SEQ ID NO: 1024806 - RNA, 22 nt, Human
uuauacauguguuuugagauga

SEQ ID NO: 1024807 - RNA, 23 nt, Human
uucuucucaauuaguugauucag

SEQ ID NO: 1024808 - RNA, 22 nt, Human
cacagguggcuccaaguuagag

SEQ ID NO: 1024809 - RNA, 23 nt, Human
cuuuccuuucuuugacacccagc

SEQ ID NO: 1024810 - RNA, 22 nt, Human
uagaaacaucagcuaaccaaaa

SEQ ID NO: 1024811 - RNA, 22 nt, Human
gaaaggucaguuccacuuccau

SEQ ID NO: 1024812 - RNA, 22 nt, Human
uccagucaggcugaauucaagg

SEQ ID NO: 1024813 - RNA, 22 nt, Human
ccagcuuuucagaaucugccug

SEQ ID NO: 1024814 - RNA, 22 nt, Human
ggcuucaccgcgggguugcagg

SEQ ID NO: 1024815 - RNA, 22 nt, Human
augacacaauuuuagagcugaa

SEQ ID NO: 1024816 - RNA, 22 nt, Human
uagucucuggagacucuagggg

SEQ ID NO: 1024817 - RNA, 22 nt, Human
uagaacagaguuccagugauca

SEQ ID NO: 1024818 - RNA, 22 nt, Human
aaugagacacgugaagcagaug

SEQ ID NO: 1024819 - RNA, 18 nt, Human
ccugagcccugcuuacuu

SEQ ID NO: 1024820 - RNA, 22 nt, Human
cacagaagaaucaugcuguguu

SEQ ID NO: 1024821 - RNA, 22 nt, Human
auaaaaguaggaccaacuuaca

SEQ ID NO: 1024822 - RNA, 22 nt, Human
ucacaggacccugaggguggcg

SEQ ID NO: 1024823 - RNA, 22 nt, Human
cagauaaaggcuuacuaguagu

SEQ ID NO: 1024824 - RNA, 22 nt, Human
ugaagcagcaccauuuuagagc

SEQ ID NO: 1024825 - RNA, 22 nt, Human
aucaguuuggugcuuucaguga

SEQ ID NO: 1024826 - RNA, 22 nt, Human
agggagaaaauuggaugcacaa

SEQ ID NO: 1024827 - RNA, 22 nt, Human
gucaggauuauuuuauuaaaag

SEQ ID NO: 1024828 - RNA, 20 nt, Human
uacuugaauguugcagcagu

SEQ ID NO: 1024829 - RNA, 22 nt, Human
uagggcaguuucauguuaucuu

SEQ ID NO: 1024830 - RNA, 22 nt, Human
uccugaggaaaguucaugaaug

SEQ ID NO: 1024831 - RNA, 22 nt, Human
uuuaccaagcuuuaauuacaua

SEQ ID NO: 1024832 - RNA, 22 nt, Human
gaggacaggagacucacuguuu

SEQ ID NO: 1024833 - RNA, 22 nt, Human
ugcagcagacugaguaugagaa

SEQ ID NO: 1024834 - RNA, 22 nt, Human
cacauaaucaccaaguccuuuc

SEQ ID NO: 1024835 - RNA, 22 nt, Human
gggucagcugcugggggcugac

SEQ ID NO: 1024836 - RNA, 22 nt, Human
cuggcucaauaaauauuagcug

SEQ ID NO: 1024837 - RNA, 22 nt, Human
cagugucuuauuuguagcucag

SEQ ID NO: 1024838 - RNA, 22 nt, Human
ggaggcaggaaagacagguuca

SEQ ID NO: 1024839 - RNA, 22 nt, Human
auuugaagaaaguuuucuagau

SEQ ID NO: 1024840 - RNA, 20 nt, Human
agggcagagggauuacaggc

SEQ ID NO: 1024841 - RNA, 21 nt, Human
gggccuggcugcgcaggacgg

SEQ ID NO: 1024842 - RNA, 17 nt, Human
cagacagauauccuggg

SEQ ID NO: 1024843 - RNA, 22 nt, Human
guaaacaugcuguguacucagc

SEQ ID NO: 1024844 - RNA, 22 nt, Human
aucuggcuggauucuuagcguu

SEQ ID NO: 1024845 - RNA, 22 nt, Human
agcccucauggaacagcuccua

SEQ ID NO: 1024846 - RNA, 22 nt, Human
aaaucuaggcucauccuggucc

SEQ ID NO: 1024847 - RNA, 22 nt, Human
ugccuggaugugcuggccucac

SEQ ID NO: 1024848 - RNA, 22 nt, Human
cuggcucccucgcugaggugcu

SEQ ID NO: 1024849 - RNA, 22 nt, Human
uauguuuuucaagugcacacua

SEQ ID NO: 1024850 - RNA, 22 nt, Human
agaggcacuccagccacugguc

SEQ ID NO: 1024851 - RNA, 22 nt, Human
aggccagguggucaugcuugcu

SEQ ID NO: 1024852 - RNA, 23 nt, Human
gagguacagcaccagugaauagg

SEQ ID NO: 1024853 - RNA, 22 nt, Human
cuuuggaagugaccacaauccu

SEQ ID NO: 1024854 - RNA, 22 nt, Human
aggcucugcagaccccagcugu

SEQ ID NO: 1024855 - RNA, 22 nt, Human
cagaggccucacuuccagccag

SEQ ID NO: 1024856 - RNA, 21 nt, Human
cccuguguuccacagcagaca

SEQ ID NO: 1024857 - RNA, 22 nt, Human
cccacagguccccaugaacucg

SEQ ID NO: 1024858 - RNA, 22 nt, Human
uuugcauuguuucaaaagugaa

SEQ ID NO: 1024859 - RNA, 22 nt, Human
ugugcucuggaguugccuucac

SEQ ID NO: 1024860 - RNA, 22 nt, Human
agcagccagagaaugaugcagu

SEQ ID NO: 1024861 - RNA, 22 nt, Human
aggguccugggugcaguugcuu

SEQ ID NO: 1024862 - RNA, 22 nt, Human
ccuccucugggaagauucagag

SEQ ID NO: 1024863 - RNA, 22 nt, Human
aagcagcugauuucacagcuca

SEQ ID NO: 1024864 - RNA, 22 nt, Human
agcuggcacagaccaggagauc

SEQ ID NO: 1024865 - RNA, 22 nt, Human
cucugagaaagcugugagcuaa

SEQ ID NO: 1024866 - RNA, 20 nt, Human
agccagaagaaggcuggaga

SEQ ID NO: 1024867 - RNA, 22 nt, Human
gggucucucucggcuccacgcg

SEQ ID NO: 1024868 - RNA, 22 nt, Human
ggcaggugcucugugggccugg

SEQ ID NO: 1024869 - RNA, 22 nt, Human
uucaguaaaacacugcaauguc

SEQ ID NO: 1024870 - RNA, 23 nt, Human
aaacugcuuccaauuccugccau

SEQ ID NO: 1024871 - RNA, 22 nt, Human
uccuucagaggacggcagccag

SEQ ID NO: 1024872 - RNA, 22 nt, Human
aucugcuuuugagaauuuacuu

SEQ ID NO: 1024873 - RNA, 22 nt, Human
cauuagggucucucagcugaau

SEQ ID NO: 1024874 - RNA, 21 nt, Human
ucuuugcaucaguuguuuucu

SEQ ID NO: 1024875 - RNA, 22 nt, Human
caggagcugggucuggaagcag

SEQ ID NO: 1024876 - RNA, 20 nt, Human
gagccugggaagucuaaggu

SEQ ID NO: 1024877 - RNA, 17 nt, Human
gugcagggaugaaggau

SEQ ID NO: 1024878 - RNA, 22 nt, Human
gccaggugcuaucccugcgcug

SEQ ID NO: 1024879 - RNA, 22 nt, Human
ucucagagaagugaugagcaau

SEQ ID NO: 1024880 - RNA, 22 nt, Human
gaggcacugaauacuugagggu

SEQ ID NO: 1024881 - RNA, 22 nt, Human
ugguaaauauguccauucucuu

SEQ ID NO: 1024882 - RNA, 22 nt, Human
cagucacacaaguggacuuggg

SEQ ID NO: 1024883 - RNA, 22 nt, Human
gcaggagcucguuuccaggcug

SEQ ID NO: 1024884 - RNA, 22 nt, Human
gucaggauguuuauucuccagu

SEQ ID NO: 1024885 - RNA, 22 nt, Human
aggcccagggcugcucucugaa

SEQ ID NO: 1024886 - RNA, 22 nt, Human
agaggcacagaggcaguccccu

SEQ ID NO: 1024887 - RNA, 22 nt, Human
gugggagcccucagggaggugc

SEQ ID NO: 1024888 - RNA, 22 nt, Human
uccucugcuguucugguucuuu

SEQ ID NO: 1024889 - RNA, 22 nt, Human
cagacccucgggugaguuggcc

SEQ ID NO: 1024890 - RNA, 21 nt, Human
guauugcagaguuaugugcuc

SEQ ID NO: 1024891 - RNA, 22 nt, Human
uuucacagcuggguggcagagu

SEQ ID NO: 1024892 - RNA, 22 nt, Human
cucagggucugguccuuagauu

SEQ ID NO: 1024893 - RNA, 22 nt, Human
ucucuggagggcuccaggcggg

SEQ ID NO: 1024894 - RNA, 21 nt, Human
cugcucuggggaccggcugug

SEQ ID NO: 1024895 - RNA, 22 nt, Human
caggguccggcugccuggcugu

SEQ ID NO: 1024896 - RNA, 22 nt, Human
ccuauugacaauucucuucucc

SEQ ID NO: 1024897 - RNA, 22 nt, Human
uauggcauaucugggagacucu

SEQ ID NO: 1024898 - RNA, 22 nt, Human
cagaggccccauuggcugugcg

SEQ ID NO: 1024899 - RNA, 22 nt, Human
aaugaacaaaauaugcuuugca

SEQ ID NO: 1024900 - RNA, 22 nt, Human
agggcuccugaggcccuucugg

SEQ ID NO: 1024901 - RNA, 21 nt, Human
cucuggaggcaagggagagug

SEQ ID NO: 1024902 - RNA, 22 nt, Human
aauuauguagccauaugaaaca

SEQ ID NO: 1024903 - RNA, 22 nt, Human
ggagcugucuguagggcacagg

SEQ ID NO: 1024904 - RNA, 22 nt, Human
uaaaugagggcugacaugauug

SEQ ID NO: 1024905 - RNA, 22 nt, Human
gcaggcagguggcaucuuguga

SEQ ID NO: 1024906 - RNA, 22 nt, Human
cuacccagcaccuaggcugccu

SEQ ID NO: 1024907 - RNA, 22 nt, Human
caggggcagucugugugcgugg

SEQ ID NO: 1024908 - RNA, 22 nt, Human
gcugcccugucugcagcaggac

SEQ ID NO: 1024909 - RNA, 22 nt, Human
gaggaaugucagcacaggccuc

SEQ ID NO: 1024910 - RNA, 21 nt, Human
uucuucaaagaagaaggcaca

SEQ ID NO: 1024911 - RNA, 22 nt, Human
guguuuccucacuucucugacu

SEQ ID NO: 1024912 - RNA, 22 nt, Human
uaagaacaucuguccccagauu

SEQ ID NO: 1024913 - RNA, 22 nt, Human
uauguacuacacuagaacauuu

SEQ ID NO: 1024914 - RNA, 22 nt, Human
cuucuucauaggcaguccuguu

SEQ ID NO: 1024915 - RNA, 22 nt, Human
ucccagaagugaaauuucuaga

SEQ ID NO: 1024916 - RNA, 22 nt, Human
gguguccaucaggcugugcuuc

SEQ ID NO: 1024917 - RNA, 20 nt, Human
ugucauuguuucuaggaccu

SEQ ID NO: 1024918 - RNA, 22 nt, Human
cugguuuagcuguaagguuccc

SEQ ID NO: 1024919 - RNA, 22 nt, Human
cugcugcucagugucaucaugu

SEQ ID NO: 1024920 - RNA, 22 nt, Human
gcaggaugggagcuucacucug

SEQ ID NO: 1024921 - RNA, 22 nt, Human
agaauccuguuuuacuucauca

SEQ ID NO: 1024922 - RNA, 22 nt, Human
uccauuuuucaugacuccucaa

SEQ ID NO: 1024923 - RNA, 22 nt, Human
cauacauugcucauucaguauc

SEQ ID NO: 1024924 - RNA, 22 nt, Human
ggguguccugugccaagcuggg

SEQ ID NO: 1024925 - RNA, 22 nt, Human
acagagaaagugggcugaagau

SEQ ID NO: 1024926 - RNA, 22 nt, Human
agcugcucaggagagccagguc

SEQ ID NO: 1024927 - RNA, 21 nt, Human
auacauucuauuaagcauuua

SEQ ID NO: 1024928 - RNA, 22 nt, Human
agggccagagucuguguagaua

SEQ ID NO: 1024929 - RNA, 22 nt, Human
ugucugucugcaagccagaaag

SEQ ID NO: 1024930 - RNA, 22 nt, Human
ucagcagggccuccuugugcag

SEQ ID NO: 1024931 - RNA, 22 nt, Human
gcuggcagaauuucuucuugcu

SEQ ID NO: 1024932 - RNA, 22 nt, Human
ucuuuuggaaaugaugugcagg

SEQ ID NO: 1024933 - RNA, 22 nt, Human
cagcagugucuccagcaucaca

SEQ ID NO: 1024934 - RNA, 22 nt, Human
uuugcaguagacaucuuauuuu

SEQ ID NO: 1024935 - RNA, 22 nt, Human
aguacuuugcacuuugcucaga

SEQ ID NO: 1024936 - RNA, 22 nt, Human
ugggcugcugcggugcucuugg

SEQ ID NO: 1024937 - RNA, 22 nt, Human
ucuggccuuaucuguccaagcc

SEQ ID NO: 1024938 - RNA, 22 nt, Human
cacccuggaaagaaggucuggg

SEQ ID NO: 1024939 - RNA, 22 nt, Human
ccuaugccugucacucugcgcu

SEQ ID NO: 1024940 - RNA, 22 nt, Human
uccuuuuugguccaaggugacc

SEQ ID NO: 1024941 - RNA, 20 nt, Human
uauaacaguguugggugugu

SEQ ID NO: 1024942 - RNA, 22 nt, Human
gugggaugguagguagguaaua

SEQ ID NO: 1024943 - RNA, 22 nt, Human
gcauguguugguuuaugcaugu

SEQ ID NO: 1024944 - RNA, 22 nt, Human
uauuacugagguuuuauggagu

SEQ ID NO: 1024945 - RNA, 22 nt, Human
uccuucaggccucauucucaua

SEQ ID NO: 1024946 - RNA, 22 nt, Human
uuuucuaacaucuaguaauuug

SEQ ID NO: 1024947 - RNA, 22 nt, Human
ucaugcuuaaaagacacuugag

SEQ ID NO: 1024948 - RNA, 22 nt, Human
gcagggugaaggucacauagaa

SEQ ID NO: 1024949 - RNA, 22 nt, Human
gagagugaugaaugguuaaaca

SEQ ID NO: 1024950 - RNA, 22 nt, Human
uuggaggcaaugggaaggaggc

SEQ ID NO: 1024951 - RNA, 22 nt, Human
uggagcuggaauuugagcugga

SEQ ID NO: 1024952 - RNA, 22 nt, Human
gaugaggggucauuggcuggga

SEQ ID NO: 1024953 - RNA, 22 nt, Human
acuguggggggcuuugcucagu

SEQ ID NO: 1024954 - RNA, 22 nt, Human
caggaaccuaaugaaggcucac

SEQ ID NO: 1024955 - RNA, 22 nt, Human
gccaggccugcaagugcuggug

SEQ ID NO: 1024956 - RNA, 22 nt, Human
ggcuuuauuauguggccaugug

SEQ ID NO: 1024957 - RNA, 22 nt, Human
aagagcuggauggaaucuggga

SEQ ID NO: 1024958 - RNA, 22 nt, Human
ucaugcacaugugucaccauca

SEQ ID NO: 1024959 - RNA, 18 nt, Human
uggccuggagacaacucu

SEQ ID NO: 1024960 - RNA, 22 nt, Human
cugcaagauuggaagaugcaau

SEQ ID NO: 1024961 - RNA, 22 nt, Human
cauuucugauuacagaauacua

SEQ ID NO: 1024962 - RNA, 22 nt, Human
gugcgccagcucaaggggaggc

SEQ ID NO: 1024963 - RNA, 22 nt, Human
agcagaagaaagccacaugacu

SEQ ID NO: 1024964 - RNA, 22 nt, Human
ucuguaucacccguucccagaa

SEQ ID NO: 1024965 - RNA, 22 nt, Human
agcugcaggcccaugcucaguc

SEQ ID NO: 1024966 - RNA, 17 nt, Human
aagauuucauuagcuga

SEQ ID NO: 1024967 - RNA, 22 nt, Human
ucaggggagguugaaucgucuc

SEQ ID NO: 1024968 - RNA, 22 nt, Human
ccuuucucuuugcugaucaugu

SEQ ID NO: 1024969 - RNA, 22 nt, Human
ugaugggaaaaugaggccuggg

SEQ ID NO: 1024970 - RNA, 22 nt, Human
cuuuccaaugcauuuccaaugu

SEQ ID NO: 1024971 - RNA, 22 nt, Human
aggggcugccuggcuuggcacu

SEQ ID NO: 1024972 - RNA, 22 nt, Human
agggcuggaggguacuaguuua

SEQ ID NO: 1024973 - RNA, 22 nt, Human
ggccugggcccacugucaagag

SEQ ID NO: 1024974 - RNA, 22 nt, Human
cucccugguguccccuccagga

SEQ ID NO: 1024975 - RNA, 22 nt, Human
gaagcccuauccucuccuggga

SEQ ID NO: 1024976 - RNA, 22 nt, Human
aagauuucugcuuuuggaggca

SEQ ID NO: 1024977 - RNA, 22 nt, Human
gcauuauuaauagcugcaugag

SEQ ID NO: 1024978 - RNA, 22 nt, Human
accagccugucugagucguggg

SEQ ID NO: 1024979 - RNA, 22 nt, Human
aggcuuuaauuaucuacaggag

SEQ ID NO: 1024980 - RNA, 22 nt, Human
gggcaugagagggcagcuggca

SEQ ID NO: 1024981 - RNA, 22 nt, Human
caaugaaaauuuaaguugcagc

SEQ ID NO: 1024982 - RNA, 18 nt, Human
gcuccuggaccaggucac

SEQ ID NO: 1024983 - RNA, 22 nt, Human
cagaaccaggaacugauggaga

SEQ ID NO: 1024984 - RNA, 22 nt, Human
agcuuuauauaaaagaguacau

SEQ ID NO: 1024985 - RNA, 22 nt, Human
cugagccacugcuuguucagug

SEQ ID NO: 1024986 - RNA, 22 nt, Human
aagauacugaugauguaggcua

SEQ ID NO: 1024987 - RNA, 22 nt, Human
ugaaaugagauagauaaucagg

SEQ ID NO: 1024988 - RNA, 23 nt, Human
gcugucugucaucucugcgggag

SEQ ID NO: 1024989 - RNA, 22 nt, Human
ucagaccauccugcuguuagug

SEQ ID NO: 1024990 - RNA, 22 nt, Human
aaagauuucacaucccaagccu

SEQ ID NO: 1024991 - RNA, 22 nt, Human
ccgggccucgggacaccgggua

SEQ ID NO: 1024992 - RNA, 23 nt, Human
cagggcugggcuugguguuaggc

SEQ ID NO: 1024993 - RNA, 22 nt, Human
cugggcucagaugagaggaagg

SEQ ID NO: 1024994 - RNA, 22 nt, Human
aagccagguguuuaggccagcg

SEQ ID NO: 1024995 - RNA, 22 nt, Human
gugucauguagaaauugaugaa

SEQ ID NO: 1024996 - RNA, 22 nt, Human
gggcuggagccagcuguggcug

SEQ ID NO: 1024997 - RNA, 22 nt, Human
guucccauacaguaucagugcu

SEQ ID NO: 1024998 - RNA, 22 nt, Human
uggcugggugcuauccaguacu

SEQ ID NO: 1024999 - RNA, 22 nt, Human
gggcuggcaucaguugccgaga

SEQ ID NO: 1025000 - RNA, 22 nt, Human
ugcuugagacacauaugaauuu

SEQ ID NO: 1025001 - RNA, 22 nt, Human
aggucaaaccacagcucuaggc

SEQ ID NO: 1025002 - RNA, 22 nt, Human
aaugucugcucuacucaggagg

SEQ ID NO: 1025003 - RNA, 22 nt, Human
ucccuggaacagagagacaacg

SEQ ID NO: 1025004 - RNA, 22 nt, Human
uuuuuccuuagggguuacucac

SEQ ID NO: 1025005 - RNA, 19 nt, Human
acauuuaaauucagaucuc

SEQ ID NO: 1025006 - RNA, 22 nt, Human
aagggcucgguagcaguccuga

SEQ ID NO: 1025007 - RNA, 21 nt, Human
gccuggcagguggaagggcuc

SEQ ID NO: 1025008 - RNA, 22 nt, Human
cacacaugaaucccuaguaccu

SEQ ID NO: 1025009 - RNA, 22 nt, Human
ugucuuuaaaauuaaacacauc

SEQ ID NO: 1025010 - RNA, 22 nt, Human
cugaggucucuuuccauaguga

SEQ ID NO: 1025011 - RNA, 22 nt, Human
gccaggcuggcaaaaggaaacc

SEQ ID NO: 1025012 - RNA, 22 nt, Human
cagaggcacaagaaagcaaggc

SEQ ID NO: 1025013 - RNA, 22 nt, Human
gcuuccuagaucugugguacuc

SEQ ID NO: 1025014 - RNA, 22 nt, Human
agggaccugcucacugccuggc

SEQ ID NO: 1025015 - RNA, 22 nt, Human
uuaaauauuuucagcaggguca

SEQ ID NO: 1025016 - RNA, 22 nt, Human
uaauguguccugaaagcuucug

SEQ ID NO: 1025017 - RNA, 22 nt, Human
ucacaauacucacucaauggcu

SEQ ID NO: 1025018 - RNA, 22 nt, Human
aucgagggugaguacagcggac

SEQ ID NO: 1025019 - RNA, 20 nt, Human
uccugcagucgcuagcgccc

SEQ ID NO: 1025020 - RNA, 22 nt, Human
cagggagggacaauugucaccu

SEQ ID NO: 1025021 - RNA, 22 nt, Human
gcaugggcaagaggacuggggg

SEQ ID NO: 1025022 - RNA, 22 nt, Human
ucaggggcugugcauuucccag

SEQ ID NO: 1025023 - RNA, 23 nt, Human
aaaguguagccagguuaagaacc

SEQ ID NO: 1025024 - RNA, 22 nt, Human
cagagguacaagcuaaguuggg

SEQ ID NO: 1025025 - RNA, 22 nt, Human
cucugugauuuugugagccaga

SEQ ID NO: 1025026 - RNA, 18 nt, Human
ucuuccaacacugacacc

SEQ ID NO: 1025027 - RNA, 22 nt, Human
gcccugugccagucacgcugug

SEQ ID NO: 1025028 - RNA, 22 nt, Human
cccagggucccugcucucugug

SEQ ID NO: 1025029 - RNA, 22 nt, Human
ccagcagaggggcggagugcag

SEQ ID NO: 1025030 - RNA, 22 nt, Human
guagaagugaugucauguuaua

SEQ ID NO: 1025031 - RNA, 22 nt, Human
gugcauguuaaugguguacaaa

SEQ ID NO: 1025032 - RNA, 21 nt, Human
aagggagauaggaaucaggcc

SEQ ID NO: 1025033 - RNA, 22 nt, Human
gcucuggcuacuguggcuaccg

SEQ ID NO: 1025034 - RNA, 22 nt, Human
cccuuagcucaauuucuugccc

SEQ ID NO: 1025035 - RNA, 22 nt, Human
uguggcugcucaggugcagacc

SEQ ID NO: 1025036 - RNA, 22 nt, Human
augaugguggguaauguguaaa

SEQ ID NO: 1025037 - RNA, 22 nt, Human
cuguacaucucugaggacagua

SEQ ID NO: 1025038 - RNA, 22 nt, Human
uuuauuccaugugucuaugacc

SEQ ID NO: 1025039 - RNA, 22 nt, Human
cucagaauuuagggcucugagg

SEQ ID NO: 1025040 - RNA, 22 nt, Human
ggcuagaauaauugacuucauu

SEQ ID NO: 1025041 - RNA, 22 nt, Human
uaaugugugucaucaguagagu

SEQ ID NO: 1025042 - RNA, 22 nt, Human
agucucuuuguggacucugccu

SEQ ID NO: 1025043 - RNA, 22 nt, Human
agcaggugacagggcuguggug

SEQ ID NO: 1025044 - RNA, 22 nt, Human
aggccugggucucgugccuacc

SEQ ID NO: 1025045 - RNA, 18 nt, Human
cuccagggaacucaguca

SEQ ID NO: 1025046 - RNA, 22 nt, Human
gcagugggaagguuggcacaug

SEQ ID NO: 1025047 - RNA, 22 nt, Human
augauugaccaucugcugggcu

SEQ ID NO: 1025048 - RNA, 22 nt, Human
ucucccacagccgugcuucaag

SEQ ID NO: 1025049 - RNA, 19 nt, Human
ugacaggcuguugccuuga

SEQ ID NO: 1025050 - RNA, 22 nt, Human
gcugaaauucagauuccuaggc

SEQ ID NO: 1025051 - RNA, 22 nt, Human
gaaacaauuuuuguugucuaag

SEQ ID NO: 1025052 - RNA, 22 nt, Human
guugaguggguuaggaugcuga

SEQ ID NO: 1025053 - RNA, 22 nt, Human
auccaugaagguacuucucagg

SEQ ID NO: 1025054 - RNA, 22 nt, Human
ugcucuguugugcaugugggau

SEQ ID NO: 1025055 - RNA, 22 nt, Human
gcaguccaaaguggcucucacc

SEQ ID NO: 1025056 - RNA, 20 nt, Human
acaaaugcauucugugacau

SEQ ID NO: 1025057 - RNA, 22 nt, Human
ccagcucuagccccauguggcu

SEQ ID NO: 1025058 - RNA, 22 nt, Human
auuuauuauugugguuacuucu

SEQ ID NO: 1025059 - RNA, 21 nt, Human
gagugcaggucugaugccauc

SEQ ID NO: 1025060 - RNA, 22 nt, Human
agugcuuuaccuagauaauguu

SEQ ID NO: 1025061 - RNA, 22 nt, Human
ugcccacauucaaaaggugaug

SEQ ID NO: 1025062 - RNA, 22 nt, Human
agcucccaauugacuugaacua

SEQ ID NO: 1025063 - RNA, 22 nt, Human
uggcuuccacugugugcccccu

SEQ ID NO: 1025064 - RNA, 22 nt, Human
cagagcagggugcaccuugggc

SEQ ID NO: 1025065 - RNA, 22 nt, Human
gcagugggagcuuaggcagugc

SEQ ID NO: 1025066 - RNA, 22 nt, Human
aaucauaauuguauacauucau

SEQ ID NO: 1025067 - RNA, 22 nt, Human
guccugggccugcugaggcuga

SEQ ID NO: 1025068 - RNA, 22 nt, Human
ucagaggucccuagcaggagug

SEQ ID NO: 1025069 - RNA, 22 nt, Human
cgaggcagggaagcugcaaaag

SEQ ID NO: 1025070 - RNA, 22 nt, Human
cuccaugaauuugagcuuugug

SEQ ID NO: 1025071 - RNA, 22 nt, Human
cugcagagcaaguaacauccuc

SEQ ID NO: 1025072 - RNA, 22 nt, Human
auauauuuacucuccuguugca

SEQ ID NO: 1025073 - RNA, 22 nt, Human
aaauacauaaagguuguaccag

SEQ ID NO: 1025074 - RNA, 17 nt, Human
uggagcugcguguguuc

SEQ ID NO: 1025075 - RNA, 22 nt, Human
acuguccauucacucauauuca

SEQ ID NO: 1025076 - RNA, 22 nt, Human
uaucuacuccucuuucagaugc

SEQ ID NO: 1025077 - RNA, 22 nt, Human
ugucccagauacuggacauaga

SEQ ID NO: 1025078 - RNA, 22 nt, Human
gcucaagagagaugcaguucuu

SEQ ID NO: 1025079 - RNA, 22 nt, Human
aaacugcugguugcuggccagc

SEQ ID NO: 1025080 - RNA, 22 nt, Human
cacgggagacgugaucuuggac

SEQ ID NO: 1025081 - RNA, 22 nt, Human
gccugagacagugugguccaau

SEQ ID NO: 1025082 - RNA, 19 nt, Human
gugaggauacugcucagag

SEQ ID NO: 1025083 - RNA, 22 nt, Human
agauuugcggcuuuacuuugca

SEQ ID NO: 1025084 - RNA, 22 nt, Human
aaggagaaaugguagaugugca

SEQ ID NO: 1025085 - RNA, 20 nt, Human
cagcuuggaugagaggcuga

SEQ ID NO: 1025086 - RNA, 22 nt, Human
acuguguccuauuuccuugaca

SEQ ID NO: 1025087 - RNA, 22 nt, Human
ucuucaaaugcuaguaauauca

SEQ ID NO: 1025088 - RNA, 22 nt, Human
uccagagggcgauggcuggggg

SEQ ID NO: 1025089 - RNA, 18 nt, Human
gcaggugccacugcuguu

SEQ ID NO: 1025090 - RNA, 22 nt, Human
gugggagcugcuaccuccuucc

SEQ ID NO: 1025091 - RNA, 22 nt, Human
gagcagaugugugccaggaugc

SEQ ID NO: 1025092 - RNA, 22 nt, Human
aggggcucaguuacuuuggcag

SEQ ID NO: 1025093 - RNA, 22 nt, Human
cuuuucauuguuuguacaugca

SEQ ID NO: 1025094 - RNA, 22 nt, Human
gcugccacauuuucaggacuaa

SEQ ID NO: 1025095 - RNA, 19 nt, Human
ucauucaggaccaguggau

SEQ ID NO: 1025096 - RNA, 22 nt, Human
uggcugaauaauauucuguugu

SEQ ID NO: 1025097 - RNA, 22 nt, Human
aaggagugcaugacucagagua

SEQ ID NO: 1025098 - RNA, 22 nt, Human
cuagaaauauuuuacagucaag

SEQ ID NO: 1025099 - RNA, 22 nt, Human
augcagcuucaggauuaugaug

SEQ ID NO: 1025100 - RNA, 22 nt, Human
ugaaaucuccucuuuauauauc

SEQ ID NO: 1025101 - RNA, 22 nt, Human
caacagcugaucuuugaugaag

SEQ ID NO: 1025102 - RNA, 22 nt, Human
gcagagugauggaaugugggug

SEQ ID NO: 1025103 - RNA, 22 nt, Human
uguaugaaucucauuuguuuaa

SEQ ID NO: 1025104 - RNA, 22 nt, Human
aguguguguuugggcgguuuau

SEQ ID NO: 1025105 - RNA, 22 nt, Human
cccagggacagcuagguggggc

SEQ ID NO: 1025106 - RNA, 22 nt, Human
aggggugugcauccuggaggau

SEQ ID NO: 1025107 - RNA, 22 nt, Human
gaggccuggguuggaggugcau

SEQ ID NO: 1025108 - RNA, 23 nt, Human
ggcagcucucaucugaugacuga

SEQ ID NO: 1025109 - RNA, 22 nt, Human
acuuccugcagcuucucagccc

SEQ ID NO: 1025110 - RNA, 22 nt, Human
aaguucaauggaaaagcuuuag

SEQ ID NO: 1025111 - RNA, 22 nt, Human
aauguaugagcgugaaagcacu

SEQ ID NO: 1025112 - RNA, 22 nt, Human
gccagcaguauguccuggcagu

SEQ ID NO: 1025113 - RNA, 22 nt, Human
uagaaagugaagguuaauuaau

SEQ ID NO: 1025114 - RNA, 22 nt, Human
ggucaggguuccagguaucuuc

SEQ ID NO: 1025115 - RNA, 22 nt, Human
guuuccauggcucuguuaaugg

SEQ ID NO: 1025116 - RNA, 22 nt, Human
uaugaccuuaggaagcaagaag

SEQ ID NO: 1025117 - RNA, 22 nt, Human
agggcagagaucugagugggca

SEQ ID NO: 1025118 - RNA, 22 nt, Human
uggcugccuagugucugagcag

SEQ ID NO: 1025119 - RNA, 22 nt, Human
ggcagaggaagcuggaaguggg

SEQ ID NO: 1025120 - RNA, 22 nt, Human
ucaucacucauuggacaacaga

SEQ ID NO: 1025121 - RNA, 22 nt, Human
ccaggaguuugaggcugcagug

SEQ ID NO: 1025122 - RNA, 22 nt, Human
ugucauaacuuagugacaaauc

SEQ ID NO: 1025123 - RNA, 22 nt, Human
cccugcugucaggugcugggag

SEQ ID NO: 1025124 - RNA, 21 nt, Human
acagaugggaugagcacacug

SEQ ID NO: 1025125 - RNA, 20 nt, Human
gucaucgccggcagcaaaga

SEQ ID NO: 1025126 - RNA, 22 nt, Human
cagcucugaggaacacuccuuu

SEQ ID NO: 1025127 - RNA, 22 nt, Human
ugucaccucuuuggcugcagcu

SEQ ID NO: 1025128 - RNA, 22 nt, Human
caggaugagguagaggcagaua

SEQ ID NO: 1025129 - RNA, 22 nt, Human
cuucucucugcauaggcauggg

SEQ ID NO: 1025130 - RNA, 22 nt, Human
auaacagaguugggaagugaaa

SEQ ID NO: 1025131 - RNA, 22 nt, Human
uccaggcuggacaugaggcggg

SEQ ID NO: 1025132 - RNA, 22 nt, Human
cuggcuuucucugugguguuca

SEQ ID NO: 1025133 - RNA, 22 nt, Human
cagcugccagcuucucuccauc

SEQ ID NO: 1025134 - RNA, 20 nt, Human
uccucagaagacauuugggg

SEQ ID NO: 1025135 - RNA, 20 nt, Human
cugcugugguccuuuauuuu

SEQ ID NO: 1025136 - RNA, 22 nt, Human
ucuuugcaucccuuccauaguu

SEQ ID NO: 1025137 - RNA, 22 nt, Human
gacuacucaaacuuucucuaua

SEQ ID NO: 1025138 - RNA, 22 nt, Human
aacuuuauuguuaggggcuaaa

SEQ ID NO: 1025139 - RNA, 22 nt, Human
ccccuuccgucucuugaguguc

SEQ ID NO: 1025140 - RNA, 22 nt, Human
gagccuggauagccuuguucca

SEQ ID NO: 1025141 - RNA, 22 nt, Human
aagugggaauagaaaugaaggu

SEQ ID NO: 1025142 - RNA, 22 nt, Human
gagccuggauugucaccgacuu

SEQ ID NO: 1025143 - RNA, 22 nt, Human
uuugacaucaauacccuagaau

SEQ ID NO: 1025144 - RNA, 22 nt, Human
auaaggcauauagucacuuuuu

SEQ ID NO: 1025145 - RNA, 22 nt, Human
ugacuagaccuauaucuuuuug

SEQ ID NO: 1025146 - RNA, 22 nt, Human
gaggucaauaauaugugcuuua

SEQ ID NO: 1025147 - RNA, 22 nt, Human
ucuggcuccaggaccgggcaca

SEQ ID NO: 1025148 - RNA, 22 nt, Human
aucaaauauaauaauuuucgcu

SEQ ID NO: 1025149 - RNA, 22 nt, Human
agaugcugucacacacacuguu

SEQ ID NO: 1025150 - RNA, 19 nt, Human
uggggccuccugucccugg

SEQ ID NO: 1025151 - RNA, 22 nt, Human
acagucuugcuguauggucagg

SEQ ID NO: 1025152 - RNA, 22 nt, Human
auguacaaaaugccacugaauu

SEQ ID NO: 1025153 - RNA, 22 nt, Human
cucacugcaaguuccaccuacc

SEQ ID NO: 1025154 - RNA, 22 nt, Human
ccacagcugaccgcaggugagc

SEQ ID NO: 1025155 - RNA, 22 nt, Human
ugucucagaguaucccugaacu

SEQ ID NO: 1025156 - RNA, 22 nt, Human
aaguucuaauuuugcauucagg

SEQ ID NO: 1025157 - RNA, 22 nt, Human
agaccaugggcucugaagagca

SEQ ID NO: 1025158 - RNA, 22 nt, Human
uggcucaguagcagugugguca

SEQ ID NO: 1025159 - RNA, 22 nt, Human
gcugcucuggcucugcaguguc

SEQ ID NO: 1025160 - RNA, 22 nt, Human
aaugcacagcuaaagugguucc

SEQ ID NO: 1025161 - RNA, 22 nt, Human
cucugcuuggaacuggacagaa

SEQ ID NO: 1025162 - RNA, 22 nt, Human
ucgcugugguuucuguacaugg

SEQ ID NO: 1025163 - RNA, 22 nt, Human
cugccuggcuaaacucaagucg

SEQ ID NO: 1025164 - RNA, 23 nt, Human
agaggccaacuucuugccccucc

SEQ ID NO: 1025165 - RNA, 22 nt, Human
uucaaauacauucuuugccacu

SEQ ID NO: 1025166 - RNA, 22 nt, Human
cuagucacucagcacugacaaa

SEQ ID NO: 1025167 - RNA, 22 nt, Human
ccugguguugugaaguagccgu

SEQ ID NO: 1025168 - RNA, 18 nt, Human
aauuuccauaugaauugc

SEQ ID NO: 1025169 - RNA, 22 nt, Human
acuggaagccaguugacaauca

SEQ ID NO: 1025170 - RNA, 22 nt, Human
auccaaagcccuaaguuaacug

SEQ ID NO: 1025171 - RNA, 22 nt, Human
gcugccucugcacagcucacuc

SEQ ID NO: 1025172 - RNA, 22 nt, Human
ucccagagcucuggagguugga

SEQ ID NO: 1025173 - RNA, 22 nt, Human
agucaguguucuccggagaggc

SEQ ID NO: 1025174 - RNA, 22 nt, Human
aggcuccuaucgcuuucagcaa

SEQ ID NO: 1025175 - RNA, 22 nt, Human
gcucccaccuccagccugaguu

SEQ ID NO: 1025176 - RNA, 22 nt, Human
gcccagcuggcuuccagcacau

SEQ ID NO: 1025177 - RNA, 22 nt, Human
uuggcagggccaggcucucucu

SEQ ID NO: 1025178 - RNA, 22 nt, Human
cugaagaggacgcagcagcaag

SEQ ID NO: 1025179 - RNA, 22 nt, Human
caugggaggucugcaaggugcu

SEQ ID NO: 1025180 - RNA, 22 nt, Human
uguguuauugccacugaagacc

SEQ ID NO: 1025181 - RNA, 22 nt, Human
augggaggcagacacuaaguuc

SEQ ID NO: 1025182 - RNA, 22 nt, Human
aauauguucaaaauagaucacu

SEQ ID NO: 1025183 - RNA, 22 nt, Human
cacagaaaaaggcuugaaaauc

SEQ ID NO: 1025184 - RNA, 22 nt, Human
gcugccuucaguucugauucau

SEQ ID NO: 1025185 - RNA, 22 nt, Human
acauuucugcauguaggguaau

SEQ ID NO: 1025186 - RNA, 22 nt, Human
caggcacuggggaugcugggau

SEQ ID NO: 1025187 - RNA, 22 nt, Human
gcaggccugacuguagggggca

SEQ ID NO: 1025188 - RNA, 22 nt, Human
cccucuacagggaagcgcuuuc

SEQ ID NO: 1025189 - RNA, 22 nt, Human
cuggcucauuuuagcaucaggu

SEQ ID NO: 1025190 - RNA, 22 nt, Human
acccagcaaagauaaacuuaug

SEQ ID NO: 1025191 - RNA, 22 nt, Human
ugacacagaaauuaagcuguca

SEQ ID NO: 1025192 - RNA, 23 nt, Human
ccaaagucgaagucuaguccaga

SEQ ID NO: 1025193 - RNA, 21 nt, Human
uuaagagcuuagcaguaggcc

SEQ ID NO: 1025194 - RNA, 22 nt, Human
ccagcuccgggaguugcugcug

SEQ ID NO: 1025195 - RNA, 22 nt, Human
ggcaaaaacagcaaugacuuuu

SEQ ID NO: 1025196 - RNA, 22 nt, Human
aaggcaguaggaucuuccacag

SEQ ID NO: 1025197 - RNA, 23 nt, Human
ugcauuauccucucugaagacca

SEQ ID NO: 1025198 - RNA, 22 nt, Human
agagccacugggagacagagca

SEQ ID NO: 1025199 - RNA, 22 nt, Human
aauugugcuaugauuaugaaag

SEQ ID NO: 1025200 - RNA, 22 nt, Human
uuauuacacugaaagaauugcg

SEQ ID NO: 1025201 - RNA, 22 nt, Human
agagcagagggcucugggacaa

SEQ ID NO: 1025202 - RNA, 22 nt, Human
augcuguggaaguuccugaagc

SEQ ID NO: 1025203 - RNA, 22 nt, Human
gcagcagcccagggcucucaga

SEQ ID NO: 1025204 - RNA, 22 nt, Human
cauugcccaguaggaucaccag

SEQ ID NO: 1025205 - RNA, 22 nt, Human
gccaggcauucuagaaguagug

SEQ ID NO: 1025206 - RNA, 22 nt, Human
uccucacauggugagccacaca

SEQ ID NO: 1025207 - RNA, 22 nt, Human
auuuacagaugaugcuauuuga

SEQ ID NO: 1025208 - RNA, 22 nt, Human
ccagagccagagaggugccugc

SEQ ID NO: 1025209 - RNA, 22 nt, Human
cucucuucccgugaguguugca

SEQ ID NO: 1025210 - RNA, 22 nt, Human
uuguaugaauguauccuaauuu

SEQ ID NO: 1025211 - RNA, 22 nt, Human
auccaguuuaugucauauucuu

SEQ ID NO: 1025212 - RNA, 22 nt, Human
uucuucucggcugucagauagu

SEQ ID NO: 1025213 - RNA, 22 nt, Human
uagcacauaacuuagaauaguu

SEQ ID NO: 1025214 - RNA, 22 nt, Human
cccccaggcucugacacaggag

SEQ ID NO: 1025215 - RNA, 21 nt, Human
gcagccacugccuucaacaau

SEQ ID NO: 1025216 - RNA, 21 nt, Human
ucuuguccuugcucucccacu

SEQ ID NO: 1025217 - RNA, 22 nt, Human
cugcucuggucucuucauguuu

SEQ ID NO: 1025218 - RNA, 22 nt, Human
uaauacuuaccuugcagagucu

SEQ ID NO: 1025219 - RNA, 22 nt, Human
uagcuuuacaaagugcugcacc

SEQ ID NO: 1025220 - RNA, 20 nt, Human
cugaacacagaauaagcaca

SEQ ID NO: 1025221 - RNA, 22 nt, Human
agagucugaggcagcugcagcc

SEQ ID NO: 1025222 - RNA, 22 nt, Human
uuccuguccgcaauggccuggg

SEQ ID NO: 1025223 - RNA, 22 nt, Human
auugacaaauggauguugacau

SEQ ID NO: 1025224 - RNA, 21 nt, Human
ugcuccuuagcugccccugcc

SEQ ID NO: 1025225 - RNA, 22 nt, Human
ccuguucaauauucuuccuugu

SEQ ID NO: 1025226 - RNA, 22 nt, Human
agcaauaugacauugcuacauc

SEQ ID NO: 1025227 - RNA, 22 nt, Human
ugggcagauguggcucuccuug

SEQ ID NO: 1025228 - RNA, 22 nt, Human
ggcuuuauuucacuguaccaua

SEQ ID NO: 1025229 - RNA, 22 nt, Human
aggcugggaaaccugaaguugu

SEQ ID NO: 1025230 - RNA, 22 nt, Human
uuuauuagauuaucaaagaggu

SEQ ID NO: 1025231 - RNA, 22 nt, Human
uacaguuuguuacauuguuagu

SEQ ID NO: 1025232 - RNA, 22 nt, Human
cugccuggucucaggcaugggg

SEQ ID NO: 1025233 - RNA, 19 nt, Human
gaagaagcuugagaaguag

SEQ ID NO: 1025234 - RNA, 22 nt, Human
caguggugaagagcaggggcuc

SEQ ID NO: 1025235 - RNA, 21 nt, Human
ugaggcuguuguaccagggag

SEQ ID NO: 1025236 - RNA, 22 nt, Human
ggcacugacugugcagcgcacc

SEQ ID NO: 1025237 - RNA, 22 nt, Human
gcugccaugccacagcacucac

SEQ ID NO: 1025238 - RNA, 22 nt, Human
ucucccacagucucccauggcu

SEQ ID NO: 1025239 - RNA, 22 nt, Human
agccuccacagaugcaaagggc

SEQ ID NO: 1025240 - RNA, 22 nt, Human
cucaaggacuuauucaugccug

SEQ ID NO: 1025241 - RNA, 22 nt, Human
ggagagaauuccauggacaugu

SEQ ID NO: 1025242 - RNA, 19 nt, Human
uucuccagccugaccugag

SEQ ID NO: 1025243 - RNA, 22 nt, Human
gagcacagaaucuucccaugca

SEQ ID NO: 1025244 - RNA, 22 nt, Human
agcaucuggucaugagugagaa

SEQ ID NO: 1025245 - RNA, 22 nt, Human
ggccagagagccgcuguuagga

SEQ ID NO: 1025246 - RNA, 22 nt, Human
ucuggccagugaaaugcagaau

SEQ ID NO: 1025247 - RNA, 22 nt, Human
guggccucaugucuauaaagag

SEQ ID NO: 1025248 - RNA, 22 nt, Human
uggcucagccuggcccuuucau

SEQ ID NO: 1025249 - RNA, 22 nt, Human
ucucaggguuuguacaagugua

SEQ ID NO: 1025250 - RNA, 22 nt, Human
gcuguccaugucuggccucagu

SEQ ID NO: 1025251 - RNA, 22 nt, Human
uagggcagagcuuguacacgau

SEQ ID NO: 1025252 - RNA, 22 nt, Human
ucuaggagaaccaucagggagg

SEQ ID NO: 1025253 - RNA, 22 nt, Human
agaaguuguagguuugcauauu

SEQ ID NO: 1025254 - RNA, 22 nt, Human
ccugagggaaggaugcuaccca

SEQ ID NO: 1025255 - RNA, 22 nt, Human
agggggugcuacuuccagaguu

SEQ ID NO: 1025256 - RNA, 22 nt, Human
uuuugucuaagaacuuugcaaa

SEQ ID NO: 1025257 - RNA, 23 nt, Human
cuuuuaacuugaucugagaccag

SEQ ID NO: 1025258 - RNA, 22 nt, Human
ucagcuuuuuggauugcccaag

SEQ ID NO: 1025259 - RNA, 22 nt, Human
gccucugcccuccugggacugc

SEQ ID NO: 1025260 - RNA, 22 nt, Human
uuuuucaugagacuagaaguca

SEQ ID NO: 1025261 - RNA, 22 nt, Human
acuugggaugguggccagagcg

SEQ ID NO: 1025262 - RNA, 22 nt, Human
cugagcugggacucaguagcaa

SEQ ID NO: 1025263 - RNA, 21 nt, Human
ccugggagaucagcugccuuc

SEQ ID NO: 1025264 - RNA, 22 nt, Human
cuggcucuaucuccaaggcugg

SEQ ID NO: 1025265 - RNA, 22 nt, Human
agggcugcaucugccuggugaa

SEQ ID NO: 1025266 - RNA, 22 nt, Human
uuauucuuuucuccagaauccc

SEQ ID NO: 1025267 - RNA, 22 nt, Human
uagcuuuaagacauggugaaug

SEQ ID NO: 1025268 - RNA, 22 nt, Human
aacucagucauaaagcgaaugc

SEQ ID NO: 1025269 - RNA, 22 nt, Human
auggcucauuuaucuugcagcc

SEQ ID NO: 1025270 - RNA, 22 nt, Human
augcuuuuccuaaaaugaugcc

SEQ ID NO: 1025271 - RNA, 22 nt, Human
cagaguguaucuguguaagcau

SEQ ID NO: 1025272 - RNA, 22 nt, Human
ggccugcucaguccucuuucuu

SEQ ID NO: 1025273 - RNA, 22 nt, Human
cuggggcuggugaggcaggcuc

SEQ ID NO: 1025274 - RNA, 22 nt, Human
uuuaaauggcauuuucccagau

SEQ ID NO: 1025275 - RNA, 22 nt, Human
auucacagggacaaugggagag

SEQ ID NO: 1025276 - RNA, 22 nt, Human
uuguaugagcuccaggaacuca

SEQ ID NO: 1025277 - RNA, 22 nt, Human
cuggcuguauuaguuugauccu

SEQ ID NO: 1025278 - RNA, 22 nt, Human
caccagggcucugagcucugaa

SEQ ID NO: 1025279 - RNA, 22 nt, Human
ggauccuuaacuaucacaguga

SEQ ID NO: 1025280 - RNA, 22 nt, Human
ucgggguagacgccagcucgga

SEQ ID NO: 1025281 - RNA, 22 nt, Human
gcuggccauucucuuugagaug

SEQ ID NO: 1025282 - RNA, 22 nt, Human
aaauuuucagagcacuagagaa

SEQ ID NO: 1025283 - RNA, 22 nt, Human
cugagcugcggcaggcaccugg

SEQ ID NO: 1025284 - RNA, 22 nt, Human
acagagguguuccagaccuagg

SEQ ID NO: 1025285 - RNA, 22 nt, Human
acccuggggguggccagugcca

SEQ ID NO: 1025286 - RNA, 16 nt, Human
ccacagggcaaggggc

SEQ ID NO: 1025287 - RNA, 22 nt, Human
caaaugcauaguuuauaagaag

SEQ ID NO: 1025288 - RNA, 22 nt, Human
cauuuguacagaacagcuuuau

SEQ ID NO: 1025289 - RNA, 22 nt, Human
uggaggaaaauuacuggggucu

SEQ ID NO: 1025290 - RNA, 20 nt, Human
aaaggaauauaugaaguaua

SEQ ID NO: 1025291 - RNA, 22 nt, Human
acagugucaugucguguucccc

SEQ ID NO: 1025292 - RNA, 22 nt, Human
cuuguucaguccugacuuccug

SEQ ID NO: 1025293 - RNA, 22 nt, Human
cuccacagcucaggcucagagu

SEQ ID NO: 1025294 - RNA, 22 nt, Human
agagacaggguuuugucguguu

SEQ ID NO: 1025295 - RNA, 17 nt, Human
cccagcuggcagugccg

SEQ ID NO: 1025296 - RNA, 22 nt, Human
cagagccagcccacuguucccg

SEQ ID NO: 1025297 - RNA, 22 nt, Human
uacagggguaacaguggggaau

SEQ ID NO: 1025298 - RNA, 22 nt, Human
cuucuucaaccugaaaguuuca

SEQ ID NO: 1025299 - RNA, 22 nt, Human
cauuuauuggcauguaguaggu

SEQ ID NO: 1025300 - RNA, 22 nt, Human
acucugugugaguagagccugu

SEQ ID NO: 1025301 - RNA, 22 nt, Human
uggcugcugagaaggcagcugu

SEQ ID NO: 1025302 - RNA, 22 nt, Human
gcaggcagaucaccugucagga

SEQ ID NO: 1025303 - RNA, 22 nt, Human
gcucugcuggaaguucucugga

SEQ ID NO: 1025304 - RNA, 22 nt, Human
ccucucccacguggcagaggcu

SEQ ID NO: 1025305 - RNA, 22 nt, Human
acauuucugagcagggagcugu

SEQ ID NO: 1025306 - RNA, 22 nt, Human
ggcugccugugcccaggcacac

SEQ ID NO: 1025307 - RNA, 22 nt, Human
cauggccucaaaggacugcaga

SEQ ID NO: 1025308 - RNA, 22 nt, Human
cuucagaagccugcagccuuug

SEQ ID NO: 1025309 - RNA, 22 nt, Human
gcucacugcaaccucugcuucc

SEQ ID NO: 1025310 - RNA, 22 nt, Human
ccacaggggucucuguagcuga

SEQ ID NO: 1025311 - RNA, 22 nt, Human
uaaaugcagcaguuucuguucu

SEQ ID NO: 1025312 - RNA, 22 nt, Human
ugggagcccaagggagcugccg

SEQ ID NO: 1025313 - RNA, 22 nt, Human
aaaaagauguccugaaguuuag

SEQ ID NO: 1025314 - RNA, 21 nt, Human
uuugcauuuuacaugugggga

SEQ ID NO: 1025315 - RNA, 22 nt, Human
cuggggugucucgucugccauu

SEQ ID NO: 1025316 - RNA, 22 nt, Human
agggucaggagacacuggcaac

SEQ ID NO: 1025317 - RNA, 21 nt, Human
cugagggccgcagcugggcuc

SEQ ID NO: 1025318 - RNA, 22 nt, Human
uggcucagcuuuccccaucugg

SEQ ID NO: 1025319 - RNA, 22 nt, Human
uaauuuaauuucaugccagccu

SEQ ID NO: 1025320 - RNA, 22 nt, Human
agcagccagaaauccagaggug

SEQ ID NO: 1025321 - RNA, 20 nt, Human
cuuugccuauucucugccug

SEQ ID NO: 1025322 - RNA, 22 nt, Human
acucugaaugugcauguaaauc

SEQ ID NO: 1025323 - RNA, 22 nt, Human
uuuuccagagcugucucuugca

SEQ ID NO: 1025324 - RNA, 22 nt, Human
aagggaaaucauauggugcagu

SEQ ID NO: 1025325 - RNA, 22 nt, Human
uagaaaucagcaggcauaugua

SEQ ID NO: 1025326 - RNA, 19 nt, Human
cugcucaggucagucuguc

SEQ ID NO: 1025327 - RNA, 22 nt, Human
ggcuggcuugccaagcucaggg

SEQ ID NO: 1025328 - RNA, 22 nt, Human
cauaauuucuguaucagcacca

SEQ ID NO: 1025329 - RNA, 20 nt, Human
caggccucugggggcccugg

SEQ ID NO: 1025330 - RNA, 22 nt, Human
auaauauaauccuacuucccau

SEQ ID NO: 1025331 - RNA, 21 nt, Human
cagcuccacuaaagcagcugu

SEQ ID NO: 1025332 - RNA, 22 nt, Human
gggugacauuucccaaugagcc

SEQ ID NO: 1025333 - RNA, 22 nt, Human
cucuguagaaacagggcagaag

SEQ ID NO: 1025334 - RNA, 22 nt, Human
gggaccugggccagaggacagu

SEQ ID NO: 1025335 - RNA, 22 nt, Human
cucaggaggaggaaguucauug

SEQ ID NO: 1025336 - RNA, 22 nt, Human
ucugagcauugaauuuucuucc

SEQ ID NO: 1025337 - RNA, 22 nt, Human
acagaguauuggaaaggcagug

SEQ ID NO: 1025338 - RNA, 22 nt, Human
uggcagggaauacagauguuua

SEQ ID NO: 1025339 - RNA, 22 nt, Human
ggaccugccagaacucaggcua

SEQ ID NO: 1025340 - RNA, 22 nt, Human
gcuuucuugguucugcaggggc

SEQ ID NO: 1025341 - RNA, 22 nt, Human
agccacagcuccuugguggaga

SEQ ID NO: 1025342 - RNA, 22 nt, Human
cuguggcugcagccuugguccu

SEQ ID NO: 1025343 - RNA, 22 nt, Human
ggggcuggcucacuaagagacu

SEQ ID NO: 1025344 - RNA, 20 nt, Human
auaauuuacccugcaccacu

SEQ ID NO: 1025345 - RNA, 22 nt, Human
uccaguggguugcugagggagg

SEQ ID NO: 1025346 - RNA, 22 nt, Human
ccuguucauuuuuugacucugc

SEQ ID NO: 1025347 - RNA, 22 nt, Human
cuggugucugcucccucacagc

SEQ ID NO: 1025348 - RNA, 22 nt, Human
agggcaaguugagugugcgugg

SEQ ID NO: 1025349 - RNA, 22 nt, Human
ugcugagguuucgucugcuugc

SEQ ID NO: 1025350 - RNA, 22 nt, Human
cauucauuagaauagauaugua

SEQ ID NO: 1025351 - RNA, 22 nt, Human
gcagcuccuucaaucucaccau

SEQ ID NO: 1025352 - RNA, 22 nt, Human
cugaaauuccauuucagccaca

SEQ ID NO: 1025353 - RNA, 22 nt, Human
uuagugucuucuucauccucug

SEQ ID NO: 1025354 - RNA, 22 nt, Human
ucauuuaauaauuuuugaguag

SEQ ID NO: 1025355 - RNA, 22 nt, Human
ucuuagaaguuuauggcacgga

SEQ ID NO: 1025356 - RNA, 22 nt, Human
uaggaaaagucuagauugauga

SEQ ID NO: 1025357 - RNA, 22 nt, Human
caaggccauauugccuguaugu

SEQ ID NO: 1025358 - RNA, 17 nt, Human
agagagagcaugccacc

SEQ ID NO: 1025359 - RNA, 22 nt, Human
auuugcauaauagugauuugua

SEQ ID NO: 1025360 - RNA, 22 nt, Human
acugucacuccaacugagucgu

SEQ ID NO: 1025361 - RNA, 22 nt, Human
cugcagaguggagccucggcug

SEQ ID NO: 1025362 - RNA, 22 nt, Human
cauuuuaaaugauuuaagccaa

SEQ ID NO: 1025363 - RNA, 20 nt, Human
guccugggagccacagcaca

SEQ ID NO: 1025364 - RNA, 22 nt, Human
cagugguugguagauacuugag

SEQ ID NO: 1025365 - RNA, 22 nt, Human
aaaguuuuagaacuaggaagca

SEQ ID NO: 1025366 - RNA, 22 nt, Human
uugcauaaagauuuuauugcau

SEQ ID NO: 1025367 - RNA, 22 nt, Human
ggaggcugagaaguccaagauc

SEQ ID NO: 1025368 - RNA, 23 nt, Human
ugcucugugaauaguuggugacu

SEQ ID NO: 1025369 - RNA, 22 nt, Human
augcauugucugguuucauuuu

SEQ ID NO: 1025370 - RNA, 22 nt, Human
cuguaugaacccauauacuuau

SEQ ID NO: 1025371 - RNA, 23 nt, Human
aaauucaguccuucaacucugag

SEQ ID NO: 1025372 - RNA, 22 nt, Human
uaguuauuauuguuacuaucag

SEQ ID NO: 1025373 - RNA, 22 nt, Human
uaacaguguggacuugagaucu

SEQ ID NO: 1025374 - RNA, 22 nt, Human
guccaugacugugacucacaug

SEQ ID NO: 1025375 - RNA, 22 nt, Human
ugcauauuuuauaaagauggaa

SEQ ID NO: 1025376 - RNA, 22 nt, Human
uugcacuaggaaaaggcagcca

SEQ ID NO: 1025377 - RNA, 22 nt, Human
uucuucuuucccccugugguac

SEQ ID NO: 1025378 - RNA, 22 nt, Human
cugggagcgcagcaggcacaac

SEQ ID NO: 1025379 - RNA, 22 nt, Human
gccuggccgcuccgagcuccgc

SEQ ID NO: 1025380 - RNA, 18 nt, Human
cagcugccagcucaugga

SEQ ID NO: 1025381 - RNA, 22 nt, Human
agaauucuccuucagggcagga

SEQ ID NO: 1025382 - RNA, 22 nt, Human
gcuucccacagcuggacugggg

SEQ ID NO: 1025383 - RNA, 22 nt, Human
ccaggugggaggaaagcagaga

SEQ ID NO: 1025384 - RNA, 22 nt, Human
ucaaguguaguggugucagguc

SEQ ID NO: 1025385 - RNA, 22 nt, Human
gugcauauaugcacauaugugu

SEQ ID NO: 1025386 - RNA, 22 nt, Human
aggauccuuuggccacuucuua

SEQ ID NO: 1025387 - RNA, 17 nt, Human
agccugcugaucucaca

SEQ ID NO: 1025388 - RNA, 23 nt, Human
auaauaacgucugucuugucucu

SEQ ID NO: 1025389 - RNA, 18 nt, Human
caaagcucacguuccauc

SEQ ID NO: 1025390 - RNA, 22 nt, Human
caguguggugugcacagcuuag

SEQ ID NO: 1025391 - RNA, 22 nt, Human
ugcccugugugugcaagcacug

SEQ ID NO: 1025392 - RNA, 22 nt, Human
ucacugcucuccaauguggagu

SEQ ID NO: 1025393 - RNA, 19 nt, Human
cuuuucaucaacagccaau

SEQ ID NO: 1025394 - RNA, 22 nt, Human
uuguaacagcuguuuauauagu

SEQ ID NO: 1025395 - RNA, 22 nt, Human
caagagcauuuaguuagcuggu

SEQ ID NO: 1025396 - RNA, 22 nt, Human
ccucuguccuggggaguggagc

SEQ ID NO: 1025397 - RNA, 23 nt, Human
uggcuggcagaaacugaagcaug

SEQ ID NO: 1025398 - RNA, 22 nt, Human
ugggcccugacuucaagcaucc

SEQ ID NO: 1025399 - RNA, 22 nt, Human
agaaagcacucugucuuuuacc

SEQ ID NO: 1025400 - RNA, 22 nt, Human
ugcagaagaccuuccagggcug

SEQ ID NO: 1025401 - RNA, 22 nt, Human
ccugagaccaaguugcagccau

SEQ ID NO: 1025402 - RNA, 22 nt, Human
cacauguuuggcaugucaccaa

SEQ ID NO: 1025403 - RNA, 22 nt, Human
cccaggaggucgaagcugcagu

SEQ ID NO: 1025404 - RNA, 22 nt, Human
cccagaaggucgaggcugcagu

SEQ ID NO: 1025405 - RNA, 22 nt, Human
uaaggcacacaguugcugcaug

SEQ ID NO: 1025406 - RNA, 22 nt, Human
ugacagaaugugacucucagau

SEQ ID NO: 1025407 - RNA, 22 nt, Human
agccaagcaccacuggcacucg

SEQ ID NO: 1025408 - RNA, 22 nt, Human
acaccagggccuagccagggcg

SEQ ID NO: 1025409 - RNA, 22 nt, Human
ucuuuccauggccacacagucu

SEQ ID NO: 1025410 - RNA, 22 nt, Human
uuuguaaaggccugaauuucag

SEQ ID NO: 1025411 - RNA, 22 nt, Human
uccagucaagcuugagaauuuc

SEQ ID NO: 1025412 - RNA, 22 nt, Human
guguggcugugggagauguuca

SEQ ID NO: 1025413 - RNA, 22 nt, Human
aguuuuucugggaggcacugcu

SEQ ID NO: 1025414 - RNA, 22 nt, Human
ccugccuguaagauggguacaa

SEQ ID NO: 1025415 - RNA, 22 nt, Human
cauggcagagccugcagguggg

SEQ ID NO: 1025416 - RNA, 20 nt, Human
cagucccaauccagggccag

SEQ ID NO: 1025417 - RNA, 20 nt, Human
ccaggcacugucccaugcag

SEQ ID NO: 1025418 - RNA, 17 nt, Human
guuugcaugguguuaac

SEQ ID NO: 1025419 - RNA, 22 nt, Human
ccugucugaaggcagggggaug

SEQ ID NO: 1025420 - RNA, 22 nt, Human
ggcugcuggaagacugaacaag

SEQ ID NO: 1025421 - RNA, 22 nt, Human
uucccaguuagucauuuuuaca

SEQ ID NO: 1025422 - RNA, 22 nt, Human
uucagcagugcagacacccagu

SEQ ID NO: 1025423 - RNA, 22 nt, Human
gguaacaguauguagaguaaga

SEQ ID NO: 1025424 - RNA, 20 nt, Human
guguuucaugugauacaaug

SEQ ID NO: 1025425 - RNA, 22 nt, Human
ugucccagcacuuugggagucu

SEQ ID NO: 1025426 - RNA, 22 nt, Human
gccuggagaauuaaaaggaagg

SEQ ID NO: 1025427 - RNA, 22 nt, Human
cugccuggaccggcagcccucc

SEQ ID NO: 1025428 - RNA, 23 nt, Human
agcuuugugaaagcagacauggg

SEQ ID NO: 1025429 - RNA, 22 nt, Human
agucccuguacuuuccacugcc

SEQ ID NO: 1025430 - RNA, 22 nt, Human
agcucuggaauaaugaugugau

SEQ ID NO: 1025431 - RNA, 22 nt, Human
uccucacaagcaagcacaggua

SEQ ID NO: 1025432 - RNA, 22 nt, Human
ccucacugcuauguguuugcuc

SEQ ID NO: 1025433 - RNA, 22 nt, Human
uucagagagaaaccagugggaa

SEQ ID NO: 1025434 - RNA, 22 nt, Human
cagagccagcuguccuuggcau

SEQ ID NO: 1025435 - RNA, 22 nt, Human
uccugggcugcagggaagagca

SEQ ID NO: 1025436 - RNA, 22 nt, Human
agcagaaccacagcacuguuga

SEQ ID NO: 1025437 - RNA, 22 nt, Human
gcucucuugguggcuguccugg

SEQ ID NO: 1025438 - RNA, 22 nt, Human
cugggaggcacuauucaggagg

SEQ ID NO: 1025439 - RNA, 22 nt, Human
gagagcugcagccgagaggggg

SEQ ID NO: 1025440 - RNA, 22 nt, Human
uaagauguuuugguuugauaag

SEQ ID NO: 1025441 - RNA, 22 nt, Human
ggcaggagaaaggucucuucuu

SEQ ID NO: 1025442 - RNA, 19 nt, Human
ugugaaagcuaguguucuu

SEQ ID NO: 1025443 - RNA, 22 nt, Human
ugcugugagguugagaaggaag

SEQ ID NO: 1025444 - RNA, 22 nt, Human
aggcccugggcaguucuguagc

SEQ ID NO: 1025445 - RNA, 22 nt, Human
uggggacaggagacuuacagcu

SEQ ID NO: 1025446 - RNA, 22 nt, Human
acagaacuuccugcuggagugg

SEQ ID NO: 1025447 - RNA, 23 nt, Human
uagagcagggaaaucugucagag

SEQ ID NO: 1025448 - RNA, 22 nt, Human
gcaagauguuaacauagggaga

SEQ ID NO: 1025449 - RNA, 22 nt, Human
accuugaugccuuuccaagaug

SEQ ID NO: 1025450 - RNA, 22 nt, Human
accagagcagacuacuggaggu

SEQ ID NO: 1025451 - RNA, 22 nt, Human
cugggcugcaguuccugguccu

SEQ ID NO: 1025452 - RNA, 22 nt, Human
cuucuucaauagcaagcgcaua

SEQ ID NO: 1025453 - RNA, 22 nt, Human
gucuggagccacccuaagcauu

SEQ ID NO: 1025454 - RNA, 22 nt, Human
uggugagcgaugcugcauguuc

SEQ ID NO: 1025455 - RNA, 22 nt, Human
cagcccugcacgcugccuccgc

SEQ ID NO: 1025456 - RNA, 17 nt, Human
ccucacagggaccagac

SEQ ID NO: 1025457 - RNA, 22 nt, Human
aaaaucuaaguagcgaguaagg

SEQ ID NO: 1025458 - RNA, 22 nt, Human
gcagcuggcucagagagguggg

SEQ ID NO: 1025459 - RNA, 22 nt, Human
uguaugaaugggaaaaggaaac

SEQ ID NO: 1025460 - RNA, 23 nt, Human
aagcugccagucugaagccuggg

SEQ ID NO: 1025461 - RNA, 22 nt, Human
ugcuuugggucucucuaguuuc

SEQ ID NO: 1025462 - RNA, 22 nt, Human
caguguggcugagacagaggcu

SEQ ID NO: 1025463 - RNA, 22 nt, Human
gugucaugggagucagaaguga

SEQ ID NO: 1025464 - RNA, 17 nt, Human
cagugaggccuuuccuc

SEQ ID NO: 1025465 - RNA, 20 nt, Human
uugauaggcagcuugucagg

SEQ ID NO: 1025466 - RNA, 22 nt, Human
agaaggccuaacuugggggcaa

SEQ ID NO: 1025467 - RNA, 22 nt, Human
aggucauuaaaguuaaaugagg

SEQ ID NO: 1025468 - RNA, 21 nt, Human
ccauaccuaccucaccugguu

SEQ ID NO: 1025469 - RNA, 22 nt, Human
agagggcuuugauucucaguuc

SEQ ID NO: 1025470 - RNA, 22 nt, Human
uucagagcaucucuaaagccag

SEQ ID NO: 1025471 - RNA, 22 nt, Human
cucucugaggcaggccuguggg

SEQ ID NO: 1025472 - RNA, 22 nt, Human
guggauggauugaggcaguggg

SEQ ID NO: 1025473 - RNA, 22 nt, Human
ucaaaugcuucuacuccuaaga

SEQ ID NO: 1025474 - RNA, 22 nt, Human
gagccaggggucagcuccgagg

SEQ ID NO: 1025475 - RNA, 22 nt, Human
aagagcuggauugugcugcaga

SEQ ID NO: 1025476 - RNA, 19 nt, Human
ggccaggcugacugugguc

SEQ ID NO: 1025477 - RNA, 19 nt, Human
cucuggagcagacacugga

SEQ ID NO: 1025478 - RNA, 19 nt, Human
gcugucugaugcugagguc

SEQ ID NO: 1025479 - RNA, 22 nt, Human
uuagccauggacugaauugacu

SEQ ID NO: 1025480 - RNA, 22 nt, Human
aggugccagcucucaggcagga

SEQ ID NO: 1025481 - RNA, 22 nt, Human
acuguguccucauguggcagaa

SEQ ID NO: 1025482 - RNA, 22 nt, Human
aaaugcauaucaaagacuugaa

SEQ ID NO: 1025483 - RNA, 22 nt, Human
uggccugacugucaggcuguau

SEQ ID NO: 1025484 - RNA, 22 nt, Human
gaggcagcgggucaggaccgug

SEQ ID NO: 1025485 - RNA, 22 nt, Human
cucauuaaaggaaaucaccugc

SEQ ID NO: 1025486 - RNA, 22 nt, Human
cagcccucagguccucagcagc

SEQ ID NO: 1025487 - RNA, 22 nt, Human
gagccaccuucaacucaggaau

SEQ ID NO: 1025488 - RNA, 22 nt, Human
aacuuucuuggaugucucaaca

SEQ ID NO: 1025489 - RNA, 22 nt, Human
cuucuucaguugcauguauugg

SEQ ID NO: 1025490 - RNA, 22 nt, Human
ucacaugcuugaggaaagaaaa

SEQ ID NO: 1025491 - RNA, 22 nt, Human
uuccucugaaauggcuuggaaa

SEQ ID NO: 1025492 - RNA, 22 nt, Human
uuccaggaagcaguuagcagcc

SEQ ID NO: 1025493 - RNA, 22 nt, Human
cagauuuagaguggggcuugga

SEQ ID NO: 1025494 - RNA, 22 nt, Human
ugcucccaaacgaccuacugug

SEQ ID NO: 1025495 - RNA, 22 nt, Human
uucauuccuucuguaccuugcc

SEQ ID NO: 1025496 - RNA, 22 nt, Human
acaggcaggcgggacagcccga

SEQ ID NO: 1025497 - RNA, 22 nt, Human
ucuauuuuauacucaaaucuuc

SEQ ID NO: 1025498 - RNA, 22 nt, Human
agaggccaguggcugugcuguc

SEQ ID NO: 1025499 - RNA, 22 nt, Human
gugcaugucggggugcauguca

SEQ ID NO: 1025500 - RNA, 19 nt, Human
aagaagcaauaagcuguga

SEQ ID NO: 1025501 - RNA, 22 nt, Human
gccucugcaacuccgccuuggu

SEQ ID NO: 1025502 - RNA, 22 nt, Human
ggcagucagugugguucauaaa

SEQ ID NO: 1025503 - RNA, 22 nt, Human
ugauuuccuaggucuggagaag

SEQ ID NO: 1025504 - RNA, 22 nt, Human
uuuaagaaguuauguuauaaau

SEQ ID NO: 1025505 - RNA, 22 nt, Human
gcucuguccagcgugcacagaa

SEQ ID NO: 1025506 - RNA, 22 nt, Human
auccacagucuuagccaucaaa

SEQ ID NO: 1025507 - RNA, 22 nt, Human
auugcagcuggucaggguaauu

SEQ ID NO: 1025508 - RNA, 22 nt, Human
accagagaaaacacagcaggcu

SEQ ID NO: 1025509 - RNA, 22 nt, Human
agcaggguauguuagagcugua

SEQ ID NO: 1025510 - RNA, 22 nt, Human
uuuagggaugucagaacaggga

SEQ ID NO: 1025511 - RNA, 22 nt, Human
ucagcuuugcaaguuagaaaau

SEQ ID NO: 1025512 - RNA, 22 nt, Human
aaguucaaggcucuagaguucc

SEQ ID NO: 1025513 - RNA, 18 nt, Human
caggagcaggaguugaac

SEQ ID NO: 1025514 - RNA, 22 nt, Human
caucugcuguuccuuggacuca

SEQ ID NO: 1025515 - RNA, 22 nt, Human
auaucaaacgaaguuauuuuaa

SEQ ID NO: 1025516 - RNA, 22 nt, Human
aggccuguuccaggccccuuuu

SEQ ID NO: 1025517 - RNA, 22 nt, Human
gcuucucucucagacugcaagc

SEQ ID NO: 1025518 - RNA, 22 nt, Human
guaacagaaagucaugcucauu

SEQ ID NO: 1025519 - RNA, 22 nt, Human
uaauuuuaacugugcuguuugg

SEQ ID NO: 1025520 - RNA, 20 nt, Human
gcaaggcacagugaggaggg

SEQ ID NO: 1025521 - RNA, 22 nt, Human
ugcucugguaacucacuuccau

SEQ ID NO: 1025522 - RNA, 22 nt, Human
uucucagguagugcugaugcug

SEQ ID NO: 1025523 - RNA, 20 nt, Human
uugcauuggaugugcaggug

SEQ ID NO: 1025524 - RNA, 22 nt, Human
gcuggccauagaagccaaagag

SEQ ID NO: 1025525 - RNA, 22 nt, Human
agggcuccuaugaugcucugcc

SEQ ID NO: 1025526 - RNA, 22 nt, Human
ggccugcucuggcuguggucag

SEQ ID NO: 1025527 - RNA, 22 nt, Human
cuggccaguuguccuggcuugg

SEQ ID NO: 1025528 - RNA, 20 nt, Human
uccugcaguuccuaggaggg

SEQ ID NO: 1025529 - RNA, 22 nt, Human
uuauuauagauuaugcaagauu

SEQ ID NO: 1025530 - RNA, 22 nt, Human
uuugcaguuucauugcugaaau

SEQ ID NO: 1025531 - RNA, 22 nt, Human
gcaggggcaggagaucucaggc

SEQ ID NO: 1025532 - RNA, 21 nt, Human
augugaaaccuuccacgcuga

SEQ ID NO: 1025533 - RNA, 22 nt, Human
gagccugaauuugaccugcuua

SEQ ID NO: 1025534 - RNA, 22 nt, Human
ucucagagaacaguuggugcuu

SEQ ID NO: 1025535 - RNA, 22 nt, Human
cuggugguucaggagaauggcu

SEQ ID NO: 1025536 - RNA, 23 nt, Human
uaauucacauauacauugcuuca

SEQ ID NO: 1025537 - RNA, 17 nt, Human
caggcuccuuccagauu

SEQ ID NO: 1025538 - RNA, 22 nt, Human
guggccuggaaaggcuggucug

SEQ ID NO: 1025539 - RNA, 19 nt, Human
uccaggaggcugccauuga

SEQ ID NO: 1025540 - RNA, 22 nt, Human
ggugcagugguguggcaaaggg

SEQ ID NO: 1025541 - RNA, 22 nt, Human
caagaauuguacaaacugggug

SEQ ID NO: 1025542 - RNA, 18 nt, Human
acaggccucaguccugca

SEQ ID NO: 1025543 - RNA, 21 nt, Human
gaacauuuggguuguuucuac

SEQ ID NO: 1025544 - RNA, 22 nt, Human
gagccugccucuagucucuaga

SEQ ID NO: 1025545 - RNA, 22 nt, Human
aagauucuacaguagguacauu

SEQ ID NO: 1025546 - RNA, 22 nt, Human
gaagagcugcucagaacaugau

SEQ ID NO: 1025547 - RNA, 22 nt, Human
gaaagagaaccugggccuagau

SEQ ID NO: 1025548 - RNA, 20 nt, Human
cuggcaggagcgagucuacc

SEQ ID NO: 1025549 - RNA, 22 nt, Human
gucugucauacggcuuauguaa

SEQ ID NO: 1025550 - RNA, 22 nt, Human
ggcgaggccgggacaggcugga

SEQ ID NO: 1025551 - RNA, 22 nt, Human
uugcucaggcuggugugcagug

SEQ ID NO: 1025552 - RNA, 22 nt, Human
agagccaggaugucuucugggg

SEQ ID NO: 1025553 - RNA, 17 nt, Human
aggcauggucuggggug

SEQ ID NO: 1025554 - RNA, 22 nt, Human
gcauugucaaaagugguaugac

SEQ ID NO: 1025555 - RNA, 22 nt, Human
agaaaugugagccccuuaucaa

SEQ ID NO: 1025556 - RNA, 22 nt, Human
acagggcaccugagguaggaag

SEQ ID NO: 1025557 - RNA, 22 nt, Human
uucaggauaguggugaguggca

SEQ ID NO: 1025558 - RNA, 22 nt, Human
caggggccaggcugucugcugu

SEQ ID NO: 1025559 - RNA, 22 nt, Human
gggaguggagagcaauggauga

SEQ ID NO: 1025560 - RNA, 22 nt, Human
augcugugucaccuuaggauuu

SEQ ID NO: 1025561 - RNA, 22 nt, Human
guuauguaugggggccuuauga

SEQ ID NO: 1025562 - RNA, 22 nt, Human
cugcugcauuacucuucucaag

SEQ ID NO: 1025563 - RNA, 22 nt, Human
aaguucaagucugcaucuuuuu

SEQ ID NO: 1025564 - RNA, 22 nt, Human
agggcccuccccgcucagggca

SEQ ID NO: 1025565 - RNA, 18 nt, Human
uggagcaggaagccuggc

SEQ ID NO: 1025566 - RNA, 22 nt, Human
cugugugcugaaaugcagugag

SEQ ID NO: 1025567 - RNA, 22 nt, Human
uggccugccugggagcagcagg

SEQ ID NO: 1025568 - RNA, 22 nt, Human
gcagagccccauugcuggcggg

SEQ ID NO: 1025569 - RNA, 23 nt, Human
acagugugguggacaaggagcag

SEQ ID NO: 1025570 - RNA, 22 nt, Human
ccagggcagccaacccagaugc

SEQ ID NO: 1025571 - RNA, 22 nt, Human
ggcucaagcagucugccugccu

SEQ ID NO: 1025572 - RNA, 22 nt, Human
acuucaugcagaagagagcugu

SEQ ID NO: 1025573 - RNA, 19 nt, Human
gcagcugugggaagagcca

SEQ ID NO: 1025574 - RNA, 22 nt, Human
auauaguuggguuucauucuac

SEQ ID NO: 1025575 - RNA, 22 nt, Human
uguguuuuacaaauucucuuaa

SEQ ID NO: 1025576 - RNA, 22 nt, Human
uuuucauuuuuguagaugcaag

SEQ ID NO: 1025577 - RNA, 22 nt, Human
gacaucauagggugggaggaaa

SEQ ID NO: 1025578 - RNA, 22 nt, Human
aauacaaucaaauucacuagca

SEQ ID NO: 1025579 - RNA, 19 nt, Human
ggaugagggucaggcauag

SEQ ID NO: 1025580 - RNA, 23 nt, Human
ucagagagcuguugagagcugcc

SEQ ID NO: 1025581 - RNA, 22 nt, Human
agagccugcuguguaagucaca

SEQ ID NO: 1025582 - RNA, 22 nt, Human
uggcagcuugaaugcagucuuu

SEQ ID NO: 1025583 - RNA, 22 nt, Human
gggcugggaauggcuaaguaug

SEQ ID NO: 1025584 - RNA, 22 nt, Human
aagagcuggaugaagaaaucaa

SEQ ID NO: 1025585 - RNA, 22 nt, Human
aggggugauuugggacaggaca

SEQ ID NO: 1025586 - RNA, 22 nt, Human
ccagggcuggguuugucggugu

SEQ ID NO: 1025587 - RNA, 22 nt, Human
uuguaugaucaaaagaaaugua

SEQ ID NO: 1025588 - RNA, 22 nt, Human
caaauccagaucccagucguag

SEQ ID NO: 1025589 - RNA, 22 nt, Human
cagcaggggaacugugggccag

SEQ ID NO: 1025590 - RNA, 22 nt, Human
caaggagaaaacggcuucugaa

SEQ ID NO: 1025591 - RNA, 22 nt, Human
aagggcagagggaaucccacau

SEQ ID NO: 1025592 - RNA, 22 nt, Human
gcuguucagaugcgauucagga

SEQ ID NO: 1025593 - RNA, 22 nt, Human
agugauuugggugucagaaagu

SEQ ID NO: 1025594 - RNA, 22 nt, Human
uggagcugacucacaccagcua

SEQ ID NO: 1025595 - RNA, 22 nt, Human
ccagaggcuggggaaggauaca

SEQ ID NO: 1025596 - RNA, 22 nt, Human
gugcaagguacauccuugaugu

SEQ ID NO: 1025597 - RNA, 23 nt, Human
uuucuucagaagccuugcgaggc

SEQ ID NO: 1025598 - RNA, 22 nt, Human
uaauaaaugaaagugcuggcau

SEQ ID NO: 1025599 - RNA, 22 nt, Human
uuaaauuauuucuagugaggug

SEQ ID NO: 1025600 - RNA, 22 nt, Human
ucugucaucucuaaaauagaaa

SEQ ID NO: 1025601 - RNA, 22 nt, Human
cuucucagaggccagaagcuau

SEQ ID NO: 1025602 - RNA, 22 nt, Human
ugucucaguauacgaaacacuu

SEQ ID NO: 1025603 - RNA, 22 nt, Human
ccagggcugagcugugaccaug

SEQ ID NO: 1025604 - RNA, 22 nt, Human
ugucucagggcagcagcagggg

SEQ ID NO: 1025605 - RNA, 22 nt, Human
aauucauccaugaacaauucca

SEQ ID NO: 1025606 - RNA, 22 nt, Human
cuuguucaguugccucuccugc

SEQ ID NO: 1025607 - RNA, 18 nt, Human
aucuuuccauagcauguu

SEQ ID NO: 1025608 - RNA, 22 nt, Human
cagaggcagaggucaucucugg

SEQ ID NO: 1025609 - RNA, 22 nt, Human
uccauuuuguagguaugcuaca

SEQ ID NO: 1025610 - RNA, 22 nt, Human
ugggccagcaauugcugcucag

SEQ ID NO: 1025611 - RNA, 22 nt, Human
gggcaagcucuucagaagcucu

SEQ ID NO: 1025612 - RNA, 22 nt, Human
acaguguguuggaggagacugu

SEQ ID NO: 1025613 - RNA, 22 nt, Human
ggcagaggaaggaugaauucac

SEQ ID NO: 1025614 - RNA, 22 nt, Human
aacaaccaaaaagaugaaugua

SEQ ID NO: 1025615 - RNA, 21 nt, Human
gauugaaaccauggcagugag

SEQ ID NO: 1025616 - RNA, 23 nt, Human
uccuccuuuugcuugugcuuccc

SEQ ID NO: 1025617 - RNA, 22 nt, Human
ccagugcaggugagcaccaggu

SEQ ID NO: 1025618 - RNA, 22 nt, Human
acauuucuccuugcaggaguca

SEQ ID NO: 1025619 - RNA, 23 nt, Human
ccagugauugccuggaaggaggu

SEQ ID NO: 1025620 - RNA, 22 nt, Human
gugcugugucuaucaggaauaa

SEQ ID NO: 1025621 - RNA, 22 nt, Human
ccucucuguguggccucuccau

SEQ ID NO: 1025622 - RNA, 22 nt, Human
uggccugccucccggcuucuuu

SEQ ID NO: 1025623 - RNA, 22 nt, Human
agccuuguuggucugaguuugg

SEQ ID NO: 1025624 - RNA, 22 nt, Human
cugggagcuggaaugggagaag

SEQ ID NO: 1025625 - RNA, 22 nt, Human
uacauuguucaugcaugagaaa

SEQ ID NO: 1025626 - RNA, 22 nt, Human
aagggcagcuuaaauugguagc

SEQ ID NO: 1025627 - RNA, 22 nt, Human
uaugcacaauaugaucuauuug

SEQ ID NO: 1025628 - RNA, 22 nt, Human
uuugaaaauuuaagugcuacac

SEQ ID NO: 1025629 - RNA, 22 nt, Human
ccacuguuuuucaguuaacuuu

SEQ ID NO: 1025630 - RNA, 22 nt, Human
gaaauauucuugucuuguuuuc

SEQ ID NO: 1025631 - RNA, 22 nt, Human
cucucuggcuuggcacggagau

SEQ ID NO: 1025632 - RNA, 22 nt, Human
aaaccuauuggcaagaauaaua

SEQ ID NO: 1025633 - RNA, 22 nt, Human
uguccucaaggagcuucagucu

SEQ ID NO: 1025634 - RNA, 22 nt, Human
ugugucagaaggcaauggggau

SEQ ID NO: 1025635 - RNA, 20 nt, Human
cugagcugagcuccaugggu

SEQ ID NO: 1025636 - RNA, 22 nt, Human
cugcugugagugguucuugccu

SEQ ID NO: 1025637 - RNA, 22 nt, Human
ccccagcugcauacuugccaag

SEQ ID NO: 1025638 - RNA, 19 nt, Human
ugaaauggcaguugcuaaa

SEQ ID NO: 1025639 - RNA, 21 nt, Human
uaaaugugagcagggcugggc

SEQ ID NO: 1025640 - RNA, 22 nt, Human
gcugucagaaggugaaggguaa

SEQ ID NO: 1025641 - RNA, 22 nt, Human
uggaaauauacaaugugucucu

SEQ ID NO: 1025642 - RNA, 22 nt, Human
aggcucuggaguguggugcugg

SEQ ID NO: 1025643 - RNA, 22 nt, Human
agauguguuucuaguuccugca

SEQ ID NO: 1025644 - RNA, 22 nt, Human
caaggccacuccagagacuggu

SEQ ID NO: 1025645 - RNA, 22 nt, Human
uuugacauugccaauuugcuca

SEQ ID NO: 1025646 - RNA, 22 nt, Human
ggaggccaggguggguggaucg

SEQ ID NO: 1025647 - RNA, 22 nt, Human
ucuucauuuuauagcaucugug

SEQ ID NO: 1025648 - RNA, 20 nt, Human
cauauauaccuagaagugga

SEQ ID NO: 1025649 - RNA, 22 nt, Human
agugaaaucagguuuugacugc

SEQ ID NO: 1025650 - RNA, 22 nt, Human
accaaggaagaaucuauuugag

SEQ ID NO: 1025651 - RNA, 23 nt, Human
cagcuuucagggcuuuagggaag

SEQ ID NO: 1025652 - RNA, 22 nt, Human
cagcugcccugccuugcccuua

SEQ ID NO: 1025653 - RNA, 22 nt, Human
aaauauguauggaguucaugaa

SEQ ID NO: 1025654 - RNA, 22 nt, Human
ucugccuggauuccauucucca

SEQ ID NO: 1025655 - RNA, 22 nt, Human
cuauuagguaugugguugcuau

SEQ ID NO: 1025656 - RNA, 22 nt, Human
cagcuuauucaguaagcacaua

SEQ ID NO: 1025657 - RNA, 22 nt, Human
uggcugaauaaaauaugguguu

SEQ ID NO: 1025658 - RNA, 22 nt, Human
gggggcucugacucccucagcu

SEQ ID NO: 1025659 - RNA, 22 nt, Human
auuugaagucuucaugauuucu

SEQ ID NO: 1025660 - RNA, 22 nt, Human
ugcugguggagaaaguggaggu

SEQ ID NO: 1025661 - RNA, 22 nt, Human
agcuggagcuucaagcagguaa

SEQ ID NO: 1025662 - RNA, 22 nt, Human
ucuccucugcgcggcagugccc

SEQ ID NO: 1025663 - RNA, 22 nt, Human
gucugucucucuccagagugca

SEQ ID NO: 1025664 - RNA, 22 nt, Human
aaaugcaucagcucauaagaga

SEQ ID NO: 1025665 - RNA, 22 nt, Human
gcugucccgaaccccugguaau

SEQ ID NO: 1025666 - RNA, 22 nt, Human
ggcucugcccagguggacagca

SEQ ID NO: 1025667 - RNA, 22 nt, Human
aggggcugggacagagccaagc

SEQ ID NO: 1025668 - RNA, 23 nt, Human
gucagggcuggggucagagugac

SEQ ID NO: 1025669 - RNA, 22 nt, Human
uuugaaagcuacuuucggguca

SEQ ID NO: 1025670 - RNA, 22 nt, Human
cugggagcuuguuaggaaugca

SEQ ID NO: 1025671 - RNA, 22 nt, Human
ugggcucugcugcguaccaguu

SEQ ID NO: 1025672 - RNA, 22 nt, Human
aaucacuuuucucuaauguagc

SEQ ID NO: 1025673 - RNA, 22 nt, Human
ugcaaacuauugguagagaugg

SEQ ID NO: 1025674 - RNA, 22 nt, Human
cugucauuuaagacauucugga

SEQ ID NO: 1025675 - RNA, 22 nt, Human
aagcagaugggacuccaaggca

SEQ ID NO: 1025676 - RNA, 22 nt, Human
cugggcugucccaaccccaucc

SEQ ID NO: 1025677 - RNA, 22 nt, Human
aggucauugaaguuauuuucuu

SEQ ID NO: 1025678 - RNA, 22 nt, Human
gucugucucccugugacugaga

SEQ ID NO: 1025679 - RNA, 22 nt, Human
ccagaagggcuauugcagugac

SEQ ID NO: 1025680 - RNA, 22 nt, Human
agacucaagcagauaggaauua

SEQ ID NO: 1025681 - RNA, 22 nt, Human
gcugagagaaaagugagguucu

SEQ ID NO: 1025682 - RNA, 22 nt, Human
uuugcagucuggccugcuuugg

SEQ ID NO: 1025683 - RNA, 22 nt, Human
uacaugcucaguaacuuucagu

SEQ ID NO: 1025684 - RNA, 22 nt, Human
ccugggagagccaucuguggcc

SEQ ID NO: 1025685 - RNA, 22 nt, Human
ucucacugcaaauauuauguau

SEQ ID NO: 1025686 - RNA, 22 nt, Human
gccuucaguaguauccucauga

SEQ ID NO: 1025687 - RNA, 22 nt, Human
gagcucauccccaugguccguc

SEQ ID NO: 1025688 - RNA, 22 nt, Human
ggcugcagcagagggacucacg

SEQ ID NO: 1025689 - RNA, 22 nt, Human
cuaaaugcccuacaaugacugg

SEQ ID NO: 1025690 - RNA, 19 nt, Human
auuuacugccuaaaaucuc

SEQ ID NO: 1025691 - RNA, 22 nt, Human
uugaaucuggguacuuguaaua

SEQ ID NO: 1025692 - RNA, 22 nt, Human
aaugcacauauauguguauaca

SEQ ID NO: 1025693 - RNA, 22 nt, Human
ccuuugggugaauuccucucuu

SEQ ID NO: 1025694 - RNA, 22 nt, Human
gugucccaggagaggagacaau

SEQ ID NO: 1025695 - RNA, 22 nt, Human
ccccuggguccaggcuucucug

SEQ ID NO: 1025696 - RNA, 18 nt, Human
gaggccugagaaccaggu

SEQ ID NO: 1025697 - RNA, 18 nt, Human
uaaaugcauguuaauaac

SEQ ID NO: 1025698 - RNA, 19 nt, Human
uacauuuguguacacuugu

SEQ ID NO: 1025699 - RNA, 22 nt, Human
agcagggcuugccgcuuguccu

SEQ ID NO: 1025700 - RNA, 23 nt, Human
auuuccuacuauaaaagagguaa

SEQ ID NO: 1025701 - RNA, 22 nt, Human
guggcuugaccaucccugcuac

SEQ ID NO: 1025702 - RNA, 22 nt, Human
cccaggagauggagguugcagu

SEQ ID NO: 1025703 - RNA, 22 nt, Human
aaaugcacaaaguaaguguaau

SEQ ID NO: 1025704 - RNA, 22 nt, Human
acuuuacaagcuuauagccuag

SEQ ID NO: 1025705 - RNA, 22 nt, Human
uugaacagcuguuacauuguua

SEQ ID NO: 1025706 - RNA, 22 nt, Human
gagagugauucccucccauaga

SEQ ID NO: 1025707 - RNA, 22 nt, Human
cccuggagcugcuugcauguug

SEQ ID NO: 1025708 - RNA, 22 nt, Human
gacagugcauuuccuggcaugg

SEQ ID NO: 1025709 - RNA, 22 nt, Human
uggaggaugccuggggaggccu

SEQ ID NO: 1025710 - RNA, 22 nt, Human
ucagaagagcuggugcugccug

SEQ ID NO: 1025711 - RNA, 22 nt, Human
ugagccagccuugcagcugugc

SEQ ID NO: 1025712 - RNA, 22 nt, Human
auugaaagagaauguagcucuu

SEQ ID NO: 1025713 - RNA, 22 nt, Human
ggcaccuggagguuuacuggau

SEQ ID NO: 1025714 - RNA, 22 nt, Human
cugcugugaguuuggaggucua

SEQ ID NO: 1025715 - RNA, 22 nt, Human
gccugagcaggcguggaccaug

SEQ ID NO: 1025716 - RNA, 22 nt, Human
uuucauaauagugcaguuuguu

SEQ ID NO: 1025717 - RNA, 22 nt, Human
aauuaggggaggacguaucaua

SEQ ID NO: 1025718 - RNA, 22 nt, Human
ggcuggcacagagggcuggugu

SEQ ID NO: 1025719 - RNA, 22 nt, Human
caucaguguggcaguucacugu

SEQ ID NO: 1025720 - RNA, 22 nt, Human
aaauguagaccuauagggaccu

SEQ ID NO: 1025721 - RNA, 22 nt, Human
uuuuuuaguuaggucagaaugu

SEQ ID NO: 1025722 - RNA, 22 nt, Human
ucugccugaaauucacauguaa

SEQ ID NO: 1025723 - RNA, 22 nt, Human
gcccccucuuuggagccagcca

SEQ ID NO: 1025724 - RNA, 21 nt, Human
cagggcacacagaggauggua

SEQ ID NO: 1025725 - RNA, 22 nt, Human
cagggcuggcucaugaaaaguu

SEQ ID NO: 1025726 - RNA, 22 nt, Human
auucuuauuuaaauagagucug

SEQ ID NO: 1025727 - RNA, 22 nt, Human
cuuuggcagccucugcuauuga

SEQ ID NO: 1025728 - RNA, 22 nt, Human
gagaggccaccugacgagcagu

SEQ ID NO: 1025729 - RNA, 22 nt, Human
caguggggaggccaggauagaa

SEQ ID NO: 1025730 - RNA, 22 nt, Human
gucuuucuuaauucaagugcuu

SEQ ID NO: 1025731 - RNA, 22 nt, Human
caaagccucugauuucacuugu

SEQ ID NO: 1025732 - RNA, 19 nt, Human
agaggcugucaccuguagc

SEQ ID NO: 1025733 - RNA, 22 nt, Human
uuucacaaugcaauccuacuuc

SEQ ID NO: 1025734 - RNA, 22 nt, Human
gccuggcugggcaccaggggag

SEQ ID NO: 1025735 - RNA, 22 nt, Human
ugcugccuucuaggcgugcccu

SEQ ID NO: 1025736 - RNA, 22 nt, Human
uuaauuuucucaucugugaaau

SEQ ID NO: 1025737 - RNA, 23 nt, Human
ucagaaugcacugaauuuacccu

SEQ ID NO: 1025738 - RNA, 22 nt, Human
uagaggugacacugagaccaua

SEQ ID NO: 1025739 - RNA, 22 nt, Human
ccucgaccuccccaggcucagg

SEQ ID NO: 1025740 - RNA, 22 nt, Human
accugggagucacaccugagaa

SEQ ID NO: 1025741 - RNA, 22 nt, Human
ggagacagugacuuagagacug

SEQ ID NO: 1025742 - RNA, 22 nt, Human
cucugguguccuuuagaauuua

SEQ ID NO: 1025743 - RNA, 22 nt, Human
uucuuugaguuaguacagucca

SEQ ID NO: 1025744 - RNA, 22 nt, Human
ccuggcugcauuuugcuggaug

SEQ ID NO: 1025745 - RNA, 22 nt, Human
aaguguuuauuuauaacgaucu

SEQ ID NO: 1025746 - RNA, 22 nt, Human
agaugaaaauacgugacuuuaa

SEQ ID NO: 1025747 - RNA, 22 nt, Human
agggcagagauuaauuaagaca

SEQ ID NO: 1025748 - RNA, 22 nt, Human
uuuccucugaugcugacuugga

SEQ ID NO: 1025749 - RNA, 22 nt, Human
ucugucaauauaugugcugcag

SEQ ID NO: 1025750 - RNA, 22 nt, Human
uucugagacaauugagagucua

SEQ ID NO: 1025751 - RNA, 22 nt, Human
ugugacaucgcugugucuguuu

SEQ ID NO: 1025752 - RNA, 22 nt, Human
acuggcaggcugcuggccggcg

SEQ ID NO: 1025753 - RNA, 22 nt, Human
ucagaacaauugggaaccauua

SEQ ID NO: 1025754 - RNA, 22 nt, Human
gaugcacuugccccuccucaga

SEQ ID NO: 1025755 - RNA, 22 nt, Human
ugacacaggcagcucccagcac

SEQ ID NO: 1025756 - RNA, 20 nt, Human
ugucaugcauuagaugaaga

SEQ ID NO: 1025757 - RNA, 22 nt, Human
ugcagugccucggcagugcagc

SEQ ID NO: 1025758 - RNA, 22 nt, Human
cagggccuuauccugccauuga

SEQ ID NO: 1025759 - RNA, 22 nt, Human
aguuugaauugaaaugcagaug

SEQ ID NO: 1025760 - RNA, 22 nt, Human
ucucaggaauagaguggcagca

SEQ ID NO: 1025761 - RNA, 21 nt, Human
gcucagaguauugcacuguuu

SEQ ID NO: 1025762 - RNA, 22 nt, Human
acagccugagaguggagcuggc

SEQ ID NO: 1025763 - RNA, 19 nt, Human
gcauuucucuuuacagcca

SEQ ID NO: 1025764 - RNA, 22 nt, Human
uccagggauguccuguagcacu

SEQ ID NO: 1025765 - RNA, 17 nt, Human
ugaggccugcaucagug

SEQ ID NO: 1025766 - RNA, 22 nt, Human
agcuguucccucacugcaguca

SEQ ID NO: 1025767 - RNA, 22 nt, Human
aguuuauagcccagauucaugg

SEQ ID NO: 1025768 - RNA, 22 nt, Human
caaugauguuuagauaaaaucc

SEQ ID NO: 1025769 - RNA, 22 nt, Human
gcaggggcugagcaccagcggg

SEQ ID NO: 1025770 - RNA, 22 nt, Human
agcagaacugaugagacuugag

SEQ ID NO: 1025771 - RNA, 22 nt, Human
ggcucugcaugugagugggugg

SEQ ID NO: 1025772 - RNA, 22 nt, Human
accuuuuuguucuguucucagc

SEQ ID NO: 1025773 - RNA, 20 nt, Human
uagaaaucuuauaaaagacu

SEQ ID NO: 1025774 - RNA, 22 nt, Human
aucuucaaagcacaucguuugu

SEQ ID NO: 1025775 - RNA, 22 nt, Human
ugucccucugaggcuucccugg

SEQ ID NO: 1025776 - RNA, 22 nt, Human
aaaguuucaauagaggaagugg

SEQ ID NO: 1025777 - RNA, 22 nt, Human
ccccaggcagggccuaacagag

SEQ ID NO: 1025778 - RNA, 22 nt, Human
ccuggccucgugcucacggcuc

SEQ ID NO: 1025779 - RNA, 22 nt, Human
gagagcacaugaacauggagga

SEQ ID NO: 1025780 - RNA, 22 nt, Human
agccucugcacgggcacgggug

SEQ ID NO: 1025781 - RNA, 22 nt, Human
caggauagaaaggccauggagu

SEQ ID NO: 1025782 - RNA, 22 nt, Human
aggacagugguguucuggagug

SEQ ID NO: 1025783 - RNA, 20 nt, Human
ggcugugcccuuccguggcc

SEQ ID NO: 1025784 - RNA, 22 nt, Human
ggcccugugguuuugcaaaguc

SEQ ID NO: 1025785 - RNA, 22 nt, Human
ggguggaggagaacaggcccca

SEQ ID NO: 1025786 - RNA, 22 nt, Human
cuuucucuguguuucacaugcu

SEQ ID NO: 1025787 - RNA, 22 nt, Human
ccacugaggcaggcaguaucua

SEQ ID NO: 1025788 - RNA, 22 nt, Human
ucccugggaacaaaggaugaga

SEQ ID NO: 1025789 - RNA, 22 nt, Human
aaggcugagacagcacaggucc

SEQ ID NO: 1025790 - RNA, 22 nt, Human
ccugagcugaacuaagcaguuu

SEQ ID NO: 1025791 - RNA, 22 nt, Human
aucuagaaaguguugaagauca

SEQ ID NO: 1025792 - RNA, 22 nt, Human
agccaggaaccagcuacagucu

SEQ ID NO: 1025793 - RNA, 22 nt, Human
acagggcagagggcaguuggua

SEQ ID NO: 1025794 - RNA, 20 nt, Human
auguagaugaaagcaaaggc

SEQ ID NO: 1025795 - RNA, 22 nt, Human
uaagaacagauaaaguuucccc

SEQ ID NO: 1025796 - RNA, 22 nt, Human
cauuuccugucuggaggucaaa

SEQ ID NO: 1025797 - RNA, 22 nt, Human
ccagcugcaggggagcagugga

SEQ ID NO: 1025798 - RNA, 22 nt, Human
ucuagggaacaugggucaagcu

SEQ ID NO: 1025799 - RNA, 22 nt, Human
uucucauggugucuuuauacau

SEQ ID NO: 1025800 - RNA, 22 nt, Human
gugcagggcuggcaccggaggc

SEQ ID NO: 1025801 - RNA, 19 nt, Human
ucucacaguuuccuugccu

SEQ ID NO: 1025802 - RNA, 19 nt, Human
ucuguucacauuguuucgc

SEQ ID NO: 1025803 - RNA, 22 nt, Human
guccaguguguuuaucuuggau

SEQ ID NO: 1025804 - RNA, 22 nt, Human
aaagccuuggucaucugguucc

SEQ ID NO: 1025805 - RNA, 22 nt, Human
uauuucuugaguggucaguuuc

SEQ ID NO: 1025806 - RNA, 22 nt, Human
cuacccaggcuggagugcagua

SEQ ID NO: 1025807 - RNA, 22 nt, Human
accagagauggggcuucucugu

SEQ ID NO: 1025808 - RNA, 22 nt, Human
gcugagguggcugccuuaguaa

SEQ ID NO: 1025809 - RNA, 22 nt, Human
auugaaagcacaaagaacaagu

SEQ ID NO: 1025810 - RNA, 22 nt, Human
gagacacacacaggagguggca

SEQ ID NO: 1025811 - RNA, 18 nt, Human
gagcacugguguugaggu

SEQ ID NO: 1025812 - RNA, 21 nt, Human
acucaggagacuaacuauguc

SEQ ID NO: 1025813 - RNA, 22 nt, Human
ggcacugagaacaggcugacuu

SEQ ID NO: 1025814 - RNA, 22 nt, Human
uuucacacugcagcaucagaga

SEQ ID NO: 1025815 - RNA, 22 nt, Human
aagcagcacaguaauauuggug

SEQ ID NO: 1025816 - RNA, 22 nt, Human
uuucugaacaaagccauuauca

SEQ ID NO: 1025817 - RNA, 22 nt, Human
cacagcuucugagugaggauuu

SEQ ID NO: 1025818 - RNA, 22 nt, Human
caggacaguauaggcuuuagga

SEQ ID NO: 1025819 - RNA, 22 nt, Human
ucucagagugguggucccucug

SEQ ID NO: 1025820 - RNA, 22 nt, Human
uuccagagaaaagguuuauuuc

SEQ ID NO: 1025821 - RNA, 22 nt, Human
ccagcuccccucagcagguaau

SEQ ID NO: 1025822 - RNA, 22 nt, Human
caaggccaugagcagcgagugu

SEQ ID NO: 1025823 - RNA, 22 nt, Human
uuucugaauaacucuaugauau

SEQ ID NO: 1025824 - RNA, 22 nt, Human
guuaacacaggacucucugccu

SEQ ID NO: 1025825 - RNA, 22 nt, Human
uggaccugaagaauaggaagua

SEQ ID NO: 1025826 - RNA, 22 nt, Human
cagagugaaauaggggaucaag

SEQ ID NO: 1025827 - RNA, 22 nt, Human
guucacaucacuucacugaacc

SEQ ID NO: 1025828 - RNA, 22 nt, Human
ccucccacauccuagcucugcu

SEQ ID NO: 1025829 - RNA, 23 nt, Human
agaugagccaacaccuccaugcc

SEQ ID NO: 1025830 - RNA, 22 nt, Human
ccagcaccuugaucuuggaguu

SEQ ID NO: 1025831 - RNA, 20 nt, Human
uggagcuccagcguccaugu

SEQ ID NO: 1025832 - RNA, 22 nt, Human
accaggcugugaagugagacua

SEQ ID NO: 1025833 - RNA, 22 nt, Human
ggacacagcugcagccacaccc

SEQ ID NO: 1025834 - RNA, 22 nt, Human
gaggggcugggcagucccugga

SEQ ID NO: 1025835 - RNA, 22 nt, Human
cauuuugugcuagacacuaugg

SEQ ID NO: 1025836 - RNA, 22 nt, Human
uccugagagcagcugcuuugga

SEQ ID NO: 1025837 - RNA, 22 nt, Human
aggccucacucucagagcuucu

SEQ ID NO: 1025838 - RNA, 22 nt, Human
gagggcuccucacauucucuau

SEQ ID NO: 1025839 - RNA, 22 nt, Human
ucugggaguggguccaaggaau

SEQ ID NO: 1025840 - RNA, 22 nt, Human
auaugagaauuggaaaauauca

SEQ ID NO: 1025841 - RNA, 22 nt, Human
agaaaucuaagaugcucaagga

SEQ ID NO: 1025842 - RNA, 22 nt, Human
cggcuggggcuguccccaugac

SEQ ID NO: 1025843 - RNA, 22 nt, Human
cauauaaauacaacauguguua

SEQ ID NO: 1025844 - RNA, 21 nt, Human
ccugcugugaucuuagugagu

SEQ ID NO: 1025845 - RNA, 22 nt, Human
uucuuucacucaagaaggaucu

SEQ ID NO: 1025846 - RNA, 22 nt, Human
ggcccagcacagugcuuggggg

SEQ ID NO: 1025847 - RNA, 22 nt, Human
gucacuggggccacaugcagaa

SEQ ID NO: 1025848 - RNA, 22 nt, Human
cuguccagucuuuagcaagcug

SEQ ID NO: 1025849 - RNA, 22 nt, Human
gaaaugugaccuacuuccuugu

SEQ ID NO: 1025850 - RNA, 19 nt, Human
ugcagaagacacaguggug

SEQ ID NO: 1025851 - RNA, 22 nt, Human
auuuaaauuuucugauggagag

SEQ ID NO: 1025852 - RNA, 22 nt, Human
uggaggcaccacuggcugcccg

SEQ ID NO: 1025853 - RNA, 22 nt, Human
uugaaauacugcauuguucagu

SEQ ID NO: 1025854 - RNA, 22 nt, Human
uaucaauugggccaaaugguac

SEQ ID NO: 1025855 - RNA, 22 nt, Human
cucugaccauucccuugauuuu

SEQ ID NO: 1025856 - RNA, 22 nt, Human
uggcucaguaaucgagucuccu

SEQ ID NO: 1025857 - RNA, 22 nt, Human
uucagagccacuucaagucuaa

SEQ ID NO: 1025858 - RNA, 23 nt, Human
ugggaguguugggaucucugcuc

SEQ ID NO: 1025859 - RNA, 22 nt, Human
guggagaccuccuaggaugugu

SEQ ID NO: 1025860 - RNA, 22 nt, Human
uacauuguuuuuucuugccauc

SEQ ID NO: 1025861 - RNA, 22 nt, Human
uggcagagaacacggcugaucu

SEQ ID NO: 1025862 - RNA, 20 nt, Human
cagcaggaaaagugccucag

SEQ ID NO: 1025863 - RNA, 22 nt, Human
ccugggcuucugucuagauguu

SEQ ID NO: 1025864 - RNA, 22 nt, Human
ggcagggagagcaugcugauaa

SEQ ID NO: 1025865 - RNA, 22 nt, Human
gaggagagggcugcgggcccac

SEQ ID NO: 1025866 - RNA, 22 nt, Human
gaggccuggaauuccagccugg

SEQ ID NO: 1025867 - RNA, 22 nt, Human
uuaacacagggggagacaaagu

SEQ ID NO: 1025868 - RNA, 22 nt, Human
gacccagcuaaccaggugggga

SEQ ID NO: 1025869 - RNA, 22 nt, Human
aguugcagacgcagagauguug

SEQ ID NO: 1025870 - RNA, 22 nt, Human
ucccagccauuccuuuaggugu

SEQ ID NO: 1025871 - RNA, 22 nt, Human
uuuugugagcccauaaaugcca

SEQ ID NO: 1025872 - RNA, 22 nt, Human
guuugcauuucuugaacuauau

SEQ ID NO: 1025873 - RNA, 22 nt, Human
caggacaguuugcuuugcccug

SEQ ID NO: 1025874 - RNA, 23 nt, Human
uggagcugggcucagacccuggg

SEQ ID NO: 1025875 - RNA, 22 nt, Human
agggcagaaauauugauacugu

SEQ ID NO: 1025876 - RNA, 22 nt, Human
gggcugucaugugucagugacc

SEQ ID NO: 1025877 - RNA, 22 nt, Human
augcaguacugauacaugccac

SEQ ID NO: 1025878 - RNA, 22 nt, Human
ucauaaaacacaccagguaguu

SEQ ID NO: 1025879 - RNA, 22 nt, Human
accuggagucauuugaggagua

SEQ ID NO: 1025880 - RNA, 20 nt, Human
uaggcagagcugugcagccu

SEQ ID NO: 1025881 - RNA, 22 nt, Human
gcaggguaggugacagguaguc

SEQ ID NO: 1025882 - RNA, 22 nt, Human
ugcauuauaacugaauguuguu

SEQ ID NO: 1025883 - RNA, 22 nt, Human
aagacauuuauuugaaucaauu

SEQ ID NO: 1025884 - RNA, 19 nt, Human
ugaguucugugguucucaa

SEQ ID NO: 1025885 - RNA, 22 nt, Human
gaaugcacacgugugugcaugc

SEQ ID NO: 1025886 - RNA, 22 nt, Human
acacagaguauuuagaaggggu

SEQ ID NO: 1025887 - RNA, 20 nt, Human
uggagcugugguaaggagca

SEQ ID NO: 1025888 - RNA, 22 nt, Human
uguccugcaacugaaggagaag

SEQ ID NO: 1025889 - RNA, 22 nt, Human
gucaaguuaagauaaggucaug

SEQ ID NO: 1025890 - RNA, 22 nt, Human
ugucucugguauuaggugaaaa

SEQ ID NO: 1025891 - RNA, 22 nt, Human
ugcuuuauucagucucugccau

SEQ ID NO: 1025892 - RNA, 22 nt, Human
uuugaaagucaaccuuccaguu

SEQ ID NO: 1025893 - RNA, 22 nt, Human
aagauauagauaaaacuaugca

SEQ ID NO: 1025894 - RNA, 22 nt, Human
cccuggaguccggagcucaccu

SEQ ID NO: 1025895 - RNA, 22 nt, Human
gacauuucaaucucauuauggg

SEQ ID NO: 1025896 - RNA, 22 nt, Human
auuucacucauucauguuacuu

SEQ ID NO: 1025897 - RNA, 22 nt, Human
ugggcagaaaucaguaucagau

SEQ ID NO: 1025898 - RNA, 22 nt, Human
gacccuguuucuacaaauaauu

SEQ ID NO: 1025899 - RNA, 23 nt, Human
ucucuuucaagagcuuaaugugc

SEQ ID NO: 1025900 - RNA, 22 nt, Human
ucuucuccagugcuucugcaca

SEQ ID NO: 1025901 - RNA, 22 nt, Human
cccagccugugacagccguccu

SEQ ID NO: 1025902 - RNA, 22 nt, Human
uucuguauauuguaaagacuca

SEQ ID NO: 1025903 - RNA, 22 nt, Human
ggcugcuggggacgugggagag

SEQ ID NO: 1025904 - RNA, 22 nt, Human
aggcccugcaggaagcaggaug

SEQ ID NO: 1025905 - RNA, 22 nt, Human
cauguugaauggccuugauuuu

SEQ ID NO: 1025906 - RNA, 22 nt, Human
aguaugaacggaaggccuggga

SEQ ID NO: 1025907 - RNA, 22 nt, Human
uuuccucugagugagcugggag

SEQ ID NO: 1025908 - RNA, 22 nt, Human
aggccagcucacccuggcuccu

SEQ ID NO: 1025909 - RNA, 22 nt, Human
aggccagaugucgggcuagaag

SEQ ID NO: 1025910 - RNA, 20 nt, Human
augugagggguugaaguggg

SEQ ID NO: 1025911 - RNA, 22 nt, Human
uccauucuaugcuuacauuuau

SEQ ID NO: 1025912 - RNA, 22 nt, Human
caggcacagaguuauucauuua

SEQ ID NO: 1025913 - RNA, 22 nt, Human
acauuuagaguucuuuacucca

SEQ ID NO: 1025914 - RNA, 22 nt, Human
uugaggaguguuuagggugagg

SEQ ID NO: 1025915 - RNA, 18 nt, Human
ugacagaaccuggagccu

SEQ ID NO: 1025916 - RNA, 22 nt, Human
aagaggaagucuccauggagag

SEQ ID NO: 1025917 - RNA, 22 nt, Human
cauggcagagaaggggaacugg

SEQ ID NO: 1025918 - RNA, 22 nt, Human
agccaggcugcaguuggcuggc

SEQ ID NO: 1025919 - RNA, 22 nt, Human
aucaggauggguuuggcuuagg

SEQ ID NO: 1025920 - RNA, 22 nt, Human
ugggcacuauggcucugugcac

SEQ ID NO: 1025921 - RNA, 22 nt, Human
uggcugucagcugccuggugcg

SEQ ID NO: 1025922 - RNA, 22 nt, Human
gcugugugcucacguaguggaa

SEQ ID NO: 1025923 - RNA, 22 nt, Human
ucccagcgcggggggaggaucc

SEQ ID NO: 1025924 - RNA, 21 nt, Human
augaagucuaugcuucugugu

SEQ ID NO: 1025925 - RNA, 22 nt, Human
uggcugccuuucaccucaucuc

SEQ ID NO: 1025926 - RNA, 22 nt, Human
gggaccuggucuagcacugagc

SEQ ID NO: 1025927 - RNA, 22 nt, Human
gccucccuguucuuccacaaua

SEQ ID NO: 1025928 - RNA, 22 nt, Human
cauuuacuuaaaucuuuacaag

SEQ ID NO: 1025929 - RNA, 22 nt, Human
uugaacauuaacuucagucuau

SEQ ID NO: 1025930 - RNA, 22 nt, Human
uucuuacagcccuauuacuaaa

SEQ ID NO: 1025931 - RNA, 22 nt, Human
guacccaggcacgccuugcuga

SEQ ID NO: 1025932 - RNA, 22 nt, Human
gagaggucaucucccaucagca

SEQ ID NO: 1025933 - RNA, 22 nt, Human
ucauccuuuugcaugggaaggc

SEQ ID NO: 1025934 - RNA, 22 nt, Human
acauuucugcuagaauagguga

SEQ ID NO: 1025935 - RNA, 22 nt, Human
aguucacauaucuguuuuauuu

SEQ ID NO: 1025936 - RNA, 22 nt, Human
ccagccuucugagcugccugga

SEQ ID NO: 1025937 - RNA, 20 nt, Human
cuggguggcaagcaaggggg

SEQ ID NO: 1025938 - RNA, 22 nt, Human
agcaggaguuugaugcuuuuau

SEQ ID NO: 1025939 - RNA, 22 nt, Human
ccagugcauaaucaauacagcc

SEQ ID NO: 1025940 - RNA, 22 nt, Human
ggcagaaggccucccagcuccu

SEQ ID NO: 1025941 - RNA, 22 nt, Human
agagggagcccagucauagcug

SEQ ID NO: 1025942 - RNA, 22 nt, Human
acccacgaagaugagcggcaug

SEQ ID NO: 1025943 - RNA, 22 nt, Human
uccugcagaucaaagccuuuga

SEQ ID NO: 1025944 - RNA, 22 nt, Human
gaugcugagagguggagggaac

SEQ ID NO: 1025945 - RNA, 22 nt, Human
uauuucugaggcccaggaagug

SEQ ID NO: 1025946 - RNA, 22 nt, Human
acagcuuuguuuucccugcuga

SEQ ID NO: 1025947 - RNA, 17 nt, Human
ugagcaguagaagaugc

SEQ ID NO: 1025948 - RNA, 22 nt, Human
acuuuauuuccuauugcaucca

SEQ ID NO: 1025949 - RNA, 22 nt, Human
auccuugagccuuaucuuuugu

SEQ ID NO: 1025950 - RNA, 22 nt, Human
gaaggccuagggaugcucugcg

SEQ ID NO: 1025951 - RNA, 22 nt, Human
ucugggcacugcugagccugua

SEQ ID NO: 1025952 - RNA, 22 nt, Human
ggcaggugcaccugagccaucu

SEQ ID NO: 1025953 - RNA, 22 nt, Human
uaaggcaccuguccaggcuggg

SEQ ID NO: 1025954 - RNA, 22 nt, Human
cagcagcucccauccgcugagc

SEQ ID NO: 1025955 - RNA, 22 nt, Human
gcagaggcugggugucccaguc

SEQ ID NO: 1025956 - RNA, 22 nt, Human
cagagccucagaauccugugga

SEQ ID NO: 1025957 - RNA, 22 nt, Human
cugccucuccccagaguggccc

SEQ ID NO: 1025958 - RNA, 22 nt, Human
ccagggccucguguucugagug

SEQ ID NO: 1025959 - RNA, 22 nt, Human
cagggcagaaggcacucuacuc

SEQ ID NO: 1025960 - RNA, 19 nt, Human
auauauguauacaaugugg

SEQ ID NO: 1025961 - RNA, 20 nt, Human
ccagagcagccacugaaguu

SEQ ID NO: 1025962 - RNA, 22 nt, Human
gaagcagcuagcccacuaguca

SEQ ID NO: 1025963 - RNA, 22 nt, Human
uuugagauggagucuugcucug

SEQ ID NO: 1025964 - RNA, 22 nt, Human
uuacaggggacauuggggacau

SEQ ID NO: 1025965 - RNA, 22 nt, Human
gagagucacugucugcauuucc

SEQ ID NO: 1025966 - RNA, 22 nt, Human
aggagguggccugagcgugccc

SEQ ID NO: 1025967 - RNA, 22 nt, Human
gcugcucucagagcucaugcug

SEQ ID NO: 1025968 - RNA, 22 nt, Human
caagagcuagacuuugucagga

SEQ ID NO: 1025969 - RNA, 22 nt, Human
ccaggccuccugugaguggacc

SEQ ID NO: 1025970 - RNA, 22 nt, Human
cuugcugucuugcauuuagagc

SEQ ID NO: 1025971 - RNA, 22 nt, Human
gcacccagaauaaggacaggac

SEQ ID NO: 1025972 - RNA, 22 nt, Human
uguacuuccccaaugacagcac

SEQ ID NO: 1025973 - RNA, 22 nt, Human
uuugaaucugauauggcagcau

SEQ ID NO: 1025974 - RNA, 22 nt, Human
ucucccaggugggugccuggag

SEQ ID NO: 1025975 - RNA, 22 nt, Human
ugggccugaaggagcugcgccc

SEQ ID NO: 1025976 - RNA, 21 nt, Human
ccuggcagaagccugauaugc

SEQ ID NO: 1025977 - RNA, 22 nt, Human
agcauucauugcuagaauguaa

SEQ ID NO: 1025978 - RNA, 22 nt, Human
ucuggcucucauacucgccagu

SEQ ID NO: 1025979 - RNA, 22 nt, Human
uggccugcuuucauuugaugcu

SEQ ID NO: 1025980 - RNA, 22 nt, Human
agccccaguaagggagggccug

SEQ ID NO: 1025981 - RNA, 22 nt, Human
uguuucauuaguacugacaaua

SEQ ID NO: 1025982 - RNA, 22 nt, Human
cccuguccuggaugggagcacu

SEQ ID NO: 1025983 - RNA, 22 nt, Human
agacaaaggauuaaugaugaug

SEQ ID NO: 1025984 - RNA, 22 nt, Human
aaaguuuccugcuaagugcuau

SEQ ID NO: 1025985 - RNA, 22 nt, Human
ggcuggagauaugucuggaaca

SEQ ID NO: 1025986 - RNA, 22 nt, Human
ggcuucccaaggagccaggaug

SEQ ID NO: 1025987 - RNA, 22 nt, Human
aggcagcaaagaaaugaugcug

SEQ ID NO: 1025988 - RNA, 22 nt, Human
uucuuuccaaccagauauuggu

SEQ ID NO: 1025989 - RNA, 22 nt, Human
ccugccucaucaacuugucgug

SEQ ID NO: 1025990 - RNA, 23 nt, Human
uuuauauuccuaaugucuugagc

SEQ ID NO: 1025991 - RNA, 22 nt, Human
aucagcaaucaaauugcagagu

SEQ ID NO: 1025992 - RNA, 22 nt, Human
uggagcaggugggaugucguga

SEQ ID NO: 1025993 - RNA, 22 nt, Human
aagugacaccucuucccuuucc

SEQ ID NO: 1025994 - RNA, 22 nt, Human
uagggcucugcucaucaguugu

SEQ ID NO: 1025995 - RNA, 22 nt, Human
agaggagugggaagcagugcaa

SEQ ID NO: 1025996 - RNA, 22 nt, Human
gggcauggaggucugucugcag

SEQ ID NO: 1025997 - RNA, 22 nt, Human
agaugguguuuccccaggugga

SEQ ID NO: 1025998 - RNA, 22 nt, Human
gagugguaggcaguguuaggaa

SEQ ID NO: 1025999 - RNA, 22 nt, Human
gccaggcacaguucuaggugcu

SEQ ID NO: 1026000 - RNA, 22 nt, Human
gggagcaggagccugccugcca

SEQ ID NO: 1026001 - RNA, 16 nt, Human
cagcuuuaugucagug

SEQ ID NO: 1026002 - RNA, 22 nt, Human
ccuguucaagguauuaauuauc

SEQ ID NO: 1026003 - RNA, 22 nt, Human
aaguucaaggugauaguggcag

SEQ ID NO: 1026004 - RNA, 22 nt, Human
gcaaauucuuaacuggacugug

SEQ ID NO: 1026005 - RNA, 22 nt, Human
agugaccauuuucagcuagagg

SEQ ID NO: 1026006 - RNA, 22 nt, Human
guuuauuauacaacaaaagcua

SEQ ID NO: 1026007 - RNA, 22 nt, Human
aaggagcuuguucgccuuccuc

SEQ ID NO: 1026008 - RNA, 22 nt, Human
acuggacagaggaaauauggag

SEQ ID NO: 1026009 - RNA, 22 nt, Human
ccagagagguagcuuacccucu

SEQ ID NO: 1026010 - RNA, 22 nt, Human
acauucuagaagucuuugcaau

SEQ ID NO: 1026011 - RNA, 22 nt, Human
uucugugauugacauguggcuu

SEQ ID NO: 1026012 - RNA, 22 nt, Human
gcuggcuccucuguccucacgg

SEQ ID NO: 1026013 - RNA, 22 nt, Human
acaugauuuuaguaucauaaua

SEQ ID NO: 1026014 - RNA, 23 nt, Human
uccagcagccaagaaggguagaa

SEQ ID NO: 1026015 - RNA, 22 nt, Human
agggacuuguguccuauguaug

SEQ ID NO: 1026016 - RNA, 22 nt, Human
acaguguuuuagaaaagcuuga

SEQ ID NO: 1026017 - RNA, 22 nt, Human
gccagccugugcuuggccaggc

SEQ ID NO: 1026018 - RNA, 22 nt, Human
uauuugaaggcauacauuuuga

SEQ ID NO: 1026019 - RNA, 22 nt, Human
gcugggaggaauuuggggaaua

SEQ ID NO: 1026020 - RNA, 23 nt, Human
cagggccaggcagcagcugucac

SEQ ID NO: 1026021 - RNA, 22 nt, Human
aggccugcagcaggagcaaacc

SEQ ID NO: 1026022 - RNA, 22 nt, Human
uuaagucacuuaucuaaagaca

SEQ ID NO: 1026023 - RNA, 22 nt, Human
gggccugugcacaguucuguua

SEQ ID NO: 1026024 - RNA, 18 nt, Human
gagaggcccggcugugcc

SEQ ID NO: 1026025 - RNA, 22 nt, Human
ugugugccagccuacgaggagc

SEQ ID NO: 1026026 - RNA, 22 nt, Human
ucccuggacaacagacuucacu

SEQ ID NO: 1026027 - RNA, 22 nt, Human
aauaauuagugggacagagaac

SEQ ID NO: 1026028 - RNA, 22 nt, Human
cccucccaagcacucugacaua

SEQ ID NO: 1026029 - RNA, 22 nt, Human
gaaaauguuuccuguuauuugc

SEQ ID NO: 1026030 - RNA, 20 nt, Human
gagauggacagaugaagggg

SEQ ID NO: 1026031 - RNA, 22 nt, Human
uugcauugaugucuauacgcug

SEQ ID NO: 1026032 - RNA, 22 nt, Human
auggccuggggagcaugggaag

SEQ ID NO: 1026033 - RNA, 22 nt, Human
agcagcugagaugguaagauuc

SEQ ID NO: 1026034 - RNA, 22 nt, Human
ccuggcagcgugccgagcugcg

SEQ ID NO: 1026035 - RNA, 22 nt, Human
augaggcauuccacucaaacuc

SEQ ID NO: 1026036 - RNA, 22 nt, Human
ugcuuuggccacuagaauucag

SEQ ID NO: 1026037 - RNA, 21 nt, Human
uggcucugcucagagcagucc

SEQ ID NO: 1026038 - RNA, 23 nt, Human
aggcacugaaugugucagugagu

SEQ ID NO: 1026039 - RNA, 22 nt, Human
accucugcucaagaccccuccg

SEQ ID NO: 1026040 - RNA, 22 nt, Human
ccagcaugagacgaugaugaag

SEQ ID NO: 1026041 - RNA, 22 nt, Human
ugcuuuuaagaacaaugcugcu

SEQ ID NO: 1026042 - RNA, 22 nt, Human
agcugagccagcagcaacagga

SEQ ID NO: 1026043 - RNA, 22 nt, Human
uugagggucuggaucugcugcu

SEQ ID NO: 1026044 - RNA, 22 nt, Human
ucaucacauaugucaugauuug

SEQ ID NO: 1026045 - RNA, 22 nt, Human
gccugcagaacugugaggcaau

SEQ ID NO: 1026046 - RNA, 23 nt, Human
aaucuggcugauguuuuuucucu

SEQ ID NO: 1026047 - RNA, 21 nt, Human
cuguggaagggaacuagaggg

SEQ ID NO: 1026048 - RNA, 22 nt, Human
auguuugacugaguuuggcaga

SEQ ID NO: 1026049 - RNA, 22 nt, Human
auccagggauaaaaguaagguu

SEQ ID NO: 1026050 - RNA, 22 nt, Human
gucccuggaucugggacagcug

SEQ ID NO: 1026051 - RNA, 18 nt, Human
aagcugcccucaggcagg

SEQ ID NO: 1026052 - RNA, 21 nt, Human
uccucagggccccagagcacu

SEQ ID NO: 1026053 - RNA, 21 nt, Human
cagaaguaaggguaacuucuc

SEQ ID NO: 1026054 - RNA, 22 nt, Human
gaaucauuuagcucugcaugga

SEQ ID NO: 1026055 - RNA, 22 nt, Human
aguggcagaucucuggucugga

SEQ ID NO: 1026056 - RNA, 22 nt, Human
ggcacuguguacacacagagac

SEQ ID NO: 1026057 - RNA, 22 nt, Human
uuggaaagcaagcuggacauac

SEQ ID NO: 1026058 - RNA, 17 nt, Human
acacagggagagggagc

SEQ ID NO: 1026059 - RNA, 22 nt, Human
uacugcauaacuggcauguggg

SEQ ID NO: 1026060 - RNA, 22 nt, Human
ggccagagaauaugccuuacgu

SEQ ID NO: 1026061 - RNA, 22 nt, Human
ucaggcugccuaucagacugug

SEQ ID NO: 1026062 - RNA, 22 nt, Human
agcagccagugggagugauaca

SEQ ID NO: 1026063 - RNA, 17 nt, Human
aguggcaggcagauggg

SEQ ID NO: 1026064 - RNA, 22 nt, Human
cccagcuccuuggaugggcagg

SEQ ID NO: 1026065 - RNA, 22 nt, Human
ggggauggauuccgggucccug

SEQ ID NO: 1026066 - RNA, 22 nt, Human
uucaguuucagucuugcaaaaa

SEQ ID NO: 1026067 - RNA, 22 nt, Human
agcuuuauggugccucacuuga

SEQ ID NO: 1026068 - RNA, 22 nt, Human
uacaacauguaaagugguuuaa

SEQ ID NO: 1026069 - RNA, 22 nt, Human
ggcauggcucggagucagaaca

SEQ ID NO: 1026070 - RNA, 22 nt, Human
gugcauuucucauacacuaaau

SEQ ID NO: 1026071 - RNA, 22 nt, Human
agucccagaugacccagcuacu

SEQ ID NO: 1026072 - RNA, 22 nt, Human
ccacagaggacaacugccuggc

SEQ ID NO: 1026073 - RNA, 22 nt, Human
uccagugcuggaccagagcacc

SEQ ID NO: 1026074 - RNA, 22 nt, Human
gcugauccuuuuaugucuagcu

SEQ ID NO: 1026075 - RNA, 22 nt, Human
aauauaauuuuauuccuagagu

SEQ ID NO: 1026076 - RNA, 22 nt, Human
aaguccaucucugccccacaca

SEQ ID NO: 1026077 - RNA, 22 nt, Human
ugcaauaaagugcuauaaaucc

SEQ ID NO: 1026078 - RNA, 22 nt, Human
uuguccuuggaugaagcuggga

SEQ ID NO: 1026079 - RNA, 22 nt, Human
gagaggagucccuaucacaguu

SEQ ID NO: 1026080 - RNA, 20 nt, Human
cugcuguguuauuguagaac

SEQ ID NO: 1026081 - RNA, 20 nt, Human
ucagagagagggugccacuu

SEQ ID NO: 1026082 - RNA, 22 nt, Human
aucaggaugcugucaguuacca

SEQ ID NO: 1026083 - RNA, 23 nt, Human
aaaguugauuugcaguuuaagag

SEQ ID NO: 1026084 - RNA, 22 nt, Human
aagggcucugcugucucucccc

SEQ ID NO: 1026085 - RNA, 19 nt, Human
cccaaggcccugggcaggc

SEQ ID NO: 1026086 - RNA, 22 nt, Human
cuccagggaugagacagaguag

SEQ ID NO: 1026087 - RNA, 19 nt, Human
cuugguuaugguaugaugc

SEQ ID NO: 1026088 - RNA, 22 nt, Human
caguacuugggggguucuaagu

SEQ ID NO: 1026089 - RNA, 22 nt, Human
aagccagguguugugguaagag

SEQ ID NO: 1026090 - RNA, 22 nt, Human
auuucucuuagcaagacauuac

SEQ ID NO: 1026091 - RNA, 22 nt, Human
cugggcagaauuuuaggauggc

SEQ ID NO: 1026092 - RNA, 22 nt, Human
aaggcagucugguuucaaagca

SEQ ID NO: 1026093 - RNA, 22 nt, Human
ccucugagagaaggccuucagc

SEQ ID NO: 1026094 - RNA, 22 nt, Human
cagcagagcuuauguuggguca

SEQ ID NO: 1026095 - RNA, 22 nt, Human
gccuggagggauagaaugcaag

SEQ ID NO: 1026096 - RNA, 22 nt, Human
auucuucacauaagugcuguac

SEQ ID NO: 1026097 - RNA, 22 nt, Human
agccucugcuggcccuggcacu

SEQ ID NO: 1026098 - RNA, 20 nt, Human
ccugucugcaauggagguca

SEQ ID NO: 1026099 - RNA, 22 nt, Human
uaucuauuccaaauaucagcgu

SEQ ID NO: 1026100 - RNA, 22 nt, Human
uggcugcucaagggaggaggcu

SEQ ID NO: 1026101 - RNA, 22 nt, Human
guuucuuagguaaauucuuuga

SEQ ID NO: 1026102 - RNA, 22 nt, Human
gccaccucuuugucucugccgc

SEQ ID NO: 1026103 - RNA, 22 nt, Human
cuuuauguccaccagacugcaa

SEQ ID NO: 1026104 - RNA, 22 nt, Human
uacaguaacauguuguacaagc

SEQ ID NO: 1026105 - RNA, 22 nt, Human
gagcugccaguguaugaauucu

SEQ ID NO: 1026106 - RNA, 22 nt, Human
uuucuugaccacuauguugaua

SEQ ID NO: 1026107 - RNA, 22 nt, Human
gugcauuuggugacucucaccc

SEQ ID NO: 1026108 - RNA, 22 nt, Human
agagcuguuuggacaucugagu

SEQ ID NO: 1026109 - RNA, 19 nt, Human
ugaagcaauaccauuuuug

SEQ ID NO: 1026110 - RNA, 22 nt, Human
auucuucauaccuacugagguu

SEQ ID NO: 1026111 - RNA, 22 nt, Human
ugggcuggugagggaucauuua

SEQ ID NO: 1026112 - RNA, 22 nt, Human
ccuuucucuuggauaccgauug

SEQ ID NO: 1026113 - RNA, 22 nt, Human
uauuuagaugcauuuggauugc

SEQ ID NO: 1026114 - RNA, 22 nt, Human
gaugugggguugagggaccagc

SEQ ID NO: 1026115 - RNA, 21 nt, Human
uggcccuggccacggcugcca

SEQ ID NO: 1026116 - RNA, 22 nt, Human
agccuggagguaaugaggaaac

SEQ ID NO: 1026117 - RNA, 22 nt, Human
gagccagcgccuugccucuggg

SEQ ID NO: 1026118 - RNA, 22 nt, Human
agcagccacagucugggacagg

SEQ ID NO: 1026119 - RNA, 22 nt, Human
ggcuggguuauuuauggccaag

SEQ ID NO: 1026120 - RNA, 22 nt, Human
gagggaccuuuacacagacauu

SEQ ID NO: 1026121 - RNA, 19 nt, Human
ugucccagacuccgugucu

SEQ ID NO: 1026122 - RNA, 22 nt, Human
uuuacuuuugguaaggucauuu

SEQ ID NO: 1026123 - RNA, 22 nt, Human
aaauuauaggugccaccuugga

SEQ ID NO: 1026124 - RNA, 22 nt, Human
ucucucuugucaccccaucugc

SEQ ID NO: 1026125 - RNA, 22 nt, Human
uauuucccagggagcaacaagc

SEQ ID NO: 1026126 - RNA, 22 nt, Human
agaccacagucaggcuccuggu

SEQ ID NO: 1026127 - RNA, 21 nt, Human
uccugcaggaggccugagagg

SEQ ID NO: 1026128 - RNA, 22 nt, Human
ugcauaguucuccuuccuccuc

SEQ ID NO: 1026129 - RNA, 22 nt, Human
gaaggccacggaauggagcugg

SEQ ID NO: 1026130 - RNA, 17 nt, Human
uuccaguuuaguauugu

SEQ ID NO: 1026131 - RNA, 22 nt, Human
cccacucccugcacgccugccg

SEQ ID NO: 1026132 - RNA, 22 nt, Human
ggaggccacgguuuagcaccga

SEQ ID NO: 1026133 - RNA, 22 nt, Human
cacauauuguaguucaccagga

SEQ ID NO: 1026134 - RNA, 22 nt, Human
ugagccagucugucugggugaa

SEQ ID NO: 1026135 - RNA, 22 nt, Human
cuagguauucauguuucguggc

SEQ ID NO: 1026136 - RNA, 22 nt, Human
aacaucuuuuuguuugcugaaa

SEQ ID NO: 1026137 - RNA, 22 nt, Human
uugaaagacuucuccugugaaa

SEQ ID NO: 1026138 - RNA, 19 nt, Human
ucuuucauuucuagcucug

SEQ ID NO: 1026139 - RNA, 22 nt, Human
aacauucugguucuaaaaaccu

SEQ ID NO: 1026140 - RNA, 22 nt, Human
agguauaagucucauuucuguu

SEQ ID NO: 1026141 - RNA, 22 nt, Human
ucagagugugagacauauugga

SEQ ID NO: 1026142 - RNA, 21 nt, Human
ugggcacugagggugcugcuc

SEQ ID NO: 1026143 - RNA, 22 nt, Human
uguauaaauuuaaauuccugcu

SEQ ID NO: 1026144 - RNA, 22 nt, Human
cagagccuuccuagcagacucu

SEQ ID NO: 1026145 - RNA, 22 nt, Human
ccuggcucucugcagauccugg

SEQ ID NO: 1026146 - RNA, 22 nt, Human
ugugccagccucuggcuguguc

SEQ ID NO: 1026147 - RNA, 22 nt, Human
gccugcagggugaugggcugcc

SEQ ID NO: 1026148 - RNA, 22 nt, Human
guguuccauguuugagguaguu

SEQ ID NO: 1026149 - RNA, 22 nt, Human
uggccuugggcagguggccugc

SEQ ID NO: 1026150 - RNA, 22 nt, Human
cccugaggggaguggugaggug

SEQ ID NO: 1026151 - RNA, 22 nt, Human
agucccaggcagccgagccggu

SEQ ID NO: 1026152 - RNA, 22 nt, Human
uuuccucuuuguaccuugacua

SEQ ID NO: 1026153 - RNA, 22 nt, Human
cccaccaguacagaugguagau

SEQ ID NO: 1026154 - RNA, 22 nt, Human
caggagacaaguuagcagcuga

SEQ ID NO: 1026155 - RNA, 22 nt, Human
aucaaaaugcuccagugauggu

SEQ ID NO: 1026156 - RNA, 22 nt, Human
ucuuggagaauggcagagaagc

SEQ ID NO: 1026157 - RNA, 22 nt, Human
uuuuuccuuggaugugucucuc

SEQ ID NO: 1026158 - RNA, 22 nt, Human
ucuuuguaaaugccuagcauaa

SEQ ID NO: 1026159 - RNA, 22 nt, Human
ggccagggccuggggacugucc

SEQ ID NO: 1026160 - RNA, 22 nt, Human
ugcaggugaaaauuaugaggau

SEQ ID NO: 1026161 - RNA, 22 nt, Human
auuagagguacaaaccuucacu

SEQ ID NO: 1026162 - RNA, 22 nt, Human
cucuggagguugagcccagcaa

SEQ ID NO: 1026163 - RNA, 22 nt, Human
ucugggaaguccucugucaugc

SEQ ID NO: 1026164 - RNA, 22 nt, Human
guggccaggccgacugccaggc

SEQ ID NO: 1026165 - RNA, 22 nt, Human
accaggcaacugugaaugggcu

SEQ ID NO: 1026166 - RNA, 21 nt, Human
uggagacucugguucuuugug

SEQ ID NO: 1026167 - RNA, 22 nt, Human
agcccagcagaaaguccagccu

SEQ ID NO: 1026168 - RNA, 22 nt, Human
ucagggugaaccaggcaggaau

SEQ ID NO: 1026169 - RNA, 22 nt, Human
aguaugaaucucuuuauucugc

SEQ ID NO: 1026170 - RNA, 21 nt, Human
guccaguggaggaggacagga

SEQ ID NO: 1026171 - RNA, 22 nt, Human
caucagcacuaugauuaaagua

SEQ ID NO: 1026172 - RNA, 22 nt, Human
uggcucaggccuacgacgccuu

SEQ ID NO: 1026173 - RNA, 22 nt, Human
caucucaugggcaugccaagcu

SEQ ID NO: 1026174 - RNA, 22 nt, Human
agucucagaguaccugagggac

SEQ ID NO: 1026175 - RNA, 22 nt, Human
ugaagacacauacaagggaaug

SEQ ID NO: 1026176 - RNA, 22 nt, Human
auacaaguugugauaauguaaa

SEQ ID NO: 1026177 - RNA, 22 nt, Human
gcugagcuagaaaaggaccaca

SEQ ID NO: 1026178 - RNA, 22 nt, Human
caugaaugcuggguucauguaa

SEQ ID NO: 1026179 - RNA, 22 nt, Human
ggcugggcaaacaagacucuuc

SEQ ID NO: 1026180 - RNA, 22 nt, Human
ugggaggcagguaggugaugau

SEQ ID NO: 1026181 - RNA, 22 nt, Human
gcucccucugcucaggcacuug

SEQ ID NO: 1026182 - RNA, 22 nt, Human
gagcacugaggaaagcugguua

SEQ ID NO: 1026183 - RNA, 22 nt, Human
ucaguuuucaauuucaucagag

SEQ ID NO: 1026184 - RNA, 22 nt, Human
agguggagaagagaugggcagu

SEQ ID NO: 1026185 - RNA, 22 nt, Human
cagcagagcugugugggaaggg

SEQ ID NO: 1026186 - RNA, 22 nt, Human
ucccagagauuuccucuccuuc

SEQ ID NO: 1026187 - RNA, 19 nt, Human
aucagcaagguaggaugug

SEQ ID NO: 1026188 - RNA, 22 nt, Human
ccuguucacccuccaugcacag

SEQ ID NO: 1026189 - RNA, 22 nt, Human
cuccagggaggucugcaggacu

SEQ ID NO: 1026190 - RNA, 22 nt, Human
ugaagacagaccaaggagaaug

SEQ ID NO: 1026191 - RNA, 22 nt, Human
ugcuggccaacaaggcuccaag

SEQ ID NO: 1026192 - RNA, 22 nt, Human
ucagggacgugagcucagaguc

SEQ ID NO: 1026193 - RNA, 22 nt, Human
ccaggccuggaccaugccaggg

SEQ ID NO: 1026194 - RNA, 22 nt, Human
ccucuuugugccugcaggcugc

SEQ ID NO: 1026195 - RNA, 22 nt, Human
uauuuuaaagugaagggucuug

SEQ ID NO: 1026196 - RNA, 22 nt, Human
guuuggggucugcagagcggcg

SEQ ID NO: 1026197 - RNA, 22 nt, Human
agugaaauugcuguaagaggaa

SEQ ID NO: 1026198 - RNA, 22 nt, Human
acugggccuugccauggcagcc

SEQ ID NO: 1026199 - RNA, 22 nt, Human
guggcagcugguaugcagacag

SEQ ID NO: 1026200 - RNA, 22 nt, Human
augggaggaagagaagaugucu

SEQ ID NO: 1026201 - RNA, 22 nt, Human
uguaugcaaauuuauuagcaca

SEQ ID NO: 1026202 - RNA, 22 nt, Human
gcagggacgcagcacucuccgu

SEQ ID NO: 1026203 - RNA, 22 nt, Human
cagggcuguaaauuagugcuga

SEQ ID NO: 1026204 - RNA, 22 nt, Human
ccaggcagcucugauuuauguc

SEQ ID NO: 1026205 - RNA, 22 nt, Human
ggcucuggcguccaauggagcg

SEQ ID NO: 1026206 - RNA, 22 nt, Human
cugggugguucuaacuguugau

SEQ ID NO: 1026207 - RNA, 22 nt, Human
auugacaauuagcccuuaggug

SEQ ID NO: 1026208 - RNA, 23 nt, Human
cacugggcccaggguguggaggc

SEQ ID NO: 1026209 - RNA, 22 nt, Human
gcagcugaauguccauugcugc

SEQ ID NO: 1026210 - RNA, 22 nt, Human
ggcucccugccuguccucaguc

SEQ ID NO: 1026211 - RNA, 22 nt, Human
cagcaaucgggugauaugcaau

SEQ ID NO: 1026212 - RNA, 22 nt, Human
auuuccuagccucucuugcagu

SEQ ID NO: 1026213 - RNA, 22 nt, Human
agccacagcauguguguaugua

SEQ ID NO: 1026214 - RNA, 23 nt, Human
uucauuugucuacuucacuuguu

SEQ ID NO: 1026215 - RNA, 22 nt, Human
ugucaacacaccuaucucaauu

SEQ ID NO: 1026216 - RNA, 22 nt, Human
ccugugggagggagcggcugga

SEQ ID NO: 1026217 - RNA, 22 nt, Human
aagggcaggcacccacccucac

SEQ ID NO: 1026218 - RNA, 22 nt, Human
uggugccuugggccuacagcgc

SEQ ID NO: 1026219 - RNA, 22 nt, Human
gccugccuagaauugcagcuuu

SEQ ID NO: 1026220 - RNA, 22 nt, Human
cccuucagcugagugggacagc

SEQ ID NO: 1026221 - RNA, 22 nt, Human
gaagagcuuaguuguccuagaa

SEQ ID NO: 1026222 - RNA, 22 nt, Human
cccaggaguuugaguucagcau

SEQ ID NO: 1026223 - RNA, 22 nt, Human
uauuucuguaacucagggucug

SEQ ID NO: 1026224 - RNA, 22 nt, Human
auaaggcaagcugucaguuugu

SEQ ID NO: 1026225 - RNA, 22 nt, Human
aaacuuuaagacaguccucaag

SEQ ID NO: 1026226 - RNA, 22 nt, Human
ucagaagaagagacuccacagc

SEQ ID NO: 1026227 - RNA, 22 nt, Human
aggugcagaaaaaaguccuuua

SEQ ID NO: 1026228 - RNA, 19 nt, Human
gcucugagaggggcauggg

SEQ ID NO: 1026229 - RNA, 22 nt, Human
guuugcauauuugcacaggaau

SEQ ID NO: 1026230 - RNA, 22 nt, Human
ucacagaaauaagauaguuauu

SEQ ID NO: 1026231 - RNA, 22 nt, Human
aaggaccuauauugucagagga

SEQ ID NO: 1026232 - RNA, 22 nt, Human
gagagcuggccagcuucaguau

SEQ ID NO: 1026233 - RNA, 22 nt, Human
aacagcagggggaccugcuggu

SEQ ID NO: 1026234 - RNA, 22 nt, Human
cuguuuauacgacagguggagg

SEQ ID NO: 1026235 - RNA, 22 nt, Human
auuucucaguuccuacuguuua

SEQ ID NO: 1026236 - RNA, 22 nt, Human
auucugucuuuuuaaaauaaua

SEQ ID NO: 1026237 - RNA, 22 nt, Human
gcaaaugcuaaaguguagagac

SEQ ID NO: 1026238 - RNA, 22 nt, Human
gagucccaugaugauagccaca

SEQ ID NO: 1026239 - RNA, 22 nt, Human
aacaggcaggagaauucugccu

SEQ ID NO: 1026240 - RNA, 22 nt, Human
gugcagggagcccagaaggucc

SEQ ID NO: 1026241 - RNA, 22 nt, Human
ucuuagaaguucauguuccagc

SEQ ID NO: 1026242 - RNA, 20 nt, Human
uaucaaucagaaagaagacu

SEQ ID NO: 1026243 - RNA, 22 nt, Human
cugagcuggucuauggacuugg

SEQ ID NO: 1026244 - RNA, 22 nt, Human
cugggcuguucugccccugggu

SEQ ID NO: 1026245 - RNA, 22 nt, Human
caggaacacaaguucagggaug

SEQ ID NO: 1026246 - RNA, 22 nt, Human
ugucagagagcaggcaguagaa

SEQ ID NO: 1026247 - RNA, 22 nt, Human
gugcagugaaaaaagaaugucc

SEQ ID NO: 1026248 - RNA, 22 nt, Human
ccugcuguaaugugucuuuauu

SEQ ID NO: 1026249 - RNA, 22 nt, Human
agugcagccgagaucaggugcu

SEQ ID NO: 1026250 - RNA, 22 nt, Human
ggcucugcuucagaaggcucau

SEQ ID NO: 1026251 - RNA, 22 nt, Human
ucaucuugcugccauugcuuua

SEQ ID NO: 1026252 - RNA, 22 nt, Human
ucugcagauuuaucagcagcug

SEQ ID NO: 1026253 - RNA, 23 nt, Human
uuugcaaauuggacacaaccaca

SEQ ID NO: 1026254 - RNA, 22 nt, Human
gaggccuggagccgccuaggcg

SEQ ID NO: 1026255 - RNA, 22 nt, Human
uuguauuagcuguaaauuuucu

SEQ ID NO: 1026256 - RNA, 22 nt, Human
guuuauuaacugucaagugauu

SEQ ID NO: 1026257 - RNA, 22 nt, Human
uagcugcugcagcacagggagg

SEQ ID NO: 1026258 - RNA, 20 nt, Human
gcucccugguagaaauguuu

SEQ ID NO: 1026259 - RNA, 22 nt, Human
ucacagacaauuguuuuggugu

SEQ ID NO: 1026260 - RNA, 22 nt, Human
cagggccacccucugcugggug

SEQ ID NO: 1026261 - RNA, 22 nt, Human
uuauacuaaaacgcauugaauu

SEQ ID NO: 1026262 - RNA, 22 nt, Human
uagccucuggaauccuuucucu

SEQ ID NO: 1026263 - RNA, 22 nt, Human
gcaggauggugcccuuucugcc

SEQ ID NO: 1026264 - RNA, 22 nt, Human
uggagggaacccaggcugcucu

SEQ ID NO: 1026265 - RNA, 22 nt, Human
gaacccaguccaggugcagccu

SEQ ID NO: 1026266 - RNA, 22 nt, Human
uuucagaugcaauuaauuuuca

SEQ ID NO: 1026267 - RNA, 22 nt, Human
gccuccugguugcuucuccaac

SEQ ID NO: 1026268 - RNA, 22 nt, Human
gcagccaggaaagcuggacccu

SEQ ID NO: 1026269 - RNA, 22 nt, Human
gaagcagcuuucuggugaggag

SEQ ID NO: 1026270 - RNA, 22 nt, Human
agcccaggucuggcccagccug

SEQ ID NO: 1026271 - RNA, 22 nt, Human
gagggcugauaacaggaauaca

SEQ ID NO: 1026272 - RNA, 22 nt, Human
aacaaauguguuuuguaauuaa

SEQ ID NO: 1026273 - RNA, 22 nt, Human
ucucagggaccaugaugaugac

SEQ ID NO: 1026274 - RNA, 23 nt, Human
ugacacauuuccuuuccacugca

SEQ ID NO: 1026275 - RNA, 22 nt, Human
ggagcugcucagagccaguccc

SEQ ID NO: 1026276 - RNA, 22 nt, Human
ccacagggaacaugacagccuu

SEQ ID NO: 1026277 - RNA, 22 nt, Human
gagccuucaucgcagccuuguu

SEQ ID NO: 1026278 - RNA, 20 nt, Human
cucaguguggccugaguguu

SEQ ID NO: 1026279 - RNA, 21 nt, Human
aguugcauaggccagccaucc

SEQ ID NO: 1026280 - RNA, 22 nt, Human
uaggccagcccuuaguccuguc

SEQ ID NO: 1026281 - RNA, 22 nt, Human
augagacuaccuguaauguggc

SEQ ID NO: 1026282 - RNA, 22 nt, Human
guaugaaaauuguaaaguucuu

SEQ ID NO: 1026283 - RNA, 22 nt, Human
gcagauggaaagugcuugaggg

SEQ ID NO: 1026284 - RNA, 22 nt, Human
acauguuagaaaugcagaaucu

SEQ ID NO: 1026285 - RNA, 22 nt, Human
ugugaggagaggcccagcuccc

SEQ ID NO: 1026286 - RNA, 21 nt, Human
gcucccuggcugugugaccug

SEQ ID NO: 1026287 - RNA, 22 nt, Human
gccugagauucugcauuucuaa

SEQ ID NO: 1026288 - RNA, 22 nt, Human
acaggggauugauuggaagucu

SEQ ID NO: 1026289 - RNA, 23 nt, Human
ugcagccacucaggagcucagug

SEQ ID NO: 1026290 - RNA, 22 nt, Human
aaacuucauggauaauauaaag

SEQ ID NO: 1026291 - RNA, 23 nt, Human
ucccagggaaggugagcgaggcu

SEQ ID NO: 1026292 - RNA, 22 nt, Human
aauuaacaaauguagcugugau

SEQ ID NO: 1026293 - RNA, 22 nt, Human
aguguguccagaaaucuguauu

SEQ ID NO: 1026294 - RNA, 22 nt, Human
ucuuuucuggacucugcaugga

SEQ ID NO: 1026295 - RNA, 22 nt, Human
cucaguuucuucauauuguagg

SEQ ID NO: 1026296 - RNA, 22 nt, Human
uucacuuauagggauguuauug

SEQ ID NO: 1026297 - RNA, 22 nt, Human
cacaggagagcugggaggugcc

SEQ ID NO: 1026298 - RNA, 22 nt, Human
ggaggaugccaagcugugcaca

SEQ ID NO: 1026299 - RNA, 22 nt, Human
aagggcucucugcauugaaauu

SEQ ID NO: 1026300 - RNA, 22 nt, Human
accauuugacucucuaaggaua

SEQ ID NO: 1026301 - RNA, 22 nt, Human
caaauucucuuacuguuugaca

SEQ ID NO: 1026302 - RNA, 21 nt, Human
cucaaagaccaaaaguguaga

SEQ ID NO: 1026303 - RNA, 22 nt, Human
agucccaguucgguucuuccuc

SEQ ID NO: 1026304 - RNA, 22 nt, Human
gggcucuguccauuccuucaua

SEQ ID NO: 1026305 - RNA, 22 nt, Human
gcaagcuggcuguuagaggaug

SEQ ID NO: 1026306 - RNA, 22 nt, Human
ucuguucauuugccucggcucu

SEQ ID NO: 1026307 - RNA, 22 nt, Human
gagggagagugauggaccauug

SEQ ID NO: 1026308 - RNA, 22 nt, Human
augugaggaagaaagagguaag

SEQ ID NO: 1026309 - RNA, 22 nt, Human
agagccuguacuuuucugugaa

SEQ ID NO: 1026310 - RNA, 22 nt, Human
augaaggcuguguagauggaug

SEQ ID NO: 1026311 - RNA, 22 nt, Human
cagguggggcgcccucaggcag

SEQ ID NO: 1026312 - RNA, 22 nt, Human
gcagggugccgacuucagggau

SEQ ID NO: 1026313 - RNA, 22 nt, Human
cccacucuggcucccuucuagu

SEQ ID NO: 1026314 - RNA, 22 nt, Human
uggcucagugaagagauaacuu

SEQ ID NO: 1026315 - RNA, 22 nt, Human
guauuagguuggugcaaaauug

SEQ ID NO: 1026316 - RNA, 22 nt, Human
cucacugacgaggaagcugaga

SEQ ID NO: 1026317 - RNA, 22 nt, Human
aucacaggugguaggaaaagaa

SEQ ID NO: 1026318 - RNA, 22 nt, Human
aguccaugguucugacucaucu

SEQ ID NO: 1026319 - RNA, 22 nt, Human
gcucccuccaugaggcagaccg

SEQ ID NO: 1026320 - RNA, 19 nt, Human
aggacucuggaggcaugag

SEQ ID NO: 1026321 - RNA, 22 nt, Human
gcuggccugaccagccacaggc

SEQ ID NO: 1026322 - RNA, 22 nt, Human
uaaauucuacaacuucaaagau

SEQ ID NO: 1026323 - RNA, 22 nt, Human
agaacagcagcacgucaagcug

SEQ ID NO: 1026324 - RNA, 22 nt, Human
cagcccuguccagcagagggug

SEQ ID NO: 1026325 - RNA, 22 nt, Human
cuggcagcuuccuuugcaucug

SEQ ID NO: 1026326 - RNA, 19 nt, Human
uccuucagucagaucuggg

SEQ ID NO: 1026327 - RNA, 22 nt, Human
aaucucuuuggcucaaggaucc

SEQ ID NO: 1026328 - RNA, 22 nt, Human
ccuguggggccaucucagucac

SEQ ID NO: 1026329 - RNA, 22 nt, Human
guaucacuuuugagagugagaa

SEQ ID NO: 1026330 - RNA, 22 nt, Human
cccauuuaaacacaagcuuuca

SEQ ID NO: 1026331 - RNA, 22 nt, Human
aauccaggguguggccuuucca

SEQ ID NO: 1026332 - RNA, 22 nt, Human
uccugugccuccaccugcuccg

SEQ ID NO: 1026333 - RNA, 22 nt, Human
agcugcaguaaagcucuccagg

SEQ ID NO: 1026334 - RNA, 21 nt, Human
ccuggcuucagggugcacugg

SEQ ID NO: 1026335 - RNA, 22 nt, Human
gcagcugggccccagccucucc

SEQ ID NO: 1026336 - RNA, 22 nt, Human
gccugggaacucugaucuccug

SEQ ID NO: 1026337 - RNA, 22 nt, Human
cucaggaaaggccaugcaaggg

SEQ ID NO: 1026338 - RNA, 22 nt, Human
agaaaaggcuugaagagguuuu

SEQ ID NO: 1026339 - RNA, 19 nt, Human
aucugccuuagugcugcug

SEQ ID NO: 1026340 - RNA, 22 nt, Human
gguaaaaugcagauucuuagcc

SEQ ID NO: 1026341 - RNA, 22 nt, Human
uuugacaaaggaaaaaugcaca

SEQ ID NO: 1026342 - RNA, 22 nt, Human
ccugggugaugugcugcccucg

SEQ ID NO: 1026343 - RNA, 22 nt, Human
ugggcacaggggaauggaugaa

SEQ ID NO: 1026344 - RNA, 22 nt, Human
agggcacaucugcugggaaugg

SEQ ID NO: 1026345 - RNA, 22 nt, Human
gaauaguucuauggcugcaggg

SEQ ID NO: 1026346 - RNA, 22 nt, Human
cugcagggaugugaggcccguu

SEQ ID NO: 1026347 - RNA, 22 nt, Human
uuucugaaaucucuuuugagga

SEQ ID NO: 1026348 - RNA, 19 nt, Human
uggcagggagugauauuag

SEQ ID NO: 1026349 - RNA, 22 nt, Human
ggcuuggaccagucacaguggu

SEQ ID NO: 1026350 - RNA, 19 nt, Human
ccaggccuggcgucuccgc

SEQ ID NO: 1026351 - RNA, 22 nt, Human
ccagcugggauuaagggaaaau

SEQ ID NO: 1026352 - RNA, 22 nt, Human
aaggcaguagguguuucaaacu

SEQ ID NO: 1026353 - RNA, 19 nt, Human
agaaucaggucaggugaca

SEQ ID NO: 1026354 - RNA, 22 nt, Human
auguaucagauaaagcaugugg

SEQ ID NO: 1026355 - RNA, 22 nt, Human
ugggacagagugagcuuuggcc

SEQ ID NO: 1026356 - RNA, 22 nt, Human
ucuccuuugaaaguuaggacug

SEQ ID NO: 1026357 - RNA, 22 nt, Human
gccuuggcugaugugcgaauga

SEQ ID NO: 1026358 - RNA, 22 nt, Human
uaaaauguuugcaagagaccag

SEQ ID NO: 1026359 - RNA, 22 nt, Human
accucugcaacccuggaauggg

SEQ ID NO: 1026360 - RNA, 22 nt, Human
caguggccaugguggcaggggu

SEQ ID NO: 1026361 - RNA, 22 nt, Human
gcugccuggcuuuaguccacuu

SEQ ID NO: 1026362 - RNA, 22 nt, Human
cccucugaccuccugccacagu

SEQ ID NO: 1026363 - RNA, 22 nt, Human
gaggagagagggacugucugca

SEQ ID NO: 1026364 - RNA, 22 nt, Human
uaggcugggagccugaggcuag

SEQ ID NO: 1026365 - RNA, 22 nt, Human
ugggccuguggcuuggcucuag

SEQ ID NO: 1026366 - RNA, 22 nt, Human
gcuugggacuggagaauagggu

SEQ ID NO: 1026367 - RNA, 22 nt, Human
gguggguauugaauacaggugu

SEQ ID NO: 1026368 - RNA, 22 nt, Human
guggcuucuggcugggccucag

SEQ ID NO: 1026369 - RNA, 22 nt, Human
ucccugcucagcucaccuggca

SEQ ID NO: 1026370 - RNA, 21 nt, Human
auuuucauuaauucagugugg

SEQ ID NO: 1026371 - RNA, 22 nt, Human
gccaggugggagacagacagca

SEQ ID NO: 1026372 - RNA, 20 nt, Human
aaaaucucccagaaacuuau

SEQ ID NO: 1026373 - RNA, 22 nt, Human
agcagcugucccuuaacaucag

SEQ ID NO: 1026374 - RNA, 22 nt, Human
agacccucuccaugcccacugc

SEQ ID NO: 1026375 - RNA, 22 nt, Human
ugggcucauggcccagcacugg

SEQ ID NO: 1026376 - RNA, 22 nt, Human
uggcagccaucugagggugggg

SEQ ID NO: 1026377 - RNA, 22 nt, Human
gaacuguaguuaauacuacaca

SEQ ID NO: 1026378 - RNA, 22 nt, Human
cugggguggugcaggccucaug

SEQ ID NO: 1026379 - RNA, 22 nt, Human
ugaagaugucagcagggguggu

SEQ ID NO: 1026380 - RNA, 22 nt, Human
agggaagaagcugguaguaggu

SEQ ID NO: 1026381 - RNA, 22 nt, Human
auuagggaaggauuuggccuga

SEQ ID NO: 1026382 - RNA, 22 nt, Human
uggagcugguaaacagugacau

SEQ ID NO: 1026383 - RNA, 22 nt, Human
caaagugcuaggauuacaggcc

SEQ ID NO: 1026384 - RNA, 22 nt, Human
uucagcaaauggacuguucagg

SEQ ID NO: 1026385 - RNA, 22 nt, Human
guuuacaaauauuuuaaauggu

SEQ ID NO: 1026386 - RNA, 22 nt, Human
cugcucuggcguacucggcauc

SEQ ID NO: 1026387 - RNA, 21 nt, Human
agccugcaauguagguaccgg

SEQ ID NO: 1026388 - RNA, 22 nt, Human
ggcugcugguggaaugguaggc

SEQ ID NO: 1026389 - RNA, 22 nt, Human
cccuggaggcaaagguugcagu

SEQ ID NO: 1026390 - RNA, 22 nt, Human
cggcagagacggcgcuuugaac

SEQ ID NO: 1026391 - RNA, 22 nt, Human
cccuggaggcggauguugcagu

SEQ ID NO: 1026392 - RNA, 22 nt, Human
cugggacacccagagcugcaga

SEQ ID NO: 1026393 - RNA, 19 nt, Human
acaaagcugugagcagcuu

SEQ ID NO: 1026394 - RNA, 21 nt, Human
ucacaugcccauuacuggagc

SEQ ID NO: 1026395 - RNA, 22 nt, Human
agccaggauuggcugagccuua

SEQ ID NO: 1026396 - RNA, 22 nt, Human
cagggccacuguagaugaggag

SEQ ID NO: 1026397 - RNA, 22 nt, Human
acagagagaaacaaucagcagc

SEQ ID NO: 1026398 - RNA, 20 nt, Human
agaguaacuggcacauaggg

SEQ ID NO: 1026399 - RNA, 22 nt, Human
ggcuuuaucaaaugagacccug

SEQ ID NO: 1026400 - RNA, 22 nt, Human
uggcucagagcagggacucugg

SEQ ID NO: 1026401 - RNA, 22 nt, Human
uaagaacaagauguuccuguuu

SEQ ID NO: 1026402 - RNA, 22 nt, Human
aagcugccagauucagucugcu

SEQ ID NO: 1026403 - RNA, 22 nt, Human
uaagauaugguaggaaguuugg

SEQ ID NO: 1026404 - RNA, 22 nt, Human
ugcuagaaaucugaaacuagca

SEQ ID NO: 1026405 - RNA, 22 nt, Human
uugaaucuauguauucagugua

SEQ ID NO: 1026406 - RNA, 22 nt, Human
cagagaaagggugaauuccuuc

SEQ ID NO: 1026407 - RNA, 22 nt, Human
gaggccuuagagcuuuucuaga

SEQ ID NO: 1026408 - RNA, 22 nt, Human
uacaaacuuguuuuaaguaagu

SEQ ID NO: 1026409 - RNA, 18 nt, Human
cagaugagaugcaaucuc

SEQ ID NO: 1026410 - RNA, 22 nt, Human
cucagcccagcccaggaccagg

SEQ ID NO: 1026411 - RNA, 22 nt, Human
aauuugauuuucuuaaaccaua

SEQ ID NO: 1026412 - RNA, 23 nt, Human
ucuccagugucucuucauugagu

SEQ ID NO: 1026413 - RNA, 22 nt, Human
agccucucuuucugguggcuaa

SEQ ID NO: 1026414 - RNA, 22 nt, Human
ucagaagcaaacaucacucuag

SEQ ID NO: 1026415 - RNA, 22 nt, Human
agaggggcucaagcaguggucu

SEQ ID NO: 1026416 - RNA, 22 nt, Human
gccugcagccucaagggcugag

SEQ ID NO: 1026417 - RNA, 22 nt, Human
accacaggaauugcucuguggu

SEQ ID NO: 1026418 - RNA, 22 nt, Human
cuacagacccaccuuggaagaa

SEQ ID NO: 1026419 - RNA, 19 nt, Human
cucuuaaauugucucuugc

SEQ ID NO: 1026420 - RNA, 18 nt, Human
uuugcaaaggaaguaugg

SEQ ID NO: 1026421 - RNA, 22 nt, Human
ugauuuccaaaaggcuucuaag

SEQ ID NO: 1026422 - RNA, 22 nt, Human
uugauacagcagccugugaucc

SEQ ID NO: 1026423 - RNA, 22 nt, Human
agagcuguucagcagccagguu

SEQ ID NO: 1026424 - RNA, 22 nt, Human
ugaaaugagcauuuauucuuua

SEQ ID NO: 1026425 - RNA, 22 nt, Human
uccugcagccuugggcuggagc

SEQ ID NO: 1026426 - RNA, 22 nt, Human
uuccuuaggcuguuugcagugc

SEQ ID NO: 1026427 - RNA, 22 nt, Human
uuagaaaaaggcuguggucuua

SEQ ID NO: 1026428 - RNA, 22 nt, Human
aaucagaauuuauugaaucuuu

SEQ ID NO: 1026429 - RNA, 22 nt, Human
guguuuuaucagacaaaguaua

SEQ ID NO: 1026430 - RNA, 22 nt, Human
ucugcgcugccuugauccuugg

SEQ ID NO: 1026431 - RNA, 22 nt, Human
ggccucuggcaggcaggcccuc

SEQ ID NO: 1026432 - RNA, 22 nt, Human
guggccugggguuuguucugag

SEQ ID NO: 1026433 - RNA, 22 nt, Human
ggugacuggagggacccaggcc

SEQ ID NO: 1026434 - RNA, 21 nt, Human
agucccaggggugagugaugu

SEQ ID NO: 1026435 - RNA, 22 nt, Human
ccugccaggccagugagcuucc

SEQ ID NO: 1026436 - RNA, 22 nt, Human
cugggagcaagucaggaaaggu

SEQ ID NO: 1026437 - RNA, 22 nt, Human
acccugccgugggcugcuugug

SEQ ID NO: 1026438 - RNA, 22 nt, Human
agcuuccuacaaccaucucaga

SEQ ID NO: 1026439 - RNA, 22 nt, Human
uggcugugaacaaagagaauaa

SEQ ID NO: 1026440 - RNA, 23 nt, Human
aggagccaggugcagcccuugug

SEQ ID NO: 1026441 - RNA, 22 nt, Human
ccugggaggcagagguugcagu

SEQ ID NO: 1026442 - RNA, 22 nt, Human
agcugcugcgccucacccuggc

SEQ ID NO: 1026443 - RNA, 22 nt, Human
ccagugcuaagguagccucugc

SEQ ID NO: 1026444 - RNA, 22 nt, Human
gcagaggcaaucagguaugugg

SEQ ID NO: 1026445 - RNA, 22 nt, Human
cuuagaaaucgaacucagguua

SEQ ID NO: 1026446 - RNA, 22 nt, Human
aggccugaaggaagaugagcug

SEQ ID NO: 1026447 - RNA, 22 nt, Human
uccugcagcucugagaagcauc

SEQ ID NO: 1026448 - RNA, 23 nt, Human
acagacaacacugaugagagaaa

SEQ ID NO: 1026449 - RNA, 22 nt, Human
gcaggagcagucaggggcagcu

SEQ ID NO: 1026450 - RNA, 22 nt, Human
aaguucaagaucaagguuccag

SEQ ID NO: 1026451 - RNA, 22 nt, Human
cccaucaggaacccaggagccc

SEQ ID NO: 1026452 - RNA, 22 nt, Human
ugagugccugaacauagaguag

SEQ ID NO: 1026453 - RNA, 22 nt, Human
ucccagggacucucugccuucc

SEQ ID NO: 1026454 - RNA, 22 nt, Human
aauuagggagagguagcuaggu

SEQ ID NO: 1026455 - RNA, 22 nt, Human
ucuggcucuauaacuccuagcu

SEQ ID NO: 1026456 - RNA, 22 nt, Human
auuucacucuuaauugcuuccu

SEQ ID NO: 1026457 - RNA, 22 nt, Human
aggacccugagcgggcaugccg

SEQ ID NO: 1026458 - RNA, 22 nt, Human
agcaggaggguuuuguagaguc

SEQ ID NO: 1026459 - RNA, 22 nt, Human
cagcauggggaucacuguaggc

SEQ ID NO: 1026460 - RNA, 22 nt, Human
gcucucuuuuuccagugguggu

SEQ ID NO: 1026461 - RNA, 20 nt, Human
uccagccacuuccgcugguc

SEQ ID NO: 1026462 - RNA, 22 nt, Human
aagccagggucaggggccuccu

SEQ ID NO: 1026463 - RNA, 18 nt, Human
uggcagggaggaaauaua

SEQ ID NO: 1026464 - RNA, 22 nt, Human
ccauuguaguaucuguuuuagu

SEQ ID NO: 1026465 - RNA, 22 nt, Human
gcucagagaaucagcagacacc

SEQ ID NO: 1026466 - RNA, 23 nt, Human
cagggcugguagggaagagcgug

SEQ ID NO: 1026467 - RNA, 22 nt, Human
gugccugugccaggggugugcu

SEQ ID NO: 1026468 - RNA, 22 nt, Human
aguccggggucuggacaccugg

SEQ ID NO: 1026469 - RNA, 22 nt, Human
ugggcacuggaagccugcugug

SEQ ID NO: 1026470 - RNA, 22 nt, Human
acguuuucagccuuaauguaga

SEQ ID NO: 1026471 - RNA, 22 nt, Human
cagccaggacagggaaacuagu

SEQ ID NO: 1026472 - RNA, 22 nt, Human
aggcugggaaauguagucuucc

SEQ ID NO: 1026473 - RNA, 19 nt, Human
ucaggacugacuugaaguc

SEQ ID NO: 1026474 - RNA, 22 nt, Human
uauuuguauuucaugcaguaaa

SEQ ID NO: 1026475 - RNA, 22 nt, Human
caaauacuaaacauaagauuuu

SEQ ID NO: 1026476 - RNA, 22 nt, Human
acucaggagggaucagcuauca

SEQ ID NO: 1026477 - RNA, 22 nt, Human
uacacacaugcauuugccuuau

SEQ ID NO: 1026478 - RNA, 22 nt, Human
ugaacauauucaccucuaaaua

SEQ ID NO: 1026479 - RNA, 22 nt, Human
auccuugaacuuagacacuagg

SEQ ID NO: 1026480 - RNA, 22 nt, Human
uucauuacugcgguagucacac

SEQ ID NO: 1026481 - RNA, 22 nt, Human
cccagcagccagaaugaggagc

SEQ ID NO: 1026482 - RNA, 22 nt, Human
ggcuuuauguuuuucauguggu

SEQ ID NO: 1026483 - RNA, 22 nt, Human
caggcacucauucagagaggug

SEQ ID NO: 1026484 - RNA, 22 nt, Human
uuuaauuuguauuucuagaggg

SEQ ID NO: 1026485 - RNA, 22 nt, Human
ugcugagcgcauccggcggccg

SEQ ID NO: 1026486 - RNA, 22 nt, Human
cauuaaaauaucucaugguguu

SEQ ID NO: 1026487 - RNA, 22 nt, Human
gcccagcuccucugcagacccu

SEQ ID NO: 1026488 - RNA, 22 nt, Human
acaguaauuaaaauggaucugc

SEQ ID NO: 1026489 - RNA, 20 nt, Human
caccacagaauuggggacag

SEQ ID NO: 1026490 - RNA, 22 nt, Human
cuguaugguccacgugggugcc

SEQ ID NO: 1026491 - RNA, 20 nt, Human
gagggcaggcacccauuuca

SEQ ID NO: 1026492 - RNA, 20 nt, Human
uuuuccuucugaguauguug

SEQ ID NO: 1026493 - RNA, 21 nt, Human
uuuagggaccaggucauaggc

SEQ ID NO: 1026494 - RNA, 22 nt, Human
agugucauaugccacugcaucc

SEQ ID NO: 1026495 - RNA, 22 nt, Human
cagcucccuauggugaggcgac

SEQ ID NO: 1026496 - RNA, 22 nt, Human
cuuuccuagauggccaucuuuc

SEQ ID NO: 1026497 - RNA, 22 nt, Human
gguggcaggcccugagcauccc

SEQ ID NO: 1026498 - RNA, 22 nt, Human
ggcuggcuuucucuccgcaccu

SEQ ID NO: 1026499 - RNA, 22 nt, Human
ggcugcagggcagcuggugugg

SEQ ID NO: 1026500 - RNA, 21 nt, Human
ugccagcauguaggcuaguug

SEQ ID NO: 1026501 - RNA, 22 nt, Human
uggccuggggaccugugagacc

SEQ ID NO: 1026502 - RNA, 22 nt, Human
gcagacagggcuacagagguac

SEQ ID NO: 1026503 - RNA, 22 nt, Human
gccuggagcucggcugagggcg

SEQ ID NO: 1026504 - RNA, 22 nt, Human
uagagcugcuggacuguaacag

SEQ ID NO: 1026505 - RNA, 23 nt, Human
ccugugugcccuuaauucacagc

SEQ ID NO: 1026506 - RNA, 22 nt, Human
ugcucacagcccagaacauaau

SEQ ID NO: 1026507 - RNA, 22 nt, Human
ggcuucaccaggugcaugcaug

SEQ ID NO: 1026508 - RNA, 22 nt, Human
cacugaagaugcgacuagugcu

SEQ ID NO: 1026509 - RNA, 22 nt, Human
uuuuagauugggaaauguaaag

SEQ ID NO: 1026510 - RNA, 22 nt, Human
agauacauuaguaguuacuugu

SEQ ID NO: 1026511 - RNA, 22 nt, Human
cagcuuuggcccagucgggagg

SEQ ID NO: 1026512 - RNA, 22 nt, Human
gcccauggacacccaagugcca

SEQ ID NO: 1026513 - RNA, 22 nt, Human
ucuuugaacuuggcugaucucu

SEQ ID NO: 1026514 - RNA, 22 nt, Human
caggugcucccagagaagugcu

SEQ ID NO: 1026515 - RNA, 22 nt, Human
uauuuugagguauuuuugagcu

SEQ ID NO: 1026516 - RNA, 22 nt, Human
gcugucucauacaaggcccugc

SEQ ID NO: 1026517 - RNA, 22 nt, Human
auggacagugugucuguuucca

SEQ ID NO: 1026518 - RNA, 22 nt, Human
uaaguucauuagacuacagaua

SEQ ID NO: 1026519 - RNA, 22 nt, Human
auuucuguaguccacauucuuu

SEQ ID NO: 1026520 - RNA, 22 nt, Human
uacaaaugaaccaacuuugaug

SEQ ID NO: 1026521 - RNA, 22 nt, Human
gcaggagcuggaaagugauguu

SEQ ID NO: 1026522 - RNA, 22 nt, Human
ugaucagucccaugaucuucca

SEQ ID NO: 1026523 - RNA, 22 nt, Human
aacauuuaugauugagguaaau

SEQ ID NO: 1026524 - RNA, 22 nt, Human
ucaaagucauggcuaguaauga

SEQ ID NO: 1026525 - RNA, 18 nt, Human
uuuuacucauagcaggcc

SEQ ID NO: 1026526 - RNA, 22 nt, Human
cccaggcugaguuagagguguc

SEQ ID NO: 1026527 - RNA, 20 nt, Human
uuucacaucugucccuuuaa

SEQ ID NO: 1026528 - RNA, 22 nt, Human
acuucuggugucauacugcauu

SEQ ID NO: 1026529 - RNA, 17 nt, Human
gcuuccugugcugggga

SEQ ID NO: 1026530 - RNA, 22 nt, Human
uuuccauauuuggucuuuggga

SEQ ID NO: 1026531 - RNA, 22 nt, Human
ccugugccauccugagcauccc

SEQ ID NO: 1026532 - RNA, 22 nt, Human
gagacagugguugcagaagcuc

SEQ ID NO: 1026533 - RNA, 22 nt, Human
cugcuuugaaaauaaacuuguc

SEQ ID NO: 1026534 - RNA, 21 nt, Human
accagcaggagaucagaagga

SEQ ID NO: 1026535 - RNA, 22 nt, Human
aauuagggaaguauuuaguagu

SEQ ID NO: 1026536 - RNA, 22 nt, Human
uuucuucucgacaccuuauccc

SEQ ID NO: 1026537 - RNA, 22 nt, Human
uucaggaucacuaaacccucca

SEQ ID NO: 1026538 - RNA, 22 nt, Human
ggccucugcaacuggcuguggc

SEQ ID NO: 1026539 - RNA, 22 nt, Human
ccucuucuagguuucagccugc

SEQ ID NO: 1026540 - RNA, 22 nt, Human
caucaaauggcaagugaaagcu

SEQ ID NO: 1026541 - RNA, 22 nt, Human
cucaggcacgggucagugagcg

SEQ ID NO: 1026542 - RNA, 22 nt, Human
ugaaggaaugaguauacuguuu

SEQ ID NO: 1026543 - RNA, 21 nt, Human
ucagcagcuuuugcagucccu

SEQ ID NO: 1026544 - RNA, 22 nt, Human
auaguuugaaggcuguucuacu

SEQ ID NO: 1026545 - RNA, 22 nt, Human
cccuggaguccuggcaguugau

SEQ ID NO: 1026546 - RNA, 22 nt, Human
cuguccagaaagggggcaacaa

SEQ ID NO: 1026547 - RNA, 22 nt, Human
agcagcauagaagcugggagga

SEQ ID NO: 1026548 - RNA, 22 nt, Human
agauuguagaaacuguagcauu

SEQ ID NO: 1026549 - RNA, 21 nt, Human
acaugucucuaaucucaguga

SEQ ID NO: 1026550 - RNA, 22 nt, Human
cauaacuagagugaaauguuga

SEQ ID NO: 1026551 - RNA, 21 nt, Human
acagcaagccuuccuuucagg

SEQ ID NO: 1026552 - RNA, 22 nt, Human
cuccugagcucugaggaagcuu

SEQ ID NO: 1026553 - RNA, 22 nt, Human
gagugaaaaaggaagggccaua

SEQ ID NO: 1026554 - RNA, 22 nt, Human
gcugucugggaugucacugcug

SEQ ID NO: 1026555 - RNA, 22 nt, Human
uugcagagaucagcagguuuga

SEQ ID NO: 1026556 - RNA, 22 nt, Human
aagggcuccaagagguagcugg

SEQ ID NO: 1026557 - RNA, 22 nt, Human
ccuuccuggcuguccgccugau

SEQ ID NO: 1026558 - RNA, 21 nt, Human
aggcccagcuuuccucuugcu

SEQ ID NO: 1026559 - RNA, 22 nt, Human
uguauuuucuucuggaagcuua

SEQ ID NO: 1026560 - RNA, 22 nt, Human
aaggcagcagugcacgacugau

SEQ ID NO: 1026561 - RNA, 22 nt, Human
uagucaaaccucagaauacccc

SEQ ID NO: 1026562 - RNA, 22 nt, Human
ugaauaugugacuuugauuuca

SEQ ID NO: 1026563 - RNA, 22 nt, Human
auuauguagcuaaaaauugugu

SEQ ID NO: 1026564 - RNA, 22 nt, Human
acucugccaucccaggugcugu

SEQ ID NO: 1026565 - RNA, 22 nt, Human
ugccaggcccugugcuggaugc

SEQ ID NO: 1026566 - RNA, 22 nt, Human
agcucugacauugauucucagc

SEQ ID NO: 1026567 - RNA, 22 nt, Human
gccuggaggguugagguuuugu

SEQ ID NO: 1026568 - RNA, 23 nt, Human
aggauguaggauguauggcagag

SEQ ID NO: 1026569 - RNA, 22 nt, Human
ugcccuguuccugccuccagcu

SEQ ID NO: 1026570 - RNA, 22 nt, Human
agucucagaaaagaagcaugga

SEQ ID NO: 1026571 - RNA, 22 nt, Human
ucagagagugcaaaauauagcu

SEQ ID NO: 1026572 - RNA, 22 nt, Human
uucuuucccaguagaugugaaa

SEQ ID NO: 1026573 - RNA, 20 nt, Human
ugaaggccagcagcauaggg

SEQ ID NO: 1026574 - RNA, 22 nt, Human
agcuaggaaauugaggcugaga

SEQ ID NO: 1026575 - RNA, 21 nt, Human
aaagagguuaauauuguaagu

SEQ ID NO: 1026576 - RNA, 22 nt, Human
augacagaaggccucccugaca

SEQ ID NO: 1026577 - RNA, 20 nt, Human
aguguacagacacuagaaau

SEQ ID NO: 1026578 - RNA, 22 nt, Human
gaaaggagggaaacagagcggu

SEQ ID NO: 1026579 - RNA, 22 nt, Human
auaucauuauguuaugagcaca

SEQ ID NO: 1026580 - RNA, 22 nt, Human
cuggccacaugugugcugagca

SEQ ID NO: 1026581 - RNA, 22 nt, Human
cuggugcaggaaggagcuggca

SEQ ID NO: 1026582 - RNA, 22 nt, Human
ccuagaugggauggcggccggg

SEQ ID NO: 1026583 - RNA, 22 nt, Human
cugcagaggccucgccuccucu

SEQ ID NO: 1026584 - RNA, 22 nt, Human
augcagguugggcaaguguggg

SEQ ID NO: 1026585 - RNA, 22 nt, Human
guggaggacaaaagaagccuuu

SEQ ID NO: 1026586 - RNA, 22 nt, Human
uaacacauuaguucuccuagau

SEQ ID NO: 1026587 - RNA, 22 nt, Human
aguaugaauacagauuuucucu

SEQ ID NO: 1026588 - RNA, 22 nt, Human
gaggccugguuuccagcauccu

SEQ ID NO: 1026589 - RNA, 22 nt, Human
ccaggccucccuuuuccagcca

SEQ ID NO: 1026590 - RNA, 22 nt, Human
cagcuucugcuaucgaacaucu

SEQ ID NO: 1026591 - RNA, 22 nt, Human
aaauggaucuguggaauacauu

SEQ ID NO: 1026592 - RNA, 22 nt, Human
ggcagggaggaggugaaaguga

SEQ ID NO: 1026593 - RNA, 22 nt, Human
acagagcaguucuggagcuggc

SEQ ID NO: 1026594 - RNA, 22 nt, Human
agagcuggccagggaucacucu

SEQ ID NO: 1026595 - RNA, 22 nt, Human
gacaauaaaaugaucuuacagu

SEQ ID NO: 1026596 - RNA, 22 nt, Human
acuuccugggcaugcagagucc

SEQ ID NO: 1026597 - RNA, 22 nt, Human
agcuuccaauuucuccaagaga

SEQ ID NO: 1026598 - RNA, 20 nt, Human
gucaggauuaguaaacucug

SEQ ID NO: 1026599 - RNA, 20 nt, Human
ugaagcagccuugauucugu

SEQ ID NO: 1026600 - RNA, 22 nt, Human
uuugcauuccugccugcauuca

SEQ ID NO: 1026601 - RNA, 22 nt, Human
auaucuuuguuuuugccaagau

SEQ ID NO: 1026602 - RNA, 22 nt, Human
cugugcuugcggguguggagcc

SEQ ID NO: 1026603 - RNA, 22 nt, Human
acacagggcugcgccugacccc

SEQ ID NO: 1026604 - RNA, 22 nt, Human
ggucccagguugacagggagac

SEQ ID NO: 1026605 - RNA, 22 nt, Human
cccucuggcucuucucaggccg

SEQ ID NO: 1026606 - RNA, 22 nt, Human
gcucccacgcaauucuuuucag

SEQ ID NO: 1026607 - RNA, 22 nt, Human
aggcccugcauuguacugaggg

SEQ ID NO: 1026608 - RNA, 22 nt, Human
uggcccugacacgugguacugg

SEQ ID NO: 1026609 - RNA, 22 nt, Human
accaugggucagccaccucagc

SEQ ID NO: 1026610 - RNA, 20 nt, Human
gcugggggugugcugaguga

SEQ ID NO: 1026611 - RNA, 22 nt, Human
gggcagauggggcacaggcuga

SEQ ID NO: 1026612 - RNA, 22 nt, Human
aauaaacugcucaauugcauca

SEQ ID NO: 1026613 - RNA, 22 nt, Human
uuguacaaauaggaaccucuga

SEQ ID NO: 1026614 - RNA, 19 nt, Human
cagcaauaaugccagaugg

SEQ ID NO: 1026615 - RNA, 22 nt, Human
augucccuucuuuggugcucag

SEQ ID NO: 1026616 - RNA, 22 nt, Human
aggaccaacauagcagcagugg

SEQ ID NO: 1026617 - RNA, 22 nt, Human
uugcugaaguuaaugcuugcaa

SEQ ID NO: 1026618 - RNA, 22 nt, Human
ggagccuggccuggcucugugu

SEQ ID NO: 1026619 - RNA, 22 nt, Human
uucauucuugggaucagagagu

SEQ ID NO: 1026620 - RNA, 22 nt, Human
gcuggcauuacaggagagaacc

SEQ ID NO: 1026621 - RNA, 17 nt, Human
gguggccugcaguggcu

SEQ ID NO: 1026622 - RNA, 22 nt, Human
uacaaaguuugagaaugcuuuc

SEQ ID NO: 1026623 - RNA, 22 nt, Human
auucuucaucagagaugcacua

SEQ ID NO: 1026624 - RNA, 22 nt, Human
cugcccugacugaccuuuugaa

SEQ ID NO: 1026625 - RNA, 22 nt, Human
ugguccugccccgugcacagag

SEQ ID NO: 1026626 - RNA, 22 nt, Human
acacagggucuagaguuaggcc

SEQ ID NO: 1026627 - RNA, 22 nt, Human
cagagcugggaucccaugggcg

SEQ ID NO: 1026628 - RNA, 22 nt, Human
acagucauuagauacaaugucu

SEQ ID NO: 1026629 - RNA, 22 nt, Human
gucaggaucucccaguacauau

SEQ ID NO: 1026630 - RNA, 22 nt, Human
cagaguggcgacccccucagcu

SEQ ID NO: 1026631 - RNA, 22 nt, Human
ccaaggaguagagcaggaagcu

SEQ ID NO: 1026632 - RNA, 22 nt, Human
ccagguggaggugugagguccu

SEQ ID NO: 1026633 - RNA, 23 nt, Human
ggcagagagcauggcuggggccc

SEQ ID NO: 1026634 - RNA, 22 nt, Human
agucauaauuauaaacaucagu

SEQ ID NO: 1026635 - RNA, 22 nt, Human
gccaggcuggccagcaccuucu

SEQ ID NO: 1026636 - RNA, 18 nt, Human
gcagcugcaguuguagcu

SEQ ID NO: 1026637 - RNA, 22 nt, Human
acagaggccaugagcugccacc

SEQ ID NO: 1026638 - RNA, 22 nt, Human
ucuguucaugucuuuuuaagug

SEQ ID NO: 1026639 - RNA, 22 nt, Human
gauggccuguauuugggccaga

SEQ ID NO: 1026640 - RNA, 22 nt, Human
ccagagcccagcacacggugcu

SEQ ID NO: 1026641 - RNA, 22 nt, Human
agguuuaugccuuggagcuggg

SEQ ID NO: 1026642 - RNA, 22 nt, Human
uuccggaagguucucuagaauu

SEQ ID NO: 1026643 - RNA, 22 nt, Human
cugggaaggggaagguccucuc

SEQ ID NO: 1026644 - RNA, 22 nt, Human
ugucuuuucuacuguaagcaua

SEQ ID NO: 1026645 - RNA, 22 nt, Human
acaggugauucaggcucuggga

SEQ ID NO: 1026646 - RNA, 20 nt, Human
ccuggagccuggaaggaguc

SEQ ID NO: 1026647 - RNA, 22 nt, Human
auccaggcuggguguggcuacu

SEQ ID NO: 1026648 - RNA, 22 nt, Human
ccagcugcagguguuccagaug

SEQ ID NO: 1026649 - RNA, 17 nt, Human
uccuucagugccucugc

SEQ ID NO: 1026650 - RNA, 22 nt, Human
gcuggcagcuggaaguugggcu

SEQ ID NO: 1026651 - RNA, 22 nt, Human
ucaucaguguccuuaucacuua

SEQ ID NO: 1026652 - RNA, 22 nt, Human
ucagaggagaaguugggaaaau

SEQ ID NO: 1026653 - RNA, 22 nt, Human
gcucccagcaauugaggcagcc

SEQ ID NO: 1026654 - RNA, 22 nt, Human
agcugcaggccucuccugggga

SEQ ID NO: 1026655 - RNA, 22 nt, Human
gugcagcagggggaagacagug

SEQ ID NO: 1026656 - RNA, 21 nt, Human
ccucugcucgggcaugcguuu

SEQ ID NO: 1026657 - RNA, 22 nt, Human
accaugaugcauccuuaaggaa

SEQ ID NO: 1026658 - RNA, 22 nt, Human
guccucuggccuuucccaggac

SEQ ID NO: 1026659 - RNA, 22 nt, Human
guagccauuggcaaugaagccu

SEQ ID NO: 1026660 - RNA, 22 nt, Human
cagcuuuauuucacguguuugu

SEQ ID NO: 1026661 - RNA, 22 nt, Human
caguuuuucaaaauuacaugau

SEQ ID NO: 1026662 - RNA, 22 nt, Human
gcaccugcaggaugagccaggg

SEQ ID NO: 1026663 - RNA, 22 nt, Human
cugcagugcaagcccagaugga

SEQ ID NO: 1026664 - RNA, 23 nt, Human
gaggcagcuccugcagugcccug

SEQ ID NO: 1026665 - RNA, 22 nt, Human
gaguuauuucagaaggaaagau

SEQ ID NO: 1026666 - RNA, 22 nt, Human
cucccuggcacagcgagagguu

SEQ ID NO: 1026667 - RNA, 22 nt, Human
cagcaauaagguaagcuucucc

SEQ ID NO: 1026668 - RNA, 22 nt, Human
ggccugcuucucagugagcuug

SEQ ID NO: 1026669 - RNA, 22 nt, Human
uccaggagucagacagauggug

SEQ ID NO: 1026670 - RNA, 22 nt, Human
aauauuguuucaagaucacaga

SEQ ID NO: 1026671 - RNA, 22 nt, Human
uccaggcauguugggaagauga

SEQ ID NO: 1026672 - RNA, 22 nt, Human
ugagccaguggaagauggcagu

SEQ ID NO: 1026673 - RNA, 22 nt, Human
gguggcagaggugcaucagccc

SEQ ID NO: 1026674 - RNA, 22 nt, Human
cuggcugcuggccugaggaugc

SEQ ID NO: 1026675 - RNA, 22 nt, Human
ugaagcaguucucagaaguggg

SEQ ID NO: 1026676 - RNA, 22 nt, Human
ugcauauuauguguaucugucu

SEQ ID NO: 1026677 - RNA, 22 nt, Human
cccuggagggcagacagaugcc

SEQ ID NO: 1026678 - RNA, 22 nt, Human
ccugggaggcggagguugcagg

SEQ ID NO: 1026679 - RNA, 22 nt, Human
ccugcagguaaggcuaacugcc

SEQ ID NO: 1026680 - RNA, 22 nt, Human
auagacuugguuaguaaauuug

SEQ ID NO: 1026681 - RNA, 22 nt, Human
cugggagggguagccaauccua

SEQ ID NO: 1026682 - RNA, 22 nt, Human
cuguccagcuuggcuccugggg

SEQ ID NO: 1026683 - RNA, 22 nt, Human
gaggggcuggguagggcaaccc

SEQ ID NO: 1026684 - RNA, 23 nt, Human
uugugggcagauuccauggggag

SEQ ID NO: 1026685 - RNA, 22 nt, Human
gcuggcaguaaaggguuuggca

SEQ ID NO: 1026686 - RNA, 22 nt, Human
cucuggagggaggcugagcugg

SEQ ID NO: 1026687 - RNA, 22 nt, Human
gagggcuccacacgggcccagc

SEQ ID NO: 1026688 - RNA, 22 nt, Human
gcacccagcccagggcgugaug

SEQ ID NO: 1026689 - RNA, 22 nt, Human
acagaguaucuaucaggaguau

SEQ ID NO: 1026690 - RNA, 22 nt, Human
cagcuuccaucuccacugcccu

SEQ ID NO: 1026691 - RNA, 22 nt, Human
cugggcuucucccccuggcaga

SEQ ID NO: 1026692 - RNA, 20 nt, Human
cacaggcuauaugagagcca

SEQ ID NO: 1026693 - RNA, 22 nt, Human
gaaagaggaaggagauguauua

SEQ ID NO: 1026694 - RNA, 15 nt, Human
uccaggcauucauuc

SEQ ID NO: 1026695 - RNA, 19 nt, Human
gccacuccugaugcugccc

SEQ ID NO: 1026696 - RNA, 22 nt, Human
ggugggcacauucagucucugu

SEQ ID NO: 1026697 - RNA, 22 nt, Human
ccaggcugcuguugguguccgc

SEQ ID NO: 1026698 - RNA, 22 nt, Human
uaucuguuugcucacagguguu

SEQ ID NO: 1026699 - RNA, 22 nt, Human
cuuuccaagaaugcagauaccu

SEQ ID NO: 1026700 - RNA, 22 nt, Human
uccucucagugugguuguggga

SEQ ID NO: 1026701 - RNA, 22 nt, Human
gagccauacaaccuauaaagug

SEQ ID NO: 1026702 - RNA, 22 nt, Human
gcaggcagagguggaggagaca

SEQ ID NO: 1026703 - RNA, 22 nt, Human
uucaggauuauacucucuuccc

SEQ ID NO: 1026704 - RNA, 22 nt, Human
uagggcucagcucuagcuccug

SEQ ID NO: 1026705 - RNA, 22 nt, Human
ucccaggacaugggcucugcuc

SEQ ID NO: 1026706 - RNA, 22 nt, Human
augugaaaauccaauggcagca

SEQ ID NO: 1026707 - RNA, 22 nt, Human
aaaauccuuagccgagugaggu

SEQ ID NO: 1026708 - RNA, 22 nt, Human
cugggagcccgcguccuggugg

SEQ ID NO: 1026709 - RNA, 22 nt, Human
uuuccaagacuccaguucuccc

SEQ ID NO: 1026710 - RNA, 22 nt, Human
agcauuuaugacuaauguaaaa

SEQ ID NO: 1026711 - RNA, 23 nt, Human
gcauugucuccccacuucugggc

SEQ ID NO: 1026712 - RNA, 22 nt, Human
gcagggccagugcagagaggaa

SEQ ID NO: 1026713 - RNA, 22 nt, Human
caaagucccagcugcuuagaga

SEQ ID NO: 1026714 - RNA, 17 nt, Human
aggcuggcucacaggga

SEQ ID NO: 1026715 - RNA, 22 nt, Human
ucucucagaggccaggguccug

SEQ ID NO: 1026716 - RNA, 21 nt, Human
ucuugaaaauuguagcaguuu

SEQ ID NO: 1026717 - RNA, 20 nt, Human
aacuuguucuaccuguuuca

SEQ ID NO: 1026718 - RNA, 22 nt, Human
uuuggccacagauccuuggggg

SEQ ID NO: 1026719 - RNA, 22 nt, Human
cuucuuaaugacagauuaaaau

SEQ ID NO: 1026720 - RNA, 22 nt, Human
ucaggagucugugcaguuccac

SEQ ID NO: 1026721 - RNA, 19 nt, Human
ucagaggauuuggcuauga

SEQ ID NO: 1026722 - RNA, 22 nt, Human
uaguuucagcuccuucauccug

SEQ ID NO: 1026723 - RNA, 22 nt, Human
uagaacagaggguugcccagau

SEQ ID NO: 1026724 - RNA, 22 nt, Human
uggagaugaauauguguaccug

SEQ ID NO: 1026725 - RNA, 22 nt, Human
acagccuguuugaucuggugcu

SEQ ID NO: 1026726 - RNA, 22 nt, Human
ucucugggaaugggccugggua

SEQ ID NO: 1026727 - RNA, 22 nt, Human
uuuaucuuuaggacuuugcaga

SEQ ID NO: 1026728 - RNA, 22 nt, Human
aagggacuuugucagcuuucca

SEQ ID NO: 1026729 - RNA, 22 nt, Human
agcagccaaccuuacauucauc

SEQ ID NO: 1026730 - RNA, 19 nt, Human
ugcucauggggacuucucc

SEQ ID NO: 1026731 - RNA, 22 nt, Human
agaccauggccauccuaggaaa

SEQ ID NO: 1026732 - RNA, 23 nt, Human
uucuuucaagaaguucacagugc

SEQ ID NO: 1026733 - RNA, 22 nt, Human
aaauauguaagauuagcacuag

SEQ ID NO: 1026734 - RNA, 22 nt, Human
ggcaaggccuugcccagcauuc

SEQ ID NO: 1026735 - RNA, 22 nt, Human
cuugaaagcacuccuuugacug

SEQ ID NO: 1026736 - RNA, 17 nt, Human
ugaaacaccaagacugu

SEQ ID NO: 1026737 - RNA, 22 nt, Human
ucagggcaaaagggaaaccauu

SEQ ID NO: 1026738 - RNA, 22 nt, Human
ugaacacauaaggcuuuccugu

SEQ ID NO: 1026739 - RNA, 22 nt, Human
gagucacauuaauuuaauuuua

SEQ ID NO: 1026740 - RNA, 18 nt, Human
acauuucuaugcuucugg

SEQ ID NO: 1026741 - RNA, 22 nt, Human
aagacagagggaagcaaugaug

SEQ ID NO: 1026742 - RNA, 22 nt, Human
ugagguaggugguaagagauac

SEQ ID NO: 1026743 - RNA, 22 nt, Human
auacaucucauguaagagauaa

SEQ ID NO: 1026744 - RNA, 22 nt, Human
ucagcugaaguggagaagcaga

SEQ ID NO: 1026745 - RNA, 20 nt, Human
gcaggcagggaaugggggug

SEQ ID NO: 1026746 - RNA, 20 nt, Human
augccucuaauuuugcaaac

SEQ ID NO: 1026747 - RNA, 22 nt, Human
cccuggaagguucucuggcuca

SEQ ID NO: 1026748 - RNA, 22 nt, Human
uuccuucucagcccucgaggau

SEQ ID NO: 1026749 - RNA, 22 nt, Human
cacagaggcaaccuucuggggu

SEQ ID NO: 1026750 - RNA, 22 nt, Human
gagggcucuaccaaguaacucu

SEQ ID NO: 1026751 - RNA, 20 nt, Human
cucugcagcaaggccugggu

SEQ ID NO: 1026752 - RNA, 22 nt, Human
agggccaggaacaccugaaggg

SEQ ID NO: 1026753 - RNA, 20 nt, Human
cagaccugcacccacuucga

SEQ ID NO: 1026754 - RNA, 22 nt, Human
uauuuugucuucugcucaucac

SEQ ID NO: 1026755 - RNA, 22 nt, Human
aguggcaguagaugagcugguu

SEQ ID NO: 1026756 - RNA, 22 nt, Human
gaaaaaugcuccaaaucugugg

SEQ ID NO: 1026757 - RNA, 22 nt, Human
cucugaaagaguuuaguauuau

SEQ ID NO: 1026758 - RNA, 20 nt, Human
agucccuuuggucagguauu

SEQ ID NO: 1026759 - RNA, 22 nt, Human
ggcuuuauuaacucauccguaa

SEQ ID NO: 1026760 - RNA, 22 nt, Human
cuuguccuuuacuugagacuca

SEQ ID NO: 1026761 - RNA, 22 nt, Human
ccugcugugaccggggagcagg

SEQ ID NO: 1026762 - RNA, 22 nt, Human
caagggugguauugggagcaua

SEQ ID NO: 1026763 - RNA, 22 nt, Human
auuuuuccaauuaggauaaaga

SEQ ID NO: 1026764 - RNA, 22 nt, Human
uggcucaggagggaucuuugcu

SEQ ID NO: 1026765 - RNA, 22 nt, Human
auaaagaggauguauuuacagc

SEQ ID NO: 1026766 - RNA, 22 nt, Human
ccucacucugcacccugcagca

SEQ ID NO: 1026767 - RNA, 22 nt, Human
ggcaggaggaagaguuagcacc

SEQ ID NO: 1026768 - RNA, 22 nt, Human
cccuggagcaucucugcugucu

SEQ ID NO: 1026769 - RNA, 22 nt, Human
ugggcuccggcggccucaggcu

SEQ ID NO: 1026770 - RNA, 23 nt, Human
cccuggagcuagucugagcagag

SEQ ID NO: 1026771 - RNA, 18 nt, Human
acaaaggucugcaagacc

SEQ ID NO: 1026772 - RNA, 22 nt, Human
guagggacuguucucaccugag

SEQ ID NO: 1026773 - RNA, 22 nt, Human
augugugccccuuuuacucuuu

SEQ ID NO: 1026774 - RNA, 22 nt, Human
uuacugaaaauucuucaggauu

SEQ ID NO: 1026775 - RNA, 17 nt, Human
gggcugacaguggccuc

SEQ ID NO: 1026776 - RNA, 22 nt, Human
uggggcuguccuuagucugaga

SEQ ID NO: 1026777 - RNA, 22 nt, Human
cugcugugggcaggguagcugg

SEQ ID NO: 1026778 - RNA, 18 nt, Human
ggucuuuaggucaguguc

SEQ ID NO: 1026779 - RNA, 22 nt, Human
agugcacagcgugauguauugg

SEQ ID NO: 1026780 - RNA, 23 nt, Human
uuuuccuguggagacaugacugg

SEQ ID NO: 1026781 - RNA, 22 nt, Human
ugucccuggaacuauggcucca

SEQ ID NO: 1026782 - RNA, 22 nt, Human
aggcaauccccugaggauacuu

SEQ ID NO: 1026783 - RNA, 22 nt, Human
gcagggcugggugggagacaga

SEQ ID NO: 1026784 - RNA, 22 nt, Human
cucuccucagaacaggcccucu

SEQ ID NO: 1026785 - RNA, 22 nt, Human
uggaagagggagcuggguggcc

SEQ ID NO: 1026786 - RNA, 19 nt, Human
uuugaauccagcugguaac

SEQ ID NO: 1026787 - RNA, 22 nt, Human
acugcuuuaucugagaaguccu

SEQ ID NO: 1026788 - RNA, 22 nt, Human
caggugggcguggcgagaaggc

SEQ ID NO: 1026789 - RNA, 22 nt, Human
gcuguggccaacaaaccacuuu

SEQ ID NO: 1026790 - RNA, 22 nt, Human
uaggcacugggcuaggacaggu

SEQ ID NO: 1026791 - RNA, 22 nt, Human
uucccaguauuaccuucaggaa

SEQ ID NO: 1026792 - RNA, 22 nt, Human
auuaaagaaacccagcauguga

SEQ ID NO: 1026793 - RNA, 22 nt, Human
aaagacuagcauuuauauguac

SEQ ID NO: 1026794 - RNA, 22 nt, Human
ucucccaggcugcccuguggac

SEQ ID NO: 1026795 - RNA, 22 nt, Human
gggcugcacguauucugcucac

SEQ ID NO: 1026796 - RNA, 22 nt, Human
agacaaaugguaauuaugucua

SEQ ID NO: 1026797 - RNA, 22 nt, Human
cucucccccacagcagccuucu

SEQ ID NO: 1026798 - RNA, 22 nt, Human
agaggcuccaccuucucugucc

SEQ ID NO: 1026799 - RNA, 22 nt, Human
gaugguuuaugauagaugggaa

SEQ ID NO: 1026800 - RNA, 21 nt, Human
ucagagagucacagugaacug

SEQ ID NO: 1026801 - RNA, 22 nt, Human
caagagcugcaaauagcgugac

SEQ ID NO: 1026802 - RNA, 22 nt, Human
gacccuggaacuuucagcagag

SEQ ID NO: 1026803 - RNA, 22 nt, Human
gcucugcugucuucuugcaggc

SEQ ID NO: 1026804 - RNA, 22 nt, Human
cuggauuuaauuaacuguugcu

SEQ ID NO: 1026805 - RNA, 22 nt, Human
uauguguuugacacccugcaag

SEQ ID NO: 1026806 - RNA, 22 nt, Human
gaggccagcgcgcagcacuuuu

SEQ ID NO: 1026807 - RNA, 22 nt, Human
cuagccaugggcauuaaaggua

SEQ ID NO: 1026808 - RNA, 22 nt, Human
gcccagagagaugcuguagacc

SEQ ID NO: 1026809 - RNA, 22 nt, Human
cucugucagaguguugucccca

SEQ ID NO: 1026810 - RNA, 21 nt, Human
uucaauacuauuucaauaguc

SEQ ID NO: 1026811 - RNA, 22 nt, Human
uggccuggggaagaccaugggc

SEQ ID NO: 1026812 - RNA, 22 nt, Human
guuugcauaucugugaaaugga

SEQ ID NO: 1026813 - RNA, 22 nt, Human
ucaggaaagaagaugcucagug

SEQ ID NO: 1026814 - RNA, 22 nt, Human
ugacagaaagaauaugucaauc

SEQ ID NO: 1026815 - RNA, 22 nt, Human
gauggguggucucagacuugcc

SEQ ID NO: 1026816 - RNA, 22 nt, Human
gaagcucucaaacucuccccuu

SEQ ID NO: 1026817 - RNA, 22 nt, Human
gagagugagauaauuucacaua

SEQ ID NO: 1026818 - RNA, 22 nt, Human
gccaccagggggcuccagugag

SEQ ID NO: 1026819 - RNA, 22 nt, Human
agcagcaggcuguguggacuga

SEQ ID NO: 1026820 - RNA, 22 nt, Human
auugacaaggaaacuauaccag

SEQ ID NO: 1026821 - RNA, 22 nt, Human
gcuggccucuggagaagggcuu

SEQ ID NO: 1026822 - RNA, 22 nt, Human
uguauguaaaguuuguaauaga

SEQ ID NO: 1026823 - RNA, 22 nt, Human
ucuuuacaguccucugucaauc

SEQ ID NO: 1026824 - RNA, 22 nt, Human
acaggcugacuuccugccaugu

SEQ ID NO: 1026825 - RNA, 22 nt, Human
ugaggggagaagcagcagccug

SEQ ID NO: 1026826 - RNA, 22 nt, Human
uuagagccaguuacaaggucaa

SEQ ID NO: 1026827 - RNA, 22 nt, Human
ucaggccacggcucacugagac

SEQ ID NO: 1026828 - RNA, 22 nt, Human
uaucuguugucuuuuacaugua

SEQ ID NO: 1026829 - RNA, 22 nt, Human
augcaguacagauaauucuaca

SEQ ID NO: 1026830 - RNA, 22 nt, Human
uccucagaagaaccccuagauu

SEQ ID NO: 1026831 - RNA, 22 nt, Human
uuguaacaggcacucugugcca

SEQ ID NO: 1026832 - RNA, 20 nt, Human
uccuucaggcagggccuagu

SEQ ID NO: 1026833 - RNA, 22 nt, Human
cauuucacaaauggccacauca

SEQ ID NO: 1026834 - RNA, 22 nt, Human
aagggcagccugacucacgguc

SEQ ID NO: 1026835 - RNA, 22 nt, Human
ucuggcucaucucuccagguaa

SEQ ID NO: 1026836 - RNA, 22 nt, Human
gcucagaggagcaucauaagga

SEQ ID NO: 1026837 - RNA, 22 nt, Human
accaggcacuccugaggucuga

SEQ ID NO: 1026838 - RNA, 22 nt, Human
ucagagugcagcgggaggcugg

SEQ ID NO: 1026839 - RNA, 22 nt, Human
ccggggacuuaaagugaaggaa

SEQ ID NO: 1026840 - RNA, 19 nt, Human
agacacacuugauaugugu

SEQ ID NO: 1026841 - RNA, 22 nt, Human
uugaaagaagaagcugcgaugu

SEQ ID NO: 1026842 - RNA, 22 nt, Human
cagacaggcaggugcugcuuug

SEQ ID NO: 1026843 - RNA, 22 nt, Human
auguccagaguaaagcacauuc

SEQ ID NO: 1026844 - RNA, 22 nt, Human
ugguggccuugauggcaucugc

SEQ ID NO: 1026845 - RNA, 20 nt, Human
aguaggggaaugcaagagca

SEQ ID NO: 1026846 - RNA, 22 nt, Human
acaaaauuguguuaaacuuuau

SEQ ID NO: 1026847 - RNA, 22 nt, Human
ggucauugaaaucagaaggguu

SEQ ID NO: 1026848 - RNA, 22 nt, Human
ccagcuccuucugucuguggag

SEQ ID NO: 1026849 - RNA, 22 nt, Human
gacccaggcccaaggcugccag

SEQ ID NO: 1026850 - RNA, 20 nt, Human
acuggcagccugccugcugu

SEQ ID NO: 1026851 - RNA, 22 nt, Human
caggauggagaguuguugguug

SEQ ID NO: 1026852 - RNA, 23 nt, Human
ugagcaucacaggagaaccaggc

SEQ ID NO: 1026853 - RNA, 20 nt, Human
acaauagauuugagcaaagu

SEQ ID NO: 1026854 - RNA, 22 nt, Human
uaggcacugaggggagcaaggu

SEQ ID NO: 1026855 - RNA, 22 nt, Human
agugauggugagugagaagcuc

SEQ ID NO: 1026856 - RNA, 22 nt, Human
gccugcagccccucugcaguag

SEQ ID NO: 1026857 - RNA, 22 nt, Human
aaaaugugaucuacaaaugcaa

SEQ ID NO: 1026858 - RNA, 22 nt, Human
agcuuuaucuucaccugggaau

SEQ ID NO: 1026859 - RNA, 22 nt, Human
uagcugccauugcuccaggaag

SEQ ID NO: 1026860 - RNA, 22 nt, Human
cagccugggcuccagagucccu

SEQ ID NO: 1026861 - RNA, 22 nt, Human
aggcaccuugagagcaggagcu

SEQ ID NO: 1026862 - RNA, 22 nt, Human
aggcccugggagcagagaugca

SEQ ID NO: 1026863 - RNA, 22 nt, Human
cauacuuuugcccugacauucu

SEQ ID NO: 1026864 - RNA, 22 nt, Human
cucccaggguagggagagacua

SEQ ID NO: 1026865 - RNA, 22 nt, Human
gucucccaucguuugugaggaa

SEQ ID NO: 1026866 - RNA, 22 nt, Human
uggccugguuauauugcuauca

SEQ ID NO: 1026867 - RNA, 22 nt, Human
uggcacuggcgcaggauggcgg

SEQ ID NO: 1026868 - RNA, 22 nt, Human
uccugccuugccugggacauca

SEQ ID NO: 1026869 - RNA, 22 nt, Human
ugggaggagcccucugggaagg

SEQ ID NO: 1026870 - RNA, 22 nt, Human
ggagccaggcaaucuguacuuu

SEQ ID NO: 1026871 - RNA, 22 nt, Human
cagauccaucucucagaaagag

SEQ ID NO: 1026872 - RNA, 22 nt, Human
agggcccucuggcaggccaggc

SEQ ID NO: 1026873 - RNA, 22 nt, Human
caggccugaguguggaagucuu

SEQ ID NO: 1026874 - RNA, 22 nt, Human
gcuuggccagcagccgggaugc

SEQ ID NO: 1026875 - RNA, 22 nt, Human
ccaguuuuuccagugcuuucug

SEQ ID NO: 1026876 - RNA, 20 nt, Human
uacauucaaaacaaacucug

SEQ ID NO: 1026877 - RNA, 22 nt, Human
cagcauuggguuaccuuuguuu

SEQ ID NO: 1026878 - RNA, 22 nt, Human
ugcuggaauaauuucauguuaa

SEQ ID NO: 1026879 - RNA, 22 nt, Human
caaggccacguucugcaugcgg

SEQ ID NO: 1026880 - RNA, 22 nt, Human
augcaguagauaggcacuuuua

SEQ ID NO: 1026881 - RNA, 22 nt, Human
gaugguuuggaaugaaguagcu

SEQ ID NO: 1026882 - RNA, 22 nt, Human
ccugucauacuaacguaguggg

SEQ ID NO: 1026883 - RNA, 22 nt, Human
ugucaugccaggaaauaguccc

SEQ ID NO: 1026884 - RNA, 22 nt, Human
uuguuacaucuuauguaagugg

SEQ ID NO: 1026885 - RNA, 20 nt, Human
aaggcacuaugucugcuagc

SEQ ID NO: 1026886 - RNA, 22 nt, Human
agcauugccugccuauugcuaa

SEQ ID NO: 1026887 - RNA, 22 nt, Human
ucugucacaauuugcuuacucu

SEQ ID NO: 1026888 - RNA, 22 nt, Human
ucagcugccuuucccaugcuag

SEQ ID NO: 1026889 - RNA, 22 nt, Human
acagccagggucucaggaggcg

SEQ ID NO: 1026890 - RNA, 22 nt, Human
gggcuggcgggaaaggcaauuc

SEQ ID NO: 1026891 - RNA, 22 nt, Human
cugcccugaccugccucagagu

SEQ ID NO: 1026892 - RNA, 22 nt, Human
acagcugugaaaauccacagga

SEQ ID NO: 1026893 - RNA, 22 nt, Human
ggaggcccagagaggugaagug

SEQ ID NO: 1026894 - RNA, 22 nt, Human
agagccuggaccugagcuacaa

SEQ ID NO: 1026895 - RNA, 22 nt, Human
uguucuugagccuuuagaccua

SEQ ID NO: 1026896 - RNA, 22 nt, Human
acagccuggacuggcucucugc

SEQ ID NO: 1026897 - RNA, 22 nt, Human
cccucugcugccuggcuggguc

SEQ ID NO: 1026898 - RNA, 22 nt, Human
auccugggcagugugucacucu

SEQ ID NO: 1026899 - RNA, 22 nt, Human
auaaggcagaaauagggaaagu

SEQ ID NO: 1026900 - RNA, 22 nt, Human
gaggcagcaucuauggugggaa

SEQ ID NO: 1026901 - RNA, 22 nt, Human
agagcccucucauuggcuuauu

SEQ ID NO: 1026902 - RNA, 22 nt, Human
cgccucagccguggucaucuuc

SEQ ID NO: 1026903 - RNA, 22 nt, Human
gcagcugaagcugcaguuccag

SEQ ID NO: 1026904 - RNA, 22 nt, Human
gggcucugggaugcucuuagag

SEQ ID NO: 1026905 - RNA, 22 nt, Human
cugcugggcagaggcugcauga

SEQ ID NO: 1026906 - RNA, 22 nt, Human
uucaacacaggaacaugauaua

SEQ ID NO: 1026907 - RNA, 22 nt, Human
ucuucaaauccuacagugucug

SEQ ID NO: 1026908 - RNA, 22 nt, Human
uccauaagcagguucuuccuga

SEQ ID NO: 1026909 - RNA, 21 nt, Human
gccacugcacuccagccuggg

SEQ ID NO: 1026910 - RNA, 22 nt, Human
cuccucacuuuccagacugggc

SEQ ID NO: 1026911 - RNA, 22 nt, Human
gcagagcuguuaauggagcuga

SEQ ID NO: 1026912 - RNA, 23 nt, Human
uuuuccagaaucgacucuguaga

SEQ ID NO: 1026913 - RNA, 22 nt, Human
aaagauucgagcgauguauaaa

SEQ ID NO: 1026914 - RNA, 22 nt, Human
cuuuggaauauuuuauugagaa

SEQ ID NO: 1026915 - RNA, 21 nt, Human
auugaaagucaacaaucaguu

SEQ ID NO: 1026916 - RNA, 22 nt, Human
uuucuagucucgaucucuuaau

SEQ ID NO: 1026917 - RNA, 22 nt, Human
cugcagccuaggugcagcuggg

SEQ ID NO: 1026918 - RNA, 22 nt, Human
ugguuugcccacucgagugauu

SEQ ID NO: 1026919 - RNA, 22 nt, Human
acagcagcuaaaggugucuccu

SEQ ID NO: 1026920 - RNA, 22 nt, Human
ucccucagaaauucucucugaa

SEQ ID NO: 1026921 - RNA, 22 nt, Human
gggaaauugucaacacucucaa

SEQ ID NO: 1026922 - RNA, 22 nt, Human
ccuguucaccauggucacgugc

SEQ ID NO: 1026923 - RNA, 21 nt, Human
cugcucugacagugaggccag

SEQ ID NO: 1026924 - RNA, 21 nt, Human
ugggaugggucugggaccagc

SEQ ID NO: 1026925 - RNA, 22 nt, Human
gcccagcugucuggcagggaug

SEQ ID NO: 1026926 - RNA, 22 nt, Human
ccaaaguccauaguuuacauua

SEQ ID NO: 1026927 - RNA, 23 nt, Human
caguggagacucaugcuuccuua

SEQ ID NO: 1026928 - RNA, 22 nt, Human
ugcaggugguuuggacacugcu

SEQ ID NO: 1026929 - RNA, 22 nt, Human
acagcagcacuauugacauuuu

SEQ ID NO: 1026930 - RNA, 23 nt, Human
ucacacagcuggucagguacaga

SEQ ID NO: 1026931 - RNA, 22 nt, Human
cucuggagcgcugcuucccgcg

SEQ ID NO: 1026932 - RNA, 22 nt, Human
cacugggcaauucugagccuaa

SEQ ID NO: 1026933 - RNA, 22 nt, Human
uagcucuucauuucaucugauu

SEQ ID NO: 1026934 - RNA, 22 nt, Human
ugugucccuuggaaccucagcu

SEQ ID NO: 1026935 - RNA, 22 nt, Human
cacacagaugguaagggaggga

SEQ ID NO: 1026936 - RNA, 22 nt, Human
ucagcuuugggggucucaggag

SEQ ID NO: 1026937 - RNA, 22 nt, Human
gggcacugcuuugcucugucac

SEQ ID NO: 1026938 - RNA, 15 nt, Human
cuccaugauuuugca

SEQ ID NO: 1026939 - RNA, 22 nt, Human
ccuggcugcuauagcagcaugu

SEQ ID NO: 1026940 - RNA, 22 nt, Human
gcccaggagaggccagggcuga

SEQ ID NO: 1026941 - RNA, 22 nt, Human
uuucacauaucaacucuauccu

SEQ ID NO: 1026942 - RNA, 22 nt, Human
gugucacaugguuuacugcagc

SEQ ID NO: 1026943 - RNA, 22 nt, Human
agggccugacacccuugccagc

SEQ ID NO: 1026944 - RNA, 22 nt, Human
acauaugugcuuauauccauga

SEQ ID NO: 1026945 - RNA, 22 nt, Human
uuucauguuuucuuaaauggca

SEQ ID NO: 1026946 - RNA, 21 nt, Human
ucagggcagcugcucuucaga

SEQ ID NO: 1026947 - RNA, 22 nt, Human
uauugaaauucuucauguccuc

SEQ ID NO: 1026948 - RNA, 20 nt, Human
augauuuugcacuaacuuca

SEQ ID NO: 1026949 - RNA, 22 nt, Human
gcugguuuccuuaucuauaaag

SEQ ID NO: 1026950 - RNA, 22 nt, Human
uuagacauguuugcuaaaauga

SEQ ID NO: 1026951 - RNA, 22 nt, Human
ugggccaggauuucaagacccu

SEQ ID NO: 1026952 - RNA, 22 nt, Human
acaagguauccacauuaaaugu

SEQ ID NO: 1026953 - RNA, 22 nt, Human
uaaagguaguuuuaaaggugcu

SEQ ID NO: 1026954 - RNA, 22 nt, Human
ucuuugaauccuuuacaucuga

SEQ ID NO: 1026955 - RNA, 20 nt, Human
cuccaggggaagagccuucc

SEQ ID NO: 1026956 - RNA, 22 nt, Human
cugcucuaacugcauuaguuuu

SEQ ID NO: 1026957 - RNA, 17 nt, Human
gggcagggacuccuggg

SEQ ID NO: 1026958 - RNA, 22 nt, Human
uaaauuguuuucuagaaguugu

SEQ ID NO: 1026959 - RNA, 22 nt, Human
cugccucuggccucaggcccag

SEQ ID NO: 1026960 - RNA, 22 nt, Human
guagggacccacagucuauauu

SEQ ID NO: 1026961 - RNA, 22 nt, Human
cugaagcacagcauauaaauaa

SEQ ID NO: 1026962 - RNA, 22 nt, Human
cuggcagugacauugcaggugc

SEQ ID NO: 1026963 - RNA, 22 nt, Human
gcucagaggcacgaccucuugg

SEQ ID NO: 1026964 - RNA, 22 nt, Human
uaugcauagguaucuauacuca

SEQ ID NO: 1026965 - RNA, 22 nt, Human
ggacagagcccugguggccuaa

SEQ ID NO: 1026966 - RNA, 22 nt, Human
gcugagguggagauugcaguga

SEQ ID NO: 1026967 - RNA, 22 nt, Human
uuuacagaaugucaauuucuau

SEQ ID NO: 1026968 - RNA, 22 nt, Human
uagagaaaagcagggaucagga

SEQ ID NO: 1026969 - RNA, 22 nt, Human
guauuuauaggggaaugagagu

SEQ ID NO: 1026970 - RNA, 22 nt, Human
cagcugcaggaacaaaaaugug

SEQ ID NO: 1026971 - RNA, 22 nt, Human
aaaggugacugcagcagcuauu

SEQ ID NO: 1026972 - RNA, 22 nt, Human
ggcuagaacuuuacacuuugca

SEQ ID NO: 1026973 - RNA, 22 nt, Human
ugggacaggaugaccagaaggu

SEQ ID NO: 1026974 - RNA, 22 nt, Human
aggagccccucuucaguccugg

SEQ ID NO: 1026975 - RNA, 21 nt, Human
aaauguguuccauaaugcuuu

SEQ ID NO: 1026976 - RNA, 22 nt, Human
ugucacaaacauacauuauaga

SEQ ID NO: 1026977 - RNA, 22 nt, Human
uuucacauaaauauuaugccua

SEQ ID NO: 1026978 - RNA, 22 nt, Human
gcugccuggaauaacggcuggc

SEQ ID NO: 1026979 - RNA, 23 nt, Human
uuguuuuuagagguggcaugaga

SEQ ID NO: 1026980 - RNA, 22 nt, Human
ugcagcugauuaaagggcagac

SEQ ID NO: 1026981 - RNA, 22 nt, Human
ccugcagagccacgugccagcg

SEQ ID NO: 1026982 - RNA, 22 nt, Human
ugauuuuuagcuauucugaaga

SEQ ID NO: 1026983 - RNA, 22 nt, Human
aucugucaagauagacucugca

SEQ ID NO: 1026984 - RNA, 22 nt, Human
gcuuccugagaaacaaucugau

SEQ ID NO: 1026985 - RNA, 22 nt, Human
gagaacucagacgcaggucaug

SEQ ID NO: 1026986 - RNA, 22 nt, Human
guugaaaguagaugcuauuugg

SEQ ID NO: 1026987 - RNA, 19 nt, Human
uggcugggcgugccuccgu

SEQ ID NO: 1026988 - RNA, 22 nt, Human
aaaguucuuucucuuauuuggu

SEQ ID NO: 1026989 - RNA, 22 nt, Human
auuguaaguagaaauguuaugg

SEQ ID NO: 1026990 - RNA, 22 nt, Human
uccuggagaauccugccaccug

SEQ ID NO: 1026991 - RNA, 22 nt, Human
gcugccuguugaagggucugug

SEQ ID NO: 1026992 - RNA, 22 nt, Human
cuugaaguugcaaaacauuaau

SEQ ID NO: 1026993 - RNA, 19 nt, Human
uggccagguacugucugcu

SEQ ID NO: 1026994 - RNA, 22 nt, Human
uuuacuuugugucaagucaaga

SEQ ID NO: 1026995 - RNA, 22 nt, Human
uaaugcuuaacagcuggcuuuu

SEQ ID NO: 1026996 - RNA, 22 nt, Human
agauuucucuuucccuggcuga

SEQ ID NO: 1026997 - RNA, 22 nt, Human
acucccagguugccuggcaggc

SEQ ID NO: 1026998 - RNA, 22 nt, Human
aggcuggcuggcaggggacaca

SEQ ID NO: 1026999 - RNA, 22 nt, Human
agccugagagccaagcugugca

SEQ ID NO: 1027000 - RNA, 22 nt, Human
uuucagaugugugucucugaag

SEQ ID NO: 1027001 - RNA, 22 nt, Human
ggccugcugcuaugacuuccug

SEQ ID NO: 1027002 - RNA, 23 nt, Human
aguuuguaaagaaauauuugcac

SEQ ID NO: 1027003 - RNA, 22 nt, Human
gccagagcacaggcugguagua

SEQ ID NO: 1027004 - RNA, 23 nt, Human
cccagcgcugagcccugcaggca

SEQ ID NO: 1027005 - RNA, 22 nt, Human
uggcagagagagugcagucgac

SEQ ID NO: 1027006 - RNA, 22 nt, Human
ccuuaaauucuccauuugaaag

SEQ ID NO: 1027007 - RNA, 22 nt, Human
cagaguccugcaccagcuccag

SEQ ID NO: 1027008 - RNA, 22 nt, Human
caggcucccugggcaguggcag

SEQ ID NO: 1027009 - RNA, 22 nt, Human
uuucaaaccuacuuguauguuu

SEQ ID NO: 1027010 - RNA, 22 nt, Human
uccugagauucugcauuucuaa

SEQ ID NO: 1027011 - RNA, 22 nt, Human
gccugagagucugcauuucuaa

SEQ ID NO: 1027012 - RNA, 22 nt, Human
caggguggcaggcaccauggcc

SEQ ID NO: 1027013 - RNA, 22 nt, Human
cugggccucauccucagaguuu

SEQ ID NO: 1027014 - RNA, 22 nt, Human
ccagagaggccuuggcaagaca

SEQ ID NO: 1027015 - RNA, 22 nt, Human
cuagaaaugcucaagagaaagu

SEQ ID NO: 1027016 - RNA, 22 nt, Human
uccaaacacccuccaugcugca

SEQ ID NO: 1027017 - RNA, 22 nt, Human
gccagagacacuuggagguaga

SEQ ID NO: 1027018 - RNA, 22 nt, Human
cuuccucugcggcgccgggcgc

SEQ ID NO: 1027019 - RNA, 22 nt, Human
cugggcagugguggcaucuuug

SEQ ID NO: 1027020 - RNA, 22 nt, Human
aauguaugacaguucuaguggu

SEQ ID NO: 1027021 - RNA, 22 nt, Human
gaaaugugugacaaguuucaau

SEQ ID NO: 1027022 - RNA, 18 nt, Human
cccagcuuagcgccccuc

SEQ ID NO: 1027023 - RNA, 22 nt, Human
gcuuccuucuaccacaucaugc

SEQ ID NO: 1027024 - RNA, 22 nt, Human
ggcugcaguuugucuuuugcuu

SEQ ID NO: 1027025 - RNA, 22 nt, Human
uauuuccaccuauuauuuucug

SEQ ID NO: 1027026 - RNA, 22 nt, Human
auguuucaucaguaagguuuug

SEQ ID NO: 1027027 - RNA, 22 nt, Human
aaguuguauauaccgcuuuaag

SEQ ID NO: 1027028 - RNA, 22 nt, Human
caagggccuccaccuugcucgu

SEQ ID NO: 1027029 - RNA, 22 nt, Human
gccuggcaggccuguuggggcu

SEQ ID NO: 1027030 - RNA, 22 nt, Human
aauguguguauuucuaggcgag

SEQ ID NO: 1027031 - RNA, 22 nt, Human
gugugccaccagucaaggugaa

SEQ ID NO: 1027032 - RNA, 22 nt, Human
cuccauugaacauccucucaga

SEQ ID NO: 1027033 - RNA, 22 nt, Human
ccugcucugguuuagucagucu

SEQ ID NO: 1027034 - RNA, 22 nt, Human
uggaaagaaaaacaggccauga

SEQ ID NO: 1027035 - RNA, 21 nt, Human
ggauggauagggaagagauuu

SEQ ID NO: 1027036 - RNA, 19 nt, Human
ccucugccagcccgccucu

SEQ ID NO: 1027037 - RNA, 22 nt, Human
gcucaagggaugggagugggug

SEQ ID NO: 1027038 - RNA, 22 nt, Human
gaggccugcuuuggcacucugg

SEQ ID NO: 1027039 - RNA, 22 nt, Human
ucaacacuauccaggcaaucuu

SEQ ID NO: 1027040 - RNA, 22 nt, Human
cugccuggaaugccagcuucuc

SEQ ID NO: 1027041 - RNA, 21 nt, Human
uuucaauguguucuuuguagu

SEQ ID NO: 1027042 - RNA, 22 nt, Human
cugcaucaguggauaugauggu

SEQ ID NO: 1027043 - RNA, 22 nt, Human
uauaauguuuuccauggacuga

SEQ ID NO: 1027044 - RNA, 22 nt, Human
cagacuuucaaggagugaaggc

SEQ ID NO: 1027045 - RNA, 22 nt, Human
uuugaaagaaaccagugaguga

SEQ ID NO: 1027046 - RNA, 22 nt, Human
aaggcugcuuuuaacaugcaua

SEQ ID NO: 1027047 - RNA, 22 nt, Human
ucuuguccuaagagcuggauuc

SEQ ID NO: 1027048 - RNA, 22 nt, Human
aguguuccugcucucaggaagc

SEQ ID NO: 1027049 - RNA, 17 nt, Human
aggugcuggagcaucag

SEQ ID NO: 1027050 - RNA, 22 nt, Human
ugugcccauuacacagaggcau

SEQ ID NO: 1027051 - RNA, 22 nt, Human
uuccauaaaggugauaguauac

SEQ ID NO: 1027052 - RNA, 21 nt, Human
gauuuuaaagagacugccaca

SEQ ID NO: 1027053 - RNA, 22 nt, Human
agcuuguuagaaauguagacuc

SEQ ID NO: 1027054 - RNA, 19 nt, Human
cugggacaaugaaagcauc

SEQ ID NO: 1027055 - RNA, 22 nt, Human
ucauggagacuuugagccuguu

SEQ ID NO: 1027056 - RNA, 22 nt, Human
caggaggccaacugugggacuu

SEQ ID NO: 1027057 - RNA, 22 nt, Human
ccagucccagcucugccaugcu

SEQ ID NO: 1027058 - RNA, 22 nt, Human
ccuuuugcucucccauccagaa

SEQ ID NO: 1027059 - RNA, 22 nt, Human
agcugcagagguuugugcaaca

SEQ ID NO: 1027060 - RNA, 22 nt, Human
agcugccacaugcccaagggca

SEQ ID NO: 1027061 - RNA, 22 nt, Human
ugcuggguuaccuaagccuaaa

SEQ ID NO: 1027062 - RNA, 22 nt, Human
aggcugucugaccccagagccc

SEQ ID NO: 1027063 - RNA, 18 nt, Human
gggcccuggcguccgccc

SEQ ID NO: 1027064 - RNA, 22 nt, Human
uuucuuauauucugucauuguu

SEQ ID NO: 1027065 - RNA, 22 nt, Human
auugucuuuccacugagaaguu

SEQ ID NO: 1027066 - RNA, 22 nt, Human
caguagcaggcaggugcuuuug

SEQ ID NO: 1027067 - RNA, 22 nt, Human
uuucuauugaucuaauaaacau

SEQ ID NO: 1027068 - RNA, 19 nt, Human
acaggcagaauugggugug

SEQ ID NO: 1027069 - RNA, 22 nt, Human
cagccccucacagagcuguccu

SEQ ID NO: 1027070 - RNA, 22 nt, Human
acuggcagccacaacuggcagg

SEQ ID NO: 1027071 - RNA, 22 nt, Human
gccucugggcucugccccuggc

SEQ ID NO: 1027072 - RNA, 18 nt, Human
gaaaugugauucuagggc

SEQ ID NO: 1027073 - RNA, 22 nt, Human
cacagggcuucucauggggugc

SEQ ID NO: 1027074 - RNA, 22 nt, Human
agagauguucauucagcauguu

SEQ ID NO: 1027075 - RNA, 22 nt, Human
ucaaagagcuauucaguugugg

SEQ ID NO: 1027076 - RNA, 22 nt, Human
uugggcugaaguagagggcaga

SEQ ID NO: 1027077 - RNA, 22 nt, Human
caaaugauacuguuuuuagucu

SEQ ID NO: 1027078 - RNA, 21 nt, Human
ucuguacaucauugagucccc

SEQ ID NO: 1027079 - RNA, 18 nt, Human
gagcccugagucugcaca

SEQ ID NO: 1027080 - RNA, 22 nt, Human
uaguauuuaaucacuuuugucu

SEQ ID NO: 1027081 - RNA, 22 nt, Human
uguacauacauagauauacaca

SEQ ID NO: 1027082 - RNA, 22 nt, Human
caucagcagucacaugaugcug

SEQ ID NO: 1027083 - RNA, 22 nt, Human
cagagcugguaagugguagagg

SEQ ID NO: 1027084 - RNA, 22 nt, Human
ucugugacuugcgggaggagaa

SEQ ID NO: 1027085 - RNA, 22 nt, Human
cuggaagguuccucccagcucc

SEQ ID NO: 1027086 - RNA, 21 nt, Human
uccuuccuugagguccuuucc

SEQ ID NO: 1027087 - RNA, 22 nt, Human
gugugcaugcauagacaccaca

SEQ ID NO: 1027088 - RNA, 20 nt, Human
gagauuuccaaucaugccca

SEQ ID NO: 1027089 - RNA, 22 nt, Human
cagaauggcuuuuauggcucag

SEQ ID NO: 1027090 - RNA, 22 nt, Human
ucugggagguaaccaugcugau

SEQ ID NO: 1027091 - RNA, 22 nt, Human
gcagagccaggagcccaggauc

SEQ ID NO: 1027092 - RNA, 22 nt, Human
aguucuucauaaccuuacugug

SEQ ID NO: 1027093 - RNA, 22 nt, Human
ggcccucccugagccagguggg

SEQ ID NO: 1027094 - RNA, 22 nt, Human
acucaggaaaugaagacugguu

SEQ ID NO: 1027095 - RNA, 22 nt, Human
caugggcuuuggaggcuggagg

SEQ ID NO: 1027096 - RNA, 22 nt, Human
ggaggccaguccuggccgggcu

SEQ ID NO: 1027097 - RNA, 22 nt, Human
cagcaggguagguuguaucagu

SEQ ID NO: 1027098 - RNA, 22 nt, Human
auucuucauacagacaaguccu

SEQ ID NO: 1027099 - RNA, 22 nt, Human
uuugacaugcaaagcacuuuag

SEQ ID NO: 1027100 - RNA, 22 nt, Human
ucagagaguccuggucauuugc

SEQ ID NO: 1027101 - RNA, 22 nt, Human
uccugcagagacagaggccuca

SEQ ID NO: 1027102 - RNA, 22 nt, Human
agcagggggccacagucacagc

SEQ ID NO: 1027103 - RNA, 22 nt, Human
uauguacauaacaugaaaugca

SEQ ID NO: 1027104 - RNA, 22 nt, Human
ucugggaguuguaguccggugg

SEQ ID NO: 1027105 - RNA, 22 nt, Human
guccagggaaauagcgacaggg

SEQ ID NO: 1027106 - RNA, 23 nt, Human
cacugcagcguggucuggcagga

SEQ ID NO: 1027107 - RNA, 22 nt, Human
ggucccaggaaucuguguucua

SEQ ID NO: 1027108 - RNA, 22 nt, Human
acuccuggggauccauuccuuu

SEQ ID NO: 1027109 - RNA, 22 nt, Human
uccugcaggccuguucccagua

SEQ ID NO: 1027110 - RNA, 22 nt, Human
cagcuuugcaggcuggucagug

SEQ ID NO: 1027111 - RNA, 23 nt, Human
uuuauccaacucuguaaucucuc

SEQ ID NO: 1027112 - RNA, 22 nt, Human
guccaggaaucaaaagauggaa

SEQ ID NO: 1027113 - RNA, 22 nt, Human
aggcacuguacuagguacaggg

SEQ ID NO: 1027114 - RNA, 22 nt, Human
cagagccaaaugcugugguuau

SEQ ID NO: 1027115 - RNA, 22 nt, Human
agggcagacuaggauggaagug

SEQ ID NO: 1027116 - RNA, 22 nt, Human
cccagggagguagcaggagaaa

SEQ ID NO: 1027117 - RNA, 22 nt, Human
uaguuacagcaggcaggauaua

SEQ ID NO: 1027118 - RNA, 22 nt, Human
aaauccuaauaaugcacuagug

SEQ ID NO: 1027119 - RNA, 22 nt, Human
gaggccacagcuaucagggaca

SEQ ID NO: 1027120 - RNA, 22 nt, Human
ggagggugcauuuuacccugug

SEQ ID NO: 1027121 - RNA, 22 nt, Human
ucucugguggcuccaucaguag

SEQ ID NO: 1027122 - RNA, 22 nt, Human
gcucaggaaaacagucuaguaa

SEQ ID NO: 1027123 - RNA, 22 nt, Human
uuaagacauucagauauuucua

SEQ ID NO: 1027124 - RNA, 22 nt, Human
uucuuucucaacaugaauguuu

SEQ ID NO: 1027125 - RNA, 22 nt, Human
ccagguggcuucugcccgaugu

SEQ ID NO: 1027126 - RNA, 22 nt, Human
uaaaugugaccuucauuuuaua

SEQ ID NO: 1027127 - RNA, 22 nt, Human
acaauguguuuuuauacauuug

SEQ ID NO: 1027128 - RNA, 22 nt, Human
caggcagcucgaugccuuguug

SEQ ID NO: 1027129 - RNA, 22 nt, Human
gauuuagagaauguuuuguaag

SEQ ID NO: 1027130 - RNA, 22 nt, Human
aaaucucaauuugaauuguagc

SEQ ID NO: 1027131 - RNA, 22 nt, Human
acagcuguggccacuugcaucc

SEQ ID NO: 1027132 - RNA, 22 nt, Human
aagcugccaaugguaagcugcu

SEQ ID NO: 1027133 - RNA, 22 nt, Human
aauacaguagguaauaguucau

SEQ ID NO: 1027134 - RNA, 22 nt, Human
uaaggccaaggggccauagucu

SEQ ID NO: 1027135 - RNA, 22 nt, Human
ugagcccagucugucugacaug

SEQ ID NO: 1027136 - RNA, 22 nt, Human
aaagucauguaaugauaugauu

SEQ ID NO: 1027137 - RNA, 22 nt, Human
ggcucuggagacauguggagag

SEQ ID NO: 1027138 - RNA, 22 nt, Human
aguuuuauuccaaugugcagca

SEQ ID NO: 1027139 - RNA, 22 nt, Human
uuccaggaggcacugacagagg

SEQ ID NO: 1027140 - RNA, 23 nt, Human
ggcucugugcugggccugcagga

SEQ ID NO: 1027141 - RNA, 22 nt, Human
cagagcugagucuucaagguug

SEQ ID NO: 1027142 - RNA, 22 nt, Human
ugucccagcagcuggguucucu

SEQ ID NO: 1027143 - RNA, 22 nt, Human
augaccccuaaaauuuacuguc

SEQ ID NO: 1027144 - RNA, 22 nt, Human
ugagcccagagcccuuguaggg

SEQ ID NO: 1027145 - RNA, 22 nt, Human
caccagcagaagacugagggug

SEQ ID NO: 1027146 - RNA, 22 nt, Human
ccacagugguucucaaccaggg

SEQ ID NO: 1027147 - RNA, 22 nt, Human
ucaaaugcucuuugcagagagg

SEQ ID NO: 1027148 - RNA, 20 nt, Human
auaaaauaacugccacaaga

SEQ ID NO: 1027149 - RNA, 22 nt, Human
gaggcugaggguuagagaguca

SEQ ID NO: 1027150 - RNA, 22 nt, Human
cccuccagcucaaagcaaccgg

SEQ ID NO: 1027151 - RNA, 22 nt, Human
aucugucaggagcaaggacuac

SEQ ID NO: 1027152 - RNA, 22 nt, Human
gacagggcgagacucagucuca

SEQ ID NO: 1027153 - RNA, 22 nt, Human
auuuccauagagcgucucacag

SEQ ID NO: 1027154 - RNA, 22 nt, Human
cuuauguaaacuacagauaaua

SEQ ID NO: 1027155 - RNA, 22 nt, Human
auagauacauuagguaacuugu

SEQ ID NO: 1027156 - RNA, 22 nt, Human
uagggcagaguccaggaugggc

SEQ ID NO: 1027157 - RNA, 22 nt, Human
auaguguuacccuucuuaaagu

SEQ ID NO: 1027158 - RNA, 17 nt, Human
uuauuuuuugggcugag

SEQ ID NO: 1027159 - RNA, 21 nt, Human
uggcugcuggcccucucucca

SEQ ID NO: 1027160 - RNA, 22 nt, Human
ccuggacucaggcugugggcac

SEQ ID NO: 1027161 - RNA, 22 nt, Human
caucacugacgcugagauucca

SEQ ID NO: 1027162 - RNA, 22 nt, Human
ccagagaguaaacauuuuccgg

SEQ ID NO: 1027163 - RNA, 22 nt, Human
aagauuuagggccaguuuacau

SEQ ID NO: 1027164 - RNA, 22 nt, Human
gggcuucucuuaugcuaacugg

SEQ ID NO: 1027165 - RNA, 22 nt, Human
aggagcuguuuuguucagcaaa

SEQ ID NO: 1027166 - RNA, 22 nt, Human
aggcuggggaauugaauuugcu

SEQ ID NO: 1027167 - RNA, 22 nt, Human
ggccugugcacaugugcaggaa

SEQ ID NO: 1027168 - RNA, 22 nt, Human
ugcuggcugggcugcuggagac

SEQ ID NO: 1027169 - RNA, 22 nt, Human
agggcuggagccacagcuggga

SEQ ID NO: 1027170 - RNA, 22 nt, Human
ggaaaaggccauuguuucucug

SEQ ID NO: 1027171 - RNA, 21 nt, Human
auucagaguaauucaucuuua

SEQ ID NO: 1027172 - RNA, 22 nt, Human
cugcugggcuccucaugugacu

SEQ ID NO: 1027173 - RNA, 20 nt, Human
uccagaggccacauccagug

SEQ ID NO: 1027174 - RNA, 22 nt, Human
ugcugggcuugaaagcugcuaa

SEQ ID NO: 1027175 - RNA, 22 nt, Human
uauaauuuuagaagagauggaa

SEQ ID NO: 1027176 - RNA, 22 nt, Human
uuguaugaggauagcaagaagc

SEQ ID NO: 1027177 - RNA, 22 nt, Human
augcuauacauaugacaucaca

SEQ ID NO: 1027178 - RNA, 21 nt, Human
acagucuccccagaucucucc

SEQ ID NO: 1027179 - RNA, 20 nt, Human
aguagcagugugacauugac

SEQ ID NO: 1027180 - RNA, 22 nt, Human
uggaagcagugauucuugucug

SEQ ID NO: 1027181 - RNA, 22 nt, Human
cauccagggcagccauggccug

SEQ ID NO: 1027182 - RNA, 22 nt, Human
gaagccucaacaucucugcguc

SEQ ID NO: 1027183 - RNA, 22 nt, Human
acuugcauuauauuuaucacaa

SEQ ID NO: 1027184 - RNA, 19 nt, Human
auuucaagagguuuauugg

SEQ ID NO: 1027185 - RNA, 18 nt, Human
cucucugggugaggacaa

SEQ ID NO: 1027186 - RNA, 21 nt, Human
gcaugccugcaucuuaguguu

SEQ ID NO: 1027187 - RNA, 22 nt, Human
agcugcugugugcucaggcagg

SEQ ID NO: 1027188 - RNA, 22 nt, Human
guuauaaaaugcacaguuguuu

SEQ ID NO: 1027189 - RNA, 22 nt, Human
ugucagugaguuaguugcaagu

SEQ ID NO: 1027190 - RNA, 22 nt, Human
aggugaguuacaggaggagguc

SEQ ID NO: 1027191 - RNA, 22 nt, Human
cugaaggauuagagagcacuua

SEQ ID NO: 1027192 - RNA, 22 nt, Human
acccagcuguuucccgugucau

SEQ ID NO: 1027193 - RNA, 22 nt, Human
cucucugagugagggacaagcu

SEQ ID NO: 1027194 - RNA, 22 nt, Human
ccaggggaaacagggagcacuc

SEQ ID NO: 1027195 - RNA, 22 nt, Human
cuguaugaggaucagacuggac

SEQ ID NO: 1027196 - RNA, 22 nt, Human
auuaauuuuaccuuuguaaaca

SEQ ID NO: 1027197 - RNA, 22 nt, Human
cugagagucagcuucuccuccu

SEQ ID NO: 1027198 - RNA, 22 nt, Human
uccugccugagcguggaggagg

SEQ ID NO: 1027199 - RNA, 19 nt, Human
uccauaagcuuguguucau

SEQ ID NO: 1027200 - RNA, 22 nt, Human
ucugggagagcugcugucagag

SEQ ID NO: 1027201 - RNA, 22 nt, Human
gucuucuuguguugccugucuu

SEQ ID NO: 1027202 - RNA, 22 nt, Human
uaagcauucaaugcuuagcacu

SEQ ID NO: 1027203 - RNA, 22 nt, Human
uuccauaacugaccgaaugcau

SEQ ID NO: 1027204 - RNA, 22 nt, Human
gcugggaggaucucucccuguc

SEQ ID NO: 1027205 - RNA, 22 nt, Human
cagccagguaugggcgugcggg

SEQ ID NO: 1027206 - RNA, 22 nt, Human
cucaaguaagaaacagaauugg

SEQ ID NO: 1027207 - RNA, 22 nt, Human
ugcguugcgcuccugcagcagg

SEQ ID NO: 1027208 - RNA, 22 nt, Human
gugggaugcaguggugaguggc

SEQ ID NO: 1027209 - RNA, 22 nt, Human
ucuggcuccuggcuccacugcc

SEQ ID NO: 1027210 - RNA, 21 nt, Human
agcugcuuucagcuccuagag

SEQ ID NO: 1027211 - RNA, 22 nt, Human
gaaaagggcaagagagagggca

SEQ ID NO: 1027212 - RNA, 22 nt, Human
augucaaacacaacaccagugg

SEQ ID NO: 1027213 - RNA, 22 nt, Human
guggcucuccauugacauggaa

SEQ ID NO: 1027214 - RNA, 22 nt, Human
acuuugcacuaaguuacucauu

SEQ ID NO: 1027215 - RNA, 22 nt, Human
ccagggugaggaggcucccacg

SEQ ID NO: 1027216 - RNA, 22 nt, Human
cagggcucaccacugggauccu

SEQ ID NO: 1027217 - RNA, 23 nt, Human
gggggcugguugacucucugcag

SEQ ID NO: 1027218 - RNA, 22 nt, Human
ucagagagccucaggcacugcc

SEQ ID NO: 1027219 - RNA, 20 nt, Human
ugcagagcuggcuggcuccu

SEQ ID NO: 1027220 - RNA, 22 nt, Human
ggcagggcuugucucugugaug

SEQ ID NO: 1027221 - RNA, 22 nt, Human
ccuggccucagacagagggugg

SEQ ID NO: 1027222 - RNA, 22 nt, Human
uucugucacuuuuuuggaaucu

SEQ ID NO: 1027223 - RNA, 22 nt, Human
cuugugcauuucauuccucagg

SEQ ID NO: 1027224 - RNA, 19 nt, Human
auaaggcaauuggauuugg

SEQ ID NO: 1027225 - RNA, 22 nt, Human
acaguguucacuuaacaaugga

SEQ ID NO: 1027226 - RNA, 22 nt, Human
uuaaacagguuuuugaauggcc

SEQ ID NO: 1027227 - RNA, 22 nt, Human
ugacuucaaaggcucuacuccu

SEQ ID NO: 1027228 - RNA, 22 nt, Human
gggcacagaagucuaagacauc

SEQ ID NO: 1027229 - RNA, 22 nt, Human
ucagucuucccuccagugcaac

SEQ ID NO: 1027230 - RNA, 22 nt, Human
gaggcugcugagagcccuguuu

SEQ ID NO: 1027231 - RNA, 22 nt, Human
ugggcuccagcaccugugcucu

SEQ ID NO: 1027232 - RNA, 22 nt, Human
gccugcagacguguuuuccuca

SEQ ID NO: 1027233 - RNA, 22 nt, Human
ggaaaugacuuggugcuucguu

SEQ ID NO: 1027234 - RNA, 22 nt, Human
aggcucccaagcacugacccca

SEQ ID NO: 1027235 - RNA, 22 nt, Human
ugcagcuguaacagaggccuca

SEQ ID NO: 1027236 - RNA, 22 nt, Human
aaaguucugggggagaagaacg

SEQ ID NO: 1027237 - RNA, 22 nt, Human
uuccucagaaaauacuguccaa

SEQ ID NO: 1027238 - RNA, 22 nt, Human
ugcauggaggaagaugaaugca

SEQ ID NO: 1027239 - RNA, 22 nt, Human
agccuggagaagauguguauug

SEQ ID NO: 1027240 - RNA, 22 nt, Human
uuucaguguaagguuuccagga

SEQ ID NO: 1027241 - RNA, 22 nt, Human
ccagccugguucagaauuggcu

SEQ ID NO: 1027242 - RNA, 22 nt, Human
ucuugggaaauaaacagauuga

SEQ ID NO: 1027243 - RNA, 20 nt, Human
cuugaguucagagcugucau

SEQ ID NO: 1027244 - RNA, 22 nt, Human
aacuagaaagaacauauuucca

SEQ ID NO: 1027245 - RNA, 22 nt, Human
cugcugucuuuauuucacugcu

SEQ ID NO: 1027246 - RNA, 20 nt, Human
uugagcagcagugcuguguc

SEQ ID NO: 1027247 - RNA, 22 nt, Human
uccucauucuuggugcaucaaa

SEQ ID NO: 1027248 - RNA, 22 nt, Human
cugagcacguaguuagggucca

SEQ ID NO: 1027249 - RNA, 22 nt, Human
cuuucuuucgaagacgugauua

SEQ ID NO: 1027250 - RNA, 22 nt, Human
uucccagauuggagggcagggg

SEQ ID NO: 1027251 - RNA, 22 nt, Human
gggcucggcaucuguggacucu

SEQ ID NO: 1027252 - RNA, 22 nt, Human
acugagcaggguuccgcaugga

SEQ ID NO: 1027253 - RNA, 22 nt, Human
cugaucuuaaguaacauuauuu

SEQ ID NO: 1027254 - RNA, 22 nt, Human
gcuggccugaccugaggcuggg

SEQ ID NO: 1027255 - RNA, 22 nt, Human
uuuuggcucugcagguuugcac

SEQ ID NO: 1027256 - RNA, 18 nt, Human
cugccagugugcucuccg

SEQ ID NO: 1027257 - RNA, 22 nt, Human
aucuucccaggcuggggagagg

SEQ ID NO: 1027258 - RNA, 22 nt, Human
ccagguaggagagucaacaugu

SEQ ID NO: 1027259 - RNA, 22 nt, Human
gcugguggcagagcuccgcggc

SEQ ID NO: 1027260 - RNA, 22 nt, Human
auggugguagaagcacuaugug

SEQ ID NO: 1027261 - RNA, 22 nt, Human
gggcagcaucaggaggggcuuu

SEQ ID NO: 1027262 - RNA, 22 nt, Human
cugaggagauccccccagaagu

SEQ ID NO: 1027263 - RNA, 22 nt, Human
ggcagaggaagcuggaaguggg

SEQ ID NO: 1027264 - RNA, 22 nt, Human
cauugcaacuucaaacuccugg

SEQ ID NO: 1027265 - RNA, 22 nt, Human
ugugaagaauuaaugugaauca

SEQ ID NO: 1027266 - RNA, 22 nt, Human
ucucugagaucagccacugacu

SEQ ID NO: 1027267 - RNA, 23 nt, Human
uggagaauucagucuuuguuuug

SEQ ID NO: 1027268 - RNA, 22 nt, Human
caguuuccugaagagaaagaau

SEQ ID NO: 1027269 - RNA, 22 nt, Human
ggcuggaaggcccuuuguugau

SEQ ID NO: 1027270 - RNA, 22 nt, Human
gucugugcaguuacuagcuggu

SEQ ID NO: 1027271 - RNA, 22 nt, Human
ucugugggcauuuauaaucugg

SEQ ID NO: 1027272 - RNA, 22 nt, Human
uucucuucacagggaucauccu

SEQ ID NO: 1027273 - RNA, 19 nt, Human
uccuugacuguauucagag

SEQ ID NO: 1027274 - RNA, 22 nt, Human
uagggcucugagaguucagccu

SEQ ID NO: 1027275 - RNA, 22 nt, Human
acauucaugcaccuuccuaucc

SEQ ID NO: 1027276 - RNA, 22 nt, Human
uggccucuccuggcagcaucca

SEQ ID NO: 1027277 - RNA, 22 nt, Human
gcuuucuuuucaagaauguauu

SEQ ID NO: 1027278 - RNA, 22 nt, Human
agugauguagguggauucuggc

SEQ ID NO: 1027279 - RNA, 19 nt, Human
ugggcuuccccagggcaga

SEQ ID NO: 1027280 - RNA, 22 nt, Human
agucuggagugauuauguggga

SEQ ID NO: 1027281 - RNA, 22 nt, Human
uccuggccucugagucaagaac

SEQ ID NO: 1027282 - RNA, 22 nt, Human
gaaacauuuguugaguacuugc

SEQ ID NO: 1027283 - RNA, 22 nt, Human
auagcaaaggacaauagucagu

SEQ ID NO: 1027284 - RNA, 22 nt, Human
uucuuuuaauuucugucugcag

SEQ ID NO: 1027285 - RNA, 22 nt, Human
ucacgugagggaccugugucug

SEQ ID NO: 1027286 - RNA, 21 nt, Human
gcuggcugucucuuacacggu

SEQ ID NO: 1027287 - RNA, 22 nt, Human
uggaaauacaagaaguauguca

SEQ ID NO: 1027288 - RNA, 22 nt, Human
ccagaaugugugaaauuugaug

SEQ ID NO: 1027289 - RNA, 22 nt, Human
gggacagcuguagugcuuggcu

SEQ ID NO: 1027290 - RNA, 22 nt, Human
acaggauuaauaaaaaauugua

SEQ ID NO: 1027291 - RNA, 22 nt, Human
ugauuccugugcuuauuccagu

SEQ ID NO: 1027292 - RNA, 22 nt, Human
uguuuuaagggucaacugucac

SEQ ID NO: 1027293 - RNA, 22 nt, Human
auugcacaucugcacuacagcc

SEQ ID NO: 1027294 - RNA, 22 nt, Human
cacaguuuuaucuuauacugau

SEQ ID NO: 1027295 - RNA, 22 nt, Human
augcacuaugaugagcuagucu

SEQ ID NO: 1027296 - RNA, 23 nt, Human
uggccucuccccaccuggcagaa

SEQ ID NO: 1027297 - RNA, 22 nt, Human
guacuuucaggcuuucccuuaa

SEQ ID NO: 1027298 - RNA, 22 nt, Human
uuaaggaacuugucuuucucuu

SEQ ID NO: 1027299 - RNA, 22 nt, Human
cccaggaguuagagguuguggu

SEQ ID NO: 1027300 - RNA, 22 nt, Human
ccuuuuggccaggucagugcag

SEQ ID NO: 1027301 - RNA, 22 nt, Human
aaugaaacuaguagaaucuuug

SEQ ID NO: 1027302 - RNA, 22 nt, Human
gagaguuaguugagcagucuga

SEQ ID NO: 1027303 - RNA, 22 nt, Human
cuuauuggucccaggaggagaa

SEQ ID NO: 1027304 - RNA, 22 nt, Human
ggucuccugaccuuuagucccu

SEQ ID NO: 1027305 - RNA, 22 nt, Human
caaaugaugcauggcuagugag

SEQ ID NO: 1027306 - RNA, 22 nt, Human
uaaaguuuauuggcaccaccau

SEQ ID NO: 1027307 - RNA, 22 nt, Human
uggcuggcuguccagcugggca

SEQ ID NO: 1027308 - RNA, 21 nt, Human
ugucagcaacaauacuuucuc

SEQ ID NO: 1027309 - RNA, 22 nt, Human
auuuccaggaguugaggucuga

SEQ ID NO: 1027310 - RNA, 22 nt, Human
acaaguuucauuguuuagaacc

SEQ ID NO: 1027311 - RNA, 22 nt, Human
uucaguaugcugaaugauuuuu

SEQ ID NO: 1027312 - RNA, 22 nt, Human
cuauuuucccauaugguugaca

SEQ ID NO: 1027313 - RNA, 22 nt, Human
cuguggcugcgcccugggggag

SEQ ID NO: 1027314 - RNA, 22 nt, Human
ugcugggauuacagucaugagc

SEQ ID NO: 1027315 - RNA, 22 nt, Human
ccugugucaucagcuguggcua

SEQ ID NO: 1027316 - RNA, 22 nt, Human
cauugcuguuaauugucucuag

SEQ ID NO: 1027317 - RNA, 22 nt, Human
uucugugcucaaaacuuuccaa

SEQ ID NO: 1027318 - RNA, 22 nt, Human
gagcugggaagauagcuugagc

SEQ ID NO: 1027319 - RNA, 22 nt, Human
cuucauuaaugucuauaaguuu

SEQ ID NO: 1027320 - RNA, 17 nt, Human
ucuggaugucauggaag

SEQ ID NO: 1027321 - RNA, 22 nt, Human
acugcauuugguaaagucaaga

SEQ ID NO: 1027322 - RNA, 22 nt, Human
ugggggagccuucacaguagcu

SEQ ID NO: 1027323 - RNA, 22 nt, Human
agggcagagauuaauuaagaca

SEQ ID NO: 1027324 - RNA, 22 nt, Human
ugggugcucugcgaccguaggg

SEQ ID NO: 1027325 - RNA, 22 nt, Human
uuaggcauccugucccuggauu

SEQ ID NO: 1027326 - RNA, 22 nt, Human
uggcagcagggccccuggagga

SEQ ID NO: 1027327 - RNA, 22 nt, Human
gaugugucccuuucaacucaga

SEQ ID NO: 1027328 - RNA, 22 nt, Human
cugggguuggccagggcccuag

SEQ ID NO: 1027329 - RNA, 22 nt, Human
ugaacaugcuguugauggccug

SEQ ID NO: 1027330 - RNA, 22 nt, Human
gcucugugccccugccguggac

SEQ ID NO: 1027331 - RNA, 22 nt, Human
uugcaaauaauagccugaaacu

SEQ ID NO: 1027332 - RNA, 22 nt, Human
acaaacuucccagacaagcucc

SEQ ID NO: 1027333 - RNA, 22 nt, Human
cucugguuucgcaggaaauaga

SEQ ID NO: 1027334 - RNA, 22 nt, Human
cuuccagugcauagguagauca

SEQ ID NO: 1027335 - RNA, 22 nt, Human
auggauggaacucugcuguggu

SEQ ID NO: 1027336 - RNA, 22 nt, Human
ugaggaggugggcacacagagu

SEQ ID NO: 1027337 - RNA, 22 nt, Human
cugagcugguucucuugugaaa

SEQ ID NO: 1027338 - RNA, 22 nt, Human
uuguccagcgaccaggcucugu

SEQ ID NO: 1027339 - RNA, 22 nt, Human
ucaggcuagcccagugcuuggg

SEQ ID NO: 1027340 - RNA, 22 nt, Human
gcugccuggaauaacggcuggc

SEQ ID NO: 1027341 - RNA, 22 nt, Human
uugcugccagcgcccugcaggg

SEQ ID NO: 1027342 - RNA, 22 nt, Human
cuggugcuguagccugauugag

SEQ ID NO: 1027343 - RNA, 22 nt, Human
gcuggguggaucggaggcucug

SEQ ID NO: 1027344 - RNA, 22 nt, Human
gaucuguccuggcaguuaacac

SEQ ID NO: 1027345 - RNA, 22 nt, Human
ugagcagacuugaugaggcagc

SEQ ID NO: 1027346 - RNA, 22 nt, Human
ccucuggccuaggccgggagag

SEQ ID NO: 1027347 - RNA, 22 nt, Human
uuggaggaagcucaugggggau

SEQ ID NO: 1027348 - RNA, 22 nt, Human
ucuggauggucagcucuuccug

SEQ ID NO: 1027349 - RNA, 22 nt, Human
gguguggcaguggaccugugaa

SEQ ID NO: 1027350 - RNA, 22 nt, Human
uugagacucgagucucucagac

SEQ ID NO: 1027351 - RNA, 19 nt, Human
uuuaaugugugcugcaauc

SEQ ID NO: 1027352 - RNA, 22 nt, Human
cugcgggcugucaggcgugcca

SEQ ID NO: 1027353 - RNA, 22 nt, Human
uaaugccuuaugucaaauguaa

SEQ ID NO: 1027354 - RNA, 22 nt, Human
guuauucuauuaaugugauugu

SEQ ID NO: 1027355 - RNA, 22 nt, Human
cuggcagcucugagucccuucu

SEQ ID NO: 1027356 - RNA, 22 nt, Human
gccuggagcucggcugagggcg

SEQ ID NO: 1027357 - RNA, 22 nt, Human
gccucugcaccaguacugugcc

SEQ ID NO: 1027358 - RNA, 22 nt, Human
agcauucuguggucuucuaugg

SEQ ID NO: 1027359 - RNA, 22 nt, Human
cugaccaguccuuagcaccugg

SEQ ID NO: 1027360 - RNA, 22 nt, Human
gcuucuggugaggccucaggaa

SEQ ID NO: 1027361 - RNA, 22 nt, Human
caauguuuuuccuuccuuaaua

SEQ ID NO: 1027362 - RNA, 22 nt, Human
uagaggaugauccuuccuugcc

SEQ ID NO: 1027363 - RNA, 22 nt, Human
caguuuuucaaaauuacaugau

SEQ ID NO: 1027364 - RNA, 22 nt, Human
acagccaggaauucuggagaag

SEQ ID NO: 1027365 - RNA, 22 nt, Human
ucauugaggaaagguaguggcu

SEQ ID NO: 1027366 - RNA, 22 nt, Human
guucuucagcccucagguccua

SEQ ID NO: 1027367 - RNA, 22 nt, Human
agcaaauaauugucuuugaggg

SEQ ID NO: 1027368 - RNA, 22 nt, Human
auccuugaaugacucugcccuc

SEQ ID NO: 1027369 - RNA, 22 nt, Human
agaaaucugacugcugugcaca

SEQ ID NO: 1027370 - RNA, 22 nt, Human
uuuucuuggaguggcuguccuu

SEQ ID NO: 1027371 - RNA, 22 nt, Human
acugcauuaucaccaagaugua

SEQ ID NO: 1027372 - RNA, 22 nt, Human
ugggaacuguacugccuugaac

SEQ ID NO: 1027373 - RNA, 23 nt, Human
cguguccuucagggagagugugg

SEQ ID NO: 1027374 - RNA, 22 nt, Human
uuucauuauaaaaaguuggcuu

SEQ ID NO: 1027375 - RNA, 22 nt, Human
cuggcccugucagcacagaauc

SEQ ID NO: 1027376 - RNA, 22 nt, Human
auggaguucugccagcgcugcu

SEQ ID NO: 1027377 - RNA, 22 nt, Human
cugcuucacccugccugagaac

SEQ ID NO: 1027378 - RNA, 22 nt, Human
gacaggugcuaagggaccuggc

SEQ ID NO: 1027379 - RNA, 22 nt, Human
gcugccaucuccugaggacagg

SEQ ID NO: 1027380 - RNA, 22 nt, Human
cuccagcagaaagggcgagugg

SEQ ID NO: 1027381 - RNA, 22 nt, Human
cccagaggcugaguugggagca

SEQ ID NO: 1027382 - RNA, 22 nt, Human
uccaggcugacgcagcuauuua

SEQ ID NO: 1027383 - RNA, 22 nt, Human
auagacacagcuaugauuugag

SEQ ID NO: 1027384 - RNA, 22 nt, Human
ucggggauggugucugagggag

SEQ ID NO: 1027385 - RNA, 22 nt, Human
ucauccugaagaaccugcuucc

SEQ ID NO: 1027386 - RNA, 22 nt, Human
gugggugucaguaucuuuaacg

SEQ ID NO: 1027387 - RNA, 22 nt, Human
acaaaggugagcagaagacaca

SEQ ID NO: 1027388 - RNA, 22 nt, Human
aucauuaacccuugaugcuggg

SEQ ID NO: 1027389 - RNA, 22 nt, Human
ucucugguuauuaacuaacucc

SEQ ID NO: 1027390 - RNA, 20 nt, Human
gaccagaucccuuaccagcu

SEQ ID NO: 1027391 - RNA, 22 nt, Human
ugaggauggaaugcugugcaag

SEQ ID NO: 1027392 - RNA, 22 nt, Human
uaucugucgggagucuuccgga

SEQ ID NO: 1027393 - RNA, 22 nt, Human
augcauugaggaugacaugagu

SEQ ID NO: 1027394 - RNA, 21 nt, Human
uccuccuguagaggguccugg

SEQ ID NO: 1027395 - RNA, 22 nt, Human
aacaugaugacauuguaagcuu

SEQ ID NO: 1027396 - RNA, 22 nt, Human
gacaaagcgccugcucgcgggc

SEQ ID NO: 1027397 - RNA, 22 nt, Human
auuccaaagccugaauaaugga

SEQ ID NO: 1027398 - RNA, 22 nt, Human
cugagaggcacaaggcauuucg

SEQ ID NO: 1027399 - RNA, 22 nt, Human
auucucuguacagaagguaccg

SEQ ID NO: 1027400 - RNA, 22 nt, Human
ccagcaugcucagucuaaauug

SEQ ID NO: 1027401 - RNA, 22 nt, Human
uggggugccgacagggagggca

SEQ ID NO: 1027402 - RNA, 22 nt, Human
acauuguugagccucuuguuca

SEQ ID NO: 1027403 - RNA, 22 nt, Human
uccuuagagugguugugcuaug

SEQ ID NO: 1027404 - RNA, 22 nt, Human
acaaagugaaaagcaucgaauu

SEQ ID NO: 1027405 - RNA, 22 nt, Human
cuggaagcgucggaggaagggc

SEQ ID NO: 1027406 - RNA, 22 nt, Human
guggaaauuuuaggaucaucuu

SEQ ID NO: 1027407 - RNA, 22 nt, Human
auguuguugaacucuuugcaug

SEQ ID NO: 1027408 - RNA, 22 nt, Human
ucagaagcauccauuucaccac

SEQ ID NO: 1027409 - RNA, 22 nt, Human
aaugcauacguguuuguggcaa

SEQ ID NO: 1027410 - RNA, 23 nt, Human
aauagcugguaaugauagcacaa

SEQ ID NO: 1027411 - RNA, 22 nt, Human
ccugugggcgcagcuggaguca

SEQ ID NO: 1027412 - RNA, 19 nt, Human
cucuggcuccugggcugcc

SEQ ID NO: 1027413 - RNA, 22 nt, Human
gugcuggggagauaggaagaga

SEQ ID NO: 1027414 - RNA, 22 nt, Human
ugccuggauggcucugagcagg

SEQ ID NO: 1027415 - RNA, 21 nt, Human
uucugagacucauuugaacuc

SEQ ID NO: 1027416 - RNA, 22 nt, Human
ucaugauaauacaggccuucua

SEQ ID NO: 1027417 - RNA, 22 nt, Human
gccuucugauugcuggacugac

SEQ ID NO: 1027418 - RNA, 22 nt, Human
gacaguggagccacguugggag

SEQ ID NO: 1027419 - RNA, 16 nt, Human
uccuaacuggcaguuc

SEQ ID NO: 1027420 - RNA, 22 nt, Human
gaugugugugcccugggccugc

SEQ ID NO: 1027421 - RNA, 22 nt, Human
auuuccagcagcauauuugucu

SEQ ID NO: 1027422 - RNA, 22 nt, Human
aggcauuuaaagauguaagacu

SEQ ID NO: 1027423 - RNA, 22 nt, Human
cuguggccagagcgccguugac

SEQ ID NO: 1027424 - RNA, 22 nt, Human
aucagagcugcauuuuagagcc

SEQ ID NO: 1027425 - RNA, 22 nt, Human
ggcaguggugggaggcucgcuc

SEQ ID NO: 1027426 - RNA, 22 nt, Human
gcauucuugguggagugcuaaa

SEQ ID NO: 1027427 - RNA, 22 nt, Human
ugucauuggugaucugaugccu

SEQ ID NO: 1027428 - RNA, 22 nt, Human
gucccuggucuaccguggcuuc

SEQ ID NO: 1027429 - RNA, 21 nt, Human
uaaacauaaccuuguauggcu

SEQ ID NO: 1027430 - RNA, 22 nt, Human
aguaacuuaagcaauuguguau

SEQ ID NO: 1027431 - RNA, 22 nt, Human
gcuucuggaagcauaugcaaga

SEQ ID NO: 1027432 - RNA, 22 nt, Human
gauugcugggucccacucccag

SEQ ID NO: 1027433 - RNA, 20 nt, Human
ugggguccuggaggggaucc

SEQ ID NO: 1027434 - RNA, 17 nt, Human
gugcuggccuggggcuc

SEQ ID NO: 1027435 - RNA, 22 nt, Human
ggcuguggucauuaggagguug

SEQ ID NO: 1027436 - RNA, 22 nt, Human
ggcuucuuagaauuugacuuac

SEQ ID NO: 1027437 - RNA, 22 nt, Human
uggcaggaaaaagggccagagg

SEQ ID NO: 1027438 - RNA, 22 nt, Human
guugcaaaugggaagaugguua

SEQ ID NO: 1027439 - RNA, 22 nt, Human
ugcagcaucuccuugugccaug

SEQ ID NO: 1027440 - RNA, 22 nt, Human
cuggccucacagaggcuaagcc

SEQ ID NO: 1027441 - RNA, 22 nt, Human
uggggugugcucagagcagggg

SEQ ID NO: 1027442 - RNA, 22 nt, Human
ugggugccaaccucugguggcc

SEQ ID NO: 1027443 - RNA, 22 nt, Human
ucguuaaucagcaccagaauuc

SEQ ID NO: 1027444 - RNA, 22 nt, Human
gaggagcuucagaggaaucuua

SEQ ID NO: 1027445 - RNA, 22 nt, Human
cagcugcucugguggucucucc

SEQ ID NO: 1027446 - RNA, 22 nt, Human
ucuuucagaaacuuugucugcg

SEQ ID NO: 1027447 - RNA, 22 nt, Human
cuuccucuguggccagagugua

SEQ ID NO: 1027448 - RNA, 22 nt, Human
agauaucuuacacuuugaaguu

SEQ ID NO: 1027449 - RNA, 22 nt, Human
uucccuuucuuaaagaguuagg

SEQ ID NO: 1027450 - RNA, 22 nt, Human
gccuggggaacuugauccuguc

SEQ ID NO: 1027451 - RNA, 17 nt, Human
aguuggcagccguugcu

SEQ ID NO: 1027452 - RNA, 22 nt, Human
uggcugcccccucccguggaca

SEQ ID NO: 1027453 - RNA, 22 nt, Human
uacauuguguuaaaacagaaga

SEQ ID NO: 1027454 - RNA, 17 nt, Human
ugggggcccuguguaga

SEQ ID NO: 1027455 - RNA, 22 nt, Human
auggaguugagcucuguugucc

SEQ ID NO: 1027456 - RNA, 22 nt, Human
caaagaugccaaaaggaagaca

SEQ ID NO: 1027457 - RNA, 22 nt, Human
uugcauauccuccaacacaugg

SEQ ID NO: 1027458 - RNA, 22 nt, Human
aauggcugccagggcaggaggu

SEQ ID NO: 1027459 - RNA, 22 nt, Human
uccaggauugucagccagaagg

SEQ ID NO: 1027460 - RNA, 22 nt, Human
agguggcuaugaggaugcaguc

SEQ ID NO: 1027461 - RNA, 22 nt, Human
cccaggaguaagugacauuguu

SEQ ID NO: 1027462 - RNA, 22 nt, Human
uuuccacacucacugcacucau

SEQ ID NO: 1027463 - RNA, 22 nt, Human
uuuccagggaggaauguggggu

SEQ ID NO: 1027464 - RNA, 22 nt, Human
gucagcaggguccccuugagug

SEQ ID NO: 1027465 - RNA, 22 nt, Human
ccugugacucugucugaugguc

SEQ ID NO: 1027466 - RNA, 22 nt, Human
uugcuugaacccaggaagugga

SEQ ID NO: 1027467 - RNA, 22 nt, Human
uggcuguagaaucagagacuug

SEQ ID NO: 1027468 - RNA, 22 nt, Human
uuccccuugauaaugcaguaag

SEQ ID NO: 1027469 - RNA, 22 nt, Human
aggacagcagugcuggcacuug

SEQ ID NO: 1027470 - RNA, 22 nt, Human
cucugggguggaggaggcugac

SEQ ID NO: 1027471 - RNA, 22 nt, Human
ucugagugggaacucucaugac

SEQ ID NO: 1027472 - RNA, 22 nt, Human
cucugugaaccccuccuuucuu

SEQ ID NO: 1027473 - RNA, 21 nt, Human
agggccagaucaccaaggagc

SEQ ID NO: 1027474 - RNA, 19 nt, Human
ucuggcugccaaggauuga

SEQ ID NO: 1027475 - RNA, 22 nt, Human
ccugugauauuguucauaauau

SEQ ID NO: 1027476 - RNA, 22 nt, Human
ugcauuaagaauuucugaggau

SEQ ID NO: 1027477 - RNA, 22 nt, Human
ucucauuuacuuccacaggcug

SEQ ID NO: 1027478 - RNA, 22 nt, Human
gauggugcaggugaagugcugg

SEQ ID NO: 1027479 - RNA, 19 nt, Human
ggggcccggggucugcgag

SEQ ID NO: 1027480 - RNA, 22 nt, Human
ucccugagugggcugguaguau

SEQ ID NO: 1027481 - RNA, 22 nt, Human
ggagacagugacuuagagacug

SEQ ID NO: 1027482 - RNA, 22 nt, Human
gcugcuggcuuccugcuguuuu

SEQ ID NO: 1027483 - RNA, 22 nt, Human
ucccugggguaucgcugaggca

SEQ ID NO: 1027484 - RNA, 22 nt, Human
cugagcagucuagccagguguu

SEQ ID NO: 1027485 - RNA, 22 nt, Human
ucugagagcuguagaagccuau

SEQ ID NO: 1027486 - RNA, 22 nt, Human
accagagucaauuauuuugcca

SEQ ID NO: 1027487 - RNA, 22 nt, Human
ugugcccuccugccaggggcug

SEQ ID NO: 1027488 - RNA, 22 nt, Human
aucuaugugggaaucauaauag

SEQ ID NO: 1027489 - RNA, 21 nt, Human
acugaacuuguguucuagagg

SEQ ID NO: 1027490 - RNA, 22 nt, Human
cauuguguauuucuguaguacu

SEQ ID NO: 1027491 - RNA, 22 nt, Human
uucaccugugacagguagaguu

SEQ ID NO: 1027492 - RNA, 22 nt, Human
uggcuuuugaaaaggugaugua

SEQ ID NO: 1027493 - RNA, 22 nt, Human
ccaccagaccaccaagagcaac

SEQ ID NO: 1027494 - RNA, 22 nt, Human
gggagcugaacugcugaaguug

SEQ ID NO: 1027495 - RNA, 22 nt, Human
agcauuagguguguuucagagg

SEQ ID NO: 1027496 - RNA, 22 nt, Human
uuguccuuaccucaaucuggaa

SEQ ID NO: 1027497 - RNA, 22 nt, Human
gcugucaggaacaugccuuggu

SEQ ID NO: 1027498 - RNA, 22 nt, Human
uggcuacauuuauacucucauu

SEQ ID NO: 1027499 - RNA, 22 nt, Human
caggaacagcaccaggagcuag

SEQ ID NO: 1027500 - RNA, 22 nt, Human
cgaggaggaaacgcggagaacu

SEQ ID NO: 1027501 - RNA, 22 nt, Human
agaggagguccuuuucugaugu

SEQ ID NO: 1027502 - RNA, 22 nt, Human
uuuggagagaugaaguucugug

SEQ ID NO: 1027503 - RNA, 22 nt, Human
uucagaagguaggaaugucccu

SEQ ID NO: 1027504 - RNA, 22 nt, Human
acauagcuuaaaugagaagaua

SEQ ID NO: 1027505 - RNA, 22 nt, Human
guaugugucuuagaacuuggga

SEQ ID NO: 1027506 - RNA, 22 nt, Human
uugaggagucaggggcacggaa

SEQ ID NO: 1027507 - RNA, 22 nt, Human
gugggggcaggcagugcuagga

SEQ ID NO: 1027508 - RNA, 22 nt, Human
uggcugagcugcagcguggcuu

SEQ ID NO: 1027509 - RNA, 23 nt, Human
uggcuugcuaauguuccaaauaa

SEQ ID NO: 1027510 - RNA, 22 nt, Human
ggaggaggggugacugaaugcu

SEQ ID NO: 1027511 - RNA, 22 nt, Human
cuucuggcguuggaggucugag

SEQ ID NO: 1027512 - RNA, 21 nt, Human
auucaaagaagaggaaggccc

SEQ ID NO: 1027513 - RNA, 22 nt, Human
gggagcugaaggagccggcggg

SEQ ID NO: 1027514 - RNA, 22 nt, Human
gccuggcucugaguuucucucc

SEQ ID NO: 1027515 - RNA, 23 nt, Human
ucuggcugcuccuuucaaugcuc

SEQ ID NO: 1027516 - RNA, 22 nt, Human
cucaucuggcuucaguaacagu

SEQ ID NO: 1027517 - RNA, 19 nt, Human
gggugaggaagagcguugc

SEQ ID NO: 1027518 - RNA, 20 nt, Human
uuugauugccccucugacuu

SEQ ID NO: 1027519 - RNA, 20 nt, Human
uucaugcagugguugcugug

SEQ ID NO: 1027520 - RNA, 20 nt, Human
ggcagcaaccauaugcuaca

SEQ ID NO: 1027521 - RNA, 22 nt, Human
uugauucugcugaucucggacg

SEQ ID NO: 1027522 - RNA, 22 nt, Human
auuuacucgugcuucauugaau

SEQ ID NO: 1027523 - RNA, 22 nt, Human
caggucuucuucagcacuugga

SEQ ID NO: 1027524 - RNA, 18 nt, Human
gaaggcauucaguggcuu

SEQ ID NO: 1027525 - RNA, 22 nt, Human
gggagaguagcuggaagguucu

SEQ ID NO: 1027526 - RNA, 22 nt, Human
cuugaugaaugaccuggguggu

SEQ ID NO: 1027527 - RNA, 22 nt, Human
ccaugcccuugucaucuccagg

SEQ ID NO: 1027528 - RNA, 22 nt, Human
ugaggucuguccugucuuugga

SEQ ID NO: 1027529 - RNA, 22 nt, Human
gugagagugguuuauguccaug

SEQ ID NO: 1027530 - RNA, 22 nt, Human
uauggcaagaugacauguucuc

SEQ ID NO: 1027531 - RNA, 22 nt, Human
uguuucaggcuucugggauuuu

SEQ ID NO: 1027532 - RNA, 22 nt, Human
uccaggcuccccugcgugcucc

SEQ ID NO: 1027533 - RNA, 22 nt, Human
uugggugcugucauggggcacg

SEQ ID NO: 1027534 - RNA, 22 nt, Human
ugagcucaagcaauucacccgc

SEQ ID NO: 1027535 - RNA, 22 nt, Human
ucugcuugugucuguccagccu

SEQ ID NO: 1027536 - RNA, 22 nt, Human
ucuggcuucaacuuuacugaaa

SEQ ID NO: 1027537 - RNA, 22 nt, Human
cucagcaacagcgacuuaaggg

SEQ ID NO: 1027538 - RNA, 22 nt, Human
ugucuucuaccuugacagcauu

SEQ ID NO: 1027539 - RNA, 22 nt, Human
ugaauagagcugcaguggacau

SEQ ID NO: 1027540 - RNA, 22 nt, Human
ccaaagcuggcuuucaugguuu

SEQ ID NO: 1027541 - RNA, 22 nt, Human
cuggagaggcugggaacagguu

SEQ ID NO: 1027542 - RNA, 23 nt, Human
acugccugugccgaucucucuca

SEQ ID NO: 1027543 - RNA, 22 nt, Human
auacaccaccuuggaucuuuca

SEQ ID NO: 1027544 - RNA, 22 nt, Human
ccuuugagccugggcgcggacc

SEQ ID NO: 1027545 - RNA, 22 nt, Human
ucuccucuauuucuguauguau

SEQ ID NO: 1027546 - RNA, 22 nt, Human
gcucagguagaugggguugucc

SEQ ID NO: 1027547 - RNA, 22 nt, Human
augaggagucaaggagucggag

SEQ ID NO: 1027548 - RNA, 22 nt, Human
uggugcugccaccuccucugcu

SEQ ID NO: 1027549 - RNA, 22 nt, Human
ucuauuaaugauucaauagugu

SEQ ID NO: 1027550 - RNA, 22 nt, Human
gucaggggccaugggccaagga

SEQ ID NO: 1027551 - RNA, 22 nt, Human
gagcugucucuuugggccuuuu

SEQ ID NO: 1027552 - RNA, 22 nt, Human
augugagcuggggcccggccag

SEQ ID NO: 1027553 - RNA, 22 nt, Human
ugacuuuggacuagugauuuaa

SEQ ID NO: 1027554 - RNA, 21 nt, Human
ucccucagaagcucuugguca

SEQ ID NO: 1027555 - RNA, 22 nt, Human
gccagaggggcucgaaggcgcg

SEQ ID NO: 1027556 - RNA, 22 nt, Human
ugcaaauauuccaugcuguuca

SEQ ID NO: 1027557 - RNA, 22 nt, Human
ccuugagacacagccaaagaug

SEQ ID NO: 1027558 - RNA, 21 nt, Human
ucuccucccggggagaggccg

SEQ ID NO: 1027559 - RNA, 22 nt, Human
guucuccaggggcuguucaucu

SEQ ID NO: 1027560 - RNA, 22 nt, Human
gagcagcaggccagguugcagg

SEQ ID NO: 1027561 - RNA, 22 nt, Human
ccaucgcuucaaaucucagacu

SEQ ID NO: 1027562 - RNA, 21 nt, Human
uggagagugauuucagugugg

SEQ ID NO: 1027563 - RNA, 22 nt, Human
ugccuguguccccuucuuggca

SEQ ID NO: 1027564 - RNA, 22 nt, Human
caugggcucuucuggacugcac

SEQ ID NO: 1027565 - RNA, 22 nt, Human
uggcccagcucagggugggcgg

SEQ ID NO: 1027566 - RNA, 22 nt, Human
ugcuggaagggucggcgugggc

SEQ ID NO: 1027567 - RNA, 22 nt, Human
uucguuuaguccacaaaugcau

SEQ ID NO: 1027568 - RNA, 22 nt, Human
aaccagacucuccaaaggcaaa

SEQ ID NO: 1027569 - RNA, 22 nt, Human
gucuccugaggcauccauugaa

SEQ ID NO: 1027570 - RNA, 22 nt, Human
cuuggcugaacuccaggaugca

SEQ ID NO: 1027571 - RNA, 23 nt, Human
uacagccaugucgcugauuuaac

SEQ ID NO: 1027572 - RNA, 22 nt, Human
ugaacagugugagggugugacc

SEQ ID NO: 1027573 - RNA, 22 nt, Human
ggggucccugcaccagcauguc

SEQ ID NO: 1027574 - RNA, 22 nt, Human
gugcugagugcagagugcagag

SEQ ID NO: 1027575 - RNA, 22 nt, Human
gcggggggcagcagucgcucag

SEQ ID NO: 1027576 - RNA, 22 nt, Human
ucugcucagccgaucugcuccg

SEQ ID NO: 1027577 - RNA, 22 nt, Human
auucccuuugacgaucccuagg

SEQ ID NO: 1027578 - RNA, 22 nt, Human
uuagaaaaaggcuguggucuua

SEQ ID NO: 1027579 - RNA, 20 nt, Human
uuucacuggcuugauaaggu

SEQ ID NO: 1027580 - RNA, 18 nt, Human
ucagacaaguuagacagg

SEQ ID NO: 1027581 - RNA, 22 nt, Human
agccacccuaccagcccugaaa

SEQ ID NO: 1027582 - RNA, 19 nt, Human
caggucuucuuggaggacu

SEQ ID NO: 1027583 - RNA, 22 nt, Human
ggaguugacggccgacacccag

SEQ ID NO: 1027584 - RNA, 22 nt, Human
uuccuuggaaagagacgucgcu

SEQ ID NO: 1027585 - RNA, 20 nt, Human
uugaggagauauugaauacu

SEQ ID NO: 1027586 - RNA, 22 nt, Human
uggauguuugaaguugcaugug

SEQ ID NO: 1027587 - RNA, 22 nt, Human
ccuggccugugaaucugagagc

SEQ ID NO: 1027588 - RNA, 19 nt, Human
ugcuugccugccuuuccca

SEQ ID NO: 1027589 - RNA, 22 nt, Human
uuccuuggagucaaacagggag

SEQ ID NO: 1027590 - RNA, 22 nt, Human
aagaggaggacgguucccagaa

SEQ ID NO: 1027591 - RNA, 22 nt, Human
ucuccaggggcagggucuggag

SEQ ID NO: 1027592 - RNA, 22 nt, Human
gcuggccugcgagggcaggcug

SEQ ID NO: 1027593 - RNA, 22 nt, Human
gcagcuuuggagguggaacucu

SEQ ID NO: 1027594 - RNA, 22 nt, Human
cagaggauauaugguuuguaug

SEQ ID NO: 1027595 - RNA, 22 nt, Human
aggcuguagaucuagacaugua

SEQ ID NO: 1027596 - RNA, 22 nt, Human
gucaucaucaggcagaugcugc

SEQ ID NO: 1027597 - RNA, 22 nt, Human
ggcuggaacuucuucuggcauu

SEQ ID NO: 1027598 - RNA, 22 nt, Human
ucccagugggaagcagcacgcu

SEQ ID NO: 1027599 - RNA, 22 nt, Human
ggaauccugguguuuucugccu

SEQ ID NO: 1027600 - RNA, 20 nt, Human
ugugggccuucggcgugcuc

SEQ ID NO: 1027601 - RNA, 22 nt, Human
ccuggguccaauucuggcuugu

SEQ ID NO: 1027602 - RNA, 22 nt, Human
gagaacuugaacuuuuccucug

SEQ ID NO: 1027603 - RNA, 22 nt, Human
auuuggucuacauuuuccaaau

SEQ ID NO: 1027604 - RNA, 22 nt, Human
cacaauuuccauugagcagcag

SEQ ID NO: 1027605 - RNA, 18 nt, Human
ucugugggaucagugagg

SEQ ID NO: 1027606 - RNA, 22 nt, Human
cugagcaggacagugggagacc

SEQ ID NO: 1027607 - RNA, 22 nt, Human
uggcaauguggaaugguccagg

SEQ ID NO: 1027608 - RNA, 22 nt, Human
uggccucuuucuucccuuugac

SEQ ID NO: 1027609 - RNA, 22 nt, Human
ugcuggccucggcgcugggccu

SEQ ID NO: 1027610 - RNA, 22 nt, Human
ugguaccagcuguguguucacu

SEQ ID NO: 1027611 - RNA, 22 nt, Human
uugggacaaagacuccuugaau

SEQ ID NO: 1027612 - RNA, 22 nt, Human
gccagugccugcugcucagggc

SEQ ID NO: 1027613 - RNA, 20 nt, Human
guggcagugguggcagcagu

SEQ ID NO: 1027614 - RNA, 22 nt, Human
ugacucauauuucauggauacg

SEQ ID NO: 1027615 - RNA, 22 nt, Human
augcuugaaaguuauuucauuu

SEQ ID NO: 1027616 - RNA, 22 nt, Human
gguggcaccuuacccugcgcag

SEQ ID NO: 1027617 - RNA, 21 nt, Human
gcaggguuugugcugugaguu

SEQ ID NO: 1027618 - RNA, 22 nt, Human
cuguggcuaggaagcuguggga

SEQ ID NO: 1027619 - RNA, 22 nt, Human
cuucuggguauuccagauaccu

SEQ ID NO: 1027620 - RNA, 22 nt, Human
auuguugacuugauuacucaac

SEQ ID NO: 1027621 - RNA, 22 nt, Human
uagcugggacuacuggcccugc

SEQ ID NO: 1027622 - RNA, 23 nt, Human
uuguccucuggaucgguuugguu

SEQ ID NO: 1027623 - RNA, 22 nt, Human
ugugacuaggccugagcucuug

SEQ ID NO: 1027624 - RNA, 22 nt, Human
guugcauuaaucugcucaggcu

SEQ ID NO: 1027625 - RNA, 22 nt, Human
agguucccagagauagagcugu

SEQ ID NO: 1027626 - RNA, 22 nt, Human
auguucaaguaccuuugugucu

SEQ ID NO: 1027627 - RNA, 22 nt, Human
uugaggucuucaggaucaggcu

SEQ ID NO: 1027628 - RNA, 22 nt, Human
auguccagaguaaagcacauuc

SEQ ID NO: 1027629 - RNA, 22 nt, Human
cuggcuuuuuucccauuaugca

SEQ ID NO: 1027630 - RNA, 22 nt, Human
ucugaggacagugcugugccug

SEQ ID NO: 1027631 - RNA, 22 nt, Human
uaacuucucugagccucauucc

SEQ ID NO: 1027632 - RNA, 22 nt, Human
uugagcagaucgggcugugggg

SEQ ID NO: 1027633 - RNA, 22 nt, Human
guugguccuuugagcaagaucc

SEQ ID NO: 1027634 - RNA, 22 nt, Human
cugaugcucuggauguagucaa

SEQ ID NO: 1027635 - RNA, 22 nt, Human
uuugcaaaguccauugaaguua

SEQ ID NO: 1027636 - RNA, 22 nt, Human
agaagugaguugugacuauggg

SEQ ID NO: 1027637 - RNA, 22 nt, Human
cccucuggcucuucucaggccg

SEQ ID NO: 1027638 - RNA, 22 nt, Human
cacagcuaccugcaugccugcu

SEQ ID NO: 1027639 - RNA, 22 nt, Human
gcaaaacagucgaugccuccca

SEQ ID NO: 1027640 - RNA, 22 nt, Human
accagucauagaaagcaguggu

SEQ ID NO: 1027641 - RNA, 18 nt, Human
uccaggcuccaggcuaac

SEQ ID NO: 1027642 - RNA, 22 nt, Human
ucauggaugauagcuucauugc

SEQ ID NO: 1027643 - RNA, 22 nt, Human
gggagcuggagcuggaagacuc

SEQ ID NO: 1027644 - RNA, 22 nt, Human
aacacugugcccacccuagucc

SEQ ID NO: 1027645 - RNA, 22 nt, Human
uaaugccuuucuguacuauaug

SEQ ID NO: 1027646 - RNA, 22 nt, Human
ucuuggcaguucuugugcuuuu

SEQ ID NO: 1027647 - RNA, 22 nt, Human
cucuggagggaggcugagcugg

SEQ ID NO: 1027648 - RNA, 21 nt, Human
uggacauuuacccuucaggga

SEQ ID NO: 1027649 - RNA, 22 nt, Human
aacagauuguaaccugauagcc

SEQ ID NO: 1027650 - RNA, 22 nt, Human
auaaugacauucuuagacugga

SEQ ID NO: 1027651 - RNA, 22 nt, Human
agacaagagcugaggacauauu

SEQ ID NO: 1027652 - RNA, 22 nt, Human
ggcaaucauuggcauucucugg

SEQ ID NO: 1027653 - RNA, 22 nt, Human
cuugggcaggggaaacagcugc

SEQ ID NO: 1027654 - RNA, 22 nt, Human
gaguggggcccacugcugggug

SEQ ID NO: 1027655 - RNA, 20 nt, Human
ggccggggagcucuccaggg

SEQ ID NO: 1027656 - RNA, 22 nt, Human
ucugccaucaagaugcucuggc

SEQ ID NO: 1027657 - RNA, 22 nt, Human
guucuucagauuccauuucagu

SEQ ID NO: 1027658 - RNA, 22 nt, Human
ugggguccucucacuuggaggg

SEQ ID NO: 1027659 - RNA, 22 nt, Human
gaagcuucgaaagagugauuuc

SEQ ID NO: 1027660 - RNA, 22 nt, Human
ucccucugcuagugcuugagcu

SEQ ID NO: 1027661 - RNA, 22 nt, Human
agguuaggaaugggagguaaug

SEQ ID NO: 1027662 - RNA, 22 nt, Human
ucauccagccucaucaggagcu

SEQ ID NO: 1027663 - RNA, 22 nt, Human
ugucuuggccacuaggagugcc

SEQ ID NO: 1027664 - RNA, 22 nt, Human
ucacugaauuucaagcuagugg

SEQ ID NO: 1027665 - RNA, 22 nt, Human
agugacagauuaccggcagagc

SEQ ID NO: 1027666 - RNA, 22 nt, Human
cuagggcagggaguguuugcgc

SEQ ID NO: 1027667 - RNA, 22 nt, Human
ugcuggcugggcugcuggagac

SEQ ID NO: 1027668 - RNA, 22 nt, Human
uccuuggcaugccgucuucucc

SEQ ID NO: 1027669 - RNA, 22 nt, Human
gaccugugcagugacugguggc

SEQ ID NO: 1027670 - RNA, 18 nt, Human
uggggggcuugucugaag

SEQ ID NO: 1027671 - RNA, 18 nt, Human
cuggucucccuucgcuuu

SEQ ID NO: 1027672 - RNA, 22 nt, Human
guuggcuaugagagcuuuagug

SEQ ID NO: 1027673 - RNA, 22 nt, Human
cugagcagaagggugcacgugc

SEQ ID NO: 1027674 - RNA, 22 nt, Human
ccuggggaccugccucagcccu

SEQ ID NO: 1027675 - RNA, 23 nt, Human
cguuuuuuccucagauguucugg

SEQ ID NO: 1027676 - RNA, 22 nt, Human
uuuuucaagacaaccugcaugu

SEQ ID NO: 1027677 - RNA, 22 nt, Human
aaagcugggcuggccaacccag

SEQ ID NO: 1027678 - RNA, 22 nt, Human
ucuuugcauggacauguguuuu

SEQ ID NO: 1027679 - RNA, 22 nt, Human
cugggcuguuuguucuggucuc

SEQ ID NO: 1027680 - RNA, 22 nt, Human
caaugggccuggagagagcugg

SEQ ID NO: 1027681 - RNA, 22 nt, Human
ggugggugagcccugggagcug

SEQ ID NO: 1027682 - RNA, 22 nt, Human
aggggcuuguggaguugcuggu

SEQ ID NO: 1027683 - RNA, 22 nt, Human
ucguggaucaccgcgucugugu

SEQ ID NO: 1027684 - RNA, 22 nt, Human
auuuugacauugcggcauugcu

SEQ ID NO: 1027685 - RNA, 22 nt, Human
uaguauuuccuguaagcuauag

SEQ ID NO: 1027686 - RNA, 22 nt, Human
ccuggggagaagagcuuccccc

SEQ ID NO: 1027687 - RNA, 22 nt, Human
aggaauuugggguuacaugaug

SEQ ID NO: 1027688 - RNA, 22 nt, Human
ugucuggauagagccuaggccc

SEQ ID NO: 1027689 - RNA, 22 nt, Human
guucuucaggcugugcucuaga

SEQ ID NO: 1027690 - RNA, 22 nt, Human
gcccagggcugcaaguggacgc

SEQ ID NO: 1027691 - RNA, 22 nt, Human
augaaacucuagcuuucagcac

SEQ ID NO: 1027692 - RNA, 22 nt, Human
ugugaggaccucagcagagucu

SEQ ID NO: 1027693 - RNA, 22 nt, Human
guuuuguucaugaacauugggu

SEQ ID NO: 1027694 - RNA, 22 nt, Human
ccugcucaacgaauauggcgau

SEQ ID NO: 1027695 - RNA, 22 nt, Human
caugcuggucagccaguggaug

SEQ ID NO: 1027696 - RNA, 22 nt, Human
gcauaacaacagacucuguguu

SEQ ID NO: 1027697 - RNA, 19 nt, Human
ccuggcccugcugcgcggg

SEQ ID NO: 1027698 - RNA, 19 nt, Human
cugggacaaugaaagcauc

SEQ ID NO: 1027699 - RNA, 22 nt, Human
ccuugcagcauauagagucccu

SEQ ID NO: 1027700 - RNA, 21 nt, Human
ucugaggagaaacucuuggug

SEQ ID NO: 1027701 - RNA, 22 nt, Human
cagcuggcgacucuccucgaug

SEQ ID NO: 1027702 - RNA, 18 nt, Human
gacaaaaguacagacaga

SEQ ID NO: 1027703 - RNA, 22 nt, Human
agugacauuauuuuguguacua

SEQ ID NO: 1027704 - RNA, 22 nt, Human
aggagcagaacuguuguggagg

SEQ ID NO: 1027705 - RNA, 18 nt, Human
uccaccgcgugcaccucu

SEQ ID NO: 1027706 - RNA, 22 nt, Human
gugaagcacaugggcguugggu

SEQ ID NO: 1027707 - RNA, 20 nt, Human
uggccucugagaugccacgg

SEQ ID NO: 1027708 - RNA, 22 nt, Human
uucucugaguacguuucagugu

SEQ ID NO: 1027709 - RNA, 22 nt, Human
ugcugcgggacccacugugggc

SEQ ID NO: 1027710 - RNA, 22 nt, Human
guuugagauggguuauugcucu

SEQ ID NO: 1027711 - RNA, 22 nt, Human
aaguuugucucauuugaucuuc

SEQ ID NO: 1027712 - RNA, 22 nt, Human
gcuguccugggaacaggcacua

SEQ ID NO: 1027713 - RNA, 23 nt, Human
uggcucuguggaucccucaggag

SEQ ID NO: 1027714 - RNA, 22 nt, Human
ccagaucccuguuugccucugg

SEQ ID NO: 1027715 - RNA, 22 nt, Human
cagaaagcaguugucaaugggc

SEQ ID NO: 1027716 - RNA, 22 nt, Human
uugacacagucaacuugauuuu

SEQ ID NO: 1027717 - RNA, 22 nt, Human
caagagcuggguggcaagcuag

SEQ ID NO: 1027718 - RNA, 22 nt, Human
aucuucaaagcacaucguuugu

SEQ ID NO: 1027719 - RNA, 22 nt, Human
cugccaucugagccaaaagugc

SEQ ID NO: 1027720 - RNA, 22 nt, Human
aggcuuuugcucuggcuccucu

SEQ ID NO: 1027721 - RNA, 22 nt, Human
uuaauggauuggagguuucaau

SEQ ID NO: 1027722 - RNA, 22 nt, Human
ucagccaggccaggcauucaca

SEQ ID NO: 1027723 - RNA, 22 nt, Human
uugaugcugucuuucagaauca

SEQ ID NO: 1027724 - RNA, 23 nt, Human
gggugcugccuguagucaugcug

SEQ ID NO: 1027725 - RNA, 22 nt, Human
ugguuuguauauguuugugaga

SEQ ID NO: 1027726 - RNA, 22 nt, Human
gccuucugaucgcuggacugac

SEQ ID NO: 1027727 - RNA, 22 nt, Human
acugcauucuuuaucccacaac

SEQ ID NO: 1027728 - RNA, 22 nt, Human
ggugggucuuguggggcagcuu

SEQ ID NO: 1027729 - RNA, 21 nt, Human
ucuuggggaggagggcugcac

SEQ ID NO: 1027730 - RNA, 22 nt, Human
cugggauccacgggcucccaag

SEQ ID NO: 1027731 - RNA, 22 nt, Human
ggccucugccccgcggggcucg

SEQ ID NO: 1027732 - RNA, 22 nt, Human
aauggcuguucucugugauugg

SEQ ID NO: 1027733 - RNA, 22 nt, Human
agguggucuuguggaugccgca

SEQ ID NO: 1027734 - RNA, 22 nt, Human
uccuuggcagcagggagcauga

SEQ ID NO: 1027735 - RNA, 22 nt, Human
guggggacgggauggcucacug

SEQ ID NO: 1027736 - RNA, 22 nt, Human
caggcuguguuccuggaacccc

SEQ ID NO: 1027737 - RNA, 22 nt, Human
aaagucuuaauguaaguuuagu

SEQ ID NO: 1027738 - RNA, 22 nt, Human
uuugaauauacuucaaacaaag

SEQ ID NO: 1027739 - RNA, 23 nt, Human
gagcugggauacaggcuuacugc

SEQ ID NO: 1027740 - RNA, 22 nt, Human
cauugcugugggcauuugcugc

SEQ ID NO: 1027741 - RNA, 22 nt, Human
uucacagugguagugcauuuag

SEQ ID NO: 1027742 - RNA, 21 nt, Human
ugcauauauaagugcauacac

SEQ ID NO: 1027743 - RNA, 22 nt, Human
auaggcauaacacugauguccu

SEQ ID NO: 1027744 - RNA, 22 nt, Human
ugcugcucuucaccauggccuc

SEQ ID NO: 1027745 - RNA, 22 nt, Human
gaugucuggcuaccacucgcac

SEQ ID NO: 1027746 - RNA, 22 nt, Human
gcuguggcuccaauggugagcc

SEQ ID NO: 1027747 - RNA, 22 nt, Human
ggcggccugugggucggccuca

SEQ ID NO: 1027748 - RNA, 22 nt, Human
aggugcugccccgagaaggaug

SEQ ID NO: 1027749 - RNA, 22 nt, Human
ccucuugauugguuggaagcgg

SEQ ID NO: 1027750 - RNA, 22 nt, Human
ugagucauguaauaaugcugcu

SEQ ID NO: 1027751 - RNA, 22 nt, Human
uugcaggucuggggguccuggu

SEQ ID NO: 1027752 - RNA, 22 nt, Human
ucuccaggcuuaaucucagcuu

SEQ ID NO: 1027753 - RNA, 22 nt, Human
gcugauggcuugcuggcugaca

SEQ ID NO: 1027754 - RNA, 22 nt, Human
uuuuccuuaacagagggagaaa

SEQ ID NO: 1027755 - RNA, 22 nt, Human
uucauugauuuccuuggaauaa

SEQ ID NO: 1027756 - RNA, 22 nt, Human
uuccuccagccuggagcacuuc

SEQ ID NO: 1027757 - RNA, 22 nt, Human
gaaacuguauguaguuuuuggg

SEQ ID NO: 1027758 - RNA, 22 nt, Human
gcugggagucgcgucuguggcc

SEQ ID NO: 1027759 - RNA, 22 nt, Human
cucccucaggccuuagcccugc

SEQ ID NO: 1027760 - RNA, 23 nt, Human
aucuguguguggguagggaugau

SEQ ID NO: 1027761 - RNA, 22 nt, Human
agcuccagggaaagaguggauc

SEQ ID NO: 1027762 - RNA, 22 nt, Human
uccuccuuuccccgcuggagcc

SEQ ID NO: 1027763 - RNA, 22 nt, Human
agggccagcagcuuggccaacc

SEQ ID NO: 1027764 - RNA, 22 nt, Human
agcucagaacugcagacaugug

SEQ ID NO: 1027765 - RNA, 22 nt, Human
aaaugccucauuuucucucacu

SEQ ID NO: 1027766 - RNA, 22 nt, Human
uaggcagggauuaggguugauu

SEQ ID NO: 1027767 - RNA, 22 nt, Human
uauuucagcucuuuggauuauc

SEQ ID NO: 1027768 - RNA, 22 nt, Human
gaggcugugugucccucuggac

SEQ ID NO: 1027769 - RNA, 22 nt, Human
ggaaacuuggaugccagcacuc

SEQ ID NO: 1027770 - RNA, 22 nt, Human
aguggcugugaaauacauggga

SEQ ID NO: 1027771 - RNA, 22 nt, Human
aguguccaacucagcuugucaa

SEQ ID NO: 1027772 - RNA, 22 nt, Human
gcggggggcaggcaguacguug

SEQ ID NO: 1027773 - RNA, 22 nt, Human
gagcuuggugcugccuguuguc

SEQ ID NO: 1027774 - RNA, 22 nt, Human
auggcuguguuguuccucugaa

SEQ ID NO: 1027775 - RNA, 22 nt, Human
gacuggcucuaucuccuuggcg

SEQ ID NO: 1027776 - RNA, 22 nt, Human
ugcccuguuccugccuccagcu

SEQ ID NO: 1027777 - RNA, 21 nt, Human
uuggaacaagcagcaguuugc

SEQ ID NO: 1027778 - RNA, 22 nt, Human
agcugugaccuucaagagcuac

SEQ ID NO: 1027779 - RNA, 22 nt, Human
ucagguagugguuaaguucugu

SEQ ID NO: 1027780 - RNA, 22 nt, Human
cugcacagucauuuccucucaa

SEQ ID NO: 1027781 - RNA, 22 nt, Human
aggccagugguucucugugucc

SEQ ID NO: 1027782 - RNA, 22 nt, Human
caagggcagaggcagggccccg

SEQ ID NO: 1027783 - RNA, 22 nt, Human
ccuucaaucuuaagucagccca

SEQ ID NO: 1027784 - RNA, 22 nt, Human
aguucugacucugaaucuggga

SEQ ID NO: 1027785 - RNA, 17 nt, Human
acuuguauugugcuuua

SEQ ID NO: 1027786 - RNA, 22 nt, Human
cuccaggacaugacuuucuugc

SEQ ID NO: 1027787 - RNA, 23 nt, Human
gguuggcuguacccaggcucccu

SEQ ID NO: 1027788 - RNA, 22 nt, Human
ggauguggaccuugccugguga

SEQ ID NO: 1027789 - RNA, 23 nt, Human
auaugucaugcaccagcacuuua

SEQ ID NO: 1027790 - RNA, 22 nt, Human
ggcuuggaaauugcaggacaca

SEQ ID NO: 1027791 - RNA, 22 nt, Human
uugucaggaacuaugauuaugc

SEQ ID NO: 1027792 - RNA, 22 nt, Human
uuauuuaaaagugguaagauuc

SEQ ID NO: 1027793 - RNA, 22 nt, Human
ccucuuccuucucacuguggaa

SEQ ID NO: 1027794 - RNA, 22 nt, Human
uugucgggcuuacgcagggcca

SEQ ID NO: 1027795 - RNA, 22 nt, Human
ucuggggucaccuggggugcuu

SEQ ID NO: 1027796 - RNA, 22 nt, Human
ucuuccagauacuuccugacuu

SEQ ID NO: 1027797 - RNA, 22 nt, Human
uuauuuuguagcucugaucuuu

SEQ ID NO: 1027798 - RNA, 22 nt, Human
gccuggaucccagggagucagg

SEQ ID NO: 1027799 - RNA, 19 nt, Human
ggauaagguuggagugauc

SEQ ID NO: 1027800 - RNA, 22 nt, Human
cucaggucuuaguucugucauc

SEQ ID NO: 1027801 - RNA, 22 nt, Human
agugcguggaccccuggcugcu

SEQ ID NO: 1027802 - RNA, 22 nt, Human
gaauucggguacucuaggccag

SEQ ID NO: 1027803 - RNA, 22 nt, Human
acuagaaacuaauggauuauua

SEQ ID NO: 1027804 - RNA, 22 nt, Human
aggguccugggugcaguugcuu

SEQ ID NO: 1027805 - RNA, 22 nt, Human
cugcaccgugucucgggcugcc

SEQ ID NO: 1027806 - RNA, 22 nt, Human
uuguacuuaaauaugcaaauag

SEQ ID NO: 1027807 - RNA, 22 nt, Human
cuccuuccugguuagcaccuua

SEQ ID NO: 1027808 - RNA, 22 nt, Human
gggcuguaggagcuggaauggg

SEQ ID NO: 1027809 - RNA, 22 nt, Human
guucuucaaagugacaacuaaa

SEQ ID NO: 1027810 - RNA, 22 nt, Human
auuaauaucccccgccguucug

SEQ ID NO: 1027811 - RNA, 21 nt, Human
agcugugguuuuacaucuuuu

SEQ ID NO: 1027812 - RNA, 22 nt, Human
guaaagcaaaauguagagauug

SEQ ID NO: 1027813 - RNA, 22 nt, Human
gcuagagaccagaggccuugaa

SEQ ID NO: 1027814 - RNA, 22 nt, Human
guggccuuuucaaguaggguau

SEQ ID NO: 1027815 - RNA, 22 nt, Human
ugaguggacgugaggcugagua

SEQ ID NO: 1027816 - RNA, 23 nt, Human
ugggcagcuucugcaugcccacc

SEQ ID NO: 1027817 - RNA, 22 nt, Human
ugcuugacuuaguuucucauuu

SEQ ID NO: 1027818 - RNA, 22 nt, Human
cagugcugcaggcgccugcggu

SEQ ID NO: 1027819 - RNA, 22 nt, Human
ggagugggaacaaugacauggu

SEQ ID NO: 1027820 - RNA, 22 nt, Human
ggucuggagcuaaucuuguugg

SEQ ID NO: 1027821 - RNA, 22 nt, Human
gcugccauggcugggggccgug

SEQ ID NO: 1027822 - RNA, 22 nt, Human
cguggcucugggcuccuuugcc

SEQ ID NO: 1027823 - RNA, 22 nt, Human
ugggcugcuucuauuggugguc

SEQ ID NO: 1027824 - RNA, 22 nt, Human
uguauuucugcuuucucuagua

SEQ ID NO: 1027825 - RNA, 22 nt, Human
ccugggaaggugaggcccugga

SEQ ID NO: 1027826 - RNA, 22 nt, Human
ucccugagcucacauggcagga

SEQ ID NO: 1027827 - RNA, 22 nt, Human
gucauuuuugacuuugaaguga

SEQ ID NO: 1027828 - RNA, 22 nt, Human
uauuagggaacugcaagacuaa

SEQ ID NO: 1027829 - RNA, 22 nt, Human
cuccuuggguucuuucgguucc

SEQ ID NO: 1027830 - RNA, 22 nt, Human
ccucugagcuggccuguggggc

SEQ ID NO: 1027831 - RNA, 22 nt, Human
gauugcugccagcguguccgug

SEQ ID NO: 1027832 - RNA, 22 nt, Human
ccugugggagggagcggcugga

SEQ ID NO: 1027833 - RNA, 22 nt, Human
aaugccuuggagagccuagagg

SEQ ID NO: 1027834 - RNA, 22 nt, Human
uucagguuuuuaaguucugccu

SEQ ID NO: 1027835 - RNA, 22 nt, Human
gauuuucauuauagcuaguuuc

SEQ ID NO: 1027836 - RNA, 22 nt, Human
aucuggcucccuuggaauccgu

SEQ ID NO: 1027837 - RNA, 22 nt, Human
cagagggagcccuccaggagca

SEQ ID NO: 1027838 - RNA, 22 nt, Human
ucggagcgucacuggcuggagg

SEQ ID NO: 1027839 - RNA, 22 nt, Human
uguacauauucaagcacuucua

SEQ ID NO: 1027840 - RNA, 22 nt, Human
uuugagaagcauggcuguauuc

SEQ ID NO: 1027841 - RNA, 22 nt, Human
uaugccuaccuccaaaauauau

SEQ ID NO: 1027842 - RNA, 22 nt, Human
agaauccuggagaagcuguacc

SEQ ID NO: 1027843 - RNA, 22 nt, Human
agcuuucuauauaugaguugcu

SEQ ID NO: 1027844 - RNA, 22 nt, Human
gggagcugagcuggaagagaau

SEQ ID NO: 1027845 - RNA, 22 nt, Human
gucuguggaguugcuugcugga

SEQ ID NO: 1027846 - RNA, 22 nt, Human
ucuggaaggggaucugugguca

SEQ ID NO: 1027847 - RNA, 22 nt, Human
agauugucauugacgaugagca

SEQ ID NO: 1027848 - RNA, 23 nt, Human
aaugaguugggcagcauacaggc

SEQ ID NO: 1027849 - RNA, 22 nt, Human
ggacucuggcucaguguugcuu

SEQ ID NO: 1027850 - RNA, 22 nt, Human
augcugagugagugaaacccag

SEQ ID NO: 1027851 - RNA, 22 nt, Human
ugggcagggagcuggaaccaca

SEQ ID NO: 1027852 - RNA, 22 nt, Human
uuccaggacuggguguuugaag

SEQ ID NO: 1027853 - RNA, 21 nt, Human
gcagcaugagaaagccccaaa

SEQ ID NO: 1027854 - RNA, 22 nt, Human
cucggaauggaacaacagcggu

SEQ ID NO: 1027855 - RNA, 22 nt, Measles virus
acuguucucaguagucuccugu

SEQ ID NO: 1027856 - RNA, 22 nt, Measles virus
acucuggaggagcagaugcaag

SEQ ID NO: 1027857 - RNA, 22 nt, Measles virus
aacaucaugguggauuaauucu

SEQ ID NO: 1027858 - RNA, 22 nt, Measles virus
uggggccaaauaaugacaggau

SEQ ID NO: 1027859 - RNA, 22 nt, Measles virus
ucuucacauuagaagcacaggc

SEQ ID NO: 1027860 - RNA, 22 nt, Measles virus
guugacucuuugucuucuaugu

SEQ ID NO: 1027861 - RNA, 22 nt, Measles virus
aaguuguugccucuggauugga

SEQ ID NO: 1027862 - RNA, 22 nt, Measles virus
gugccugcucuucugccaucgg

SEQ ID NO: 1027863 - RNA, 23 nt, Measles virus
auuacaucuucacgucgaaacag

SEQ ID NO: 1027864 - RNA, 19 nt, Measles virus
auuuggccccagcuuacgg

SEQ ID NO: 1027865 - RNA, 20 nt, Measles virus
gcagcaugcagggggagggu

SEQ ID NO: 1027866 - RNA, 22 nt, Measles virus
uuugcagccaucaguuccucaa

SEQ ID NO: 1027867 - RNA, 22 nt, Measles virus
cugguuuuugcacuugguggga

SEQ ID NO: 1027868 - RNA, 22 nt, Measles virus
guugacucuuugucuucuaugu

SEQ ID NO: 1027869 - RNA, 22 nt, Measles virus
gugccugcucuucugccaucgg

SEQ ID NO: 1027870 - RNA, 22 nt, Measles virus
aucugagcaauuugagcccuag

SEQ ID NO: 1027871 - RNA, 22 nt, Measles virus
auagaguuaagcaauccaucuu

SEQ ID NO: 1027872 - RNA, 22 nt, Measles virus
auauggaauaugagagugggcc

SEQ ID NO: 1027873 - RNA, 22 nt, Measles virus
uccccuccuucugcaguuucaa

SEQ ID NO: 1027874 - RNA, 22 nt, Measles virus
ucugucauuguggaacuuagga

SEQ ID NO: 1027875 - RNA, 22 nt, Measles virus
aaguuguugccucuggauugga

SEQ ID NO: 1027876 - RNA, 22 nt, Measles virus
acccuucaccugaagcuugagc

SEQ ID NO: 1027877 - RNA, 22 nt, Measles virus
uccuaaguuuuuuauaauggau

SEQ ID NO: 1027878 - RNA, 22 nt, Measles virus
aacaucaugguggauuaauucu

SEQ ID NO: 1027879 - RNA, 19 nt, Measles virus
auuuggccccagcuuacgg

SEQ ID NO: 1027880 - RNA, 22 nt, Measles virus
uggggccaaauaaugacaggau

SEQ ID NO: 1027881 - RNA, 22 nt, Measles virus
acuguucucaguagucuccugu

SEQ ID NO: 1027882 - RNA, 22 nt, Measles virus
gcaguuauugaggagaguuaua

SEQ ID NO: 1027883 - RNA, 20 nt, Measles virus
gcagcaugcagggggagggu

SEQ ID NO: 1027884 - RNA, 22 nt, Human
uuuguucacugagcaaugauua

SEQ ID NO: 1027885 - RNA, 22 nt, Human
uauggaaaguguuuucuucugu

SEQ ID NO: 1027886 - RNA, 22 nt, Human
caaaagaagcucuuggggcuag

SEQ ID NO: 1027887 - RNA, 22 nt, Human
guccaagagucaagaagggggc

SEQ ID NO: 1027888 - RNA, 22 nt, Human
ucugaaaugcaaauuugacuga

SEQ ID NO: 1027889 - RNA, 22 nt, Human
aagaagaaguguuauuuuuaga

SEQ ID NO: 1027890 - RNA, 18 nt, Human
agugucuggauauuuggg

SEQ ID NO: 1027891 - RNA, 21 nt, Human
agaauucuuaaguauucuaau

SEQ ID NO: 1027892 - RNA, 22 nt, Human
uucaucuugauggcuuccuaau

SEQ ID NO: 1027893 - RNA, 22 nt, Human
auucagaaauagaaaauuugau

SEQ ID NO: 1027894 - RNA, 22 nt, Human
ucuguaaucaagauauuugaga

SEQ ID NO: 1027895 - RNA, 22 nt, Human
uucuucauggguucuuuuagga

SEQ ID NO: 1027896 - RNA, 22 nt, Human
aauucuauaggcaagcuauuuu

SEQ ID NO: 1027897 - RNA, 22 nt, Human
ucuuucuacaucauuugcuucu

SEQ ID NO: 1027898 - RNA, 21 nt, Human
uuuguucaggggcaaaguuaa

SEQ ID NO: 1027899 - RNA, 20 nt, Human
gucuccacuggggguuaacc

SEQ ID NO: 1027900 - RNA, 22 nt, Human
gguuccccaggcggcccuugga

SEQ ID NO: 1027901 - RNA, 22 nt, Human
uguugauuugugggcugcaaaa

SEQ ID NO: 1027902 - RNA, 22 nt, Human
ucagaaauagucuuuaaaauga

SEQ ID NO: 1027903 - RNA, 22 nt, Human
ugugccuacugauagagccaag

SEQ ID NO: 1027904 - RNA, 22 nt, Human
uucugaaaggcagguuguuugc

SEQ ID NO: 1027905 - RNA, 22 nt, Human
uuaguaauguguuaauaugaau

SEQ ID NO: 1027906 - RNA, 22 nt, Human
uuuguucauuuugagcucauca

SEQ ID NO: 1027907 - RNA, 22 nt, Human
aaacucuuuccacgauuacuuu

SEQ ID NO: 1027908 - RNA, 22 nt, Human
uucuggaaguguuagaaucugg

SEQ ID NO: 1027909 - RNA, 22 nt, Human
guuuaauuuuagguugucaagc

SEQ ID NO: 1027910 - RNA, 23 nt, Human
uugcuuagagaccuccucaucag

SEQ ID NO: 1027911 - RNA, 22 nt, Human
aauuuguuacacagcaauauaa

SEQ ID NO: 1027912 - RNA, 22 nt, Human
uucauaguguuuccuuccagug

SEQ ID NO: 1027913 - RNA, 22 nt, Human
cuguuauuuagaacauggaauc

SEQ ID NO: 1027914 - RNA, 22 nt, Human
ucccuagucgcaucuguggaga

SEQ ID NO: 1027915 - RNA, 22 nt, Human
ggagugacucacagcugggaca

SEQ ID NO: 1027916 - RNA, 22 nt, Human
ccugcuuaacauugccaugaca

SEQ ID NO: 1027917 - RNA, 22 nt, Human
ucuauuucgcauauaaguuuug

SEQ ID NO: 1027918 - RNA, 22 nt, Human
ucugaaaugcaggcaauuugcu

SEQ ID NO: 1027919 - RNA, 22 nt, Human
cuuagaugaagucacagaaccc

SEQ ID NO: 1027920 - RNA, 22 nt, Human
aguuucuguuaccauauuugac

SEQ ID NO: 1027921 - RNA, 22 nt, Human
uuuguucaugccuauauucuca

SEQ ID NO: 1027922 - RNA, 22 nt, Human
ucugaaauguucucuuguuuug

SEQ ID NO: 1027923 - RNA, 22 nt, Human
auucuucugccuacuuucaucc

SEQ ID NO: 1027924 - RNA, 20 nt, Human
gaaauucucguauuaguuua

SEQ ID NO: 1027925 - RNA, 22 nt, Human
ggagagcugguagcuggcucca

SEQ ID NO: 1027926 - RNA, 22 nt, Human
cagugcuguuguaagcucauug

SEQ ID NO: 1027927 - RNA, 22 nt, Human
agaugacuaacauaguauugcu

SEQ ID NO: 1027928 - RNA, 22 nt, Human
ugaagacaguuuuacucaugag

SEQ ID NO: 1027929 - RNA, 21 nt, Human
ugacaguguggcauggaaggu

SEQ ID NO: 1027930 - RNA, 22 nt, Human
acugcauuaucaccaagaugua

SEQ ID NO: 1027931 - RNA, 22 nt, Human
ugcccuguuccugccuccagcu

SEQ ID NO: 1027932 - RNA, 22 nt, Human
gucuguccacuuggaagcuccc

SEQ ID NO: 1027933 - RNA, 22 nt, Human
uuccuccagccuggagcacuuc

SEQ ID NO: 1027934 - RNA, 22 nt, Human
gcacagucaacacuuauucacc

SEQ ID NO: 1027935 - RNA, 22 nt, Human
ccuggccauagggcccaggaaa

SEQ ID NO: 1027936 - RNA, 22 nt, Human
guggcgcagaggguggcagaga

SEQ ID NO: 1027937 - RNA, 22 nt, Human
ugugacguuguucuggauuccc

SEQ ID NO: 1027938 - RNA, 20 nt, Human
gaccagaucccuuaccagcu

SEQ ID NO: 1027939 - RNA, 22 nt, Human
uugacuauacucuggcggaaaa

SEQ ID NO: 1027940 - RNA, 22 nt, Human
aaggcaguuaauuuggcuagaa

SEQ ID NO: 1027941 - RNA, 22 nt, Human
ggcuagcuuagagucaugcuag

SEQ ID NO: 1027942 - RNA, 22 nt, Human
ucaggccccaucccagacuuau

SEQ ID NO: 1027943 - RNA, 22 nt, Human
augcccucuguuucccaaggcc

SEQ ID NO: 1027944 - RNA, 20 nt, Human
ggccugagcauggcuggcag

SEQ ID NO: 1027945 - RNA, 20 nt, Human
uucaugcagugguugcugug

SEQ ID NO: 1027946 - RNA, 19 nt, Human
agcagggagugguuguggg

SEQ ID NO: 1027947 - RNA, 22 nt, Human
ugaaguuguuaagguugccauu

SEQ ID NO: 1027948 - RNA, 19 nt, Human
agcagagcagggccguggg

SEQ ID NO: 1027949 - RNA, 22 nt, Human
uggugaagucagcggagcccgg

SEQ ID NO: 1027950 - RNA, 22 nt, Human
ggcagcugaagaggaacuuugg

SEQ ID NO: 1027951 - RNA, 22 nt, Human
uguagcucuccagccagcaagg

SEQ ID NO: 1027952 - RNA, 22 nt, Human
cuggacacuggggaugcgcagu

SEQ ID NO: 1027953 - RNA, 22 nt, Human
uuuggagagaugaaguucugug

SEQ ID NO: 1027954 - RNA, 22 nt, Human
aaagcagcagcacguggaagag

SEQ ID NO: 1027955 - RNA, 22 nt, Human
accuuguuguagguacaaaaga

SEQ ID NO: 1027956 - RNA, 22 nt, Human
ugaacaggugccuucagggagu

SEQ ID NO: 1027957 - RNA, 22 nt, Human
ggugacgaauccauagcaucga

SEQ ID NO: 1027958 - RNA, 22 nt, Human
aggccgugugagcaugugugag

SEQ ID NO: 1027959 - RNA, 22 nt, Human
ucuacuuccgcaaaaggcacau

SEQ ID NO: 1027960 - RNA, 22 nt, Human
agaaucugcauuuuaacaagau

SEQ ID NO: 1027961 - RNA, 22 nt, Human
ggcacagcugaugcagacacac

SEQ ID NO: 1027962 - RNA, 22 nt, Human
cuccccacgccuggacuaagag

SEQ ID NO: 1027963 - RNA, 22 nt, Human
gucagcgugcucagccuauuau

SEQ ID NO: 1027964 - RNA, 22 nt, Human
ucaaagcacuggggaaagccug

SEQ ID NO: 1027965 - RNA, 22 nt, Human
cuggagccggcgagccccagcc

SEQ ID NO: 1027966 - RNA, 22 nt, Human
ugcuugacuuaguuucucauuu

SEQ ID NO: 1027967 - RNA, 22 nt, Human
agugaaaaccuaaucaugcagu

SEQ ID NO: 1027968 - RNA, 22 nt, Human
auuucauccauuaagaguacuc

SEQ ID NO: 1027969 - RNA, 22 nt, Human
cccaccacgugcuuugcuggag

SEQ ID NO: 1027970 - RNA, 22 nt, Human
augaggagucaaggagucggag

SEQ ID NO: 1027971 - RNA, 22 nt, Human
ugcuggcugggcugcuggagac

SEQ ID NO: 1027972 - RNA, 22 nt, Human
caggcuugaugugucuauacuu

SEQ ID NO: 1027973 - RNA, 22 nt, Human
gaggcucagagggacuuucaag

SEQ ID NO: 1027974 - RNA, 22 nt, Human
ccugggugaugugcugcccucg

SEQ ID NO: 1027975 - RNA, 20 nt, Human
augcacccucagggucccug

SEQ ID NO: 1027976 - RNA, 22 nt, Human
ggugaccagggucaguagcuuu

SEQ ID NO: 1027977 - RNA, 22 nt, Human
cuucucagagcuuccagaaaac

SEQ ID NO: 1027978 - RNA, 23 nt, Human
gagcugggauacaggcuuacugc

SEQ ID NO: 1027979 - RNA, 22 nt, Human
ucaccgccuugcccggccgggc

SEQ ID NO: 1027980 - RNA, 22 nt, Human
gcaaggagcaccuuucuggaac

SEQ ID NO: 1027981 - RNA, 22 nt, Human
uacucuggaguugagaugcgag

SEQ ID NO: 1027982 - RNA, 22 nt, Human
cacaccuuaggccugagcgcuu

SEQ ID NO: 1027983 - RNA, 22 nt, Human
agaaacaucgcuuaguccucau

SEQ ID NO: 1027984 - RNA, 22 nt, Human
aagcagccagccaucaugcccg

SEQ ID NO: 1027985 - RNA, 22 nt, Human
cagagcagcagagcuuccaugg

SEQ ID NO: 1027986 - RNA, 22 nt, Human
cggggccuagucuaccucggca

SEQ ID NO: 1027987 - RNA, 22 nt, Human
acagccaggaauucuggagaag

SEQ ID NO: 1027988 - RNA, 22 nt, Human
ucaucuguuaugggaguuuuug

SEQ ID NO: 1027989 - RNA, 22 nt, Human
ccgcguggcacccuccuggagg

SEQ ID NO: 1027990 - RNA, 22 nt, Human
acaagucuguuaugcaccugga

SEQ ID NO: 1027991 - RNA, 22 nt, Human
uugaacaguccuaagagacccu

SEQ ID NO: 1027992 - RNA, 22 nt, Human
agaacauaucuguuuucuaacu

SEQ ID NO: 1027993 - RNA, 22 nt, Human
aucccugugacgagcaucccua

SEQ ID NO: 1027994 - RNA, 22 nt, Human
aggcaguggcuuuuguuguguu

SEQ ID NO: 1027995 - RNA, 22 nt, Human
uggcccagcucagggugggcgg

SEQ ID NO: 1027996 - RNA, 22 nt, Human
aaggcccacagaacugucucca

SEQ ID NO: 1027997 - RNA, 22 nt, Human
uggcacugaagcuggaaagccu

SEQ ID NO: 1027998 - RNA, 16 nt, Human
ggcagcagcuccgugc

SEQ ID NO: 1027999 - RNA, 22 nt, Human
aggccagugguucucugugucc

SEQ ID NO: 1028000 - RNA, 21 nt, Human
aggcagcgauuuucauauugc

SEQ ID NO: 1028001 - RNA, 22 nt, Human
auggacagcucuuaugugggca

SEQ ID NO: 1028002 - RNA, 21 nt, Human
aggcaugagcccugcauggac

SEQ ID NO: 1028003 - RNA, 22 nt, Human
caggaacacaaugagucucaaa

SEQ ID NO: 1028004 - RNA, 22 nt, Human
agugccucugcagguccgaguu

SEQ ID NO: 1028005 - RNA, 22 nt, Human
ccagagacaaggagcuggaguc

SEQ ID NO: 1028006 - RNA, 22 nt, Human
caagccaggaaggauccagcac

SEQ ID NO: 1028007 - RNA, 22 nt, Human
cuggagcucuccagagccccgu

SEQ ID NO: 1028008 - RNA, 22 nt, Human
ugugaagaucaggguccuagag

SEQ ID NO: 1028009 - RNA, 22 nt, Human
aaggagucugggccauucagag

SEQ ID NO: 1028010 - RNA, 22 nt, Human
cugucaccucugcccuuugccc

SEQ ID NO: 1028011 - RNA, 20 nt, Human
ugagccugcuguaggaggcc

SEQ ID NO: 1028012 - RNA, 22 nt, Human
agaggaaguaaucaggaccugc

SEQ ID NO: 1028013 - RNA, 22 nt, Human
gaaguauuucugaguugcccag

SEQ ID NO: 1028014 - RNA, 19 nt, Human
agugagcauggcuugacug

SEQ ID NO: 1028015 - RNA, 17 nt, Human
uuuguucguuaguccgg

SEQ ID NO: 1028016 - RNA, 22 nt, Human
ccggcgucucuuccacuuccua

SEQ ID NO: 1028017 - RNA, 22 nt, Human
ucuugggcaauuucucuagagg

SEQ ID NO: 1028018 - RNA, 15 nt, Human
uggugguguugagac

SEQ ID NO: 1028019 - RNA, 22 nt, Human
aagggggaaauccuagcgccgc

SEQ ID NO: 1028020 - RNA, 20 nt, Human
ugcuggaggcgccggcgcuc

SEQ ID NO: 1028021 - RNA, 22 nt, Human
ggggcccagcaccccuccucgc

SEQ ID NO: 1028022 - RNA, 22 nt, Human
ucccugccuccuggcagugcca

SEQ ID NO: 1028023 - RNA, 22 nt, Human
acagcugggaacucacacagca

SEQ ID NO: 1028024 - RNA, 22 nt, Human
uggcaaggccacaggugcaguu

SEQ ID NO: 1028025 - RNA, 22 nt, Human
agcuccugaaaagcgcuugcuu

SEQ ID NO: 1028026 - RNA, 21 nt, Human
gccaccucaaucuucuagcgc

SEQ ID NO: 1028027 - RNA, 18 nt, Human
cuggucucccuucgcuuu

SEQ ID NO: 1028028 - RNA, 22 nt, Human
ucaccccuugugaaugcugcuc

SEQ ID NO: 1028029 - RNA, 22 nt, Human
cugagcagaagggugcacgugc

SEQ ID NO: 1028030 - RNA, 20 nt, Human
ggcauggcaaauguucuugc

SEQ ID NO: 1028031 - RNA, 22 nt, Human
ccuguggccgcgucgggcggcg

SEQ ID NO: 1028032 - RNA, 22 nt, Human
ccgcuguccuggagcugcugcu

SEQ ID NO: 1028033 - RNA, 22 nt, Human
cugcugagguggagauugcagu

SEQ ID NO: 1028034 - RNA, 22 nt, Human
gucccuggucuaccguggcuuc

SEQ ID NO: 1028035 - RNA, 22 nt, Human
cugcugucuuuauuucacugcu

SEQ ID NO: 1028036 - RNA, 22 nt, Human
gcaggcuuauggggagacagag

SEQ ID NO: 1028037 - RNA, 22 nt, Human
agagcuagaaggaagcauuucu

SEQ ID NO: 1028038 - RNA, 21 nt, Human
gcuccuggugcugcguggcgc

SEQ ID NO: 1028039 - RNA, 22 nt, Human
gcagcagugugggcugaaccua

SEQ ID NO: 1028040 - RNA, 22 nt, Human
gagcagcaggccagguugcagg

SEQ ID NO: 1028041 - RNA, 20 nt, Human
aggggcaccugcgacggggc

SEQ ID NO: 1028042 - RNA, 22 nt, Human
gggcauuucuugucaauguagg

SEQ ID NO: 1028043 - RNA, 22 nt, Human
auaguagcgagaucucagcuca

SEQ ID NO: 1028044 - RNA, 22 nt, Human
aagguccuguagccacagagcc

SEQ ID NO: 1028045 - RNA, 22 nt, Human
acggagcccgugucagguggga

SEQ ID NO: 1028046 - RNA, 22 nt, Human
gaggcuggcagaaaagcacagg

SEQ ID NO: 1028047 - RNA, 20 nt, Human
gcugugccaugacccucgag

SEQ ID NO: 1028048 - RNA, 22 nt, Human
auggccugcagugcugccacag

SEQ ID NO: 1028049 - RNA, 22 nt, Human
guucuccaggggcuguucaucu

SEQ ID NO: 1028050 - RNA, 22 nt, Human
caagcagauauuuuagucaaga

SEQ ID NO: 1028051 - RNA, 22 nt, Human
cugcacagccugucugggggcc

SEQ ID NO: 1028052 - RNA, 22 nt, Human
ucggaaccgaccugggagcugg

SEQ ID NO: 1028053 - RNA, 22 nt, Human
acagaguaucuaucaggaguau

SEQ ID NO: 1028054 - RNA, 22 nt, Human
uggcccagaucucugaccuuga

SEQ ID NO: 1028055 - RNA, 22 nt, Human
gagcugggaagauagcuugagc

SEQ ID NO: 1028056 - RNA, 22 nt, Human
uggugcagacaggagccccgcu

SEQ ID NO: 1028057 - RNA, 22 nt, Human
ugagaagcauuaggaagaacau

SEQ ID NO: 1028058 - RNA, 22 nt, Human
uaggcuccaguguguggcgagu

SEQ ID NO: 1028059 - RNA, 22 nt, Human
gggcagagguucaacuucaaca

SEQ ID NO: 1028060 - RNA, 22 nt, Human
ugcccuggcuccucccacgcug

SEQ ID NO: 1028061 - RNA, 22 nt, Human
cggagccugcuuguugcagcug

SEQ ID NO: 1028062 - RNA, 20 nt, Human
uggcccagcacgacgaggac

SEQ ID NO: 1028063 - RNA, 22 nt, Human
augucccugagggucucucuga

SEQ ID NO: 1028064 - RNA, 22 nt, Human
cagcugcucugguggucucucc

SEQ ID NO: 1028065 - RNA, 22 nt, Human
ccugggacuuggucugggguuu

SEQ ID NO: 1028066 - RNA, 21 nt, Human
uguguucuucuaggucagcua

SEQ ID NO: 1028067 - RNA, 22 nt, Human
ucaggggcuugaggugcauguc

SEQ ID NO: 1028068 - RNA, 22 nt, Human
aggcucugucaggcggagcagc

SEQ ID NO: 1028069 - RNA, 22 nt, Human
acaguguuucacuuaaccguuu

SEQ ID NO: 1028070 - RNA, 22 nt, Human
cugcacagucauuuccucucaa

SEQ ID NO: 1028071 - RNA, 22 nt, Human
guugcaaaugggaagaugguua

SEQ ID NO: 1028072 - RNA, 22 nt, Human
uggcuccaggggacacgcagua

SEQ ID NO: 1028073 - RNA, 22 nt, Human
uuccuuaguuauuugguccccu

SEQ ID NO: 1028074 - RNA, 23 nt, Human
gacagguaaggguugggagaauc

SEQ ID NO: 1028075 - RNA, 22 nt, Human
ugggcugcuuccucagcugaga

SEQ ID NO: 1028076 - RNA, 22 nt, Human
uccagcugugcuccaggaggug

SEQ ID NO: 1028077 - RNA, 22 nt, Human
uguggugccgagagucuggacg

SEQ ID NO: 1028078 - RNA, 21 nt, Human
cccgugccuucagcaguccug

SEQ ID NO: 1028079 - RNA, 21 nt, Human
uuccuggaggcagaaacguga

SEQ ID NO: 1028080 - RNA, 22 nt, Human
agauggcagggguaccuggaag

SEQ ID NO: 1028081 - RNA, 22 nt, Human
uucucacguuauuggcugagag

SEQ ID NO: 1028082 - RNA, 22 nt, Human
agacacuguguacagaaaaaga

SEQ ID NO: 1028083 - RNA, 22 nt, Human
ugcacacaguucucaggaaaga

SEQ ID NO: 1028084 - RNA, 22 nt, Human
cugcucucuguuccccuggauc

SEQ ID NO: 1028085 - RNA, 22 nt, Human
ugggcagacgggagcuugccuu

SEQ ID NO: 1028086 - RNA, 22 nt, Human
gggcucggcaucuguggacucu

SEQ ID NO: 1028087 - RNA, 23 nt, Human
aaaguacuuaaucugcaaaccac

SEQ ID NO: 1028088 - RNA, 22 nt, Human
cugucucugauaagcucgaggg

SEQ ID NO: 1028089 - RNA, 22 nt, Human
cugaaggauguguggugggagu

SEQ ID NO: 1028090 - RNA, 22 nt, Human
cugcugccuuccaaaggccagg

SEQ ID NO: 1028091 - RNA, 22 nt, Human
acuggcaguagagggagcgcau

SEQ ID NO: 1028092 - RNA, 22 nt, Human
gccuggcucugaguuucucucc

SEQ ID NO: 1028093 - RNA, 22 nt, Human
uccucuccaggugagccgaaau

SEQ ID NO: 1028094 - RNA, 22 nt, Human
ucugaggucauuccaaggacau

SEQ ID NO: 1028095 - RNA, 22 nt, Human
uggcuccguuguacaggcugga

SEQ ID NO: 1028096 - RNA, 22 nt, Human
uggguagggagcuggaauccua

SEQ ID NO: 1028097 - RNA, 22 nt, Human
gcuuggccagcagccgggaugc

SEQ ID NO: 1028098 - RNA, 22 nt, Human
agaguguggaaauguucagagu

SEQ ID NO: 1028099 - RNA, 22 nt, Human
agucagucugcuagccugugga

SEQ ID NO: 1028100 - RNA, 22 nt, Human
cggagaggugggggcagcaucu

SEQ ID NO: 1028101 - RNA, 19 nt, Human
gggucccacugcccgucug

SEQ ID NO: 1028102 - RNA, 22 nt, Human
gggcagcaaaucugagucuggu

SEQ ID NO: 1028103 - RNA, 22 nt, Human
gagcugucucuuugggccuuuu

SEQ ID NO: 1028104 - RNA, 22 nt, Human
ucaugucccguugcuggcugcc

SEQ ID NO: 1028105 - RNA, 22 nt, Human
ugcagcugccuagggcuggcuu

SEQ ID NO: 1028106 - RNA, 22 nt, Human
ugaaaugccuaugaagucagga

SEQ ID NO: 1028107 - RNA, 22 nt, Human
ugagaagcaguuucaguaagaa

SEQ ID NO: 1028108 - RNA, 22 nt, Human
agcaugucuaacucuucagggu

SEQ ID NO: 1028109 - RNA, 22 nt, Human
ugcucccaggcauucucuguug

SEQ ID NO: 1028110 - RNA, 22 nt, Human
gggccuuggcgaaguguggugg

SEQ ID NO: 1028111 - RNA, 22 nt, Human
ugucuuggccacuaggagugcc

SEQ ID NO: 1028112 - RNA, 22 nt, Human
gccagccccagacauccuaucg

SEQ ID NO: 1028113 - RNA, 22 nt, Human
cugggaagggacgccagugccu

SEQ ID NO: 1028114 - RNA, 22 nt, Human
ucaggagaguguucaguggagg

SEQ ID NO: 1028115 - RNA, 22 nt, Human
gcacagagagcagugggggaca

SEQ ID NO: 1028116 - RNA, 22 nt, Human
ugcuucucucuaggaagacgcu

SEQ ID NO: 1028117 - RNA, 22 nt, Human
ugcugcgggacccacugugggc

SEQ ID NO: 1028118 - RNA, 22 nt, Human
ugcccacaggaagacaccagcg

SEQ ID NO: 1028119 - RNA, 22 nt, Human
cacugcccuggggguugccauc

SEQ ID NO: 1028120 - RNA, 22 nt, Human
guugaguguugugcaugcacca

SEQ ID NO: 1028121 - RNA, 22 nt, Human
caugugguauugugagauccac

SEQ ID NO: 1028122 - RNA, 22 nt, Human
cacaucucagggcuacaggcag

SEQ ID NO: 1028123 - RNA, 22 nt, Human
guuuuguucaugaacauugggu

SEQ ID NO: 1028124 - RNA, 22 nt, Human
aaccauggauuucaguucaccu

SEQ ID NO: 1028125 - RNA, 16 nt, Human
aggcucagaggcugga

SEQ ID NO: 1028126 - RNA, 21 nt, Human
aaagugguaaggauuauuuug

SEQ ID NO: 1028127 - RNA, 22 nt, Human
cccgaccucgcaaagcgcacuc

SEQ ID NO: 1028128 - RNA, 22 nt, Human
ugaauagagcugcaguggacau

SEQ ID NO: 1028129 - RNA, 22 nt, Human
ccuggagacccacuucugccaa

SEQ ID NO: 1028130 - RNA, 18 nt, Human
gacaaaaguacagacaga

SEQ ID NO: 1028131 - RNA, 22 nt, Human
uuccaggccgggcaggaaacac

SEQ ID NO: 1028132 - RNA, 22 nt, Human
agccagcuaccggggcuccugg

SEQ ID NO: 1028133 - RNA, 22 nt, Human
gugacaugguuugccgucccug

SEQ ID NO: 1028134 - RNA, 22 nt, Human
ccugcucaacgaauauggcgau

SEQ ID NO: 1028135 - RNA, 22 nt, Human
ccaggagagcucucguucagug

SEQ ID NO: 1028136 - RNA, 22 nt, Human
caggaaugccaaccagugcaug

SEQ ID NO: 1028137 - RNA, 22 nt, Human
gccuggcuucccuuggagcauu

SEQ ID NO: 1028138 - RNA, 22 nt, Human
gcucugugcaguucagggacac

SEQ ID NO: 1028139 - RNA, 22 nt, Human
acacaagcagcuuuugagcgga

SEQ ID NO: 1028140 - RNA, 22 nt, Human
cagagccaaaccucagggcccg

SEQ ID NO: 1028141 - RNA, 20 nt, Human
ccacccuguccggggcggag

SEQ ID NO: 1028142 - RNA, 22 nt, Human
agccugugagggaugcugcagu

SEQ ID NO: 1028143 - RNA, 22 nt, Human
agggcagagauuaauuaagaca

SEQ ID NO: 1028144 - RNA, 22 nt, Human
ucuuccuggauggggguugaug

SEQ ID NO: 1028145 - RNA, 22 nt, Human
aacacauggcaagagcaggaaa

SEQ ID NO: 1028146 - RNA, 22 nt, Human
guguggcuaggauggcuuugcu

SEQ ID NO: 1028147 - RNA, 17 nt, Human
gugcuggccuggggcuc

SEQ ID NO: 1028148 - RNA, 22 nt, Human
aagaguggagcuggaaaguggg

SEQ ID NO: 1028149 - RNA, 22 nt, Human
gcaggccuccccugcuggagcu

SEQ ID NO: 1028150 - RNA, 22 nt, Human
cucucuccuuagcugcagacca

SEQ ID NO: 1028151 - RNA, 22 nt, Human
agagcaccaaggugguuuggac

SEQ ID NO: 1028152 - RNA, 22 nt, Human
ucugagagcuguagaagccuau

SEQ ID NO: 1028153 - RNA, 22 nt, Human
gccugcuuccuagccuuccaag

SEQ ID NO: 1028154 - RNA, 22 nt, Human
gcacguguucuguggcaugggu

SEQ ID NO: 1028155 - RNA, 22 nt, Human
agcugaacgugcuucugcagca

SEQ ID NO: 1028156 - RNA, 20 nt, Human
gcuccccuucucugggccuc

SEQ ID NO: 1028157 - RNA, 22 nt, Human
cucccagccuucgccagucuga

SEQ ID NO: 1028158 - RNA, 22 nt, Human
caggcacaaugagcgccaucuu

SEQ ID NO: 1028159 - RNA, 22 nt, Human
guggccuuuucaaguaggguau

SEQ ID NO: 1028160 - RNA, 22 nt, Human
auggaggaugugcagcaugggc

SEQ ID NO: 1028161 - RNA, 22 nt, Human
ucaguguccuucguucuuguug

SEQ ID NO: 1028162 - RNA, 22 nt, Human
caaacauuuguuggaaccccug

SEQ ID NO: 1028163 - RNA, 22 nt, Human
gagacagagagguacucaacau

SEQ ID NO: 1028164 - RNA, 22 nt, Human
caucaggaauaaaugaggcugu

SEQ ID NO: 1028165 - RNA, 22 nt, Human
guuuccuuuuggaauuagagcu

SEQ ID NO: 1028166 - RNA, 22 nt, Human
agccagugcagcuggaaauuca

SEQ ID NO: 1028167 - RNA, 22 nt, Human
ucagcacaggucuugcaaaaca

SEQ ID NO: 1028168 - RNA, 20 nt, Human
ucuggggaugaggucuagga

SEQ ID NO: 1028169 - RNA, 22 nt, Human
ccuuugagccugggcgcggacc

SEQ ID NO: 1028170 - RNA, 21 nt, Human
ugagcaccagcugcaugcccc

SEQ ID NO: 1028171 - RNA, 20 nt, Human
uucacagaggacucagguca

SEQ ID NO: 1028172 - RNA, 21 nt, Human
cacuccacuuagaacaggguu

SEQ ID NO: 1028173 - RNA, 22 nt, Human
ugaaagcucugucaucauuccu

SEQ ID NO: 1028174 - RNA, 22 nt, Human
gcggccugcgcugcucccgacg

SEQ ID NO: 1028175 - RNA, 22 nt, Human
ugcagcuucucugcaacaggag

SEQ ID NO: 1028176 - RNA, 22 nt, Human
gucuggagccacugcugcugcu

SEQ ID NO: 1028177 - RNA, 22 nt, Human
ugcgcaugcguggcucuccggc

SEQ ID NO: 1028178 - RNA, 22 nt, Human
acuuggucguggugcagcaugg

SEQ ID NO: 1028179 - RNA, 22 nt, Human
aggugugcaggaugaaccccuc

SEQ ID NO: 1028180 - RNA, 22 nt, Human
ggugaccucaccuggucccacc

SEQ ID NO: 1028181 - RNA, 22 nt, Human
cagcaguacuucucagagguau

SEQ ID NO: 1028182 - RNA, 22 nt, Human
agcucaguggcuggggcgcugc

SEQ ID NO: 1028183 - RNA, 22 nt, Human
gacauuuauuggauuuuacgag

SEQ ID NO: 1028184 - RNA, 22 nt, Human
gagcugcauagcugggauccuc

SEQ ID NO: 1028185 - RNA, 22 nt, Human
ccucagucuauuuccagcaggu

SEQ ID NO: 1028186 - RNA, 22 nt, Human
cccucucccugcagaauguggc

SEQ ID NO: 1028187 - RNA, 22 nt, Human
acccggaggcgggggaugcagu

SEQ ID NO: 1028188 - RNA, 22 nt, Human
gagcucauccccaugguccguc

SEQ ID NO: 1028189 - RNA, 22 nt, Human
ccagccagcugcccuuggggcc

SEQ ID NO: 1028190 - RNA, 22 nt, Human
ugaaaacacuuuaguuuagguc

SEQ ID NO: 1028191 - RNA, 22 nt, Human
cucucuuuuucgugugccgaag

SEQ ID NO: 1028192 - RNA, 22 nt, Human
gcucagagauguucaguagcuu

SEQ ID NO: 1028193 - RNA, 23 nt, Human
ugucuggauucgacugugguugg

SEQ ID NO: 1028194 - RNA, 22 nt, Human
uagcagcacuauuuguuguagu

SEQ ID NO: 1028195 - RNA, 22 nt, Human
acugcauuugguaaagucaaga

SEQ ID NO: 1028196 - RNA, 22 nt, Human
cucggaauggaacaacagcggu

SEQ ID NO: 1028197 - RNA, 22 nt, Human
caggcacaagaucggcuagaua

SEQ ID NO: 1028198 - RNA, 22 nt, Human
caugaaaugauauuuggguggg

SEQ ID NO: 1028199 - RNA, 19 nt, Human
ugguggaggugcaccugac

SEQ ID NO: 1028200 - RNA, 22 nt, Human
ucuuugcauggacauguguuuu

SEQ ID NO: 1028201 - RNA, 22 nt, Human
cagcuuuugcagacuucuugcc

SEQ ID NO: 1028202 - RNA, 21 nt, Human
gacauugagcgugucgcagug

SEQ ID NO: 1028203 - RNA, 22 nt, Human
caugcauuucuaccaaggaaua

SEQ ID NO: 1028204 - RNA, 22 nt, Human
ccugcagacacuuguccagcaa

SEQ ID NO: 1028205 - RNA, 22 nt, Human
ggauguggaccuugccugguga

SEQ ID NO: 1028206 - RNA, 22 nt, Human
agcauggccucccgggccuggc

SEQ ID NO: 1028207 - RNA, 22 nt, Human
gaagcccuggggucagugucgu

SEQ ID NO: 1028208 - RNA, 22 nt, Human
cccuguccugcuaggcccuggu

SEQ ID NO: 1028209 - RNA, 22 nt, Human
cugcagggcagggccuccuggc

SEQ ID NO: 1028210 - RNA, 22 nt, Human
cuccagagagaaaggaggccgc

SEQ ID NO: 1028211 - RNA, 22 nt, Human
ugagaacaaaguugaaaguuug

SEQ ID NO: 1028212 - RNA, 22 nt, Human
caagagcuuuagaaaugcucau

SEQ ID NO: 1028213 - RNA, 22 nt, Human
agaugcugccaggccccucagu

SEQ ID NO: 1028214 - RNA, 22 nt, Human
uccuggcucaggccccuggugc

SEQ ID NO: 1028215 - RNA, 22 nt, Human
gagguggcugcuugcugggaaa

SEQ ID NO: 1028216 - RNA, 22 nt, Human
caguaaauguccucgcagggaa

SEQ ID NO: 1028217 - RNA, 22 nt, Human
ugacauccuacaccccuggguc

SEQ ID NO: 1028218 - RNA, 22 nt, Human
agcaguuuauccucauaaugga

SEQ ID NO: 1028219 - RNA, 22 nt, Human
agcggcgccgagcuuggccagg

SEQ ID NO: 1028220 - RNA, 22 nt, Human
ugucuguccaucugucugggac

SEQ ID NO: 1028221 - RNA, 19 nt, Human
ugcuccaggccuugccgca

SEQ ID NO: 1028222 - RNA, 22 nt, Human
gccccgucguggggccagggau

SEQ ID NO: 1028223 - RNA, 22 nt, Human
gcugucaggaacaugccuuggu

SEQ ID NO: 1028224 - RNA, 22 nt, Human
ugcaugcagcuggucgggcgcc

SEQ ID NO: 1028225 - RNA, 19 nt, Human
ugccuggcaccagcuccac

SEQ ID NO: 1028226 - RNA, 22 nt, Human
ucucgugcaggccuugcucgga

SEQ ID NO: 1028227 - RNA, 22 nt, Human
acucauguccuaggaguaaagc

SEQ ID NO: 1028228 - RNA, 22 nt, Human
uccugaaggccugaguuccacc

SEQ ID NO: 1028229 - RNA, 22 nt, Human
gaguuugugggaauggaguauu

SEQ ID NO: 1028230 - RNA, 22 nt, Human
acggugcuggguauugggguuc

SEQ ID NO: 1028231 - RNA, 22 nt, Human
gcaccagccugagccucuugca

SEQ ID NO: 1028232 - RNA, 22 nt, Human
guccuggugcuggucauugucg

SEQ ID NO: 1028233 - RNA, 22 nt, Human
gggucugcuccaccugcagccc

SEQ ID NO: 1028234 - RNA, 22 nt, Human
uuuguaguuguggaugcugaag

SEQ ID NO: 1028235 - RNA, 22 nt, Human
gcugccaucuccugaggacagg

SEQ ID NO: 1028236 - RNA, 22 nt, Human
cugccaggauucugugaacccc

SEQ ID NO: 1028237 - RNA, 22 nt, Human
agcagccuugugacuccggggu

SEQ ID NO: 1028238 - RNA, 22 nt, Human
aaagugacaaccauuuauuaag

SEQ ID NO: 1028239 - RNA, 22 nt, Human
agagcagaggcauggccguggg

SEQ ID NO: 1028240 - RNA, 17 nt, Human
gcguguccccgcgucuc

SEQ ID NO: 1028241 - RNA, 22 nt, Human
ucuguucagaagaggugaaagu

SEQ ID NO: 1028242 - RNA, 22 nt, Human
gccaggcaggccacgcuguguu

SEQ ID NO: 1028243 - RNA, 22 nt, Human
cagcuggacugggauguagcga

SEQ ID NO: 1028244 - RNA, 15 nt, Human
gagaugcucucaggg

SEQ ID NO: 1028245 - RNA, 22 nt, Human
uccggcggccggccugagcccg

SEQ ID NO: 1028246 - RNA, 22 nt, Human
uuucaugauuaacuuagugaau

SEQ ID NO: 1028247 - RNA, 17 nt, Human
agcagcuggguugaucu

SEQ ID NO: 1028248 - RNA, 22 nt, Human
ggaaggggagcuaaaucuacug

SEQ ID NO: 1028249 - RNA, 19 nt, Human
acugcagggaggaggugug

SEQ ID NO: 1028250 - RNA, 22 nt, Human
ggcuagcuccuccgcgcaucca

SEQ ID NO: 1028251 - RNA, 22 nt, Human
ggccagccuggggcucccagac

SEQ ID NO: 1028252 - RNA, 22 nt, Human
aggcucagcaucugauucauau

SEQ ID NO: 1028253 - RNA, 22 nt, Human
ugcaagagcccaaacuauauac

SEQ ID NO: 1028254 - RNA, 21 nt, Human
gcacuucugcagggcugcugg

SEQ ID NO: 1028255 - RNA, 22 nt, Human
uugaugcugucuuucagaauca

SEQ ID NO: 1028256 - RNA, 22 nt, Human
guggcagcggcccaggccgucu

SEQ ID NO: 1028257 - RNA, 22 nt, Human
uggggugccgacagggagggca

SEQ ID NO: 1028258 - RNA, 22 nt, Human
acucagugggcuugaugucgaa

SEQ ID NO: 1028259 - RNA, 18 nt, Human
uggcaugcuuugauacau

SEQ ID NO: 1028260 - RNA, 22 nt, Human
cugugugcagggcacaauggaa

SEQ ID NO: 1028261 - RNA, 21 nt, Human
agaaggcaaaagcagacaucu

SEQ ID NO: 1028262 - RNA, 22 nt, Human
acuggcccuggcugcuaggcug

SEQ ID NO: 1028263 - RNA, 22 nt, Human
ccucuuccacugggccccaucc

SEQ ID NO: 1028264 - RNA, 22 nt, Human
cccuugagguagacugaacacc

SEQ ID NO: 1028265 - RNA, 22 nt, Human
gcuaagggauaggcugccuccu

SEQ ID NO: 1028266 - RNA, 22 nt, Human
ucagccaggccaggcauucaca

SEQ ID NO: 1028267 - RNA, 22 nt, Human
cuucucugucacaggguuacgu

SEQ ID NO: 1028268 - RNA, 22 nt, Human
uagcagaacaauagucaaugau

SEQ ID NO: 1028269 - RNA, 22 nt, Human
ugcucgagguccccaccggcuc

SEQ ID NO: 1028270 - RNA, 20 nt, Human
ggccggggagcucuccaggg

SEQ ID NO: 1028271 - RNA, 23 nt, Human
gcacagagcaguuaggggaagau

SEQ ID NO: 1028272 - RNA, 22 nt, Human
aagcucuuuccacuaaaccacu

SEQ ID NO: 1028273 - RNA, 22 nt, Human
gccagcagcucuugggcgggca

SEQ ID NO: 1028274 - RNA, 22 nt, Human
gugcaggugguuggcccagccg

SEQ ID NO: 1028275 - RNA, 22 nt, Human
gcaccgagaaggaagcaugccu

SEQ ID NO: 1028276 - RNA, 22 nt, Human
ugcuuguauucauaucacagcu

SEQ ID NO: 1028277 - RNA, 20 nt, Human
uuucacuggcuugauaaggu

SEQ ID NO: 1028278 - RNA, 22 nt, Human
agagcuccaggguuuuguagug

SEQ ID NO: 1028279 - RNA, 19 nt, Human
uccuggggaggggcauggc

SEQ ID NO: 1028280 - RNA, 23 nt, Human
cagcugguugugggaguggcugc

SEQ ID NO: 1028281 - RNA, 22 nt, Human
ccaggaugacccccacuuuccu

SEQ ID NO: 1028282 - RNA, 22 nt, Human
aaccagcacugcuggggccugc

SEQ ID NO: 1028283 - RNA, 22 nt, Human
acgugcuggagaagagcucgcc

SEQ ID NO: 1028284 - RNA, 22 nt, Human
cucgcggcgcccgaagcccuug

SEQ ID NO: 1028285 - RNA, 20 nt, Human
uuugauugccccucugacuu

SEQ ID NO: 1028286 - RNA, 22 nt, Human
aagucuucagacuggagagauu

SEQ ID NO: 1028287 - RNA, 22 nt, Human
uagucaccuguugugugaugcc

SEQ ID NO: 1028288 - RNA, 22 nt, Human
agcuccacucccugccuguuuc

SEQ ID NO: 1028289 - RNA, 22 nt, Human
cgccccagccaguugagcggcg

SEQ ID NO: 1028290 - RNA, 22 nt, Human
ugcuggccucggcgcugggccu

SEQ ID NO: 1028291 - RNA, 22 nt, Human
ugucugccugcgggccggcaca

SEQ ID NO: 1028292 - RNA, 22 nt, Human
uagcuguucucuguaaauugga

SEQ ID NO: 1028293 - RNA, 22 nt, Human
gccugaucagguccucggcaua

SEQ ID NO: 1028294 - RNA, 22 nt, Human
gcagcugccgugagcucacgcc

SEQ ID NO: 1028295 - RNA, 22 nt, Human
gcgagaaacuaagugcccuuug

SEQ ID NO: 1028296 - RNA, 22 nt, Human
gcagcccaggaggcgggagccc

SEQ ID NO: 1028297 - RNA, 17 nt, Human
gugagcugagucaggac

SEQ ID NO: 1028298 - RNA, 22 nt, Human
aggcugcugccuuggagagugu

SEQ ID NO: 1028299 - RNA, 23 nt, Human
aagaaugcuucugaagagcugcc

SEQ ID NO: 1028300 - RNA, 22 nt, Human
accaggaguuuugaccaggggc

SEQ ID NO: 1028301 - RNA, 22 nt, Human
cccuuguuuuugaguacaauag

SEQ ID NO: 1028302 - RNA, 22 nt, Human
gcagcuuuggagguggaacucu

SEQ ID NO: 1028303 - RNA, 22 nt, Human
acagugcaaauaggacugucuu

SEQ ID NO: 1028304 - RNA, 22 nt, Human
ugcauggacgugacuuggccaa

SEQ ID NO: 1028305 - RNA, 22 nt, Human
ucuguggcauguugcacuugua

SEQ ID NO: 1028306 - RNA, 22 nt, Human
aaggcuccagugaaugcuggca

SEQ ID NO: 1028307 - RNA, 22 nt, Human
gccuggaaugcaaugugacgaa

SEQ ID NO: 1028308 - RNA, 23 nt, Human
acagucguagguauccuuuuccu

SEQ ID NO: 1028309 - RNA, 22 nt, Human
cugagguccucagagggaaagg

SEQ ID NO: 1028310 - RNA, 22 nt, Human
cugcaccgugucucgggcugcc

SEQ ID NO: 1028311 - RNA, 22 nt, Human
uggcugaggcacagcugccgcc

SEQ ID NO: 1028312 - RNA, 22 nt, Human
cuugccagggacucagucaggg

SEQ ID NO: 1028313 - RNA, 22 nt, Human
gcucugagucacacugcccugu

SEQ ID NO: 1028314 - RNA, 22 nt, Human
ggugcggagacuccaugaggcc

SEQ ID NO: 1028315 - RNA, 22 nt, Human
cugaaggacacgugaggagcca

SEQ ID NO: 1028316 - RNA, 22 nt, Human
cagggagccccaauuccaugcc

SEQ ID NO: 1028317 - RNA, 22 nt, Human
gagccaggcccguacuugcugu

SEQ ID NO: 1028318 - RNA, 22 nt, Human
ggcaguggugggaggcucgcuc

SEQ ID NO: 1028319 - RNA, 22 nt, Human
auuuccuguaggggcuugcgaa

SEQ ID NO: 1028320 - RNA, 22 nt, Human
ugggcugcuucuauuggugguc

SEQ ID NO: 1028321 - RNA, 22 nt, Human
gggacaaccaacuuagcauuac

SEQ ID NO: 1028322 - RNA, 23 nt, Human
acucguggaauucucugcgaucg

SEQ ID NO: 1028323 - RNA, 22 nt, Human
ugcaggccuggacugauguggu

SEQ ID NO: 1028324 - RNA, 22 nt, Human
ugaggcuggaugggaugccucc

SEQ ID NO: 1028325 - RNA, 20 nt, Human
ccagagcugauggcugcccg

SEQ ID NO: 1028326 - RNA, 22 nt, Human
uucugugcucaaaacuuuccaa

SEQ ID NO: 1028327 - RNA, 22 nt, Human
agcugccgaugcccagcugcau

SEQ ID NO: 1028328 - RNA, 22 nt, Human
agggaagcagcagccgccuguc

SEQ ID NO: 1028329 - RNA, 22 nt, Human
cgccguccccuaggaaagagcu

SEQ ID NO: 1028330 - RNA, 18 nt, Human
gaaggcauucaguggcuu

SEQ ID NO: 1028331 - RNA, 22 nt, Human
agcucagggccaggcgcguuuc

SEQ ID NO: 1028332 - RNA, 22 nt, Human
cacagaggaugcccaagcgauc

SEQ ID NO: 1028333 - RNA, 22 nt, Human
uggguguguccauauuuugacu

SEQ ID NO: 1028334 - RNA, 22 nt, Human
acacauggucuacuucuucuca

SEQ ID NO: 1028335 - RNA, 22 nt, Human
cagaaacacuguauuuagggaa

SEQ ID NO: 1028336 - RNA, 22 nt, Human
ugcccagucuccgggccagccc

SEQ ID NO: 1028337 - RNA, 22 nt, Human
ccuuccaguucuugguuguaau

SEQ ID NO: 1028338 - RNA, 22 nt, Human
agguggagaagagaugggcagu

SEQ ID NO: 1028339 - RNA, 22 nt, Human
agagaccuuuugccuucuaguu

SEQ ID NO: 1028340 - RNA, 22 nt, Human
ucacaggagcccaggggagcug

SEQ ID NO: 1028341 - RNA, 22 nt, Human
gggcugacaccacccaggcgca

SEQ ID NO: 1028342 - RNA, 22 nt, Human
aguccgcgcuccaugggagucc

SEQ ID NO: 1028343 - RNA, 22 nt, Human
cagcugccuaugaccuagccuc

SEQ ID NO: 1028344 - RNA, 22 nt, Human
uguaccacucuacuaaggguuc

SEQ ID NO: 1028345 - RNA, 22 nt, Human
ggaaggcuuuaagcaccaaagc

SEQ ID NO: 1028346 - RNA, 22 nt, Human
uccuggccaaguagauguggcg

SEQ ID NO: 1028347 - RNA, 22 nt, Human
ccagcugggucccugcuggggc

SEQ ID NO: 1028348 - RNA, 22 nt, Human
aggacaggauugagcugaacug

SEQ ID NO: 1028349 - RNA, 22 nt, Human
cugugcuggcagaccuggaguu

SEQ ID NO: 1028350 - RNA, 22 nt, Human
gccuggcgccgggcugccuguc

SEQ ID NO: 1028351 - RNA, 22 nt, Human
gggagccccaccucggugcccg

SEQ ID NO: 1028352 - RNA, 22 nt, Human
uugggacaaagacuccuugaau

SEQ ID NO: 1028353 - RNA, 22 nt, Human
gcggcccgagcaggacgggugg

SEQ ID NO: 1028354 - RNA, 22 nt, Human
auacaccaccuuggaucuuuca

SEQ ID NO: 1028355 - RNA, 22 nt, Human
gauggaggagauggcagggugc

SEQ ID NO: 1028356 - RNA, 22 nt, Human
gguuccaggcauggcaggaugu

SEQ ID NO: 1028357 - RNA, 22 nt, Human
ucacccuucccagcuguccgcc

SEQ ID NO: 1028358 - RNA, 22 nt, Human
uugugcccucaaagggugcguc

SEQ ID NO: 1028359 - RNA, 22 nt, Human
ggaguucaaaucuuuuggaucu

SEQ ID NO: 1028360 - RNA, 22 nt, Human
guggccaucuuuggcccugacu

SEQ ID NO: 1028361 - RNA, 22 nt, Human
cagggcucgcucuugcccuucg

SEQ ID NO: 1028362 - RNA, 22 nt, Human
ggagguggagcuggaaguucca

SEQ ID NO: 1028363 - RNA, 22 nt, Human
ccaggaagaaacagucuuuaua

SEQ ID NO: 1028364 - RNA, 22 nt, Human
ugggcacacugaaucugcuauu

SEQ ID NO: 1028365 - RNA, 22 nt, Human
gacaaagcgccugcucgcgggc

SEQ ID NO: 1028366 - RNA, 22 nt, Human
gcggcuccgaagccaggccgcg

SEQ ID NO: 1028367 - RNA, 22 nt, Human
aaguguguauuuuucuucagug

SEQ ID NO: 1028368 - RNA, 22 nt, Human
gaggugaguggggucuccaggg

SEQ ID NO: 1028369 - RNA, 22 nt, Human
cugccguguuuuucauguuaaa

SEQ ID NO: 1028370 - RNA, 22 nt, Human
ugguggggccagacuucagcuc

SEQ ID NO: 1028371 - RNA, 22 nt, Human
uuccaggaagcucucggccucu

SEQ ID NO: 1028372 - RNA, 22 nt, Human
uggcucaggccuacgacgccuu

SEQ ID NO: 1028373 - RNA, 22 nt, Human
uaugcgugccucugucugucug

SEQ ID NO: 1028374 - RNA, 22 nt, Human
augcaguuagguaauagucuca

SEQ ID NO: 1028375 - RNA, 22 nt, Human
ugcugcccacuguauuucucca

SEQ ID NO: 1028376 - RNA, 22 nt, Human
caggacccaucagccaggcacu

SEQ ID NO: 1028377 - RNA, 22 nt, Human
gagugggugaaugugcucauaa

SEQ ID NO: 1028378 - RNA, 21 nt, Human
caaaagagacugauucuugga

SEQ ID NO: 1028379 - RNA, 22 nt, Human
gcugccgacccacagggguuaa

SEQ ID NO: 1028380 - RNA, 22 nt, Human
cagggcucacucggcuggcguc

SEQ ID NO: 1028381 - RNA, 22 nt, Human
ucuccucuccuuucauguuguu

SEQ ID NO: 1028382 - RNA, 22 nt, Human
auuuacagacguggauuagugc

SEQ ID NO: 1028383 - RNA, 22 nt, Human
aguacuuuuuguucaauugugc

SEQ ID NO: 1028384 - RNA, 22 nt, Human
caucugcaggggaagccaguuu

SEQ ID NO: 1028385 - RNA, 22 nt, Human
guggccuccuccguccgccucu

SEQ ID NO: 1028386 - RNA, 18 nt, Human
gccugccagccgagggac

SEQ ID NO: 1028387 - RNA, 22 nt, Human
cauugagcgacccugcaugacu

SEQ ID NO: 1028388 - RNA, 20 nt, Human
acguggccaccaguggcuua

SEQ ID NO: 1028389 - RNA, 22 nt, Human
agagcuggguggacuuguaguu

SEQ ID NO: 1028390 - RNA, 22 nt, Human
agcuuugcugcuggagaagggu

SEQ ID NO: 1028391 - RNA, 22 nt, Human
ggccacuguuuccugggcaguu

SEQ ID NO: 1028392 - RNA, 22 nt, Human
ugucuucuaccuugacagcauu

SEQ ID NO: 1028393 - RNA, 22 nt, Human
uucuguucccuaggaccugggg

SEQ ID NO: 1028394 - RNA, 20 nt, Human
gcagcagacagacaggggac

SEQ ID NO: 1028395 - RNA, 22 nt, Human
cgcaggugccggcagauggggu

SEQ ID NO: 1028396 - RNA, 22 nt, Human
uggucaggcugcucugcggcgu

SEQ ID NO: 1028397 - RNA, 22 nt, Human
ccagcugcugcaccgugcaugg

SEQ ID NO: 1028398 - RNA, 22 nt, Human
ggugccuaauaauucuauugca

SEQ ID NO: 1028399 - RNA, 23 nt, Human
uggcucugagcuuccugguggcc

SEQ ID NO: 1028400 - RNA, 22 nt, Human
cucugcguggcugggcccaggg

SEQ ID NO: 1028401 - RNA, 22 nt, Human
aaaagagccacuuaugaccuca

SEQ ID NO: 1028402 - RNA, 22 nt, Human
cgggcagugcccagcggggcag

SEQ ID NO: 1028403 - RNA, 22 nt, Human
agugcguggaccccuggcugcu

SEQ ID NO: 1028404 - RNA, 22 nt, Human
gaagcgugcagguccguauacu

SEQ ID NO: 1028405 - RNA, 22 nt, Human
ggcacugggugagggucacugg

SEQ ID NO: 1028406 - RNA, 22 nt, Human
gauacuugaggagaucaccaca

SEQ ID NO: 1028407 - RNA, 23 nt, Human
gguuggcuguacccaggcucccu

SEQ ID NO: 1028408 - RNA, 22 nt, Human
guguuucccuggcacaagaacc

SEQ ID NO: 1028409 - RNA, 21 nt, Human
gcagcaugagaaagccccaaa

SEQ ID NO: 1028410 - RNA, 22 nt, Human
gucccucugccugugguucucu

SEQ ID NO: 1028411 - RNA, 22 nt, Human
ugcaugguuauauacuacuagu

SEQ ID NO: 1028412 - RNA, 22 nt, Human
agggagcugcucugcuuccgug

SEQ ID NO: 1028413 - RNA, 22 nt, Human
acaugaggaacucaggagucac

SEQ ID NO: 1028414 - RNA, 22 nt, Human
uugagacucgagucucucagac

SEQ ID NO: 1028415 - RNA, 19 nt, Human
ggggcccggggucugcgag

SEQ ID NO: 1028416 - RNA, 22 nt, Human
ccucguccacaauccuugcaca

SEQ ID NO: 1028417 - RNA, 22 nt, Human
cuugggcaggggaaacagcugc

SEQ ID NO: 1028418 - RNA, 22 nt, Human
acucaucuuugaauuuucagua

SEQ ID NO: 1028419 - RNA, 22 nt, Human
gagcacucuggcauguaaccuu

SEQ ID NO: 1028420 - RNA, 22 nt, Human
ugcccauggcaggauuucugaa

SEQ ID NO: 1028421 - RNA, 22 nt, Human
gacacugcacuuggggcccaca

SEQ ID NO: 1028422 - RNA, 22 nt, Human
gguuuguggagcuggaaacacu

SEQ ID NO: 1028423 - RNA, 17 nt, Human
ucugcagggggccgugu

SEQ ID NO: 1028424 - RNA, 22 nt, Human
cguggcucugggcuccuuugcc

SEQ ID NO: 1028425 - RNA, 22 nt, Human
ugcagcaccuauggacacuugu

SEQ ID NO: 1028426 - RNA, 20 nt, Human
gcucagggccugggucugga

SEQ ID NO: 1028427 - RNA, 22 nt, Human
gcucuggcuacuguggcuaccg

SEQ ID NO: 1028428 - RNA, 22 nt, Human
gccuucugauugcuggacugac

SEQ ID NO: 1028429 - RNA, 22 nt, Human
cacaguuuugucuugguuucca

SEQ ID NO: 1028430 - RNA, 20 nt, Human
gagcagugagccagggaaag

SEQ ID NO: 1028431 - RNA, 22 nt, Human
ccaggcaaagcccaugcaagag

SEQ ID NO: 1028432 - RNA, 22 nt, Human
gacaguggagccacguugggag

SEQ ID NO: 1028433 - RNA, 22 nt, Human
uggaaacacccacgcaugcaua

SEQ ID NO: 1028434 - RNA, 22 nt, Human
caggcgaccccuaggagcaaca

SEQ ID NO: 1028435 - RNA, 22 nt, Human
gcucguacaccagcguggaggu

SEQ ID NO: 1028436 - RNA, 22 nt, Human
cuguguccaauggccuuagcag

SEQ ID NO: 1028437 - RNA, 22 nt, Human
ucagugcagggugggagagaga

SEQ ID NO: 1028438 - RNA, 22 nt, Human
aggggcagccucacaauccucu

SEQ ID NO: 1028439 - RNA, 22 nt, Human
aagaagguugaaugacuacuuu

SEQ ID NO: 1028440 - RNA, 22 nt, Human
agccacugugugaccagcuguc

SEQ ID NO: 1028441 - RNA, 22 nt, Human
ggccauggcgggagccggcguc

SEQ ID NO: 1028442 - RNA, 22 nt, Human
uggccuugcccagcgccuaggu

SEQ ID NO: 1028443 - RNA, 22 nt, Human
cagaaccaggaacugauggaga

SEQ ID NO: 1028444 - RNA, 22 nt, Human
aggcggcuccgggagugugggc

SEQ ID NO: 1028445 - RNA, 17 nt, Human
uaagggggaaacggagc

SEQ ID NO: 1028446 - RNA, 22 nt, Human
gcagaagcugggcagcgaggug

SEQ ID NO: 1028447 - RNA, 22 nt, Human
gauggcgguggccaccuccuug

SEQ ID NO: 1028448 - RNA, 22 nt, Human
uacugcauuaucaaggggaagg

SEQ ID NO: 1028449 - RNA, 22 nt, Human
gcuucucauguuuauuuuuaca

SEQ ID NO: 1028450 - RNA, 22 nt, Human
gcuggguggaucggaggcucug

SEQ ID NO: 1028451 - RNA, 22 nt, Human
ggcuggccuguguggccgccac

SEQ ID NO: 1028452 - RNA, 22 nt, Human
caggacagaaauaaggaauaua

SEQ ID NO: 1028453 - RNA, 22 nt, Human
ugcuugucacccugccugagug

SEQ ID NO: 1028454 - RNA, 19 nt, Human
uggcagcauugguaccuug

SEQ ID NO: 1028455 - RNA, 22 nt, Human
auguccagaguaaagcacauuc

SEQ ID NO: 1028456 - RNA, 22 nt, Human
cccaccagaccugcaccggcac

SEQ ID NO: 1028457 - RNA, 22 nt, Human
auugucgucaauggacacauag

SEQ ID NO: 1028458 - RNA, 22 nt, Human
accuggaggcagagguugcagu

SEQ ID NO: 1028459 - RNA, 22 nt, Human
ugagaccuuggacuccauccuu

SEQ ID NO: 1028460 - RNA, 22 nt, Human
cugaaagcaaaguaauucuuaa

SEQ ID NO: 1028461 - RNA, 22 nt, Human
guguggucgaaguucucccgga

SEQ ID NO: 1028462 - RNA, 22 nt, Human
ggcagcaggguagccauuucuc

SEQ ID NO: 1028463 - RNA, 18 nt, Human
ggccucagccuggccgga

SEQ ID NO: 1028464 - RNA, 22 nt, Human
cccagguaaggaugcuccucau

SEQ ID NO: 1028465 - RNA, 22 nt, Human
gguguuguacauucuguggauu

SEQ ID NO: 1028466 - RNA, 22 nt, Human
gggaggugauuaggaccaugua

SEQ ID NO: 1028467 - RNA, 22 nt, Human
gugggggcaggcagugcuagga

SEQ ID NO: 1028468 - RNA, 22 nt, Human
ucaugcagaguagaaagggcaa

SEQ ID NO: 1028469 - RNA, 22 nt, Human
uccaagacaagcacauuccugc

SEQ ID NO: 1028470 - RNA, 22 nt, Human
cacggccacugcagcaccccag

SEQ ID NO: 1028471 - RNA, 20 nt, Human
agcuugccccugucuuugcc

SEQ ID NO: 1028472 - RNA, 22 nt, Human
cgcugggcgcgcuccgaacccg

SEQ ID NO: 1028473 - RNA, 22 nt, Human
uccaggaggacugagggggcug

SEQ ID NO: 1028474 - RNA, 22 nt, Human
auggucacuucacccaugagcu

SEQ ID NO: 1028475 - RNA, 22 nt, Human
aggcaguuguugcugagcagcu

SEQ ID NO: 1028476 - RNA, 22 nt, Human
aagcagggugucuugacccaug

SEQ ID NO: 1028477 - RNA, 22 nt, Human
gcuguccugggaacaggcacua

SEQ ID NO: 1028478 - RNA, 22 nt, Human
ucagguccaagauggccaucca

SEQ ID NO: 1028479 - RNA, 22 nt, Human
acagcuucgaggaucucauccc

SEQ ID NO: 1028480 - RNA, 22 nt, Human
agcaauguuggccuauauaccu

SEQ ID NO: 1028481 - RNA, 22 nt, Human
agccagggacgcugcaggcuac

SEQ ID NO: 1028482 - RNA, 22 nt, Human
cgugaugcucaggaggucauag

SEQ ID NO: 1028483 - RNA, 22 nt, Human
gcugcaggcucugcaggaauug

SEQ ID NO: 1028484 - RNA, 22 nt, Human
aguucugggaggugcacgucca

SEQ ID NO: 1028485 - RNA, 22 nt, Human
aggcccugcugaggccucccuc

SEQ ID NO: 1028486 - RNA, 22 nt, Human
ggccaaggcucuugagggcuga

SEQ ID NO: 1028487 - RNA, 22 nt, Human
cccacaggcaggugcaugggcu

SEQ ID NO: 1028488 - RNA, 22 nt, Human
ugggugccaaccucugguggcc

SEQ ID NO: 1028489 - RNA, 22 nt, Human
gcgacgcaggcacgacguguug

SEQ ID NO: 1028490 - RNA, 22 nt, Human
cccauugugguuguugaggaua

SEQ ID NO: 1028491 - RNA, 22 nt, Human
ucguuagccucgagaucuuugu

SEQ ID NO: 1028492 - RNA, 22 nt, Human
gccuucugaucgcuggacugac

SEQ ID NO: 1028493 - RNA, 22 nt, Human
gcagcucucuggccugcccugg

SEQ ID NO: 1028494 - RNA, 22 nt, Human
gcuguggcuccaauggugagcc

SEQ ID NO: 1028495 - RNA, 22 nt, Human
uuacgcagcugcuccaggaagc

SEQ ID NO: 1028496 - RNA, 22 nt, Human
gcuucuggaagcauaugcaaga

SEQ ID NO: 1028497 - RNA, 22 nt, Human
ugcauaaauauuguugggagua

SEQ ID NO: 1028498 - RNA, 23 nt, Human
acagaagccaggagccgcugggc

SEQ ID NO: 1028499 - RNA, 22 nt, Human
uggagcagccuuuucuaagcaa

SEQ ID NO: 1028500 - RNA, 17 nt, Human
aggucugagaguaucug

SEQ ID NO: 1028501 - RNA, 22 nt, Human
cuggcuuugaucagagugaccu

SEQ ID NO: 1028502 - RNA, 22 nt, Human
gccagaggggcucgaaggcgcg

SEQ ID NO: 1028503 - RNA, 22 nt, Human
auugcacaucugcacuacagcc

SEQ ID NO: 1028504 - RNA, 22 nt, Human
ccugguccccaucggcccagcg

SEQ ID NO: 1028505 - RNA, 22 nt, Human
auucuggacaaggcaagcuccu

SEQ ID NO: 1028506 - RNA, 22 nt, Human
gagcagcaucuccggcuuaaag

SEQ ID NO: 1028507 - RNA, 22 nt, Human
caggaaugguuaaucuaaagug

SEQ ID NO: 1028508 - RNA, 22 nt, Human
gagcugcagcggcugacgcaac

SEQ ID NO: 1028509 - RNA, 22 nt, Human
ugcauccuguucuagguuuggg

SEQ ID NO: 1028510 - RNA, 22 nt, Human
cuggagcagcagguggccaggg

SEQ ID NO: 1028511 - RNA, 22 nt, Human
gccacguagaagugccgcgaga

SEQ ID NO: 1028512 - RNA, 22 nt, Human
guccacauaggaacccagcuuc

SEQ ID NO: 1028513 - RNA, 23 nt, Human
gcauccagagcucaguccccuuu

SEQ ID NO: 1028514 - RNA, 22 nt, Human
cuagagaaaaagcuuagguacg

SEQ ID NO: 1028515 - RNA, 22 nt, Human
caaguaugagaaagcuauuacc

SEQ ID NO: 1028516 - RNA, 22 nt, Human
ucauuuacacuucacaaaugga

SEQ ID NO: 1028517 - RNA, 22 nt, Human
cagcuggcgacucuccucgaug

SEQ ID NO: 1028518 - RNA, 22 nt, Human
uggccaggcagguagaacggcc

SEQ ID NO: 1028519 - RNA, 22 nt, Human
aguguugucaaacggcucagca

SEQ ID NO: 1028520 - RNA, 22 nt, Human
gcagcucacagucuccgccauc

SEQ ID NO: 1028521 - RNA, 22 nt, Human
augcacacguacccuacaaggc

SEQ ID NO: 1028522 - RNA, 17 nt, Human
ugggggcccuguguaga

SEQ ID NO: 1028523 - RNA, 22 nt, Human
guucuucagcccucagguccua

SEQ ID NO: 1028524 - RNA, 22 nt, Human
aaggcuuguugucacgcucuug

SEQ ID NO: 1028525 - RNA, 22 nt, Human
caugcuggucagccaguggaug

SEQ ID NO: 1028526 - RNA, 21 nt, Human
caggaacauucuuuacauuua

SEQ ID NO: 1028527 - RNA, 22 nt, Human
augcuacauuuugguuuauaaa

SEQ ID NO: 1028528 - RNA, 22 nt, Human
gcggggggcagcagucgcucag

SEQ ID NO: 1028529 - RNA, 22 nt, Human
ccucugagcuggccuguggggc

SEQ ID NO: 1028530 - RNA, 22 nt, Human
agcagugugggcugcacgcugg

SEQ ID NO: 1028531 - RNA, 22 nt, Human
aucaugcagcaacaagcaaggc

SEQ ID NO: 1028532 - RNA, 22 nt, Human
auggcuguguuguuccucugaa

SEQ ID NO: 1028533 - RNA, 22 nt, Human
aaggcauggcaggguuuacaca

SEQ ID NO: 1028534 - RNA, 19 nt, Human
cucugccucuggcuguggc

SEQ ID NO: 1028535 - RNA, 22 nt, Human
cucuggucaagcaaagagguuu

SEQ ID NO: 1028536 - RNA, 22 nt, Human
ugugugcucgauggcccugcag

SEQ ID NO: 1028537 - RNA, 23 nt, Human
aagugcucaguggacagcauugc

SEQ ID NO: 1028538 - RNA, 22 nt, Human
ugcagcaucuccuugugccaug

SEQ ID NO: 1028539 - RNA, 20 nt, Human
caucaacaccuugucagccu

SEQ ID NO: 1028540 - RNA, 20 nt, Human
cgggacacucaagcucuggg

SEQ ID NO: 1028541 - RNA, 21 nt, Human
ggucaggcaugugcccugagc

SEQ ID NO: 1028542 - RNA, 22 nt, Human
uugaguuuccugacagcgaagg

SEQ ID NO: 1028543 - RNA, 22 nt, Human
gucgaucaccucguccuccgug

SEQ ID NO: 1028544 - RNA, 22 nt, Human
acugauuucagggaugagaaga

SEQ ID NO: 1028545 - RNA, 22 nt, Human
gcccuguguguuugcacugauu

SEQ ID NO: 1028546 - RNA, 22 nt, Human
cagagaauaaaagggcauuccu

SEQ ID NO: 1028547 - RNA, 21 nt, Human
uggcccuggccacggcugcca

SEQ ID NO: 1028548 - RNA, 22 nt, Human
uggcacaguuaaaguuguagaa

SEQ ID NO: 1028549 - RNA, 22 nt, Human
ugcuucucaaaaggagguaggu

SEQ ID NO: 1028550 - RNA, 22 nt, Human
uagcaccggcagugguaggugc

SEQ ID NO: 1028551 - RNA, 22 nt, Human
ccaagcuggacagcagcaagga

SEQ ID NO: 1028552 - RNA, 22 nt, Human
ucuguagcauucaccagcccug

SEQ ID NO: 1028553 - RNA, 22 nt, Human
augugagcuggggcccggccag

SEQ ID NO: 1028554 - RNA, 22 nt, Human
uuucaaguagagggaucgcuag

SEQ ID NO: 1028555 - RNA, 22 nt, Human
cagagcugucauuugccaguga

SEQ ID NO: 1028556 - RNA, 22 nt, Human
gccuggagcucggcugagggcg

SEQ ID NO: 1028557 - RNA, 22 nt, Human
cucgagagauccucuugccacc

SEQ ID NO: 1028558 - RNA, 19 nt, Human
aaugcugcuucuuuuugca

SEQ ID NO: 1028559 - RNA, 22 nt, Human
caggccagcagggccuccgugg

SEQ ID NO: 1028560 - RNA, 22 nt, Human
uuugaagauaaauauggagaaa

SEQ ID NO: 1028561 - RNA, 21 nt, Human
cccuugccugcacuccucggc

SEQ ID NO: 1028562 - RNA, 18 nt, Human
acuguggcucagaguugc

SEQ ID NO: 1028563 - RNA, 22 nt, Human
uugauuugauuguaauggcucu

SEQ ID NO: 1028564 - RNA, 18 nt, Human
gccuggcuucggagccgc

SEQ ID NO: 1028565 - RNA, 22 nt, Human
agcaccaggucgcuggcacgcu

SEQ ID NO: 1028566 - RNA, 22 nt, Human
agcuggugugccaguuccaguu

SEQ ID NO: 1028567 - RNA, 22 nt, Human
cuguggcuaggaagcuguggga

SEQ ID NO: 1028568 - RNA, 22 nt, Human
ccuggccugugaaucugagagc

SEQ ID NO: 1028569 - RNA, 22 nt, Human
ccaagaggggcagagggcugca

SEQ ID NO: 1028570 - RNA, 22 nt, Human
cuccugcagcccucagcagcca

SEQ ID NO: 1028571 - RNA, 22 nt, Human
agucaggaagcuggagcugggg

SEQ ID NO: 1028572 - RNA, 22 nt, Human
cucuccaggcgagguccuacug

SEQ ID NO: 1028573 - RNA, 22 nt, Human
gcagggcagggcaagaacuggg

SEQ ID NO: 1028574 - RNA, 22 nt, Human
cuccagaggcgacuugcaucac

SEQ ID NO: 1028575 - RNA, 22 nt, Human
gcuuuggaaauauagacucaag

SEQ ID NO: 1028576 - RNA, 22 nt, Human
aggaagccuggaguccugccca

SEQ ID NO: 1028577 - RNA, 20 nt, Human
cagagcagugcccaggcggc

SEQ ID NO: 1028578 - RNA, 22 nt, Human
acagcagguuauuguuauggca

SEQ ID NO: 1028579 - RNA, 22 nt, Human
uccugagauaggaguugaaggc

SEQ ID NO: 1028580 - RNA, 22 nt, Human
ggagacucaccccgcauucuag

SEQ ID NO: 1028581 - RNA, 22 nt, Human
agcgggcucacccgguuguugu

SEQ ID NO: 1028582 - RNA, 22 nt, Human
agacuucucuaacuugaggacc

SEQ ID NO: 1028583 - RNA, 22 nt, Human
gagcagcuguucugacuugucu

SEQ ID NO: 1028584 - RNA, 22 nt, Human
ggcugcccucggggucgcaggc

SEQ ID NO: 1028585 - RNA, 18 nt, Human
ucugaaggaaugauucca

SEQ ID NO: 1028586 - RNA, 21 nt, Human
uagaccagcugugcuccucgg

SEQ ID NO: 1028587 - RNA, 22 nt, Human
gcaaaacagucgaugccuccca

SEQ ID NO: 1028588 - RNA, 22 nt, Human
cgaggagugugaaggcuugucg

SEQ ID NO: 1028589 - RNA, 22 nt, Human
cuugucuaguuccuggugaugu

SEQ ID NO: 1028590 - RNA, 22 nt, Human
aagccacugcagcaggagcugc

SEQ ID NO: 1028591 - RNA, 22 nt, Human
caggaugccuuugaacucugga

SEQ ID NO: 1028592 - RNA, 22 nt, Human
cccugcacagccuggcucucuu

SEQ ID NO: 1028593 - RNA, 18 nt, Human
cgcauguacacgucaugc

SEQ ID NO: 1028594 - RNA, 22 nt, Human
agaagugaguugugacuauggg

SEQ ID NO: 1028595 - RNA, 22 nt, Human
ucccacagcuucgugcuucccc

SEQ ID NO: 1028596 - RNA, 22 nt, Human
cugagcugcucccgcugcagcg

SEQ ID NO: 1028597 - RNA, 21 nt, Human
auucugaguugucagucuuca

SEQ ID NO: 1028598 - RNA, 22 nt, Human
ggggucugggcuuagcuggaau

SEQ ID NO: 1028599 - RNA, 22 nt, Human
augaacugcaguauaaacuugg

SEQ ID NO: 1028600 - RNA, 22 nt, Human
uggggucagcaggccuggccug

SEQ ID NO: 1028601 - RNA, 22 nt, Human
agagaugcuguggguagaggca

SEQ ID NO: 1028602 - RNA, 22 nt, Human
uugacccgaguccuucuugggg

SEQ ID NO: 1028603 - RNA, 22 nt, Human
ggagccuggaguuucugauggg

SEQ ID NO: 1028604 - RNA, 22 nt, Human
ccagguaggagagucaacaugu

SEQ ID NO: 1028605 - RNA, 22 nt, Human
gagcugcuggccuccugcggga

SEQ ID NO: 1028606 - RNA, 21 nt, Human
ucuuggggaggagggcugcac

SEQ ID NO: 1028607 - RNA, 22 nt, Human
aagacagugacagucacaauug

SEQ ID NO: 1028608 - RNA, 22 nt, Human
gcaguaucuaugugauggguug

SEQ ID NO: 1028609 - RNA, 22 nt, Human
uugcacgcuugcgguuccugcc

SEQ ID NO: 1028610 - RNA, 22 nt, Human
ggcagccagagggcagcuggau

SEQ ID NO: 1028611 - RNA, 22 nt, Human
agccuugcaugauuucauucau

SEQ ID NO: 1028612 - RNA, 22 nt, Human
uccuuggcagcagggagcauga

SEQ ID NO: 1028613 - RNA, 22 nt, Human
uuccuucuucauuguguuacag

SEQ ID NO: 1028614 - RNA, 23 nt, Human
ugagagccuggcagccuggguuc

SEQ ID NO: 1028615 - RNA, 23 nt, Human
agguggagcugugcagccggggc

SEQ ID NO: 1028616 - RNA, 22 nt, Human
cgggcuccgggucuuugcaguc

SEQ ID NO: 1028617 - RNA, 22 nt, Human
cugggguccuugccauguguca

SEQ ID NO: 1028618 - RNA, 22 nt, Human
gauggugcaggugaagugcugg

SEQ ID NO: 1028619 - RNA, 18 nt, Human
accugauuggcgcagccc

SEQ ID NO: 1028620 - RNA, 22 nt, Human
cccuggcucugccucagagccc

SEQ ID NO: 1028621 - RNA, 18 nt, Human
gaggcacauaguuggggc

SEQ ID NO: 1028622 - RNA, 22 nt, Human
caccugagcaacccugugcggg

SEQ ID NO: 1028623 - RNA, 19 nt, Human
gcuuccagcacugcaggag

SEQ ID NO: 1028624 - RNA, 22 nt, Human
gagcacugagcuggaauuggag

SEQ ID NO: 1028625 - RNA, 22 nt, Human
aaggagcuuucauuacagccuu

SEQ ID NO: 1028626 - RNA, 22 nt, Human
ucugggugucacuccugccugc

SEQ ID NO: 1028627 - RNA, 22 nt, Human
gugcuggggagauaggaagaga

SEQ ID NO: 1028628 - RNA, 22 nt, Human
uuccugagucgccgagucuaug

SEQ ID NO: 1028629 - RNA, 22 nt, Human
cuggcagcucugagucccuucu

SEQ ID NO: 1028630 - RNA, 22 nt, Human
cucagagaagauggaugaggua

SEQ ID NO: 1028631 - RNA, 22 nt, Human
ugaucagcaucuucccagcucg

SEQ ID NO: 1028632 - RNA, 22 nt, Human
gcugggugauucauuuccauaa

SEQ ID NO: 1028633 - RNA, 22 nt, Human
ugggugugagcccgggagccgc

SEQ ID NO: 1028634 - RNA, 22 nt, Human
uuccugcaggccauagagccug

SEQ ID NO: 1028635 - RNA, 22 nt, Human
gguggcagaggugcaucagccc

SEQ ID NO: 1028636 - RNA, 22 nt, Human
aggugcccaugagcuccauggc

SEQ ID NO: 1028637 - RNA, 22 nt, Human
cugccuuggcccuaguucaugg

SEQ ID NO: 1028638 - RNA, 22 nt, Human
aagcucucuguccccuggacug

SEQ ID NO: 1028639 - RNA, 23 nt, Human
uuguucuuggaucuuccugaagc

SEQ ID NO: 1028640 - RNA, 20 nt, Human
agcuggcccccgguggccug

SEQ ID NO: 1028641 - RNA, 22 nt, Human
gcagucauggguagaacucaag

SEQ ID NO: 1028642 - RNA, 22 nt, Human
ucuccuggcauuugguugagua

SEQ ID NO: 1028643 - RNA, 22 nt, Human
ucaccucucuggccgucuaccu

SEQ ID NO: 1028644 - RNA, 22 nt, Human
gcugugcagaggugagaaucca

SEQ ID NO: 1028645 - RNA, 19 nt, Human
ugguggaggccccauguuc

SEQ ID NO: 1028646 - RNA, 22 nt, Human
uugcccacuggcuguuggucag

SEQ ID NO: 1028647 - RNA, 22 nt, Human
uugucgggcuuacgcagggcca

SEQ ID NO: 1028648 - RNA, 22 nt, Human
ggugagagaaaagaaacacugu

SEQ ID NO: 1028649 - RNA, 22 nt, Human
ggucuggccuccgggcaggugg

SEQ ID NO: 1028650 - RNA, 22 nt, Human
gacggggcagccagcugguggc

SEQ ID NO: 1028651 - RNA, 23 nt, Human
uggccucuccccaccuggcagaa

SEQ ID NO: 1028652 - RNA, 22 nt, Human
caugggcucuucuggacugcac

SEQ ID NO: 1028653 - RNA, 22 nt, Human
agacagcgaggacagaggggug

SEQ ID NO: 1028654 - RNA, 21 nt, Human
uuuaaggccagcaggagguga

SEQ ID NO: 1028655 - RNA, 22 nt, Human
cuccaggacaugacuuucuugc

SEQ ID NO: 1028656 - RNA, 22 nt, Human
ugcugcuuguuuuguaaauaaa

SEQ ID NO: 1028657 - RNA, 17 nt, Human
gcaggcacugcugccug

SEQ ID NO: 1028658 - RNA, 22 nt, Human
aggccacaggaguacugucggu

SEQ ID NO: 1028659 - RNA, 22 nt, Human
cagcagcaacaacggaagccuu

SEQ ID NO: 1028660 - RNA, 21 nt, Human
agcgucaauaucgucaacagg

SEQ ID NO: 1028661 - RNA, 22 nt, Human
agggaugcaguaaaaacuguag

SEQ ID NO: 1028662 - RNA, 22 nt, Human
uucuuucugggguccuucggcu

SEQ ID NO: 1028663 - RNA, 22 nt, Human
ugcugcucaagcugcagcaaaa

SEQ ID NO: 1028664 - RNA, 19 nt, Human
agacaaguuuccagaagcc

SEQ ID NO: 1028665 - RNA, 22 nt, Human
uuuccagggaggaauguggggu

SEQ ID NO: 1028666 - RNA, 20 nt, Human
ggaaaaguacuccuccuuaa

SEQ ID NO: 1028667 - RNA, 22 nt, Human
uaagucauagauuaauggccac

SEQ ID NO: 1028668 - RNA, 22 nt, Human
cagcccuguugcgcuuccggcg

SEQ ID NO: 1028669 - RNA, 19 nt, Human
ucuggcugccaaggauuga

SEQ ID NO: 1028670 - RNA, 22 nt, Human
cuucuccgacaaccgacgccgg

SEQ ID NO: 1028671 - RNA, 22 nt, Human
gccaggucgucuccauguccaa

SEQ ID NO: 1028672 - RNA, 22 nt, Human
uggcacugucaccaaugcuguc

SEQ ID NO: 1028673 - RNA, 18 nt, Human
uggcagccagcugcuccu

SEQ ID NO: 1028674 - RNA, 22 nt, Human
cuuguuuucuucugcagucuau

SEQ ID NO: 1028675 - RNA, 22 nt, Human
uuuucaguugugcucucuaguu

SEQ ID NO: 1028676 - RNA, 22 nt, Human
uggcugcccccucccguggaca

SEQ ID NO: 1028677 - RNA, 22 nt, Human
gcugccaauccagcugugggag

SEQ ID NO: 1028678 - RNA, 22 nt, Human
cccccagcucugcugggucccg

SEQ ID NO: 1028679 - RNA, 22 nt, Human
gucugcugacagagcauggacc

SEQ ID NO: 1028680 - RNA, 22 nt, Human
agaugcugcuccacaggccagg

SEQ ID NO: 1028681 - RNA, 22 nt, Human
augaagcugguuuuggcuuggg

SEQ ID NO: 1028682 - RNA, 22 nt, Human
ugggcaaggcuggagccugcag

SEQ ID NO: 1028683 - RNA, 22 nt, Human
ucuucaugucaugguauauuga

SEQ ID NO: 1028684 - RNA, 22 nt, Human
gaggcagagacuccaccuucag

SEQ ID NO: 1028685 - RNA, 22 nt, Human
uucacguuguugaagaaaauac

SEQ ID NO: 1028686 - RNA, 22 nt, Human
ccgaggcuggccucagggcugu

SEQ ID NO: 1028687 - RNA, 22 nt, Human
gugcugcagagucucgugccgc

SEQ ID NO: 1028688 - RNA, 22 nt, Human
cagcagcaggcgcacggccguc

SEQ ID NO: 1028689 - RNA, 22 nt, Human
agccacagucuguagccagcuu

SEQ ID NO: 1028690 - RNA, 22 nt, Human
ucggagcuguagaugaaacccu

SEQ ID NO: 1028691 - RNA, 22 nt, Human
aagccagguguuuaggccagcg

SEQ ID NO: 1028692 - RNA, 22 nt, Human
gagcuuggugcugccuguuguc

SEQ ID NO: 1028693 - RNA, 22 nt, Human
cccaggaacagcacagaacagc

SEQ ID NO: 1028694 - RNA, 22 nt, Human
agacagcacuuuuguauggggg

SEQ ID NO: 1028695 - RNA, 22 nt, Human
agcugcugcaaguggugcuaac

SEQ ID NO: 1028696 - RNA, 22 nt, Human
agcccugugugcuuguguuccu

SEQ ID NO: 1028697 - RNA, 22 nt, Human
ggggaagaaauagaacauuuug

SEQ ID NO: 1028698 - RNA, 21 nt, Human
uuggaacaagcagcaguuugc

SEQ ID NO: 1028699 - RNA, 21 nt, Human
uccagcacagaugaccucccc

SEQ ID NO: 1028700 - RNA, 22 nt, Human
caaaauuguugaugcugcuuug

SEQ ID NO: 1028701 - RNA, 22 nt, Human
agucagcuugucucuaggguug

SEQ ID NO: 1028702 - RNA, 22 nt, Human
ccauggccugaaggagugcauc

SEQ ID NO: 1028703 - RNA, 22 nt, Human
gccacaggaaagcacccuggag

SEQ ID NO: 1028704 - RNA, 22 nt, Human
uuaaguccuugguaauuuucuu

SEQ ID NO: 1028705 - RNA, 22 nt, Human
augacagcucuagcacacagua

SEQ ID NO: 1028706 - RNA, 22 nt, Human
gccccagcguggcuguguuagg

SEQ ID NO: 1028707 - RNA, 22 nt, Human
ccauggccaggaaagccaaggu

SEQ ID NO: 1028708 - RNA, 22 nt, Human
cagugcaacguugugcauucaa

SEQ ID NO: 1028709 - RNA, 22 nt, Human
guagagcagggagcaggaagcu

SEQ ID NO: 1028710 - RNA, 22 nt, Human
agggcccuagggaaugagacau

SEQ ID NO: 1028711 - RNA, 22 nt, Human
auuguugacuugauuacucaac

SEQ ID NO: 1028712 - RNA, 22 nt, Human
ucagucucuggggcuucuguuu

SEQ ID NO: 1028713 - RNA, 22 nt, Human
agguccugucuuaucucuguaa

SEQ ID NO: 1028714 - RNA, 22 nt, Human
aggcucaguauagcuggcaagu

SEQ ID NO: 1028715 - RNA, 22 nt, Human
gcggccuuguggcggagcaggc

SEQ ID NO: 1028716 - RNA, 22 nt, Human
aggagccgggccugggcccugc

SEQ ID NO: 1028717 - RNA, 23 nt, Human
gggugcugccuguagucaugcug

SEQ ID NO: 1028718 - RNA, 22 nt, Human
cagagggagcccuccaggagca

SEQ ID NO: 1028719 - RNA, 22 nt, Human
gcugcagggagcuggaaggcuc

SEQ ID NO: 1028720 - RNA, 22 nt, Human
gcagcugcgcugguguggggca

SEQ ID NO: 1028721 - RNA, 22 nt, Human
ggcggcgcguagccggagacuu

SEQ ID NO: 1028722 - RNA, 22 nt, Human
aggcgaagggaccagacgguag

SEQ ID NO: 1028723 - RNA, 22 nt, Human
gauuuucauuauagcuaguuuc

SEQ ID NO: 1028724 - RNA, 22 nt, Human
uccuuggcaugccgucuucucc

SEQ ID NO: 1028725 - RNA, 22 nt, Human
gcacugccugugagcccugguu

SEQ ID NO: 1028726 - RNA, 22 nt, Human
ugccuggcugggcugcucaugg

SEQ ID NO: 1028727 - RNA, 22 nt, Human
ggacuggucugagagggauuca

SEQ ID NO: 1028728 - RNA, 22 nt, Human
uuugaacuucuaccugucauau

SEQ ID NO: 1028729 - RNA, 22 nt, Human
cuggcacaggauccgagaccuu

SEQ ID NO: 1028730 - RNA, 22 nt, Human
uucuccucagcaaggcagcuuu

SEQ ID NO: 1028731 - RNA, 23 nt, Human
ggaggcacuuaggcagagcagag

SEQ ID NO: 1028732 - RNA, 18 nt, Human
cagaaaguuauuuacucu

SEQ ID NO: 1028733 - RNA, 18 nt, Human
uccaggcuccaggcuaac

SEQ ID NO: 1028734 - RNA, 22 nt, Human
cacucacccgguccuucccagu

SEQ ID NO: 1028735 - RNA, 22 nt, Human
aagcagaaaaacugagcuccaa

SEQ ID NO: 1028736 - RNA, 22 nt, Human
gagcuaggauaucaugagggua

SEQ ID NO: 1028737 - RNA, 22 nt, Human
aggcugagccugggcguggugg

SEQ ID NO: 1028738 - RNA, 22 nt, Human
gagcaaggaugggucuauagua

SEQ ID NO: 1028739 - RNA, 22 nt, Human
ccagcuugcuccucugcaaugg

SEQ ID NO: 1028740 - RNA, 21 nt, Human
uaagaacauuaucuucuuccu

SEQ ID NO: 1028741 - RNA, 18 nt, Human
ucagggaaucuuggccuu

SEQ ID NO: 1028742 - RNA, 22 nt, Human
cuguccauggcaaugaugcaga

SEQ ID NO: 1028743 - RNA, 22 nt, Human
ucagguagugguuaaguucugu

SEQ ID NO: 1028744 - RNA, 22 nt, Human
aggcuaggccuugcccuggaac

SEQ ID NO: 1028745 - RNA, 22 nt, Human
guguuuggucagacguccgggg

SEQ ID NO: 1028746 - RNA, 22 nt, Human
uuucgagggauuagcuaggacu

SEQ ID NO: 1028747 - RNA, 22 nt, Human
uugaacaguuuugucagguuca

SEQ ID NO: 1028748 - RNA, 22 nt, Human
ggacucucaggcugucggcuuc

SEQ ID NO: 1028749 - RNA, 22 nt, Human
gcagaggggaagcugaggaauu

SEQ ID NO: 1028750 - RNA, 22 nt, Human
augcaguggcagcuccuggugu

SEQ ID NO: 1028751 - RNA, 22 nt, Human
ucccaggauguuuauggcuggu

SEQ ID NO: 1028752 - RNA, 22 nt, Human
ucucaggcuuccuggugcugug

SEQ ID NO: 1028753 - RNA, 22 nt, Human
ugcuagguaagaagggggcucc

SEQ ID NO: 1028754 - RNA, 22 nt, Human
cuggccagccucccagguaccc

SEQ ID NO: 1028755 - RNA, 22 nt, Human
uccagcaguccaugugagacac

SEQ ID NO: 1028756 - RNA, 22 nt, Human
uggguccuggaaggcgacaggu

SEQ ID NO: 1028757 - RNA, 22 nt, Human
aggcagccuauggggagcucag

SEQ ID NO: 1028758 - RNA, 22 nt, Human
aucagagcuaguacuugcaggu

SEQ ID NO: 1028759 - RNA, 22 nt, Human
gagggcucaacuacuacuaggc

SEQ ID NO: 1028760 - RNA, 22 nt, Human
ccagguggacggcgaguacagg

SEQ ID NO: 1028761 - RNA, 22 nt, Human
agaggagguccuuuucugaugu

SEQ ID NO: 1028762 - RNA, 22 nt, Human
cagggaugggauggagucaguu

SEQ ID NO: 1028763 - RNA, 22 nt, Human
aggcugucucaccucaggaggg

SEQ ID NO: 1028764 - RNA, 22 nt, Human
uuguuuguaaggcucuuagaau

SEQ ID NO: 1028765 - RNA, 22 nt, Human
uagaucuuucacuacuguguag

SEQ ID NO: 1028766 - RNA, 22 nt, Human
gccagcuggcugcaggucccag

SEQ ID NO: 1028767 - RNA, 22 nt, Human
ugugcccuccugccaggggcug

SEQ ID NO: 1028768 - RNA, 22 nt, Human
uuccaggacuggguguuugaag

SEQ ID NO: 1028769 - RNA, 22 nt, Human
uccaggcugacgcagcuauuua

SEQ ID NO: 1028770 - RNA, 19 nt, Human
augagcuggcauuucaggu

SEQ ID NO: 1028771 - RNA, 22 nt, Human
ggcagguguuuuuauauuaaag

SEQ ID NO: 1028772 - RNA, 22 nt, Human
uacagugcuugguaucuaguaa

SEQ ID NO: 1028773 - RNA, 22 nt, Human
ccuggaaaaugccacuuucaca

SEQ ID NO: 1028774 - RNA, 22 nt, Human
uuucccaggcuggaaugcagug

SEQ ID NO: 1028775 - RNA, 22 nt, Human
uuucucagccuccuugcuggag

SEQ ID NO: 1028776 - RNA, 22 nt, Human
uccuggcaaagauguugguguu

SEQ ID NO: 1028777 - RNA, 22 nt, Human
gugacagguauacucaccauug

SEQ ID NO: 1028778 - RNA, 22 nt, Human
gucagcaggguccccuugagug

SEQ ID NO: 1028779 - RNA, 22 nt, Human
ucaggggacagccagcuggagg

SEQ ID NO: 1028780 - RNA, 22 nt, Human
gcuggccugcgagggcaggcug

SEQ ID NO: 1028781 - RNA, 22 nt, Human
ugcgggucccagggucacaggc

SEQ ID NO: 1028782 - RNA, 22 nt, Human
uuccuuggaaagagacgucgcu

SEQ ID NO: 1028783 - RNA, 22 nt, Human
gccuuugcugugacaaugcugg

SEQ ID NO: 1028784 - RNA, 22 nt, Human
agagaccuuccugacuccagag

SEQ ID NO: 1028785 - RNA, 22 nt, Human
aggagccauugcaggauggcag

SEQ ID NO: 1028786 - RNA, 23 nt, Human
augcuagcugugccaacaccaua

SEQ ID NO: 1028787 - RNA, 22 nt, Human
agccccaguccgcugcgggcgg

SEQ ID NO: 1028788 - RNA, 22 nt, Human
cuggagcuggcccaggcuggcc

SEQ ID NO: 1028789 - RNA, 22 nt, Human
aggcuuuugcucuggcuccucu

SEQ ID NO: 1028790 - RNA, 22 nt, Human
cccaggaguuagagguuguggu

SEQ ID NO: 1028791 - RNA, 22 nt, Human
accuccuccaaggagccauagg

SEQ ID NO: 1028792 - RNA, 22 nt, Human
ugcccguggccuggggcagcuu

SEQ ID NO: 1028793 - RNA, 22 nt, Human
gggcccuggacguggcggcaga

SEQ ID NO: 1028794 - RNA, 22 nt, Human
cgaggaggaaacgcggagaacu

SEQ ID NO: 1028795 - RNA, 22 nt, Human
ucagauggaaugaugccacugc

SEQ ID NO: 1028796 - RNA, 22 nt, Human
uggagcugguucuggggaagcu

SEQ ID NO: 1028797 - RNA, 22 nt, Human
ugagaugaagugauguaaaaca

SEQ ID NO: 1028798 - RNA, 22 nt, Human
ggcucacgcaauuaucccggcc

SEQ ID NO: 1028799 - RNA, 22 nt, Human
cucuggagggaggcugagcugg

SEQ ID NO: 1028800 - RNA, 22 nt, Human
ggcuagggagacagagggcaug

SEQ ID NO: 1028801 - RNA, 22 nt, Human
acaggaucgcccuguugcccag

SEQ ID NO: 1028802 - RNA, 22 nt, Human
caaacugaacacgaaagucuuu

SEQ ID NO: 1028803 - RNA, 22 nt, Human
gggagacaaaggugagguucuu

SEQ ID NO: 1028804 - RNA, 22 nt, Human
acugcauucuuuaucccacaac

SEQ ID NO: 1028805 - RNA, 19 nt, Human
cacuguccuagucgaggcc

SEQ ID NO: 1028806 - RNA, 22 nt, Human
ccagcaugcucagucuaaauug

SEQ ID NO: 1028807 - RNA, 22 nt, Human
uaaagacaauuucgagcuguag

SEQ ID NO: 1028808 - RNA, 22 nt, Human
gcugcccucuguguuuguccuu

SEQ ID NO: 1028809 - RNA, 22 nt, Human
caggccgggcacugcgcuaggu

SEQ ID NO: 1028810 - RNA, 22 nt, Human
ccagucagccaagcugcagcgg

SEQ ID NO: 1028811 - RNA, 22 nt, Human
uguggccaccagagcugcuauu

SEQ ID NO: 1028812 - RNA, 19 nt, Human
cuucuggauccgcagggcc

SEQ ID NO: 1028813 - RNA, 22 nt, Human
ugcagguggcagcggggcacca

SEQ ID NO: 1028814 - RNA, 22 nt, Human
ucauccugaagaaccugcuucc

SEQ ID NO: 1028815 - RNA, 22 nt, Human
ucauuccuccagcgggagucca

SEQ ID NO: 1028816 - RNA, 22 nt, Human
gugccaccagaugcuguugcua

SEQ ID NO: 1028817 - RNA, 22 nt, Human
aggcugagguaggaggaucgcu

SEQ ID NO: 1028818 - RNA, 22 nt, Human
caguggccucuggcuuugcugu

SEQ ID NO: 1028819 - RNA, 18 nt, Human
gugacugccccaaaaggc

SEQ ID NO: 1028820 - RNA, 22 nt, Human
ccucauucucgcguguguuucu

SEQ ID NO: 1028821 - RNA, 22 nt, Human
uccugccaccggggguggcgau

SEQ ID NO: 1028822 - RNA, 22 nt, Human
auuuccuggaggaauggaagca

SEQ ID NO: 1028823 - RNA, 22 nt, Human
ccaguucuuucugugugcaaca

SEQ ID NO: 1028824 - RNA, 22 nt, Human
gcccuguuuucuggguuccuug

SEQ ID NO: 1028825 - RNA, 22 nt, Human
gcucagugaagggugccaagua

SEQ ID NO: 1028826 - RNA, 22 nt, Human
gacagucccccagcagcaaacc

SEQ ID NO: 1028827 - RNA, 22 nt, Human
agauaaaguccaaacuguguag

SEQ ID NO: 1028828 - RNA, 22 nt, Human
ggcuggacuugguccuguuuug

SEQ ID NO: 1028829 - RNA, 22 nt, Human
cuggagggcugcagcgaggcug

SEQ ID NO: 1028830 - RNA, 22 nt, Human
accaggcccuccagcugcgugg

SEQ ID NO: 1028831 - RNA, 22 nt, Human
aggaaagcucccaguagggcuc

SEQ ID NO: 1028832 - RNA, 22 nt, Human
cauggaaggcaaaagacacaga

SEQ ID NO: 1028833 - RNA, 22 nt, Human
acagugucuccugguacccagu

SEQ ID NO: 1028834 - RNA, 22 nt, Human
uaggcacugggcuaggacaggu

SEQ ID NO: 1028835 - RNA, 22 nt, Human
cagagcagaaaccugggugauu

SEQ ID NO: 1028836 - RNA, 22 nt, Human
ugcugcacuuauggcucugagg

SEQ ID NO: 1028837 - RNA, 22 nt, Human
gucuugcacuuaccuaagaacu

SEQ ID NO: 1028838 - RNA, 22 nt, Human
uuugccaguauuuuauugauga

SEQ ID NO: 1028839 - RNA, 22 nt, Human
aggcaguguguagcuggaagag

SEQ ID NO: 1028840 - RNA, 22 nt, Human
ugcauuucccauuguguggcuc

SEQ ID NO: 1028841 - RNA, 22 nt, Human
cucuguccugguuuauacuggc

SEQ ID NO: 1028842 - RNA, 22 nt, Human
ggacugucuccuugcugguagg

SEQ ID NO: 1028843 - RNA, 22 nt, Human
agaauaaccaguguuucacagu

SEQ ID NO: 1028844 - RNA, 22 nt, Human
agccaccaccacugaaagguua

SEQ ID NO: 1028845 - RNA, 22 nt, Human
gaagcgcggcgucggcgugggu

SEQ ID NO: 1028846 - RNA, 22 nt, Human
gaugugugugcccugggccugc

SEQ ID NO: 1028847 - RNA, 22 nt, Human
aaagcugcaagcuccugaggaa

SEQ ID NO: 1028848 - RNA, 22 nt, Human
uugcuggaagguggcuggaauc

SEQ ID NO: 1028849 - RNA, 22 nt, Human
agcagcaggugaccucgaugcc

SEQ ID NO: 1028850 - RNA, 22 nt, Human
ggaagcuguuaucaucuguauc

SEQ ID NO: 1028851 - RNA, 22 nt, Human
uugagcugccuggcuguggcuc

SEQ ID NO: 1028852 - RNA, 22 nt, Human
aauccagguggcggagguugug

SEQ ID NO: 1028853 - RNA, 22 nt, Human
gcacuuguuuuauguuccugag

SEQ ID NO: 1028854 - RNA, 22 nt, Human
gagcuccuauggucgguggcuc

SEQ ID NO: 1028855 - RNA, 22 nt, Human
uacagcgaaaauuuagcuugau

SEQ ID NO: 1028856 - RNA, 22 nt, Human
ccuugcagcauauagagucccu

SEQ ID NO: 1028857 - RNA, 22 nt, Human
acuggauucucuuacacagaug

SEQ ID NO: 1028858 - RNA, 22 nt, Human
ccagcaggagacuagcaacaua

SEQ ID NO: 1028859 - RNA, 22 nt, Human
gccugcacucaaacacucucuu

SEQ ID NO: 1028860 - RNA, 22 nt, Human
gccaugaacucgggcauggaga

SEQ ID NO: 1028861 - RNA, 18 nt, Human
uagcucuuguugguccau

SEQ ID NO: 1028862 - RNA, 22 nt, Human
cuugcuacuaugccuggcuaau

SEQ ID NO: 1028863 - RNA, 22 nt, Human
gcagagauccaggguauagguu

SEQ ID NO: 1028864 - RNA, 22 nt, Human
gcauucuugguggagugcuaaa

SEQ ID NO: 1028865 - RNA, 22 nt, Human
gcccagcugcacccuggugggu

SEQ ID NO: 1028866 - RNA, 22 nt, Human
gcacugguuuauuuaagaacaa

SEQ ID NO: 1028867 - RNA, 22 nt, Human
augcccugggagugcuguacca

SEQ ID NO: 1028868 - RNA, 22 nt, Human
ugggcacagugaguugccuuua

SEQ ID NO: 1028869 - RNA, 22 nt, Human
agccccaggcccggacgccucu

SEQ ID NO: 1028870 - RNA, 22 nt, Human
caggggcggguaaaaggccucc

SEQ ID NO: 1028871 - RNA, 22 nt, Human
acugccaguuguuuuguccagu

SEQ ID NO: 1028872 - RNA, 22 nt, Human
gcucaugggcccagagcagccc

SEQ ID NO: 1028873 - RNA, 22 nt, Human
gacggagcugguugcugcggcu

SEQ ID NO: 1028874 - RNA, 22 nt, Human
ggccgggcuguggagaaggggu

SEQ ID NO: 1028875 - RNA, 22 nt, Human
uuggcagugacugcgggccccg

SEQ ID NO: 1028876 - RNA, 22 nt, Human
gagugugucggucagcguggcg

SEQ ID NO: 1028877 - RNA, 22 nt, Human
ucguggaugcgcagggcggccu

SEQ ID NO: 1028878 - RNA, 22 nt, Human
aagcagcacagcaaugacucua

SEQ ID NO: 1028879 - RNA, 22 nt, Human
uccaaggucagcgagagucacu

SEQ ID NO: 1028880 - RNA, 19 nt, Human
ggcugccuucugcucaucu

SEQ ID NO: 1028881 - RNA, 22 nt, Human
agggugcccaccgcuucugccc

SEQ ID NO: 1028882 - RNA, 22 nt, Human
gaggucaggggagaggcugaug

SEQ ID NO: 1028883 - RNA, 22 nt, Human
cugccguugugaagcucuuaga

SEQ ID NO: 1028884 - RNA, 22 nt, Human
cgggaagguggagguugcagug

SEQ ID NO: 1028885 - RNA, 22 nt, Human
cucaugucggcaggacucgccc

SEQ ID NO: 1028886 - RNA, 22 nt, Human
ucccagugggaagcagcacgcu

SEQ ID NO: 1028887 - RNA, 22 nt, Human
uguucugcaaugcugccuccuu

SEQ ID NO: 1028888 - RNA, 22 nt, Human
cggucaggugcagcguuggcac

SEQ ID NO: 1028889 - RNA, 22 nt, Human
agccuggacagcuacggagaac

SEQ ID NO: 1028890 - RNA, 22 nt, Human
ccaccgaaacgucugcggaucc

SEQ ID NO: 1028891 - RNA, 18 nt, Human
augggcagguaagaucca

SEQ ID NO: 1028892 - RNA, 22 nt, Human
cucagcaacccacacacggucu

SEQ ID NO: 1028893 - RNA, 22 nt, Human
ggcuggcuggcuuagcagagga

SEQ ID NO: 1028894 - RNA, 22 nt, Human
uuccaggcgcacgucggccuua

SEQ ID NO: 1028895 - RNA, 22 nt, Human
agcgcuugccgcacuccaagca

SEQ ID NO: 1028896 - RNA, 22 nt, Human
cuccagcucgcgagcucugcuc

SEQ ID NO: 1028897 - RNA, 22 nt, Human
aggcucgcaugcccugcaccac

SEQ ID NO: 1028898 - RNA, 22 nt, Human
agcucugcuucuugggaagaug

SEQ ID NO: 1028899 - RNA, 22 nt, Human
cugggcuuucaggcccuaaggc

SEQ ID NO: 1028900 - RNA, 22 nt, Human
aaggggggcaccugcaugcccg

SEQ ID NO: 1028901 - RNA, 22 nt, Human
gcggcccggguccccagcagca

SEQ ID NO: 1028902 - RNA, 21 nt, Human
gcaaccagaccacagggcagu

SEQ ID NO: 1028903 - RNA, 22 nt, Human
ugggaagauaugagugaccaac

SEQ ID NO: 1028904 - RNA, 22 nt, Human
cuggccgcaguguggaguugug

SEQ ID NO: 1028905 - RNA, 22 nt, Human
agugucugcgggcagaggagcg

SEQ ID NO: 1028906 - RNA, 22 nt, Human
auuugugggacuauaaugcagg

SEQ ID NO: 1028907 - RNA, 22 nt, Human
cucgccccggcacaguguccgu

SEQ ID NO: 1028908 - RNA, 21 nt, Human
gccaucaccaagcucuucccc

SEQ ID NO: 1028909 - RNA, 22 nt, Human
agcagugccgcaucuugugacc

SEQ ID NO: 1028910 - RNA, 22 nt, Human
gugugcgccgacacagccaggu

SEQ ID NO: 1028911 - RNA, 22 nt, Human
ugugagacguaggccaucgagg

SEQ ID NO: 1028912 - RNA, 22 nt, Human
uggugcugccaccuccucugcu

SEQ ID NO: 1028913 - RNA, 22 nt, Human
uccguuuucacacugcuauaaa

SEQ ID NO: 1028914 - RNA, 22 nt, Human
caggguggcaggcaccauggcc

SEQ ID NO: 1028915 - RNA, 22 nt, Human
agcccugaccuguccuguucug

SEQ ID NO: 1028916 - RNA, 22 nt, Human
aagugcaggucucagcuacucu

SEQ ID NO: 1028917 - RNA, 21 nt, Human
ugcuccaggagggggcagucc

SEQ ID NO: 1028918 - RNA, 21 nt, Human
cuagaaagaauguugucgucu

SEQ ID NO: 1028919 - RNA, 22 nt, Human
ucgcagcacuagcccugcauug

SEQ ID NO: 1028920 - RNA, 22 nt, Human
uccagcucugcugugcgccggu

SEQ ID NO: 1028921 - RNA, 22 nt, Human
ucugcuguuuacugugugauau

SEQ ID NO: 1028922 - RNA, 22 nt, Human
gaccuccguguacaccucccag

SEQ ID NO: 1028923 - RNA, 22 nt, Human
ugaaagaagccucccuuuggag

SEQ ID NO: 1028924 - RNA, 22 nt, Human
cacaggaagcaagccuggggcc

SEQ ID NO: 1028925 - RNA, 22 nt, Human
gccagugccugcugcucagggc

SEQ ID NO: 1028926 - RNA, 22 nt, Human
ugcuugcugaaaggcauuuaga

SEQ ID NO: 1028927 - RNA, 22 nt, Human
uuuacagcuacuguccuauuuc

SEQ ID NO: 1028928 - RNA, 22 nt, Human
uggaaggggccaggcgcggagu

SEQ ID NO: 1028929 - RNA, 22 nt, Human
aagcuuccugcaugggacugcu

SEQ ID NO: 1028930 - RNA, 22 nt, Human
acagggcaccugagguaggaag

SEQ ID NO: 1028931 - RNA, 18 nt, Human
cgauguguaugugauuug

SEQ ID NO: 1028932 - RNA, 21 nt, Human
uccugccuuaguccagagcag

SEQ ID NO: 1028933 - RNA, 22 nt, Human
ucucugucucccguguguccgg

SEQ ID NO: 1028934 - RNA, 22 nt, Human
ccccaacccugguuccguggcg

SEQ ID NO: 1028935 - RNA, 22 nt, Human
uggcagaaugaagacuggggcc

SEQ ID NO: 1028936 - RNA, 18 nt, Human
augcucuagucuuuccug

SEQ ID NO: 1028937 - RNA, 19 nt, Human
ccugcugaagugaugcagc

SEQ ID NO: 1028938 - RNA, 21 nt, Human
agggccagaucaccaaggagc

SEQ ID NO: 1028939 - RNA, 22 nt, Human
gcccagcaccucucucaggguu

SEQ ID NO: 1028940 - RNA, 22 nt, Human
cugcucaauuccggcacgcugg

SEQ ID NO: 1028941 - RNA, 22 nt, Human
cagcuugcacacauauuagacg

SEQ ID NO: 1028942 - RNA, 22 nt, Human
gagcuguguaugcaucauucug

SEQ ID NO: 1028943 - RNA, 22 nt, Human
cugagcugguucucuugugaaa

SEQ ID NO: 1028944 - RNA, 22 nt, Human
uagcaggaggcaguuccucgcu

SEQ ID NO: 1028945 - RNA, 22 nt, Human
caggaacagcaccaggagcuag

SEQ ID NO: 1028946 - RNA, 21 nt, Human
uggcaggcagcuggaagcuug

SEQ ID NO: 1028947 - RNA, 22 nt, Human
uccaagaagcuuacaaucuaau

SEQ ID NO: 1028948 - RNA, 22 nt, Human
uucaguuuugcuuuuaaucaug

SEQ ID NO: 1028949 - RNA, 22 nt, Human
ugcccuccacaguggcuccacc

SEQ ID NO: 1028950 - RNA, 22 nt, Human
ccaggagcccugccacaauggu

SEQ ID NO: 1028951 - RNA, 19 nt, Human
ugcagcuguaugagcuuaa

SEQ ID NO: 1028952 - RNA, 22 nt, Human
uuccuuucucuggacugcagcc

SEQ ID NO: 1028953 - RNA, 22 nt, Human
augcuugcccauguuucugaag

SEQ ID NO: 1028954 - RNA, 22 nt, Human
uagcaggagagaaguuuuaagu

SEQ ID NO: 1028955 - RNA, 22 nt, Human
cugagaguauuggcaggcuugg

SEQ ID NO: 1028956 - RNA, 22 nt, Human
gcugcucucucccuaaguuggg

SEQ ID NO: 1028957 - RNA, 22 nt, Human
acuagugcacauuguuucucaa

SEQ ID NO: 1028958 - RNA, 22 nt, Human
agcugucuaccugcagaguccu

SEQ ID NO: 1028959 - RNA, 22 nt, Human
gccaccagccccaugcgcugug

SEQ ID NO: 1028960 - RNA, 22 nt, Human
gugcugucguggaacugggcug

SEQ ID NO: 1028961 - RNA, 22 nt, Human
augcugagugagugaaacccag

SEQ ID NO: 1028962 - RNA, 22 nt, Human
ccagcagcgauagggugagugc

SEQ ID NO: 1028963 - RNA, 22 nt, Human
gcggggccauguccaacggccu

SEQ ID NO: 1028964 - RNA, 22 nt, Human
ucuuuuaucuguuguguaacaa

SEQ ID NO: 1028965 - RNA, 22 nt, Human
gccucugcaccaguacugugcc

SEQ ID NO: 1028966 - RNA, 22 nt, Human
uguccagcugaaggcagccuca

SEQ ID NO: 1028967 - RNA, 16 nt, Human
guagccguggccgcug

SEQ ID NO: 1028968 - RNA, 22 nt, Human
uccuccuuuccccgcuggagcc

SEQ ID NO: 1028969 - RNA, 22 nt, Human
uucagcacuggacagcgagucu

SEQ ID NO: 1028970 - RNA, 22 nt, Human
uuaagugcuucaagggaagcuc

SEQ ID NO: 1028971 - RNA, 22 nt, Human
cuucacugcagucauggcucug

SEQ ID NO: 1028972 - RNA, 20 nt, Human
uccugggguaagccaugguc

SEQ ID NO: 1028973 - RNA, 21 nt, Human
uaggugggagccccaguaugc

SEQ ID NO: 1028974 - RNA, 18 nt, Human
auuugcaggcaugcaggc

SEQ ID NO: 1028975 - RNA, 22 nt, Human
ccuuugugaauaugcagaaaau

SEQ ID NO: 1028976 - RNA, 22 nt, Human
caagcuuguuucuccugggggu

SEQ ID NO: 1028977 - RNA, 22 nt, Human
guucaguuauuucugaagauau

SEQ ID NO: 1028978 - RNA, 22 nt, Human
uccuggcccuguggccugcagu

SEQ ID NO: 1028979 - RNA, 17 nt, Human
ugcaugcgucugugaua

SEQ ID NO: 1028980 - RNA, 22 nt, Human
cucguugcugaagccaaaguca

SEQ ID NO: 1028981 - RNA, 22 nt, Human
ucggagcgucacuggcuggagg

SEQ ID NO: 1028982 - RNA, 22 nt, Human
auggaguucugccagcgcugcu

SEQ ID NO: 1028983 - RNA, 22 nt, Human
acacggcacuuuaggaaggggc

SEQ ID NO: 1028984 - RNA, 22 nt, Human
ggagcugugcugggugaucagg

SEQ ID NO: 1028985 - RNA, 22 nt, Human
agcugggcuggagcuccaagcg

SEQ ID NO: 1028986 - RNA, 22 nt, Human
gcggggggcaggcaguacguug

SEQ ID NO: 1028987 - RNA, 22 nt, Human
cagagccacugucugccaggca

SEQ ID NO: 1028988 - RNA, 21 nt, Human
uccaggagcacgggacuagga

SEQ ID NO: 1028989 - RNA, 22 nt, Human
gcugcuggcuuccugcuguuuu

SEQ ID NO: 1028990 - RNA, 22 nt, Human
uuccugguaacaaucucaaagu

SEQ ID NO: 1028991 - RNA, 22 nt, Human
aacacugagaggggaguggcac

SEQ ID NO: 1028992 - RNA, 22 nt, Human
cugagcagucuagccagguguu

SEQ ID NO: 1028993 - RNA, 22 nt, Human
gcucguugaaccuguccccgag

SEQ ID NO: 1028994 - RNA, 22 nt, Human
ggagcagggaauuacagcgcag

SEQ ID NO: 1028995 - RNA, 22 nt, Human
gcagagcugucuaagucacuuc

SEQ ID NO: 1028996 - RNA, 22 nt, Human
ugcuugucucucugugcccacu

SEQ ID NO: 1028997 - RNA, 22 nt, Human
agcccucucccuuucuucuuag

SEQ ID NO: 1028998 - RNA, 18 nt, Human
gccagcccuccaaccucc

SEQ ID NO: 1028999 - RNA, 18 nt, Human
cugccuguugcugagagg

SEQ ID NO: 1029000 - RNA, 22 nt, Human
ggccgcggauuuucccgcuggc

SEQ ID NO: 1029001 - RNA, 19 nt, Human
cucugccauuugcugccug

SEQ ID NO: 1029002 - RNA, 22 nt, Human
gccaggaccucagaugcagggc

SEQ ID NO: 1029003 - RNA, 22 nt, Human
gcgcugccucugcucuccccac

SEQ ID NO: 1029004 - RNA, 22 nt, Human
ucacacuuuauuuauuucaugc

SEQ ID NO: 1029005 - RNA, 22 nt, Human
cugagccagcgggcucacuuuu

SEQ ID NO: 1029006 - RNA, 23 nt, Human
gggcagcuuaagcuuguuuuucu

SEQ ID NO: 1029007 - RNA, 22 nt, Human
uccuucaaucacccagugggga

SEQ ID NO: 1029008 - RNA, 22 nt, Human
cugaccaguccuuagcaccugg

SEQ ID NO: 1029009 - RNA, 22 nt, Human
ccagcugcgggcaucgagaguu

SEQ ID NO: 1029010 - RNA, 22 nt, Human
ggcuuuuguuucagcucugcua

SEQ ID NO: 1029011 - RNA, 22 nt, Human
caaauguuugguggcauuuugu

SEQ ID NO: 1029012 - RNA, 22 nt, Human
ccagaacagaccugccugaccu

SEQ ID NO: 1029013 - RNA, 23 nt, Human
ugcaaaauuugcagaguucgaug

SEQ ID NO: 1029014 - RNA, 20 nt, Human
uuugacaccuugggagagac

SEQ ID NO: 1029015 - RNA, 19 nt, Human
uugcuucaugucuuuugcu

SEQ ID NO: 1029016 - RNA, 22 nt, Human
ggaguagcugcauuccgagcac

SEQ ID NO: 1029017 - RNA, 22 nt, Human
ucuccaggggcagggucuggag

SEQ ID NO: 1029018 - RNA, 22 nt, Human
gggcuccagccaggugucccca

SEQ ID NO: 1029019 - RNA, 22 nt, Human
agcaccauugcaaauauggcag

SEQ ID NO: 1029020 - RNA, 22 nt, Human
uugcucuauguuuguaaacaga

SEQ ID NO: 1029021 - RNA, 22 nt, Human
caagaaguugacagccagguga

SEQ ID NO: 1029022 - RNA, 22 nt, Human
guggucaucuaacuaaauuuuc

SEQ ID NO: 1029023 - RNA, 22 nt, Human
caugggaauaaaguuauuucaa

SEQ ID NO: 1029024 - RNA, 22 nt, Human
caggacccaaccucccugcucu

SEQ ID NO: 1029025 - RNA, 22 nt, Human
cagcuccccucuguggggcagu

SEQ ID NO: 1029026 - RNA, 22 nt, Human
cggcuucucgggucggauuccg

SEQ ID NO: 1029027 - RNA, 22 nt, Human
uggcucugccccauaccccugc

SEQ ID NO: 1029028 - RNA, 22 nt, Human
cuccagcagaaagggcgagugg

SEQ ID NO: 1029029 - RNA, 22 nt, Human
agacgcgguggugcaugccugu

SEQ ID NO: 1029030 - RNA, 22 nt, Human
cugcccugcagcuccacggacu

SEQ ID NO: 1029031 - RNA, 20 nt, Human
ccagguggugccuggagagg

SEQ ID NO: 1029032 - RNA, 22 nt, Human
gcgguauuugugugggugucga

SEQ ID NO: 1029033 - RNA, 22 nt, Human
agagaagcagggagucaucugu

SEQ ID NO: 1029034 - RNA, 22 nt, Human
agauuauuuaagacaggaacca

SEQ ID NO: 1029035 - RNA, 22 nt, Human
ugugcugcucucagugacagcc

SEQ ID NO: 1029036 - RNA, 22 nt, Human
cggagcagagccacucgggccg

SEQ ID NO: 1029037 - RNA, 22 nt, Human
gccccucuccuugugcaccugc

SEQ ID NO: 1029038 - RNA, 22 nt, Human
uccugcagccauuagaggucaa

SEQ ID NO: 1029039 - RNA, 22 nt, Human
gagucacauacuauguaauaga

SEQ ID NO: 1029040 - RNA, 22 nt, Human
gcccagcgagcagagguggacg

SEQ ID NO: 1029041 - RNA, 22 nt, Human
ugcaggaacucgaaaacuauag

SEQ ID NO: 1029042 - RNA, 22 nt, Human
gccgugcgugcgcaggugcugu

SEQ ID NO: 1029043 - RNA, 22 nt, Human
agcaccagcucaaggugcaccu

SEQ ID NO: 1029044 - RNA, 22 nt, Human
acggccgaugacuccagcaugg

SEQ ID NO: 1029045 - RNA, 22 nt, Human
ccucuggccuaggccgggagag

SEQ ID NO: 1029046 - RNA, 22 nt, Human
uaccaggagcccccuucugguc

SEQ ID NO: 1029047 - RNA, 22 nt, Human
gcagagcugguacuugagccug

SEQ ID NO: 1029048 - RNA, 22 nt, Human
gagugcucgggccucugccugc

SEQ ID NO: 1029049 - RNA, 22 nt, Human
uaguggggaaggaggacaagaa

SEQ ID NO: 1029050 - RNA, 22 nt, Human
ggcggcacgcaggcugcugucg

SEQ ID NO: 1029051 - RNA, 22 nt, Human
uagcccuugaugcugcggccag

SEQ ID NO: 1029052 - RNA, 22 nt, Human
ccacccagccagaugcaggaag

SEQ ID NO: 1029053 - RNA, 22 nt, Human
ucuccccaguauggauucucug

SEQ ID NO: 1029054 - RNA, 22 nt, Human
gaggagagaagcuaacggugcu

SEQ ID NO: 1029055 - RNA, 22 nt, Human
aggagcggauguguccugccag

SEQ ID NO: 1029056 - RNA, 22 nt, Human
ucccagccugacagugcaucaa

SEQ ID NO: 1029057 - RNA, 22 nt, Human
ggcggccugugggucggccuca

SEQ ID NO: 1029058 - RNA, 22 nt, Human
aacaugaugacauuguaagcuu

SEQ ID NO: 1029059 - RNA, 18 nt, Human
agggagagaccgcggguc

SEQ ID NO: 1029060 - RNA, 22 nt, Human
cauggggaugaggcugagacuu

SEQ ID NO: 1029061 - RNA, 22 nt, Human
cccagcauuucugggcugcacu

SEQ ID NO: 1029062 - RNA, 17 nt, Human
gccuggcccagccuggc

SEQ ID NO: 1029063 - RNA, 22 nt, Human
ugcuccaggcugcugaagaucu

SEQ ID NO: 1029064 - RNA, 22 nt, Human
cagcuggaggagcagcuuccag

SEQ ID NO: 1029065 - RNA, 20 nt, Human
cucuuuucacucucaguggu

SEQ ID NO: 1029066 - RNA, 22 nt, Human
gcugccaccguggagaugagug

SEQ ID NO: 1029067 - RNA, 22 nt, Human
cugagcacguaguuagggucca

SEQ ID NO: 1029068 - RNA, 22 nt, Human
gccagguugcugacgacgaucu

SEQ ID NO: 1029069 - RNA, 16 nt, Human
ugcggcaacuugcggc

SEQ ID NO: 1029070 - RNA, 22 nt, Human
gugcugauugggagcugggauu

SEQ ID NO: 1029071 - RNA, 22 nt, Human
gccuggcuaagcagaaggaccc

SEQ ID NO: 1029072 - RNA, 22 nt, Human
uaaccuguuaagggcugaccca

SEQ ID NO: 1029073 - RNA, 22 nt, Human
cagaggccccauuggcugugcg

SEQ ID NO: 1029074 - RNA, 22 nt, Human
caacauuucaaggucuuuagga

SEQ ID NO: 1029075 - RNA, 20 nt, Human
uugagcagcagugcuguguc

SEQ ID NO: 1029076 - RNA, 20 nt, Human
guggcagugguggcagcagu

SEQ ID NO: 1029077 - RNA, 22 nt, Human
auggcugugguaucagacgcag

SEQ ID NO: 1029078 - RNA, 22 nt, Human
aaucaggagugugcacuuugau

SEQ ID NO: 1029079 - RNA, 21 nt, Human
uuccuccucuggagaagaaga

SEQ ID NO: 1029080 - RNA, 22 nt, Human
ucccuggcacaagaaggcuguc

SEQ ID NO: 1029081 - RNA, 22 nt, Human
ggagggaguuucauuccugccc

SEQ ID NO: 1029082 - RNA, 22 nt, Human
agccccaguucccuggaagucu

SEQ ID NO: 1029083 - RNA, 22 nt, Human
aaucccuccccaggcaaguccu

SEQ ID NO: 1029084 - RNA, 21 nt, Human
gcugcucgagauccagugcuu

SEQ ID NO: 1029085 - RNA, 22 nt, Human
aagcauuuuagauaaagcauca

SEQ ID NO: 1029086 - RNA, 22 nt, Human
ccugcugaggucagccacccaa

SEQ ID NO: 1029087 - RNA, 22 nt, Human
cacagagagcuacgugcagcgu

SEQ ID NO: 1029088 - RNA, 22 nt, Human
aggacucaucccugcuugucag

SEQ ID NO: 1029089 - RNA, 22 nt, Human
aacacaguuucugcauugguag

SEQ ID NO: 1029090 - RNA, 22 nt, Human
cucugcaggcacccaggguggg

SEQ ID NO: 1029091 - RNA, 22 nt, Human
gucugcacgugccagggagggg

SEQ ID NO: 1029092 - RNA, 22 nt, Human
agggcccaccuuggugcugagg

SEQ ID NO: 1029093 - RNA, 22 nt, Human
uagcaucuguacugacauaauc

SEQ ID NO: 1029094 - RNA, 22 nt, Human
aaagugcugggauuacaggugu

SEQ ID NO: 1029095 - RNA, 22 nt, Human
cagggagcuggugccagccgac

SEQ ID NO: 1029096 - RNA, 22 nt, Human
ggcugcugcccaccccugcaug

SEQ ID NO: 1029097 - RNA, 22 nt, Human
aaggcagcaugaaucccuguac

SEQ ID NO: 1029098 - RNA, 22 nt, Human
gcugucugcugggucgcucagg

SEQ ID NO: 1029099 - RNA, 22 nt, Human
ggcuuccuccuuccugcuguca

SEQ ID NO: 1029100 - RNA, 22 nt, Human
gccaaaguccuccagccaugca

SEQ ID NO: 1029101 - RNA, 22 nt, Human
cuggcuccauccuugagcucug

SEQ ID NO: 1029102 - RNA, 22 nt, Human
ucucugagguuguuuccagcac

SEQ ID NO: 1029103 - RNA, 22 nt, Human
gaccugugcagugacugguggc

SEQ ID NO: 1029104 - RNA, 22 nt, Human
cuucuggcguuggaggucugag

SEQ ID NO: 1029105 - RNA, 22 nt, Human
uccaggaguccuggguggcccc

SEQ ID NO: 1029106 - RNA, 22 nt, Human
ggcccucucuacauguuagacg

SEQ ID NO: 1029107 - RNA, 22 nt, Human
agcaggaggagagccuggcggu

SEQ ID NO: 1029108 - RNA, 22 nt, Human
gcuuccaaugcuucuaucacau

SEQ ID NO: 1029109 - RNA, 22 nt, Human
ccugcgcgucugggucugucuc

SEQ ID NO: 1029110 - RNA, 22 nt, Human
uuucuuggucuucccgaccugg

SEQ ID NO: 1029111 - RNA, 22 nt, Human
gccacaggucggcuagaggguc

SEQ ID NO: 1029112 - RNA, 22 nt, Human
aggggcacgaguagagcucuag

SEQ ID NO: 1029113 - RNA, 22 nt, Human
gggcagcaucaggaggggcuuu

SEQ ID NO: 1029114 - RNA, 22 nt, Human
agcagcaccuguccucgcugcu

SEQ ID NO: 1029115 - RNA, 22 nt, Human
uugaccacugaaugguucugaa

SEQ ID NO: 1029116 - RNA, 22 nt, Human
gcuaggaguggugggucaagga

SEQ ID NO: 1029117 - RNA, 22 nt, Human
acagacacaggcguggagucgc

SEQ ID NO: 1029118 - RNA, 22 nt, Human
gcccagaguuugaagauacagu

SEQ ID NO: 1029119 - RNA, 22 nt, Human
agcuccagggaaagaguggauc

SEQ ID NO: 1029120 - RNA, 22 nt, Human
cgcagcugcugcucugaaacag

SEQ ID NO: 1029121 - RNA, 22 nt, Human
uucuuggcacagaugagauucu

SEQ ID NO: 1029122 - RNA, 22 nt, Human
ggcaguggcuccucucuacucc

SEQ ID NO: 1029123 - RNA, 22 nt, Human
aggaggguggggucugccuguc

SEQ ID NO: 1029124 - RNA, 22 nt, Human
ugcacagagggaggcauaaaau

SEQ ID NO: 1029125 - RNA, 22 nt, Human
uuuuuggguccaggcuguaucu

SEQ ID NO: 1029126 - RNA, 22 nt, Human
augaaacucuagcuuucagcac

SEQ ID NO: 1029127 - RNA, 22 nt, Human
ccaggacaagccagagggacag

SEQ ID NO: 1029128 - RNA, 22 nt, Human
cuguggcugcgcccugggggag

SEQ ID NO: 1029129 - RNA, 22 nt, Human
agcugcaccggcuggaccacug

SEQ ID NO: 1029130 - RNA, 22 nt, Human
gcagacccugaacugggcaugg

SEQ ID NO: 1029131 - RNA, 22 nt, Human
aggugccugucgucucugguua

SEQ ID NO: 1029132 - RNA, 22 nt, Human
uggccagucuuagcugugccug

SEQ ID NO: 1029133 - RNA, 22 nt, Human
acaggacagucuaguaacagua

SEQ ID NO: 1029134 - RNA, 19 nt, Human
agcagccaucgaccaugga

SEQ ID NO: 1029135 - RNA, 22 nt, Human
gaggcuguaacuugggcacugg

SEQ ID NO: 1029136 - RNA, 22 nt, Human
cucaucuggcuucaguaacagu

SEQ ID NO: 1029137 - RNA, 22 nt, Human
cuugcuuuaucugguuucucau

SEQ ID NO: 1029138 - RNA, 22 nt, Human
uucaaacaguguagaauauaug

SEQ ID NO: 1029139 - RNA, 22 nt, Human
uuggcgcccaggacgccgccgc

SEQ ID NO: 1029140 - RNA, 23 nt, Human
uguacacuuggucaagguacuua

SEQ ID NO: 1029141 - RNA, 22 nt, Human
uggcacguuggauugggaguuc

SEQ ID NO: 1029142 - RNA, 22 nt, Human
ugcucagaauugcgcuggugga

SEQ ID NO: 1029143 - RNA, 22 nt, Human
agcccgcaucucgcuaaagaua

SEQ ID NO: 1029144 - RNA, 22 nt, Human
ugggcccaucauugcugugggc

SEQ ID NO: 1029145 - RNA, 22 nt, Human
gcacuucaccacuguccugguu

SEQ ID NO: 1029146 - RNA, 22 nt, Human
cggucguaguucuucagcaggu

SEQ ID NO: 1029147 - RNA, 22 nt, Human
agcacugugagcaccagcacgc

SEQ ID NO: 1029148 - RNA, 22 nt, Human
uuuccuguccugguacuuggca

SEQ ID NO: 1029149 - RNA, 22 nt, Human
gcagagcacccugcagugguau

SEQ ID NO: 1029150 - RNA, 22 nt, Human
ugcacgugugagcauucacaug

SEQ ID NO: 1029151 - RNA, 22 nt, Human
gggcuccagaggcucacccugg

SEQ ID NO: 1029152 - RNA, 22 nt, Human
aaugcaaugcagcaccuccuug

SEQ ID NO: 1029153 - RNA, 20 nt, Human
ccacaguggagacuggagac

SEQ ID NO: 1029154 - RNA, 22 nt, Human
cuucuggguauuccagauaccu

SEQ ID NO: 1029155 - RNA, 22 nt, Human
gcaggaguguggugggacaucc

SEQ ID NO: 1029156 - RNA, 22 nt, Human
uggcggugacggcggcgccugg

SEQ ID NO: 1029157 - RNA, 22 nt, Human
gcaguccuuaggagaggaagua

SEQ ID NO: 1029158 - RNA, 22 nt, Human
agggccagcagcuuggccaacc

SEQ ID NO: 1029159 - RNA, 22 nt, Human
uagcgggucacccugcugugaa

SEQ ID NO: 1029160 - RNA, 22 nt, Human
aaguccagguccucauuccauc

SEQ ID NO: 1029161 - RNA, 22 nt, Human
cagggcucgcucgcucgcucgc

SEQ ID NO: 1029162 - RNA, 22 nt, Human
aaauuaacuaucacuuuuguga

SEQ ID NO: 1029163 - RNA, 22 nt, Human
aucugucccuccucacagccuc

SEQ ID NO: 1029164 - RNA, 22 nt, Human
agggugugcuguugggucuuuc

SEQ ID NO: 1029165 - RNA, 22 nt, Human
aggacaaaggaccagaucugga

SEQ ID NO: 1029166 - RNA, 23 nt, Human
gccagagcugccugcccuugcug

SEQ ID NO: 1029167 - RNA, 22 nt, Human
aggcucccaagcacugacccca

SEQ ID NO: 1029168 - RNA, 22 nt, Human
gugagcugggugaaugguaggg

SEQ ID NO: 1029169 - RNA, 22 nt, Human
gggagagcgcgcuagggccgag

SEQ ID NO: 1029170 - RNA, 22 nt, Human
agauugucauugacgaugagca

SEQ ID NO: 1029171 - RNA, 22 nt, Human
caugcagugcuuugcgccgggc

SEQ ID NO: 1029172 - RNA, 22 nt, Human
auugacuuucccuucuccucau

SEQ ID NO: 1029173 - RNA, 22 nt, Human
gaggggccuggcgaggacaugu

SEQ ID NO: 1029174 - RNA, 22 nt, Human
uacuuugucauucuaaccuucc

SEQ ID NO: 1029175 - RNA, 22 nt, Human
acaagcgggccacagugcuggu

SEQ ID NO: 1029176 - RNA, 22 nt, Human
cugggcuguuuguucuggucuc

SEQ ID NO: 1029177 - RNA, 22 nt, Human
ucuggaaggggaucugugguca

SEQ ID NO: 1029178 - RNA, 22 nt, Human
gggagcuggagcuggaagacuc

SEQ ID NO: 1029179 - RNA, 22 nt, Human
aaagcugggcuggccaacccag

SEQ ID NO: 1029180 - RNA, 22 nt, Human
guuguacauaugaggauaaguu

SEQ ID NO: 1029181 - RNA, 22 nt, Human
uugggugcugucauggggcacg

SEQ ID NO: 1029182 - RNA, 22 nt, Human
uucuccagcucaucagggaggg

SEQ ID NO: 1029183 - RNA, 22 nt, Human
acagugcuaucaauagcuagaa

SEQ ID NO: 1029184 - RNA, 22 nt, Human
cggcagcgguuggagguuguag

SEQ ID NO: 1029185 - RNA, 22 nt, Human
gcaugcaggaagggcuugggga

SEQ ID NO: 1029186 - RNA, 23 nt, Human
acaaguguuuccaauauggcugg

SEQ ID NO: 1029187 - RNA, 22 nt, Human
gugcagcugggcgcugaccuuc

SEQ ID NO: 1029188 - RNA, 22 nt, Human
gccugagccgccugagcggcgg

SEQ ID NO: 1029189 - RNA, 22 nt, Human
cugguggaauggcagagggaac

SEQ ID NO: 1029190 - RNA, 22 nt, Human
uggcccgggaguuuugaagagu

SEQ ID NO: 1029191 - RNA, 22 nt, Human
gcugucccgaaccccugguaau

SEQ ID NO: 1029192 - RNA, 22 nt, Human
acugagcaggguuccgcaugga

SEQ ID NO: 1029193 - RNA, 23 nt, Human
ggacaugucucuggguauuuuga

SEQ ID NO: 1029194 - RNA, 22 nt, Human
gcccagccccuggguggacgug

SEQ ID NO: 1029195 - RNA, 22 nt, Human
ucccacacagcccgcucaccgg

SEQ ID NO: 1029196 - RNA, 22 nt, Human
gucugugcaguuacuagcuggu

SEQ ID NO: 1029197 - RNA, 22 nt, Human
ggcucuggcgagcuuuaguaca

SEQ ID NO: 1029198 - RNA, 22 nt, Human
aggaauguggaagguggcggcg

SEQ ID NO: 1029199 - RNA, 22 nt, Human
gaggggcugggguugacuccaa

SEQ ID NO: 1029200 - RNA, 22 nt, Human
uguuggcagugcuacagucagu

SEQ ID NO: 1029201 - RNA, 22 nt, Human
aguggcuguuccaggugaggac

SEQ ID NO: 1029202 - RNA, 22 nt, Human
ugagcugcuucuuauaaugugu

SEQ ID NO: 1029203 - RNA, 22 nt, Human
uagcugcuugaccaggcagugg

SEQ ID NO: 1029204 - RNA, 22 nt, Human
cagcuccagccaccggggggug

SEQ ID NO: 1029205 - RNA, 22 nt, Human
uagggcucugagaguucagccu

SEQ ID NO: 1029206 - RNA, 22 nt, Human
cagcccacugccucugugguag

SEQ ID NO: 1029207 - RNA, 22 nt, Human
auguuguugaacucuuugcaug

SEQ ID NO: 1029208 - RNA, 22 nt, Human
gcagugacagacaacuguuuga

SEQ ID NO: 1029209 - RNA, 22 nt, Human
ucuguggcaaacacagugacca

SEQ ID NO: 1029210 - RNA, 22 nt, Human
auagcuuugagggcuccuuagg

SEQ ID NO: 1029211 - RNA, 22 nt, Human
ucccagucuagagccggauugg

SEQ ID NO: 1029212 - RNA, 22 nt, Human
acuggaaaguauucuuucacug

SEQ ID NO: 1029213 - RNA, 22 nt, Human
agcaggcauuugauauauauuu

SEQ ID NO: 1029214 - RNA, 22 nt, Human
uugcuugaacccaggaagugga

SEQ ID NO: 1029215 - RNA, 22 nt, Human
uuugcagagugcagaagcaucu

SEQ ID NO: 1029216 - RNA, 22 nt, Human
agcuccugaaaauccagacugg

SEQ ID NO: 1029217 - RNA, 22 nt, Human
ucugcuggaaaaccagggaauu

SEQ ID NO: 1029218 - RNA, 22 nt, Human
ucagaagcauccauuucaccac

SEQ ID NO: 1029219 - RNA, 22 nt, Human
uuccuggggacuuaccgucauu

SEQ ID NO: 1029220 - RNA, 22 nt, Human
gggagccagcagggcauggagc

SEQ ID NO: 1029221 - RNA, 22 nt, Human
gggagcugaacugcugaaguug

SEQ ID NO: 1029222 - RNA, 22 nt, Human
gguccccguggaggcuggagcg

SEQ ID NO: 1029223 - RNA, 22 nt, Human
aaaaugcucaucagcgauggcu

SEQ ID NO: 1029224 - RNA, 22 nt, Human
guggacagacauaauccuaauu

SEQ ID NO: 1029225 - RNA, 22 nt, Human
agagcgagucuggggcucggau

SEQ ID NO: 1029226 - RNA, 22 nt, Human
cuguguacccacgugggcaccc

SEQ ID NO: 1029227 - RNA, 22 nt, Human
agcggcgccggagggaggugcg

SEQ ID NO: 1029228 - RNA, 22 nt, Human
ccugugggcgcagcuggaguca

SEQ ID NO: 1029229 - RNA, 22 nt, Human
gcagauggauguggacggcgcc

SEQ ID NO: 1029230 - RNA, 22 nt, Human
cagaaagcaguugucaaugggc

SEQ ID NO: 1029231 - RNA, 22 nt, Human
cagcugccuguauuguccucau

SEQ ID NO: 1029232 - RNA, 22 nt, Human
uggcaggaaaaagggccagagg

SEQ ID NO: 1029233 - RNA, 19 nt, Human
ccauucugucucugccaca

SEQ ID NO: 1029234 - RNA, 22 nt, Human
cuguccagcgacuaggggaugg

SEQ ID NO: 1029235 - RNA, 20 nt, Human
cucagugcuuucauugccuc

SEQ ID NO: 1029236 - RNA, 22 nt, Human
acagcuggccgaggcucaggga

SEQ ID NO: 1029237 - RNA, 22 nt, Human
gggagggcuuggacccagaugu

SEQ ID NO: 1029238 - RNA, 22 nt, Human
ccugugcaugccaggguacacc

SEQ ID NO: 1029239 - RNA, 22 nt, Human
auuguuacuggguuaauuugga

SEQ ID NO: 1029240 - RNA, 22 nt, Human
uggcacagcuugucauaaacuc

SEQ ID NO: 1029241 - RNA, 22 nt, Human
caggccuugaaggccugcggga

SEQ ID NO: 1029242 - RNA, 22 nt, Human
gagguccacugaggcaacaggg

SEQ ID NO: 1029243 - RNA, 17 nt, Human
agccugcugaucucaca

SEQ ID NO: 1029244 - RNA, 22 nt, Human
caaugcacauggacaucaggcu

SEQ ID NO: 1029245 - RNA, 22 nt, Human
aggugacaucccggcagcagag

SEQ ID NO: 1029246 - RNA, 22 nt, Human
uggcagcauuuuuuccagaaca

SEQ ID NO: 1029247 - RNA, 22 nt, Human
ugacucacuuaauuuacaaguc

SEQ ID NO: 1029248 - RNA, 21 nt, Human
ugcaaugcauugacagcagca

SEQ ID NO: 1029249 - RNA, 22 nt, Human
caaugcagauaccuuccagaga

SEQ ID NO: 1029250 - RNA, 19 nt, Human
ggguccauggugucaagga

SEQ ID NO: 1029251 - RNA, 22 nt, Human
gaggaggcuuccgggaggcacg

SEQ ID NO: 1029252 - RNA, 22 nt, Human
uuugagaagauaggggaauacu

SEQ ID NO: 1029253 - RNA, 23 nt, Human
gggcugcuccaggccaaggcugg

SEQ ID NO: 1029254 - RNA, 22 nt, Human
acugggcaaggauaugaugggu

SEQ ID NO: 1029255 - RNA, 22 nt, Human
agccagugucgugugacaugag

SEQ ID NO: 1029256 - RNA, 22 nt, Human
uacaccagauuauuuauaacau

SEQ ID NO: 1029257 - RNA, 22 nt, Human
ucugcgcccugucgccugcucc

SEQ ID NO: 1029258 - RNA, 18 nt, Human
gagagcccagcagguggu

SEQ ID NO: 1029259 - RNA, 22 nt, Human
cuggccucacagaggcuaagcc

SEQ ID NO: 1029260 - RNA, 22 nt, Human
cugggccacaagccugugugau

SEQ ID NO: 1029261 - RNA, 22 nt, Human
acgccucugcagcugccgggcc

SEQ ID NO: 1029262 - RNA, 22 nt, Human
gguagacaacuuuguaauagcc

SEQ ID NO: 1029263 - RNA, 22 nt, Human
ugcaggcuggaggagggacuaa

SEQ ID NO: 1029264 - RNA, 22 nt, Human
uuccuggugguggugacagcac

SEQ ID NO: 1029265 - RNA, 22 nt, Human
gcacccagggcaggaagugagg

SEQ ID NO: 1029266 - RNA, 19 nt, Human
caggucuucuuggaggacu

SEQ ID NO: 1029267 - RNA, 22 nt, Human
cuguuccuccaccucaacaaac

SEQ ID NO: 1029268 - RNA, 22 nt, Human
gggcugcacuagggcaagguga

SEQ ID NO: 1029269 - RNA, 22 nt, Human
aagcuggccuguaccugcugag

SEQ ID NO: 1029270 - RNA, 22 nt, Human
ggagaugccuuguuucaggaac

SEQ ID NO: 1029271 - RNA, 22 nt, Human
ggaauccugguguuuucugccu

SEQ ID NO: 1029272 - RNA, 22 nt, Human
agcgcuggugaucucuauuuug

SEQ ID NO: 1029273 - RNA, 22 nt, Human
auggagcagcagaaggggcuug

SEQ ID NO: 1029274 - RNA, 21 nt, Human
agagacugucacugcaguacc

SEQ ID NO: 1029275 - RNA, 22 nt, Human
gggggaaaguggagguucguga

SEQ ID NO: 1029276 - RNA, 22 nt, Human
gugcugagugcagagugcagag

SEQ ID NO: 1029277 - RNA, 22 nt, Human
gggagcugaaggagccggcggg

SEQ ID NO: 1029278 - RNA, 22 nt, Human
gcucugugccccugccguggac

SEQ ID NO: 1029279 - RNA, 22 nt, Human
cuggccagggugcgaucguggu

SEQ ID NO: 1029280 - RNA, 22 nt, Human
uuagcaaacaucuucgugugag

SEQ ID NO: 1029281 - RNA, 22 nt, Human
ugggcagggagcuggaaccaca

SEQ ID NO: 1029282 - RNA, 22 nt, Human
gccuggcaaggcccuguugacu

SEQ ID NO: 1029283 - RNA, 22 nt, Human
auaggacuuuguaucaggauga

SEQ ID NO: 1029284 - RNA, 22 nt, Human
cuggagcucuguguguuccuga

SEQ ID NO: 1029285 - RNA, 22 nt, Human
ugaggauggaaugcugugcaag

SEQ ID NO: 1029286 - RNA, 22 nt, Human
ccaggcccugccugugguuccu

SEQ ID NO: 1029287 - RNA, 22 nt, Human
auuuacucgugcuucauugaau

SEQ ID NO: 1029288 - RNA, 22 nt, Human
cugacucccaaagaggacgcgu

SEQ ID NO: 1029289 - RNA, 22 nt, Human
augcugugccuggaaagcggcu

SEQ ID NO: 1029290 - RNA, 21 nt, Human
agccaggcaagcacccccacu

SEQ ID NO: 1029291 - RNA, 22 nt, Human
agacugugagaagauggcugcg

SEQ ID NO: 1029292 - RNA, 22 nt, Human
gacuggcucuaucaggauaaau

SEQ ID NO: 1029293 - RNA, 22 nt, Human
gcugcuccgcagagugugugug

SEQ ID NO: 1029294 - RNA, 22 nt, Human
cagugcccuuccaggacugcag

SEQ ID NO: 1029295 - RNA, 22 nt, Human
cugcagggcccaaggucaacgg

SEQ ID NO: 1029296 - RNA, 22 nt, Human
cuccuuggguucuuucgguucc

SEQ ID NO: 1029297 - RNA, 22 nt, Human
ucucuccuccacaccgggugcu

SEQ ID NO: 1029298 - RNA, 22 nt, Human
caggccacacggcggcucccug

SEQ ID NO: 1029299 - RNA, 22 nt, Human
uccaggagcucauccacgucaa

SEQ ID NO: 1029300 - RNA, 22 nt, Human
ugcucccaaaccugacaggcuc

SEQ ID NO: 1029301 - RNA, 22 nt, Human
aagcccgguugggaacguggug

SEQ ID NO: 1029302 - RNA, 22 nt, Human
uguuaccauaggucagaacguu

SEQ ID NO: 1029303 - RNA, 22 nt, Human
ugacaggcuugcuaagacauag

SEQ ID NO: 1029304 - RNA, 22 nt, Human
uugaggucuggcaguagcguug

SEQ ID NO: 1029305 - RNA, 22 nt, Human
cguggggcggguggacacuugc

SEQ ID NO: 1029306 - RNA, 19 nt, Human
guuggcacugaaaauggcu

SEQ ID NO: 1029307 - RNA, 22 nt, Human
ggagcggagggagggccacugu

SEQ ID NO: 1029308 - RNA, 22 nt, Human
ucagcccggguucgcaaacacu

SEQ ID NO: 1029309 - RNA, 22 nt, Human
uccaaggacauuguucuaguug

SEQ ID NO: 1029310 - RNA, 22 nt, Human
ucucugguuaugucauuaagca

SEQ ID NO: 1029311 - RNA, 22 nt, Human
gcaaugagcacccagagggcag

SEQ ID NO: 1029312 - RNA, 22 nt, Human
gcgagucgccgcugcagcccua

SEQ ID NO: 1029313 - RNA, 19 nt, Human
gaugcucauucagguggaa

SEQ ID NO: 1029314 - RNA, 22 nt, Human
gugccgcuggagcuggaauuga

SEQ ID NO: 1029315 - RNA, 22 nt, Human
cuucucggccguguggaugcgc

SEQ ID NO: 1029316 - RNA, 22 nt, Human
caaagccaggcuuucuaaugua

SEQ ID NO: 1029317 - RNA, 19 nt, Human
acacaccagugccugugac

SEQ ID NO: 1029318 - RNA, 22 nt, Human
cacgcacgcuggguggaggcgc

SEQ ID NO: 1029319 - RNA, 22 nt, Human
aagccgggccugagaaaugaca

SEQ ID NO: 1029320 - RNA, 22 nt, Human
cuugaggcugcacuccagggcc

SEQ ID NO: 1029321 - RNA, 22 nt, Human
aaggcacuugcccagagcugca

SEQ ID NO: 1029322 - RNA, 22 nt, Human
uuccuggccucuuccaccacca

SEQ ID NO: 1029323 - RNA, 20 nt, Human
cugaccagcagccugucucc

SEQ ID NO: 1029324 - RNA, 22 nt, Human
gugcucacugugagacguccug

SEQ ID NO: 1029325 - RNA, 22 nt, Human
uucuggagacccagcaacaggg

SEQ ID NO: 1029326 - RNA, 22 nt, Human
agcaggggcaggguuuugugcu

SEQ ID NO: 1029327 - RNA, 22 nt, Human
uggcaugcaagaggaggcuccc

SEQ ID NO: 1029328 - RNA, 22 nt, Human
aggacagcagugcuggcacuug

SEQ ID NO: 1029329 - RNA, 22 nt, Human
cucugggguggaggaggcugac

SEQ ID NO: 1029330 - RNA, 22 nt, Human
uguacauauucaagcacuucua

SEQ ID NO: 1029331 - RNA, 22 nt, Human
agccagucggggccaugcuggg

SEQ ID NO: 1029332 - RNA, 22 nt, Human
gcagagucagguccaaggacug

SEQ ID NO: 1029333 - RNA, 22 nt, Human
cagcccaggacugcagguguuu

SEQ ID NO: 1029334 - RNA, 22 nt, Human
ugucuucauuccccaugaaguc

SEQ ID NO: 1029335 - RNA, 22 nt, Human
uggcccaggugcacccagaggc

SEQ ID NO: 1029336 - RNA, 22 nt, Human
uccugggcccuccggaucaggu

SEQ ID NO: 1029337 - RNA, 22 nt, Human
cuuccagcugauuggcauccag

SEQ ID NO: 1029338 - RNA, 21 nt, Human
gcccacagugaggaggauccc

SEQ ID NO: 1029339 - RNA, 22 nt, Human
ggugggugagcccugggagcug

SEQ ID NO: 1029340 - RNA, 22 nt, Human
accauccuuuaguuugcguuuc

SEQ ID NO: 1029341 - RNA, 22 nt, Human
ucugcacccugugguccucuag

SEQ ID NO: 1029342 - RNA, 22 nt, Human
gagcuguucugugauugaucua

SEQ ID NO: 1029343 - RNA, 22 nt, Human
aggaagagcuggaccagaggac

SEQ ID NO: 1029344 - RNA, 22 nt, Human
ugcccugcagacccugcagugu

SEQ ID NO: 1029345 - RNA, 22 nt, Human
uguguggcaagcuguaugcuag

SEQ ID NO: 1029346 - RNA, 22 nt, Human
cuaccugguacauagaaauguu

SEQ ID NO: 1029347 - RNA, 22 nt, Human
acaucguguaucacugaaccuu

SEQ ID NO: 1029348 - RNA, 22 nt, Human
gcugggcaggccucgugagggc

SEQ ID NO: 1029349 - RNA, 22 nt, Human
uccuggccucugagucaagaac

SEQ ID NO: 1029350 - RNA, 21 nt, Human
acauguccccuaugcuuaagg

SEQ ID NO: 1029351 - RNA, 22 nt, Human
agcacuggaaaguuaagaguuu

SEQ ID NO: 1029352 - RNA, 22 nt, Human
ccuuuuggccaggucagugcag

SEQ ID NO: 1029353 - RNA, 20 nt, Human
cagugcccguggaaaagaug

SEQ ID NO: 1029354 - RNA, 22 nt, Human
acauauuuugaaagcuuucuaa

SEQ ID NO: 1029355 - RNA, 22 nt, Human
gcgaguccacuggggggcgcag

SEQ ID NO: 1029356 - RNA, 22 nt, Human
ccucuucuaggacguccuugug

SEQ ID NO: 1029357 - RNA, 22 nt, Human
auuuacagccuugccaucuaua

SEQ ID NO: 1029358 - RNA, 22 nt, Human
gccagagggauuccuggugugu

SEQ ID NO: 1029359 - RNA, 19 nt, Human
uggugcgcuguuccugagc

SEQ ID NO: 1029360 - RNA, 22 nt, Human
accugguaaccugccugacuaa

SEQ ID NO: 1029361 - RNA, 22 nt, Human
uggcuggcuguccagcugggca

SEQ ID NO: 1029362 - RNA, 22 nt, Human
aagcacagggacucaggaccgg

SEQ ID NO: 1029363 - RNA, 22 nt, Human
ucuccagaguaaccuuggagca

SEQ ID NO: 1029364 - RNA, 21 nt, Human
acccugcuuuaugccguccuc

SEQ ID NO: 1029365 - RNA, 22 nt, Human
ucauggcucuaaagacauagau

SEQ ID NO: 1029366 - RNA, 23 nt, Human
cuuuccuuucuuugacacccagc

SEQ ID NO: 1029367 - RNA, 22 nt, Human
gccagcuagaggcugcagugca

SEQ ID NO: 1029368 - RNA, 22 nt, Human
ccgcgagguggagguugcagug

SEQ ID NO: 1029369 - RNA, 22 nt, Human
ggggagaguauuuuauucaagu

SEQ ID NO: 1029370 - RNA, 22 nt, Human
ugugacagugccagcuucauag

SEQ ID NO: 1029371 - RNA, 22 nt, Human
gaccaggagauuugagcuaggc

SEQ ID NO: 1029372 - RNA, 23 nt, Human
agacagaggcugaggcuggccgc

SEQ ID NO: 1029373 - RNA, 22 nt, Human
gguguugcaguugaagacuggu

SEQ ID NO: 1029374 - RNA, 22 nt, Human
ggcucuguaaguguugcaggua

SEQ ID NO: 1029375 - RNA, 23 nt, Human
ugggcagcuucugcaugcccacc

SEQ ID NO: 1029376 - RNA, 22 nt, Human
cagcaguguacaaggugucaga

SEQ ID NO: 1029377 - RNA, 22 nt, Human
ugcgccugcgcaaagguuucug

SEQ ID NO: 1029378 - RNA, 22 nt, Human
agugcuuuauguuguugugcaa

SEQ ID NO: 1029379 - RNA, 22 nt, Human
ugcaaggcacccacucugcuuu

SEQ ID NO: 1029380 - RNA, 22 nt, Human
ggcagagcuugcagugagccga

SEQ ID NO: 1029381 - RNA, 22 nt, Human
gaggcuggacgugcauuucuac

SEQ ID NO: 1029382 - RNA, 22 nt, Human
cgggagccucugggucacacug

SEQ ID NO: 1029383 - RNA, 22 nt, Human
gacacuacguggcucacauuuc

SEQ ID NO: 1029384 - RNA, 18 nt, Human
uccaccgcgugcaccucu

SEQ ID NO: 1029385 - RNA, 22 nt, Human
uugaggagucaggggcacggaa

SEQ ID NO: 1029386 - RNA, 22 nt, Human
ccaagagcuucccauagcuucu

SEQ ID NO: 1029387 - RNA, 21 nt, Human
ccaccaggucuucugcucggg

SEQ ID NO: 1029388 - RNA, 22 nt, Human
cagugcagccaaggacaggcac

SEQ ID NO: 1029389 - RNA, 22 nt, Human
acauuguugagccucuuguuca

SEQ ID NO: 1029390 - RNA, 22 nt, Human
ugagccuggagucguggagggg

SEQ ID NO: 1029391 - RNA, 22 nt, Human
ccggcucggcgaccaggcugaa

SEQ ID NO: 1029392 - RNA, 22 nt, Human
aaggcucccucuucucgagugu

SEQ ID NO: 1029393 - RNA, 22 nt, Human
gcugaagagagaugcguccagc

SEQ ID NO: 1029394 - RNA, 22 nt, Human
gcuucugcagagccguccugag

SEQ ID NO: 1029395 - RNA, 22 nt, Human
uggcuccuuccgcagcaugccu

SEQ ID NO: 1029396 - RNA, 21 nt, Human
ugcuaagugucacaugucugc

SEQ ID NO: 1029397 - RNA, 22 nt, Human
ggcgcggugacucagccucgcu

SEQ ID NO: 1029398 - RNA, 23 nt, Human
guguggccccagggccuccucgc

SEQ ID NO: 1029399 - RNA, 19 nt, Human
ucuugaggaaaguaaggca

SEQ ID NO: 1029400 - RNA, 22 nt, Human
ccaagaggggaagggccgcagc

SEQ ID NO: 1029401 - RNA, 22 nt, Human
cugucacagcccgcgucuccuc

SEQ ID NO: 1029402 - RNA, 22 nt, Human
gcugccuggaauaacggcuggc

SEQ ID NO: 1029403 - RNA, 22 nt, Human
uccaugacagcgugagaguuug

SEQ ID NO: 1029404 - RNA, 22 nt, Human
ugugaagcgugugcaggggaca

SEQ ID NO: 1029405 - RNA, 22 nt, Human
gggacagcuguagugcuuggcu

SEQ ID NO: 1029406 - RNA, 19 nt, Human
gcagcugugggaagagcca

SEQ ID NO: 1029407 - RNA, 22 nt, Human
uucuuugcccauguuuccuaag

SEQ ID NO: 1029408 - RNA, 22 nt, Human
cccaggcacacugaagugacau

SEQ ID NO: 1029409 - RNA, 22 nt, Human
aacagaaaucauuuagggcucu

SEQ ID NO: 1029410 - RNA, 21 nt, Human
acagaaguggcuuggucucag

SEQ ID NO: 1029411 - RNA, 22 nt, Human
gugagagugguuuauguccaug

SEQ ID NO: 1029412 - RNA, 22 nt, Human
caggagcucaagaccacccugg

SEQ ID NO: 1029413 - RNA, 22 nt, Human
aggcaguguggagggcuguugc

SEQ ID NO: 1029414 - RNA, 22 nt, Human
ucccucugcuagugcuugagcu

SEQ ID NO: 1029415 - RNA, 22 nt, Human
agaagagccacuguugacggca

SEQ ID NO: 1029416 - RNA, 22 nt, Human
gacagguaaagaugguggcagg

SEQ ID NO: 1029417 - RNA, 22 nt, Human
uuguguacucaccagcacauac

SEQ ID NO: 1029418 - RNA, 21 nt, Human
aacaggucccccacgggcuuu

SEQ ID NO: 1029419 - RNA, 22 nt, Human
agcaggaacucagggaguucuc

SEQ ID NO: 1029420 - RNA, 22 nt, Human
ggccugcuucucugggcuuucu

SEQ ID NO: 1029421 - RNA, 22 nt, Human
ccgugugcacgcgccggugcug

SEQ ID NO: 1029422 - RNA, 22 nt, Human
gcgaaucucagcuggugcugcg

SEQ ID NO: 1029423 - RNA, 22 nt, Human
augcauugaggaugacaugagu

SEQ ID NO: 1029424 - RNA, 22 nt, Human
ucuuccagauacuuccugacuu

SEQ ID NO: 1029425 - RNA, 22 nt, Human
acagagacacggaagcuaaaga

SEQ ID NO: 1029426 - RNA, 22 nt, Human
gagcaacacauugaaugaggau

SEQ ID NO: 1029427 - RNA, 22 nt, Human
agacacauuuucagcucugcca

SEQ ID NO: 1029428 - RNA, 22 nt, Human
gggcagcaggcuccacguuccu

SEQ ID NO: 1029429 - RNA, 22 nt, Human
aaagaggcucaaggugggccag

SEQ ID NO: 1029430 - RNA, 22 nt, Human
gaagaccccagagcgagguaag

SEQ ID NO: 1029431 - RNA, 22 nt, Human
gugcaaagcuuaacauucugca

SEQ ID NO: 1029432 - RNA, 22 nt, Human
ggcuuuggggguguccaagaaa

SEQ ID NO: 1029433 - RNA, 22 nt, Human
ucccgggcaggucgagcgagcc

SEQ ID NO: 1029434 - RNA, 22 nt, Human
cugcgugguaggacucaguucu

SEQ ID NO: 1029435 - RNA, 22 nt, Human
gggggcgccgccgcucaucuca

SEQ ID NO: 1029436 - RNA, 22 nt, Human
uuuuccuucugauacuccauuu

SEQ ID NO: 1029437 - RNA, 22 nt, Human
uggggugugcucagagcagggg

SEQ ID NO: 1029438 - RNA, 21 nt, Human
ggcagcucagcagauggggac

SEQ ID NO: 1029439 - RNA, 22 nt, Human
gagcagcagcugggccagguuc

SEQ ID NO: 1029440 - RNA, 20 nt, Human
uuuuccacuccucaaaacag

SEQ ID NO: 1029441 - RNA, 22 nt, Human
ggcuucuuagaauuugacuuac

SEQ ID NO: 1029442 - RNA, 22 nt, Human
ucuugccgcgcaggcgcaguuc

SEQ ID NO: 1029443 - RNA, 22 nt, Human
gcuagggagacuugugucauca

SEQ ID NO: 1029444 - RNA, 22 nt, Human
accaagaguccaagugagguug

SEQ ID NO: 1029445 - RNA, 21 nt, Human
ugcuuugcagguggauuuagu

SEQ ID NO: 1029446 - RNA, 22 nt, Human
gaaggcaagcagcauaaauguc

SEQ ID NO: 1029447 - RNA, 22 nt, Human
cuggagaggcugggaacagguu

SEQ ID NO: 1029448 - RNA, 20 nt, Human
cugcuccacccggcucucag

SEQ ID NO: 1029449 - RNA, 22 nt, Human
ugcugugcuggcggcagaggcc

SEQ ID NO: 1029450 - RNA, 22 nt, Human
gugcgccagcucaaggggaggc

SEQ ID NO: 1029451 - RNA, 22 nt, Human
cauuucaaacaguuacagcugc

SEQ ID NO: 1029452 - RNA, 22 nt, Human
ugaguccagaugggccagcagg

SEQ ID NO: 1029453 - RNA, 22 nt, Human
cuggaagcgucggaggaagggc

SEQ ID NO: 1029454 - RNA, 20 nt, Human
gugcccaguuggugacagac

SEQ ID NO: 1029455 - RNA, 22 nt, Human
acucgcggcggacggcggccag

SEQ ID NO: 1029456 - RNA, 22 nt, Human
gcugacugguucaggucccgcu

SEQ ID NO: 1029457 - RNA, 22 nt, Human
cuugucugcuauaaaaauccag

SEQ ID NO: 1029458 - RNA, 22 nt, Human
gcagcagcaggcgcucggccgu

SEQ ID NO: 1029459 - RNA, 22 nt, Human
ggacauggaaguauggagugga

SEQ ID NO: 1029460 - RNA, 22 nt, Human
gccggacugcugcagcugcuag

SEQ ID NO: 1029461 - RNA, 18 nt, Human
acagggagggcgcugggg

SEQ ID NO: 1029462 - RNA, 22 nt, Human
gugcuggcuggggcaucaggca

SEQ ID NO: 1029463 - RNA, 22 nt, Human
gccaggguggcagaaggcccca

SEQ ID NO: 1029464 - RNA, 22 nt, Human
ucugccaucaagaugcucuggc

SEQ ID NO: 1029465 - RNA, 22 nt, Human
guagaggggugauucugugaga

SEQ ID NO: 1029466 - RNA, 22 nt, Human
ugaggucuguccugucuuugga

SEQ ID NO: 1029467 - RNA, 22 nt, Human
gggagaguagcuggaagguucu

SEQ ID NO: 1029468 - RNA, 22 nt, Human
gcugcagugagccaagaucgug

SEQ ID NO: 1029469 - RNA, 21 nt, Human
ggagucagggucuggcugggg

SEQ ID NO: 1029470 - RNA, 22 nt, Human
cgcggucucuuuaaggcggguc

SEQ ID NO: 1029471 - RNA, 22 nt, Human
gcaggccugucuugcucgcccu

SEQ ID NO: 1029472 - RNA, 22 nt, Human
ugaguggacgugaggcugagua

SEQ ID NO: 1029473 - RNA, 22 nt, Human
cuugacacugucacucaggcca

SEQ ID NO: 1029474 - RNA, 22 nt, Human
cccugcuucccugggagaggcg

SEQ ID NO: 1029475 - RNA, 22 nt, Human
aggcuccaugguucucccucag

SEQ ID NO: 1029476 - RNA, 22 nt, Human
cauguguauuauucuuguggaa

SEQ ID NO: 1029477 - RNA, 22 nt, Human
cgugcagcggagcuggucacug

SEQ ID NO: 1029478 - RNA, 22 nt, Human
ggcgcaguugagcgugcuguuc

SEQ ID NO: 1029479 - RNA, 22 nt, Human
cagcaugaauguguucguaggg

SEQ ID NO: 1029480 - RNA, 22 nt, Human
cugagggccuucuaugcugagc

SEQ ID NO: 1029481 - RNA, 22 nt, Human
ucgggguagacgccagcucgga

SEQ ID NO: 1029482 - RNA, 22 nt, Human
ucaugcaccucuccaugucccc

SEQ ID NO: 1029483 - RNA, 20 nt, Human
uugagcuuuuaguacagaca

SEQ ID NO: 1029484 - RNA, 22 nt, Human
guggcaggagggcaucacuugg

SEQ ID NO: 1029485 - RNA, 22 nt, Human
aguguguccaggaagcagaugg

SEQ ID NO: 1029486 - RNA, 22 nt, Human
uggcucaucuuuuuagacuuau

SEQ ID NO: 1029487 - RNA, 22 nt, Human
agagccuguucggaggcgcccc

SEQ ID NO: 1029488 - RNA, 22 nt, Human
cccucucgcggggcagcggagg

SEQ ID NO: 1029489 - RNA, 22 nt, Human
gggagggucugagagcugcacc

SEQ ID NO: 1029490 - RNA, 22 nt, Human
gcccagcccagaaagguucgga

SEQ ID NO: 1029491 - RNA, 22 nt, Human
uacauggauguuauccuuacug

SEQ ID NO: 1029492 - RNA, 22 nt, Human
agcucuuuuaucaugaggagag

SEQ ID NO: 1029493 - RNA, 22 nt, Human
uccguggggccuguggcuuccg

SEQ ID NO: 1029494 - RNA, 22 nt, Human
ggcucucuuaacuggccauccu

SEQ ID NO: 1029495 - RNA, 19 nt, Human
agcucaggcccaucguccc

SEQ ID NO: 1029496 - RNA, 22 nt, Human
ggcucugcugguaagaugccuc

SEQ ID NO: 1029497 - RNA, 22 nt, Human
aucugccuggcuccaggugagc

SEQ ID NO: 1029498 - RNA, 22 nt, Human
acaggcgcacaugagggccgug

SEQ ID NO: 1029499 - RNA, 22 nt, Human
ugcugggauuacagucaugagc

SEQ ID NO: 1029500 - RNA, 22 nt, Human
uuccuuuucuucuaccacaugu

SEQ ID NO: 1029501 - RNA, 22 nt, Human
uccagcagguccgagacaaguu

SEQ ID NO: 1029502 - RNA, 20 nt, Human
gugcuaaguacugugaaggg

SEQ ID NO: 1029503 - RNA, 22 nt, Human
caugccugccuggugggcgugg

SEQ ID NO: 1029504 - RNA, 22 nt, Human
gagccucguggcggccacugcg

SEQ ID NO: 1029505 - RNA, 22 nt, Human
uguuccugacggccaaagaggu

SEQ ID NO: 1029506 - RNA, 21 nt, Human
agaugcaguuugcaggugggu

SEQ ID NO: 1029507 - RNA, 22 nt, Human
cccuugggcuucagcccuaccg

SEQ ID NO: 1029508 - RNA, 22 nt, Human
agaguguguggggcugagguca

SEQ ID NO: 1029509 - RNA, 22 nt, Human
uuucuucucacccaggacagag

SEQ ID NO: 1029510 - RNA, 22 nt, Human
ggcuauguguccagcaucuuug

SEQ ID NO: 1029511 - RNA, 22 nt, Human
aagucauugguagcuugauagg

SEQ ID NO: 1029512 - RNA, 22 nt, Human
gcacugggggcagcagugaggg

SEQ ID NO: 1029513 - RNA, 20 nt, Human
ccuggagccuggaaggaguc

SEQ ID NO: 1029514 - RNA, 22 nt, Human
gaggcaaagcauguggcucagg

SEQ ID NO: 1029515 - RNA, 22 nt, Human
caggucuucuucagcacuugga

SEQ ID NO: 1029516 - RNA, 22 nt, Human
aaggcacauauuuuagagucac

SEQ ID NO: 1029517 - RNA, 22 nt, Human
agcaggugucacuuucacucca

SEQ ID NO: 1029518 - RNA, 22 nt, Human
cagggcuccccagagagccucu

SEQ ID NO: 1029519 - RNA, 18 nt, Human
uacagcuugaguugacug

SEQ ID NO: 1029520 - RNA, 22 nt, Human
gaaguccgggaggaucauguuc

SEQ ID NO: 1029521 - RNA, 22 nt, Human
uauagcagcaugauuuauaguc

SEQ ID NO: 1029522 - RNA, 22 nt, Human
gcuguagguaaggauggcaaag

SEQ ID NO: 1029523 - RNA, 22 nt, Human
ugcugaggagguggcugugcuu

SEQ ID NO: 1029524 - RNA, 22 nt, Human
aaagcagaacugagagagcugg

SEQ ID NO: 1029525 - RNA, 22 nt, Human
guugcagcaucacugcugagug

SEQ ID NO: 1029526 - RNA, 22 nt, Human
ugccuggauggcucugagcagg

SEQ ID NO: 1029527 - RNA, 22 nt, Human
cgcugcgaggcgcccuuguugc

SEQ ID NO: 1029528 - RNA, 22 nt, Human
acagagccuccaggagugcugg

SEQ ID NO: 1029529 - RNA, 22 nt, Human
acgucuucguuggcagagauuu

SEQ ID NO: 1029530 - RNA, 22 nt, Human
ucucaguccaaaugagagguug

SEQ ID NO: 1029531 - RNA, 22 nt, Human
cuggagucggcgccccaacaga

SEQ ID NO: 1029532 - RNA, 22 nt, Human
cucagugcuuaguguguuuugg

SEQ ID NO: 1029533 - RNA, 22 nt, Human
cugcggcuggggacagcuguug

SEQ ID NO: 1029534 - RNA, 22 nt, Human
ccucuugauugguuggaagcgg

SEQ ID NO: 1029535 - RNA, 22 nt, Human
ccaugcagugcuggagcugauu

SEQ ID NO: 1029536 - RNA, 22 nt, Human
cagugccagcugcuuggccuac

SEQ ID NO: 1029537 - RNA, 21 nt, Human
ucagcuugcuucauuauuaug

SEQ ID NO: 1029538 - RNA, 19 nt, Human
aacuacagcgcacuguccu

SEQ ID NO: 1029539 - RNA, 22 nt, Human
acgcggugcggcaaguucaugg

SEQ ID NO: 1029540 - RNA, 22 nt, Human
ccugaggcccuggcugugcuga

SEQ ID NO: 1029541 - RNA, 22 nt, Human
caggcccuuuccugggcauagg

SEQ ID NO: 1029542 - RNA, 22 nt, Human
ucucugccacagcuucugccuu

SEQ ID NO: 1029543 - RNA, 21 nt, Human
ugcuggguuugcccaucaggc

SEQ ID NO: 1029544 - RNA, 22 nt, Human
cacagcuucuccccgcugcggc

SEQ ID NO: 1029545 - RNA, 22 nt, Human
agcacguucuucauuacuucac

SEQ ID NO: 1029546 - RNA, 22 nt, Human
gaagccaaguccucgaguuuca

SEQ ID NO: 1029547 - RNA, 22 nt, Human
ggugcccaaggaagguugccgu

SEQ ID NO: 1029548 - RNA, 22 nt, Human
uggcugagcugcagcguggcuu

SEQ ID NO: 1029549 - RNA, 22 nt, Human
agccuuacauaaacagccuuau

SEQ ID NO: 1029550 - RNA, 22 nt, Human
acguagcacugagagaugcagg

SEQ ID NO: 1029551 - RNA, 22 nt, Human
gccucugcacuguggcacacca

SEQ ID NO: 1029552 - RNA, 23 nt, Human
uccugcagauaagcugguugaca

SEQ ID NO: 1029553 - RNA, 22 nt, Human
acuuugccuucuuacuguguug

SEQ ID NO: 1029554 - RNA, 21 nt, Human
acagaagcggcgaguggcccc

SEQ ID NO: 1029555 - RNA, 22 nt, Human
gcagcccucuuggucacuaggc

SEQ ID NO: 1029556 - RNA, 22 nt, Human
cugcgggcugucaggcgugcca

SEQ ID NO: 1029557 - RNA, 22 nt, Human
uggcuuccagaacugagcaaca

SEQ ID NO: 1029558 - RNA, 22 nt, Human
uucaaacacugcuuugagaggg

SEQ ID NO: 1029559 - RNA, 23 nt, Human
agcccagcagagaaccuaggucc

SEQ ID NO: 1029560 - RNA, 22 nt, Human
ucaagcggacugagauacucug

SEQ ID NO: 1029561 - RNA, 22 nt, Human
caggccugugacaccgugucug

SEQ ID NO: 1029562 - RNA, 22 nt, Human
uccucuucaaaauagcucugaa

SEQ ID NO: 1029563 - RNA, 22 nt, Human
agucaggacagauuuucugggg

SEQ ID NO: 1029564 - RNA, 22 nt, Human
gaggcugugugucccucuggac

SEQ ID NO: 1029565 - RNA, 22 nt, Human
cucuagcucccagggagcgucu

SEQ ID NO: 1029566 - RNA, 18 nt, Human
gcugaaauucuaaacaaa

SEQ ID NO: 1029567 - RNA, 22 nt, Human
ggcagugaugucaaacagugaa

SEQ ID NO: 1029568 - RNA, 22 nt, Human
gcggggacagaaggcgguucuc

SEQ ID NO: 1029569 - RNA, 22 nt, Human
ccugucugaaggcagggggaug

SEQ ID NO: 1029570 - RNA, 22 nt, Human
cagggccagggcuauggugaag

SEQ ID NO: 1029571 - RNA, 22 nt, Human
ucuucaugucucugcuugaguc

SEQ ID NO: 1029572 - RNA, 23 nt, Human
ucuggcugcuccuuucaaugcuc

SEQ ID NO: 1029573 - RNA, 22 nt, Human
cagcuccaucuugcuuauacca

SEQ ID NO: 1029574 - RNA, 22 nt, Human
aguaacagguguacagacuauc

SEQ ID NO: 1029575 - RNA, 22 nt, Human
gguguggcaguggaccugugaa

SEQ ID NO: 1029576 - RNA, 22 nt, Human
ugugcuugucguggagccaggc

SEQ ID NO: 1029577 - RNA, 22 nt, Human
ggcggugguugagaggacggcg

SEQ ID NO: 1029578 - RNA, 22 nt, Human
acaguguuacuugauaguguau

SEQ ID NO: 1029579 - RNA, 22 nt, Human
ggaaggggagcuggaaagggua

SEQ ID NO: 1029580 - RNA, 22 nt, Human
caugucaagacugaagauccag

SEQ ID NO: 1029581 - RNA, 22 nt, Human
acaaaugcuuaguucaccaaaa

SEQ ID NO: 1029582 - RNA, 22 nt, Human
aagcccuuggcgcacaccgggc

SEQ ID NO: 1029583 - RNA, 22 nt, Human
cugaagcugggcacuuccuuuu

SEQ ID NO: 1029584 - RNA, 22 nt, Human
aacagauuguaaccugauagcc

SEQ ID NO: 1029585 - RNA, 22 nt, Human
gcaaggaagcagaguugcuauc

SEQ ID NO: 1029586 - RNA, 22 nt, Human
ggagaagggaacugaguuuuug

SEQ ID NO: 1029587 - RNA, 20 nt, Human
uccuccuugcagagcccaga

SEQ ID NO: 1029588 - RNA, 22 nt, Human
gagaacuugaacuuuuccucug

SEQ ID NO: 1029589 - RNA, 22 nt, Human
augcacaagguagauuauuauu

SEQ ID NO: 1029590 - RNA, 22 nt, Human
cucccagggucuaggcugcugg

SEQ ID NO: 1029591 - RNA, 22 nt, Human
uggcugagugaacauguccauu

SEQ ID NO: 1029592 - RNA, 22 nt, Human
ucaucuccauacggucucgcag

SEQ ID NO: 1029593 - RNA, 22 nt, Human
cauuuacauuuaagguuaauau

SEQ ID NO: 1029594 - RNA, 22 nt, Human
gccuguuucuccuccuuggccc

SEQ ID NO: 1029595 - RNA, 22 nt, Human
uggaaggggagcuggaaagggg

SEQ ID NO: 1029596 - RNA, 22 nt, Human
cuccgcuuguguauaccuccaa

SEQ ID NO: 1029597 - RNA, 22 nt, Human
ucaguccuuaucugguguucag

SEQ ID NO: 1029598 - RNA, 22 nt, Human
guaugucaugagccuugugcgu

SEQ ID NO: 1029599 - RNA, 22 nt, Human
guaguucuuucucaauguucaa

SEQ ID NO: 1029600 - RNA, 22 nt, Human
uggccuuggcagugagaagagu

SEQ ID NO: 1029601 - RNA, 22 nt, Human
aagcagcauaugacagcaucca

SEQ ID NO: 1029602 - RNA, 22 nt, Human
guggcccaggcuuggcgcuggc

SEQ ID NO: 1029603 - RNA, 22 nt, Human
gccggucuuaagcugacuguga

SEQ ID NO: 1029604 - RNA, 22 nt, Human
gccggggcuggggagagacaug

SEQ ID NO: 1029605 - RNA, 23 nt, Human
gguucugccgcuuacugcugugc

SEQ ID NO: 1029606 - RNA, 22 nt, Human
ugccucugcugcauauucaccu

SEQ ID NO: 1029607 - RNA, 22 nt, Human
guagcccaccuggggagggcga

SEQ ID NO: 1029608 - RNA, 22 nt, Human
cgugcggccucggggcccggcu

SEQ ID NO: 1029609 - RNA, 22 nt, Human
uggaagggguuacgcagcagga

SEQ ID NO: 1029610 - RNA, 22 nt, Human
aguggguguagucuuccuccug

SEQ ID NO: 1029611 - RNA, 22 nt, Human
gcagccuccgcacugcgagucc

SEQ ID NO: 1029612 - RNA, 22 nt, Human
ucacaguucaacuaguucagau

SEQ ID NO: 1029613 - RNA, 22 nt, Human
cagccggaccugagggauuccu

SEQ ID NO: 1029614 - RNA, 22 nt, Human
ccuggccgacauggugaaacgc

SEQ ID NO: 1029615 - RNA, 22 nt, Human
uagcaggacaugugcagagaag

SEQ ID NO: 1029616 - RNA, 22 nt, Human
gggagcugagcuggaagagaau

SEQ ID NO: 1029617 - RNA, 22 nt, Human
ggagccaguuuagaccucaguu

SEQ ID NO: 1029618 - RNA, 22 nt, Human
auggcucugcugggcaaagcaa

SEQ ID NO: 1029619 - RNA, 22 nt, Human
ccuguggcacaugcagggauuc

SEQ ID NO: 1029620 - RNA, 21 nt, Human
ucgaccugcugggcucgggcu

SEQ ID NO: 1029621 - RNA, 22 nt, Human
guggccaaggcagagaaagagc

SEQ ID NO: 1029622 - RNA, 22 nt, Human
cacagcuaccugcaugccugcu

SEQ ID NO: 1029623 - RNA, 22 nt, Human
gcaugagacuagcucaugagca

SEQ ID NO: 1029624 - RNA, 22 nt, Human
gugcaggacagcacaucuccug

SEQ ID NO: 1029625 - RNA, 22 nt, Human
ucggugcgcgaggcgcgguccc

SEQ ID NO: 1029626 - RNA, 22 nt, Human
gugaccaucaucucagcuaguu

SEQ ID NO: 1029627 - RNA, 22 nt, Human
ggaccugaacauaaaacgaggc

SEQ ID NO: 1029628 - RNA, 22 nt, Human
cagguagaggcugccaucagcu

SEQ ID NO: 1029629 - RNA, 22 nt, Human
ugacagcccaccucacaggauu

SEQ ID NO: 1029630 - RNA, 22 nt, Human
caugaccagagaggacggccag

SEQ ID NO: 1029631 - RNA, 22 nt, Human
uuguugcaagccuggaaucugg

SEQ ID NO: 1029632 - RNA, 22 nt, Human
cgcugccuucaucccacgccua

SEQ ID NO: 1029633 - RNA, 22 nt, Human
cagggucuuggcgccaucaccc

SEQ ID NO: 1029634 - RNA, 22 nt, Human
cugacagcgagagaguugcccc

SEQ ID NO: 1029635 - RNA, 20 nt, Human
ggggcccaagcccucuugcc

SEQ ID NO: 1029636 - RNA, 22 nt, Human
gcuucuggugaggccucaggaa

SEQ ID NO: 1029637 - RNA, 22 nt, Human
cccuggcucaggcagcuuuguu

SEQ ID NO: 1029638 - RNA, 22 nt, Human
gugcucuagaaauugucagugg

SEQ ID NO: 1029639 - RNA, 22 nt, Human
gugccugguuuggggaauguuc

SEQ ID NO: 1029640 - RNA, 22 nt, Human
ccugcgggcugugcugaagccu

SEQ ID NO: 1029641 - RNA, 18 nt, Human
uaaguggacacaggucac

SEQ ID NO: 1029642 - RNA, 22 nt, Human
aaaggugccucuuacaaggcuu

SEQ ID NO: 1029643 - RNA, 22 nt, Human
auccuugaaugacucugcccuc

SEQ ID NO: 1029644 - RNA, 22 nt, Human
uacagcagcccaccuucuucug

SEQ ID NO: 1029645 - RNA, 19 nt, Human
cgcacagccugccaggcgc

SEQ ID NO: 1029646 - RNA, 22 nt, Human
cggcgcaggcagaccgcgggcu

SEQ ID NO: 1029647 - RNA, 20 nt, Human
caacacugcccauuguuugc

SEQ ID NO: 1029648 - RNA, 22 nt, Human
ucugagggauuugucccuuauc

SEQ ID NO: 1029649 - RNA, 22 nt, Human
ucagacaccgucuauuuugccu

SEQ ID NO: 1029650 - RNA, 22 nt, Human
aggguccugggugcaguugcuu

SEQ ID NO: 1029651 - RNA, 22 nt, Human
uugcugccuuuguacucugaug

SEQ ID NO: 1029652 - RNA, 22 nt, Human
ugcagggcagcuagggagcuuu

SEQ ID NO: 1029653 - RNA, 20 nt, Human
cuguuugcuaucaugagcug

SEQ ID NO: 1029654 - RNA, 22 nt, Human
ucugaggcugaauggacuccgu

SEQ ID NO: 1029655 - RNA, 22 nt, Human
agcccuugguauuuuccgaucc

SEQ ID NO: 1029656 - RNA, 22 nt, Human
cggcuggagcugagaaaggagc

SEQ ID NO: 1029657 - RNA, 22 nt, Human
gaggagaggcuggacgcgguga

SEQ ID NO: 1029658 - RNA, 22 nt, Human
ucaggaugagucaucaagcugc

SEQ ID NO: 1029659 - RNA, 22 nt, Human
uccaggagggggagccgugccg

SEQ ID NO: 1029660 - RNA, 22 nt, Human
cucucugggcccaguuggcacc

SEQ ID NO: 1029661 - RNA, 22 nt, Human
cuggagaacagagcuguuuaga

SEQ ID NO: 1029662 - RNA, 22 nt, Human
uggcagcagggccccuggagga

SEQ ID NO: 1029663 - RNA, 22 nt, Human
uuggaggaagcucaugggggau

SEQ ID NO: 1029664 - RNA, 22 nt, Human
ggagagagaccuccaugcccag

SEQ ID NO: 1029665 - RNA, 21 nt, Human
ccuggagacaaagacagggug

SEQ ID NO: 1029666 - RNA, 22 nt, Human
ggaagcaaauuccagaaccaca

SEQ ID NO: 1029667 - RNA, 22 nt, Human
gcccagggcugcaaguggacgc

SEQ ID NO: 1029668 - RNA, 15 nt, Human
agcucuuucagcuac

SEQ ID NO: 1029669 - RNA, 21 nt, Human
acucaucuuuuuggagaccag

SEQ ID NO: 1029670 - RNA, 22 nt, Human
cuggcaguguccagcucgugau

SEQ ID NO: 1029671 - RNA, 22 nt, Human
ccacugcuaacuugcugcagcu

SEQ ID NO: 1029672 - RNA, 22 nt, Human
uuuugguaauuaaguagauauu

SEQ ID NO: 1029673 - RNA, 22 nt, Human
cuccguggcuguggacgcagcc

SEQ ID NO: 1029674 - RNA, 22 nt, Human
auuggccagacuuauccuucag

SEQ ID NO: 1029675 - RNA, 22 nt, Human
gcugccauggcugggggccgug

SEQ ID NO: 1029676 - RNA, 22 nt, Human
uugacguccucgauggggaacu

SEQ ID NO: 1029677 - RNA, 22 nt, Human
ggccgugcuccaaagucaucgu

SEQ ID NO: 1029678 - RNA, 21 nt, Human
agccugcaauguagguaccgg

SEQ ID NO: 1029679 - RNA, 22 nt, Human
ggugggucuuguggggcagcuu

SEQ ID NO: 1029680 - RNA, 21 nt, Human
gcuguucggcggcccucgcgc

SEQ ID NO: 1029681 - RNA, 21 nt, Human
ucaggaagagccaguucaugc

SEQ ID NO: 1029682 - RNA, 22 nt, Human
guugggcugaagugugugcuua

SEQ ID NO: 1029683 - RNA, 22 nt, Human
gagugccuuccccaugcuuugg

SEQ ID NO: 1029684 - RNA, 22 nt, Human
ucaccggcagacguggccugau

SEQ ID NO: 1029685 - RNA, 22 nt, Human
gcaguggccacauggaggagga

SEQ ID NO: 1029686 - RNA, 22 nt, Human
ugagacaaagcagcugacagaa

SEQ ID NO: 1029687 - RNA, 22 nt, Human
gcagggcugauggcuucccuca

SEQ ID NO: 1029688 - RNA, 22 nt, Human
uuccuguucaggaaaguugugu

SEQ ID NO: 1029689 - RNA, 19 nt, Human
augggaagcggccagcgga

SEQ ID NO: 1029690 - RNA, 22 nt, Human
aucaagggcgcgugguucggcg

SEQ ID NO: 1029691 - RNA, 22 nt, Human
acccggagucggagguugcagu

SEQ ID NO: 1029692 - RNA, 22 nt, Human
uggccugauuuugcuaagagaa

SEQ ID NO: 1029693 - RNA, 22 nt, Human
ccuuuguucacuggagagugga

SEQ ID NO: 1029694 - RNA, 22 nt, Human
cuggccuggcaggggaccucua

SEQ ID NO: 1029695 - RNA, 22 nt, Human
ugucauggacuggauuucugcu

SEQ ID NO: 1029696 - RNA, 22 nt, Human
gugaagcacaugggcguugggu

SEQ ID NO: 1029697 - RNA, 22 nt, Human
gcagcugcgaagaagucuaucu

SEQ ID NO: 1029698 - RNA, 22 nt, Human
gaaccuggcagcccuauaucug

SEQ ID NO: 1029699 - RNA, 22 nt, Human
cgcagcuucagggccaggaggg

SEQ ID NO: 1029700 - RNA, 22 nt, Human
caggaggaaaguuccacucaac

SEQ ID NO: 1029701 - RNA, 22 nt, Human
aaagcacauuacaagcucaguc

SEQ ID NO: 1029702 - RNA, 22 nt, Human
cgggcacucagggucgaggugg

SEQ ID NO: 1029703 - RNA, 22 nt, Human
cuacuucuguggcucuaagaga

SEQ ID NO: 1029704 - RNA, 22 nt, Human
uguggaagaacuucuugcuugg

SEQ ID NO: 1029705 - RNA, 22 nt, Human
gagaggaagccuucuguacuug

SEQ ID NO: 1029706 - RNA, 19 nt, Human
agcaguggagccaugccug

SEQ ID NO: 1029707 - RNA, 22 nt, Human
cuugaugaaugaccuggguggu

SEQ ID NO: 1029708 - RNA, 23 nt, Human
guuauugcuggugcuggccagcc

SEQ ID NO: 1029709 - RNA, 22 nt, Human
uggccuuggucacaaugcaaac

SEQ ID NO: 1029710 - RNA, 22 nt, Human
agcauggcuuuggaggauagca

SEQ ID NO: 1029711 - RNA, 22 nt, Human
cugggagaugacucagagcagg

SEQ ID NO: 1029712 - RNA, 22 nt, Human
augggucccuggccgcccucgg

SEQ ID NO: 1029713 - RNA, 22 nt, Human
aagcgcagacacagagagugga

SEQ ID NO: 1029714 - RNA, 22 nt, Human
ugccagcaguagcaguaggcca

SEQ ID NO: 1029715 - RNA, 22 nt, Human
uccaggcuccccugcgugcucc

SEQ ID NO: 1029716 - RNA, 22 nt, Human
auacaugugugugcauacaugu

SEQ ID NO: 1029717 - RNA, 22 nt, Human
cuucacaaaauauuucauuaua

SEQ ID NO: 1029718 - RNA, 22 nt, Human
ucgggacgguggcauuugugcc

SEQ ID NO: 1029719 - RNA, 22 nt, Human
ggccucugccccgcggggcucg

SEQ ID NO: 1029720 - RNA, 22 nt, Human
uaggccacagagaggagauuuc

SEQ ID NO: 1029721 - RNA, 22 nt, Human
uuccuggcagaggccccgacag

SEQ ID NO: 1029722 - RNA, 22 nt, Human
cgucauuuguaaaugaucaaga

SEQ ID NO: 1029723 - RNA, 22 nt, Human
aggugcugccccgagaaggaug

SEQ ID NO: 1029724 - RNA, 22 nt, Human
gcccagcugagaagcgcggggc

SEQ ID NO: 1029725 - RNA, 23 nt, Human
ugucuccaucucauuacuugggg

SEQ ID NO: 1029726 - RNA, 22 nt, Human
uuguacacacaggaacaaacgu

SEQ ID NO: 1029727 - RNA, 18 nt, Human
ucugagggugcgggagcu

SEQ ID NO: 1029728 - RNA, 22 nt, Human
gcaggggcugagcaccagcggg

SEQ ID NO: 1029729 - RNA, 22 nt, Human
gugggccugaugcugccaugag

SEQ ID NO: 1029730 - RNA, 22 nt, Human
ggcacuggcaaagcaaagucug

SEQ ID NO: 1029731 - RNA, 22 nt, Human
uggcuccacaggccagggugug

SEQ ID NO: 1029732 - RNA, 22 nt, Human
ccaggaggaaagaccagcccau

SEQ ID NO: 1029733 - RNA, 21 nt, Human
acucugaaaauuaauaguuau

SEQ ID NO: 1029734 - RNA, 22 nt, Human
ccaggcccugcuccucacacca

SEQ ID NO: 1029735 - RNA, 22 nt, Human
gcccucugccacaggacgccag

SEQ ID NO: 1029736 - RNA, 22 nt, Human
ugcuccaucuagagcucugcag

SEQ ID NO: 1029737 - RNA, 22 nt, Human
acagcaucccugaagauaacca

SEQ ID NO: 1029738 - RNA, 22 nt, Human
ugccuguggaaaggcuggugcu

SEQ ID NO: 1029739 - RNA, 19 nt, Human
uuuaaugugugcugcaauc

SEQ ID NO: 1029740 - RNA, 22 nt, Human
uugaugagaccauugccgcguc

SEQ ID NO: 1029741 - RNA, 22 nt, Human
aggcuguccucucuugcucagu

SEQ ID NO: 1029742 - RNA, 21 nt, Human
gcuggcugucucuuacacggu

SEQ ID NO: 1029743 - RNA, 22 nt, Human
gaggagcuucagaggaaucuua

SEQ ID NO: 1029744 - RNA, 22 nt, Human
cuccuucacgcaggcugccaug

SEQ ID NO: 1029745 - RNA, 22 nt, Human
cagacaggguccuguccgucac

SEQ ID NO: 1029746 - RNA, 22 nt, Human
uggaagggagcuggaauuugga

SEQ ID NO: 1029747 - RNA, 22 nt, Human
caugcaugccgggcugacagag

SEQ ID NO: 1029748 - RNA, 22 nt, Human
ggcucuccacuauggaugagaa

SEQ ID NO: 1029749 - RNA, 22 nt, Human
cagcgguggcaaggugacugug

SEQ ID NO: 1029750 - RNA, 22 nt, Human
uguuccucugaacuucuuccaa

SEQ ID NO: 1029751 - RNA, 22 nt, Human
uacauguacaugcauagguaga

SEQ ID NO: 1029752 - RNA, 22 nt, Human
uuucuagguguucacagagcau

SEQ ID NO: 1029753 - RNA, 22 nt, Human
aaaggagacuucagaucuccuu

SEQ ID NO: 1029754 - RNA, 22 nt, Human
ugggagcaagcuggugcuggag

SEQ ID NO: 1029755 - RNA, 22 nt, Human
uccaggagugauaaggccacug

SEQ ID NO: 1029756 - RNA, 22 nt, Human
guccguaguggcugaugcuuug

SEQ ID NO: 1029757 - RNA, 22 nt, Human
gagcucagccugaggccuggcu

SEQ ID NO: 1029758 - RNA, 21 nt, Human
cuggagcuuggugagaagugu

SEQ ID NO: 1029759 - RNA, 22 nt, Human
ggaaugugcugacacgcgagag

SEQ ID NO: 1029760 - RNA, 22 nt, Human
guccaggccugccucugaggag

SEQ ID NO: 1029761 - RNA, 22 nt, Human
augcaggaagagcccuggagcu

SEQ ID NO: 1029762 - RNA, 22 nt, Human
aucauuaacccuugaugcuggg

SEQ ID NO: 1029763 - RNA, 22 nt, Human
agcgggucugcaagccuucccu

SEQ ID NO: 1029764 - RNA, 20 nt, Human
gggcucugcauccaucagcc

SEQ ID NO: 1029765 - RNA, 22 nt, Human
gguuguaguuggagguuguaua

SEQ ID NO: 1029766 - RNA, 22 nt, Human
cggcagagcccugagucagccu

SEQ ID NO: 1029767 - RNA, 22 nt, Human
cgccaguggcagcuggaacagg

SEQ ID NO: 1029768 - RNA, 22 nt, Human
agguuuggguucauugcuggcu

SEQ ID NO: 1029769 - RNA, 18 nt, Human
agcugaggggacugaaga

SEQ ID NO: 1029770 - RNA, 22 nt, Human
ccagcuggcccagcugugcucc

SEQ ID NO: 1029771 - RNA, 22 nt, Human
ccagcagcucccucaggguccg

SEQ ID NO: 1029772 - RNA, 22 nt, Human
augcuugaaaguuauuucauuu

SEQ ID NO: 1029773 - RNA, 22 nt, Human
ccccacaccugccgggcagcag

SEQ ID NO: 1029774 - RNA, 22 nt, Human
ggcagcagaacuggcccuguau

SEQ ID NO: 1029775 - RNA, 22 nt, Human
gccccuucguggaagugcauuc

SEQ ID NO: 1029776 - RNA, 22 nt, Human
augccccagugugugcuuccuu

SEQ ID NO: 1029777 - RNA, 23 nt, Human
uggcuugcuaauguuccaaauaa

SEQ ID NO: 1029778 - RNA, 22 nt, Human
aguggcaguagaugagcugguu

SEQ ID NO: 1029779 - RNA, 22 nt, Human
gagccacaguggauugauucca

SEQ ID NO: 1029780 - RNA, 22 nt, Human
ggagcugcucagagccaguccc

SEQ ID NO: 1029781 - RNA, 22 nt, Human
gguggcaccuuacccugcgcag

SEQ ID NO: 1029782 - RNA, 22 nt, Human
agaggcucuuugagcugggaga

SEQ ID NO: 1029783 - RNA, 23 nt, Human
ggaagcucacguaguccugcacu

SEQ ID NO: 1029784 - RNA, 22 nt, Human
acuucacagauauuuauuuggu

SEQ ID NO: 1029785 - RNA, 22 nt, Human
gccugagauucccggagccgug

SEQ ID NO: 1029786 - RNA, 22 nt, Human
agccagcauauauauaguugaa

SEQ ID NO: 1029787 - RNA, 22 nt, Human
ucugcucagccgaucugcuccg

SEQ ID NO: 1029788 - RNA, 22 nt, Human
cuagcagcauucuucuaguuag

SEQ ID NO: 1029789 - RNA, 22 nt, Human
cagcugcuguucaguuuuguuu

SEQ ID NO: 1029790 - RNA, 22 nt, Human
ucuacaacgugguuuuguugua

SEQ ID NO: 1029791 - RNA, 22 nt, Human
cuuugugauaguguuaagacca

SEQ ID NO: 1029792 - RNA, 17 nt, Human
ucuccuggcucuaucag

SEQ ID NO: 1029793 - RNA, 22 nt, Human
ugugcucagucuuuggcuggga

SEQ ID NO: 1029794 - RNA, 22 nt, Human
ugugaacuggcagguggacggg

SEQ ID NO: 1029795 - RNA, 22 nt, Human
gaauaauugugaugcuugaagu

SEQ ID NO: 1029796 - RNA, 22 nt, Human
gacuuugccacuugcuccagcu

SEQ ID NO: 1029797 - RNA, 22 nt, Human
agggcuccuaugccccauggac

SEQ ID NO: 1029798 - RNA, 22 nt, Human
gccacccuggacgcacuguucg

SEQ ID NO: 1029799 - RNA, 22 nt, Human
cagaccagccauuugccucuuc

SEQ ID NO: 1029800 - RNA, 22 nt, Human
gaagguuuuguuugcaaaucau

SEQ ID NO: 1029801 - RNA, 22 nt, Human
ucugcuugugucuguccagccu

SEQ ID NO: 1029802 - RNA, 21 nt, Human
uaagccaccaugugaaaccag

SEQ ID NO: 1029803 - RNA, 22 nt, Human
acgugcaggaucugguuggcga

SEQ ID NO: 1029804 - RNA, 22 nt, Human
gaaccuguccugagugaggagu

SEQ ID NO: 1029805 - RNA, 22 nt, Human
gucguucucugccagggcguug

SEQ ID NO: 1029806 - RNA, 19 nt, Human
ugcuugccugccuuuccca

SEQ ID NO: 1029807 - RNA, 22 nt, Human
gccagguaugaauuacgcacga

SEQ ID NO: 1029808 - RNA, 22 nt, Human
caaagaagagauuuacagagcu

SEQ ID NO: 1029809 - RNA, 22 nt, Human
gcuacaggggucaguccuuugc

SEQ ID NO: 1029810 - RNA, 23 nt, Human
agcaacagugggugaguguugcu

SEQ ID NO: 1029811 - RNA, 22 nt, Human
ccagacuggggcuccuugaggg

SEQ ID NO: 1029812 - RNA, 22 nt, Human
ccucaaaggccuggcaccagaa

SEQ ID NO: 1029813 - RNA, 22 nt, Human
gagggcugccacguugggcgag

SEQ ID NO: 1029814 - RNA, 22 nt, Human
ugaggaggugggcacacagagu

SEQ ID NO: 1029815 - RNA, 22 nt, Human
cagcccuugcgacacccuggcu

SEQ ID NO: 1029816 - RNA, 22 nt, Human
uuuguguuguacuucugugcau

SEQ ID NO: 1029817 - RNA, 22 nt, Human
cuuuacuucagcaagcuuuccu

SEQ ID NO: 1029818 - RNA, 22 nt, Human
gcagagcuggaacugguacuca

SEQ ID NO: 1029819 - RNA, 22 nt, Human
agcaggccugccaccucggggu

SEQ ID NO: 1029820 - RNA, 22 nt, Human
ccaggacacgauuuuuagucug

SEQ ID NO: 1029821 - RNA, 23 nt, Human
acacauguuuaugcuugggggca

SEQ ID NO: 1029822 - RNA, 22 nt, Human
ggcagguguggugaccagagau

SEQ ID NO: 1029823 - RNA, 22 nt, Human
gguccagcacaacacuggcaug

SEQ ID NO: 1029824 - RNA, 22 nt, Human
uuggggaagcuuugaaauacuu

SEQ ID NO: 1029825 - RNA, 20 nt, Human
ggcagagcuaugucuguugc

SEQ ID NO: 1029826 - RNA, 22 nt, Human
uuucgggaaaaacugguaagac

SEQ ID NO: 1029827 - RNA, 22 nt, Human
cagcuccagcccaggcagcucc

SEQ ID NO: 1029828 - RNA, 21 nt, Human
gggcuggauauuggaaagagg

SEQ ID NO: 1029829 - RNA, 22 nt, Human
gcagaagcccggucagcgcacg

SEQ ID NO: 1029830 - RNA, 22 nt, Human
ucccagaacccugccagguccu

SEQ ID NO: 1029831 - RNA, 22 nt, Human
acaugcacccaguuacacucuc

SEQ ID NO: 1029832 - RNA, 22 nt, Human
uggcagccugcgugaaggagcu

SEQ ID NO: 1029833 - RNA, 22 nt, Human
ccugcacuaccuggggcugcug

SEQ ID NO: 1029834 - RNA, 22 nt, Human
ucccuguccugggcaaucccag

SEQ ID NO: 1029835 - RNA, 22 nt, Human
gagcaccgccuccacgaugccc

SEQ ID NO: 1029836 - RNA, 22 nt, Human
ggaccugcucucccaguucucu

SEQ ID NO: 1029837 - RNA, 22 nt, Human
ugggaagaguuagagacagcug

SEQ ID NO: 1029838 - RNA, 22 nt, Human
gugcaugucuuuggaggccucc

SEQ ID NO: 1029839 - RNA, 22 nt, Human
uuggaggacuaguuaagagacc

SEQ ID NO: 1029840 - RNA, 19 nt, Human
uucacuaggucacaagguc

SEQ ID NO: 1029841 - RNA, 18 nt, Human
cccacggugcuguagggc

SEQ ID NO: 1029842 - RNA, 22 nt, Human
gucccugauaagagccaucgau

SEQ ID NO: 1029843 - RNA, 22 nt, Human
ugguaugcuuauuaucuucaac

SEQ ID NO: 1029844 - RNA, 22 nt, Human
cuugccaguguugcagaagcuc

SEQ ID NO: 1029845 - RNA, 22 nt, Human
aggccugggacgggagccguga

SEQ ID NO: 1029846 - RNA, 22 nt, Human
gggcucuguuuagaccagagau

SEQ ID NO: 1029847 - RNA, 22 nt, Human
ugagcaccaggcaccacagcuc

SEQ ID NO: 1029848 - RNA, 22 nt, Human
ggggaccuuuccauuucugaga

SEQ ID NO: 1029849 - RNA, 22 nt, Human
gcugguggcagagcuccgcggc

SEQ ID NO: 1029850 - RNA, 16 nt, Human
aggagcuggguaggag

SEQ ID NO: 1029851 - RNA, 22 nt, Human
cuguucccgguggccgggccag

SEQ ID NO: 1029852 - RNA, 22 nt, Human
gaaagcagaugaaauugcaaca

SEQ ID NO: 1029853 - RNA, 22 nt, Human
gggaccuggacaugugugugcu

SEQ ID NO: 1029854 - RNA, 22 nt, Human
ggcagaggagcuggaaacaugg

SEQ ID NO: 1029855 - RNA, 21 nt, Human
uccugcugagaaacagauggu

SEQ ID NO: 1029856 - RNA, 22 nt, Human
gacagcagccacagggagaggg

SEQ ID NO: 1029857 - RNA, 22 nt, Human
ggccuugggauguggcugcagc

SEQ ID NO: 1029858 - RNA, 22 nt, Human
gcggagaggcagagacuccgcg

SEQ ID NO: 1029859 - RNA, 22 nt, Human
gcagcagcggggccccugcgcg

SEQ ID NO: 1029860 - RNA, 22 nt, Human
cugcuguguggauucaauggcu

SEQ ID NO: 1029861 - RNA, 19 nt, Human
ugguucuccuuccacaguc

SEQ ID NO: 1029862 - RNA, 22 nt, Human
ugccauagcaaugguaagcuga

SEQ ID NO: 1029863 - RNA, 22 nt, Human
ggcagccuccagggcacuggug

SEQ ID NO: 1029864 - RNA, 21 nt, Human
agaugcagugacccacugggg

SEQ ID NO: 1029865 - RNA, 22 nt, Human
cuggugcuguagccugauugag

SEQ ID NO: 1029866 - RNA, 22 nt, Human
ccugguguuaucauaggucaug

SEQ ID NO: 1029867 - RNA, 22 nt, Human
guuggcuaugagagcuuuagug

SEQ ID NO: 1029868 - RNA, 22 nt, Human
gaugucuggcuaccacucgcac

SEQ ID NO: 1029869 - RNA, 22 nt, Human
guacuuucaggcuuucccuuaa

SEQ ID NO: 1029870 - RNA, 22 nt, Human
ccaggaaguaugacccaacaga

SEQ ID NO: 1029871 - RNA, 22 nt, Human
uucuccccgucucucugaggcc

SEQ ID NO: 1029872 - RNA, 22 nt, Human
agaacaggaggaagccagcucc

SEQ ID NO: 1029873 - RNA, 22 nt, Human
cagagcugagucuucaagguug

SEQ ID NO: 1029874 - RNA, 22 nt, Human
uuccggacgcccgucuuccagc

SEQ ID NO: 1029875 - RNA, 23 nt, Human
uggugggcccugcuugcucacug

SEQ ID NO: 1029876 - RNA, 22 nt, Human
cagcauggagacaaagugggca

SEQ ID NO: 1029877 - RNA, 22 nt, Human
ccaggcuccccaggaggcccuu

SEQ ID NO: 1029878 - RNA, 22 nt, Human
gcugcaagugcauguugcaacu

SEQ ID NO: 1029879 - RNA, 22 nt, Human
uggagugcaguugggaggacac

SEQ ID NO: 1029880 - RNA, 22 nt, Human
uuguugcugcucaaccucuaua

SEQ ID NO: 1029881 - RNA, 22 nt, Human
ugguccugagcaccagccugac

SEQ ID NO: 1029882 - RNA, 22 nt, Human
uggcugaggucuggggcuucug

SEQ ID NO: 1029883 - RNA, 22 nt, Human
ccagcagccaccuucucgaaau

SEQ ID NO: 1029884 - RNA, 22 nt, Human
cugagcaugcuacaugcagcac

SEQ ID NO: 1029885 - RNA, 22 nt, Human
ugccgcgcgcccagguuaggug

SEQ ID NO: 1029886 - RNA, 20 nt, Human
cagcucugggcaggucgagg

SEQ ID NO: 1029887 - RNA, 22 nt, Human
agucauguguucaucuuucauu

SEQ ID NO: 1029888 - RNA, 22 nt, Human
guggcuaggcccaacggcagga

SEQ ID NO: 1029889 - RNA, 22 nt, Human
cuccaggacugaggacagagcu

SEQ ID NO: 1029890 - RNA, 22 nt, Human
gcagcaaucuucacagugucau

SEQ ID NO: 1029891 - RNA, 22 nt, Human
cagagcugacccaaggauugaa

SEQ ID NO: 1029892 - RNA, 22 nt, Human
ggcaagagggcagauggagugc

SEQ ID NO: 1029893 - RNA, 22 nt, Human
aaggggaguuagugauaaaacc

SEQ ID NO: 1029894 - RNA, 22 nt, Human
ccugugcuucacucaacaagcc

SEQ ID NO: 1029895 - RNA, 22 nt, Human
aggccaagcucccagagaagcu

SEQ ID NO: 1029896 - RNA, 22 nt, Human
uucccuggugggugagaaccug

SEQ ID NO: 1029897 - RNA, 22 nt, Human
cagggccugccugguuccugga

SEQ ID NO: 1029898 - RNA, 22 nt, Human
aaucuucaggguccuggggcuc

SEQ ID NO: 1029899 - RNA, 23 nt, Human
uggcucuguggaucccucaggag

SEQ ID NO: 1029900 - RNA, 22 nt, Human
guaggggccagaaagacuuaga

SEQ ID NO: 1029901 - RNA, 22 nt, Human
cuacagcuguguguuuaugugc

SEQ ID NO: 1029902 - RNA, 22 nt, Human
gggcccugcgacucgcggcgga

SEQ ID NO: 1029903 - RNA, 22 nt, Human
ccuccugggccuugcucuguga

SEQ ID NO: 1029904 - RNA, 22 nt, Human
guucuucaggcugugcucuaga

SEQ ID NO: 1029905 - RNA, 22 nt, Human
augcggagccccaagcuugaag

SEQ ID NO: 1029906 - RNA, 22 nt, Human
uucucaggaacucagugucagc

SEQ ID NO: 1029907 - RNA, 22 nt, Human
cuucauuucaggcugaagaaua

SEQ ID NO: 1029908 - RNA, 20 nt, Human
ucugugugccaucaccuaac

SEQ ID NO: 1029909 - RNA, 22 nt, Human
gccugcuggcuggaaauucucc

SEQ ID NO: 1029910 - RNA, 17 nt, Human
gagguaggaagugaguc

SEQ ID NO: 1029911 - RNA, 19 nt, Human
ucuuucauuucuagcucug

SEQ ID NO: 1029912 - RNA, 22 nt, Human
ugaggacauuuaucuuggcgca

SEQ ID NO: 1029913 - RNA, 22 nt, Human
ugccaggcugcccuccagucug

SEQ ID NO: 1029914 - RNA, 22 nt, Human
aucacuagaguuacauugccag

SEQ ID NO: 1029915 - RNA, 22 nt, Human
auucuugauauagauaguuaau

SEQ ID NO: 1029916 - RNA, 22 nt, Human
ucucagucuuugcaaggaugcu

SEQ ID NO: 1029917 - RNA, 22 nt, Human
ugagcagacuugaugaggcagc

SEQ ID NO: 1029918 - RNA, 22 nt, Human
agggagcauugugacauaucac

SEQ ID NO: 1029919 - RNA, 22 nt, Human
caggugggagccacagcguaca

SEQ ID NO: 1029920 - RNA, 22 nt, Human
cagguugaaaguggaggagcua

SEQ ID NO: 1029921 - RNA, 22 nt, Human
uccgggagcugaacgucuugcg

SEQ ID NO: 1029922 - RNA, 22 nt, Human
acagagacaauauuuguaaagu

SEQ ID NO: 1029923 - RNA, 22 nt, Human
ccaggcagccugcuccauucug

SEQ ID NO: 1029924 - RNA, 22 nt, Human
acugcacuccagcccgagcaac

SEQ ID NO: 1029925 - RNA, 22 nt, Human
ucucucugcagcccgggacacu

SEQ ID NO: 1029926 - RNA, 22 nt, Human
ccugugggagggagcggcugga

SEQ ID NO: 1029927 - RNA, 18 nt, Human
ugugccucugcaggacgu

SEQ ID NO: 1029928 - RNA, 22 nt, Human
cuucaugcugauauccucgaug

SEQ ID NO: 1029929 - RNA, 22 nt, Human
gugccuccaggcucgacuaguc

SEQ ID NO: 1029930 - RNA, 22 nt, Human
gcacagcuaugagcugaauugu

SEQ ID NO: 1029931 - RNA, 22 nt, Human
uugaggucuucaggaucaggcu

SEQ ID NO: 1029932 - RNA, 22 nt, Human
ccaggccuguguuguguggagg

SEQ ID NO: 1029933 - RNA, 22 nt, Human
ugggugguugcugaggcuccuu

SEQ ID NO: 1029934 - RNA, 22 nt, Human
ugacaagagaccccuccgcagg

SEQ ID NO: 1029935 - RNA, 22 nt, Human
uccccaguaagccugcacugug

SEQ ID NO: 1029936 - RNA, 22 nt, Human
uccugugccuccaccugcuccg

SEQ ID NO: 1029937 - RNA, 22 nt, Human
uugcaggucuggggguccuggu

SEQ ID NO: 1029938 - RNA, 22 nt, Human
ccuggccuccuggccuucucau

SEQ ID NO: 1029939 - RNA, 22 nt, Human
aacccgggagguggagguuaug

SEQ ID NO: 1029940 - RNA, 22 nt, Human
gucaggaugagggaugaggagu

SEQ ID NO: 1029941 - RNA, 22 nt, Human
gggcacagucugcagcccccca

SEQ ID NO: 1029942 - RNA, 22 nt, Human
ucccggcgcugggagguggguc

SEQ ID NO: 1029943 - RNA, 22 nt, Human
ccagcaggaaagugacguuuga

SEQ ID NO: 1029944 - RNA, 22 nt, Human
auccauuugccgugcuaugugc

SEQ ID NO: 1029945 - RNA, 22 nt, Human
agaaggcaucagaaguguguag

SEQ ID NO: 1029946 - RNA, 22 nt, Human
caggcuguguuccuggaacccc

SEQ ID NO: 1029947 - RNA, 22 nt, Human
augcaauaguaauucuagucug

SEQ ID NO: 1029948 - RNA, 22 nt, Human
ccugggcaaaugccagagacaa

SEQ ID NO: 1029949 - RNA, 22 nt, Human
ugcuccugaacacagcccuaug

SEQ ID NO: 1029950 - RNA, 22 nt, Human
aaggaggaauguagccagcucc

SEQ ID NO: 1029951 - RNA, 22 nt, Human
ugcugcucuucaccauggccuc

SEQ ID NO: 1029952 - RNA, 22 nt, Human
agagucaguuaugucaagugcu

SEQ ID NO: 1029953 - RNA, 22 nt, Human
cuuccugcaacaccuguguugc

SEQ ID NO: 1029954 - RNA, 22 nt, Human
agagggcgcccaggcccacgcc

SEQ ID NO: 1029955 - RNA, 22 nt, Human
gaaggcaagugagccaagagaa

SEQ ID NO: 1029956 - RNA, 22 nt, Human
cucacagcugcuucaggaucca

SEQ ID NO: 1029957 - RNA, 22 nt, Human
gugcagcugugguggagccagg

SEQ ID NO: 1029958 - RNA, 22 nt, Human
cuuuggucuccgucaucaauca

SEQ ID NO: 1029959 - RNA, 22 nt, Human
uggugcaggccaagcugcgagc

SEQ ID NO: 1029960 - RNA, 22 nt, Human
gaucggguggguucugccauca

SEQ ID NO: 1029961 - RNA, 22 nt, Human
ucucuacagcacccgcaugcua

SEQ ID NO: 1029962 - RNA, 22 nt, Human
uccuuggagaaucuuguuuuac

SEQ ID NO: 1029963 - RNA, 22 nt, Human
ccgagcuguggucucuuuuacg

SEQ ID NO: 1029964 - RNA, 22 nt, Human
guccuguguaaguacuugcuca

SEQ ID NO: 1029965 - RNA, 22 nt, Human
ucuccaggcuuaaucucagcuu

SEQ ID NO: 1029966 - RNA, 22 nt, Human
ugagcuucuuuauuuggccaga

SEQ ID NO: 1029967 - RNA, 20 nt, Human
ugugcccaauguccagguuc

SEQ ID NO: 1029968 - RNA, 22 nt, Human
agguggcuaugaggaugcaguc

SEQ ID NO: 1029969 - RNA, 22 nt, Human
aagacacuuucuaaauagaagu

SEQ ID NO: 1029970 - RNA, 22 nt, Human
aggcucagugauguaaaauaua

SEQ ID NO: 1029971 - RNA, 19 nt, Human
ucucccaugccugugucua

SEQ ID NO: 1029972 - RNA, 22 nt, Human
gcaguugcaggauuuguguugu

SEQ ID NO: 1029973 - RNA, 22 nt, Human
cauggcaggugcagauucugug

SEQ ID NO: 1029974 - RNA, 22 nt, Human
uccuucagaggacggcagccag

SEQ ID NO: 1029975 - RNA, 22 nt, Human
aaagagcucggaaaguguugaa

SEQ ID NO: 1029976 - RNA, 22 nt, Human
ggcuuucugucugcgucugugu

SEQ ID NO: 1029977 - RNA, 22 nt, Human
cucuggagcgcugcuucccgcg

SEQ ID NO: 1029978 - RNA, 22 nt, Human
aggagcagaacuguuguggagg

SEQ ID NO: 1029979 - RNA, 22 nt, Human
acagagggucugggcacaggac

SEQ ID NO: 1029980 - RNA, 22 nt, Human
ugugugcacaaagaguacaugg

SEQ ID NO: 1029981 - RNA, 22 nt, Human
gcucuccacugaccacggggca

SEQ ID NO: 1029982 - RNA, 23 nt, Human
cugagggcuggucugaagucugc

SEQ ID NO: 1029983 - RNA, 22 nt, Human
gugcuccaggucgcucagagag

SEQ ID NO: 1029984 - RNA, 18 nt, Human
ggcggguguuuuauucac

SEQ ID NO: 1029985 - RNA, 22 nt, Human
ucacagcucacuguagccucga

SEQ ID NO: 1029986 - RNA, 22 nt, Human
uuuucaguuccaucucugcucu

SEQ ID NO: 1029987 - RNA, 22 nt, Human
cagcuuguuuacaugcuuauuc

SEQ ID NO: 1029988 - RNA, 22 nt, Human
acacuggacucagaggccagaa

SEQ ID NO: 1029989 - RNA, 22 nt, Human
gcggcgccugggacccgccagc

SEQ ID NO: 1029990 - RNA, 22 nt, Human
ucuccucuauuucuguauguau

SEQ ID NO: 1029991 - RNA, 22 nt, Human
agcuggugauguggucccucac

SEQ ID NO: 1029992 - RNA, 22 nt, Human
cccaggucgucagcaguguggu

SEQ ID NO: 1029993 - RNA, 22 nt, Human
ugcuggaguggcacuguguggc

SEQ ID NO: 1029994 - RNA, 22 nt, Human
cuuugcagagggggugggagcu

SEQ ID NO: 1029995 - RNA, 22 nt, Human
gugagguccucccugcugggag

SEQ ID NO: 1029996 - RNA, 22 nt, Human
ggagaggguagggguccugccc

SEQ ID NO: 1029997 - RNA, 22 nt, Human
ccugugucaucagcuguggcua

SEQ ID NO: 1029998 - RNA, 22 nt, Human
ggucagugccuaucaugugggc

SEQ ID NO: 1029999 - RNA, 22 nt, Human
cuggucaauaaucauguaguac

SEQ ID NO: 1030000 - RNA, 22 nt, Human
uccgcgcucucacccgcucccg

SEQ ID NO: 1030001 - RNA, 20 nt, Human
uaugugcaguuugguuuauc

SEQ ID NO: 1030002 - RNA, 22 nt, Human
uaggugucuggacaacuuugua

SEQ ID NO: 1030003 - RNA, 22 nt, Human
gugcagcugguggagucugggg

SEQ ID NO: 1030004 - RNA, 22 nt, Human
gggcuggagagucccacguggg

SEQ ID NO: 1030005 - RNA, 22 nt, Human
cccagcugaacuugcauuccaa

SEQ ID NO: 1030006 - RNA, 22 nt, Human
gaagagguucaacguggucauc

SEQ ID NO: 1030007 - RNA, 17 nt, Human
ucugagaaugcuggagg

SEQ ID NO: 1030008 - RNA, 22 nt, Human
cccaggacucugacacccccaa

SEQ ID NO: 1030009 - RNA, 22 nt, Human
aagagagaacucccuucgccag

SEQ ID NO: 1030010 - RNA, 22 nt, Human
agaagcagaaggaagcagggcc

SEQ ID NO: 1030011 - RNA, 22 nt, Human
caagggcagaggcagggccccg

SEQ ID NO: 1030012 - RNA, 22 nt, Human
aggcagagaaaaaccagauaug

SEQ ID NO: 1030013 - RNA, 22 nt, Human
ggagcgugcacuccaggcccuu

SEQ ID NO: 1030014 - RNA, 22 nt, Human
cuucauguacaguuauuggaga

SEQ ID NO: 1030015 - RNA, 22 nt, Human
cacgccuggacggcggagggug

SEQ ID NO: 1030016 - RNA, 22 nt, Human
cccacugcaugaguugguauua

SEQ ID NO: 1030017 - RNA, 22 nt, Human
gagcuccugaaacguuccugcc

SEQ ID NO: 1030018 - RNA, 21 nt, Human
agaugaggauacugaggccua

SEQ ID NO: 1030019 - RNA, 22 nt, Human
accugccagaaugcuaguccug

SEQ ID NO: 1030020 - RNA, 22 nt, Human
ggcagaggaagcuggaaguggg

SEQ ID NO: 1030021 - RNA, 22 nt, Human
gugcgggccuggggguuucucu

SEQ ID NO: 1030022 - RNA, 22 nt, Human
cacgugcaggucuuaggagaca

SEQ ID NO: 1030023 - RNA, 22 nt, Human
gaagcuucgaaagagugauuuc

SEQ ID NO: 1030024 - RNA, 22 nt, Human
uugcacagaugcacaugguugc

SEQ ID NO: 1030025 - RNA, 21 nt, Human
cagaggggcuagccuggcugc

SEQ ID NO: 1030026 - RNA, 22 nt, Human
gcuugcugaacaggaaccuggc

SEQ ID NO: 1030027 - RNA, 22 nt, Human
cagugcugcaggcgccugcggu

SEQ ID NO: 1030028 - RNA, 22 nt, Human
ggcuguggucauuaggagguug

SEQ ID NO: 1030029 - RNA, 22 nt, Human
ccuggauucucacuggacucca

SEQ ID NO: 1030030 - RNA, 22 nt, Human
agcuggguguagggcuggacaa

SEQ ID NO: 1030031 - RNA, 22 nt, Human
acagcuggaggucugugagcac

SEQ ID NO: 1030032 - RNA, 22 nt, Human
agcugugaccuucaagagcuac

SEQ ID NO: 1030033 - RNA, 19 nt, Human
cugggacaaugaaagcauc

SEQ ID NO: 1030034 - RNA, 22 nt, Human
ccacagcaugcaggccugacac

SEQ ID NO: 1030035 - RNA, 20 nt, Human
cucaccagguguaggcugag

SEQ ID NO: 1030036 - RNA, 22 nt, Human
aagagcuggcucuugcagcagc

SEQ ID NO: 1030037 - RNA, 22 nt, Human
agaucaaggacaugaagaggcu

SEQ ID NO: 1030038 - RNA, 22 nt, Human
gugcugccuccauauccgucag

SEQ ID NO: 1030039 - RNA, 22 nt, Human
ggcgagcaugagucacucuggg

SEQ ID NO: 1030040 - RNA, 19 nt, Human
gagcagcuuccuaucuggu

SEQ ID NO: 1030041 - RNA, 22 nt, Human
auaggcauaacacugauguccu

SEQ ID NO: 1030042 - RNA, 22 nt, Human
ccccagcagacucagggcaggu

SEQ ID NO: 1030043 - RNA, 22 nt, Human
ccacccuuccauucuuccucuu

SEQ ID NO: 1030044 - RNA, 22 nt, Human
cagggcacuuaaauugccucgu

SEQ ID NO: 1030045 - RNA, 21 nt, Human
aguuagcagauuucugucucc

SEQ ID NO: 1030046 - RNA, 22 nt, Human
caccgagugacaguagccauca

SEQ ID NO: 1030047 - RNA, 22 nt, Human
uucucugguuugcuguuucuga

SEQ ID NO: 1030048 - RNA, 22 nt, Human
gaaaggcucagauucccccagg

SEQ ID NO: 1030049 - RNA, 19 nt, Human
aggaaggcggcggcugccc

SEQ ID NO: 1030050 - RNA, 22 nt, Human
cuggcagcugcccgagaugccc

SEQ ID NO: 1030051 - RNA, 22 nt, Human
ucugagagccacugaacagcaa

SEQ ID NO: 1030052 - RNA, 19 nt, Human
cccagaggaaugccuggaa

SEQ ID NO: 1030053 - RNA, 22 nt, Human
aagcauuucagguagagauauu

SEQ ID NO: 1030054 - RNA, 19 nt, Human
uccuugacuguauucagag

SEQ ID NO: 1030055 - RNA, 22 nt, Human
cugggccucacccuagaccaau

SEQ ID NO: 1030056 - RNA, 22 nt, Human
uucagguuuuuaaguucugccu

SEQ ID NO: 1030057 - RNA, 22 nt, Human
uuuucuuggaguggcuguccuu

SEQ ID NO: 1030058 - RNA, 22 nt, Human
gcaguaaauugagagucauguu

SEQ ID NO: 1030059 - RNA, 22 nt, Human
uggcugaggagagggcggaagu

SEQ ID NO: 1030060 - RNA, 17 nt, Human
gcccgugggcuacggua

SEQ ID NO: 1030061 - RNA, 22 nt, Human
caguguuuagcacagugcuugg

SEQ ID NO: 1030062 - RNA, 22 nt, Human
ugacagugugcccggagguuag

SEQ ID NO: 1030063 - RNA, 22 nt, Human
gagcccuuuuccuagauacugu

SEQ ID NO: 1030064 - RNA, 19 nt, Human
gcacacccugcaccaccau

SEQ ID NO: 1030065 - RNA, 22 nt, Human
gcugcccauugcucucccacuc

SEQ ID NO: 1030066 - RNA, 22 nt, Human
cagcacauggauggaguuagga

SEQ ID NO: 1030067 - RNA, 23 nt, Human
agccucuuguggauggucagcga

SEQ ID NO: 1030068 - RNA, 22 nt, Human
ucuccauggauuuggaaaugau

SEQ ID NO: 1030069 - RNA, 22 nt, Human
uugagcagaucgggcugugggg

SEQ ID NO: 1030070 - RNA, 21 nt, Human
uaaagcucguucaggaaaguc

SEQ ID NO: 1030071 - RNA, 16 nt, Human
uugccgcacaggucgc

SEQ ID NO: 1030072 - RNA, 22 nt, Human
acaugggcaucuaugaggcucu

SEQ ID NO: 1030073 - RNA, 22 nt, Human
ugggggagccuucacaguagcu

SEQ ID NO: 1030074 - RNA, 22 nt, Human
agaauccuggagaagcuguacc

SEQ ID NO: 1030075 - RNA, 22 nt, Human
gccugccuucggugcgcagcgg

SEQ ID NO: 1030076 - RNA, 22 nt, Human
ggaagaggcugaggccaugcug

SEQ ID NO: 1030077 - RNA, 21 nt, Human
ucugugcuuuuuuggcuccua

SEQ ID NO: 1030078 - RNA, 22 nt, Human
ucuuauugguaaugauggcauu

SEQ ID NO: 1030079 - RNA, 22 nt, Human
agguggaguuaagugugaacug

SEQ ID NO: 1030080 - RNA, 22 nt, Human
gccugugcuuaacugacgugag

SEQ ID NO: 1030081 - RNA, 22 nt, Human
gccagcagcgagaguuuaaccu

SEQ ID NO: 1030082 - RNA, 22 nt, Human
agcaaggcagcuuucacugcuu

SEQ ID NO: 1030083 - RNA, 22 nt, Human
ugccgcugucgccaccauggcu

SEQ ID NO: 1030084 - RNA, 22 nt, Human
uccuugcagcaggaacccacuu

SEQ ID NO: 1030085 - RNA, 22 nt, Human
gcucgguggccagccugaggcc

SEQ ID NO: 1030086 - RNA, 22 nt, Human
ggccuugguaaauuggcauuug

SEQ ID NO: 1030087 - RNA, 23 nt, Human
ccacuggagaaaguggcaggugg

SEQ ID NO: 1030088 - RNA, 23 nt, Human
cagcacaguacauuuccugucuc

SEQ ID NO: 1030089 - RNA, 22 nt, Human
gaggggcucuugggcaugaagg

SEQ ID NO: 1030090 - RNA, 20 nt, Human
ucucuggcaagaagcugcag

SEQ ID NO: 1030091 - RNA, 22 nt, Human
acaugcuuucuagguccuucug

SEQ ID NO: 1030092 - RNA, 22 nt, Human
aggggagccagggcugcgaguu

SEQ ID NO: 1030093 - RNA, 22 nt, Human
ggccuuccauugcucuuuucua

SEQ ID NO: 1030094 - RNA, 22 nt, Human
gcacaaaagguacuucauguag

SEQ ID NO: 1030095 - RNA, 22 nt, Human
caagagcuggguggcaagcuag

SEQ ID NO: 1030096 - RNA, 22 nt, Human
gacagcaggaugugaggggaug

SEQ ID NO: 1030097 - RNA, 22 nt, Human
ggccuuccugcugcuccgggcc

SEQ ID NO: 1030098 - RNA, 22 nt, Human
uguguuucugagaaucccaccu

SEQ ID NO: 1030099 - RNA, 22 nt, Human
ucgggcugcucgcugcggaacu

SEQ ID NO: 1030100 - RNA, 22 nt, Human
uggccccugaggagcgucagcc

SEQ ID NO: 1030101 - RNA, 22 nt, Human
uugcaggguugacacugccugc

SEQ ID NO: 1030102 - RNA, 22 nt, Human
ggcgcucaguguugccccagag

SEQ ID NO: 1030103 - RNA, 22 nt, Human
gcuggccugaccugaggcuggg

SEQ ID NO: 1030104 - RNA, 17 nt, Human
ugagcaguagaagaugc

SEQ ID NO: 1030105 - RNA, 22 nt, Human
gcugcugcuugaaggcucggag

SEQ ID NO: 1030106 - RNA, 22 nt, Human
guccuggugccaccugcgggau

SEQ ID NO: 1030107 - RNA, 22 nt, Human
caggcucgguccaguggcaccc

SEQ ID NO: 1030108 - RNA, 22 nt, Human
cgcccacgaaguagguggcauu

SEQ ID NO: 1030109 - RNA, 22 nt, Human
gccccagcagcaaugcgguuga

SEQ ID NO: 1030110 - RNA, 22 nt, Human
cuugaaguggagcuuuugaaau

SEQ ID NO: 1030111 - RNA, 22 nt, Human
gagagaagggggauaugagccu

SEQ ID NO: 1030112 - RNA, 23 nt, Human
cacuggugggguuuaaaagaagc

SEQ ID NO: 1030113 - RNA, 22 nt, Human
cagcagcucaggcuccuuccca

SEQ ID NO: 1030114 - RNA, 17 nt, Human
uggcacagaggugcuau

SEQ ID NO: 1030115 - RNA, 18 nt, Human
ggaaggugcuggagugca

SEQ ID NO: 1030116 - RNA, 22 nt, Human
uccugucucaguguauuugcag

SEQ ID NO: 1030117 - RNA, 22 nt, Human
augugggccgugcggguguccu

SEQ ID NO: 1030118 - RNA, 22 nt, Human
cucuggcaauugcugcugacuc

SEQ ID NO: 1030119 - RNA, 22 nt, Human
cccuggaacccauggccagugu

SEQ ID NO: 1030120 - RNA, 22 nt, Human
cugaggagauccccccagaagu

SEQ ID NO: 1030121 - RNA, 17 nt, Human
gcuccagaauucuaguc

SEQ ID NO: 1030122 - RNA, 21 nt, Human
aggucccagguuugggcagca

SEQ ID NO: 1030123 - RNA, 22 nt, Human
uuuuccuuaacagagggagaaa

SEQ ID NO: 1030124 - RNA, 22 nt, Human
gagucgagcagaaagccgucgg

SEQ ID NO: 1030125 - RNA, 22 nt, Human
agcagcaggagccgugggguga

SEQ ID NO: 1030126 - RNA, 22 nt, Human
caggcgggcaggugcggccccu

SEQ ID NO: 1030127 - RNA, 22 nt, Human
ggcaucagcccgguccugggcu

SEQ ID NO: 1030128 - RNA, 22 nt, Human
ccaggcagccaagugugugugu

SEQ ID NO: 1030129 - RNA, 22 nt, Human
gcaagcagcccagaacagcucu

SEQ ID NO: 1030130 - RNA, 22 nt, Human
uugcugccagcgcccugcaggg

SEQ ID NO: 1030131 - RNA, 22 nt, Human
gcucgcuuagauuuuccucuga

SEQ ID NO: 1030132 - RNA, 22 nt, Human
ggcuagggaucuagaccaggac

SEQ ID NO: 1030133 - RNA, 22 nt, Human
aagugacuuaaucuccucucag

SEQ ID NO: 1030134 - RNA, 19 nt, Human
ccuggcccugcugcgcggg

SEQ ID NO: 1030135 - RNA, 22 nt, Human
aacuugccaagagcuuugcuag

SEQ ID NO: 1030136 - RNA, 22 nt, Human
gcucuagcuggcgcugaccugg

SEQ ID NO: 1030137 - RNA, 22 nt, Human
gucuccugaggcauccauugaa

SEQ ID NO: 1030138 - RNA, 22 nt, Human
acaguucuguccuagacuucgu

SEQ ID NO: 1030139 - RNA, 22 nt, Human
uacauguuauuucacuauuggu

SEQ ID NO: 1030140 - RNA, 22 nt, Human
uggggcuccuccuggcaggagg

SEQ ID NO: 1030141 - RNA, 22 nt, Human
cuuccucuguggccagagugua

SEQ ID NO: 1030142 - RNA, 22 nt, Human
cgcgcugcagacagcggaggcc

SEQ ID NO: 1030143 - RNA, 22 nt, Human
agacaagagcugaggacauauu

SEQ ID NO: 1030144 - RNA, 23 nt, Human
gcugccaaggaggcaggggugcc

SEQ ID NO: 1030145 - RNA, 22 nt, Molluscum contagiosum virus
cuggcgggcagcucugcuggca

SEQ ID NO: 1030146 - RNA, 22 nt, Molluscum contagiosum virus
uggagaccggcggcucggaaug

SEQ ID NO: 1030147 - RNA, 19 nt, Molluscum contagiosum virus
uggaagaaucggacucgga

SEQ ID NO: 1030148 - RNA, 22 nt, Molluscum contagiosum virus
ugcuggccgcccuggcgcuguu

SEQ ID NO: 1030149 - RNA, 22 nt, Molluscum contagiosum virus
ugcuggcguucguucgcgccag

SEQ ID NO: 1030150 - RNA, 22 nt, Molluscum contagiosum virus
ugcuggucgucgccggcgccaa

SEQ ID NO: 1030151 - RNA, 23 nt, Molluscum contagiosum virus
ugcuucuucgacgagcgcgcggg

SEQ ID NO: 1030152 - RNA, 22 nt, Molluscum contagiosum virus
ugcugcgcgccaguuuuccgug

SEQ ID NO: 1030153 - RNA, 22 nt, Molluscum contagiosum virus
ugcuuugaugacuaugcgucuu

SEQ ID NO: 1030154 - RNA, 22 nt, Molluscum contagiosum virus
uggaggacgugcacgggccagc

SEQ ID NO: 1030155 - RNA, 22 nt, Molluscum contagiosum virus
ugcgagccauuaugcucggagu

SEQ ID NO: 1030156 - RNA, 22 nt, Molluscum contagiosum virus
ugcgcauuggcagcgcuuuguu

SEQ ID NO: 1030157 - RNA, 22 nt, Molluscum contagiosum virus
ugccggcguccucuucccgcgg

SEQ ID NO: 1030158 - RNA, 22 nt, Molluscum contagiosum virus
ugccuccugcacgcgguccauc

SEQ ID NO: 1030159 - RNA, 20 nt, Molluscum contagiosum virus
ugcucgcucgugcugccggu

SEQ ID NO: 1030160 - RNA, 22 nt, Molluscum contagiosum virus
ugcuaguccuagccgcgagccc

SEQ ID NO: 1030161 - RNA, 22 nt, Molluscum contagiosum virus
ugcgugcccagcagguagcugg

SEQ ID NO: 1030162 - RNA, 21 nt, Molluscum contagiosum virus
ugcggguaccuuuccugcggg

SEQ ID NO: 1030163 - RNA, 22 nt, Molluscum contagiosum virus
ugcgcgcguggugugcuaccag

SEQ ID NO: 1030164 - RNA, 22 nt, Molluscum contagiosum virus
ugcgcgugaacaucggcagcgg

SEQ ID NO: 1030165 - RNA, 21 nt, Molluscum contagiosum virus
ugcggcuugggcaccgcgcgg

SEQ ID NO: 1030166 - RNA, 22 nt, Molluscum contagiosum virus
accgagucggaccgcaucucgg

SEQ ID NO: 1030167 - RNA, 22 nt, Molluscum contagiosum virus
accccgagcugcggcgcgugcu

SEQ ID NO: 1030168 - RNA, 22 nt, Molluscum contagiosum virus
ugcagcagcagcgcuuucaggu

SEQ ID NO: 1030169 - RNA, 22 nt, Molluscum contagiosum virus
ugcaggccagugcgacguugcg

SEQ ID NO: 1030170 - RNA, 22 nt, Molluscum contagiosum virus
accuugucacugucgcgacaac

SEQ ID NO: 1030171 - RNA, 22 nt, Molluscum contagiosum virus
aaugaaagacgugcugcugcug

SEQ ID NO: 1030172 - RNA, 22 nt, Molluscum contagiosum virus
aaugcgaggcgcgacuggcaca

SEQ ID NO: 1030173 - RNA, 20 nt, Molluscum contagiosum virus
accagugugaccaggucucc

SEQ ID NO: 1030174 - RNA, 22 nt, Molluscum contagiosum virus
acauguccaagcugcaggaacg

SEQ ID NO: 1030175 - RNA, 22 nt, Molluscum contagiosum virus
acagugcucgcaaaggagucgc

SEQ ID NO: 1030176 - RNA, 22 nt, Molluscum contagiosum virus
aaguacuucucgauguugggaa

SEQ ID NO: 1030177 - RNA, 22 nt, Molluscum contagiosum virus
ucuguucgagaaccugcacgcg

SEQ ID NO: 1030178 - RNA, 17 nt, Molluscum contagiosum virus
ucugcgugacauccgcc

SEQ ID NO: 1030179 - RNA, 22 nt, Molluscum contagiosum virus
ucucugcgcgcaagucaccgcu

SEQ ID NO: 1030180 - RNA, 20 nt, Molluscum contagiosum virus
ucuacguguccgcauccgcc

SEQ ID NO: 1030181 - RNA, 19 nt, Molluscum contagiosum virus
ucuagcagcugcgccagcg

SEQ ID NO: 1030182 - RNA, 22 nt, Molluscum contagiosum virus
ucuccccggacggugcggucuu

SEQ ID NO: 1030183 - RNA, 22 nt, Molluscum contagiosum virus
ucucgacggggccguaguaggg

SEQ ID NO: 1030184 - RNA, 22 nt, Molluscum contagiosum virus
ucucgcagcuggaccugcgcgc

SEQ ID NO: 1030185 - RNA, 18 nt, Molluscum contagiosum virus
uccagcagcaguguugcc

SEQ ID NO: 1030186 - RNA, 23 nt, Molluscum contagiosum virus
uccaggccacgucguugcggcac

SEQ ID NO: 1030187 - RNA, 22 nt, Molluscum contagiosum virus
ucagcguuuaccccgagggccg

SEQ ID NO: 1030188 - RNA, 20 nt, Molluscum contagiosum virus
uccaaguucaacaacgucuu

SEQ ID NO: 1030189 - RNA, 22 nt, Molluscum contagiosum virus
uccacgaagcacagcaugcagu

SEQ ID NO: 1030190 - RNA, 20 nt, Molluscum contagiosum virus
ucauguggaugucgcaguag

SEQ ID NO: 1030191 - RNA, 22 nt, Molluscum contagiosum virus
uccgcggacgcgggccuguccg

SEQ ID NO: 1030192 - RNA, 22 nt, Molluscum contagiosum virus
uccgcgggcgcgggccuguccg

SEQ ID NO: 1030193 - RNA, 22 nt, Molluscum contagiosum virus
uccggcgaaaagccgcucgcgu

SEQ ID NO: 1030194 - RNA, 22 nt, Molluscum contagiosum virus
uaggcguguccgcagcugugcg

SEQ ID NO: 1030195 - RNA, 22 nt, Molluscum contagiosum virus
uagugcucuuuguggaccgcgg

SEQ ID NO: 1030196 - RNA, 22 nt, Molluscum contagiosum virus
uaguuguagucgggcagcuugu

SEQ ID NO: 1030197 - RNA, 22 nt, Molluscum contagiosum virus
uaugggcagcagcgagagcaug

SEQ ID NO: 1030198 - RNA, 21 nt, Molluscum contagiosum virus
uauccacgccaccaggccugg

SEQ ID NO: 1030199 - RNA, 22 nt, Molluscum contagiosum virus
ucagcgcgaucucgaucgaaca

SEQ ID NO: 1030200 - RNA, 23 nt, Molluscum contagiosum virus
ugauggacauguacacgcgcgcg

SEQ ID NO: 1030201 - RNA, 22 nt, Molluscum contagiosum virus
ugcaccuguuccagcacguagc

SEQ ID NO: 1030202 - RNA, 22 nt, Molluscum contagiosum virus
ugcacgcuguccaggcgcugca

SEQ ID NO: 1030203 - RNA, 22 nt, Molluscum contagiosum virus
ugcacuacaaccauggcgcgcu

SEQ ID NO: 1030204 - RNA, 21 nt, Molluscum contagiosum virus
ugaucguguccaaguucaaga

SEQ ID NO: 1030205 - RNA, 22 nt, Molluscum contagiosum virus
ugaucguguccaaguucaagaa

SEQ ID NO: 1030206 - RNA, 22 nt, Molluscum contagiosum virus
ugaugagcucgccguugguguu

SEQ ID NO: 1030207 - RNA, 22 nt, Molluscum contagiosum virus
ugaccuuguacugcacgugcuc

SEQ ID NO: 1030208 - RNA, 22 nt, Molluscum contagiosum virus
gaugcgugcacgucgagcacgg

SEQ ID NO: 1030209 - RNA, 22 nt, Molluscum contagiosum virus
gaugcucauggacgcgcucggg

SEQ ID NO: 1030210 - RNA, 22 nt, Molluscum contagiosum virus
gagugucgcgaccguagaagau

SEQ ID NO: 1030211 - RNA, 22 nt, Molluscum contagiosum virus
gaugaccucguucccgucgacc

SEQ ID NO: 1030212 - RNA, 22 nt, Molluscum contagiosum virus
cguaagccaccgcgcaggaccg

SEQ ID NO: 1030213 - RNA, 22 nt, Molluscum contagiosum virus
cgucaggcugggcgcgcgagcu

SEQ ID NO: 1030214 - RNA, 22 nt, Molluscum contagiosum virus
cgucugcuuuugcgucgcgcgu

SEQ ID NO: 1030215 - RNA, 22 nt, Molluscum contagiosum virus
cgucggacaggccuugcagacg

SEQ ID NO: 1030216 - RNA, 22 nt, Molluscum contagiosum virus
cguggcgccgcugcuggaacag

SEQ ID NO: 1030217 - RNA, 22 nt, Molluscum contagiosum virus
gacguccugcgccaugcgcagu

SEQ ID NO: 1030218 - RNA, 22 nt, Molluscum contagiosum virus
gacguccuguagcaaggggucu

SEQ ID NO: 1030219 - RNA, 22 nt, Molluscum contagiosum virus
cgugcccgagcacgcgugugug

SEQ ID NO: 1030220 - RNA, 22 nt, Molluscum contagiosum virus
cgugcgcaccugcgcaagaugu

SEQ ID NO: 1030221 - RNA, 22 nt, Molluscum contagiosum virus
cgugcgccgcgcccagucgacc

SEQ ID NO: 1030222 - RNA, 22 nt, Molluscum contagiosum virus
cgugcgguguugcucgaagggc

SEQ ID NO: 1030223 - RNA, 22 nt, Molluscum contagiosum virus
cgugcucacggcagcguaaucc

SEQ ID NO: 1030224 - RNA, 19 nt, Molluscum contagiosum virus
cgugagggacagagucgcu

SEQ ID NO: 1030225 - RNA, 22 nt, Molluscum contagiosum virus
gacugcuucguuuucgaccugg

SEQ ID NO: 1030226 - RNA, 22 nt, Molluscum contagiosum virus
gagaaagcugaugcccucguug

SEQ ID NO: 1030227 - RNA, 22 nt, Molluscum contagiosum virus
gagccgcacaaagaacgcgcgu

SEQ ID NO: 1030228 - RNA, 22 nt, Molluscum contagiosum virus
gagauguuccccgagcucgacc

SEQ ID NO: 1030229 - RNA, 22 nt, Molluscum contagiosum virus
gagcacgugcgccgcuucgagg

SEQ ID NO: 1030230 - RNA, 22 nt, Molluscum contagiosum virus
gaggugcacgcagagcuggucg

SEQ ID NO: 1030231 - RNA, 22 nt, Molluscum contagiosum virus
gaggauccgcauccucuaggcg

SEQ ID NO: 1030232 - RNA, 22 nt, Molluscum contagiosum virus
gaggacgugcgcgagaacuacu

SEQ ID NO: 1030233 - RNA, 22 nt, Molluscum contagiosum virus
gaggagaaaugucuugaucgug

SEQ ID NO: 1030234 - RNA, 22 nt, Molluscum contagiosum virus
gagcgagcgaacucgacaacgc

SEQ ID NO: 1030235 - RNA, 22 nt, Molluscum contagiosum virus
gagcgcgagaagaaguacaucc

SEQ ID NO: 1030236 - RNA, 22 nt, Molluscum contagiosum virus
cgccuggaaaccacgcuauccg

SEQ ID NO: 1030237 - RNA, 22 nt, Molluscum contagiosum virus
cgcgagcgcuugcgaccugaag

SEQ ID NO: 1030238 - RNA, 22 nt, Molluscum contagiosum virus
cgcgacauggacaucgccagug

SEQ ID NO: 1030239 - RNA, 22 nt, Molluscum contagiosum virus
cgcggcacgccuucgucagcuu

SEQ ID NO: 1030240 - RNA, 22 nt, Molluscum contagiosum virus
cgcggcaguccgagcuguucaa

SEQ ID NO: 1030241 - RNA, 22 nt, Molluscum contagiosum virus
cgcgggagcggccuccggagaa

SEQ ID NO: 1030242 - RNA, 21 nt, Molluscum contagiosum virus
cgcgcagguccagcugcgaga

SEQ ID NO: 1030243 - RNA, 22 nt, Molluscum contagiosum virus
cgcgcccgaugaucugcuugag

SEQ ID NO: 1030244 - RNA, 22 nt, Molluscum contagiosum virus
cggagacucgcgcaacagcgcu

SEQ ID NO: 1030245 - RNA, 21 nt, Molluscum contagiosum virus
cggcccagcacgcgcggcucc

SEQ ID NO: 1030246 - RNA, 22 nt, Molluscum contagiosum virus
cggacucgggcacaggcgugau

SEQ ID NO: 1030247 - RNA, 22 nt, Molluscum contagiosum virus
cggacgcgggccuguccgcgga

SEQ ID NO: 1030248 - RNA, 22 nt, Molluscum contagiosum virus
cgcuuccgaagcccaggccugg

SEQ ID NO: 1030249 - RNA, 22 nt, Molluscum contagiosum virus
cgcuggugucgcuuccaugggc

SEQ ID NO: 1030250 - RNA, 22 nt, Molluscum contagiosum virus
cgcucgucuuccagagccugcg

SEQ ID NO: 1030251 - RNA, 20 nt, Molluscum contagiosum virus
cgcugcguacguggucuugc

SEQ ID NO: 1030252 - RNA, 22 nt, Molluscum contagiosum virus
cgcguacaauguagcugccgau

SEQ ID NO: 1030253 - RNA, 17 nt, Molluscum contagiosum virus
cgcguacguguccaugc

SEQ ID NO: 1030254 - RNA, 22 nt, Molluscum contagiosum virus
cgcguaggccagcaccugagcc

SEQ ID NO: 1030255 - RNA, 22 nt, Molluscum contagiosum virus
cgcgcucuuccguccgugcccg

SEQ ID NO: 1030256 - RNA, 22 nt, Molluscum contagiosum virus
cgcgugugcggggcagcaggca

SEQ ID NO: 1030257 - RNA, 22 nt, Molluscum contagiosum virus
cggugcacgcguagcacggcca

SEQ ID NO: 1030258 - RNA, 22 nt, Molluscum contagiosum virus
cggugcuggcgcgcgugcccug

SEQ ID NO: 1030259 - RNA, 22 nt, Molluscum contagiosum virus
cgggcucagaaggcgucgggag

SEQ ID NO: 1030260 - RNA, 22 nt, Molluscum contagiosum virus
cgggccggaagcccacgauggc

SEQ ID NO: 1030261 - RNA, 18 nt, Molluscum contagiosum virus
cgggcgcgaccugcggcu

SEQ ID NO: 1030262 - RNA, 22 nt, Molluscum contagiosum virus
cggccgcgagcagcuguggggg

SEQ ID NO: 1030263 - RNA, 22 nt, Molluscum contagiosum virus
cggcgcgucgagcuugggcgug

SEQ ID NO: 1030264 - RNA, 18 nt, Molluscum contagiosum virus
gugcgcagcccgcugccc

SEQ ID NO: 1030265 - RNA, 22 nt, Molluscum contagiosum virus
gugcgcgucauuaaacuccagg

SEQ ID NO: 1030266 - RNA, 22 nt, Molluscum contagiosum virus
gugcgcuuugaggaacuagugc

SEQ ID NO: 1030267 - RNA, 22 nt, Molluscum contagiosum virus
gugcuuggguucccguguaacc

SEQ ID NO: 1030268 - RNA, 22 nt, Molluscum contagiosum virus
gugcgucgcugcgcgugguggg

SEQ ID NO: 1030269 - RNA, 22 nt, Molluscum contagiosum virus
gugccgucagcacccaccaaga

SEQ ID NO: 1030270 - RNA, 22 nt, Molluscum contagiosum virus
gugggcggcagagagccggcgc

SEQ ID NO: 1030271 - RNA, 22 nt, Molluscum contagiosum virus
guggcaugcugcacgucgucca

SEQ ID NO: 1030272 - RNA, 22 nt, Molluscum contagiosum virus
guuccagcuagaagaggccguc

SEQ ID NO: 1030273 - RNA, 22 nt, Molluscum contagiosum virus
guugccgucgucgcugcaguuu

SEQ ID NO: 1030274 - RNA, 22 nt, Molluscum contagiosum virus
uacacguaguugaggucgcugc

SEQ ID NO: 1030275 - RNA, 22 nt, Molluscum contagiosum virus
uacagccucuacacgcagaacg

SEQ ID NO: 1030276 - RNA, 22 nt, Molluscum contagiosum virus
uagcucugcucgcucugcgaga

SEQ ID NO: 1030277 - RNA, 22 nt, Molluscum contagiosum virus
uacucggccacgcgguggugcg

SEQ ID NO: 1030278 - RNA, 22 nt, Molluscum contagiosum virus
guccugcgagcucgacaugucc

SEQ ID NO: 1030279 - RNA, 18 nt, Molluscum contagiosum virus
gucgacugggcgcggcgc

SEQ ID NO: 1030280 - RNA, 22 nt, Molluscum contagiosum virus
gucgacugggcgcggcgcacgu

SEQ ID NO: 1030281 - RNA, 22 nt, Molluscum contagiosum virus
gucgcccaucacgucgaagauc

SEQ ID NO: 1030282 - RNA, 22 nt, Molluscum contagiosum virus
gucggcgggcacggccagcguc

SEQ ID NO: 1030283 - RNA, 22 nt, Molluscum contagiosum virus
gugagcacaguguagcgcgcgc

SEQ ID NO: 1030284 - RNA, 22 nt, Molluscum contagiosum virus
gucgugcuccacgcgcagcuuc

SEQ ID NO: 1030285 - RNA, 22 nt, Molluscum contagiosum virus
gucuagugcguccgcccuuacg

SEQ ID NO: 1030286 - RNA, 22 nt, Molluscum contagiosum virus
gucugcuuuugcgucgcgcguu

SEQ ID NO: 1030287 - RNA, 22 nt, Molluscum contagiosum virus
aucagcgcgaucucgaucgaac

SEQ ID NO: 1030288 - RNA, 22 nt, Molluscum contagiosum virus
aucgagcccgagucuuccagcu

SEQ ID NO: 1030289 - RNA, 22 nt, Molluscum contagiosum virus
aucagguagagcgcgcagccgg

SEQ ID NO: 1030290 - RNA, 22 nt, Molluscum contagiosum virus
agugaaggucgcguuccaggug

SEQ ID NO: 1030291 - RNA, 20 nt, Molluscum contagiosum virus
aucuucguggagacggcgac

SEQ ID NO: 1030292 - RNA, 21 nt, Molluscum contagiosum virus
augcgcgccuuggcuagcagc

SEQ ID NO: 1030293 - RNA, 22 nt, Molluscum contagiosum virus
augcaggcggagcagcugcugg

SEQ ID NO: 1030294 - RNA, 22 nt, Molluscum contagiosum virus
auggccaccgggaugcgcaugg

SEQ ID NO: 1030295 - RNA, 22 nt, Molluscum contagiosum virus
auggccagcuucugcgccgcgc

SEQ ID NO: 1030296 - RNA, 22 nt, Molluscum contagiosum virus
auggccccuugucuaguuggag

SEQ ID NO: 1030297 - RNA, 22 nt, Molluscum contagiosum virus
auggcggccagcguugcgccga

SEQ ID NO: 1030298 - RNA, 20 nt, Molluscum contagiosum virus
augucgcgcaucaccgagcg

SEQ ID NO: 1030299 - RNA, 22 nt, Molluscum contagiosum virus
cccgagcucuucagcagcugca

SEQ ID NO: 1030300 - RNA, 22 nt, Molluscum contagiosum virus
ccgcagugcucgcacacgugca

SEQ ID NO: 1030301 - RNA, 22 nt, Molluscum contagiosum virus
ccggggugugccuuuuccuugu

SEQ ID NO: 1030302 - RNA, 22 nt, Molluscum contagiosum virus
ccgcgcagaaaagccucgcagu

SEQ ID NO: 1030303 - RNA, 22 nt, Molluscum contagiosum virus
ccgcgugacgucuucucgcggg

SEQ ID NO: 1030304 - RNA, 22 nt, Molluscum contagiosum virus
uucuugaccuugaucgagaugu

SEQ ID NO: 1030305 - RNA, 22 nt, Molluscum contagiosum virus
uugaugcugaacgaucucugac

SEQ ID NO: 1030306 - RNA, 22 nt, Molluscum contagiosum virus
uucgggccuuaaaugaacacca

SEQ ID NO: 1030307 - RNA, 22 nt, Molluscum contagiosum virus
uucguccaccagcgugugguug

SEQ ID NO: 1030308 - RNA, 22 nt, Molluscum contagiosum virus
uuguaguugcgguggugcaucc

SEQ ID NO: 1030309 - RNA, 22 nt, Molluscum contagiosum virus
uugccaucgauuaugcuugagu

SEQ ID NO: 1030310 - RNA, 22 nt, Molluscum contagiosum virus
ccguuccugguagugcaccagg

SEQ ID NO: 1030311 - RNA, 22 nt, Molluscum contagiosum virus
uuccuggacacgcgcaucgugu

SEQ ID NO: 1030312 - RNA, 22 nt, Molluscum contagiosum virus
uuccaugcgcaacgugcugcgu

SEQ ID NO: 1030313 - RNA, 22 nt, Molluscum contagiosum virus
uuacggacgcccuccucgaccu

SEQ ID NO: 1030314 - RNA, 22 nt, Molluscum contagiosum virus
uuugaacucuugcgagcggcaa

SEQ ID NO: 1030315 - RNA, 22 nt, Molluscum contagiosum virus
uuuugcgggggcgcgcgaaugc

SEQ ID NO: 1030316 - RNA, 22 nt, Molluscum contagiosum virus
cgccggcuggcaauguagcgua

SEQ ID NO: 1030317 - RNA, 18 nt, Molluscum contagiosum virus
cgccucaagcucgggccc

SEQ ID NO: 1030318 - RNA, 22 nt, Molluscum contagiosum virus
cgccgacacgcgcgugcucauc

SEQ ID NO: 1030319 - RNA, 22 nt, Molluscum contagiosum virus
cgagcagccgcgccgcacuguc

SEQ ID NO: 1030320 - RNA, 18 nt, Molluscum contagiosum virus
cgacgccuucugagcccg

SEQ ID NO: 1030321 - RNA, 22 nt, Molluscum contagiosum virus
cgacgccuucugagcccgagcu

SEQ ID NO: 1030322 - RNA, 18 nt, Molluscum contagiosum virus
cgacaccuuccgagcccg

SEQ ID NO: 1030323 - RNA, 22 nt, Molluscum contagiosum virus
cgcagcacgcugagcguggcag

SEQ ID NO: 1030324 - RNA, 22 nt, Molluscum contagiosum virus
cgaggguggccacgucgagucu

SEQ ID NO: 1030325 - RNA, 22 nt, Molluscum contagiosum virus
cgcacagcugcgggcugcggcu

SEQ ID NO: 1030326 - RNA, 22 nt, Molluscum contagiosum virus
aggagcacguuccugccgguga

SEQ ID NO: 1030327 - RNA, 22 nt, Molluscum contagiosum virus
agguccguguacccgcgcucgu

SEQ ID NO: 1030328 - RNA, 22 nt, Molluscum contagiosum virus
aggucuucgccgcgggagaacu

SEQ ID NO: 1030329 - RNA, 22 nt, Molluscum contagiosum virus
aggugcacgaccgcgcgcugcu

SEQ ID NO: 1030330 - RNA, 22 nt, Molluscum contagiosum virus
ccuucgugcacgccuucgacgc

SEQ ID NO: 1030331 - RNA, 22 nt, Molluscum contagiosum virus
ccuucucgguguagauguggua

SEQ ID NO: 1030332 - RNA, 22 nt, Molluscum contagiosum virus
ccuugcgcuugugcguacgcgc

SEQ ID NO: 1030333 - RNA, 22 nt, Molluscum contagiosum virus
ccugcggggugccuuuccugcg

SEQ ID NO: 1030334 - RNA, 22 nt, Molluscum contagiosum virus
aggugcucgaugagaguucgcg

SEQ ID NO: 1030335 - RNA, 22 nt, Molluscum contagiosum virus
ccugcacguucacgcgcuccag

SEQ ID NO: 1030336 - RNA, 22 nt, Molluscum contagiosum virus
ccugcagcagcaaugugcacac

SEQ ID NO: 1030337 - RNA, 22 nt, Molluscum contagiosum virus
ccugcaugacgauguagcucuu

SEQ ID NO: 1030338 - RNA, 22 nt, Molluscum contagiosum virus
acugcgcagccgccgaguaugg

SEQ ID NO: 1030339 - RNA, 22 nt, Molluscum contagiosum virus
acguguucgaacugcucgcguu

SEQ ID NO: 1030340 - RNA, 21 nt, Molluscum contagiosum virus
acuucgagaugaucucgcggc

SEQ ID NO: 1030341 - RNA, 22 nt, Molluscum contagiosum virus
acgggcucccuaagcgagcgag

SEQ ID NO: 1030342 - RNA, 22 nt, Molluscum contagiosum virus
acggcguacacaacuuccgcgu

SEQ ID NO: 1030343 - RNA, 22 nt, Molluscum contagiosum virus
acguaaagacggcgauucgugc

SEQ ID NO: 1030344 - RNA, 20 nt, Molluscum contagiosum virus
acguacacgccgcacauugc

SEQ ID NO: 1030345 - RNA, 22 nt, Molluscum contagiosum virus
acgugcucgauagcgcagagcu

SEQ ID NO: 1030346 - RNA, 22 nt, Molluscum contagiosum virus
acguggcgggcaaggcgcgaca

SEQ ID NO: 1030347 - RNA, 22 nt, Molluscum contagiosum virus
agcgaauauggaccuugcacgc

SEQ ID NO: 1030348 - RNA, 22 nt, Molluscum contagiosum virus
agcgacucggacucgagcgacu

SEQ ID NO: 1030349 - RNA, 22 nt, Molluscum contagiosum virus
agcgagauggcguugaugcugc

SEQ ID NO: 1030350 - RNA, 22 nt, Molluscum contagiosum virus
agcgccgugaacugugcgacgc

SEQ ID NO: 1030351 - RNA, 22 nt, Molluscum contagiosum virus
agcgccuucuugaccagcacca

SEQ ID NO: 1030352 - RNA, 22 nt, Molluscum contagiosum virus
agcgcgaaaacacguuggagga

SEQ ID NO: 1030353 - RNA, 22 nt, Molluscum contagiosum virus
agccgcgcugucgcugccugua

SEQ ID NO: 1030354 - RNA, 22 nt, Molluscum contagiosum virus
agcgcgugagcuacgagcgcca

SEQ ID NO: 1030355 - RNA, 23 nt, Molluscum contagiosum virus
agcuugguguuauugacggcguc

SEQ ID NO: 1030356 - RNA, 22 nt, Molluscum contagiosum virus
agcgguguugcugacgacugcg

SEQ ID NO: 1030357 - RNA, 22 nt, Molluscum contagiosum virus
agcucgcgcagcgcaucggggg

SEQ ID NO: 1030358 - RNA, 22 nt, Molluscum contagiosum virus
agcggcgacucuggcacguggu

SEQ ID NO: 1030359 - RNA, 22 nt, Molluscum contagiosum virus
agcgguagucggcgaugagccc

SEQ ID NO: 1030360 - RNA, 22 nt, Molluscum contagiosum virus
agcgggcgcgccacucccuguc

SEQ ID NO: 1030361 - RNA, 22 nt, Molluscum contagiosum virus
agacacgcgcgcgugccugacg

SEQ ID NO: 1030362 - RNA, 22 nt, Molluscum contagiosum virus
agaagcuuuccaugccgcuccc

SEQ ID NO: 1030363 - RNA, 22 nt, Molluscum contagiosum virus
agagaaacauguagaaggccag

SEQ ID NO: 1030364 - RNA, 22 nt, Molluscum contagiosum virus
agagcccgugcaugugagccau

SEQ ID NO: 1030365 - RNA, 22 nt, Molluscum contagiosum virus
agagcugcccgaguuucggaag

SEQ ID NO: 1030366 - RNA, 22 nt, Molluscum contagiosum virus
agcccgcaguauugcgcgagcc

SEQ ID NO: 1030367 - RNA, 22 nt, Molluscum contagiosum virus
agcccgucuacauuuugcggcg

SEQ ID NO: 1030368 - RNA, 22 nt, Molluscum contagiosum virus
agcacguuguucuugcgcgugg

SEQ ID NO: 1030369 - RNA, 22 nt, Molluscum contagiosum virus
agcacuucuccgaugggucggu

SEQ ID NO: 1030370 - RNA, 22 nt, Molluscum contagiosum virus
agcaauucgcuuugcagcccgc

SEQ ID NO: 1030371 - RNA, 22 nt, Molluscum contagiosum virus
agaucacgcuggaccuggcgca

SEQ ID NO: 1030372 - RNA, 22 nt, Molluscum contagiosum virus
agaucgcgaucuugaaggagua

SEQ ID NO: 1030373 - RNA, 22 nt, Molluscum contagiosum virus
agaugcucauggacgcgcucgg

SEQ ID NO: 1030374 - RNA, 22 nt, Molluscum contagiosum virus
ggggccugcaguugagagccuu

SEQ ID NO: 1030375 - RNA, 22 nt, Molluscum contagiosum virus
gggcuugucggaauuucugucu

SEQ ID NO: 1030376 - RNA, 22 nt, Molluscum contagiosum virus
gggcguccgagggcgcgugccu

SEQ ID NO: 1030377 - RNA, 22 nt, Molluscum contagiosum virus
gggcgcgccgacgucaccgggc

SEQ ID NO: 1030378 - RNA, 22 nt, Molluscum contagiosum virus
gggcgcugaacuuagcgcgcag

SEQ ID NO: 1030379 - RNA, 18 nt, Molluscum contagiosum virus
gggccugccagccggcgc

SEQ ID NO: 1030380 - RNA, 22 nt, Molluscum contagiosum virus
gcagcauuuuggugggcacgca

SEQ ID NO: 1030381 - RNA, 22 nt, Molluscum contagiosum virus
gcacgagcgaaaacgcgugucu

SEQ ID NO: 1030382 - RNA, 22 nt, Molluscum contagiosum virus
gcacgagcuggagcuggccuuc

SEQ ID NO: 1030383 - RNA, 22 nt, Molluscum contagiosum virus
gcacgcgcgcgugucuuccagc

SEQ ID NO: 1030384 - RNA, 22 nt, Molluscum contagiosum virus
gcacgcuuuccuuugcggcgag

SEQ ID NO: 1030385 - RNA, 22 nt, Molluscum contagiosum virus
gcacagcucgcgcugcgucugc

SEQ ID NO: 1030386 - RNA, 22 nt, Molluscum contagiosum virus
gcacagcugcgggcugcggcua

SEQ ID NO: 1030387 - RNA, 20 nt, Molluscum contagiosum virus
gcagucguacgugagcaugc

SEQ ID NO: 1030388 - RNA, 20 nt, Molluscum contagiosum virus
gcagguccuccgugcugggc

SEQ ID NO: 1030389 - RNA, 22 nt, Molluscum contagiosum virus
gccgcgacaucuuccgcuuccu

SEQ ID NO: 1030390 - RNA, 22 nt, Molluscum contagiosum virus
gcccuuugccacggcgagucac

SEQ ID NO: 1030391 - RNA, 22 nt, Molluscum contagiosum virus
gccgacgucaccgggcgcgcca

SEQ ID NO: 1030392 - RNA, 19 nt, Molluscum contagiosum virus
gccgucgaugcgcaccagc

SEQ ID NO: 1030393 - RNA, 22 nt, Molluscum contagiosum virus
gcuugauccugcgauggccgug

SEQ ID NO: 1030394 - RNA, 22 nt, Molluscum contagiosum virus
gcuuggcgggcagcggcgacga

SEQ ID NO: 1030395 - RNA, 22 nt, Molluscum contagiosum virus
gcugucugugcauguagcaguc

SEQ ID NO: 1030396 - RNA, 22 nt, Molluscum contagiosum virus
gcuuguguccaagcugggcugc

SEQ ID NO: 1030397 - RNA, 22 nt, Molluscum contagiosum virus
gcucgaucagguucgcggagug

SEQ ID NO: 1030398 - RNA, 22 nt, Molluscum contagiosum virus
gcucuacggcgugcugugccug

SEQ ID NO: 1030399 - RNA, 22 nt, Molluscum contagiosum virus
gcuggcgcucguagcucacgcg

SEQ ID NO: 1030400 - RNA, 22 nt, Molluscum contagiosum virus
gcugagcgcggagcuggcguug

SEQ ID NO: 1030401 - RNA, 22 nt, Molluscum contagiosum virus
gcugaguauggacgugggcggc

SEQ ID NO: 1030402 - RNA, 22 nt, Molluscum contagiosum virus
gcugcacaugugcgugcaccuc

SEQ ID NO: 1030403 - RNA, 22 nt, Molluscum contagiosum virus
gcugcacgggucguagucgugc

SEQ ID NO: 1030404 - RNA, 22 nt, Molluscum contagiosum virus
gcugccguccagguucagcgcg

SEQ ID NO: 1030405 - RNA, 22 nt, Molluscum contagiosum virus
gcugcgaguacuuccuggaaug

SEQ ID NO: 1030406 - RNA, 22 nt, Molluscum contagiosum virus
gcuagcgagcaaagucguggca

SEQ ID NO: 1030407 - RNA, 22 nt, Molluscum contagiosum virus
gcgugcuguggaagucgucaua

SEQ ID NO: 1030408 - RNA, 22 nt, Molluscum contagiosum virus
gcguucccgcagcgccugcgga

SEQ ID NO: 1030409 - RNA, 18 nt, Molluscum contagiosum virus
gcguucucggcaaugccc

SEQ ID NO: 1030410 - RNA, 22 nt, Molluscum contagiosum virus
gcucacggccuucgcguuccgg

SEQ ID NO: 1030411 - RNA, 22 nt, Molluscum contagiosum virus
gcucagcaugauguacuugaug

SEQ ID NO: 1030412 - RNA, 22 nt, Molluscum contagiosum virus
gcucagcauggaguuuugcaac

SEQ ID NO: 1030413 - RNA, 22 nt, Molluscum contagiosum virus
gcucauccaggcgccgcgcucg

SEQ ID NO: 1030414 - RNA, 22 nt, Molluscum contagiosum virus
gcuccgcgggcgccauaaagag

SEQ ID NO: 1030415 - RNA, 22 nt, Molluscum contagiosum virus
gcuccgcguggcagugcgcggg

SEQ ID NO: 1030416 - RNA, 22 nt, Molluscum contagiosum virus
gcguccagcuccagguuuagcu

SEQ ID NO: 1030417 - RNA, 22 nt, Molluscum contagiosum virus
gcgucccggcucugcucgucca

SEQ ID NO: 1030418 - RNA, 22 nt, Molluscum contagiosum virus
gcgucggacacguccagaaccu

SEQ ID NO: 1030419 - RNA, 22 nt, Molluscum contagiosum virus
gcgucgucgccguguuggaagu

SEQ ID NO: 1030420 - RNA, 22 nt, Molluscum contagiosum virus
gcgugcgccgcagugcaccauc

SEQ ID NO: 1030421 - RNA, 22 nt, Molluscum contagiosum virus
gcgugagccaauggacgccggg

SEQ ID NO: 1030422 - RNA, 22 nt, Molluscum contagiosum virus
gcggugcagcugccgcagagcc

SEQ ID NO: 1030423 - RNA, 22 nt, Molluscum contagiosum virus
gcggucgacgggaacgagguca

SEQ ID NO: 1030424 - RNA, 22 nt, Molluscum contagiosum virus
gacccaguggcguuugccguga

SEQ ID NO: 1030425 - RNA, 17 nt, Molluscum contagiosum virus
gacggaaugcgagcgcc

SEQ ID NO: 1030426 - RNA, 22 nt, Molluscum contagiosum virus
gacggcggguucucgucccgug

SEQ ID NO: 1030427 - RNA, 20 nt, Molluscum contagiosum virus
gaccuucuggggcucgaguc

SEQ ID NO: 1030428 - RNA, 22 nt, Molluscum contagiosum virus
gaaguucugcacagcacaggcc

SEQ ID NO: 1030429 - RNA, 22 nt, Molluscum contagiosum virus
gaacgacacggagcggaucgug

SEQ ID NO: 1030430 - RNA, 22 nt, Molluscum contagiosum virus
gaaguccagcacgcgcgcgugc

SEQ ID NO: 1030431 - RNA, 22 nt, Molluscum contagiosum virus
cuucgccaaugacggcgucucu

SEQ ID NO: 1030432 - RNA, 17 nt, Molluscum contagiosum virus
cuucgcgcagcuuggcc

SEQ ID NO: 1030433 - RNA, 22 nt, Molluscum contagiosum virus
cuguucgcgcagagauguuguc

SEQ ID NO: 1030434 - RNA, 22 nt, Molluscum contagiosum virus
cugggagcaccgcguggcgcgc

SEQ ID NO: 1030435 - RNA, 22 nt, Molluscum contagiosum virus
cugguguuuucguccauccacu

SEQ ID NO: 1030436 - RNA, 22 nt, Molluscum contagiosum virus
cugugcccgaguagaagagcgu

SEQ ID NO: 1030437 - RNA, 22 nt, Molluscum contagiosum virus
cugugcgcgcaggccacggggu

SEQ ID NO: 1030438 - RNA, 22 nt, Molluscum contagiosum virus
cugcgcguacgccgcaugguug

SEQ ID NO: 1030439 - RNA, 22 nt, Molluscum contagiosum virus
cuggcgggcagcucugcuggca

SEQ ID NO: 1030440 - RNA, 22 nt, Molluscum contagiosum virus
cuggacgacgugcagcaugcca

SEQ ID NO: 1030441 - RNA, 22 nt, Molluscum contagiosum virus
cguggucaagauccaagcgcaa

SEQ ID NO: 1030442 - RNA, 22 nt, Molluscum contagiosum virus
cuaggcguguccgcagcugugc

SEQ ID NO: 1030443 - RNA, 22 nt, Molluscum contagiosum virus
cuacgugcuggaacaggugcac

SEQ ID NO: 1030444 - RNA, 22 nt, Molluscum contagiosum virus
cugccaugcccacauuggcgcc

SEQ ID NO: 1030445 - RNA, 22 nt, Molluscum contagiosum virus
cugcaugcugugcuucguggag

SEQ ID NO: 1030446 - RNA, 22 nt, Molluscum contagiosum virus
cugccgcggggcuagcgcugca

SEQ ID NO: 1030447 - RNA, 22 nt, Molluscum contagiosum virus
cucguggcguugcugcugcgcg

SEQ ID NO: 1030448 - RNA, 22 nt, Molluscum contagiosum virus
cucugcgcuaucgagcacgucg

SEQ ID NO: 1030449 - RNA, 22 nt, Molluscum contagiosum virus
cucugugucggaauccucgcgg

SEQ ID NO: 1030450 - RNA, 22 nt, Molluscum contagiosum virus
cucgaugacgcggcgguugcgc

SEQ ID NO: 1030451 - RNA, 22 nt, Molluscum contagiosum virus
cucgcacacgcggaucuccuug

SEQ ID NO: 1030452 - RNA, 22 nt, Molluscum contagiosum virus
cuccgaugggucggucgugacu

SEQ ID NO: 1030453 - RNA, 22 nt, Molluscum contagiosum virus
cuccgcacacgugcucguugcc

SEQ ID NO: 1030454 - RNA, 22 nt, Molluscum contagiosum virus
cucccugcgcguacgccgcaug

SEQ ID NO: 1030455 - RNA, 22 nt, Molluscum contagiosum virus
cucgggcggguuguuggcgugg

SEQ ID NO: 1030456 - RNA, 20 nt, Molluscum contagiosum virus
cucggcgcuaugccgcgugc

SEQ ID NO: 1030457 - RNA, 22 nt, Molluscum contagiosum virus
cuccucgggcaaggaggcgagc

SEQ ID NO: 1030458 - RNA, 22 nt, Molluscum contagiosum virus
cucgcgcaucugccgcgacucc

SEQ ID NO: 1030459 - RNA, 22 nt, Molluscum contagiosum virus
cucgcgcgucuccgcguagaau

SEQ ID NO: 1030460 - RNA, 16 nt, Molluscum contagiosum virus
cguggcgcugcgcgag

SEQ ID NO: 1030461 - RNA, 22 nt, Molluscum contagiosum virus
ggcguccuucuuugcgugcgcc

SEQ ID NO: 1030462 - RNA, 22 nt, Molluscum contagiosum virus
ggcggaugcggacacguagacc

SEQ ID NO: 1030463 - RNA, 22 nt, Molluscum contagiosum virus
ggcggaugucacgcagaagugg

SEQ ID NO: 1030464 - RNA, 22 nt, Molluscum contagiosum virus
ggcguucgcagugcccgggggc

SEQ ID NO: 1030465 - RNA, 22 nt, Molluscum contagiosum virus
ggcuccucgcgcagcgccacgu

SEQ ID NO: 1030466 - RNA, 22 nt, Molluscum contagiosum virus
ggcucgaaaucugcgcgaggcc

SEQ ID NO: 1030467 - RNA, 22 nt, Molluscum contagiosum virus
ggcucgcaacuacccgcaggcc

SEQ ID NO: 1030468 - RNA, 22 nt, Molluscum contagiosum virus
ggcucgggguuggcuuugugca

SEQ ID NO: 1030469 - RNA, 22 nt, Molluscum contagiosum virus
ggcucguagauggcaggcacgu

SEQ ID NO: 1030470 - RNA, 23 nt, Molluscum contagiosum virus
gggaagcgugucacuuuccgaug

SEQ ID NO: 1030471 - RNA, 22 nt, Molluscum contagiosum virus
ggcugcagaaccgcgcgcugua

SEQ ID NO: 1030472 - RNA, 22 nt, Molluscum contagiosum virus
ggcuugcgcuuagaccuuuacg

SEQ ID NO: 1030473 - RNA, 23 nt, Molluscum contagiosum virus
ggcuugcgcuuagaccuuuacgu

SEQ ID NO: 1030474 - RNA, 22 nt, Molluscum contagiosum virus
gggcagcguguagcggcacacc

SEQ ID NO: 1030475 - RNA, 22 nt, Molluscum contagiosum virus
gggaccggcaccugcuacuccc

SEQ ID NO: 1030476 - RNA, 22 nt, Molluscum contagiosum virus
aacucgcucgcuuagggagccc

SEQ ID NO: 1030477 - RNA, 22 nt, Molluscum contagiosum virus
aacguuccgucgugugcuugcg

SEQ ID NO: 1030478 - RNA, 22 nt, Molluscum contagiosum virus
aaagcggaaaaaugcacgcccg

SEQ ID NO: 1030479 - RNA, 22 nt, Molluscum contagiosum virus
aagcacagcaggagcacgccug

SEQ ID NO: 1030480 - RNA, 19 nt, Molluscum contagiosum virus
gcgagcauguucugcgcga

SEQ ID NO: 1030481 - RNA, 22 nt, Molluscum contagiosum virus
gcgagcgccgugaacugugcag

SEQ ID NO: 1030482 - RNA, 22 nt, Molluscum contagiosum virus
aaggcgcacccucacaccuaga

SEQ ID NO: 1030483 - RNA, 22 nt, Molluscum contagiosum virus
aaggcgucgggagcaccgucag

SEQ ID NO: 1030484 - RNA, 22 nt, Molluscum contagiosum virus
aagggcucugccaccaugcgca

SEQ ID NO: 1030485 - RNA, 22 nt, Molluscum contagiosum virus
gcgaggcgcuggucucguucga

SEQ ID NO: 1030486 - RNA, 22 nt, Molluscum contagiosum virus
gcgcaagacgaguagugcgcga

SEQ ID NO: 1030487 - RNA, 22 nt, Molluscum contagiosum virus
gcgcacacgggcucgagcucgg

SEQ ID NO: 1030488 - RNA, 22 nt, Molluscum contagiosum virus
gcgccacgagcuugucccgcca

SEQ ID NO: 1030489 - RNA, 22 nt, Molluscum contagiosum virus
gcgccacuugagacucgcaugu

SEQ ID NO: 1030490 - RNA, 22 nt, Molluscum contagiosum virus
gcgcccugcgccgcacguaugg

SEQ ID NO: 1030491 - RNA, 22 nt, Molluscum contagiosum virus
gcgccgcgccuguguccgucuc

SEQ ID NO: 1030492 - RNA, 22 nt, Molluscum contagiosum virus
gcgccgcuggaggcgagcguug

SEQ ID NO: 1030493 - RNA, 22 nt, Molluscum contagiosum virus
gcgcugcuccgcucguucagca

SEQ ID NO: 1030494 - RNA, 23 nt, Molluscum contagiosum virus
gcgcgaaacgguaagcucgacgu

SEQ ID NO: 1030495 - RNA, 23 nt, Molluscum contagiosum virus
gcgcgcagacguggugcucgugg

SEQ ID NO: 1030496 - RNA, 19 nt, Molluscum contagiosum virus
gcgccgugccuggccuggc

SEQ ID NO: 1030497 - RNA, 17 nt, Molluscum contagiosum virus
gcgcgccuuucccgucc

SEQ ID NO: 1030498 - RNA, 22 nt, Molluscum contagiosum virus
gcgcgcggccauguguacgcag

SEQ ID NO: 1030499 - RNA, 22 nt, Molluscum contagiosum virus
gcgcgcuacacugugcucacgu

SEQ ID NO: 1030500 - RNA, 20 nt, Molluscum contagiosum virus
gcgcggacgcguuucuucgc

SEQ ID NO: 1030501 - RNA, 22 nt, Molluscum contagiosum virus
gcgcuggucacaugcacguacu

SEQ ID NO: 1030502 - RNA, 20 nt, Molluscum contagiosum virus
gcgcuucgagcacgcuuucc

SEQ ID NO: 1030503 - RNA, 22 nt, Molluscum contagiosum virus
gcggcccuucguguucgcggac

SEQ ID NO: 1030504 - RNA, 19 nt, Molluscum contagiosum virus
gcggcgccgucuuguugcc

SEQ ID NO: 1030505 - RNA, 22 nt, Molluscum contagiosum virus
gcggcgcuaccugcacaaggag

SEQ ID NO: 1030506 - RNA, 22 nt, Molluscum contagiosum virus
uccuccgcggccaauucgcgcu

SEQ ID NO: 1030507 - RNA, 22 nt, Molluscum contagiosum virus
uccucgguguacugcuugcagu

SEQ ID NO: 1030508 - RNA, 21 nt, Molluscum contagiosum virus
ucgagaggucaugaugguaca

SEQ ID NO: 1030509 - RNA, 19 nt, Molluscum contagiosum virus
ucgagcacgggcuuugcgu

SEQ ID NO: 1030510 - RNA, 22 nt, Molluscum contagiosum virus
uccgugcacgggcucgagcgcg

SEQ ID NO: 1030511 - RNA, 22 nt, Molluscum contagiosum virus
gucaaagaccgggcgguaguug

SEQ ID NO: 1030512 - RNA, 22 nt, Molluscum contagiosum virus
guagcucuggaugugcucggug

SEQ ID NO: 1030513 - RNA, 22 nt, Molluscum contagiosum virus
ggugcucguacuccucaugaau

SEQ ID NO: 1030514 - RNA, 22 nt, Molluscum contagiosum virus
ggugcacgcguagcacggccag

SEQ ID NO: 1030515 - RNA, 22 nt, Molluscum contagiosum virus
ggucuaagcgcaagccagagcu

SEQ ID NO: 1030516 - RNA, 19 nt, Molluscum contagiosum virus
ggucgcguuccaggugcug

SEQ ID NO: 1030517 - RNA, 18 nt, Molluscum contagiosum virus
gggucuggucgcacggag

SEQ ID NO: 1030518 - RNA, 22 nt, Molluscum contagiosum virus
gggugcagggcccuguuuugua

SEQ ID NO: 1030519 - RNA, 22 nt, Molluscum contagiosum virus
ggucgagucguucucgcgguac

SEQ ID NO: 1030520 - RNA, 20 nt, Molluscum contagiosum virus
gguacacggccucuggcggc

SEQ ID NO: 1030521 - RNA, 22 nt, Molluscum contagiosum virus
ucgugcucuaggugugagggug

SEQ ID NO: 1030522 - RNA, 23 nt, Molluscum contagiosum virus
ucggggaagagcagguggaugcc

SEQ ID NO: 1030523 - RNA, 22 nt, Molluscum contagiosum virus
ucggcgggcucggaaggugucg

SEQ ID NO: 1030524 - RNA, 22 nt, Molluscum contagiosum virus
ucggcgcaacgcuggccgccau

SEQ ID NO: 1030525 - RNA, 21 nt, Molluscum contagiosum virus
ucggagggucggagccugagc

SEQ ID NO: 1030526 - RNA, 22 nt, Molluscum contagiosum virus
ucggcaacgucggugcacguug

SEQ ID NO: 1030527 - RNA, 22 nt, Molluscum contagiosum virus
ucgcuagcagugccgccuccuc

SEQ ID NO: 1030528 - RNA, 22 nt, Molluscum contagiosum virus
ucgcguggaacuugacgccgua

SEQ ID NO: 1030529 - RNA, 22 nt, Molluscum contagiosum virus
ucgcgugugcggggcagcaggc

SEQ ID NO: 1030530 - RNA, 22 nt, Molluscum contagiosum virus
ucgcccagauccgcccagcuug

SEQ ID NO: 1030531 - RNA, 22 nt, Molluscum contagiosum virus
ucgcccguguucgcggagcugu

SEQ ID NO: 1030532 - RNA, 22 nt, Molluscum contagiosum virus
ucgcggcgccgcuguccuguga

SEQ ID NO: 1030533 - RNA, 22 nt, Molluscum contagiosum virus
ggagcagcggcucguagcuggu

SEQ ID NO: 1030534 - RNA, 22 nt, Molluscum contagiosum virus
ggacgacgaguacgugcaugug

SEQ ID NO: 1030535 - RNA, 22 nt, Molluscum contagiosum virus
ggaguagcgugcgccugcagcc

SEQ ID NO: 1030536 - RNA, 22 nt, Molluscum contagiosum virus
ggaaaacgcccagaaugccgag

SEQ ID NO: 1030537 - RNA, 22 nt, Molluscum contagiosum virus
ggaagaccgucgugcuguuguc

SEQ ID NO: 1030538 - RNA, 22 nt, Molluscum contagiosum virus
ggaagcgcucuagguugggugu

SEQ ID NO: 1030539 - RNA, 21 nt, Molluscum contagiosum virus
ggaagcgggcgagaucguggc

SEQ ID NO: 1030540 - RNA, 22 nt, Molluscum contagiosum virus
ggaaggccacuggcgagcguac

SEQ ID NO: 1030541 - RNA, 22 nt, Molluscum contagiosum virus
ggacgcgucucaacgugggagu

SEQ ID NO: 1030542 - RNA, 22 nt, Molluscum contagiosum virus
ggacgcucgugaggaaagcguu

SEQ ID NO: 1030543 - RNA, 22 nt, Molluscum contagiosum virus
ggagaaaagggguuguaguccc

SEQ ID NO: 1030544 - RNA, 22 nt, Molluscum contagiosum virus
ggcagcgaaacgcgugccucgc

SEQ ID NO: 1030545 - RNA, 22 nt, Molluscum contagiosum virus
ggaugccuuucaggggucuguc

SEQ ID NO: 1030546 - RNA, 22 nt, Molluscum contagiosum virus
ggaugcuggugucgagcucgcg

SEQ ID NO: 1030547 - RNA, 22 nt, Molluscum contagiosum virus
ggcaacgcaugcagucgacggc

SEQ ID NO: 1030548 - RNA, 22 nt, Molluscum contagiosum virus
ggcacgcuggcacuugcgggug

SEQ ID NO: 1030549 - RNA, 22 nt, Molluscum contagiosum virus
ggaucauggugugcacguucgc

SEQ ID NO: 1030550 - RNA, 22 nt, Molluscum contagiosum virus
ggcgacaucuucaugguuacgg

SEQ ID NO: 1030551 - RNA, 22 nt, Molluscum contagiosum virus
ggccugugcugugcagaacuuc

SEQ ID NO: 1030552 - RNA, 22 nt, Molluscum contagiosum virus
ggccuucgcugccuucgaagag

SEQ ID NO: 1030553 - RNA, 22 nt, Molluscum contagiosum virus
ggcgccucgagcgcgcuggacu

SEQ ID NO: 1030554 - RNA, 22 nt, Molluscum contagiosum virus
ugugugugcgcucacacggaac

SEQ ID NO: 1030555 - RNA, 19 nt, Molluscum contagiosum virus
uguccugguucuuugcgcg

SEQ ID NO: 1030556 - RNA, 22 nt, Molluscum contagiosum virus
ugucggucucgagcgccgccau

SEQ ID NO: 1030557 - RNA, 22 nt, Molluscum contagiosum virus
ugugcucgcgugccuugcgcgu

SEQ ID NO: 1030558 - RNA, 22 nt, Molluscum contagiosum virus
uguggacuccuugugcagguag

SEQ ID NO: 1030559 - RNA, 22 nt, Molluscum contagiosum virus
ugguguagaggaagcgcaggug

SEQ ID NO: 1030560 - RNA, 22 nt, Molluscum contagiosum virus
uggucgugcucgugcaccucgu

SEQ ID NO: 1030561 - RNA, 22 nt, Molluscum contagiosum virus
uggucuucuugccgcggcagcg

SEQ ID NO: 1030562 - RNA, 22 nt, Molluscum contagiosum virus
uggugcacgaguccgcgggcgg

SEQ ID NO: 1030563 - RNA, 22 nt, Molluscum contagiosum virus
uguccacguaccugucgagugc

SEQ ID NO: 1030564 - RNA, 22 nt, Molluscum contagiosum virus
ugucaagcacggaaaggaagug

SEQ ID NO: 1030565 - RNA, 22 nt, Molluscum contagiosum virus
uguccgagcgaaccgcggcagc

SEQ ID NO: 1030566 - RNA, 22 nt, Molluscum contagiosum virus
ugugauggagggucuaggcuuc

SEQ ID NO: 1030567 - RNA, 22 nt, Molluscum contagiosum virus
ugugcacgcacgcgguugcgcc

SEQ ID NO: 1030568 - RNA, 21 nt, Molluscum contagiosum virus
ugugcgaggacguggcgcugc

SEQ ID NO: 1030569 - RNA, 22 nt, Molluscum contagiosum virus
caaugcgugcgcccgucgccgu

SEQ ID NO: 1030570 - RNA, 22 nt, Molluscum contagiosum virus
caaugucugugugcgaucugga

SEQ ID NO: 1030571 - RNA, 23 nt, Molluscum contagiosum virus
auuucccugccggugcguuggca

SEQ ID NO: 1030572 - RNA, 22 nt, Molluscum contagiosum virus
cagcacgcgcagcguguccaug

SEQ ID NO: 1030573 - RNA, 22 nt, Molluscum contagiosum virus
cagacgcgacaccuuccgagcc

SEQ ID NO: 1030574 - RNA, 22 nt, Molluscum contagiosum virus
cacugacaaggucuuucucgcg

SEQ ID NO: 1030575 - RNA, 22 nt, Molluscum contagiosum virus
cagcgcgugccgcagaagguug

SEQ ID NO: 1030576 - RNA, 22 nt, Molluscum contagiosum virus
cagcaguagaaaaugcccagcc

SEQ ID NO: 1030577 - RNA, 19 nt, Molluscum contagiosum virus
cagcagugccagcgcuguc

SEQ ID NO: 1030578 - RNA, 22 nt, Molluscum contagiosum virus
cagcagugccagcgcuguccgc

SEQ ID NO: 1030579 - RNA, 22 nt, Molluscum contagiosum virus
cacgccucaagcucgggcccag

SEQ ID NO: 1030580 - RNA, 22 nt, Molluscum contagiosum virus
cacgcgcacgcucucgcuggcu

SEQ ID NO: 1030581 - RNA, 22 nt, Molluscum contagiosum virus
cacgcgcagcucaaugagcgug

SEQ ID NO: 1030582 - RNA, 22 nt, Molluscum contagiosum virus
cacgcuagucguuggcgcgccc

SEQ ID NO: 1030583 - RNA, 22 nt, Molluscum contagiosum virus
cacgacggcggguucucguccc

SEQ ID NO: 1030584 - RNA, 22 nt, Molluscum contagiosum virus
cacgggcgcggagaacugcacc

SEQ ID NO: 1030585 - RNA, 22 nt, Molluscum contagiosum virus
ccagcgccgccaggacagcauu

SEQ ID NO: 1030586 - RNA, 20 nt, Molluscum contagiosum virus
ccagcgccuguccgugggcg

SEQ ID NO: 1030587 - RNA, 22 nt, Molluscum contagiosum virus
ccaggccugggcuucggaagcg

SEQ ID NO: 1030588 - RNA, 22 nt, Molluscum contagiosum virus
uggccgugcccgccgacugccg

SEQ ID NO: 1030589 - RNA, 22 nt, Molluscum contagiosum virus
uggcuucucgacuggagggggc

SEQ ID NO: 1030590 - RNA, 22 nt, Molluscum contagiosum virus
ugggcuacagacaggcacgcgc

SEQ ID NO: 1030591 - RNA, 22 nt, Molluscum contagiosum virus
ugggcuccgugagcucguccga

SEQ ID NO: 1030592 - RNA, 22 nt, Molluscum contagiosum virus
caucuucuugaugaucuugcgc

SEQ ID NO: 1030593 - RNA, 22 nt, Molluscum contagiosum virus
caugacgcgcgugcgcaugucg

SEQ ID NO: 1030594 - RNA, 22 nt, Molluscum contagiosum virus
caugcacagccgcuuucugggc

SEQ ID NO: 1030595 - RNA, 22 nt, Molluscum contagiosum virus
caugggcucguccuguacuggc

SEQ ID NO: 1030596 - RNA, 22 nt, Molluscum contagiosum virus
cauguggaugucgcaguagaug

SEQ ID NO: 1030597 - RNA, 22 nt, Molluscum contagiosum virus
caggaauugcagcgccugcgac

SEQ ID NO: 1030598 - RNA, 22 nt, Molluscum contagiosum virus
caucagguagcgcucguccacg

SEQ ID NO: 1030599 - RNA, 22 nt, Molluscum contagiosum virus
auguuggccagguagguguucu

SEQ ID NO: 1030600 - RNA, 22 nt, Human
ccagcagagcauggggaggaag

SEQ ID NO: 1030601 - RNA, 21 nt, Human
gggcuggacaugguggcucau

SEQ ID NO: 1030602 - RNA, 22 nt, Human
cugcccuguuuggacagcccgg

SEQ ID NO: 1030603 - RNA, 22 nt, Human
ucaggggacagccagcuggagg

SEQ ID NO: 1030604 - RNA, 22 nt, Human
agagcuggcugguagcccugau

SEQ ID NO: 1030605 - RNA, 22 nt, Human
uccagccaugcaugacaaucac

SEQ ID NO: 1030606 - RNA, 22 nt, Human
cagcaugcaaguccagaugugg

SEQ ID NO: 1030607 - RNA, 22 nt, Human
guccucuguguaggcugcagac

SEQ ID NO: 1030608 - RNA, 22 nt, Human
cugggcacaggggagcagaguc

SEQ ID NO: 1030609 - RNA, 22 nt, Human
agccuccaguagcugaagagac

SEQ ID NO: 1030610 - RNA, 22 nt, Human
gcccucuggcagccuuggcugg

SEQ ID NO: 1030611 - RNA, 22 nt, Human
aaagaacagauguguggugcau

SEQ ID NO: 1030612 - RNA, 22 nt, Human
uaaaucaguuucucuuauuggu

SEQ ID NO: 1030613 - RNA, 22 nt, Human
aaaucugguucaguaaguccuc

SEQ ID NO: 1030614 - RNA, 22 nt, Human
cccuggcagaaugucucugggc

SEQ ID NO: 1030615 - RNA, 22 nt, Human
ucuggcucccagccugcucuca

SEQ ID NO: 1030616 - RNA, 22 nt, Human
uguacaguauauuucaaagcca

SEQ ID NO: 1030617 - RNA, 22 nt, Human
aaggcacuagcagaauuaguga

SEQ ID NO: 1030618 - RNA, 22 nt, Human
gcuggcagggacagcugcgugu

SEQ ID NO: 1030619 - RNA, 22 nt, Human
gccugcagccucaagggcugag

SEQ ID NO: 1030620 - RNA, 22 nt, Human
agcagagcuauucuugugcaau

SEQ ID NO: 1030621 - RNA, 22 nt, Human
aaggccagcuuguagggcuggu

SEQ ID NO: 1030622 - RNA, 23 nt, Human
gccugggacugguagugugaccu

SEQ ID NO: 1030623 - RNA, 22 nt, Human
agccuucaaccuagcuagagca

SEQ ID NO: 1030624 - RNA, 22 nt, Human
cagguggggcagcugugggagc

SEQ ID NO: 1030625 - RNA, 22 nt, Human
accagagcuuacaugcuagaaa

SEQ ID NO: 1030626 - RNA, 22 nt, Human
gcagaggcuccauuuuacagau

SEQ ID NO: 1030627 - RNA, 22 nt, Human
gcuggagccuucugcucuguug

SEQ ID NO: 1030628 - RNA, 22 nt, Human
uuaguaaauaaagucuacuuuc

SEQ ID NO: 1030629 - RNA, 22 nt, Human
aaugauggauuuagacaagcug

SEQ ID NO: 1030630 - RNA, 22 nt, Human
ggcuggaaguccaagaucaaga

SEQ ID NO: 1030631 - RNA, 23 nt, Human
aggugccaacugagagcugagag

SEQ ID NO: 1030632 - RNA, 22 nt, Human
gcucagagaaucagcagacacc

SEQ ID NO: 1030633 - RNA, 22 nt, Human
gaugcacuugccccuccucaga

SEQ ID NO: 1030634 - RNA, 22 nt, Human
cuggagcucuguguguuccuga

SEQ ID NO: 1030635 - RNA, 22 nt, Human
uggaaagaaaguaaaggcguau

SEQ ID NO: 1030636 - RNA, 22 nt, Human
acauuucucagggaguuuugcu

SEQ ID NO: 1030637 - RNA, 22 nt, Human
uggcucuguugugcugagccag

SEQ ID NO: 1030638 - RNA, 22 nt, Human
cugggcagaauuuuaggauggc

SEQ ID NO: 1030639 - RNA, 22 nt, Human
gccuggagggucccucucugga

SEQ ID NO: 1030640 - RNA, 22 nt, Human
cucagagaagucuuugcuaaac

SEQ ID NO: 1030641 - RNA, 22 nt, Human
uuccauaauaggcuuaagugaa

SEQ ID NO: 1030642 - RNA, 22 nt, Human
gcagugaaucuggcaagaauuu

SEQ ID NO: 1030643 - RNA, 20 nt, Human
ucauugcacauaauggaagc

SEQ ID NO: 1030644 - RNA, 22 nt, Human
cuuacauuaaguaagagauuga

SEQ ID NO: 1030645 - RNA, 22 nt, Human
caagggcucuuuugaggaaugu

SEQ ID NO: 1030646 - RNA, 22 nt, Human
agauuuccaucuuuuucaugug

SEQ ID NO: 1030647 - RNA, 17 nt, Human
aggcagcucagaacauc

SEQ ID NO: 1030648 - RNA, 22 nt, Human
agcuggguggagggcccacggu

SEQ ID NO: 1030649 - RNA, 22 nt, Human
aacaaaugauuguugguuggag

SEQ ID NO: 1030650 - RNA, 22 nt, Human
ucaaacuguuuacagugagaua

SEQ ID NO: 1030651 - RNA, 22 nt, Human
cagggccaaguuggugccuuuu

SEQ ID NO: 1030652 - RNA, 22 nt, Human
uaacagaaauuuuaguuagggg

SEQ ID NO: 1030653 - RNA, 22 nt, Human
auaagagcuagucuuuuccuug

SEQ ID NO: 1030654 - RNA, 22 nt, Human
gguccuggaaauugacggaaag

SEQ ID NO: 1030655 - RNA, 22 nt, Human
ucaagagaagugcuccacagua

SEQ ID NO: 1030656 - RNA, 23 nt, Human
gagagcugacugucaagacuguu

SEQ ID NO: 1030657 - RNA, 21 nt, Human
aucuuuauuacgcagagaaga

SEQ ID NO: 1030658 - RNA, 22 nt, Human
agauuucagaugcucggcaguu

SEQ ID NO: 1030659 - RNA, 22 nt, Human
ccacaaguuucagcacccagag

SEQ ID NO: 1030660 - RNA, 22 nt, Human
uacauucaacaugucacuaugu

SEQ ID NO: 1030661 - RNA, 22 nt, Human
uggccagguguggguucucaga

SEQ ID NO: 1030662 - RNA, 22 nt, Human
aucagcaagacuaggggaauac

SEQ ID NO: 1030663 - RNA, 22 nt, Human
guuagaaagugucugcuugggu

SEQ ID NO: 1030664 - RNA, 22 nt, Human
ccaaaauguuugaaugcaugug

SEQ ID NO: 1030665 - RNA, 22 nt, Human
agggcagccugagugcuggccc

SEQ ID NO: 1030666 - RNA, 22 nt, Human
cagaggccccagaacuagcucu

SEQ ID NO: 1030667 - RNA, 22 nt, Human
ggggcagauggaacagagcaca

SEQ ID NO: 1030668 - RNA, 22 nt, Human
cagacacagauaugcauauggc

SEQ ID NO: 1030669 - RNA, 22 nt, Human
cugcucugugguccaugagaca

SEQ ID NO: 1030670 - RNA, 22 nt, Human
caggccucuauggucagcugag

SEQ ID NO: 1030671 - RNA, 22 nt, Human
ugucucugagaugacucccacc

SEQ ID NO: 1030672 - RNA, 22 nt, Human
uggaggaugccauccaggauac

SEQ ID NO: 1030673 - RNA, 22 nt, Human
agugaaauaugcccauugcugu

SEQ ID NO: 1030674 - RNA, 22 nt, Human
ucccagcgcggggggaggaucc

SEQ ID NO: 1030675 - RNA, 22 nt, Human
agcuggagaugcccagcaccgg

SEQ ID NO: 1030676 - RNA, 22 nt, Human
cugcccugagggccuguguguu

SEQ ID NO: 1030677 - RNA, 22 nt, Human
aggagcuggaguccaggcaagu

SEQ ID NO: 1030678 - RNA, 22 nt, Human
ugaaggaaagagggaacauccc

SEQ ID NO: 1030679 - RNA, 23 nt, Human
uggcaccaggcauucuaggggua

SEQ ID NO: 1030680 - RNA, 23 nt, Human
uccugagaugagacagugcugcc

SEQ ID NO: 1030681 - RNA, 22 nt, Human
gagacaaaaguuggagugcaag

SEQ ID NO: 1030682 - RNA, 22 nt, Human
ggucucagaucuuuauuaaggc

SEQ ID NO: 1030683 - RNA, 22 nt, Human
ugggcagagucguggggaauag

SEQ ID NO: 1030684 - RNA, 22 nt, Human
uugccaggagcucaucugaggg

SEQ ID NO: 1030685 - RNA, 22 nt, Human
ucuggcagggguucugcacuug

SEQ ID NO: 1030686 - RNA, 22 nt, Human
ugcaggagcagagauggcugga

SEQ ID NO: 1030687 - RNA, 22 nt, Human
uugaggagcaggaugggaggcu

SEQ ID NO: 1030688 - RNA, 21 nt, Human
uccucagggccccagagcacu

SEQ ID NO: 1030689 - RNA, 22 nt, Human
acauuucucccugcaugccugc

SEQ ID NO: 1030690 - RNA, 22 nt, Human
ugcacagcgggugucugucagg

SEQ ID NO: 1030691 - RNA, 22 nt, Human
auguaucagauaaagcaugugg

SEQ ID NO: 1030692 - RNA, 22 nt, Human
caggggcuguuugccucaggcc

SEQ ID NO: 1030693 - RNA, 22 nt, Human
cugagauggccacugggucuca

SEQ ID NO: 1030694 - RNA, 22 nt, Human
ugggcccaagagagucuccaac

SEQ ID NO: 1030695 - RNA, 22 nt, Human
aguggugcugcgcgcggagcuc

SEQ ID NO: 1030696 - RNA, 22 nt, Human
uccagcagggaauuaguagucu

SEQ ID NO: 1030697 - RNA, 22 nt, Human
auaauaacaccugaauaggaaa

SEQ ID NO: 1030698 - RNA, 22 nt, Human
gaugguuuaugauagaugggaa

SEQ ID NO: 1030699 - RNA, 22 nt, Human
cuggccuuuagccccagugucu

SEQ ID NO: 1030700 - RNA, 22 nt, Human
acagaccaaaaaaggauauugg

SEQ ID NO: 1030701 - RNA, 22 nt, Human
ccucacagggccaggccccuca

SEQ ID NO: 1030702 - RNA, 22 nt, Human
uuugcauuuguuuagaaccuga

SEQ ID NO: 1030703 - RNA, 22 nt, Human
gcucaggaucagccaccucuuu

SEQ ID NO: 1030704 - RNA, 22 nt, Human
gccucccuggcccacagcagcg

SEQ ID NO: 1030705 - RNA, 22 nt, Human
cuguacauauacauuuuuuucc

SEQ ID NO: 1030706 - RNA, 22 nt, Human
ggcagcuguggacgucgucauu

SEQ ID NO: 1030707 - RNA, 22 nt, Human
cuuauguaaacuacagauaaua

SEQ ID NO: 1030708 - RNA, 22 nt, Human
gcagcugcuggaaguuccugcc

SEQ ID NO: 1030709 - RNA, 22 nt, Human
accuggcaugaagcaugccuua

SEQ ID NO: 1030710 - RNA, 23 nt, Human
aggaacugaggccuagggaggua

SEQ ID NO: 1030711 - RNA, 20 nt, Human
cccuccagcaaccaggacuu

SEQ ID NO: 1030712 - RNA, 20 nt, Human
uacagaaacaggacuuuugg

SEQ ID NO: 1030713 - RNA, 22 nt, Human
aggcugaggcagguggaucacc

SEQ ID NO: 1030714 - RNA, 23 nt, Human
ugauuuccagugagucaguggga

SEQ ID NO: 1030715 - RNA, 22 nt, Human
ucagcaggcgguuccuuguggg

SEQ ID NO: 1030716 - RNA, 22 nt, Human
ccaggaagccucagaugcugag

SEQ ID NO: 1030717 - RNA, 22 nt, Human
uagauaaauuagaaaguuuacu

SEQ ID NO: 1030718 - RNA, 22 nt, Human
ugugccugucacccucagagag

SEQ ID NO: 1030719 - RNA, 22 nt, Human
cuggcugcuggccugaggaugc

SEQ ID NO: 1030720 - RNA, 17 nt, Human
gcugagugcagggaguc

SEQ ID NO: 1030721 - RNA, 22 nt, Human
ugcaggcuguaaucugaggcua

SEQ ID NO: 1030722 - RNA, 22 nt, Human
guguaaggugaaaucaacaaau

SEQ ID NO: 1030723 - RNA, 23 nt, Human
gcugcagcuguggauguucucag

SEQ ID NO: 1030724 - RNA, 22 nt, Human
agaugagggguagaaaggacuu

SEQ ID NO: 1030725 - RNA, 20 nt, Human
caagcccucuuuagccugcc

SEQ ID NO: 1030726 - RNA, 22 nt, Human
aacagaaugcaggggaugcugc

SEQ ID NO: 1030727 - RNA, 19 nt, Human
agcagccaucgaccaugga

SEQ ID NO: 1030728 - RNA, 22 nt, Human
ggcucagaaacuaaaggcgcug

SEQ ID NO: 1030729 - RNA, 22 nt, Human
cucccugggcagauguggcucu

SEQ ID NO: 1030730 - RNA, 22 nt, Human
cugcacagagcagggcagacac

SEQ ID NO: 1030731 - RNA, 22 nt, Human
guauacauagaugaugaacaag

SEQ ID NO: 1030732 - RNA, 22 nt, Human
ugaagcaggaucguuugcuuca

SEQ ID NO: 1030733 - RNA, 22 nt, Human
gugcuuccccaagccacagccu

SEQ ID NO: 1030734 - RNA, 22 nt, Human
ggggccuguagagcuucaggga

SEQ ID NO: 1030735 - RNA, 21 nt, Human
accagcaggagaucagaagga

SEQ ID NO: 1030736 - RNA, 19 nt, Human
cagagcugcuggccucguc

SEQ ID NO: 1030737 - RNA, 22 nt, Human
caguuucugggcguucacaggu

SEQ ID NO: 1030738 - RNA, 22 nt, Human
cacagaauaaauugguaucaga

SEQ ID NO: 1030739 - RNA, 21 nt, Human
ucuggagcccuaagcugagaa

SEQ ID NO: 1030740 - RNA, 22 nt, Human
ucagggcaccaaaaaagaugcc

SEQ ID NO: 1030741 - RNA, 22 nt, Human
ucaccaggcuggaaugcagugg

SEQ ID NO: 1030742 - RNA, 22 nt, Human
cuggagcuggcuuccuuccacu

SEQ ID NO: 1030743 - RNA, 22 nt, Human
ucuggcuccacuuucuucauuu

SEQ ID NO: 1030744 - RNA, 22 nt, Human
gagcagcuguccccaaagcuuc

SEQ ID NO: 1030745 - RNA, 22 nt, Human
cuuuccuagauggccaucuuuc

SEQ ID NO: 1030746 - RNA, 22 nt, Human
gagagcuguaauagucaugucu

SEQ ID NO: 1030747 - RNA, 22 nt, Human
cuuguacauagagaagaagccu

SEQ ID NO: 1030748 - RNA, 22 nt, Human
ggcuggcacucuguccaguguc

SEQ ID NO: 1030749 - RNA, 22 nt, Human
acacaguauuacaauaggugcu

SEQ ID NO: 1030750 - RNA, 22 nt, Human
ggcagauggagaagcagcaggu

SEQ ID NO: 1030751 - RNA, 17 nt, Human
aguggcaggcagauggg

SEQ ID NO: 1030752 - RNA, 22 nt, Human
uucuuucccagaagauauguuu

SEQ ID NO: 1030753 - RNA, 22 nt, Human
ccuuucagaugggcauggaccg

SEQ ID NO: 1030754 - RNA, 22 nt, Human
acccagcuggaugcauggaggc

SEQ ID NO: 1030755 - RNA, 22 nt, Human
cagagccagcaguggggacagg

SEQ ID NO: 1030756 - RNA, 22 nt, Human
aggcagaaaauagucauccaaa

SEQ ID NO: 1030757 - RNA, 22 nt, Human
ucugcagaaguggcugggccac

SEQ ID NO: 1030758 - RNA, 22 nt, Human
ugcaggccggcccuaggccuca

SEQ ID NO: 1030759 - RNA, 22 nt, Human
uuccauauuuguguggcaaaag

SEQ ID NO: 1030760 - RNA, 21 nt, Human
ggagucauuagucauuuccuu

SEQ ID NO: 1030761 - RNA, 22 nt, Human
gugcccaggcccaaggcaccac

SEQ ID NO: 1030762 - RNA, 21 nt, Human
uuuauguacuucauagaguag

SEQ ID NO: 1030763 - RNA, 22 nt, Human
aauuaacaaauguagcugugau

SEQ ID NO: 1030764 - RNA, 22 nt, Human
ucaaguauaucuagucauuagg

SEQ ID NO: 1030765 - RNA, 22 nt, Human
ucagagccaaucauggugcauu

SEQ ID NO: 1030766 - RNA, 22 nt, Human
cccagacauaacagcagagagg

SEQ ID NO: 1030767 - RNA, 22 nt, Human
gcaggguauaauacuuagguga

SEQ ID NO: 1030768 - RNA, 22 nt, Human
cugggcaguuuuacaucauugc

SEQ ID NO: 1030769 - RNA, 22 nt, Human
ucagugcagaauagugaugcau

SEQ ID NO: 1030770 - RNA, 22 nt, Human
acacaugcugauaagaauauaa

SEQ ID NO: 1030771 - RNA, 22 nt, Human
ccuggagcuuuuccauccugga

SEQ ID NO: 1030772 - RNA, 20 nt, Human
acugcuucuuucucugaccu

SEQ ID NO: 1030773 - RNA, 22 nt, Human
ugagacaguucugcagcugggu

SEQ ID NO: 1030774 - RNA, 22 nt, Human
uguuauugagguuacuuauaag

SEQ ID NO: 1030775 - RNA, 22 nt, Human
uggagccaggagccugggaguc

SEQ ID NO: 1030776 - RNA, 19 nt, Human
ccagagcccgccagauggg

SEQ ID NO: 1030777 - RNA, 22 nt, Human
uggcucaguaaucgagucuccu

SEQ ID NO: 1030778 - RNA, 22 nt, Human
uagaaaauagggccuguggagc

SEQ ID NO: 1030779 - RNA, 22 nt, Human
uuuccucuccaccaggaggucu

SEQ ID NO: 1030780 - RNA, 22 nt, Human
cuggcccagagagcagagcuua

SEQ ID NO: 1030781 - RNA, 22 nt, Human
cguggccuuugagugagcuccc

SEQ ID NO: 1030782 - RNA, 22 nt, Human
gagccugaugaaacaggcagac

SEQ ID NO: 1030783 - RNA, 19 nt, Human
ugcuuccucaccaucuccc

SEQ ID NO: 1030784 - RNA, 22 nt, Human
uaugcacacauuagcacagggu

SEQ ID NO: 1030785 - RNA, 22 nt, Human
ggcagcugugaagugccucaca

SEQ ID NO: 1030786 - RNA, 22 nt, Human
aagcuggcaauuaucaaaacug

SEQ ID NO: 1030787 - RNA, 22 nt, Human
cggagcugccugccaagccugc

SEQ ID NO: 1030788 - RNA, 22 nt, Human
cagugcaugaaacaauaugcag

SEQ ID NO: 1030789 - RNA, 22 nt, Human
ggguggcacaggugcagagggu

SEQ ID NO: 1030790 - RNA, 22 nt, Human
aggagcagaccguaguccugca

SEQ ID NO: 1030791 - RNA, 22 nt, Human
ucaucaaagcgcuuggaguagg

SEQ ID NO: 1030792 - RNA, 22 nt, Human
ucauugcaggcauuccccugcc

SEQ ID NO: 1030793 - RNA, 22 nt, Human
ucucagagccuaacuaaccuaa

SEQ ID NO: 1030794 - RNA, 22 nt, Human
agggcugcuccuccuucaggcc

SEQ ID NO: 1030795 - RNA, 22 nt, Human
ccaggcugcucacaagcugccc

SEQ ID NO: 1030796 - RNA, 20 nt, Human
ucugcucagcccucaguggc

SEQ ID NO: 1030797 - RNA, 22 nt, Human
aaaguuagaaugauaucaacga

SEQ ID NO: 1030798 - RNA, 22 nt, Human
gauccuugcaacucugugaggu

SEQ ID NO: 1030799 - RNA, 22 nt, Human
uccaagaagucaucuaaacugu

SEQ ID NO: 1030800 - RNA, 21 nt, Human
gcagagccggggcgagaaggc

SEQ ID NO: 1030801 - RNA, 22 nt, Human
ucucugggaaugggccugggua

SEQ ID NO: 1030802 - RNA, 23 nt, Human
gagguacagcaccagugaauagg

SEQ ID NO: 1030803 - RNA, 22 nt, Human
ucauuuccucaaauucaagguu

SEQ ID NO: 1030804 - RNA, 22 nt, Human
cugaggcuuggaggggucuggu

SEQ ID NO: 1030805 - RNA, 22 nt, Human
ugcugaggagguggcugugcuu

SEQ ID NO: 1030806 - RNA, 22 nt, Human
gcucucugguuccagucaggaa

SEQ ID NO: 1030807 - RNA, 22 nt, Human
gccagagcacaggcugguagua

SEQ ID NO: 1030808 - RNA, 22 nt, Human
aaaagacaucuauuucaggcag

SEQ ID NO: 1030809 - RNA, 22 nt, Human
uuggccuuaaccucucugugcc

SEQ ID NO: 1030810 - RNA, 22 nt, Human
agugaaauggaugcugcuacug

SEQ ID NO: 1030811 - RNA, 22 nt, Human
ugucaugccauuuaaaauguuu

SEQ ID NO: 1030812 - RNA, 22 nt, Human
agagccaggaugucuucugggg

SEQ ID NO: 1030813 - RNA, 22 nt, Human
acugucugcuggccccugguua

SEQ ID NO: 1030814 - RNA, 22 nt, Human
acugaguguaggacuuugaguu

SEQ ID NO: 1030815 - RNA, 22 nt, Human
gucugcccucacgccagcuggg

SEQ ID NO: 1030816 - RNA, 22 nt, Human
uggcagcuguguccagguagaa

SEQ ID NO: 1030817 - RNA, 22 nt, Human
gccagcagccacagaagucacu

SEQ ID NO: 1030818 - RNA, 22 nt, Human
ggccaugguuggggaagacaug

SEQ ID NO: 1030819 - RNA, 22 nt, Human
gcagggcuauuggaaggagaug

SEQ ID NO: 1030820 - RNA, 19 nt, Human
ccuuggaguuccaggugga

SEQ ID NO: 1030821 - RNA, 22 nt, Human
aggagcagcccacuccuguccu

SEQ ID NO: 1030822 - RNA, 22 nt, Human
acaaaguuauucuuucagagga

SEQ ID NO: 1030823 - RNA, 22 nt, Human
ucuggaaguuagaggaggaaag

SEQ ID NO: 1030824 - RNA, 22 nt, Human
uuguguccugauuugacacaau

SEQ ID NO: 1030825 - RNA, 22 nt, Human
agcugcuguccuaggcacugua

SEQ ID NO: 1030826 - RNA, 17 nt, Human
gugcagggaugaaggau

SEQ ID NO: 1030827 - RNA, 22 nt, Human
ugggcagaguagcucagaagaa

SEQ ID NO: 1030828 - RNA, 22 nt, Human
cuggagccacugggucuuguau

SEQ ID NO: 1030829 - RNA, 22 nt, Human
uggcgugcccuccagacuuggc

SEQ ID NO: 1030830 - RNA, 22 nt, Human
ggccaggaagggaagaucagca

SEQ ID NO: 1030831 - RNA, 23 nt, Human
caguacuuaguguagcguuaauu

SEQ ID NO: 1030832 - RNA, 22 nt, Human
gcaagcaguuguggcuucugag

SEQ ID NO: 1030833 - RNA, 22 nt, Human
gugucauguagaaauugaugaa

SEQ ID NO: 1030834 - RNA, 22 nt, Human
accuggcacuacaggcaccugu

SEQ ID NO: 1030835 - RNA, 18 nt, Human
gggcaagcggcugucacc

SEQ ID NO: 1030836 - RNA, 19 nt, Human
ugcagccacgugagagacu

SEQ ID NO: 1030837 - RNA, 19 nt, Human
cuguggcugaccucuggcc

SEQ ID NO: 1030838 - RNA, 22 nt, Human
agaaguuaccacauacuucucu

SEQ ID NO: 1030839 - RNA, 22 nt, Human
ggcuucugagugcucugcuguu

SEQ ID NO: 1030840 - RNA, 22 nt, Human
guuauguaucuugauugggugg

SEQ ID NO: 1030841 - RNA, 22 nt, Human
uggccugggcaugaagcaucgu

SEQ ID NO: 1030842 - RNA, 20 nt, Human
ccuggagccuggaaggaguc

SEQ ID NO: 1030843 - RNA, 22 nt, Human
ucccuggguccugcuugcucuc

SEQ ID NO: 1030844 - RNA, 23 nt, Human
ccaaagucgaagucuaguccaga

SEQ ID NO: 1030845 - RNA, 22 nt, Human
cugugucccuugucccagagcc

SEQ ID NO: 1030846 - RNA, 22 nt, Human
agggcagagcacugaauuggga

SEQ ID NO: 1030847 - RNA, 22 nt, Human
cagccuccugggacacucaccg

SEQ ID NO: 1030848 - RNA, 22 nt, Human
uaacagaaaagaacugaguuug

SEQ ID NO: 1030849 - RNA, 22 nt, Human
aaaguuuccugcuaagugcuau

SEQ ID NO: 1030850 - RNA, 22 nt, Human
gccuaggagacaagcgugaaag

SEQ ID NO: 1030851 - RNA, 22 nt, Human
ccucuuccacugggccccaucc

SEQ ID NO: 1030852 - RNA, 22 nt, Human
cacauggggcgcugcauuggcc

SEQ ID NO: 1030853 - RNA, 19 nt, Human
cuggggcuuugguacugcc

SEQ ID NO: 1030854 - RNA, 16 nt, Human
ccaccugcagcucuca

SEQ ID NO: 1030855 - RNA, 22 nt, Human
ggcaaaaaccacaauuacuuuu

SEQ ID NO: 1030856 - RNA, 19 nt, Human
uccucaggggcucacagac

SEQ ID NO: 1030857 - RNA, 22 nt, Human
agagcuuagaauuucagaugau

SEQ ID NO: 1030858 - RNA, 23 nt, Human
uggggccaagugaggaagggucu

SEQ ID NO: 1030859 - RNA, 22 nt, Human
ucucucagaggccaggguccug

SEQ ID NO: 1030860 - RNA, 22 nt, Human
uacagaaaucacaucgcuuuga

SEQ ID NO: 1030861 - RNA, 22 nt, Human
gucccaggcagagucaggaggg

SEQ ID NO: 1030862 - RNA, 22 nt, Human
ggugcccaccugucuuccugga

SEQ ID NO: 1030863 - RNA, 22 nt, Human
ucccagagguugagucacuuau

SEQ ID NO: 1030864 - RNA, 22 nt, Human
aaggcacuugcccagagcugca

SEQ ID NO: 1030865 - RNA, 22 nt, Human
acagagcuuaggaugacuccca

SEQ ID NO: 1030866 - RNA, 20 nt, Human
cugcucugcuuugcaggugg

SEQ ID NO: 1030867 - RNA, 22 nt, Human
aucagcaagauguaauuucuau

SEQ ID NO: 1030868 - RNA, 22 nt, Human
ccaaagagcuagaauuauaggc

SEQ ID NO: 1030869 - RNA, 22 nt, Human
agggcagaaaccaccuugaugg

SEQ ID NO: 1030870 - RNA, 22 nt, Human
ccagcuggagcucgcagauagg

SEQ ID NO: 1030871 - RNA, 22 nt, Human
agggccugcaucaggagcuugg

SEQ ID NO: 1030872 - RNA, 22 nt, Human
uuugcauuccugccugcauuca

SEQ ID NO: 1030873 - RNA, 18 nt, Human
agggaucaucacugcagc

SEQ ID NO: 1030874 - RNA, 22 nt, Human
uccauggggcccaggaugagag

SEQ ID NO: 1030875 - RNA, 22 nt, Human
gaggugagaagggggucagaug

SEQ ID NO: 1030876 - RNA, 22 nt, Human
gucccagaugucuggaacuccc

SEQ ID NO: 1030877 - RNA, 22 nt, Human
ccagcacugcucucagacugag

SEQ ID NO: 1030878 - RNA, 22 nt, Human
gagcucccaggccccagcaagg

SEQ ID NO: 1030879 - RNA, 22 nt, Human
aacuuuauuguuaggggcuaaa

SEQ ID NO: 1030880 - RNA, 22 nt, Human
cugcagagguugguucuaagau

SEQ ID NO: 1030881 - RNA, 22 nt, Human
aucuggcuggauucuuagcguu

SEQ ID NO: 1030882 - RNA, 22 nt, Human
agccuggauucgugcauccaca

SEQ ID NO: 1030883 - RNA, 22 nt, Human
caggcagccuucucgucucaca

SEQ ID NO: 1030884 - RNA, 22 nt, Human
cagcagagguuggaacaguucu

SEQ ID NO: 1030885 - RNA, 22 nt, Human
ugucccaggccucauguugcca

SEQ ID NO: 1030886 - RNA, 22 nt, Human
ucauugcaguugaguuguguua

SEQ ID NO: 1030887 - RNA, 22 nt, Human
aguguccccuacagaggcauuc

SEQ ID NO: 1030888 - RNA, 23 nt, Human
uugauacagaagaaucaguuugu

SEQ ID NO: 1030889 - RNA, 22 nt, Human
caggugggaccaugauagggca

SEQ ID NO: 1030890 - RNA, 22 nt, Human
ucuccucaccaccagcagcaga

SEQ ID NO: 1030891 - RNA, 22 nt, Human
ugcagaagacacaagguaacgu

SEQ ID NO: 1030892 - RNA, 22 nt, Human
caggggcuuaagugacagaagg

SEQ ID NO: 1030893 - RNA, 22 nt, Human
gcaggagcccuggcauguucuu

SEQ ID NO: 1030894 - RNA, 22 nt, Human
aagugaaacauguaucucuuua

SEQ ID NO: 1030895 - RNA, 22 nt, Human
cuuccugcaggacagccaucug

SEQ ID NO: 1030896 - RNA, 22 nt, Human
uacagaaaaacuggcauugaag

SEQ ID NO: 1030897 - RNA, 22 nt, Human
gggaggugauggcaagcagcgg

SEQ ID NO: 1030898 - RNA, 22 nt, Human
cugaggugcuagggucccugcu

SEQ ID NO: 1030899 - RNA, 22 nt, Human
auuguacaugcagugagucauc

SEQ ID NO: 1030900 - RNA, 22 nt, Human
uucaaaggcaggauagcagcug

SEQ ID NO: 1030901 - RNA, 22 nt, Human
gcugggagucgcgucuguggcc

SEQ ID NO: 1030902 - RNA, 22 nt, Human
ggcuggcaagugucugcucaug

SEQ ID NO: 1030903 - RNA, 22 nt, Human
ccacaggggcccacgagccgcu

SEQ ID NO: 1030904 - RNA, 22 nt, Human
uuuucuuauggugaagcacaaa

SEQ ID NO: 1030905 - RNA, 22 nt, Human
uuaacagauguuuauggagcau

SEQ ID NO: 1030906 - RNA, 22 nt, Human
cucagggcuugaguguccagga

SEQ ID NO: 1030907 - RNA, 22 nt, Human
ccauuguaguaucuguuuuagu

SEQ ID NO: 1030908 - RNA, 22 nt, Human
guuugaaaaaagcaguauguaa

SEQ ID NO: 1030909 - RNA, 22 nt, Human
agugugaccuuauuuggaaaca

SEQ ID NO: 1030910 - RNA, 22 nt, Human
gaaaucugucuuuguuugaaua

SEQ ID NO: 1030911 - RNA, 22 nt, Human
gcugcucucagagcucaugcug

SEQ ID NO: 1030912 - RNA, 22 nt, Human
ugcucccaggcucuguggucug

SEQ ID NO: 1030913 - RNA, 22 nt, Human
ggccugcuauuggugggcagac

SEQ ID NO: 1030914 - RNA, 21 nt, Human
acagaugggaugagcacacug

SEQ ID NO: 1030915 - RNA, 22 nt, Human
gaugaagccugacuucucggug

SEQ ID NO: 1030916 - RNA, 22 nt, Human
guuaauaaagguauagaaucag

SEQ ID NO: 1030917 - RNA, 22 nt, Human
uauauguaagcuauguaagagu

SEQ ID NO: 1030918 - RNA, 22 nt, Human
uuguaacaaucugucauaaaug

SEQ ID NO: 1030919 - RNA, 16 nt, Human
gggagggaguuggugg

SEQ ID NO: 1030920 - RNA, 22 nt, Human
gccuggcccagggcucuuguug

SEQ ID NO: 1030921 - RNA, 22 nt, Human
gcugucugcugugcacugagca

SEQ ID NO: 1030922 - RNA, 22 nt, Human
uuugugaagggaacagaagugu

SEQ ID NO: 1030923 - RNA, 22 nt, Human
cugcccugagucaugccagaug

SEQ ID NO: 1030924 - RNA, 22 nt, Human
agaaaaggauugauggaucaga

SEQ ID NO: 1030925 - RNA, 22 nt, Human
agcuuaggaggaugaugaacau

SEQ ID NO: 1030926 - RNA, 22 nt, Human
gccugagauucugcauuucuaa

SEQ ID NO: 1030927 - RNA, 22 nt, Human
ggcagcucaccucugguccagg

SEQ ID NO: 1030928 - RNA, 23 nt, Human
aggcccugccugucccucuuuuu

SEQ ID NO: 1030929 - RNA, 22 nt, Human
auaugucgcuacaucauuagau

SEQ ID NO: 1030930 - RNA, 22 nt, Human
caggccucuccuuagucuggca

SEQ ID NO: 1030931 - RNA, 22 nt, Human
uagaacagaguuccagugauca

SEQ ID NO: 1030932 - RNA, 22 nt, Human
acagcuugcaauggcuuucaac

SEQ ID NO: 1030933 - RNA, 22 nt, Human
ggggacaguuaaagaccaagac

SEQ ID NO: 1030934 - RNA, 22 nt, Human
aucaaaguaggcauauguuuuu

SEQ ID NO: 1030935 - RNA, 22 nt, Human
gcucugagaggugcagcaguaa

SEQ ID NO: 1030936 - RNA, 22 nt, Human
ucucucagcuuugagaccugcu

SEQ ID NO: 1030937 - RNA, 22 nt, Human
ugucuuccucuuggcuugagcu

SEQ ID NO: 1030938 - RNA, 22 nt, Human
ugcagcauucuuggccacuacu

SEQ ID NO: 1030939 - RNA, 19 nt, Human
ggcccaaguacugagugcc

SEQ ID NO: 1030940 - RNA, 22 nt, Human
gaguuauucuagguccuuugua

SEQ ID NO: 1030941 - RNA, 22 nt, Human
ugagggaguuggguguauagga

SEQ ID NO: 1030942 - RNA, 22 nt, Human
cagugcaguugguggcaggggu

SEQ ID NO: 1030943 - RNA, 22 nt, Human
ucccagauuguugauggcuuaa

SEQ ID NO: 1030944 - RNA, 22 nt, Human
cccagcauuucugggcugcacu

SEQ ID NO: 1030945 - RNA, 22 nt, Human
aguuuuucugggaggcacugcu

SEQ ID NO: 1030946 - RNA, 22 nt, Human
ccugguguugugaaguagccgu

SEQ ID NO: 1030947 - RNA, 22 nt, Human
agcagccagugggagugauaca

SEQ ID NO: 1030948 - RNA, 22 nt, Human
uggcagagucaucacaucugga

SEQ ID NO: 1030949 - RNA, 22 nt, Human
cagaagaaaguggggagacaag

SEQ ID NO: 1030950 - RNA, 22 nt, Human
cagcucugggugacaggagggc

SEQ ID NO: 1030951 - RNA, 23 nt, Human
uggcagugaucaaaagcuuacau

SEQ ID NO: 1030952 - RNA, 23 nt, Human
uggugccucagaagcagugggcu

SEQ ID NO: 1030953 - RNA, 22 nt, Human
gugaaaucugaggcccaugaug

SEQ ID NO: 1030954 - RNA, 22 nt, Human
cagaagcagugagagaugugca

SEQ ID NO: 1030955 - RNA, 22 nt, Human
ugcagccaucgcagagucugua

SEQ ID NO: 1030956 - RNA, 22 nt, Human
ugaagacagaccaaggagaaug

SEQ ID NO: 1030957 - RNA, 20 nt, Human
auauguguacguguauacau

SEQ ID NO: 1030958 - RNA, 22 nt, Human
accagagauggggcuucucugu

SEQ ID NO: 1030959 - RNA, 22 nt, Human
agaugggcgcccuggacugagg

SEQ ID NO: 1030960 - RNA, 19 nt, Human
gcaggguguugacuguccc

SEQ ID NO: 1030961 - RNA, 22 nt, Human
aggagagucuugagucacuggu

SEQ ID NO: 1030962 - RNA, 20 nt, Human
aagcaauauagugcaaaugu

SEQ ID NO: 1030963 - RNA, 22 nt, Human
agaggccuuucuguugagugaa

SEQ ID NO: 1030964 - RNA, 22 nt, Human
agccaagcugaucuccugcuga

SEQ ID NO: 1030965 - RNA, 22 nt, Human
ucggagcuguagaugaaacccu

SEQ ID NO: 1030966 - RNA, 22 nt, Human
ucacugcagacaaccucaguca

SEQ ID NO: 1030967 - RNA, 20 nt, Human
guggccucucacauucugag

SEQ ID NO: 1030968 - RNA, 22 nt, Human
auguagcaucuauccugauaaa

SEQ ID NO: 1030969 - RNA, 22 nt, Human
ugggaggaucgcuugagcccag

SEQ ID NO: 1030970 - RNA, 22 nt, Human
augucuuucucacagccaguuc

SEQ ID NO: 1030971 - RNA, 22 nt, Human
uacuuuagaaggaaauaaguuc

SEQ ID NO: 1030972 - RNA, 22 nt, Human
cugggguggaggagcuccccug

SEQ ID NO: 1030973 - RNA, 22 nt, Human
uuuauuauucucuggagaaugu

SEQ ID NO: 1030974 - RNA, 22 nt, Human
aggaaaugcugaugcuccugga

SEQ ID NO: 1030975 - RNA, 22 nt, Human
aaaguguagagacuuuggaacc

SEQ ID NO: 1030976 - RNA, 20 nt, Human
cagagaccugucuucacaga

SEQ ID NO: 1030977 - RNA, 22 nt, Human
ggagugggaacaaugacauggu

SEQ ID NO: 1030978 - RNA, 22 nt, Human
auuugcagagcucugaauuuug

SEQ ID NO: 1030979 - RNA, 22 nt, Human
aagggcagcuauuaucgucauc

SEQ ID NO: 1030980 - RNA, 22 nt, Human
cuggggggagcugcguccagca

SEQ ID NO: 1030981 - RNA, 21 nt, Human
cucacaggaugcaguguuacu

SEQ ID NO: 1030982 - RNA, 22 nt, Human
uaauaucuacuucauagaguuu

SEQ ID NO: 1030983 - RNA, 22 nt, Human
acagagguguguguaggacagu

SEQ ID NO: 1030984 - RNA, 22 nt, Human
uucuuuggggaauauucugguu

SEQ ID NO: 1030985 - RNA, 22 nt, Human
ugucagaacucuauugaugucc

SEQ ID NO: 1030986 - RNA, 22 nt, Human
gucuuucuuaauucaagugcuu

SEQ ID NO: 1030987 - RNA, 22 nt, Human
aacugcauucagaaagcucacu

SEQ ID NO: 1030988 - RNA, 22 nt, Human
guagaagugaugucauguuaua

SEQ ID NO: 1030989 - RNA, 22 nt, Human
aucaaaguuucccagaaguugu

SEQ ID NO: 1030990 - RNA, 23 nt, Human
ccagcucccaggucugaggacug

SEQ ID NO: 1030991 - RNA, 22 nt, Human
ggccucugguucguggugaccu

SEQ ID NO: 1030992 - RNA, 19 nt, Human
uaaaaugucuguggucagu

SEQ ID NO: 1030993 - RNA, 22 nt, Human
cccuggaguccuggcaguugau

SEQ ID NO: 1030994 - RNA, 22 nt, Human
aaucacaauuacuuuugcacca

SEQ ID NO: 1030995 - RNA, 22 nt, Human
aggucauuuccuuagaggcaga

SEQ ID NO: 1030996 - RNA, 22 nt, Human
gcagagcauguccucaggacag

SEQ ID NO: 1030997 - RNA, 22 nt, Human
cagccaggcccccgagucguug

SEQ ID NO: 1030998 - RNA, 22 nt, Human
ggcauggcucggagucagaaca

SEQ ID NO: 1030999 - RNA, 22 nt, Human
ggaugcaggggcagcagagccu

SEQ ID NO: 1031000 - RNA, 18 nt, Human
ugucucugaauuccagug

SEQ ID NO: 1031001 - RNA, 22 nt, Human
cucuugaagcaggggccaguuc

SEQ ID NO: 1031002 - RNA, 21 nt, Human
caugaagccgguucccuguuu

SEQ ID NO: 1031003 - RNA, 22 nt, Human
uuaauuuauguccaaaccagau

SEQ ID NO: 1031004 - RNA, 18 nt, Human
gagcugccauauuuaguu

SEQ ID NO: 1031005 - RNA, 22 nt, Human
uggcuggcgccgggcuagccac

SEQ ID NO: 1031006 - RNA, 22 nt, Human
aucacaaaggcugcuucaugau

SEQ ID NO: 1031007 - RNA, 22 nt, Human
gccuggagaccugcuccucuac

SEQ ID NO: 1031008 - RNA, 20 nt, Human
agcccuguuuccuggagaga

SEQ ID NO: 1031009 - RNA, 22 nt, Human
ggacucuguuuuccugaucacu

SEQ ID NO: 1031010 - RNA, 22 nt, Human
ugugcugguacaugugaggaug

SEQ ID NO: 1031011 - RNA, 22 nt, Human
augggagugacagggccacugg

SEQ ID NO: 1031012 - RNA, 21 nt, Human
uauuucuuugacucucucccu

SEQ ID NO: 1031013 - RNA, 22 nt, Human
gaggagagggcugcgggcccac

SEQ ID NO: 1031014 - RNA, 22 nt, Human
cuacuuuaauuuucugcagaga

SEQ ID NO: 1031015 - RNA, 22 nt, Human
aagucauugguagcuugauagg

SEQ ID NO: 1031016 - RNA, 22 nt, Human
ugcagaagaccuuccagggcug

SEQ ID NO: 1031017 - RNA, 21 nt, Human
ccugggagaucagcugccuuc

SEQ ID NO: 1031018 - RNA, 22 nt, Human
acccugagggguauagcagaag

SEQ ID NO: 1031019 - RNA, 18 nt, Human
uggccuggagacaacucu

SEQ ID NO: 1031020 - RNA, 22 nt, Human
ccuagagcucugcuuuaucuaa

SEQ ID NO: 1031021 - RNA, 22 nt, Human
ggugaggcagguggcugcugag

SEQ ID NO: 1031022 - RNA, 22 nt, Human
ccugggcagguguggcuucccc

SEQ ID NO: 1031023 - RNA, 22 nt, Human
gcugggcagccuggccgcugcc

SEQ ID NO: 1031024 - RNA, 21 nt, Human
ugccagcauuaaacagucauu

SEQ ID NO: 1031025 - RNA, 22 nt, Human
gugggcaaggucccugccagcu

SEQ ID NO: 1031026 - RNA, 22 nt, Human
ccugugucagccccugccucca

SEQ ID NO: 1031027 - RNA, 22 nt, Human
gugggugauguacuggaggcca

SEQ ID NO: 1031028 - RNA, 22 nt, Human
uucacaggaauguaggggucuu

SEQ ID NO: 1031029 - RNA, 20 nt, Human
ccuccuggucaggugugcag

SEQ ID NO: 1031030 - RNA, 22 nt, Human
ugggccugugaugcugggcuau

SEQ ID NO: 1031031 - RNA, 22 nt, Human
ucucagagauguuagggaagag

SEQ ID NO: 1031032 - RNA, 22 nt, Human
uacaaaugaaccaacuuugaug

SEQ ID NO: 1031033 - RNA, 22 nt, Human
cagagcagaaaccugggugauu

SEQ ID NO: 1031034 - RNA, 22 nt, Human
ccagcccucacugaggccucuc

SEQ ID NO: 1031035 - RNA, 21 nt, Human
uggcucugcucagagcagucc

SEQ ID NO: 1031036 - RNA, 22 nt, Human
caguuucuucaucaguuaagca

SEQ ID NO: 1031037 - RNA, 22 nt, Human
agggaagaaaauccaucgcugc

SEQ ID NO: 1031038 - RNA, 22 nt, Human
auggaaagccaguguuccauca

SEQ ID NO: 1031039 - RNA, 22 nt, Human
agccacagucaaccuguccaua

SEQ ID NO: 1031040 - RNA, 22 nt, Human
ucaugcacaugugucaccauca

SEQ ID NO: 1031041 - RNA, 22 nt, Human
uaauuuaauuucaugccagccu

SEQ ID NO: 1031042 - RNA, 22 nt, Human
auggacagugugaagcagauag

SEQ ID NO: 1031043 - RNA, 22 nt, Human
ggcacugaauuucuuggcaucu

SEQ ID NO: 1031044 - RNA, 22 nt, Human
agcugcccugggucuugcugcu

SEQ ID NO: 1031045 - RNA, 22 nt, Human
ugucccagggaaggcccagcac

SEQ ID NO: 1031046 - RNA, 21 nt, Human
uguucacauggagcagaaugu

SEQ ID NO: 1031047 - RNA, 20 nt, Human
ccugggguacacuggcaugu

SEQ ID NO: 1031048 - RNA, 22 nt, Human
acugcagcaaagcccgugucuu

SEQ ID NO: 1031049 - RNA, 22 nt, Human
gcuggccuuugaggaagcugcg

SEQ ID NO: 1031050 - RNA, 21 nt, Human
ugcuggccucaagggugacuu

SEQ ID NO: 1031051 - RNA, 22 nt, Human
cuggaaugccucccugucagag

SEQ ID NO: 1031052 - RNA, 22 nt, Human
gggacuggaacuacuggugcag

SEQ ID NO: 1031053 - RNA, 22 nt, Human
cagggcagagggaaacuccuuu

SEQ ID NO: 1031054 - RNA, 22 nt, Human
ucuagaaauuuugccuuguauu

SEQ ID NO: 1031055 - RNA, 22 nt, Human
cagcuccccucuguggggcagu

SEQ ID NO: 1031056 - RNA, 19 nt, Human
acccucucagugccugagg

SEQ ID NO: 1031057 - RNA, 22 nt, Human
aagacccacaaggcugaauguu

SEQ ID NO: 1031058 - RNA, 22 nt, Human
agcaguggaccucagugcuauu

SEQ ID NO: 1031059 - RNA, 22 nt, Human
ucuguuccauguuuuguuccau

SEQ ID NO: 1031060 - RNA, 22 nt, Human
ugugugccagccuacgaggagc

SEQ ID NO: 1031061 - RNA, 22 nt, Human
acguuuucuagagaauaugcag

SEQ ID NO: 1031062 - RNA, 22 nt, Human
uucaagauggccccagugagcc

SEQ ID NO: 1031063 - RNA, 22 nt, Human
caugaagcacagcucucuuuuu

SEQ ID NO: 1031064 - RNA, 22 nt, Human
ggccucaguuucuccauggguu

SEQ ID NO: 1031065 - RNA, 22 nt, Human
ugggggagccuucacaguagcu

SEQ ID NO: 1031066 - RNA, 17 nt, Human
ucaggcugggugcagug

SEQ ID NO: 1031067 - RNA, 22 nt, Human
acacagggcagagagcuggcuc

SEQ ID NO: 1031068 - RNA, 22 nt, Human
ggcucugguugaccaugauggc

SEQ ID NO: 1031069 - RNA, 22 nt, Human
cacagaaucugugacuccaaga

SEQ ID NO: 1031070 - RNA, 22 nt, Human
agagcccugaagcagagcuaaa

SEQ ID NO: 1031071 - RNA, 22 nt, Human
aagaaauuaaugugccauuacu

SEQ ID NO: 1031072 - RNA, 22 nt, Human
ccaggcaggcagcguucucagg

SEQ ID NO: 1031073 - RNA, 22 nt, Human
guacauuucauuuaaaugaugu

SEQ ID NO: 1031074 - RNA, 22 nt, Human
ccauuuguucgcccagcuccaa

SEQ ID NO: 1031075 - RNA, 20 nt, Human
gggguuggcuggcacaggga

SEQ ID NO: 1031076 - RNA, 22 nt, Human
gcauuguccugcuucugagugu

SEQ ID NO: 1031077 - RNA, 22 nt, Human
ccaggguggaggcuggauggag

SEQ ID NO: 1031078 - RNA, 20 nt, Human
aguagcagugugacauugac

SEQ ID NO: 1031079 - RNA, 22 nt, Human
aucuggcugagcgaggcccaca

SEQ ID NO: 1031080 - RNA, 22 nt, Human
ugaagcaaacgcuucuguuccu

SEQ ID NO: 1031081 - RNA, 22 nt, Human
gcugucuguucgagcguguguu

SEQ ID NO: 1031082 - RNA, 22 nt, Human
auucuggauuaucaguccacca

SEQ ID NO: 1031083 - RNA, 22 nt, Human
ucucaggguuuguacaagugua

SEQ ID NO: 1031084 - RNA, 22 nt, Human
ucugagggugggagaaggagcu

SEQ ID NO: 1031085 - RNA, 22 nt, Human
aggacccugagcgggcaugccg

SEQ ID NO: 1031086 - RNA, 22 nt, Human
ccagagccggcucccucagcuu

SEQ ID NO: 1031087 - RNA, 22 nt, Human
caguggcagagaacagagaccu

SEQ ID NO: 1031088 - RNA, 22 nt, Human
ccagccuggguguuagaagaca

SEQ ID NO: 1031089 - RNA, 22 nt, Human
acauuuacagugcuagacaauc

SEQ ID NO: 1031090 - RNA, 22 nt, Human
gcuucucuggccugcagggcau

SEQ ID NO: 1031091 - RNA, 22 nt, Human
aaggcagcagugcacgacugau

SEQ ID NO: 1031092 - RNA, 22 nt, Human
ggggcuguuuuuggaauggcug

SEQ ID NO: 1031093 - RNA, 22 nt, Human
cccaggcagggacgugcucugg

SEQ ID NO: 1031094 - RNA, 22 nt, Human
gagccuccuccuggugugccga

SEQ ID NO: 1031095 - RNA, 22 nt, Human
cucaaggacuuauucaugccug

SEQ ID NO: 1031096 - RNA, 22 nt, Human
cucugggcaggaccaguggacc

SEQ ID NO: 1031097 - RNA, 22 nt, Human
ugggcagaaaucaguaucagau

SEQ ID NO: 1031098 - RNA, 22 nt, Human
gccucugcaccaguacugugcc

SEQ ID NO: 1031099 - RNA, 22 nt, Human
ggcuucuccagguacugagcau

SEQ ID NO: 1031100 - RNA, 22 nt, Human
augaacacauguacacauuucu

SEQ ID NO: 1031101 - RNA, 22 nt, Human
cuacauuuggagaguauaggaa

SEQ ID NO: 1031102 - RNA, 22 nt, Human
ggucucagcccucgccagcagc

SEQ ID NO: 1031103 - RNA, 22 nt, Human
uagaaguuaaaggaauacagaa

SEQ ID NO: 1031104 - RNA, 20 nt, Human
agcugaggcaccugagguua

SEQ ID NO: 1031105 - RNA, 22 nt, Human
auuucuuccucugucaguaacu

SEQ ID NO: 1031106 - RNA, 22 nt, Human
cccugcagcuuuugcauaguca

SEQ ID NO: 1031107 - RNA, 22 nt, Human
agcaauaugacauugcuacauc

SEQ ID NO: 1031108 - RNA, 22 nt, Human
cugaggcucccucgggucugcu

SEQ ID NO: 1031109 - RNA, 22 nt, Human
ugagccagaguggagugugccu

SEQ ID NO: 1031110 - RNA, 22 nt, Human
ucugagagguuaagcaauuuga

SEQ ID NO: 1031111 - RNA, 22 nt, Human
ugggcagcagcaaagccagacu

SEQ ID NO: 1031112 - RNA, 22 nt, Human
ugcugccuuugggaccuggccu

SEQ ID NO: 1031113 - RNA, 22 nt, Human
ucaggcacugcuuucugauaug

SEQ ID NO: 1031114 - RNA, 22 nt, Human
cccuggcauaaaacuucuccag

SEQ ID NO: 1031115 - RNA, 21 nt, Human
ccuccaggugauuccgugcuc

SEQ ID NO: 1031116 - RNA, 22 nt, Human
cacucugagaaguacaagcucc

SEQ ID NO: 1031117 - RNA, 22 nt, Human
cccaggcagagagcuggugagc

SEQ ID NO: 1031118 - RNA, 19 nt, Human
agcagccauagacaauaug

SEQ ID NO: 1031119 - RNA, 22 nt, Human
gcaggagccacuucagggaugc

SEQ ID NO: 1031120 - RNA, 23 nt, Human
ucuggcucuaugugacagcucuc

SEQ ID NO: 1031121 - RNA, 22 nt, Human
agaaugcaguuugaaauaaggu

SEQ ID NO: 1031122 - RNA, 22 nt, Human
uuacaaagagaaguuguagaau

SEQ ID NO: 1031123 - RNA, 22 nt, Human
gcagcuggagccagccagacac

SEQ ID NO: 1031124 - RNA, 22 nt, Human
cggcuggguagaggugccgggu

SEQ ID NO: 1031125 - RNA, 22 nt, Human
ucuuuccuaggugauaugcaau

SEQ ID NO: 1031126 - RNA, 22 nt, Human
cuggagcucuccagagccccgu

SEQ ID NO: 1031127 - RNA, 23 nt, Human
aacaauagguuuuggcagaauag

SEQ ID NO: 1031128 - RNA, 22 nt, Human
gugugcaguagagaaagagcag

SEQ ID NO: 1031129 - RNA, 18 nt, Human
gaggauggaaggagaugc

SEQ ID NO: 1031130 - RNA, 22 nt, Human
gcugugugcucacguaguggaa

SEQ ID NO: 1031131 - RNA, 22 nt, Human
cuggcucaggguggucuggguc

SEQ ID NO: 1031132 - RNA, 22 nt, Human
gcuguguccucacacagccuuu

SEQ ID NO: 1031133 - RNA, 22 nt, Human
aguuuaugaaacacagauuuga

SEQ ID NO: 1031134 - RNA, 22 nt, Human
ggcugggagcuggacaggccgg

SEQ ID NO: 1031135 - RNA, 22 nt, Human
agccaagcaccacuggcacucg

SEQ ID NO: 1031136 - RNA, 22 nt, Human
caguacuuaacuuauaggagag

SEQ ID NO: 1031137 - RNA, 22 nt, Human
cuggagcagguuuaggaguccc

SEQ ID NO: 1031138 - RNA, 22 nt, Human
cagguggcuucucccuaggcca

SEQ ID NO: 1031139 - RNA, 22 nt, Human
caggaaggcccaccuguccugu

SEQ ID NO: 1031140 - RNA, 22 nt, Human
acugaaggguaaugugggagcc

SEQ ID NO: 1031141 - RNA, 22 nt, Human
cccaugccuucugacucacagg

SEQ ID NO: 1031142 - RNA, 22 nt, Human
cugagccaugagccugcgccca

SEQ ID NO: 1031143 - RNA, 22 nt, Human
uugucccaggacuugcauagau

SEQ ID NO: 1031144 - RNA, 22 nt, Human
cuggccuagcucucugcuugaa

SEQ ID NO: 1031145 - RNA, 22 nt, Human
cagggcagaaggcacucuacuc

SEQ ID NO: 1031146 - RNA, 22 nt, Human
guuccuauauagccuuaaggau

SEQ ID NO: 1031147 - RNA, 22 nt, Human
cagcuggcagcccuggcccugc

SEQ ID NO: 1031148 - RNA, 22 nt, Human
gucccaggugggcuccaccucu

SEQ ID NO: 1031149 - RNA, 22 nt, Human
uucaaaacagcuagauauugga

SEQ ID NO: 1031150 - RNA, 22 nt, Human
cagagcagagugauuguucugg

SEQ ID NO: 1031151 - RNA, 22 nt, Human
gcacccagggacuuggcuggcc

SEQ ID NO: 1031152 - RNA, 22 nt, Human
cuggccuggagccucugggugg

SEQ ID NO: 1031153 - RNA, 22 nt, Human
gccuccuggccuuugcuccuca

SEQ ID NO: 1031154 - RNA, 22 nt, Human
agagugauggguugugcugacc

SEQ ID NO: 1031155 - RNA, 22 nt, Human
ugcugcucuucaccauggccuc

SEQ ID NO: 1031156 - RNA, 22 nt, Human
accucugcucaagaccccuccg

SEQ ID NO: 1031157 - RNA, 22 nt, Human
gugucacaagagcccaggaaac

SEQ ID NO: 1031158 - RNA, 22 nt, Human
gccuggcaaggcccuguugacu

SEQ ID NO: 1031159 - RNA, 20 nt, Human
agaauucuuacccuuugaug

SEQ ID NO: 1031160 - RNA, 22 nt, Human
caggagugagaugcgaucacuu

SEQ ID NO: 1031161 - RNA, 22 nt, Human
ugaaccaggaggcagccagcac

SEQ ID NO: 1031162 - RNA, 22 nt, Human
gccucugcaugcucagcaccca

SEQ ID NO: 1031163 - RNA, 22 nt, Human
cuagaaauauuuuacagucaag

SEQ ID NO: 1031164 - RNA, 22 nt, Human
acugugcuuucucuggaggcau

SEQ ID NO: 1031165 - RNA, 22 nt, Human
aaguguguugacugaauugggg

SEQ ID NO: 1031166 - RNA, 19 nt, Human
guuuuucccagacgaggca

SEQ ID NO: 1031167 - RNA, 22 nt, Human
auacauguuguaccauauguuu

SEQ ID NO: 1031168 - RNA, 22 nt, Human
gugccugguuuggggaguguuc

SEQ ID NO: 1031169 - RNA, 20 nt, Human
ccagcauguacacaugugga

SEQ ID NO: 1031170 - RNA, 22 nt, Human
cagggacagccuugggguggcg

SEQ ID NO: 1031171 - RNA, 22 nt, Human
ccugaagaugcuguggccuggu

SEQ ID NO: 1031172 - RNA, 22 nt, Human
cagcugucuaaguugagcagga

SEQ ID NO: 1031173 - RNA, 22 nt, Human
gcucccaggaugaggagccagg

SEQ ID NO: 1031174 - RNA, 22 nt, Human
guugaguggguuaggaugcuga

SEQ ID NO: 1031175 - RNA, 22 nt, Human
gaguguucccacaccccaguug

SEQ ID NO: 1031176 - RNA, 22 nt, Human
agaucaaagccaugagagauuu

SEQ ID NO: 1031177 - RNA, 22 nt, Human
caguacuuaguucucaugguuu

SEQ ID NO: 1031178 - RNA, 22 nt, Human
gaagccaguacugugcucugca

SEQ ID NO: 1031179 - RNA, 22 nt, Human
gcuggcaucacuggcuucggug

SEQ ID NO: 1031180 - RNA, 22 nt, Human
uaaggcauucucaugcugugaa

SEQ ID NO: 1031181 - RNA, 22 nt, Human
ugcauauuuuauaaagauggaa

SEQ ID NO: 1031182 - RNA, 22 nt, Human
gcagggacugugaucucacaga

SEQ ID NO: 1031183 - RNA, 19 nt, Human
ggccccucucacaggaguu

SEQ ID NO: 1031184 - RNA, 21 nt, Human
ugggggagaauugguugcuuu

SEQ ID NO: 1031185 - RNA, 22 nt, Human
uuagauaaauuaagacuuuaca

SEQ ID NO: 1031186 - RNA, 22 nt, Human
cuggagagauccuccugaaaaa

SEQ ID NO: 1031187 - RNA, 22 nt, Human
aguccaggaguugggugacauu

SEQ ID NO: 1031188 - RNA, 22 nt, Human
ggugggcaacauuuggccugag

SEQ ID NO: 1031189 - RNA, 22 nt, Human
uacauauuugucuuuguacugu

SEQ ID NO: 1031190 - RNA, 22 nt, Human
uuccuguccgcaauggccuggg

SEQ ID NO: 1031191 - RNA, 22 nt, Human
ucugccugcggcugcagguggc

SEQ ID NO: 1031192 - RNA, 22 nt, Human
cugagcugcggcaggcaccugg

SEQ ID NO: 1031193 - RNA, 22 nt, Human
agggcaaguugagugugcgugg

SEQ ID NO: 1031194 - RNA, 19 nt, Human
uccugggcugggccagguc

SEQ ID NO: 1031195 - RNA, 22 nt, Human
ugggcuggcccaccacaccucg

SEQ ID NO: 1031196 - RNA, 22 nt, Human
cugagccaguagucagggacaa

SEQ ID NO: 1031197 - RNA, 22 nt, Human
gcuucucucucagacugcaagc

SEQ ID NO: 1031198 - RNA, 22 nt, Human
cucugugccucaguuuucuucu

SEQ ID NO: 1031199 - RNA, 22 nt, Human
ggucccagcuggucacugucag

SEQ ID NO: 1031200 - RNA, 22 nt, Human
agggcacagccuaaagccuaug

SEQ ID NO: 1031201 - RNA, 17 nt, Human
aagacagaagccaugag

SEQ ID NO: 1031202 - RNA, 22 nt, Human
uucucuuagcuguaaagucaau

SEQ ID NO: 1031203 - RNA, 22 nt, Human
auccuugaaugacucugcccuc

SEQ ID NO: 1031204 - RNA, 22 nt, Human
gccagcaguauguccuggcagu

SEQ ID NO: 1031205 - RNA, 22 nt, Human
cagguacacucccuugugcuga

SEQ ID NO: 1031206 - RNA, 22 nt, Human
ggagccagagucugcaguguaa

SEQ ID NO: 1031207 - RNA, 22 nt, Human
ggagccagugcccucuggugga

SEQ ID NO: 1031208 - RNA, 22 nt, Human
gaacaguaucaguagugccagu

SEQ ID NO: 1031209 - RNA, 22 nt, Human
ggccucugguucacagggagga

SEQ ID NO: 1031210 - RNA, 22 nt, Human
cagcccuggccccagguggucu

SEQ ID NO: 1031211 - RNA, 22 nt, Human
gggccucugugcagaggggccu

SEQ ID NO: 1031212 - RNA, 22 nt, Human
uccuucagcuacucaguuucca

SEQ ID NO: 1031213 - RNA, 22 nt, Human
cuggccagcauuuuugcuuuag

SEQ ID NO: 1031214 - RNA, 17 nt, Human
cugaggcccagggccca

SEQ ID NO: 1031215 - RNA, 22 nt, Human
acuauacauugaauguuaaggu

SEQ ID NO: 1031216 - RNA, 22 nt, Human
ucccaaggcacagggcagggac

SEQ ID NO: 1031217 - RNA, 22 nt, Human
gcugucugucucugugacuuaa

SEQ ID NO: 1031218 - RNA, 22 nt, Human
ccuccagguguuacauaugacu

SEQ ID NO: 1031219 - RNA, 22 nt, Human
ucccccacucuaaaggagccuu

SEQ ID NO: 1031220 - RNA, 22 nt, Human
gguggguuuggaagagcaggcu

SEQ ID NO: 1031221 - RNA, 22 nt, Human
ugacagaaagaauaugucaauc

SEQ ID NO: 1031222 - RNA, 22 nt, Human
uagcaggguaaauguagaugga

SEQ ID NO: 1031223 - RNA, 22 nt, Human
ccagcugcugugaggaccacag

SEQ ID NO: 1031224 - RNA, 20 nt, Human
ggccuuggccucuuugcagc

SEQ ID NO: 1031225 - RNA, 22 nt, Human
accugagcaugccaggagagug

SEQ ID NO: 1031226 - RNA, 22 nt, Human
agaauuuuugauuaucuacucg

SEQ ID NO: 1031227 - RNA, 22 nt, Human
cuguagcagugugcucuuuuuc

SEQ ID NO: 1031228 - RNA, 22 nt, Human
agaacuguccuuggaggagagu

SEQ ID NO: 1031229 - RNA, 22 nt, Human
ccugggagguggagguugcagu

SEQ ID NO: 1031230 - RNA, 22 nt, Human
ugagcugggcugggcugagcug

SEQ ID NO: 1031231 - RNA, 22 nt, Human
gaggcaggguguugauuacaga

SEQ ID NO: 1031232 - RNA, 22 nt, Human
uccagccaacugccuagggagc

SEQ ID NO: 1031233 - RNA, 22 nt, Human
ggcucuggguucugcaaugcgu

SEQ ID NO: 1031234 - RNA, 22 nt, Human
agggcagcagcccauggcucug

SEQ ID NO: 1031235 - RNA, 22 nt, Human
agggacaguuacaucaucagac

SEQ ID NO: 1031236 - RNA, 22 nt, Human
acagaguagcucaagaagauug

SEQ ID NO: 1031237 - RNA, 21 nt, Human
ugaaaucugaugggacaaaug

SEQ ID NO: 1031238 - RNA, 19 nt, Human
ucaaagcaagcauguucug

SEQ ID NO: 1031239 - RNA, 22 nt, Human
ccagguggcuucugcccgaugu

SEQ ID NO: 1031240 - RNA, 22 nt, Human
cugggcuggagugcaauggcgc

SEQ ID NO: 1031241 - RNA, 22 nt, Human
aguauacauauauuagccuucg

SEQ ID NO: 1031242 - RNA, 22 nt, Human
cagcccuggaacagcugacuca

SEQ ID NO: 1031243 - RNA, 22 nt, Human
agaaagcacucugucuuuuacc

SEQ ID NO: 1031244 - RNA, 22 nt, Human
uugggaaggcguggaagcagaa

SEQ ID NO: 1031245 - RNA, 22 nt, Human
auugacaaucuacuauguucug

SEQ ID NO: 1031246 - RNA, 22 nt, Human
gcugccucaggcaccuccuggc

SEQ ID NO: 1031247 - RNA, 22 nt, Human
ccagccaguccagcauuggugu

SEQ ID NO: 1031248 - RNA, 22 nt, Human
ccagggcaggagaaagacucac

SEQ ID NO: 1031249 - RNA, 22 nt, Human
cuguacaggugaggagggggcu

SEQ ID NO: 1031250 - RNA, 22 nt, Human
auagaaaacagauguccuuaaa

SEQ ID NO: 1031251 - RNA, 22 nt, Human
aucuaagauguauugagcacuu

SEQ ID NO: 1031252 - RNA, 22 nt, Human
cccuggaggcggagcuugcagu

SEQ ID NO: 1031253 - RNA, 22 nt, Human
agaggccuaauugcuacccuuu

SEQ ID NO: 1031254 - RNA, 22 nt, Human
aggcccagggcugcucucugaa

SEQ ID NO: 1031255 - RNA, 22 nt, Human
agaggucauaucucagaagaga

SEQ ID NO: 1031256 - RNA, 22 nt, Human
cugcagugcaagcccagaugga

SEQ ID NO: 1031257 - RNA, 22 nt, Human
caggcugggcagccuccccggc

SEQ ID NO: 1031258 - RNA, 22 nt, Human
cugggccuggcguuccaggcug

SEQ ID NO: 1031259 - RNA, 22 nt, Human
uggagccaugccuggccuuucc

SEQ ID NO: 1031260 - RNA, 22 nt, Human
gcugucucggggcuuucuccug

SEQ ID NO: 1031261 - RNA, 22 nt, Human
acaaagucucuaauaaucuucu

SEQ ID NO: 1031262 - RNA, 22 nt, Human
uuuccucugcugccauugcccc

SEQ ID NO: 1031263 - RNA, 22 nt, Human
agggcagagagaugaaugggau

SEQ ID NO: 1031264 - RNA, 22 nt, Human
cagcucccuauggugaggcgac

SEQ ID NO: 1031265 - RNA, 22 nt, Human
ugggcucucuggcaggaaggcu

SEQ ID NO: 1031266 - RNA, 22 nt, Human
cagcccagcacuaaguagauuu

SEQ ID NO: 1031267 - RNA, 22 nt, Human
uuuccauauuuggucuuuggga

SEQ ID NO: 1031268 - RNA, 22 nt, Human
cuggcagcuggaggcuagaggc

SEQ ID NO: 1031269 - RNA, 22 nt, Human
ugcauuguaggauguuuagcag

SEQ ID NO: 1031270 - RNA, 22 nt, Human
cucccacuccuggcucaccaca

SEQ ID NO: 1031271 - RNA, 22 nt, Human
gaggcugggaaguccaagacca

SEQ ID NO: 1031272 - RNA, 22 nt, Human
aaaugcacagagccuuagagau

SEQ ID NO: 1031273 - RNA, 22 nt, Human
ucucaggaguagugggauccau

SEQ ID NO: 1031274 - RNA, 22 nt, Human
agauuguagaaacuguagcauu

SEQ ID NO: 1031275 - RNA, 22 nt, Human
gugugccaacaaaagacagugc

SEQ ID NO: 1031276 - RNA, 22 nt, Human
acucugugugaguagagccugu

SEQ ID NO: 1031277 - RNA, 22 nt, Human
ggcugggcugcugggucagagc

SEQ ID NO: 1031278 - RNA, 22 nt, Human
caguggguaggaaaggcucuuc

SEQ ID NO: 1031279 - RNA, 22 nt, Human
gaagagcugacagugucauccu

SEQ ID NO: 1031280 - RNA, 22 nt, Human
ccagggcaauuauuuggagggu

SEQ ID NO: 1031281 - RNA, 22 nt, Human
uggcaggguggcaacuuuuggu

SEQ ID NO: 1031282 - RNA, 22 nt, Human
cgcugggggaacagcgagggug

SEQ ID NO: 1031283 - RNA, 22 nt, Human
acuccuggguugcaguccucaa

SEQ ID NO: 1031284 - RNA, 22 nt, Human
ucaaagucauggcaggcucaga

SEQ ID NO: 1031285 - RNA, 22 nt, Human
agucccagugagaugaaccagg

SEQ ID NO: 1031286 - RNA, 23 nt, Human
cagggcugguagggaagagcgug

SEQ ID NO: 1031287 - RNA, 22 nt, Human
cagagcaggcccacugcccucc

SEQ ID NO: 1031288 - RNA, 20 nt, Human
acuuucucgguuucucaccu

SEQ ID NO: 1031289 - RNA, 22 nt, Human
cagcagugcuucagugugagau

SEQ ID NO: 1031290 - RNA, 22 nt, Human
agcugccaccucugccuuuggg

SEQ ID NO: 1031291 - RNA, 22 nt, Human
aggguauguuuuuaucuacugu

SEQ ID NO: 1031292 - RNA, 22 nt, Human
cccagcuaccucugcuaggaga

SEQ ID NO: 1031293 - RNA, 22 nt, Human
ggcaaaaaguucccaucagugu

SEQ ID NO: 1031294 - RNA, 22 nt, Human
aaggcacugcuuugcugcgccc

SEQ ID NO: 1031295 - RNA, 22 nt, Human
gaugccugcauuucaggagagu

SEQ ID NO: 1031296 - RNA, 22 nt, Human
ugggaggcuuccagaccuugcu

SEQ ID NO: 1031297 - RNA, 22 nt, Human
agaugaaaagauaagcagcaau

SEQ ID NO: 1031298 - RNA, 22 nt, Human
agccuggccugggcaggcacau

SEQ ID NO: 1031299 - RNA, 22 nt, Human
ccaggcugccgaggaaagaaag

SEQ ID NO: 1031300 - RNA, 19 nt, Human
cuguccuuggcugcacugu

SEQ ID NO: 1031301 - RNA, 23 nt, Human
aggaggccugaaacugaggcuga

SEQ ID NO: 1031302 - RNA, 20 nt, Human
cuuuggcaaugagaacaggg

SEQ ID NO: 1031303 - RNA, 22 nt, Human
aguauuuccuggcuuaucugcu

SEQ ID NO: 1031304 - RNA, 22 nt, Human
gauuucaaagguucugcaugcc

SEQ ID NO: 1031305 - RNA, 22 nt, Human
gccugggugaauuugauccuaa

SEQ ID NO: 1031306 - RNA, 22 nt, Human
ggaggggcagccauggaacucc

SEQ ID NO: 1031307 - RNA, 22 nt, Human
cacugaaggcugcagcucagcc

SEQ ID NO: 1031308 - RNA, 22 nt, Human
cucuggaggccuaaggaagugg

SEQ ID NO: 1031309 - RNA, 22 nt, Human
cuggcucuucagugcuugguuc

SEQ ID NO: 1031310 - RNA, 22 nt, Human
agcucagcuuccucuccaugcu

SEQ ID NO: 1031311 - RNA, 22 nt, Human
caggcagccaggggaccugucc

SEQ ID NO: 1031312 - RNA, 22 nt, Human
gagguuagaggucagugcaguc

SEQ ID NO: 1031313 - RNA, 22 nt, Human
cacacagaugguaagggaggga

SEQ ID NO: 1031314 - RNA, 22 nt, Human
uauguacauguuaaagggcaaa

SEQ ID NO: 1031315 - RNA, 22 nt, Human
uguuccauaaguggugcuuugu

SEQ ID NO: 1031316 - RNA, 17 nt, Human
agugaaauuuacauugc

SEQ ID NO: 1031317 - RNA, 21 nt, Human
aggugcagagccagggaccag

SEQ ID NO: 1031318 - RNA, 22 nt, Human
uguauuagaucugagaacuucu

SEQ ID NO: 1031319 - RNA, 22 nt, Human
accccagaggcggaggcugcag

SEQ ID NO: 1031320 - RNA, 22 nt, Human
ggcuucccagcagagggcgcac

SEQ ID NO: 1031321 - RNA, 22 nt, Human
ugaugguugauuauaaaucagu

SEQ ID NO: 1031322 - RNA, 22 nt, Human
aggccuggugugccggaugcag

SEQ ID NO: 1031323 - RNA, 22 nt, Human
uguguccuucugggagucccag

SEQ ID NO: 1031324 - RNA, 22 nt, Human
uaggccagcccuuaguccuguc

SEQ ID NO: 1031325 - RNA, 20 nt, Human
ccugucuggagacaaagaga

SEQ ID NO: 1031326 - RNA, 22 nt, Human
ggccugaggcaauagucagaca

SEQ ID NO: 1031327 - RNA, 22 nt, Human
uaaaaguggauaagcuguagga

SEQ ID NO: 1031328 - RNA, 22 nt, Human
cugcagaggguuugagcauccu

SEQ ID NO: 1031329 - RNA, 22 nt, Human
aaugaugguuaaacacuggagg

SEQ ID NO: 1031330 - RNA, 22 nt, Human
cccagaaggucgaggcugcagu

SEQ ID NO: 1031331 - RNA, 22 nt, Human
cccaggaggucgaagcugcagu

SEQ ID NO: 1031332 - RNA, 22 nt, Human
uggcagcuccuggggccagcac

SEQ ID NO: 1031333 - RNA, 22 nt, Human
augauggugggagaugacccag

SEQ ID NO: 1031334 - RNA, 20 nt, Human
ugcagggcugccucccagcu

SEQ ID NO: 1031335 - RNA, 22 nt, Human
uggcagaggaggcucagauuga

SEQ ID NO: 1031336 - RNA, 22 nt, Human
gcccaggcuggagugcaguagc

SEQ ID NO: 1031337 - RNA, 22 nt, Human
guggcuucugcggugugcgcag

SEQ ID NO: 1031338 - RNA, 22 nt, Human
ccagagccucuuaugaagaucg

SEQ ID NO: 1031339 - RNA, 22 nt, Human
cccuggaggcaaagguugcagu

SEQ ID NO: 1031340 - RNA, 22 nt, Human
uggcugccuagugucugagcag

SEQ ID NO: 1031341 - RNA, 22 nt, Human
ugggagcaagcuggugcuggag

SEQ ID NO: 1031342 - RNA, 18 nt, Human
acauuucuaggugaaagc

SEQ ID NO: 1031343 - RNA, 19 nt, Human
ggcugccuggagcgagggc

SEQ ID NO: 1031344 - RNA, 22 nt, Human
cucuggaauuaaggaagccugu

SEQ ID NO: 1031345 - RNA, 22 nt, Human
ccacuugugaaauaaucaaaua

SEQ ID NO: 1031346 - RNA, 22 nt, Human
ggauccuuaacuaucacaguga

SEQ ID NO: 1031347 - RNA, 22 nt, Human
gaggccagcgcgcagcacuuuu

SEQ ID NO: 1031348 - RNA, 22 nt, Human
gcucccaggaagagaagggcca

SEQ ID NO: 1031349 - RNA, 22 nt, Human
uggcucagugacauuccuccca

SEQ ID NO: 1031350 - RNA, 22 nt, Human
uuugcauugcauacaaggaacu

SEQ ID NO: 1031351 - RNA, 22 nt, Human
ccaaggcuucccagagaugcuc

SEQ ID NO: 1031352 - RNA, 18 nt, Human
cagauccaggcagcuauu

SEQ ID NO: 1031353 - RNA, 22 nt, Human
cuggggcugcggacgggagccc

SEQ ID NO: 1031354 - RNA, 22 nt, Human
ucagcaaugagaacuggcauuu

SEQ ID NO: 1031355 - RNA, 22 nt, Human
cccagggcuuuucucacuagac

SEQ ID NO: 1031356 - RNA, 22 nt, Human
caguggugaagagcaggggcuc

SEQ ID NO: 1031357 - RNA, 22 nt, Human
ccugucugcaugagugagcaua

SEQ ID NO: 1031358 - RNA, 22 nt, Human
agaauucuguucuucgggugug

SEQ ID NO: 1031359 - RNA, 22 nt, Human
agagccaggcggcugggcaccu

SEQ ID NO: 1031360 - RNA, 22 nt, Human
gucccugcaucaccacgggacu

SEQ ID NO: 1031361 - RNA, 22 nt, Human
ccuggcugugcauugccggccc

SEQ ID NO: 1031362 - RNA, 22 nt, Human
ggcagugaaugaaacagaggcu

SEQ ID NO: 1031363 - RNA, 18 nt, Human
aggcuucccaggcaggcc

SEQ ID NO: 1031364 - RNA, 22 nt, Human
cucugggcuuguugaccugcac

SEQ ID NO: 1031365 - RNA, 22 nt, Human
ugucucagaggcaggaagagcc

SEQ ID NO: 1031366 - RNA, 22 nt, Human
caagagcucccagaccugggca

SEQ ID NO: 1031367 - RNA, 22 nt, Human
cacugaaucucaaggggagggu

SEQ ID NO: 1031368 - RNA, 22 nt, Human
caugcacaacauacucaagagg

SEQ ID NO: 1031369 - RNA, 21 nt, Human
ggcagccugacccccagagag

SEQ ID NO: 1031370 - RNA, 22 nt, Human
gccugggaacucugaucuccug

SEQ ID NO: 1031371 - RNA, 22 nt, Human
uugcauugcuuggucuucaaga

SEQ ID NO: 1031372 - RNA, 22 nt, Human
ccucucaucauuaucgcuuugu

SEQ ID NO: 1031373 - RNA, 22 nt, Human
gcuggccugcgagggcaggcug

SEQ ID NO: 1031374 - RNA, 22 nt, Human
acuguacacgugucauuuacag

SEQ ID NO: 1031375 - RNA, 22 nt, Human
uauuauguagaguaaggguuaa

SEQ ID NO: 1031376 - RNA, 22 nt, Human
gggagcugagggaccucugugg

SEQ ID NO: 1031377 - RNA, 22 nt, Human
gaauuguagagggaacagaagc

SEQ ID NO: 1031378 - RNA, 22 nt, Human
cccuggaggaaaaucugaggcu

SEQ ID NO: 1031379 - RNA, 22 nt, Human
ugauuuccacagucaggggugc

SEQ ID NO: 1031380 - RNA, 22 nt, Human
cacacaugaaucccuaguaccu

SEQ ID NO: 1031381 - RNA, 22 nt, Human
ggcaggagauaaaauauuaguu

SEQ ID NO: 1031382 - RNA, 22 nt, Human
auacaguauuaccuguucagga

SEQ ID NO: 1031383 - RNA, 22 nt, Human
uacauaguuccauuuacaggaa

SEQ ID NO: 1031384 - RNA, 23 nt, Human
ggagccuggcauaugagacgcau

SEQ ID NO: 1031385 - RNA, 22 nt, Human
ugaaggcauugaugaaggaauc

SEQ ID NO: 1031386 - RNA, 22 nt, Human
gggcugcuuauacugaugauaa

SEQ ID NO: 1031387 - RNA, 22 nt, Human
aggcucagcccaagguggagag

SEQ ID NO: 1031388 - RNA, 22 nt, Human
ucucagaguuuuuuuccaggac

SEQ ID NO: 1031389 - RNA, 22 nt, Human
gaggccuguagucauggaugua

SEQ ID NO: 1031390 - RNA, 22 nt, Human
cagagccugccaccuuucuccc

SEQ ID NO: 1031391 - RNA, 22 nt, Human
aucuggcuuacgaagcacuggu

SEQ ID NO: 1031392 - RNA, 22 nt, Human
guguauaacuaucuaucuagua

SEQ ID NO: 1031393 - RNA, 22 nt, Human
cagggccugagggcugcucugc

SEQ ID NO: 1031394 - RNA, 22 nt, Human
ugccugggccucugaggaaggc

SEQ ID NO: 1031395 - RNA, 22 nt, Human
aggcccuggcacugccugggag

SEQ ID NO: 1031396 - RNA, 20 nt, Human
acagccagaggaggcagaca

SEQ ID NO: 1031397 - RNA, 22 nt, Human
ucucuggaauuuugagagugac

SEQ ID NO: 1031398 - RNA, 22 nt, Human
aaaagguuuugaguacaaauau

SEQ ID NO: 1031399 - RNA, 22 nt, Human
acugcuuacaaaaggaaagaau

SEQ ID NO: 1031400 - RNA, 22 nt, Human
gcacagguugcaaaaguucaca

SEQ ID NO: 1031401 - RNA, 22 nt, Human
gccuggaguggacuuggccccu

SEQ ID NO: 1031402 - RNA, 22 nt, Human
ccuggagguggagguugcagug

SEQ ID NO: 1031403 - RNA, 22 nt, Human
cucuggccugcuuccucaggua

SEQ ID NO: 1031404 - RNA, 22 nt, Human
gcuggcugggucccugagaggc

SEQ ID NO: 1031405 - RNA, 22 nt, Human
cccaggcugaugggaugggcca

SEQ ID NO: 1031406 - RNA, 22 nt, Human
ccaggcagagggauccccaucc

SEQ ID NO: 1031407 - RNA, 22 nt, Human
aaaaguuuaagacucauucuag

SEQ ID NO: 1031408 - RNA, 22 nt, Human
aacucagcauccugcacagaga

SEQ ID NO: 1031409 - RNA, 22 nt, Human
uaaaguucagugcaugaaugug

SEQ ID NO: 1031410 - RNA, 23 nt, Human
ccuucagaagaaguaacaggggc

SEQ ID NO: 1031411 - RNA, 22 nt, Human
uggccugguaccacauagauuu

SEQ ID NO: 1031412 - RNA, 22 nt, Human
caguggaggccuugggaccuuu

SEQ ID NO: 1031413 - RNA, 22 nt, Human
uggcugaauaauauucuguugu

SEQ ID NO: 1031414 - RNA, 22 nt, Human
gagcuguccuaccaggaguccu

SEQ ID NO: 1031415 - RNA, 22 nt, Human
augggaguuuucucugaugcuc

SEQ ID NO: 1031416 - RNA, 22 nt, Human
aaagacugguguguuacauaua

SEQ ID NO: 1031417 - RNA, 22 nt, Human
gccugaaguuucaugccucuau

SEQ ID NO: 1031418 - RNA, 18 nt, Human
agagaugguguagaguuu

SEQ ID NO: 1031419 - RNA, 22 nt, Human
gccuguguggaugcgccggugc

SEQ ID NO: 1031420 - RNA, 22 nt, Human
gauggguggucucagacuugcc

SEQ ID NO: 1031421 - RNA, 22 nt, Human
uggcuucuuagaccaguggccu

SEQ ID NO: 1031422 - RNA, 22 nt, Human
ucagcagggaggcucugugccc

SEQ ID NO: 1031423 - RNA, 22 nt, Human
agugaaauacugucguuuuuag

SEQ ID NO: 1031424 - RNA, 22 nt, Human
ggugaaggaggaagcugaugga

SEQ ID NO: 1031425 - RNA, 22 nt, Human
ccccagcucagugcagggacau

SEQ ID NO: 1031426 - RNA, 23 nt, Human
uuacuuuugcaccaaccuaauau

SEQ ID NO: 1031427 - RNA, 22 nt, Human
cccugggacccgcugcagaggc

SEQ ID NO: 1031428 - RNA, 22 nt, Human
cacaggcucuucucacuugauu

SEQ ID NO: 1031429 - RNA, 22 nt, Human
gcuaggagauugagcucugaag

SEQ ID NO: 1031430 - RNA, 22 nt, Human
acucugagcaucccaagucuua

SEQ ID NO: 1031431 - RNA, 22 nt, Human
cucaggaggugguagaggcccu

SEQ ID NO: 1031432 - RNA, 22 nt, Human
uuccucagagggcgcuggggaa

SEQ ID NO: 1031433 - RNA, 22 nt, Human
aaaucuguaagcaauugcucag

SEQ ID NO: 1031434 - RNA, 22 nt, Human
cagaaguaagauuacugugagu

SEQ ID NO: 1031435 - RNA, 21 nt, Human
cacugcagccuugaccugggc

SEQ ID NO: 1031436 - RNA, 22 nt, Human
ugccuaggaaaccucaugcuuc

SEQ ID NO: 1031437 - RNA, 22 nt, Human
gccugcaguucugugcuaggca

SEQ ID NO: 1031438 - RNA, 22 nt, Human
gcagggacagggcagggccuuu

SEQ ID NO: 1031439 - RNA, 19 nt, Human
ucucagaggaaaaauugcu

SEQ ID NO: 1031440 - RNA, 22 nt, Human
agaggccagggacacugcucaa

SEQ ID NO: 1031441 - RNA, 22 nt, Human
gcagugugaccgagcuugcuuc

SEQ ID NO: 1031442 - RNA, 22 nt, Human
uccagggagagccgcugcucca

SEQ ID NO: 1031443 - RNA, 22 nt, Human
gcacugaaauuauaugcauuug

SEQ ID NO: 1031444 - RNA, 22 nt, Human
auagaaauggcagcuggugcua

SEQ ID NO: 1031445 - RNA, 22 nt, Human
uucucauucugacucaguguag

SEQ ID NO: 1031446 - RNA, 22 nt, Human
gcaggaguguggugggacaucc

SEQ ID NO: 1031447 - RNA, 22 nt, Human
uacaaaguuugggguccucaaa

SEQ ID NO: 1031448 - RNA, 22 nt, Human
ugcauuaugcuugugcuguaua

SEQ ID NO: 1031449 - RNA, 22 nt, Human
ggcagagaugugggucagaauc

SEQ ID NO: 1031450 - RNA, 22 nt, Human
cucucuguuaugcuuucaugaa

SEQ ID NO: 1031451 - RNA, 21 nt, Human
agcuuguguguaucacagugu

SEQ ID NO: 1031452 - RNA, 22 nt, Human
acagaaggcggggacaaggcgg

SEQ ID NO: 1031453 - RNA, 22 nt, Human
gccuggugcuaugagggccagc

SEQ ID NO: 1031454 - RNA, 22 nt, Human
agccugcaggaugggcagcacc

SEQ ID NO: 1031455 - RNA, 22 nt, Human
caggcugcagaggccuuucaug

SEQ ID NO: 1031456 - RNA, 22 nt, Human
gaggaggcuaagugggcucugg

SEQ ID NO: 1031457 - RNA, 22 nt, Human
cucaguuucugacauuaaaauc

SEQ ID NO: 1031458 - RNA, 22 nt, Human
aggagugcaaauaguccagaga

SEQ ID NO: 1031459 - RNA, 22 nt, Human
ugguccagacauuucugaggua

SEQ ID NO: 1031460 - RNA, 22 nt, Human
gccuggagcagacgugucccgg

SEQ ID NO: 1031461 - RNA, 22 nt, Human
ucuuuccucugagcuccuguag

SEQ ID NO: 1031462 - RNA, 22 nt, Human
gcuucuggaggagcugggcuga

SEQ ID NO: 1031463 - RNA, 22 nt, Human
agcuggaggggccagcaggugu

SEQ ID NO: 1031464 - RNA, 22 nt, Human
agaagccaauucugugugaguc

SEQ ID NO: 1031465 - RNA, 22 nt, Human
augagcuguaagguggcuuccu

SEQ ID NO: 1031466 - RNA, 22 nt, Human
cagcuucccuuggcugagcaga

SEQ ID NO: 1031467 - RNA, 22 nt, Human
cccuggugguacggcacuggca

SEQ ID NO: 1031468 - RNA, 22 nt, Human
gaaaugugcagaauguguuaga

SEQ ID NO: 1031469 - RNA, 22 nt, Human
uggccugggucacaccaggguc

SEQ ID NO: 1031470 - RNA, 22 nt, Human
gagcucuguguagccugagggu

SEQ ID NO: 1031471 - RNA, 22 nt, Human
ugaaagcuguccacuaggcugu

SEQ ID NO: 1031472 - RNA, 22 nt, Human
agugcugucccgacaacugagg

SEQ ID NO: 1031473 - RNA, 23 nt, Human
ugcagcugccucuggcgggccgg

SEQ ID NO: 1031474 - RNA, 17 nt, Human
uccuucagugccucugc

SEQ ID NO: 1031475 - RNA, 22 nt, Human
caggaugggugucggccagcac

SEQ ID NO: 1031476 - RNA, 22 nt, Human
uuccaaagaaauugaccaagac

SEQ ID NO: 1031477 - RNA, 22 nt, Human
gccccagccaaggugacacgaa

SEQ ID NO: 1031478 - RNA, 22 nt, Human
ccugccugcguccucugagggc

SEQ ID NO: 1031479 - RNA, 22 nt, Human
ccuggcagucaggggaguccuu

SEQ ID NO: 1031480 - RNA, 22 nt, Human
aauuuagauugauaaacaugga

SEQ ID NO: 1031481 - RNA, 22 nt, Human
aagcugccuuccaugugaggaa

SEQ ID NO: 1031482 - RNA, 22 nt, Human
cggggcugcucguccuccugug

SEQ ID NO: 1031483 - RNA, 17 nt, Human
cccagagaugcugccuu

SEQ ID NO: 1031484 - RNA, 22 nt, Human
aggccugcagcaggagcaaacc

SEQ ID NO: 1031485 - RNA, 22 nt, Human
guucccauacaguaucagugcu

SEQ ID NO: 1031486 - RNA, 22 nt, Human
acacagggauauuucagguggu

SEQ ID NO: 1031487 - RNA, 22 nt, Human
gacagggcaagacucugucuaa

SEQ ID NO: 1031488 - RNA, 20 nt, Human
cucucccagcacagcuuccu

SEQ ID NO: 1031489 - RNA, 23 nt, Human
uccuucagagccucccuccaagc

SEQ ID NO: 1031490 - RNA, 22 nt, Human
agaguguaauaagggcaagggc

SEQ ID NO: 1031491 - RNA, 22 nt, Human
gcagggcagcuuagucccuguc

SEQ ID NO: 1031492 - RNA, 22 nt, Human
auguacacaugcaugcaugugc

SEQ ID NO: 1031493 - RNA, 19 nt, Human
cugggagguguucagagaa

SEQ ID NO: 1031494 - RNA, 22 nt, Human
ugagccaguggaagauggcagu

SEQ ID NO: 1031495 - RNA, 22 nt, Human
ugccugucuuaauaucuggaaa

SEQ ID NO: 1031496 - RNA, 19 nt, Human
ucuggcuccugccaggcug

SEQ ID NO: 1031497 - RNA, 22 nt, Human
aacaaauggggccuuguaugaa

SEQ ID NO: 1031498 - RNA, 22 nt, Human
ucaggaguccugccugcagccu

SEQ ID NO: 1031499 - RNA, 22 nt, Human
cuguggcuuucucugccuccuu

SEQ ID NO: 1031500 - RNA, 22 nt, Human
ugaggcuggcaaggcugguauu

SEQ ID NO: 1031501 - RNA, 19 nt, Human
cagucccaaauucuuguca

SEQ ID NO: 1031502 - RNA, 22 nt, Human
accucugcaaugcaaugucaug

SEQ ID NO: 1031503 - RNA, 22 nt, Human
cucaggauucucgacacucaca

SEQ ID NO: 1031504 - RNA, 22 nt, Human
aguaaaaauugaggugcaaaau

SEQ ID NO: 1031505 - RNA, 20 nt, Human
ugcagagcuggcuggcuccu

SEQ ID NO: 1031506 - RNA, 22 nt, Human
agccuccaucccaugcacaaag

SEQ ID NO: 1031507 - RNA, 15 nt, Human
aaucuggcggcaagu

SEQ ID NO: 1031508 - RNA, 22 nt, Human
agccuggagcuugaguuaugag

SEQ ID NO: 1031509 - RNA, 22 nt, Human
uccuugaagagugggcggucga

SEQ ID NO: 1031510 - RNA, 22 nt, Human
cuuggggcugucacucuggcau

SEQ ID NO: 1031511 - RNA, 22 nt, Human
gguggggucacgacagagggaa

SEQ ID NO: 1031512 - RNA, 23 nt, Human
aaucuggcugauguuuuuucucu

SEQ ID NO: 1031513 - RNA, 22 nt, Human
cuguguccucccgcugcaccca

SEQ ID NO: 1031514 - RNA, 22 nt, Human
ggaggcugcugccucacguggg

SEQ ID NO: 1031515 - RNA, 22 nt, Human
ccagcagaggggcggagugcag

SEQ ID NO: 1031516 - RNA, 22 nt, Human
uggcucaguuugggggauugaa

SEQ ID NO: 1031517 - RNA, 22 nt, Human
cuguccuugcuggccagguaug

SEQ ID NO: 1031518 - RNA, 22 nt, Human
ugggcaagucacuucugucuuu

SEQ ID NO: 1031519 - RNA, 22 nt, Human
ugauuuccuggcuuuggaguuc

SEQ ID NO: 1031520 - RNA, 22 nt, Human
ugcucauuggcgaucugaggga

SEQ ID NO: 1031521 - RNA, 22 nt, Human
ccaggccagcaggcacaccugc

SEQ ID NO: 1031522 - RNA, 22 nt, Human
agcaugcugguguucauggcag

SEQ ID NO: 1031523 - RNA, 20 nt, Human
gcuuccuucccagcccccac

SEQ ID NO: 1031524 - RNA, 22 nt, Human
gaugcagggcuggcaggagcuu

SEQ ID NO: 1031525 - RNA, 22 nt, Human
ccuuaaaagaacuaucucuucu

SEQ ID NO: 1031526 - RNA, 22 nt, Human
aaugucugccugaacuuuauau

SEQ ID NO: 1031527 - RNA, 22 nt, Human
uuaugcuaguauaguccuuaga

SEQ ID NO: 1031528 - RNA, 21 nt, Human
ggccucugccuugccccacuc

SEQ ID NO: 1031529 - RNA, 22 nt, Human
uauguacauggagagcaauuga

SEQ ID NO: 1031530 - RNA, 22 nt, Human
cgcugggcgccgaccugcuggc

SEQ ID NO: 1031531 - RNA, 22 nt, Human
aggccagcucacccuggcuccu

SEQ ID NO: 1031532 - RNA, 22 nt, Human
guaucuuuccacaucuucagua

SEQ ID NO: 1031533 - RNA, 19 nt, Human
uggggccuccugucccugg

SEQ ID NO: 1031534 - RNA, 22 nt, Human
ugaggugaagaguggagcucag

SEQ ID NO: 1031535 - RNA, 19 nt, Human
ccagguggaacugagguag

SEQ ID NO: 1031536 - RNA, 22 nt, Human
ccagccugguucagaauuggcu

SEQ ID NO: 1031537 - RNA, 22 nt, Human
gcauucaucuuccuccaugcag

SEQ ID NO: 1031538 - RNA, 22 nt, Human
uccagggacagcgcuggagcua

SEQ ID NO: 1031539 - RNA, 22 nt, Human
uaacagaauccuguuauugcca

SEQ ID NO: 1031540 - RNA, 22 nt, Human
agcagcucuguuuaccuggagg

SEQ ID NO: 1031541 - RNA, 22 nt, Human
gccuggagaggaagccggugga

SEQ ID NO: 1031542 - RNA, 22 nt, Human
uaacagaaaggcucaggugcuc

SEQ ID NO: 1031543 - RNA, 19 nt, Human
gcacacccugcaccaccau

SEQ ID NO: 1031544 - RNA, 22 nt, Human
caagggaccugagauggucucu

SEQ ID NO: 1031545 - RNA, 22 nt, Human
caggcuggaguuaccuuuaggg

SEQ ID NO: 1031546 - RNA, 22 nt, Human
uaaggcacuucaauguuuagaa

SEQ ID NO: 1031547 - RNA, 22 nt, Human
caggggccggcuguccgugccc

SEQ ID NO: 1031548 - RNA, 22 nt, Human
ggagcugaaggggugggcucag

SEQ ID NO: 1031549 - RNA, 22 nt, Human
aaggagcucccggcagaccagg

SEQ ID NO: 1031550 - RNA, 22 nt, Human
guccucuggugaaagcauuccc

SEQ ID NO: 1031551 - RNA, 22 nt, Human
uggaggccagagguacugggac

SEQ ID NO: 1031552 - RNA, 17 nt, Human
cuggagccuccaacucc

SEQ ID NO: 1031553 - RNA, 22 nt, Human
agcuggccuguuagagcugagu

SEQ ID NO: 1031554 - RNA, 22 nt, Human
uugaauucauuucucauugagu

SEQ ID NO: 1031555 - RNA, 22 nt, Human
ccagggcaauaggaacacuuuu

SEQ ID NO: 1031556 - RNA, 22 nt, Human
aaagaaggaccuggaggaggau

SEQ ID NO: 1031557 - RNA, 22 nt, Human
agagugaaggccagguuacagu

SEQ ID NO: 1031558 - RNA, 22 nt, Human
caguggccugagccaggcuucc

SEQ ID NO: 1031559 - RNA, 22 nt, Human
gcucucugggugugucuagaua

SEQ ID NO: 1031560 - RNA, 22 nt, Human
cagggccuccuaaggcaucuaa

SEQ ID NO: 1031561 - RNA, 22 nt, Human
uuugcauuucuaaugagcuccg

SEQ ID NO: 1031562 - RNA, 22 nt, Human
uugacaagaaucguugccuugg

SEQ ID NO: 1031563 - RNA, 19 nt, Human
augucuguugaauuucaua

SEQ ID NO: 1031564 - RNA, 22 nt, Human
acauuucuuugcuagacagcag

SEQ ID NO: 1031565 - RNA, 17 nt, Human
cuggagccaagagggcc

SEQ ID NO: 1031566 - RNA, 22 nt, Human
agugcauuauauguuucaaugg

SEQ ID NO: 1031567 - RNA, 22 nt, Human
ugcagaaggaggaggaaaucca

SEQ ID NO: 1031568 - RNA, 22 nt, Human
gccucuggggcagcugagucau

SEQ ID NO: 1031569 - RNA, 22 nt, Human
gaggcuggcagaaaagcacagg

SEQ ID NO: 1031570 - RNA, 22 nt, Human
agcugccacagagccuggccag

SEQ ID NO: 1031571 - RNA, 22 nt, Human
agaggcaggagguugacuugag

SEQ ID NO: 1031572 - RNA, 22 nt, Human
cugggaggacaacuuggagcuc

SEQ ID NO: 1031573 - RNA, 22 nt, Human
aauuucaauuacuuuugcacca

SEQ ID NO: 1031574 - RNA, 22 nt, Human
uggagcaagcuggagagaacau

SEQ ID NO: 1031575 - RNA, 22 nt, Human
gauggcacacagacauccccgc

SEQ ID NO: 1031576 - RNA, 22 nt, Human
agcuguguggugucugacagcu

SEQ ID NO: 1031577 - RNA, 22 nt, Human
ggcauguuucaucacaucaaga

SEQ ID NO: 1031578 - RNA, 21 nt, Human
agggaaagaaaaugagcuaau

SEQ ID NO: 1031579 - RNA, 22 nt, Human
cacuggugacuucugagcugga

SEQ ID NO: 1031580 - RNA, 22 nt, Human
augaagcugguuuuggcuuggg

SEQ ID NO: 1031581 - RNA, 21 nt, Human
gcagccacagccaccaagcua

SEQ ID NO: 1031582 - RNA, 22 nt, Human
ugucacauaggcaaaauguuuu

SEQ ID NO: 1031583 - RNA, 22 nt, Human
auugaauagaugcauuauacua

SEQ ID NO: 1031584 - RNA, 23 nt, Human
agaugaggcuucuccauguuggu

SEQ ID NO: 1031585 - RNA, 22 nt, Human
uugagucaguaauuccauuucu

SEQ ID NO: 1031586 - RNA, 22 nt, Human
aggccuguuccaggccccuuuu

SEQ ID NO: 1031587 - RNA, 22 nt, Human
acagacagggcaccugccuccu

SEQ ID NO: 1031588 - RNA, 22 nt, Human
ugcuggggcucugaccacucca

SEQ ID NO: 1031589 - RNA, 19 nt, Human
ugagaggcuuaaggcagcu

SEQ ID NO: 1031590 - RNA, 22 nt, Human
gcaaggagacuguagggccaag

SEQ ID NO: 1031591 - RNA, 22 nt, Human
gagacacacacaggagguggca

SEQ ID NO: 1031592 - RNA, 22 nt, Human
cuguccugauggugccacuggu

SEQ ID NO: 1031593 - RNA, 22 nt, Human
agggccagcccauaaugccaaa

SEQ ID NO: 1031594 - RNA, 22 nt, Human
cucccagggccaucgagucacu

SEQ ID NO: 1031595 - RNA, 22 nt, Human
aggagcugcaaauauuaguaau

SEQ ID NO: 1031596 - RNA, 22 nt, Human
uccagcagaaaagagguaggga

SEQ ID NO: 1031597 - RNA, 22 nt, Human
ggcucuggugggaagguuagau

SEQ ID NO: 1031598 - RNA, 21 nt, Human
augaagucuaugcuucugugu

SEQ ID NO: 1031599 - RNA, 22 nt, Human
agucagugaaggcauugcucaa

SEQ ID NO: 1031600 - RNA, 22 nt, Human
agagccaggugcugcuguuuga

SEQ ID NO: 1031601 - RNA, 22 nt, Human
gacauucacaguuuccgauggu

SEQ ID NO: 1031602 - RNA, 22 nt, Human
gggucuggacggcugcaggaag

SEQ ID NO: 1031603 - RNA, 22 nt, Human
agcagcugaucaaagcacuuau

SEQ ID NO: 1031604 - RNA, 22 nt, Human
ucagggcaggcgagcagcugcu

SEQ ID NO: 1031605 - RNA, 22 nt, Human
ggaaagagcuaaaagggugaga

SEQ ID NO: 1031606 - RNA, 22 nt, Human
auugucgcuuauuuaggugcuu

SEQ ID NO: 1031607 - RNA, 22 nt, Human
ucuucucaguuucucuaggaug

SEQ ID NO: 1031608 - RNA, 22 nt, Human
aaaagguagauucuccuucuau

SEQ ID NO: 1031609 - RNA, 22 nt, Human
uuaauacagucuccagaaguaa

SEQ ID NO: 1031610 - RNA, 22 nt, Human
uuuccauauucugcgucugcca

SEQ ID NO: 1031611 - RNA, 22 nt, Human
uacuuucuagcucuccccaguu

SEQ ID NO: 1031612 - RNA, 22 nt, Human
cagaguggcagucccaggccca

SEQ ID NO: 1031613 - RNA, 22 nt, Human
ugggcuguggagcaccuuugca

SEQ ID NO: 1031614 - RNA, 22 nt, Human
gcuggccauauauuuugcuguu

SEQ ID NO: 1031615 - RNA, 22 nt, Human
ucaguuuucaauuucaucagag

SEQ ID NO: 1031616 - RNA, 22 nt, Human
acuaaggaauaugacaaacuca

SEQ ID NO: 1031617 - RNA, 22 nt, Human
uuugcauuugcaaauaaugaaa

SEQ ID NO: 1031618 - RNA, 22 nt, Human
cagaguguauucugcaguugca

SEQ ID NO: 1031619 - RNA, 22 nt, Human
ucuggccuuaucuguccaagcc

SEQ ID NO: 1031620 - RNA, 22 nt, Human
gcagcuuuguggagaggcccau

SEQ ID NO: 1031621 - RNA, 22 nt, Human
agaggccuccgaaaggugggcu

SEQ ID NO: 1031622 - RNA, 22 nt, Human
ucccaaagcuacucuucugacu

SEQ ID NO: 1031623 - RNA, 22 nt, Human
auggacaggaacucccuuggca

SEQ ID NO: 1031624 - RNA, 22 nt, Human
ccagcucuagccccauguggcu

SEQ ID NO: 1031625 - RNA, 22 nt, Human
uuaaguccuugguaauuuucuu

SEQ ID NO: 1031626 - RNA, 22 nt, Human
aggccagcuguuacuagagcca

SEQ ID NO: 1031627 - RNA, 22 nt, Human
ucaugccacuuacaaaauaaug

SEQ ID NO: 1031628 - RNA, 22 nt, Human
uagaaacacagaucugguguca

SEQ ID NO: 1031629 - RNA, 22 nt, Human
cagugcuccugauguacccuug

SEQ ID NO: 1031630 - RNA, 20 nt, Human
cuggguggcaagcaaggggg

SEQ ID NO: 1031631 - RNA, 22 nt, Human
cugcuccacaccuccauuuccu

SEQ ID NO: 1031632 - RNA, 22 nt, Human
gcagugggcaacaagagcugga

SEQ ID NO: 1031633 - RNA, 22 nt, Human
gggccugggaacuugcauuuag

SEQ ID NO: 1031634 - RNA, 22 nt, Human
gugcauuugacgaauacucacu

SEQ ID NO: 1031635 - RNA, 22 nt, Human
gcaguggauccaaugguaucuu

SEQ ID NO: 1031636 - RNA, 18 nt, Human
uggagcaggaagccuggc

SEQ ID NO: 1031637 - RNA, 22 nt, Human
acagcaagccagcuugucacug

SEQ ID NO: 1031638 - RNA, 19 nt, Human
ugggccugcaucugggucu

SEQ ID NO: 1031639 - RNA, 22 nt, Human
ucaaggcuaaacuuucagagua

SEQ ID NO: 1031640 - RNA, 22 nt, Human
cagccucucuguaucucaggau

SEQ ID NO: 1031641 - RNA, 22 nt, Human
uguuuaaucuauaaaauggaga

SEQ ID NO: 1031642 - RNA, 22 nt, Human
uguuuuauuucuccaagaggga

SEQ ID NO: 1031643 - RNA, 22 nt, Human
gcccugagggguggugucugua

SEQ ID NO: 1031644 - RNA, 22 nt, Human
uuuuccuacugauaaacaguua

SEQ ID NO: 1031645 - RNA, 22 nt, Human
gacaggggucccucugggcugu

SEQ ID NO: 1031646 - RNA, 22 nt, Human
agcaccugcuaugugucaggga

SEQ ID NO: 1031647 - RNA, 22 nt, Human
gugcauugcgaugcagacgacc

SEQ ID NO: 1031648 - RNA, 22 nt, Human
caggcagccugagggaucuggg

SEQ ID NO: 1031649 - RNA, 22 nt, Human
gggccccaaaaugccaggcucu

SEQ ID NO: 1031650 - RNA, 22 nt, Human
ucacacgugagguucuauccug

SEQ ID NO: 1031651 - RNA, 22 nt, Human
acaggcucuggggcaggauggc

SEQ ID NO: 1031652 - RNA, 22 nt, Human
ugcccuguuaucuuggaagagu

SEQ ID NO: 1031653 - RNA, 22 nt, Human
gaggaagcagggcuuggcugag

SEQ ID NO: 1031654 - RNA, 19 nt, Human
cagagcagugguuccugaa

SEQ ID NO: 1031655 - RNA, 22 nt, Human
ucaagaaagggcuucaccagga

SEQ ID NO: 1031656 - RNA, 22 nt, Human
agcugccagcaucccggaaggg

SEQ ID NO: 1031657 - RNA, 22 nt, Human
cagagcugcgcuuuuuccuggu

SEQ ID NO: 1031658 - RNA, 22 nt, Human
gugcaugugucuuuauaguagc

SEQ ID NO: 1031659 - RNA, 22 nt, Human
guggccucaugucuauaaagag

SEQ ID NO: 1031660 - RNA, 22 nt, Human
cagaggcagaggucaucucugg

SEQ ID NO: 1031661 - RNA, 19 nt, Human
uggcuucuguuuucauguu

SEQ ID NO: 1031662 - RNA, 22 nt, Human
aucuauuaugcugagaaacugu

SEQ ID NO: 1031663 - RNA, 21 nt, Human
agaaaauggcguuuuagauuu

SEQ ID NO: 1031664 - RNA, 23 nt, Human
aggauguaggauguauggcagag

SEQ ID NO: 1031665 - RNA, 22 nt, Human
auacauuagaaucugguacuca

SEQ ID NO: 1031666 - RNA, 22 nt, Human
gcuggccugaccagccacaggc

SEQ ID NO: 1031667 - RNA, 22 nt, Human
gcugugugaaaacugggccugg

SEQ ID NO: 1031668 - RNA, 22 nt, Human
cuuucauucuuagauauuagug

SEQ ID NO: 1031669 - RNA, 22 nt, Human
agugaaaucagguuuugacugc

SEQ ID NO: 1031670 - RNA, 22 nt, Human
uggggacaggagacuuacagcu

SEQ ID NO: 1031671 - RNA, 22 nt, Human
ggcugccucugaugugcagacg

SEQ ID NO: 1031672 - RNA, 22 nt, Human
ccuggaugauccaugucaugga

SEQ ID NO: 1031673 - RNA, 22 nt, Human
ugcuuccuucccguucuucucc

SEQ ID NO: 1031674 - RNA, 22 nt, Human
agagcuggacgucugagcccua

SEQ ID NO: 1031675 - RNA, 18 nt, Human
gagguccugcucuagccc

SEQ ID NO: 1031676 - RNA, 22 nt, Human
gugcucuggcuggucucccggu

SEQ ID NO: 1031677 - RNA, 23 nt, Human
cuuuuaacuugaucugagaccag

SEQ ID NO: 1031678 - RNA, 18 nt, Human
ucugagggugcgggagcu

SEQ ID NO: 1031679 - RNA, 22 nt, Human
aggggugaaggcccgauaggag

SEQ ID NO: 1031680 - RNA, 22 nt, Human
uagcagaaccagcagucaauuu

SEQ ID NO: 1031681 - RNA, 22 nt, Human
cugggaggauacacaagaucag

SEQ ID NO: 1031682 - RNA, 22 nt, Human
augccuguaaucccagugcuuu

SEQ ID NO: 1031683 - RNA, 22 nt, Human
caacagaaggaagcagggucag

SEQ ID NO: 1031684 - RNA, 22 nt, Human
gauuucaaggauguuagaggug

SEQ ID NO: 1031685 - RNA, 22 nt, Human
uacauuccacuagugacuggcg

SEQ ID NO: 1031686 - RNA, 22 nt, Human
uauaacaguuuaggugguguca

SEQ ID NO: 1031687 - RNA, 22 nt, Human
ggcagcaguggcugcuauuguc

SEQ ID NO: 1031688 - RNA, 22 nt, Human
uugaggagcacuagucagguau

SEQ ID NO: 1031689 - RNA, 22 nt, Human
uaauuuaauuccauggauucua

SEQ ID NO: 1031690 - RNA, 22 nt, Human
cucccuggaggcccagaccugg

SEQ ID NO: 1031691 - RNA, 22 nt, Human
ugagagugauugguucgaaugu

SEQ ID NO: 1031692 - RNA, 22 nt, Human
cauugcugugggcauuugcugc

SEQ ID NO: 1031693 - RNA, 22 nt, Human
cagugcaguuucccagaugcug

SEQ ID NO: 1031694 - RNA, 22 nt, Human
uccagcagaccaucaaggcuca

SEQ ID NO: 1031695 - RNA, 22 nt, Human
aucaauucuuaggaaaauagcu

SEQ ID NO: 1031696 - RNA, 22 nt, Human
cauucacucagcgaugccagua

SEQ ID NO: 1031697 - RNA, 22 nt, Human
cucugcaggggaggcaugcacu

SEQ ID NO: 1031698 - RNA, 22 nt, Human
aggcuggcccuacuggcugccu

SEQ ID NO: 1031699 - RNA, 22 nt, Human
ggccugaggcgucccagcugug

SEQ ID NO: 1031700 - RNA, 22 nt, Human
gcugcagcagcugcaggguugu

SEQ ID NO: 1031701 - RNA, 22 nt, Human
guggccaggacauugccaggca

SEQ ID NO: 1031702 - RNA, 22 nt, Human
uuuaagaugguauuuuauaaag

SEQ ID NO: 1031703 - RNA, 22 nt, Human
uggcaggguuggccaccuuacc

SEQ ID NO: 1031704 - RNA, 22 nt, Human
ucucagggccccaaaggcuagu

SEQ ID NO: 1031705 - RNA, 22 nt, Human
gccagguggcugagcagcugca

SEQ ID NO: 1031706 - RNA, 22 nt, Human
ggcagcagcaagguuggagcug

SEQ ID NO: 1031707 - RNA, 22 nt, Human
cacugcagcaccaugcagggcu

SEQ ID NO: 1031708 - RNA, 22 nt, Human
ugcagcuguaacagaggccuca

SEQ ID NO: 1031709 - RNA, 22 nt, Human
ccaggagucaauaaaggaagcu

SEQ ID NO: 1031710 - RNA, 22 nt, Human
gcucuggaagcaucugagagga

SEQ ID NO: 1031711 - RNA, 22 nt, Human
gcaagauguuaacauagggaga

SEQ ID NO: 1031712 - RNA, 22 nt, Human
acauugaucagccucccaugca

SEQ ID NO: 1031713 - RNA, 22 nt, Human
ggucuuccgagaggccugugcu

SEQ ID NO: 1031714 - RNA, 22 nt, Human
aaguucaagaucaagguuccag

SEQ ID NO: 1031715 - RNA, 18 nt, Human
ugggauggagaguaacug

SEQ ID NO: 1031716 - RNA, 22 nt, Human
uuacauuuuaguuaaccuguga

SEQ ID NO: 1031717 - RNA, 22 nt, Human
caguguccucagccagcagcua

SEQ ID NO: 1031718 - RNA, 22 nt, Human
agcuuuauucaugauuucaggg

SEQ ID NO: 1031719 - RNA, 22 nt, Human
auguacauuuguaguaauauca

SEQ ID NO: 1031720 - RNA, 22 nt, Human
ccacagggcacaagggagguug

SEQ ID NO: 1031721 - RNA, 22 nt, Human
agagaauuuuaaaagccuugaa

SEQ ID NO: 1031722 - RNA, 22 nt, Human
aaggaggaauuucagggugaau

SEQ ID NO: 1031723 - RNA, 22 nt, Human
aggauccuguauggagaagcug

SEQ ID NO: 1031724 - RNA, 22 nt, Human
ccagcugcaggggagcagugga

SEQ ID NO: 1031725 - RNA, 22 nt, Human
ggcagcaguccauggcccaagg

SEQ ID NO: 1031726 - RNA, 22 nt, Human
cagguggagcugacugagggca

SEQ ID NO: 1031727 - RNA, 22 nt, Human
cuacccaggcuggagugcagua

SEQ ID NO: 1031728 - RNA, 22 nt, Human
gaggcagagucacaaagagucu

SEQ ID NO: 1031729 - RNA, 22 nt, Human
cugucaucacaguugagcagcc

SEQ ID NO: 1031730 - RNA, 22 nt, Human
ccugggagguggagguugcagc

SEQ ID NO: 1031731 - RNA, 22 nt, Human
cuggggugucucgucugccauu

SEQ ID NO: 1031732 - RNA, 20 nt, Human
ucagccagcuaacaugggga

SEQ ID NO: 1031733 - RNA, 18 nt, Human
ucugucucuguccuugcu

SEQ ID NO: 1031734 - RNA, 22 nt, Human
auaagaaacauuauucuuucca

SEQ ID NO: 1031735 - RNA, 22 nt, Human
cagcugaguuuccaagucugcc

SEQ ID NO: 1031736 - RNA, 22 nt, Human
augauugaccaucugcugggcu

SEQ ID NO: 1031737 - RNA, 22 nt, Human
gccugagaaggauaggaagcga

SEQ ID NO: 1031738 - RNA, 22 nt, Human
gaaaguuucuucauuaagaugu

SEQ ID NO: 1031739 - RNA, 22 nt, Human
gcagggcugcugaaacuuguuu

SEQ ID NO: 1031740 - RNA, 22 nt, Human
ucaaagucucugcuucuguaac

SEQ ID NO: 1031741 - RNA, 22 nt, Human
gucccagggagguucagggcuu

SEQ ID NO: 1031742 - RNA, 21 nt, Human
uggcucuggguaggagagugc

SEQ ID NO: 1031743 - RNA, 22 nt, Human
caggugggccgggguuuguucu

SEQ ID NO: 1031744 - RNA, 22 nt, Human
gagcucccuggagguucagaua

SEQ ID NO: 1031745 - RNA, 22 nt, Human
ggaaaguggugguggaaagagg

SEQ ID NO: 1031746 - RNA, 22 nt, Human
ucacaugcccuguauuuaccag

SEQ ID NO: 1031747 - RNA, 22 nt, Human
uguacaugugucuguauaucuu

SEQ ID NO: 1031748 - RNA, 22 nt, Human
gcaggaguuaggcgucguggau

SEQ ID NO: 1031749 - RNA, 22 nt, Human
accugccucagugcagcuggau

SEQ ID NO: 1031750 - RNA, 22 nt, Human
gaggaccacagaugagccugca

SEQ ID NO: 1031751 - RNA, 18 nt, Human
gcaggagauggguggggu

SEQ ID NO: 1031752 - RNA, 22 nt, Human
caguagcacucugucagugaag

SEQ ID NO: 1031753 - RNA, 22 nt, Human
aaagcugcugccaaucaggcuu

SEQ ID NO: 1031754 - RNA, 22 nt, Human
uagacacaagagaaggguauaa

SEQ ID NO: 1031755 - RNA, 22 nt, Human
gcugugcagguccccacugccu

SEQ ID NO: 1031756 - RNA, 22 nt, Human
ucccuggaacagagagacaacg

SEQ ID NO: 1031757 - RNA, 22 nt, Human
ggcugccuccucgagacaggau

SEQ ID NO: 1031758 - RNA, 22 nt, Human
augagacuaccuguaauguggc

SEQ ID NO: 1031759 - RNA, 22 nt, Human
aaugagcugcugcuguuccacc

SEQ ID NO: 1031760 - RNA, 22 nt, Human
acuuuauuuccuauugcaucca

SEQ ID NO: 1031761 - RNA, 22 nt, Human
gagaggccaccugacgagcagu

SEQ ID NO: 1031762 - RNA, 22 nt, Human
uuccauaaucaccuuauucuuu

SEQ ID NO: 1031763 - RNA, 22 nt, Human
caggccuggcugcagcucgccu

SEQ ID NO: 1031764 - RNA, 21 nt, Human
cgggcuggccgggcccucacc

SEQ ID NO: 1031765 - RNA, 22 nt, Human
aaggcacucagccuugggacag

SEQ ID NO: 1031766 - RNA, 22 nt, Human
uuuaguaaguucacugcaaagc

SEQ ID NO: 1031767 - RNA, 18 nt, Human
uguacaguuaugagcauu

SEQ ID NO: 1031768 - RNA, 19 nt, Human
acuuucuccaggaccuguu

SEQ ID NO: 1031769 - RNA, 22 nt, Human
gugcucuguguauuaggauguc

SEQ ID NO: 1031770 - RNA, 22 nt, Human
uuucaaauaccauaaaccuaau

SEQ ID NO: 1031771 - RNA, 22 nt, Human
uaagaauuguguugaauagagu

SEQ ID NO: 1031772 - RNA, 22 nt, Human
ggugccagccuagugcaguggu

SEQ ID NO: 1031773 - RNA, 22 nt, Human
gggcuggcaggaccugggcuga

SEQ ID NO: 1031774 - RNA, 22 nt, Human
gcucuccacugaccacggggca

SEQ ID NO: 1031775 - RNA, 22 nt, Human
acaaagugaauugcaucgaguu

SEQ ID NO: 1031776 - RNA, 22 nt, Human
ggcuucaccaggugcaugcaug

SEQ ID NO: 1031777 - RNA, 18 nt, Human
uuucacaaccuccagagg

SEQ ID NO: 1031778 - RNA, 22 nt, Human
ucugccuuggcaaccacagcuu

SEQ ID NO: 1031779 - RNA, 23 nt, Human
cagggccaggcagcagcugucac

SEQ ID NO: 1031780 - RNA, 19 nt, Human
augauggucccauucaccu

SEQ ID NO: 1031781 - RNA, 22 nt, Human
gcacccagccagcaucucagag

SEQ ID NO: 1031782 - RNA, 23 nt, Human
agccucuuuucuccugcccugca

SEQ ID NO: 1031783 - RNA, 22 nt, Human
acaugucaauuuaguacucuua

SEQ ID NO: 1031784 - RNA, 22 nt, Human
cagggccuucguaaguguccgg

SEQ ID NO: 1031785 - RNA, 22 nt, Human
gccuggaggggccaggguggua

SEQ ID NO: 1031786 - RNA, 22 nt, Human
ugcagaaguauuccaggcccca

SEQ ID NO: 1031787 - RNA, 22 nt, Human
gcuccaggagagggaagcagau

SEQ ID NO: 1031788 - RNA, 22 nt, Human
ugcaucuguucagagcugucga

SEQ ID NO: 1031789 - RNA, 22 nt, Human
agccuggaauuaaggaaaugca

SEQ ID NO: 1031790 - RNA, 22 nt, Human
uagccgcuuaauuauuugguga

SEQ ID NO: 1031791 - RNA, 22 nt, Human
ugucaccaguuccaggaaauaa

SEQ ID NO: 1031792 - RNA, 22 nt, Human
auguaguguagagauuagucuc

SEQ ID NO: 1031793 - RNA, 22 nt, Human
gcagcagagcuuuguccuggcu

SEQ ID NO: 1031794 - RNA, 22 nt, Human
gugcauguuaaugguguacaaa

SEQ ID NO: 1031795 - RNA, 22 nt, Human
augggaggcaggcucagaaccg

SEQ ID NO: 1031796 - RNA, 22 nt, Human
ccagggcauccucacaucgcag

SEQ ID NO: 1031797 - RNA, 22 nt, Human
ucucaggaucuaauacauggua

SEQ ID NO: 1031798 - RNA, 22 nt, Human
uggcagggucuugcuguguugc

SEQ ID NO: 1031799 - RNA, 22 nt, Human
gugggaugguagguagguaaua

SEQ ID NO: 1031800 - RNA, 22 nt, Human
aaaugcuguguuuuaacauaga

SEQ ID NO: 1031801 - RNA, 18 nt, Human
acaaaggucugcaagacc

SEQ ID NO: 1031802 - RNA, 22 nt, Human
gagguggguguaucacagguca

SEQ ID NO: 1031803 - RNA, 22 nt, Human
cagagcuggagcuugaauggag

SEQ ID NO: 1031804 - RNA, 22 nt, Human
ggggauggaauguaguagugau

SEQ ID NO: 1031805 - RNA, 22 nt, Human
uccagucaagcuugagaauuuc

SEQ ID NO: 1031806 - RNA, 22 nt, Human
uccugccuuagagcaaggaaaa

SEQ ID NO: 1031807 - RNA, 22 nt, Human
guaggaagcucugaggcuaguu

SEQ ID NO: 1031808 - RNA, 22 nt, Human
ugaggaugacgauggcaauggc

SEQ ID NO: 1031809 - RNA, 22 nt, Human
ccagccuggagggcaguggugg

SEQ ID NO: 1031810 - RNA, 22 nt, Human
ggcuucucgugccgaagcaaga

SEQ ID NO: 1031811 - RNA, 22 nt, Human
uacuacauuaauaaaacauuca

SEQ ID NO: 1031812 - RNA, 22 nt, Human
ugcugccaaaugcgagcucugu

SEQ ID NO: 1031813 - RNA, 21 nt, Human
gccacguuucagucuucucag

SEQ ID NO: 1031814 - RNA, 22 nt, Human
ccucucauagucuguauccuuu

SEQ ID NO: 1031815 - RNA, 22 nt, Human
ugauuuccucuacuagcaauua

SEQ ID NO: 1031816 - RNA, 19 nt, Human
agucucaguguacagaggc

SEQ ID NO: 1031817 - RNA, 20 nt, Human
uaaggcuguuuuguauuccu

SEQ ID NO: 1031818 - RNA, 22 nt, Human
uggcuggcccugggagugcaga

SEQ ID NO: 1031819 - RNA, 22 nt, Human
gccugcagggugaugggcugcc

SEQ ID NO: 1031820 - RNA, 22 nt, Human
cuccucacuuuccagacugggc

SEQ ID NO: 1031821 - RNA, 22 nt, Human
uacaaagugugcccaugcugag

SEQ ID NO: 1031822 - RNA, 22 nt, Human
auguaacuucugugaaucugac

SEQ ID NO: 1031823 - RNA, 22 nt, Human
cagcacuggggggauucggagc

SEQ ID NO: 1031824 - RNA, 22 nt, Human
uccagucaggcugaauucaagg

SEQ ID NO: 1031825 - RNA, 22 nt, Human
acagagcuuaauucaggagcuu

SEQ ID NO: 1031826 - RNA, 22 nt, Human
ccuggagcaaaaaucuaaggag

SEQ ID NO: 1031827 - RNA, 22 nt, Human
auuugucuuugagugcccugcu

SEQ ID NO: 1031828 - RNA, 22 nt, Human
aggcugcuuucauggccgcccc

SEQ ID NO: 1031829 - RNA, 22 nt, Human
aaguuugacagaaguuucuaau

SEQ ID NO: 1031830 - RNA, 22 nt, Human
acacaggagauauguaauggcu

SEQ ID NO: 1031831 - RNA, 22 nt, Human
gcucacuggccugaagaggacg

SEQ ID NO: 1031832 - RNA, 22 nt, Human
cgcaccacugaauuccagccug

SEQ ID NO: 1031833 - RNA, 18 nt, Human
gcccagaggucugggccc

SEQ ID NO: 1031834 - RNA, 22 nt, Human
gaaggccucacucugcagcaua

SEQ ID NO: 1031835 - RNA, 22 nt, Human
ugcugccaggucuugcugucca

SEQ ID NO: 1031836 - RNA, 22 nt, Human
acccaggagcaggcugggcagu

SEQ ID NO: 1031837 - RNA, 22 nt, Human
acauuuaaauaccuauguuucu

SEQ ID NO: 1031838 - RNA, 22 nt, Human
cagcaauaacucaaagccauuu

SEQ ID NO: 1031839 - RNA, 16 nt, Human
ccacagggcaaggggc

SEQ ID NO: 1031840 - RNA, 22 nt, Human
aggccugucuggggcucagcca

SEQ ID NO: 1031841 - RNA, 18 nt, Human
cuucagugacagucuggc

SEQ ID NO: 1031842 - RNA, 22 nt, Human
uuucuguauuuaaaagaucugg

SEQ ID NO: 1031843 - RNA, 21 nt, Human
ugauccuuucccccauguugc

SEQ ID NO: 1031844 - RNA, 22 nt, Human
uccuggauucugcccugaaggc

SEQ ID NO: 1031845 - RNA, 21 nt, Human
ugcuucucuagaucaacuacu

SEQ ID NO: 1031846 - RNA, 22 nt, Human
cauuucugauuacagaauacua

SEQ ID NO: 1031847 - RNA, 22 nt, Human
acaaaaauuagcugggcauggu

SEQ ID NO: 1031848 - RNA, 22 nt, Human
uugauacaggcucuauuucauc

SEQ ID NO: 1031849 - RNA, 22 nt, Human
gcugcccaguucugcugcugcc

SEQ ID NO: 1031850 - RNA, 22 nt, Human
caggaggcaucauggagcggac

SEQ ID NO: 1031851 - RNA, 22 nt, Human
ggcccagcugugcuuccagccc

SEQ ID NO: 1031852 - RNA, 22 nt, Human
ucaaaugcucuuugcagagagg

SEQ ID NO: 1031853 - RNA, 22 nt, Human
cccuccagcucaaagcaaccgg

SEQ ID NO: 1031854 - RNA, 22 nt, Human
uauugaaauucuucauguccuc

SEQ ID NO: 1031855 - RNA, 22 nt, Human
caggguggcacucagcgcaucu

SEQ ID NO: 1031856 - RNA, 22 nt, Human
ggcugcaguuugucuuuugcuu

SEQ ID NO: 1031857 - RNA, 22 nt, Human
uggccugcagcucucagggaag

SEQ ID NO: 1031858 - RNA, 23 nt, Human
agggaaaguaguaauggccuuug

SEQ ID NO: 1031859 - RNA, 22 nt, Human
cuggggaggcagggcugccccu

SEQ ID NO: 1031860 - RNA, 22 nt, Human
aaggcagccucugccagccggg

SEQ ID NO: 1031861 - RNA, 22 nt, Human
ggcuggcauccagggaaaucca

SEQ ID NO: 1031862 - RNA, 22 nt, Human
ccagcgcuucccaucagggagg

SEQ ID NO: 1031863 - RNA, 22 nt, Human
agagcugggugaagugccauca

SEQ ID NO: 1031864 - RNA, 21 nt, Human
ugccagggauuuacagagccu

SEQ ID NO: 1031865 - RNA, 22 nt, Human
ccagcagagggucuuggccauu

SEQ ID NO: 1031866 - RNA, 22 nt, Human
agcagccaggaaucugcagagc

SEQ ID NO: 1031867 - RNA, 22 nt, Human
uggcucugggaaucuguugcuu

SEQ ID NO: 1031868 - RNA, 22 nt, Human
ucacagcaaaagugugcagagc

SEQ ID NO: 1031869 - RNA, 23 nt, Human
gggaccagcuagggcugugaccu

SEQ ID NO: 1031870 - RNA, 22 nt, Human
ucugagcuuuuauuaucaaccu

SEQ ID NO: 1031871 - RNA, 22 nt, Human
uuuucacacaaggugauaaguu

SEQ ID NO: 1031872 - RNA, 22 nt, Human
cugccucucaggucccugagau

SEQ ID NO: 1031873 - RNA, 22 nt, Human
uggccuggugcucaggcaguag

SEQ ID NO: 1031874 - RNA, 22 nt, Human
gcagagccaggagcccaggauc

SEQ ID NO: 1031875 - RNA, 22 nt, Human
ggagccugcgggagcucccauu

SEQ ID NO: 1031876 - RNA, 22 nt, Human
acuggcagcuguaggaugcaug

SEQ ID NO: 1031877 - RNA, 22 nt, Human
uucuuaaagaggcaaaacacag

SEQ ID NO: 1031878 - RNA, 22 nt, Human
uuggcuucuggcagucuggacg

SEQ ID NO: 1031879 - RNA, 22 nt, Human
gugcgccagcucaaggggaggc

SEQ ID NO: 1031880 - RNA, 22 nt, Human
ucugccugcaguguggcagggc

SEQ ID NO: 1031881 - RNA, 22 nt, Human
gcccagagagaugcuguagacc

SEQ ID NO: 1031882 - RNA, 22 nt, Human
ccuggagcaggagcugcagagg

SEQ ID NO: 1031883 - RNA, 22 nt, Human
aucacaggugguaggaaaagaa

SEQ ID NO: 1031884 - RNA, 22 nt, Human
cagugccucuuaagugucaccc

SEQ ID NO: 1031885 - RNA, 22 nt, Human
cugggagauugcuagagaugca

SEQ ID NO: 1031886 - RNA, 17 nt, Human
agcagcuggguugaucu

SEQ ID NO: 1031887 - RNA, 22 nt, Human
cagagggagcccuccaggagca

SEQ ID NO: 1031888 - RNA, 22 nt, Human
agggcuggcaagggauugaaau

SEQ ID NO: 1031889 - RNA, 22 nt, Human
cagaggugcauacaggucauua

SEQ ID NO: 1031890 - RNA, 22 nt, Human
ucucauguauugcccuggugug

SEQ ID NO: 1031891 - RNA, 22 nt, Human
gaggcaggcagauugcuugagg

SEQ ID NO: 1031892 - RNA, 22 nt, Human
agcagugggugacagagcugag

SEQ ID NO: 1031893 - RNA, 17 nt, Human
aucuggcugcuucuaga

SEQ ID NO: 1031894 - RNA, 22 nt, Human
guacaugucaaaaaaugcauaa

SEQ ID NO: 1031895 - RNA, 22 nt, Human
uauguacaaucagcaguucaua

SEQ ID NO: 1031896 - RNA, 22 nt, Human
gcaccacaucaaugaggggagc

SEQ ID NO: 1031897 - RNA, 20 nt, Human
auacaaagagauugauguau

SEQ ID NO: 1031898 - RNA, 22 nt, Human
accaugggucagccaccucagc

SEQ ID NO: 1031899 - RNA, 22 nt, Human
aggagaaggaagugcaucacua

SEQ ID NO: 1031900 - RNA, 22 nt, Human
aaacagaaggguagguaaacau

SEQ ID NO: 1031901 - RNA, 22 nt, Human
acagccuggacuggcucucugc

SEQ ID NO: 1031902 - RNA, 22 nt, Human
gccaggcauucuagaaguagug

SEQ ID NO: 1031903 - RNA, 22 nt, Human
uuucagaucauuuuuuaaguac

SEQ ID NO: 1031904 - RNA, 22 nt, Human
cagggccaagcugcagcaucug

SEQ ID NO: 1031905 - RNA, 22 nt, Human
ggaggccauaguuugggaguca

SEQ ID NO: 1031906 - RNA, 22 nt, Human
cagggccauaucuugugcacca

SEQ ID NO: 1031907 - RNA, 22 nt, Human
ugugucccuuggaaccucagcu

SEQ ID NO: 1031908 - RNA, 22 nt, Human
auaacagaguugggaagugaaa

SEQ ID NO: 1031909 - RNA, 22 nt, Human
gccuuuuuuguugcucugucac

SEQ ID NO: 1031910 - RNA, 22 nt, Human
gccugccuucggugcgcagcgg

SEQ ID NO: 1031911 - RNA, 22 nt, Human
gguggggccugcuccagcggcc

SEQ ID NO: 1031912 - RNA, 22 nt, Human
cucuggaauguuuacaugcccu

SEQ ID NO: 1031913 - RNA, 22 nt, Human
guggccugaugccagcccugug

SEQ ID NO: 1031914 - RNA, 22 nt, Human
aagcagcauaauugcuauuuua

SEQ ID NO: 1031915 - RNA, 22 nt, Human
ggcugggcaaacaagacucuuc

SEQ ID NO: 1031916 - RNA, 19 nt, Human
ucacaggcaucuccccaga

SEQ ID NO: 1031917 - RNA, 22 nt, Human
ccugcugggccugagcaaugag

SEQ ID NO: 1031918 - RNA, 22 nt, Human
gcagacaggcccaguggaggga

SEQ ID NO: 1031919 - RNA, 22 nt, Human
ucaaaguagggguaagccaggc

SEQ ID NO: 1031920 - RNA, 22 nt, Human
ccuuccuggcuguccgccugau

SEQ ID NO: 1031921 - RNA, 22 nt, Human
cugugccuaagaugcaugucuc

SEQ ID NO: 1031922 - RNA, 23 nt, Human
cuggccuccgacacuggccaaga

SEQ ID NO: 1031923 - RNA, 22 nt, Human
agaaacugaauuauuucugagg

SEQ ID NO: 1031924 - RNA, 22 nt, Human
ggcaggugcaccugagccaucu

SEQ ID NO: 1031925 - RNA, 22 nt, Human
ucagggcagaauccaaagaauu

SEQ ID NO: 1031926 - RNA, 22 nt, Human
ugcucuguugugcaugugggau

SEQ ID NO: 1031927 - RNA, 22 nt, Human
aagcugccugccacgcuagaua

SEQ ID NO: 1031928 - RNA, 22 nt, Human
ggccucucuccuuggcuugcag

SEQ ID NO: 1031929 - RNA, 22 nt, Human
gagcagugacuggagcaugaga

SEQ ID NO: 1031930 - RNA, 22 nt, Human
ugacaauacagagagagcaaaa

SEQ ID NO: 1031931 - RNA, 22 nt, Human
uaaaguuuggcagacaauaaca

SEQ ID NO: 1031932 - RNA, 22 nt, Human
ggaaggaggggcaaagcaguuc

SEQ ID NO: 1031933 - RNA, 22 nt, Human
uuagauaacaguagaauaucaa

SEQ ID NO: 1031934 - RNA, 23 nt, Human
ccagccucugggucuucauccag

SEQ ID NO: 1031935 - RNA, 22 nt, Human
cuggagagaaaugacaaagcua

SEQ ID NO: 1031936 - RNA, 22 nt, Human
uguauuuucuucuggaagcuua

SEQ ID NO: 1031937 - RNA, 22 nt, Human
uguggccaccagagcugcuauu

SEQ ID NO: 1031938 - RNA, 22 nt, Human
gguggcagucuuaagagaucuu

SEQ ID NO: 1031939 - RNA, 22 nt, Human
agacccagaaagcagcugcauu

SEQ ID NO: 1031940 - RNA, 23 nt, Human
ugagcccaggaggucaaggcugc

SEQ ID NO: 1031941 - RNA, 22 nt, Human
cuuuauguccaccagacugcaa

SEQ ID NO: 1031942 - RNA, 22 nt, Human
agccucuguagaaagcagugug

SEQ ID NO: 1031943 - RNA, 22 nt, Human
ugcugucccuaagucucuucaa

SEQ ID NO: 1031944 - RNA, 22 nt, Human
cacagcuuaugccacugauugg

SEQ ID NO: 1031945 - RNA, 22 nt, Human
gaugauuuuaugucuugucauu

SEQ ID NO: 1031946 - RNA, 22 nt, Human
gagcugagccuggguggaccgc

SEQ ID NO: 1031947 - RNA, 22 nt, Human
ucugcaggaaaaaagugccugg

SEQ ID NO: 1031948 - RNA, 22 nt, Human
aagagcuggaguuugcagcccu

SEQ ID NO: 1031949 - RNA, 22 nt, Human
agaaaaaucuuggcgcuugucu

SEQ ID NO: 1031950 - RNA, 22 nt, Human
agugggaggcggcugacgggcg

SEQ ID NO: 1031951 - RNA, 20 nt, Human
accucugcaucaauccuuug

SEQ ID NO: 1031952 - RNA, 22 nt, Human
augguacaaaauguauaaaguc

SEQ ID NO: 1031953 - RNA, 22 nt, Human
ccuggagcacagcccaguccca

SEQ ID NO: 1031954 - RNA, 22 nt, Human
ucucagagauuuuguuucccuu

SEQ ID NO: 1031955 - RNA, 22 nt, Human
ggcagcuggggcagugcccugu

SEQ ID NO: 1031956 - RNA, 22 nt, Human
uucagucagugacuaagcaguu

SEQ ID NO: 1031957 - RNA, 18 nt, Human
ggaaaaggagugucuagc

SEQ ID NO: 1031958 - RNA, 17 nt, Human
uagcugccccgaaugcu

SEQ ID NO: 1031959 - RNA, 22 nt, Human
cagggcacaguuauggaggugg

SEQ ID NO: 1031960 - RNA, 22 nt, Human
gaugguuuggaaugaaguagcu

SEQ ID NO: 1031961 - RNA, 22 nt, Human
ugcuggagaucauuaauguuca

SEQ ID NO: 1031962 - RNA, 22 nt, Human
agaggcuccuagccacuggcuu

SEQ ID NO: 1031963 - RNA, 22 nt, Human
gcugucugcaucucuagagcuu

SEQ ID NO: 1031964 - RNA, 22 nt, Human
aggcccugcccagagcuccucg

SEQ ID NO: 1031965 - RNA, 22 nt, Human
ucuuagaaugucaacugauguu

SEQ ID NO: 1031966 - RNA, 22 nt, Human
cccccagccagcagugcucagc

SEQ ID NO: 1031967 - RNA, 22 nt, Human
ucaaaugcacguagagaaaaua

SEQ ID NO: 1031968 - RNA, 18 nt, Human
agucucagcggaggagua

SEQ ID NO: 1031969 - RNA, 22 nt, Human
auccuugaacuuagacacuagg

SEQ ID NO: 1031970 - RNA, 22 nt, Human
uuuccucuccggggccuccagg

SEQ ID NO: 1031971 - RNA, 22 nt, Human
ugucccagauacuggacauaga

SEQ ID NO: 1031972 - RNA, 20 nt, Human
cuccagggaacagacuggag

SEQ ID NO: 1031973 - RNA, 22 nt, Human
gggagggaggugcugguucacg

SEQ ID NO: 1031974 - RNA, 22 nt, Human
gcaggaugggagcuucacucug

SEQ ID NO: 1031975 - RNA, 22 nt, Human
agggggcaggagagaccugcug

SEQ ID NO: 1031976 - RNA, 22 nt, Human
aaaugugucaguuucauucucu

SEQ ID NO: 1031977 - RNA, 20 nt, Human
cucaggauacugcaaaguug

SEQ ID NO: 1031978 - RNA, 22 nt, Human
ccagcugacgaugccuggucuc

SEQ ID NO: 1031979 - RNA, 22 nt, Human
auguuuuauauuuugcagcagu

SEQ ID NO: 1031980 - RNA, 22 nt, Human
aagcaggcauuccagagacaau

SEQ ID NO: 1031981 - RNA, 22 nt, Human
ucuuugcaugcauuuucccuua

SEQ ID NO: 1031982 - RNA, 22 nt, Human
agaccagcugccucccagggcc

SEQ ID NO: 1031983 - RNA, 22 nt, Human
guccucagagugggcagguccu

SEQ ID NO: 1031984 - RNA, 22 nt, Human
cugggagcuagcucugagcuga

SEQ ID NO: 1031985 - RNA, 19 nt, Human
ugucuuaauuaacucagag

SEQ ID NO: 1031986 - RNA, 18 nt, Human
agaaggagcuaugggcag

SEQ ID NO: 1031987 - RNA, 22 nt, Human
cuggccugaucucaugcugucc

SEQ ID NO: 1031988 - RNA, 22 nt, Human
aaggcagccgugugacugcaug

SEQ ID NO: 1031989 - RNA, 22 nt, Human
uccugagggcgauucagcaggu

SEQ ID NO: 1031990 - RNA, 22 nt, Human
cagcuuugauucuuucugccau

SEQ ID NO: 1031991 - RNA, 22 nt, Human
ggggaugguggcauuuguaaaa

SEQ ID NO: 1031992 - RNA, 22 nt, Human
gcugauuauuacaugucugugg

SEQ ID NO: 1031993 - RNA, 22 nt, Human
cugugcuuccaggauggcagcu

SEQ ID NO: 1031994 - RNA, 22 nt, Human
aaggcacuguacuaguuaguua

SEQ ID NO: 1031995 - RNA, 22 nt, Human
gcccugugcgacucuagagguu

SEQ ID NO: 1031996 - RNA, 21 nt, Human
ccugggccaaauucccuggac

SEQ ID NO: 1031997 - RNA, 22 nt, Human
cuggcagcucugagucccuucu

SEQ ID NO: 1031998 - RNA, 22 nt, Human
gagcagcuggacaggccucccu

SEQ ID NO: 1031999 - RNA, 22 nt, Human
gcuuccuaaaugcacagggcag

SEQ ID NO: 1032000 - RNA, 22 nt, Human
ugcagaaggccugacauugcac

SEQ ID NO: 1032001 - RNA, 22 nt, Human
uggagaagucaaagugaacagg

SEQ ID NO: 1032002 - RNA, 22 nt, Human
gcauccagagguagccacugug

SEQ ID NO: 1032003 - RNA, 23 nt, Human
uggauaaagcugugcugcauagg

SEQ ID NO: 1032004 - RNA, 23 nt, Human
agcaauaagaagggauacaugug

SEQ ID NO: 1032005 - RNA, 22 nt, Human
cugccaggacugacgucuucag

SEQ ID NO: 1032006 - RNA, 22 nt, Human
ccugggugucaugggcagcugg

SEQ ID NO: 1032007 - RNA, 22 nt, Human
aggugccagcucucaggcagga

SEQ ID NO: 1032008 - RNA, 22 nt, Human
gggauggcucaaaggagucagg

SEQ ID NO: 1032009 - RNA, 22 nt, Human
gagcuguccgccccugggccga

SEQ ID NO: 1032010 - RNA, 22 nt, Human
ggcugcagcagagggacucacg

SEQ ID NO: 1032011 - RNA, 22 nt, Human
ggagccaguuuagaccucaguu

SEQ ID NO: 1032012 - RNA, 22 nt, Human
auucucaaacaagugguuugau

SEQ ID NO: 1032013 - RNA, 22 nt, Human
ggguggcuccuaugggcauagc

SEQ ID NO: 1032014 - RNA, 22 nt, Human
ccagcuccaaguuugggcauca

SEQ ID NO: 1032015 - RNA, 22 nt, Human
caaaagauacuugcaucuaacu

SEQ ID NO: 1032016 - RNA, 22 nt, Human
aaaaugugaucuacaaaugcaa

SEQ ID NO: 1032017 - RNA, 22 nt, Human
ccagagucuaugaguccucauu

SEQ ID NO: 1032018 - RNA, 22 nt, Human
gaaugcacuuccaacaucuauu

SEQ ID NO: 1032019 - RNA, 22 nt, Human
augggaggaaggaggcccuuga

SEQ ID NO: 1032020 - RNA, 22 nt, Human
cccuccagagcuugaccugcug

SEQ ID NO: 1032021 - RNA, 22 nt, Human
ugggcagauguccucugaagug

SEQ ID NO: 1032022 - RNA, 21 nt, Human
gagacagcccagugccagggc

SEQ ID NO: 1032023 - RNA, 22 nt, Human
uccagagggcgauggcuggggg

SEQ ID NO: 1032024 - RNA, 22 nt, Human
ccucagaguaggucucagcugu

SEQ ID NO: 1032025 - RNA, 22 nt, Human
aagccagguguugugguaagag

SEQ ID NO: 1032026 - RNA, 21 nt, Human
ucagaguggaagacaguuuga

SEQ ID NO: 1032027 - RNA, 22 nt, Human
gccuggaguucagccaaguccc

SEQ ID NO: 1032028 - RNA, 22 nt, Human
ucaugacaucuguuuaucucaa

SEQ ID NO: 1032029 - RNA, 22 nt, Human
uucauucccuuauauuagcauu

SEQ ID NO: 1032030 - RNA, 22 nt, Human
uggcacuggcgcaggauggcgg

SEQ ID NO: 1032031 - RNA, 22 nt, Human
gagaggcuaugagguucugugu

SEQ ID NO: 1032032 - RNA, 22 nt, Human
augcucugggcaggagcccugg

SEQ ID NO: 1032033 - RNA, 22 nt, Human
agccuggcuguaaccucauggu

SEQ ID NO: 1032034 - RNA, 22 nt, Human
cugggaguguucuaggucacau

SEQ ID NO: 1032035 - RNA, 22 nt, Human
acuuuguauaagacaauaaaga

SEQ ID NO: 1032036 - RNA, 22 nt, Human
gagaggaguaggcugauggugc

SEQ ID NO: 1032037 - RNA, 22 nt, Human
uccagggaugccagccauguug

SEQ ID NO: 1032038 - RNA, 22 nt, Human
ucccagggacaccaagcuguuu

SEQ ID NO: 1032039 - RNA, 22 nt, Human
ccagggugggaggcugaaggcg

SEQ ID NO: 1032040 - RNA, 18 nt, Human
gcugucugaggucugagg

SEQ ID NO: 1032041 - RNA, 22 nt, Human
uaucuugagagacaacacagca

SEQ ID NO: 1032042 - RNA, 20 nt, Human
uggagccacagucagguucc

SEQ ID NO: 1032043 - RNA, 22 nt, Human
ucugagagccucuagccuaagu

SEQ ID NO: 1032044 - RNA, 22 nt, Human
gcccugugccagucacgcugug

SEQ ID NO: 1032045 - RNA, 22 nt, Human
uccaguggugguuugaagggca

SEQ ID NO: 1032046 - RNA, 22 nt, Human
uuguuuucacagcuuugcccgg

SEQ ID NO: 1032047 - RNA, 22 nt, Human
ccugggcaacauagugagaccu

SEQ ID NO: 1032048 - RNA, 22 nt, Human
cugggaggcacuauucaggagg

SEQ ID NO: 1032049 - RNA, 22 nt, Human
cuccugaguaguagcauuguca

SEQ ID NO: 1032050 - RNA, 22 nt, Human
ucagagugugagacauauugga

SEQ ID NO: 1032051 - RNA, 22 nt, Human
aagggcaggcagagaucauaua

SEQ ID NO: 1032052 - RNA, 22 nt, Human
caguggcaugguugacugcagu

SEQ ID NO: 1032053 - RNA, 22 nt, Human
ugaaggagcucaaugaugaugc

SEQ ID NO: 1032054 - RNA, 20 nt, Human
ccucaagcagacugacagcu

SEQ ID NO: 1032055 - RNA, 22 nt, Human
agccucugauggcucccaagga

SEQ ID NO: 1032056 - RNA, 22 nt, Human
gaaggcugaugacagauucugc

SEQ ID NO: 1032057 - RNA, 22 nt, Human
gagcugggacauggguccucuc

SEQ ID NO: 1032058 - RNA, 22 nt, Human
gcagaugguggggcaggaaaau

SEQ ID NO: 1032059 - RNA, 22 nt, Human
gacauucacagguaaacauucc

SEQ ID NO: 1032060 - RNA, 22 nt, Human
aguugcagacgcagagauguug

SEQ ID NO: 1032061 - RNA, 22 nt, Human
uccucacaagcaagcacaggua

SEQ ID NO: 1032062 - RNA, 22 nt, Human
ugaaauguuugaagaccacuga

SEQ ID NO: 1032063 - RNA, 19 nt, Human
uuggaaggagccagagugg

SEQ ID NO: 1032064 - RNA, 22 nt, Human
ugcaguggaagagguggagauc

SEQ ID NO: 1032065 - RNA, 18 nt, Human
gcaggugccacugcuguu

SEQ ID NO: 1032066 - RNA, 22 nt, Human
gcuggccauagaagccaaagag

SEQ ID NO: 1032067 - RNA, 22 nt, Human
agagccugucugccuuucuacc

SEQ ID NO: 1032068 - RNA, 22 nt, Human
gcaaagucucaagacccaagug

SEQ ID NO: 1032069 - RNA, 22 nt, Human
ucccagagaagagcuggaugga

SEQ ID NO: 1032070 - RNA, 22 nt, Human
auccugggcagugugucacucu

SEQ ID NO: 1032071 - RNA, 22 nt, Human
uaaaugcaguuaguacuugcca

SEQ ID NO: 1032072 - RNA, 22 nt, Human
uuucagaugcaauuaauuuuca

SEQ ID NO: 1032073 - RNA, 22 nt, Human
acagcagcuaaaggugucuccu

SEQ ID NO: 1032074 - RNA, 22 nt, Human
gaggcagcuuggggcugugggu

SEQ ID NO: 1032075 - RNA, 22 nt, Human
ucaguuuucucauuuaugagau

SEQ ID NO: 1032076 - RNA, 22 nt, Human
uauacuuuccugcaacuuugau

SEQ ID NO: 1032077 - RNA, 22 nt, Human
gcaggcagaucaccugucagga

SEQ ID NO: 1032078 - RNA, 22 nt, Human
ccaggguggcguagaugcuggg

SEQ ID NO: 1032079 - RNA, 22 nt, Human
ugaaaucuccucuuuauauauc

SEQ ID NO: 1032080 - RNA, 21 nt, Human
uccugccuuaguccagagcag

SEQ ID NO: 1032081 - RNA, 22 nt, Human
ucagggcucaccagccucugcc

SEQ ID NO: 1032082 - RNA, 22 nt, Human
aggaggccccuccuggguugcu

SEQ ID NO: 1032083 - RNA, 22 nt, Human
gcuugcuggugccugcaggcuc

SEQ ID NO: 1032084 - RNA, 20 nt, Human
gagccugggaagucuaaggu

SEQ ID NO: 1032085 - RNA, 22 nt, Human
agccccuuccaguucucagauc

SEQ ID NO: 1032086 - RNA, 22 nt, Human
aggguccaucaaggacugcaca

SEQ ID NO: 1032087 - RNA, 22 nt, Human
guucacauccuugugaggauuu

SEQ ID NO: 1032088 - RNA, 22 nt, Human
ggagcugggacccugucaucug

SEQ ID NO: 1032089 - RNA, 22 nt, Human
cugaggaguuuggguuguucaa

SEQ ID NO: 1032090 - RNA, 22 nt, Human
agggccuggugaccuggguccu

SEQ ID NO: 1032091 - RNA, 22 nt, Human
augcaguaaauguuaagaaaaa

SEQ ID NO: 1032092 - RNA, 22 nt, Human
cccuggagcaucucugcugucu

SEQ ID NO: 1032093 - RNA, 22 nt, Human
gucucccaucguuugugaggaa

SEQ ID NO: 1032094 - RNA, 22 nt, Human
ccaggugggaggaaagcagaga

SEQ ID NO: 1032095 - RNA, 22 nt, Human
aaccaggacaauuuugaaagua

SEQ ID NO: 1032096 - RNA, 22 nt, Human
uuuauuauagugguggggacug

SEQ ID NO: 1032097 - RNA, 22 nt, Human
uggcccugaggacccagugugg

SEQ ID NO: 1032098 - RNA, 22 nt, Human
uuugaaaauuuaagugcuacac

SEQ ID NO: 1032099 - RNA, 22 nt, Human
agugucugccaacugcaugguc

SEQ ID NO: 1032100 - RNA, 22 nt, Human
ucucagagggaaaggccaauuu

SEQ ID NO: 1032101 - RNA, 22 nt, Human
auguacaguuucuagacucaaa

SEQ ID NO: 1032102 - RNA, 22 nt, Human
cugccucuauucacugaggcag

SEQ ID NO: 1032103 - RNA, 22 nt, Human
agagccagcauuugacacuggc

SEQ ID NO: 1032104 - RNA, 22 nt, Human
ggccucacccaucggugccuuu

SEQ ID NO: 1032105 - RNA, 22 nt, Human
cuucuuaaugacagauuaaaau

SEQ ID NO: 1032106 - RNA, 22 nt, Human
ugggaggagcccucugggaagg

SEQ ID NO: 1032107 - RNA, 22 nt, Human
uaaaugcaagugcuccugggag

SEQ ID NO: 1032108 - RNA, 22 nt, Human
cagcuuggaggaggaucuaaga

SEQ ID NO: 1032109 - RNA, 22 nt, Human
accugaggccuccccagcagac

SEQ ID NO: 1032110 - RNA, 22 nt, Human
gcugcccagcaggccccagggg

SEQ ID NO: 1032111 - RNA, 22 nt, Human
cuauugaaaguguacaauucaa

SEQ ID NO: 1032112 - RNA, 22 nt, Human
agggagagguugaaaccucagu

SEQ ID NO: 1032113 - RNA, 22 nt, Human
cccaagcagggugcagaggcau

SEQ ID NO: 1032114 - RNA, 21 nt, Human
gcagccacugccuucaacaau

SEQ ID NO: 1032115 - RNA, 22 nt, Human
ccuggcagcuguuuggcuuggc

SEQ ID NO: 1032116 - RNA, 22 nt, Human
agcaauauuucagcuagcaggu

SEQ ID NO: 1032117 - RNA, 22 nt, Human
agcagcucuuaacaaagcaugg

SEQ ID NO: 1032118 - RNA, 22 nt, Human
uuguaacagguacuaaauaacu

SEQ ID NO: 1032119 - RNA, 22 nt, Human
cugaagcaaaggaucgagcuaa

SEQ ID NO: 1032120 - RNA, 22 nt, Human
gcugagagcaaagcaugucuag

SEQ ID NO: 1032121 - RNA, 22 nt, Human
ggaggccacgguuuagcaccga

SEQ ID NO: 1032122 - RNA, 22 nt, Human
cuggagccagccagggcccucu

SEQ ID NO: 1032123 - RNA, 22 nt, Human
uggcugcuagccagagcuucag

SEQ ID NO: 1032124 - RNA, 22 nt, Human
caggaaauaucuccuggcagag

SEQ ID NO: 1032125 - RNA, 22 nt, Human
caggccuggggcuggcuuccag

SEQ ID NO: 1032126 - RNA, 22 nt, Human
ccugcagacacuuguccagcaa

SEQ ID NO: 1032127 - RNA, 22 nt, Human
agcagccagagucugaacauua

SEQ ID NO: 1032128 - RNA, 21 nt, Human
aaggaaaagcuuggucucuga

SEQ ID NO: 1032129 - RNA, 21 nt, Human
cccuguguuccacagcagaca

SEQ ID NO: 1032130 - RNA, 22 nt, Human
cucuuucaguucugauagucuc

SEQ ID NO: 1032131 - RNA, 22 nt, Human
acaggagugaaucuggcacuua

SEQ ID NO: 1032132 - RNA, 17 nt, Human
ugguggcuggagucagg

SEQ ID NO: 1032133 - RNA, 22 nt, Human
ccucugagagaaggccuucagc

SEQ ID NO: 1032134 - RNA, 22 nt, Human
ccuaagaauuaaugaauacacc

SEQ ID NO: 1032135 - RNA, 22 nt, Human
gggcagcagagcccugccgagu

SEQ ID NO: 1032136 - RNA, 22 nt, Human
cagcuuggcuuccgcuuuacug

SEQ ID NO: 1032137 - RNA, 22 nt, Human
uucauucaucucuaaaaugccu

SEQ ID NO: 1032138 - RNA, 22 nt, Human
gagccuggagcuggaacgaagc

SEQ ID NO: 1032139 - RNA, 22 nt, Human
gcugagcugaggcagggcuggg

SEQ ID NO: 1032140 - RNA, 20 nt, Human
cagcucugggaaagaggcca

SEQ ID NO: 1032141 - RNA, 22 nt, Human
aagcugcccuguguuagaguuc

SEQ ID NO: 1032142 - RNA, 22 nt, Human
ugcagaggaccauuguccugga

SEQ ID NO: 1032143 - RNA, 22 nt, Human
ugcuaucucuauauccauuuau

SEQ ID NO: 1032144 - RNA, 22 nt, Human
agccaggcugcaguuggcuggc

SEQ ID NO: 1032145 - RNA, 22 nt, Human
aagaacagauucagccugaacu

SEQ ID NO: 1032146 - RNA, 22 nt, Human
uccaggagagguguggggacug

SEQ ID NO: 1032147 - RNA, 22 nt, Human
ugccaggcauauggccucuuug

SEQ ID NO: 1032148 - RNA, 18 nt, Human
gggaagaggaucuggccc

SEQ ID NO: 1032149 - RNA, 22 nt, Human
ugccuggguguaaagggccaac

SEQ ID NO: 1032150 - RNA, 20 nt, Human
gagauggcuaagugcugaac

SEQ ID NO: 1032151 - RNA, 22 nt, Human
agagugauucuaguuagggaau

SEQ ID NO: 1032152 - RNA, 22 nt, Human
gcuggugcauuagcugcaguuc

SEQ ID NO: 1032153 - RNA, 22 nt, Human
ugaggccagucucaucacaggc

SEQ ID NO: 1032154 - RNA, 22 nt, Human
uacaguaacauguuguacaagc

SEQ ID NO: 1032155 - RNA, 22 nt, Human
gggcagugguuacacagcugag

SEQ ID NO: 1032156 - RNA, 22 nt, Human
ccugacgaaaggcgugcuggag

SEQ ID NO: 1032157 - RNA, 20 nt, Human
ccaggcacugucccaugcag

SEQ ID NO: 1032158 - RNA, 22 nt, Human
uggguagagacacagucugggg

SEQ ID NO: 1032159 - RNA, 22 nt, Human
cuuggcagagggcugggcucag

SEQ ID NO: 1032160 - RNA, 19 nt, Human
gcuggcagauguggccgug

SEQ ID NO: 1032161 - RNA, 23 nt, Human
ugcugguguuuuugggaccaggg

SEQ ID NO: 1032162 - RNA, 22 nt, Human
auuugucuagugguauucacgu

SEQ ID NO: 1032163 - RNA, 22 nt, Human
gccagcagcccagaaggacuuu

SEQ ID NO: 1032164 - RNA, 22 nt, Human
guuuuuccuugcugaggacccg

SEQ ID NO: 1032165 - RNA, 22 nt, Human
ccagcugggauuaagggaaaau

SEQ ID NO: 1032166 - RNA, 22 nt, Human
uccagggguaccggccaggcag

SEQ ID NO: 1032167 - RNA, 23 nt, Human
ucuuuccucagcacacaccaaga

SEQ ID NO: 1032168 - RNA, 22 nt, Human
aauggacaggagagcauaguca

SEQ ID NO: 1032169 - RNA, 22 nt, Human
ugcuggccgugagcucucggga

SEQ ID NO: 1032170 - RNA, 22 nt, Human
uggcucuguugagguauggauu

SEQ ID NO: 1032171 - RNA, 22 nt, Human
cugaggcugcccagggccaggu

SEQ ID NO: 1032172 - RNA, 22 nt, Human
gaagcucucaaacucuccccuu

SEQ ID NO: 1032173 - RNA, 22 nt, Human
cugaagcacagcauauaaauaa

SEQ ID NO: 1032174 - RNA, 22 nt, Human
uugcauaaagauuuuauugcau

SEQ ID NO: 1032175 - RNA, 22 nt, Human
cugagcugggaguggauagugg

SEQ ID NO: 1032176 - RNA, 22 nt, Human
ugugccaggcacuugcccaggc

SEQ ID NO: 1032177 - RNA, 22 nt, Human
uguguuuuacaaauucucuuaa

SEQ ID NO: 1032178 - RNA, 22 nt, Human
ccucagggccaucucugucccu

SEQ ID NO: 1032179 - RNA, 19 nt, Human
acagaaauguaagugagac

SEQ ID NO: 1032180 - RNA, 22 nt, Human
acccaggagguggaggcugcag

SEQ ID NO: 1032181 - RNA, 22 nt, Human
uguguuccugccuggcucuggu

SEQ ID NO: 1032182 - RNA, 22 nt, Human
ggcacugagcugccuuggggca

SEQ ID NO: 1032183 - RNA, 19 nt, Human
acuuugcaugugugucuaa

SEQ ID NO: 1032184 - RNA, 20 nt, Human
cccagccccuaccuguugcc

SEQ ID NO: 1032185 - RNA, 22 nt, Human
aguuucauauuaccaugucacc

SEQ ID NO: 1032186 - RNA, 20 nt, Human
cccuggccuguuucaugccc

SEQ ID NO: 1032187 - RNA, 22 nt, Human
ucacguuuuacugagugagaua

SEQ ID NO: 1032188 - RNA, 22 nt, Human
ggccugggcccacugucaagag

SEQ ID NO: 1032189 - RNA, 22 nt, Human
uagagcuguaucaaagagccuu

SEQ ID NO: 1032190 - RNA, 18 nt, Human
agagcagcggcaucacac

SEQ ID NO: 1032191 - RNA, 22 nt, Human
guacuuccagccaagugagaca

SEQ ID NO: 1032192 - RNA, 22 nt, Human
ggccucugccucaucugggcac

SEQ ID NO: 1032193 - RNA, 22 nt, Human
cccuggagugccggaaucaaga

SEQ ID NO: 1032194 - RNA, 22 nt, Human
gaggagggagcuggaagcucuu

SEQ ID NO: 1032195 - RNA, 22 nt, Human
ucugggcccuaaaccagcucua

SEQ ID NO: 1032196 - RNA, 22 nt, Human
cuggugguucaggagaauggcu

SEQ ID NO: 1032197 - RNA, 21 nt, Human
ggcuccugcuuugugaggggc

SEQ ID NO: 1032198 - RNA, 22 nt, Human
cuggcucaauuuguacugcugu

SEQ ID NO: 1032199 - RNA, 22 nt, Human
aagcugccugggaggaagggcu

SEQ ID NO: 1032200 - RNA, 22 nt, Human
gcacacaggcaguuuccagcca

SEQ ID NO: 1032201 - RNA, 21 nt, Human
aagagcuggaucaaggauaag

SEQ ID NO: 1032202 - RNA, 22 nt, Human
agaaaguucacugguauauuuu

SEQ ID NO: 1032203 - RNA, 22 nt, Human
aggggcugacuggaaagugcca

SEQ ID NO: 1032204 - RNA, 22 nt, Human
ugugccagccucuggcuguguc

SEQ ID NO: 1032205 - RNA, 22 nt, Human
uguuccaugucuuuguaggacu

SEQ ID NO: 1032206 - RNA, 22 nt, Human
gaggaguggaguugcuggguug

SEQ ID NO: 1032207 - RNA, 22 nt, Human
ccuggcucucugcagauccugg

SEQ ID NO: 1032208 - RNA, 21 nt, Human
uccagggaacuucucaggaau

SEQ ID NO: 1032209 - RNA, 22 nt, Human
gaugcacuuucuuuucaacagu

SEQ ID NO: 1032210 - RNA, 22 nt, Human
caggaaagguagucacaaugua

SEQ ID NO: 1032211 - RNA, 18 nt, Human
gggcaucauucacaaagu

SEQ ID NO: 1032212 - RNA, 22 nt, Human
cuggaaggucuguccccacugc

SEQ ID NO: 1032213 - RNA, 22 nt, Human
cuaaaugcccuacaaugacugg

SEQ ID NO: 1032214 - RNA, 22 nt, Human
uagcauuuauggucaugugucc

SEQ ID NO: 1032215 - RNA, 22 nt, Human
ggaagggccucgggcgugggac

SEQ ID NO: 1032216 - RNA, 22 nt, Human
ggccugcuccgggggcugagcu

SEQ ID NO: 1032217 - RNA, 22 nt, Human
cucagaguccccacaucugggu

SEQ ID NO: 1032218 - RNA, 19 nt, Human
uggcaggcccaggauggac

SEQ ID NO: 1032219 - RNA, 22 nt, Human
auucaguucuaaggucagugcc

SEQ ID NO: 1032220 - RNA, 22 nt, Human
ucagaguguggugagaugugca

SEQ ID NO: 1032221 - RNA, 22 nt, Human
cacguuuuaugacagaagaagc

SEQ ID NO: 1032222 - RNA, 22 nt, Human
ugcagagguguugcugagauaa

SEQ ID NO: 1032223 - RNA, 22 nt, Human
ggcagcucugcuccacaugagu

SEQ ID NO: 1032224 - RNA, 23 nt, Human
uggcucuguggaucccucaggag

SEQ ID NO: 1032225 - RNA, 22 nt, Human
caggcagcaggagcccugcucg

SEQ ID NO: 1032226 - RNA, 19 nt, Human
ugagugggccccugcagac

SEQ ID NO: 1032227 - RNA, 22 nt, Human
ucagccucucugaguccagacc

SEQ ID NO: 1032228 - RNA, 22 nt, Human
acugucuccucaucaugccugg

SEQ ID NO: 1032229 - RNA, 22 nt, Human
uacaaaguauauuucuagcugu

SEQ ID NO: 1032230 - RNA, 22 nt, Human
caggcuggagugcaguugugca

SEQ ID NO: 1032231 - RNA, 22 nt, Human
cagugucuccagaugcuccaau

SEQ ID NO: 1032232 - RNA, 22 nt, Human
ccccagccagcaggaccucuga

SEQ ID NO: 1032233 - RNA, 22 nt, Human
ucccagagccaagcuauggaug

SEQ ID NO: 1032234 - RNA, 22 nt, Human
aggggcugcuggguccgccccu

SEQ ID NO: 1032235 - RNA, 19 nt, Human
agaggccucagcagcuggc

SEQ ID NO: 1032236 - RNA, 22 nt, Human
uggcucugaccagguagaggag

SEQ ID NO: 1032237 - RNA, 18 nt, Human
aggccugggaagcugagg

SEQ ID NO: 1032238 - RNA, 22 nt, Human
uggcagggugccaguugcgagu

SEQ ID NO: 1032239 - RNA, 22 nt, Human
ggacccugggcuugcuccuggg

SEQ ID NO: 1032240 - RNA, 22 nt, Human
guggccuggcgagcuggcgcgg

SEQ ID NO: 1032241 - RNA, 22 nt, Human
aaggccaugcacauccuaggca

SEQ ID NO: 1032242 - RNA, 23 nt, Human
agccacuucuaucuugcuccugg

SEQ ID NO: 1032243 - RNA, 21 nt, Human
cuguuucuugugaagugacac

SEQ ID NO: 1032244 - RNA, 22 nt, Human
caggcacugugcuagauccuug

SEQ ID NO: 1032245 - RNA, 22 nt, Human
ggccuugggauguggcugcagc

SEQ ID NO: 1032246 - RNA, 22 nt, Human
ggugaggcuaagugacacaggg

SEQ ID NO: 1032247 - RNA, 22 nt, Human
aagcccagcugaaagcauuuuu

SEQ ID NO: 1032248 - RNA, 22 nt, Human
ccuggguggcagagguugcagu

SEQ ID NO: 1032249 - RNA, 22 nt, Human
gggcacuggaaggcucucaggc

SEQ ID NO: 1032250 - RNA, 22 nt, Human
aacagaauugcugcugccaaug

SEQ ID NO: 1032251 - RNA, 22 nt, Human
auaaggcacacauagauagggu

SEQ ID NO: 1032252 - RNA, 23 nt, Human
agaggcaggaguggcuugcccgg

SEQ ID NO: 1032253 - RNA, 18 nt, Human
aaaugcuaggcuacauga

SEQ ID NO: 1032254 - RNA, 22 nt, Human
cugggagucaccaggagcaagg

SEQ ID NO: 1032255 - RNA, 22 nt, Human
uuauuauugugaccugagaaug

SEQ ID NO: 1032256 - RNA, 22 nt, Human
cccaaggccucuccuuggcuug

SEQ ID NO: 1032257 - RNA, 22 nt, Human
aaaaucugguaauuugaaugug

SEQ ID NO: 1032258 - RNA, 22 nt, Human
ccugccuguacuagagacccag

SEQ ID NO: 1032259 - RNA, 22 nt, Human
gccagggaacccaagggccuca

SEQ ID NO: 1032260 - RNA, 22 nt, Human
gagcaacaguuuaugguuuuuc

SEQ ID NO: 1032261 - RNA, 22 nt, Human
cugucuguuucugauucaaccu

SEQ ID NO: 1032262 - RNA, 22 nt, Human
aggccagagaggggaccagccu

SEQ ID NO: 1032263 - RNA, 22 nt, Human
agcaagcuaccuagauagucua

SEQ ID NO: 1032264 - RNA, 22 nt, Human
agauuuccugcacugccuuuga

SEQ ID NO: 1032265 - RNA, 22 nt, Human
uaaguucagaguucucauuugu

SEQ ID NO: 1032266 - RNA, 22 nt, Human
ugcacacaaaugugaacgugcc

SEQ ID NO: 1032267 - RNA, 22 nt, Human
gagccaggucgggccgcggcga

SEQ ID NO: 1032268 - RNA, 22 nt, Human
caggcccugggcaggaucagcc

SEQ ID NO: 1032269 - RNA, 22 nt, Human
ggcucugcgcgguaaagugacu

SEQ ID NO: 1032270 - RNA, 22 nt, Human
cucagcuggcaauucuggcucc

SEQ ID NO: 1032271 - RNA, 22 nt, Human
gcuccugggcucuaccuugcua

SEQ ID NO: 1032272 - RNA, 22 nt, Human
gccaggugggagacagacagca

SEQ ID NO: 1032273 - RNA, 22 nt, Human
uguuaaauguuccuuuacugga

SEQ ID NO: 1032274 - RNA, 22 nt, Human
aagagcuggagcugcuacagga

SEQ ID NO: 1032275 - RNA, 22 nt, Human
uagugcacacgcauguagcagu

SEQ ID NO: 1032276 - RNA, 22 nt, Human
ccuccaaguuugacucaggaca

SEQ ID NO: 1032277 - RNA, 22 nt, Human
cccagcauggagugaggacuca

SEQ ID NO: 1032278 - RNA, 20 nt, Human
uauuucugggcaaccauuua

SEQ ID NO: 1032279 - RNA, 22 nt, Human
acagggcccuugccagcacaag

SEQ ID NO: 1032280 - RNA, 22 nt, Human
acuuugaaggggaacauuuuaa

SEQ ID NO: 1032281 - RNA, 22 nt, Human
ugguccagaugccuuggcuuua

SEQ ID NO: 1032282 - RNA, 22 nt, Human
ugugugcagccucugucuuugg

SEQ ID NO: 1032283 - RNA, 22 nt, Human
gugcaugugucuuuauaguaga

SEQ ID NO: 1032284 - RNA, 22 nt, Human
aagugacaaaaggguauccaaa

SEQ ID NO: 1032285 - RNA, 22 nt, Human
agggcagagaucugagugggca

SEQ ID NO: 1032286 - RNA, 22 nt, Human
agggccagggaagcuguauuuu

SEQ ID NO: 1032287 - RNA, 22 nt, Human
gggcagagguucaacuucaaca

SEQ ID NO: 1032288 - RNA, 22 nt, Human
gagcugccggcccacaguacua

SEQ ID NO: 1032289 - RNA, 19 nt, Human
ccauggcaaugaucugaug

SEQ ID NO: 1032290 - RNA, 22 nt, Human
cagggcagggccacacccccug

SEQ ID NO: 1032291 - RNA, 22 nt, Human
ucuggagccacaaaccucagcu

SEQ ID NO: 1032292 - RNA, 22 nt, Human
auaacagauacucucugugagg

SEQ ID NO: 1032293 - RNA, 22 nt, Human
ccugcagguaaggcuaacugcc

SEQ ID NO: 1032294 - RNA, 22 nt, Human
cucuggagggaggcugagcugg

SEQ ID NO: 1032295 - RNA, 22 nt, Human
ugaaaaggguagaucccuaagu

SEQ ID NO: 1032296 - RNA, 22 nt, Human
ggccugcucugcagccucuaca

SEQ ID NO: 1032297 - RNA, 20 nt, Human
ugaaaaggucaggagacaug

SEQ ID NO: 1032298 - RNA, 22 nt, Human
agcaggagcccuuaucaccagg

SEQ ID NO: 1032299 - RNA, 22 nt, Human
ugagcuuccucccugcauccau

SEQ ID NO: 1032300 - RNA, 22 nt, Human
uagcagggguagauagagugug

SEQ ID NO: 1032301 - RNA, 22 nt, Human
gcucugucuucagcacacagua

SEQ ID NO: 1032302 - RNA, 22 nt, Human
gcaguggcuaagcucgcaugca

SEQ ID NO: 1032303 - RNA, 22 nt, Human
cccagcuccuuggaugggcagg

SEQ ID NO: 1032304 - RNA, 22 nt, Human
augugacaauauuuggucuuau

SEQ ID NO: 1032305 - RNA, 22 nt, Human
cacucugcagcugaagggcugg

SEQ ID NO: 1032306 - RNA, 23 nt, Human
uggcagagacccagaaucuacau

SEQ ID NO: 1032307 - RNA, 19 nt, Human
ggucucagugcagcugcag

SEQ ID NO: 1032308 - RNA, 22 nt, Human
ggccuguguccuccuugcccug

SEQ ID NO: 1032309 - RNA, 22 nt, Human
ucuccugugcacccucccugug

SEQ ID NO: 1032310 - RNA, 22 nt, Human
ucucagaggcccgacguucucc

SEQ ID NO: 1032311 - RNA, 22 nt, Human
gccuggagcucaugugggcauu

SEQ ID NO: 1032312 - RNA, 22 nt, Human
uguaugcuuguguauaauauaa

SEQ ID NO: 1032313 - RNA, 22 nt, Human
uguaacaguaagccugugagcu

SEQ ID NO: 1032314 - RNA, 22 nt, Human
ggguggaggagaacaggcccca

SEQ ID NO: 1032315 - RNA, 22 nt, Human
gcagauggacuguaugaccuga

SEQ ID NO: 1032316 - RNA, 19 nt, Human
gggcuucugggaucaagag

SEQ ID NO: 1032317 - RNA, 22 nt, Human
cggcuggguucggcugcaggcc

SEQ ID NO: 1032318 - RNA, 20 nt, Human
aggaaaaggguggugguaga

SEQ ID NO: 1032319 - RNA, 22 nt, Human
aacccagccguguagcugccgc

SEQ ID NO: 1032320 - RNA, 22 nt, Human
agagcugaaaaagcugacccgg

SEQ ID NO: 1032321 - RNA, 22 nt, Human
aaaagagguuaaccaggugugu

SEQ ID NO: 1032322 - RNA, 22 nt, Human
ucucccacuggccuuguaugau

SEQ ID NO: 1032323 - RNA, 22 nt, Human
ccaggccuggaccaugccaggg

SEQ ID NO: 1032324 - RNA, 22 nt, Human
caguagcaggcacucagcacgu

SEQ ID NO: 1032325 - RNA, 22 nt, Human
gaggcugcuguuagcccugggc

SEQ ID NO: 1032326 - RNA, 22 nt, Human
uggccucugugggagcugagca

SEQ ID NO: 1032327 - RNA, 22 nt, Human
cugggcuucucccccuggcaga

SEQ ID NO: 1032328 - RNA, 22 nt, Human
ccugagguggcugcagcacugc

SEQ ID NO: 1032329 - RNA, 22 nt, Human
ugaaggcuguuggauggggaag

SEQ ID NO: 1032330 - RNA, 22 nt, Human
ggaggugguggcagugacaauu

SEQ ID NO: 1032331 - RNA, 22 nt, Human
acguguucaauuuccaucugac

SEQ ID NO: 1032332 - RNA, 22 nt, Human
gaaugugucacccugucccaug

SEQ ID NO: 1032333 - RNA, 22 nt, Human
acccuggguucccgcagcacca

SEQ ID NO: 1032334 - RNA, 22 nt, Human
acagagcauuugggacagagag

SEQ ID NO: 1032335 - RNA, 22 nt, Human
ggucccaggcucccucuugucc

SEQ ID NO: 1032336 - RNA, 22 nt, Human
uaguaucuauuaguaacaagag

SEQ ID NO: 1032337 - RNA, 22 nt, Human
ugcucuguaaggucagaaaagg

SEQ ID NO: 1032338 - RNA, 22 nt, Human
uccuggccugucuggaguagcu

SEQ ID NO: 1032339 - RNA, 22 nt, Human
uucaagaucgaguuuaaaguga

SEQ ID NO: 1032340 - RNA, 20 nt, Human
ucuggcucuuugcuccuccc

SEQ ID NO: 1032341 - RNA, 22 nt, Human
uagccgggugugguggaacucc

SEQ ID NO: 1032342 - RNA, 22 nt, Human
cuuccucccggcccaugcucug

SEQ ID NO: 1032343 - RNA, 22 nt, Human
acauuucuccuugcaggaguca

SEQ ID NO: 1032344 - RNA, 21 nt, Human
uugaaggaucacuucuguacc

SEQ ID NO: 1032345 - RNA, 22 nt, Human
gaaaggagggaaacagagcggu

SEQ ID NO: 1032346 - RNA, 22 nt, Human
agaggcugggaaggguccccgg

SEQ ID NO: 1032347 - RNA, 22 nt, Human
ccagcaugagacgaugaugaag

SEQ ID NO: 1032348 - RNA, 22 nt, Human
ugucacauugaauaugauuuau

SEQ ID NO: 1032349 - RNA, 22 nt, Human
auccuugagccaaugacugauu

SEQ ID NO: 1032350 - RNA, 22 nt, Human
agguggagaagagaugggcagu

SEQ ID NO: 1032351 - RNA, 22 nt, Human
uccucuggauauaagccucacc

SEQ ID NO: 1032352 - RNA, 22 nt, Human
uggcagcagggccccuggagga

SEQ ID NO: 1032353 - RNA, 20 nt, Human
aguaccuuuuguauguuacc

SEQ ID NO: 1032354 - RNA, 22 nt, Human
agcccaaggcuucccugcuggc

SEQ ID NO: 1032355 - RNA, 22 nt, Human
aggcacugugcagucccaagca

SEQ ID NO: 1032356 - RNA, 22 nt, Human
ugcaguggaggccgugagacag

SEQ ID NO: 1032357 - RNA, 22 nt, Human
ugugugccugagccgugccugg

SEQ ID NO: 1032358 - RNA, 22 nt, Human
cccagcugcaccucuauggccu

SEQ ID NO: 1032359 - RNA, 22 nt, Human
aaugcugcaagaggugaaaaga

SEQ ID NO: 1032360 - RNA, 22 nt, Human
cuccagggagcuguggagguuu

SEQ ID NO: 1032361 - RNA, 22 nt, Human
acauuucugcuagaauagguga

SEQ ID NO: 1032362 - RNA, 22 nt, Human
guggguggaggcgucgagggca

SEQ ID NO: 1032363 - RNA, 22 nt, Human
ugauuaacugucuauuaaucau

SEQ ID NO: 1032364 - RNA, 22 nt, Human
ggcagucagugugguucauaaa

SEQ ID NO: 1032365 - RNA, 22 nt, Human
guuauaaauaccuaauaggauu

SEQ ID NO: 1032366 - RNA, 22 nt, Human
agugcuguccaguuucacaggu

SEQ ID NO: 1032367 - RNA, 22 nt, Human
ggccaccuuccaguugccugca

SEQ ID NO: 1032368 - RNA, 22 nt, Human
aagccuuccugagugcaaggcc

SEQ ID NO: 1032369 - RNA, 23 nt, Human
acucacaaagcaggaucauguug

SEQ ID NO: 1032370 - RNA, 22 nt, Human
gccuggagcucuccacuugggg

SEQ ID NO: 1032371 - RNA, 22 nt, Human
agcuugaguuuuggaugaagug

SEQ ID NO: 1032372 - RNA, 22 nt, Human
cugccuuggaaaaugugguaau

SEQ ID NO: 1032373 - RNA, 22 nt, Human
agaagugccauacuguggucca

SEQ ID NO: 1032374 - RNA, 21 nt, Human
gccagccuguuuaccuguggu

SEQ ID NO: 1032375 - RNA, 22 nt, Human
ggaggccaggguggguggaucg

SEQ ID NO: 1032376 - RNA, 22 nt, Human
agcugcucuuugaaggacacuu

SEQ ID NO: 1032377 - RNA, 22 nt, Human
cagggcugguuugucgaagaaa

SEQ ID NO: 1032378 - RNA, 22 nt, Human
ucuggcucuguguccucaccca

SEQ ID NO: 1032379 - RNA, 22 nt, Human
uccuuuuugguccaaggugacc

SEQ ID NO: 1032380 - RNA, 22 nt, Human
ggcucugccugcccagcagcac

SEQ ID NO: 1032381 - RNA, 19 nt, Human
gcugcucugggucucaucu

SEQ ID NO: 1032382 - RNA, 22 nt, Human
uuuuaucaaucauuaagacauu

SEQ ID NO: 1032383 - RNA, 22 nt, Human
aggagguggccugagcgugccc

SEQ ID NO: 1032384 - RNA, 22 nt, Human
ucucccacagccgugcuucaag

SEQ ID NO: 1032385 - RNA, 22 nt, Human
aggaaaaucgagucuggaggca

SEQ ID NO: 1032386 - RNA, 22 nt, Human
cuucuggaggacacuggcccca

SEQ ID NO: 1032387 - RNA, 22 nt, Human
caguuuuuagauuaguuggugg

SEQ ID NO: 1032388 - RNA, 22 nt, Human
uccucccacauaggacaauggg

SEQ ID NO: 1032389 - RNA, 22 nt, Human
aggcacugacagauucuguguc

SEQ ID NO: 1032390 - RNA, 22 nt, Human
cugcagagcuaggcugagugaa

SEQ ID NO: 1032391 - RNA, 22 nt, Human
agcuucuggaagccuggcagca

SEQ ID NO: 1032392 - RNA, 22 nt, Human
aaagguaguacuucuagaaggg

SEQ ID NO: 1032393 - RNA, 22 nt, Human
gcacugaaaauguuggauucca

SEQ ID NO: 1032394 - RNA, 22 nt, Human
ucagaagagcuggugcugccug

SEQ ID NO: 1032395 - RNA, 22 nt, Human
aguaaacauaauuuaccuguag

SEQ ID NO: 1032396 - RNA, 22 nt, Human
cuuaacagauacaucugugguu

SEQ ID NO: 1032397 - RNA, 22 nt, Human
gcagauggcucagacacugggg

SEQ ID NO: 1032398 - RNA, 22 nt, Human
caagaacauugugaucacuuca

SEQ ID NO: 1032399 - RNA, 22 nt, Human
cacaggcuuccaguccccagcu

SEQ ID NO: 1032400 - RNA, 22 nt, Human
gagcugcccugagcuuugcaug

SEQ ID NO: 1032401 - RNA, 22 nt, Human
ccugauggagcccugcugcaug

SEQ ID NO: 1032402 - RNA, 22 nt, Human
gcaggccagcugugcagauggg

SEQ ID NO: 1032403 - RNA, 22 nt, Human
gccugguggacacugggcauca

SEQ ID NO: 1032404 - RNA, 22 nt, Human
auucuagaugcuguaaguagca

SEQ ID NO: 1032405 - RNA, 22 nt, Human
ggacuggccggcgcugaggccc

SEQ ID NO: 1032406 - RNA, 22 nt, Human
gcagcaugagcuauacaaagua

SEQ ID NO: 1032407 - RNA, 22 nt, Human
uucuuacuaguauguuucagca

SEQ ID NO: 1032408 - RNA, 22 nt, Human
cagcugagcucccaggccauca

SEQ ID NO: 1032409 - RNA, 22 nt, Human
acguuuucagccuuaauguaga

SEQ ID NO: 1032410 - RNA, 22 nt, Human
caggggcucugggugaugugag

SEQ ID NO: 1032411 - RNA, 22 nt, Human
ccucugccaccucccacgaggc

SEQ ID NO: 1032412 - RNA, 19 nt, Human
uccuccuuacuuccucuug

SEQ ID NO: 1032413 - RNA, 22 nt, Human
gcucugagucucagcuaccaca

SEQ ID NO: 1032414 - RNA, 22 nt, Human
agagggagcccagucauagcug

SEQ ID NO: 1032415 - RNA, 22 nt, Human
gcuguccucugaucucuggagg

SEQ ID NO: 1032416 - RNA, 22 nt, Human
gcugccuucaguucugauucau

SEQ ID NO: 1032417 - RNA, 17 nt, Human
ccuuucucuuucaucuc

SEQ ID NO: 1032418 - RNA, 22 nt, Human
aggaguggaauuacuggguucu

SEQ ID NO: 1032419 - RNA, 20 nt, Human
cugggcagguguuugaucuc

SEQ ID NO: 1032420 - RNA, 22 nt, Human
augcagguugggcaaguguggg

SEQ ID NO: 1032421 - RNA, 22 nt, Human
cugagcccaggcgggagcugag

SEQ ID NO: 1032422 - RNA, 22 nt, Human
cauguuuucuaggcuuucacaa

SEQ ID NO: 1032423 - RNA, 22 nt, Human
ugaggcaggaguucaggcugcg

SEQ ID NO: 1032424 - RNA, 22 nt, Human
gcaggcagguggcaucuuguga

SEQ ID NO: 1032425 - RNA, 22 nt, Human
cuugccuguggcuaguuggcuc

SEQ ID NO: 1032426 - RNA, 22 nt, Human
ccucagggacuccaugcugcag

SEQ ID NO: 1032427 - RNA, 22 nt, Human
aauucauccaugaacaauucca

SEQ ID NO: 1032428 - RNA, 20 nt, Human
acugagcugcauggagagga

SEQ ID NO: 1032429 - RNA, 22 nt, Human
agcaaggcagucagcuggcugg

SEQ ID NO: 1032430 - RNA, 22 nt, Human
auguaagguucagaguauguga

SEQ ID NO: 1032431 - RNA, 22 nt, Human
uugcucugacuggagugcagug

SEQ ID NO: 1032432 - RNA, 22 nt, Human
uccagggcuggguuggcucagc

SEQ ID NO: 1032433 - RNA, 22 nt, Human
cuggucugagggcucuugaggc

SEQ ID NO: 1032434 - RNA, 22 nt, Human
acaggcugcugggcuccgugcu

SEQ ID NO: 1032435 - RNA, 22 nt, Human
aaaugcaucagcucauaagaga

SEQ ID NO: 1032436 - RNA, 18 nt, Human
uuaagagcugaaagggga

SEQ ID NO: 1032437 - RNA, 22 nt, Human
ugugucagaaggcaauggggau

SEQ ID NO: 1032438 - RNA, 22 nt, Human
ucagcagggagaggagaaugca

SEQ ID NO: 1032439 - RNA, 22 nt, Human
ucauccuuuugcaugggaaggc

SEQ ID NO: 1032440 - RNA, 22 nt, Human
uccagcagguccgagacaaguu

SEQ ID NO: 1032441 - RNA, 22 nt, Human
aaggcagcaccgccuccugaaa

SEQ ID NO: 1032442 - RNA, 22 nt, Human
cuacacaguucugccuaauggc

SEQ ID NO: 1032443 - RNA, 22 nt, Human
caagaauuguacaaacugggug

SEQ ID NO: 1032444 - RNA, 22 nt, Human
uuaggaaauuaugguuucagau

SEQ ID NO: 1032445 - RNA, 22 nt, Human
cugugucucuccuuacaagacu

SEQ ID NO: 1032446 - RNA, 22 nt, Human
ccucccaccguaucucaguggc

SEQ ID NO: 1032447 - RNA, 22 nt, Human
cagcugaggucaaagaagcagg

SEQ ID NO: 1032448 - RNA, 22 nt, Human
aagauuucuuacuuauugaugc

SEQ ID NO: 1032449 - RNA, 22 nt, Human
ucugagagucucugaggcagau

SEQ ID NO: 1032450 - RNA, 22 nt, Human
cugagagcagggacuugagcca

SEQ ID NO: 1032451 - RNA, 22 nt, Human
ccauggcauuuuaugugucuua

SEQ ID NO: 1032452 - RNA, 22 nt, Human
ccacagaguuacaaaacaguca

SEQ ID NO: 1032453 - RNA, 19 nt, Human
gcauuucucuuuacagcca

SEQ ID NO: 1032454 - RNA, 22 nt, Human
ugccaggagagugcaugcaggg

SEQ ID NO: 1032455 - RNA, 22 nt, Human
ugggcuggagcuuguugcuucc

SEQ ID NO: 1032456 - RNA, 22 nt, Human
aaagcaaugaugguagacacgu

SEQ ID NO: 1032457 - RNA, 21 nt, Human
aggagggcacaaggccaggaa

SEQ ID NO: 1032458 - RNA, 22 nt, Human
ucugcagauuuaucagcagcug

SEQ ID NO: 1032459 - RNA, 22 nt, Human
ugcagcccuuccuuccucuggg

SEQ ID NO: 1032460 - RNA, 22 nt, Human
cuuacauuuaaucaugugucau

SEQ ID NO: 1032461 - RNA, 22 nt, Human
gccugccuagaauugcagcuuu

SEQ ID NO: 1032462 - RNA, 22 nt, Human
aaagaacaauguggaaucuccu

SEQ ID NO: 1032463 - RNA, 22 nt, Human
agaggcccucucucuccugaug

SEQ ID NO: 1032464 - RNA, 22 nt, Human
ccuauugacaauucucuucucc

SEQ ID NO: 1032465 - RNA, 22 nt, Human
uccugucugcucacagagcugg

SEQ ID NO: 1032466 - RNA, 22 nt, Human
cugaggaugguguggucuucuc

SEQ ID NO: 1032467 - RNA, 22 nt, Human
guguacauagaauugugcuuug

SEQ ID NO: 1032468 - RNA, 22 nt, Human
uuguauuagcuguaaauuuucu

SEQ ID NO: 1032469 - RNA, 22 nt, Human
ccuggccugcucggcucuuaag

SEQ ID NO: 1032470 - RNA, 18 nt, Human
aagcugcccucaggcagg

SEQ ID NO: 1032471 - RNA, 22 nt, Human
gccugggagugcacagugaggu

SEQ ID NO: 1032472 - RNA, 22 nt, Human
ggcuugcuucuuguccaggaau

SEQ ID NO: 1032473 - RNA, 19 nt, Human
ugucacugucauggcccag

SEQ ID NO: 1032474 - RNA, 22 nt, Human
ggagacagugguagggccuaag

SEQ ID NO: 1032475 - RNA, 22 nt, Human
ggugggcaggcgaggcccaggu

SEQ ID NO: 1032476 - RNA, 22 nt, Human
gcagcagaugcuuucauggaca

SEQ ID NO: 1032477 - RNA, 21 nt, Human
gcagcagaggcuugacagaca

SEQ ID NO: 1032478 - RNA, 19 nt, Human
ugaagcagcaaacucucag

SEQ ID NO: 1032479 - RNA, 22 nt, Human
aaaagucagucucuccuagcuc

SEQ ID NO: 1032480 - RNA, 22 nt, Human
ggagaaggugcuggucacugug

SEQ ID NO: 1032481 - RNA, 22 nt, Human
gguucacacuaagcuuaagugg

SEQ ID NO: 1032482 - RNA, 22 nt, Human
ucuggcucuccagugcucuuag

SEQ ID NO: 1032483 - RNA, 22 nt, Human
aaggcucuuggagugaaugcag

SEQ ID NO: 1032484 - RNA, 20 nt, Human
ccugggcuccaggagccccg

SEQ ID NO: 1032485 - RNA, 22 nt, Human
uggccuggcucacagugagauu

SEQ ID NO: 1032486 - RNA, 22 nt, Human
gccuucccacccugcgaggcug

SEQ ID NO: 1032487 - RNA, 22 nt, Human
cucucuggcuuggcacggagau

SEQ ID NO: 1032488 - RNA, 22 nt, Human
ucacacguccuugcuacuccuc

SEQ ID NO: 1032489 - RNA, 22 nt, Human
ugcuauaagaauuauauuacuc

SEQ ID NO: 1032490 - RNA, 22 nt, Human
ucaguguagcagacuuguagcc

SEQ ID NO: 1032491 - RNA, 22 nt, Human
agaaaucaugacuaagagcagu

SEQ ID NO: 1032492 - RNA, 22 nt, Human
cagcucccgccaucgggaggca

SEQ ID NO: 1032493 - RNA, 22 nt, Human
ccagguggaggugugagguccu

SEQ ID NO: 1032494 - RNA, 22 nt, Human
cuuccucacggugcaacaggaa

SEQ ID NO: 1032495 - RNA, 22 nt, Human
ugacacaggcagcucccagcac

SEQ ID NO: 1032496 - RNA, 22 nt, Human
cugggaggcagucucucuagaa

SEQ ID NO: 1032497 - RNA, 22 nt, Human
agaagaaacugucggggauauu

SEQ ID NO: 1032498 - RNA, 22 nt, Human
ccugggcuuucaaaaccagccu

SEQ ID NO: 1032499 - RNA, 22 nt, Human
cugggccagucucggccgcucu

SEQ ID NO: 1032500 - RNA, 23 nt, Human
ucagugauguugaaccuagcagu

SEQ ID NO: 1032501 - RNA, 21 nt, Human
agaggccuuacaggauagacc

SEQ ID NO: 1032502 - RNA, 22 nt, Human
uggagcugguaaacagugacau

SEQ ID NO: 1032503 - RNA, 22 nt, Human
ccagccaggcauugcaaacuga

SEQ ID NO: 1032504 - RNA, 17 nt, Human
uuccuggaagucauucc

SEQ ID NO: 1032505 - RNA, 22 nt, Human
gagcagcucugggugacccagu

SEQ ID NO: 1032506 - RNA, 22 nt, Human
uagaaaugauuuugaugcuuca

SEQ ID NO: 1032507 - RNA, 22 nt, Human
cagggccagcgcccaggcccag

SEQ ID NO: 1032508 - RNA, 22 nt, Human
gugccugggcaugagcuuguug

SEQ ID NO: 1032509 - RNA, 17 nt, Human
agaggcagauacuugga

SEQ ID NO: 1032510 - RNA, 22 nt, Human
gagcugccuacauugccaagag

SEQ ID NO: 1032511 - RNA, 22 nt, Human
ugcugucugauucagggugauu

SEQ ID NO: 1032512 - RNA, 22 nt, Human
ucaguuuuguauguuguaaguc

SEQ ID NO: 1032513 - RNA, 22 nt, Human
cauuaugugggaaaauguucuu

SEQ ID NO: 1032514 - RNA, 22 nt, Human
agccuggaccaggggccucaga

SEQ ID NO: 1032515 - RNA, 22 nt, Human
acuuggagagcauugcugggga

SEQ ID NO: 1032516 - RNA, 22 nt, Human
auaaggcagucccuuaacaagg

SEQ ID NO: 1032517 - RNA, 22 nt, Human
ucucaggcuaccuugcacaagg

SEQ ID NO: 1032518 - RNA, 22 nt, Human
agguaaagacugcaaggagaau

SEQ ID NO: 1032519 - RNA, 22 nt, Human
auaugcacacucugcccacaga

SEQ ID NO: 1032520 - RNA, 22 nt, Human
uggcuccuaucaaggagugggu

SEQ ID NO: 1032521 - RNA, 22 nt, Human
aaaaaucacuuuuauaggcagc

SEQ ID NO: 1032522 - RNA, 22 nt, Human
cuccagggcagcauggcagugg

SEQ ID NO: 1032523 - RNA, 22 nt, Human
ugagccuguccugugcauguga

SEQ ID NO: 1032524 - RNA, 22 nt, Human
ugagggcugcuuccagagcuag

SEQ ID NO: 1032525 - RNA, 22 nt, Human
cuggcucaggaaaguugcugcu

SEQ ID NO: 1032526 - RNA, 22 nt, Human
aucaguuuugggggacauacug

SEQ ID NO: 1032527 - RNA, 22 nt, Human
uccaagaucuacagcaguuuag

SEQ ID NO: 1032528 - RNA, 17 nt, Human
ugagacagggcaggccc

SEQ ID NO: 1032529 - RNA, 22 nt, Human
acucacuuuccauucaagcacc

SEQ ID NO: 1032530 - RNA, 22 nt, Human
agggcugcuauguugauucaga

SEQ ID NO: 1032531 - RNA, 22 nt, Human
aaguuauaucaucucauugacg

SEQ ID NO: 1032532 - RNA, 22 nt, Human
gccucugcugcaagccugguug

SEQ ID NO: 1032533 - RNA, 22 nt, Human
cccuggagucagguuggccugg

SEQ ID NO: 1032534 - RNA, 22 nt, Human
ucuagaaacaugacauugaucu

SEQ ID NO: 1032535 - RNA, 22 nt, Human
agugaaauuuguuuagauaggu

SEQ ID NO: 1032536 - RNA, 22 nt, Human
gagggaaagguuaauacaugau

SEQ ID NO: 1032537 - RNA, 22 nt, Human
ucuggccuacuggaguccauga

SEQ ID NO: 1032538 - RNA, 22 nt, Human
ucaucacuguaucauugauaga

SEQ ID NO: 1032539 - RNA, 22 nt, Human
gcaaaaaaugcuuguugcuuag

SEQ ID NO: 1032540 - RNA, 22 nt, Human
cugugcuuaccugcccagguga

SEQ ID NO: 1032541 - RNA, 22 nt, Human
uucaacacaggaacaugauaua

SEQ ID NO: 1032542 - RNA, 22 nt, Human
cugccucugguuuuggucccug

SEQ ID NO: 1032543 - RNA, 22 nt, Human
auggcaggcccagguguucauu

SEQ ID NO: 1032544 - RNA, 22 nt, Human
uggcagcaauuugugauguuga

SEQ ID NO: 1032545 - RNA, 22 nt, Human
cuccuuccugguuagcaccuua

SEQ ID NO: 1032546 - RNA, 22 nt, Human
cugcucugagaggcucuuccua

SEQ ID NO: 1032547 - RNA, 21 nt, Human
gcucccugcucagcuccuggg

SEQ ID NO: 1032548 - RNA, 19 nt, Human
gccugagccagccaugcaa

SEQ ID NO: 1032549 - RNA, 22 nt, Human
ucucccaggcugcccuguggac

SEQ ID NO: 1032550 - RNA, 23 nt, Human
ugcugggguaguuuguggcacag

SEQ ID NO: 1032551 - RNA, 22 nt, Human
cuguauuuaguuaaaaugcuaa

SEQ ID NO: 1032552 - RNA, 20 nt, Human
agagccuggaaaaagacauc

SEQ ID NO: 1032553 - RNA, 22 nt, Human
aaagaucagucugaagcaacau

SEQ ID NO: 1032554 - RNA, 22 nt, Human
gcugcucugugacagccuccgg

SEQ ID NO: 1032555 - RNA, 22 nt, Human
ucucagagaucuuucugcaugu

SEQ ID NO: 1032556 - RNA, 22 nt, Human
ucagcugaguucuagagcacuc

SEQ ID NO: 1032557 - RNA, 22 nt, Human
aguguuccugcucucaggaagc

SEQ ID NO: 1032558 - RNA, 22 nt, Human
ggcagcucugugucugggaagc

SEQ ID NO: 1032559 - RNA, 22 nt, Human
aaaaaugaaacggcugguuggc

SEQ ID NO: 1032560 - RNA, 22 nt, Human
agggcccaggacagcaucaggg

SEQ ID NO: 1032561 - RNA, 22 nt, Human
guggcuucacauggcauuuggc

SEQ ID NO: 1032562 - RNA, 22 nt, Human
gggaaggagguggcuugaagug

SEQ ID NO: 1032563 - RNA, 22 nt, Human
aagcaucucuauguggagagug

SEQ ID NO: 1032564 - RNA, 22 nt, Human
uuagaaaauuugcuucuuugga

SEQ ID NO: 1032565 - RNA, 22 nt, Human
ucuggcucuuugggugauugua

SEQ ID NO: 1032566 - RNA, 20 nt, Human
gaggcucugggcauggcgcc

SEQ ID NO: 1032567 - RNA, 22 nt, Human
ugugccaugaggcucugauaug

SEQ ID NO: 1032568 - RNA, 22 nt, Human
ucacugcucucuaagcaucgcc

SEQ ID NO: 1032569 - RNA, 22 nt, Human
cuggcugccacuucagggucuu

SEQ ID NO: 1032570 - RNA, 22 nt, Human
ggagccagagggaugcaguuga

SEQ ID NO: 1032571 - RNA, 22 nt, Human
agaagcaguuauuuuuugcaca

SEQ ID NO: 1032572 - RNA, 16 nt, Human
uguuagcugugcauua

SEQ ID NO: 1032573 - RNA, 22 nt, Human
auguuaaaugguuuauuauuaa

SEQ ID NO: 1032574 - RNA, 22 nt, Human
gcccaugcacuuucugugaugg

SEQ ID NO: 1032575 - RNA, 22 nt, Human
gccacaugcaauugcagcacgu

SEQ ID NO: 1032576 - RNA, 22 nt, Human
aauagguagccagauauauaaa

SEQ ID NO: 1032577 - RNA, 22 nt, Human
gcagccugaugaucuggguugu

SEQ ID NO: 1032578 - RNA, 22 nt, Human
uagaaacauguucuguucuguu

SEQ ID NO: 1032579 - RNA, 22 nt, Human
cugaggccuaagacaugaauga

SEQ ID NO: 1032580 - RNA, 22 nt, Human
gacagggcgagacucagucuca

SEQ ID NO: 1032581 - RNA, 22 nt, Human
gcugauccuuuuaugucuagcu

SEQ ID NO: 1032582 - RNA, 22 nt, Human
ccuaugccugucacucugcgcu

SEQ ID NO: 1032583 - RNA, 22 nt, Human
ugcaaucucggcacuuugggag

SEQ ID NO: 1032584 - RNA, 22 nt, Human
gaaaucugcggugaggccugag

SEQ ID NO: 1032585 - RNA, 22 nt, Human
cuggcugcuuguagacucgacu

SEQ ID NO: 1032586 - RNA, 22 nt, Human
cucuggaguuagugaucugggc

SEQ ID NO: 1032587 - RNA, 22 nt, Human
uuggaaggcccugccuagcagg

SEQ ID NO: 1032588 - RNA, 19 nt, Human
gccugcagaaaaggcaggg

SEQ ID NO: 1032589 - RNA, 22 nt, Human
gaggccugucgcuaggccucug

SEQ ID NO: 1032590 - RNA, 23 nt, Human
cuugcagggcuggaggcuuagaa

SEQ ID NO: 1032591 - RNA, 22 nt, Human
ccuggcacgaagggcugagguu

SEQ ID NO: 1032592 - RNA, 22 nt, Human
aagggcugccagggggugccag

SEQ ID NO: 1032593 - RNA, 22 nt, Human
uuccuggugguggugacagcac

SEQ ID NO: 1032594 - RNA, 22 nt, Human
uccucugccccagaugaaauuu

SEQ ID NO: 1032595 - RNA, 22 nt, Human
agccuggaguucccaggagaag

SEQ ID NO: 1032596 - RNA, 22 nt, Human
gcucuggagauggagccuugag

SEQ ID NO: 1032597 - RNA, 22 nt, Human
acagcagcaauagcagugacau

SEQ ID NO: 1032598 - RNA, 22 nt, Human
caguggccaugguggcaggggu

SEQ ID NO: 1032599 - RNA, 22 nt, Human
cuggagcauccaugcccagggu

SEQ ID NO: 1032600 - RNA, 22 nt, Human
agagccugugauugucaucacc

SEQ ID NO: 1032601 - RNA, 21 nt, Human
aggaaguggccagauugggaa

SEQ ID NO: 1032602 - RNA, 22 nt, Human
aggggcuggaguucgagguuac

SEQ ID NO: 1032603 - RNA, 22 nt, Human
agcagaacauuuucagggcugu

SEQ ID NO: 1032604 - RNA, 22 nt, Human
agcugccaaguuucucaguuua

SEQ ID NO: 1032605 - RNA, 22 nt, Human
uucauauauaugcacuacguac

SEQ ID NO: 1032606 - RNA, 22 nt, Human
gcagcccagguguagcucuuug

SEQ ID NO: 1032607 - RNA, 22 nt, Human
ucagaacagaagcuggcuauaa

SEQ ID NO: 1032608 - RNA, 22 nt, Human
ucccagagauuuccucuccuuc

SEQ ID NO: 1032609 - RNA, 22 nt, Human
gcuggcauuacaggagagaacc

SEQ ID NO: 1032610 - RNA, 22 nt, Human
ugcagccuugccuccucccagc

SEQ ID NO: 1032611 - RNA, 19 nt, Human
uagcagcugccaaaggaga

SEQ ID NO: 1032612 - RNA, 22 nt, Human
gaagagcuuaguuguccuagaa

SEQ ID NO: 1032613 - RNA, 22 nt, Human
gacagggcgcccagccuguuuc

SEQ ID NO: 1032614 - RNA, 20 nt, Human
ggagagcagggaagacagua

SEQ ID NO: 1032615 - RNA, 22 nt, Human
ccauuguaaagaguauacuuug

SEQ ID NO: 1032616 - RNA, 22 nt, Human
ccucaggcuuacgggcaaugga

SEQ ID NO: 1032617 - RNA, 22 nt, Human
cuggccugagaaugcuacccuu

SEQ ID NO: 1032618 - RNA, 22 nt, Human
agucugcacucagguggagguc

SEQ ID NO: 1032619 - RNA, 22 nt, Human
aaguucaaguaguguuacaugg

SEQ ID NO: 1032620 - RNA, 22 nt, Human
cagaaagaccugggcucaagag

SEQ ID NO: 1032621 - RNA, 22 nt, Human
ugagccugggagauggaggcug

SEQ ID NO: 1032622 - RNA, 22 nt, Human
agcugccauccuguucagcacc

SEQ ID NO: 1032623 - RNA, 20 nt, Human
uggcuccucuuggcuguggc

SEQ ID NO: 1032624 - RNA, 22 nt, Human
ucaaagucacaacucucuaauu

SEQ ID NO: 1032625 - RNA, 22 nt, Human
uccagagccuauauguucaacu

SEQ ID NO: 1032626 - RNA, 22 nt, Human
ccaggccauucccagaguugcu

SEQ ID NO: 1032627 - RNA, 22 nt, Human
agaauucuggaguugggaggaa

SEQ ID NO: 1032628 - RNA, 22 nt, Human
gaaggagagagacaucgucccu

SEQ ID NO: 1032629 - RNA, 22 nt, Human
agggugccuggaagccacucac

SEQ ID NO: 1032630 - RNA, 22 nt, Human
ccuggccuccuggccuucucau

SEQ ID NO: 1032631 - RNA, 22 nt, Human
ccagcuggugggucuuucucug

SEQ ID NO: 1032632 - RNA, 22 nt, Human
guaucuuuuacaccaggaaauu

SEQ ID NO: 1032633 - RNA, 22 nt, Human
aagagggaggugcgggugcaga

SEQ ID NO: 1032634 - RNA, 22 nt, Human
ggccugcugacccaaguccugu

SEQ ID NO: 1032635 - RNA, 16 nt, Human
agaggccuugaggaag

SEQ ID NO: 1032636 - RNA, 22 nt, Human
gguuugcacgauauuuccaugg

SEQ ID NO: 1032637 - RNA, 22 nt, Human
gcucagagcuugaaguuccacu

SEQ ID NO: 1032638 - RNA, 20 nt, Human
ccuggcuuugcaucugugau

SEQ ID NO: 1032639 - RNA, 22 nt, Human
ugcaccauacccauuccccucu

SEQ ID NO: 1032640 - RNA, 22 nt, Human
uggccgggccgggcgccuccac

SEQ ID NO: 1032641 - RNA, 23 nt, Human
aagcuuccuucacgucuccuggg

SEQ ID NO: 1032642 - RNA, 22 nt, Human
aagggaggggauguaagccugg

SEQ ID NO: 1032643 - RNA, 22 nt, Human
gaccagagaaaggcacuggaag

SEQ ID NO: 1032644 - RNA, 22 nt, Human
cccuggaggagcuuagagcuug

SEQ ID NO: 1032645 - RNA, 22 nt, Human
ccaggcugcuuagccuuaucuu

SEQ ID NO: 1032646 - RNA, 22 nt, Human
gaccugccugagcugccucugc

SEQ ID NO: 1032647 - RNA, 22 nt, Human
ugacagaacagguugggagcaa

SEQ ID NO: 1032648 - RNA, 22 nt, Human
cagggcugugcccaucuucccc

SEQ ID NO: 1032649 - RNA, 22 nt, Human
cacagccugcugcacucaagaa

SEQ ID NO: 1032650 - RNA, 22 nt, Human
gccuggcacucacugaagaggc

SEQ ID NO: 1032651 - RNA, 17 nt, Human
uucaagauauugaaaug

SEQ ID NO: 1032652 - RNA, 22 nt, Human
uggccugaauuauggcagaucu

SEQ ID NO: 1032653 - RNA, 22 nt, Human
gaggccacagcuaucagggaca

SEQ ID NO: 1032654 - RNA, 22 nt, Human
agggcugcugaggaagccuugc

SEQ ID NO: 1032655 - RNA, 22 nt, Human
gggcacagcugcuacccagugc

SEQ ID NO: 1032656 - RNA, 22 nt, Human
gcagcugggccccagccucucc

SEQ ID NO: 1032657 - RNA, 22 nt, Human
aagagcuggucacagguccauu

SEQ ID NO: 1032658 - RNA, 22 nt, Human
augccagucaaagaagaugaca

SEQ ID NO: 1032659 - RNA, 22 nt, Human
ucugagaguagagcugccucuu

SEQ ID NO: 1032660 - RNA, 22 nt, Human
ugggcacuauggcucugugcac

SEQ ID NO: 1032661 - RNA, 22 nt, Human
cccagcuccaagggacagcgaa

SEQ ID NO: 1032662 - RNA, 23 nt, Human
ucagaaugcacugaauuuacccu

SEQ ID NO: 1032663 - RNA, 20 nt, Human
gccuggcacccggggcuggc

SEQ ID NO: 1032664 - RNA, 22 nt, Human
uagagaaauaagcuuugccuug

SEQ ID NO: 1032665 - RNA, 22 nt, Human
acagcaggauuuggcgauguug

SEQ ID NO: 1032666 - RNA, 20 nt, Human
ugcuuccuggccacugcggg

SEQ ID NO: 1032667 - RNA, 22 nt, Human
uccugggcuugcuccuccagcu

SEQ ID NO: 1032668 - RNA, 22 nt, Human
uccuggguccauggcagccgaa

SEQ ID NO: 1032669 - RNA, 22 nt, Human
cagacacagcaauucuguguug

SEQ ID NO: 1032670 - RNA, 22 nt, Human
uggagccaaggccaguucucag

SEQ ID NO: 1032671 - RNA, 22 nt, Human
auacaaagacaaaucucaaucu

SEQ ID NO: 1032672 - RNA, 22 nt, Human
gcugcagcagaaguucucagag

SEQ ID NO: 1032673 - RNA, 22 nt, Human
cagggcagugaagaacacacgu

SEQ ID NO: 1032674 - RNA, 22 nt, Human
agccuggaggaggaguugagca

SEQ ID NO: 1032675 - RNA, 22 nt, Human
ccuggcuggcaagaucgugaag

SEQ ID NO: 1032676 - RNA, 20 nt, Human
aaaguguaagcauauaauua

SEQ ID NO: 1032677 - RNA, 20 nt, Human
acagaauaugcugguugugg

SEQ ID NO: 1032678 - RNA, 22 nt, Human
cugggcaguuuauucaguucug

SEQ ID NO: 1032679 - RNA, 22 nt, Human
ugagaaccaugaaaagcuguca

SEQ ID NO: 1032680 - RNA, 22 nt, Human
auuguggcuagacagucacaau

SEQ ID NO: 1032681 - RNA, 22 nt, Human
caggggaagaugccaagggaga

SEQ ID NO: 1032682 - RNA, 22 nt, Human
ugcuggaggccugacuguguuu

SEQ ID NO: 1032683 - RNA, 22 nt, Human
aaaguguaaaagcauguuaggg

SEQ ID NO: 1032684 - RNA, 22 nt, Human
cugcccugggaguaccuguccu

SEQ ID NO: 1032685 - RNA, 22 nt, Human
uucauuccuucccuaagcaacu

SEQ ID NO: 1032686 - RNA, 22 nt, Human
ucuuugcaacucccauuuccau

SEQ ID NO: 1032687 - RNA, 22 nt, Human
aaauuguugaucuacaguaagg

SEQ ID NO: 1032688 - RNA, 20 nt, Human
aggagaaauucgggacaccu

SEQ ID NO: 1032689 - RNA, 22 nt, Human
ggcugggccagggccuguggac

SEQ ID NO: 1032690 - RNA, 23 nt, Human
ggcagagagcauggcuggggccc

SEQ ID NO: 1032691 - RNA, 22 nt, Human
ucauggagacuuugagccuguu

SEQ ID NO: 1032692 - RNA, 22 nt, Human
gcaggguccauggaggcagccc

SEQ ID NO: 1032693 - RNA, 22 nt, Human
ggaggccaguccuggccgggcu

SEQ ID NO: 1032694 - RNA, 22 nt, Human
agccagggagguggagguugca

SEQ ID NO: 1032695 - RNA, 22 nt, Human
aaggccugcucagcugucugug

SEQ ID NO: 1032696 - RNA, 22 nt, Human
ccagggucuuggagaggagugc

SEQ ID NO: 1032697 - RNA, 22 nt, Human
ccucccacauccuagcucugcu

SEQ ID NO: 1032698 - RNA, 22 nt, Human
agauacauagcugugagcacac

SEQ ID NO: 1032699 - RNA, 22 nt, Human
cuguggagcuuguggcaguggg

SEQ ID NO: 1032700 - RNA, 22 nt, Human
cuggggcuucaaugcuucggug

SEQ ID NO: 1032701 - RNA, 22 nt, Human
gccaccagccccaugcgcugug

SEQ ID NO: 1032702 - RNA, 22 nt, Human
gcagacagacugcagugauuuu

SEQ ID NO: 1032703 - RNA, 22 nt, Human
auugcaccuuggguuuugaaag

SEQ ID NO: 1032704 - RNA, 22 nt, Human
cugcugccggcgagccucccuu

SEQ ID NO: 1032705 - RNA, 22 nt, Human
uugauacauagcacaguuuagg

SEQ ID NO: 1032706 - RNA, 22 nt, Human
uuuuugcaccaaccuaauagaa

SEQ ID NO: 1032707 - RNA, 22 nt, Human
acugaaggcuuucccaagguca

SEQ ID NO: 1032708 - RNA, 22 nt, Human
gccuaauaacuagcuguguaac

SEQ ID NO: 1032709 - RNA, 22 nt, Human
ggaccagagaagugagcaccug

SEQ ID NO: 1032710 - RNA, 22 nt, Human
augcacaagaggcuagaaaaga

SEQ ID NO: 1032711 - RNA, 22 nt, Human
caagaaauuucuuaagaacuaa

SEQ ID NO: 1032712 - RNA, 22 nt, Human
uuccagggcuaauuccugugga

SEQ ID NO: 1032713 - RNA, 22 nt, Human
ccugccugcggcccgcggggag

SEQ ID NO: 1032714 - RNA, 22 nt, Human
gcucugcugaagccccuugcau

SEQ ID NO: 1032715 - RNA, 22 nt, Human
cuggggcucucuggaaugcuug

SEQ ID NO: 1032716 - RNA, 21 nt, Human
ccccugggagcccugucagua

SEQ ID NO: 1032717 - RNA, 22 nt, Human
ggaggccuugaggccaggagcu

SEQ ID NO: 1032718 - RNA, 22 nt, Human
cacauuuaaagguugaagcuga

SEQ ID NO: 1032719 - RNA, 22 nt, Human
ugguaaaguguacugaauauga

SEQ ID NO: 1032720 - RNA, 22 nt, Human
acccuuucuuacucacacgcuc

SEQ ID NO: 1032721 - RNA, 22 nt, Human
caguguggagggagagagccug

SEQ ID NO: 1032722 - RNA, 22 nt, Human
gagcacagcuggagguagcauu

SEQ ID NO: 1032723 - RNA, 22 nt, Human
gcccucagaguuccccacagug

SEQ ID NO: 1032724 - RNA, 22 nt, Human
ccccuuccaggaagcagaaucg

SEQ ID NO: 1032725 - RNA, 22 nt, Human
cuggccuggucuggccucucca

SEQ ID NO: 1032726 - RNA, 22 nt, Human
uccugggaagagaccugagcau

SEQ ID NO: 1032727 - RNA, 22 nt, Human
caauaauauccugugcuguuug

SEQ ID NO: 1032728 - RNA, 22 nt, Human
cucucugcuguauccuuaggcu

SEQ ID NO: 1032729 - RNA, 21 nt, Human
ggcagaaguagcauggacggg

SEQ ID NO: 1032730 - RNA, 22 nt, Human
ggcaccuggauguagcagugaa

SEQ ID NO: 1032731 - RNA, 22 nt, Human
aaaucaguucucccuuucuuca

SEQ ID NO: 1032732 - RNA, 22 nt, Human
agggcagcucucaccucuggcc

SEQ ID NO: 1032733 - RNA, 22 nt, Human
gcagauggugggggaggaguac

SEQ ID NO: 1032734 - RNA, 22 nt, Human
aaggucauuuuuuccucuguug

SEQ ID NO: 1032735 - RNA, 22 nt, Human
ugccucagaguugucccuacca

SEQ ID NO: 1032736 - RNA, 22 nt, Human
ugcaugcauaaauguacacaca

SEQ ID NO: 1032737 - RNA, 22 nt, Human
agccuggacagcuacggagaac

SEQ ID NO: 1032738 - RNA, 22 nt, Human
auuucauugaaguuaauucuuc

SEQ ID NO: 1032739 - RNA, 22 nt, Human
acaggugauucaggcucuggga

SEQ ID NO: 1032740 - RNA, 22 nt, Human
ucuguagcaagugagaggcauu

SEQ ID NO: 1032741 - RNA, 21 nt, Human
aggcccagcuuuccucuugcu

SEQ ID NO: 1032742 - RNA, 22 nt, Human
ucugccuggauuccauucucca

SEQ ID NO: 1032743 - RNA, 22 nt, Human
uucaagaucuuccaaaggauac

SEQ ID NO: 1032744 - RNA, 22 nt, Human
aaguuuaagguggaaguggugg

SEQ ID NO: 1032745 - RNA, 22 nt, Human
gcugagagaaaagugagguucu

SEQ ID NO: 1032746 - RNA, 22 nt, Human
guggagacgggacagaagcuaa

SEQ ID NO: 1032747 - RNA, 22 nt, Human
uggagggcucuuucaccuggua

SEQ ID NO: 1032748 - RNA, 22 nt, Human
caggguggcccuguggucucau

SEQ ID NO: 1032749 - RNA, 22 nt, Human
aggaaagggguagguguggacg

SEQ ID NO: 1032750 - RNA, 22 nt, Human
acucugggccccagguggagcu

SEQ ID NO: 1032751 - RNA, 22 nt, Human
cagcaggcugcgauugcucauu

SEQ ID NO: 1032752 - RNA, 22 nt, Human
ggguccagcuacaucagggugg

SEQ ID NO: 1032753 - RNA, 22 nt, Human
ugccagcacuucuggcugucug

SEQ ID NO: 1032754 - RNA, 22 nt, Human
cagaauuugaaguaauauucca

SEQ ID NO: 1032755 - RNA, 18 nt, Human
ccuggagcuccacagcaa

SEQ ID NO: 1032756 - RNA, 22 nt, Human
cacagggccuggggcagcugcu

SEQ ID NO: 1032757 - RNA, 22 nt, Human
ggaggacaggggcugcagcaca

SEQ ID NO: 1032758 - RNA, 22 nt, Human
aaguuugagagccuuuaguaua

SEQ ID NO: 1032759 - RNA, 22 nt, Human
ccagggcaacgcugucucagag

SEQ ID NO: 1032760 - RNA, 22 nt, Human
ucucagagaacaguuggugcuu

SEQ ID NO: 1032761 - RNA, 22 nt, Human
uucaagaucuggguuuucagcu

SEQ ID NO: 1032762 - RNA, 20 nt, Human
cucugcugcccgccggcugc

SEQ ID NO: 1032763 - RNA, 22 nt, Human
agaggcugagaaacccucuucu

SEQ ID NO: 1032764 - RNA, 22 nt, Human
cagcuggggcagccacgugcgg

SEQ ID NO: 1032765 - RNA, 22 nt, Human
ugaccaaagaguugcuuguauu

SEQ ID NO: 1032766 - RNA, 22 nt, Human
gaguuauuucagaaggaaagau

SEQ ID NO: 1032767 - RNA, 22 nt, Human
aauaaacugcucaauugcauca

SEQ ID NO: 1032768 - RNA, 22 nt, Human
aagguacagaaauuaacaagga

SEQ ID NO: 1032769 - RNA, 22 nt, Human
uaaagguaguuuuaaaggugcu

SEQ ID NO: 1032770 - RNA, 22 nt, Human
agugugugcaugcauucgugca

SEQ ID NO: 1032771 - RNA, 22 nt, Human
ggcagccaugcacgcugccugg

SEQ ID NO: 1032772 - RNA, 22 nt, Human
guccuggguccccgcaggucag

SEQ ID NO: 1032773 - RNA, 22 nt, Human
agggguggccugccuuacuccc

SEQ ID NO: 1032774 - RNA, 22 nt, Human
ucugcagcuugcacaggcaggc

SEQ ID NO: 1032775 - RNA, 22 nt, Human
ucaacagaagugauagcuauua

SEQ ID NO: 1032776 - RNA, 22 nt, Human
ugcauuauacuuuuagaaauuu

SEQ ID NO: 1032777 - RNA, 21 nt, Human
ugggaugggucugggaccagc

SEQ ID NO: 1032778 - RNA, 22 nt, Human
gcagcuguggguuccaagucua

SEQ ID NO: 1032779 - RNA, 22 nt, Human
aggaccaguaugagagcaucug

SEQ ID NO: 1032780 - RNA, 22 nt, Human
uggcugggccgggccuugugcc

SEQ ID NO: 1032781 - RNA, 21 nt, Human
ccuggcuucagggugcacugg

SEQ ID NO: 1032782 - RNA, 22 nt, Human
gcagggugugucucauacaguu

SEQ ID NO: 1032783 - RNA, 22 nt, Human
ucucagaguuuagagcugagcc

SEQ ID NO: 1032784 - RNA, 22 nt, Human
uccucuggggucagggcacuac

SEQ ID NO: 1032785 - RNA, 22 nt, Human
cucccuggcacagcgagagguu

SEQ ID NO: 1032786 - RNA, 22 nt, Human
acuggcugaaguuuacuuuuug

SEQ ID NO: 1032787 - RNA, 22 nt, Human
aggccugacuugaauuuagggc

SEQ ID NO: 1032788 - RNA, 22 nt, Human
ucagagcuuuggagaccaggaa

SEQ ID NO: 1032789 - RNA, 22 nt, Human
caaggccugccucuggcagaaa

SEQ ID NO: 1032790 - RNA, 22 nt, Human
cucuggaaaaccacuagcagga

SEQ ID NO: 1032791 - RNA, 22 nt, Human
gcuggccugcugggcaccaccg

SEQ ID NO: 1032792 - RNA, 22 nt, Human
acagcuuuucaauucugcugag

SEQ ID NO: 1032793 - RNA, 22 nt, Human
ggcaggcugcuugggucauguc

SEQ ID NO: 1032794 - RNA, 22 nt, Human
aggcagagcuggguuuugaaau

SEQ ID NO: 1032795 - RNA, 22 nt, Human
acagccagguaaaggcauggca

SEQ ID NO: 1032796 - RNA, 22 nt, Human
cagagccugcucacgucucugu

SEQ ID NO: 1032797 - RNA, 22 nt, Human
aggcacugggggaugagcaagg

SEQ ID NO: 1032798 - RNA, 22 nt, Human
uggccugccuucgcugagcuga

SEQ ID NO: 1032799 - RNA, 22 nt, Human
ugacagggcuagaggcaaugca

SEQ ID NO: 1032800 - RNA, 22 nt, Human
auaccuuuuagacauguaguug

SEQ ID NO: 1032801 - RNA, 19 nt, Human
gggaugggcccucacccuc

SEQ ID NO: 1032802 - RNA, 22 nt, Human
gaggccugaaaggggaccuaug

SEQ ID NO: 1032803 - RNA, 22 nt, Human
acauuucugcaucucagagcua

SEQ ID NO: 1032804 - RNA, 22 nt, Human
guguggcugccagccaagaggc

SEQ ID NO: 1032805 - RNA, 22 nt, Human
ggaggaccugcuggcccugcaa

SEQ ID NO: 1032806 - RNA, 17 nt, Human
gcagcagagagacccuc

SEQ ID NO: 1032807 - RNA, 22 nt, Human
aaggcugaguaaaacagagaac

SEQ ID NO: 1032808 - RNA, 22 nt, Human
ugcauuccuccaccuccugcac

SEQ ID NO: 1032809 - RNA, 19 nt, Human
uagcugccuguuaccucca

SEQ ID NO: 1032810 - RNA, 22 nt, Human
uggagccauaacccuuucguac

SEQ ID NO: 1032811 - RNA, 22 nt, Human
cggagccugcuuguugcagcug

SEQ ID NO: 1032812 - RNA, 22 nt, Human
ugggugaggaugaugaggcagc

SEQ ID NO: 1032813 - RNA, 22 nt, Human
augaaaacggaccagagcuauu

SEQ ID NO: 1032814 - RNA, 22 nt, Human
ggcagcaggagccaucugguag

SEQ ID NO: 1032815 - RNA, 22 nt, Human
ccuuucucuggcagcaggacag

SEQ ID NO: 1032816 - RNA, 22 nt, Human
gggcugcacagaucuucaaggg

SEQ ID NO: 1032817 - RNA, 18 nt, Human
ccagcaugccagaggcug

SEQ ID NO: 1032818 - RNA, 22 nt, Human
gcagagguggcaucugggcucu

SEQ ID NO: 1032819 - RNA, 22 nt, Human
caagagcauuuaguuagcuggu

SEQ ID NO: 1032820 - RNA, 22 nt, Human
cugccuggcauggagaagagaa

SEQ ID NO: 1032821 - RNA, 22 nt, Human
acaaaugccauauauaaauucu

SEQ ID NO: 1032822 - RNA, 22 nt, Human
ugcugggcuugaaagcugcuaa

SEQ ID NO: 1032823 - RNA, 22 nt, Human
ucuuuucuggacucugcaugga

SEQ ID NO: 1032824 - RNA, 22 nt, Human
ucagggcagccuaaggcaccuc

SEQ ID NO: 1032825 - RNA, 22 nt, Human
auaaaacuuauuagaauugugu

SEQ ID NO: 1032826 - RNA, 21 nt, Human
uguaugcacgcacaugcacac

SEQ ID NO: 1032827 - RNA, 22 nt, Human
uggcucagcuuuccccaucugg

SEQ ID NO: 1032828 - RNA, 22 nt, Human
uggaagcaucacuucuugccug

SEQ ID NO: 1032829 - RNA, 22 nt, Human
cccagcauccucagggagcggg

SEQ ID NO: 1032830 - RNA, 22 nt, Human
ggcugagcacuuuaggcaggag

SEQ ID NO: 1032831 - RNA, 22 nt, Human
cucagaguucuccugggaggug

SEQ ID NO: 1032832 - RNA, 22 nt, Human
aaacuguauauuuauggcaugu

SEQ ID NO: 1032833 - RNA, 22 nt, Human
gggagggaggugaugcuuggcu

SEQ ID NO: 1032834 - RNA, 22 nt, Human
uacaagagguauauagaaacag

SEQ ID NO: 1032835 - RNA, 22 nt, Human
agucauaauuauaaacaucagu

SEQ ID NO: 1032836 - RNA, 22 nt, Human
uggcagaguuggagguggaaga

SEQ ID NO: 1032837 - RNA, 22 nt, Human
gcuggccugggcucaagaccag

SEQ ID NO: 1032838 - RNA, 22 nt, Human
uccuuccuggggucucugcugc

SEQ ID NO: 1032839 - RNA, 22 nt, Human
gggcuggugaggcugcccugca

SEQ ID NO: 1032840 - RNA, 22 nt, Human
ggcucuggugugaagcagccuc

SEQ ID NO: 1032841 - RNA, 22 nt, Human
cuggccuguccugacccagccu

SEQ ID NO: 1032842 - RNA, 20 nt, Human
cugugccuaaaccuccgggu

SEQ ID NO: 1032843 - RNA, 22 nt, Human
acugcagccuagggaccacagu

SEQ ID NO: 1032844 - RNA, 22 nt, Human
ggaggcucccacgcagcucaca

SEQ ID NO: 1032845 - RNA, 22 nt, Human
uuuuccucugcagagcaguuag

SEQ ID NO: 1032846 - RNA, 22 nt, Human
cugcucuggcuguguacuucag

SEQ ID NO: 1032847 - RNA, 22 nt, Human
aggagcuggguuccuuuggugg

SEQ ID NO: 1032848 - RNA, 22 nt, Human
ucagaggugguaaaggacagca

SEQ ID NO: 1032849 - RNA, 22 nt, Human
ucagagccccuccgcuguccca

SEQ ID NO: 1032850 - RNA, 20 nt, Human
cucuggcuccgcgugaccgc

SEQ ID NO: 1032851 - RNA, 20 nt, Human
auaaaauaacugccacaaga

SEQ ID NO: 1032852 - RNA, 23 nt, Human
agcagccagagauccucggcccu

SEQ ID NO: 1032853 - RNA, 22 nt, Human
gcacugaacuuuaaucauuucu

SEQ ID NO: 1032854 - RNA, 22 nt, Human
uuacuuugaugaucaaugagcg

SEQ ID NO: 1032855 - RNA, 22 nt, Human
aggaggccgauuucagaggucg

SEQ ID NO: 1032856 - RNA, 22 nt, Human
gagccuggauagccuuguucca

SEQ ID NO: 1032857 - RNA, 22 nt, Human
ccaggagcaaagaucacuggga

SEQ ID NO: 1032858 - RNA, 22 nt, Human
ggcucaggaugagccuucucau

SEQ ID NO: 1032859 - RNA, 22 nt, Human
cauggcaggaggcugcuggcag

SEQ ID NO: 1032860 - RNA, 21 nt, Human
ugcagcugacacugguaugcc

SEQ ID NO: 1032861 - RNA, 22 nt, Human
ugcagaagaaaacagcugugug

SEQ ID NO: 1032862 - RNA, 20 nt, Human
aaggcacuaugucugcuagc

SEQ ID NO: 1032863 - RNA, 22 nt, Human
cuggcucccucgcugaggugcu

SEQ ID NO: 1032864 - RNA, 21 nt, Human
gcuccuggugcugcguggcgc

SEQ ID NO: 1032865 - RNA, 22 nt, Human
gugugcagaagacacaagacau

SEQ ID NO: 1032866 - RNA, 22 nt, Human
cuggcagcgcagcaugaagucg

SEQ ID NO: 1032867 - RNA, 22 nt, Human
gugucacaugguuuacugcagc

SEQ ID NO: 1032868 - RNA, 22 nt, Human
gggggcuggacuuucccacaca

SEQ ID NO: 1032869 - RNA, 17 nt, Human
agccccucagcgucacc

SEQ ID NO: 1032870 - RNA, 22 nt, Human
aggcuuccuggaggaagaggua

SEQ ID NO: 1032871 - RNA, 22 nt, Human
cauugcacagcccuguggugau

SEQ ID NO: 1032872 - RNA, 22 nt, Human
acagaaauugggcaaauggaag

SEQ ID NO: 1032873 - RNA, 22 nt, Human
guacauuggcaacucucuuaga

SEQ ID NO: 1032874 - RNA, 22 nt, Human
ccugccugcaccuucucugggg

SEQ ID NO: 1032875 - RNA, 22 nt, Human
cagcagggggcagcgcagauca

SEQ ID NO: 1032876 - RNA, 22 nt, Human
ucuuuacaguccucugucaauc

SEQ ID NO: 1032877 - RNA, 22 nt, Human
cacagcuucugagugaggauuu

SEQ ID NO: 1032878 - RNA, 22 nt, Human
cagcugccuucugcgggaaguc

SEQ ID NO: 1032879 - RNA, 20 nt, Human
acccagcucugugcccuggg

SEQ ID NO: 1032880 - RNA, 22 nt, Human
ccacagagacaggguccuugcu

SEQ ID NO: 1032881 - RNA, 22 nt, Human
agcugcugagagucugccgggc

SEQ ID NO: 1032882 - RNA, 22 nt, Human
aguaaugugccugaaauacuug

SEQ ID NO: 1032883 - RNA, 22 nt, Human
cucagggacguuagaggacagg

SEQ ID NO: 1032884 - RNA, 22 nt, Human
gaggccuggugugucucccgcu

SEQ ID NO: 1032885 - RNA, 22 nt, Human
auauuucuugagcaccugguau

SEQ ID NO: 1032886 - RNA, 22 nt, Human
aaugcuguaaagaugcuaucug

SEQ ID NO: 1032887 - RNA, 22 nt, Human
aauuaguauugcgauucauuag

SEQ ID NO: 1032888 - RNA, 22 nt, Human
cucuggagguggagguugcagu

SEQ ID NO: 1032889 - RNA, 22 nt, Human
cuggccuuggaagggagcccgu

SEQ ID NO: 1032890 - RNA, 22 nt, Human
uccuugaaaagaaugucuccau

SEQ ID NO: 1032891 - RNA, 22 nt, Human
ucaaaguuuuugagaauuacau

SEQ ID NO: 1032892 - RNA, 23 nt, Human
agaagcagcuucuggaguaucgg

SEQ ID NO: 1032893 - RNA, 22 nt, Human
cuggaagguucuuugugugccu

SEQ ID NO: 1032894 - RNA, 20 nt, Human
gccagcccugacacaggagc

SEQ ID NO: 1032895 - RNA, 22 nt, Human
cagccagaaccuaggaugagcu

SEQ ID NO: 1032896 - RNA, 22 nt, Human
uaacagaagaugaaacuucuuu

SEQ ID NO: 1032897 - RNA, 22 nt, Human
aucuacagcugucugcacagua

SEQ ID NO: 1032898 - RNA, 22 nt, Human
ugaagcagcaccauuuuagagc

SEQ ID NO: 1032899 - RNA, 22 nt, Human
ugugccuucucaguccugcuca

SEQ ID NO: 1032900 - RNA, 22 nt, Human
aggcugcuucagcugcagggag

SEQ ID NO: 1032901 - RNA, 22 nt, Human
cccucugccucugaguaggaca

SEQ ID NO: 1032902 - RNA, 21 nt, Human
gccaccccuggcacaggugcu

SEQ ID NO: 1032903 - RNA, 22 nt, Human
agccacagggggugagggacaa

SEQ ID NO: 1032904 - RNA, 22 nt, Human
agaauucuccuucagggcagga

SEQ ID NO: 1032905 - RNA, 22 nt, Human
uaacagaauuugcuaaacuccg

SEQ ID NO: 1032906 - RNA, 22 nt, Human
agcagggccaacaguaaacacc

SEQ ID NO: 1032907 - RNA, 22 nt, Human
ugccuggaugugcuggccucac

SEQ ID NO: 1032908 - RNA, 22 nt, Human
ccaggagcaacuugaaggcaag

SEQ ID NO: 1032909 - RNA, 22 nt, Human
cagggcagggagcuuagaauga

SEQ ID NO: 1032910 - RNA, 23 nt, Human
gugagcagcccacuaggaaugcc

SEQ ID NO: 1032911 - RNA, 21 nt, Human
cagcuuugucugucuucgggg

SEQ ID NO: 1032912 - RNA, 22 nt, Human
cagugggcugugauggauucac

SEQ ID NO: 1032913 - RNA, 22 nt, Human
gagugguaggcaguguuaggaa

SEQ ID NO: 1032914 - RNA, 22 nt, Human
gcaggccugacuguagggggca

SEQ ID NO: 1032915 - RNA, 22 nt, Human
agcugaaggcuagaacagcugg

SEQ ID NO: 1032916 - RNA, 22 nt, Human
ucuggccagugaaaugcagaau

SEQ ID NO: 1032917 - RNA, 22 nt, Human
aagaauuauugcaauacuagau

SEQ ID NO: 1032918 - RNA, 22 nt, Human
aguauuucugcucaugaaagag

SEQ ID NO: 1032919 - RNA, 22 nt, Human
cacagggcagagaccugggugc

SEQ ID NO: 1032920 - RNA, 22 nt, Human
agcagagcugcaguggccugcu

SEQ ID NO: 1032921 - RNA, 22 nt, Human
ggcagaaggccucccagcuccu

SEQ ID NO: 1032922 - RNA, 21 nt, Human
gggccacaccuucugcagacc

SEQ ID NO: 1032923 - RNA, 22 nt, Human
ugcagcauuauucacaguagcc

SEQ ID NO: 1032924 - RNA, 22 nt, Human
caggggcucccugggugccagu

SEQ ID NO: 1032925 - RNA, 22 nt, Human
aaugcacauguuguaauaaaua

SEQ ID NO: 1032926 - RNA, 22 nt, Human
cagacuuucaaggagugaaggc

SEQ ID NO: 1032927 - RNA, 21 nt, Human
ggagauggguaucgccugggc

SEQ ID NO: 1032928 - RNA, 22 nt, Human
aauaguguuguucacucaggag

SEQ ID NO: 1032929 - RNA, 22 nt, Human
agguacagaugaaagucuaguu

SEQ ID NO: 1032930 - RNA, 22 nt, Human
uggcuggggccugaauccugca

SEQ ID NO: 1032931 - RNA, 22 nt, Human
ggcucagguuuccuucccagcu

SEQ ID NO: 1032932 - RNA, 21 nt, Human
uggagcugccacuuguccucc

SEQ ID NO: 1032933 - RNA, 22 nt, Human
auggcagggcagccucucagag

SEQ ID NO: 1032934 - RNA, 22 nt, Human
cagccagguucaaguccuuaua

SEQ ID NO: 1032935 - RNA, 22 nt, Human
gcagacuguaucaaugucagua

SEQ ID NO: 1032936 - RNA, 19 nt, Human
ucaaaugccaaugucacag

SEQ ID NO: 1032937 - RNA, 22 nt, Human
cagugguggaaugaggaauugu

SEQ ID NO: 1032938 - RNA, 22 nt, Human
gcaggaguguauuugcauguaa

SEQ ID NO: 1032939 - RNA, 22 nt, Human
gaggggcugcccuggugucagg

SEQ ID NO: 1032940 - RNA, 22 nt, Human
gugccagcaguuauggugauuu

SEQ ID NO: 1032941 - RNA, 22 nt, Human
ggccuggcucuugcccagccug

SEQ ID NO: 1032942 - RNA, 22 nt, Human
auuauguauuugguauaguuug

SEQ ID NO: 1032943 - RNA, 22 nt, Human
cugagccuuauucaccagcccu

SEQ ID NO: 1032944 - RNA, 22 nt, Human
ugcugccacaaauucagcugcc

SEQ ID NO: 1032945 - RNA, 22 nt, Human
uaagaacaguguuucaucucua

SEQ ID NO: 1032946 - RNA, 22 nt, Human
agcagggcuugccgcuuguccu

SEQ ID NO: 1032947 - RNA, 22 nt, Human
ccucugcaccauagccuucagc

SEQ ID NO: 1032948 - RNA, 22 nt, Human
cuggcucagacagcugugcagu

SEQ ID NO: 1032949 - RNA, 22 nt, Human
cagagccaggucuaggagucuc

SEQ ID NO: 1032950 - RNA, 22 nt, Human
ggcagcuccucaaaaaauuaaa

SEQ ID NO: 1032951 - RNA, 22 nt, Human
agcugagccagcagcaacagga

SEQ ID NO: 1032952 - RNA, 22 nt, Human
cagguaggauggaagggcucaa

SEQ ID NO: 1032953 - RNA, 22 nt, Human
gucucagauaacauguauucua

SEQ ID NO: 1032954 - RNA, 22 nt, Human
ugauuuuuagcuauucugaaga

SEQ ID NO: 1032955 - RNA, 22 nt, Human
cagcugccagcuucucuccauc

SEQ ID NO: 1032956 - RNA, 22 nt, Human
ucuuagaaaugaaguucuuucu

SEQ ID NO: 1032957 - RNA, 22 nt, Human
uaagacacaugcguacaagaua

SEQ ID NO: 1032958 - RNA, 22 nt, Human
ccacugucugcaggccucagca

SEQ ID NO: 1032959 - RNA, 22 nt, Human
gcucccagggcagcgcagaaga

SEQ ID NO: 1032960 - RNA, 22 nt, Human
auacauuagcucauaugauuaa

SEQ ID NO: 1032961 - RNA, 18 nt, Human
gcugccugcauuccucac

SEQ ID NO: 1032962 - RNA, 22 nt, Human
ccagagcuucggggcggcugua

SEQ ID NO: 1032963 - RNA, 22 nt, Human
ucuuuggauaucgcuagaccgu

SEQ ID NO: 1032964 - RNA, 22 nt, Human
aaagauuucacaucccaagccu

SEQ ID NO: 1032965 - RNA, 22 nt, Human
ccucugaguccucccugguugc

SEQ ID NO: 1032966 - RNA, 22 nt, Human
cagggcuguuagcugcugcucu

SEQ ID NO: 1032967 - RNA, 22 nt, Human
uuccuguauucuaaagggaaag

SEQ ID NO: 1032968 - RNA, 22 nt, Human
acagaaauuagcagugaguuua

SEQ ID NO: 1032969 - RNA, 22 nt, Human
auuuagaaguuggagggcaaga

SEQ ID NO: 1032970 - RNA, 22 nt, Human
aucuucaacuugaucauuugaa

SEQ ID NO: 1032971 - RNA, 22 nt, Human
gggcaagcucuucagaagcucu

SEQ ID NO: 1032972 - RNA, 22 nt, Human
accaaggagacaaagguguauu

SEQ ID NO: 1032973 - RNA, 22 nt, Human
ugcucccaaacgaccuacugug

SEQ ID NO: 1032974 - RNA, 20 nt, Human
uuugagaccagucugcccaa

SEQ ID NO: 1032975 - RNA, 22 nt, Human
gcagggcucauucuaguacaau

SEQ ID NO: 1032976 - RNA, 22 nt, Human
cuccucccucuuugccacacau

SEQ ID NO: 1032977 - RNA, 22 nt, Human
agucucagggccacccggggaa

SEQ ID NO: 1032978 - RNA, 22 nt, Human
ggggugggcgugcagggacacc

SEQ ID NO: 1032979 - RNA, 22 nt, Human
agauacaucauuuauaccuuca

SEQ ID NO: 1032980 - RNA, 22 nt, Human
ccugucauacuaacguaguggg

SEQ ID NO: 1032981 - RNA, 22 nt, Human
gcugccugccuugccuggagga

SEQ ID NO: 1032982 - RNA, 22 nt, Human
aaagccuugggauuugugauca

SEQ ID NO: 1032983 - RNA, 22 nt, Human
acuuccuguguuggucuugcug

SEQ ID NO: 1032984 - RNA, 19 nt, Human
agggcugcucuggccuggg

SEQ ID NO: 1032985 - RNA, 22 nt, Human
uccaggagaggccugaccaggu

SEQ ID NO: 1032986 - RNA, 22 nt, Human
ucugggcuuuacacugugcuua

SEQ ID NO: 1032987 - RNA, 22 nt, Human
agcagcugaccagugaguccug

SEQ ID NO: 1032988 - RNA, 22 nt, Human
uugaaaggugacauuguuagag

SEQ ID NO: 1032989 - RNA, 22 nt, Human
uggccaggcagguagaacggcc

SEQ ID NO: 1032990 - RNA, 22 nt, Human
guguccacggcugagaaugauu

SEQ ID NO: 1032991 - RNA, 22 nt, Human
aaguucaaggcucuagaguucc

SEQ ID NO: 1032992 - RNA, 23 nt, Human
ucaguuuuggcuguucaguguug

SEQ ID NO: 1032993 - RNA, 22 nt, Human
aggcacugaaagguggccagag

SEQ ID NO: 1032994 - RNA, 22 nt, Human
uggcccugcuggccaaaggcua

SEQ ID NO: 1032995 - RNA, 22 nt, Human
agcugcagagguuugugcaaca

SEQ ID NO: 1032996 - RNA, 22 nt, Human
gagagucacugucugcauuucc

SEQ ID NO: 1032997 - RNA, 22 nt, Human
ugacagaaauaguucuuaauuu

SEQ ID NO: 1032998 - RNA, 22 nt, Human
augaaggauggcuggcugcccu

SEQ ID NO: 1032999 - RNA, 22 nt, Human
ucugccagaaguucugagagua

SEQ ID NO: 1033000 - RNA, 22 nt, Human
acagaggccccgugggagagcc

SEQ ID NO: 1033001 - RNA, 22 nt, Human
ggaggguuagcaaaggcacaga

SEQ ID NO: 1033002 - RNA, 22 nt, Human
aggccuccugcagggaugagug

SEQ ID NO: 1033003 - RNA, 22 nt, Human
uggcuggcuagugggcaggauu

SEQ ID NO: 1033004 - RNA, 22 nt, Human
aguguccccuccaagggccugg

SEQ ID NO: 1033005 - RNA, 22 nt, Human
agaaauuccuaagguacacaag

SEQ ID NO: 1033006 - RNA, 22 nt, Human
gcugccugaagugucuacacug

SEQ ID NO: 1033007 - RNA, 22 nt, Human
cagcaagauuuuuaaagcaagg

SEQ ID NO: 1033008 - RNA, 22 nt, Human
auguuacauaguccuuauuugu

SEQ ID NO: 1033009 - RNA, 22 nt, Human
aaggucauggcaaauuacuuuu

SEQ ID NO: 1033010 - RNA, 22 nt, Human
ggcucuggagcacagacgucug

SEQ ID NO: 1033011 - RNA, 22 nt, Human
ccugcagagccacgugccagcg

SEQ ID NO: 1033012 - RNA, 22 nt, Human
cagcagcugggaaggaggcuga

SEQ ID NO: 1033013 - RNA, 22 nt, Human
agaaauguuacaguuguuauuu

SEQ ID NO: 1033014 - RNA, 22 nt, Human
agagcugggacuuggacucaau

SEQ ID NO: 1033015 - RNA, 22 nt, Human
ccagcuccuucugucuguggag

SEQ ID NO: 1033016 - RNA, 22 nt, Human
gagauauguuagaaagcuauug

SEQ ID NO: 1033017 - RNA, 19 nt, Human
ugccagcauuaggcugaag

SEQ ID NO: 1033018 - RNA, 22 nt, Human
uucuaacucuguuauguguuuc

SEQ ID NO: 1033019 - RNA, 22 nt, Human
uaagaacaagauguuccuguuu

SEQ ID NO: 1033020 - RNA, 22 nt, Human
gccuguccuggaugcucugcaa

SEQ ID NO: 1033021 - RNA, 22 nt, Human
gggcuaggcuuggccagcacug

SEQ ID NO: 1033022 - RNA, 22 nt, Human
ggugccaggcuguagucagggu

SEQ ID NO: 1033023 - RNA, 22 nt, Human
ucacugcagagaccucuaguca

SEQ ID NO: 1033024 - RNA, 22 nt, Human
gagcugggcacacgccacuuga

SEQ ID NO: 1033025 - RNA, 22 nt, Human
ugagccuggguggucgaggcug

SEQ ID NO: 1033026 - RNA, 22 nt, Human
gcucugggugaacuuggagcaa

SEQ ID NO: 1033027 - RNA, 22 nt, Human
cccaggaguuugaguucagcau

SEQ ID NO: 1033028 - RNA, 22 nt, Human
uccauaagcagguucuuccuga

SEQ ID NO: 1033029 - RNA, 22 nt, Human
uggcagaguggaccauacucaa

SEQ ID NO: 1033030 - RNA, 22 nt, Human
ggccuugguaaagggaugcaug

SEQ ID NO: 1033031 - RNA, 22 nt, Human
caggagugcagguggugaggca

SEQ ID NO: 1033032 - RNA, 22 nt, Human
caaggagaaaacggcuucugaa

SEQ ID NO: 1033033 - RNA, 22 nt, Human
ugggcagacgggagcuugccuu

SEQ ID NO: 1033034 - RNA, 22 nt, Human
agagcccucucauuggcuuauu

SEQ ID NO: 1033035 - RNA, 22 nt, Human
ggcucaggggccaggccugucc

SEQ ID NO: 1033036 - RNA, 22 nt, Human
ccuccuggcccugggccuggaa

SEQ ID NO: 1033037 - RNA, 22 nt, Human
agggccuggcuucacuuucuca

SEQ ID NO: 1033038 - RNA, 21 nt, Human
gcccagcaaggugagaaggcc

SEQ ID NO: 1033039 - RNA, 22 nt, Human
uacauggguagguuaagucaua

SEQ ID NO: 1033040 - RNA, 22 nt, Human
cagaaguaagauuacugugaga

SEQ ID NO: 1033041 - RNA, 22 nt, Human
cacugcaguaacucuaggacug

SEQ ID NO: 1033042 - RNA, 22 nt, Human
cugccagcagaggccagcgcug

SEQ ID NO: 1033043 - RNA, 20 nt, Human
ucugugugccaucaccuaac

SEQ ID NO: 1033044 - RNA, 22 nt, Human
aucuggcuugacuuugcgacuu

SEQ ID NO: 1033045 - RNA, 22 nt, Human
ugugaaaggggucacagggaaa

SEQ ID NO: 1033046 - RNA, 22 nt, Human
gggcagcugccaagugcaucgc

SEQ ID NO: 1033047 - RNA, 22 nt, Human
auaaggaaugauguaucaguuu

SEQ ID NO: 1033048 - RNA, 22 nt, Human
ugcaguggaaagacucagacuu

SEQ ID NO: 1033049 - RNA, 22 nt, Human
agccucugacugucagcaaggu

SEQ ID NO: 1033050 - RNA, 22 nt, Human
ucaaagucauggcuaguaauga

SEQ ID NO: 1033051 - RNA, 22 nt, Human
aggggcugggacagagccaagc

SEQ ID NO: 1033052 - RNA, 22 nt, Human
ucuggaguccagauccauuugg

SEQ ID NO: 1033053 - RNA, 22 nt, Human
uauguagaagcugcucaaagaa

SEQ ID NO: 1033054 - RNA, 20 nt, Human
cccugagacaaaggaggggc

SEQ ID NO: 1033055 - RNA, 22 nt, Human
ugccugcugcuaagcucuuugu

SEQ ID NO: 1033056 - RNA, 20 nt, Human
gccugagcuccgccuccugu

SEQ ID NO: 1033057 - RNA, 22 nt, Human
uguagcacagagcuuugacacu

SEQ ID NO: 1033058 - RNA, 19 nt, Human
agcagagcccugaagaucc

SEQ ID NO: 1033059 - RNA, 22 nt, Human
cagggccugcuuccuucuuguu

SEQ ID NO: 1033060 - RNA, 22 nt, Human
uguggcuuaagaaugccuuuaa

SEQ ID NO: 1033061 - RNA, 22 nt, Human
aagccagggucaggggccuccu

SEQ ID NO: 1033062 - RNA, 20 nt, Human
gggcuggcgcauggggaaag

SEQ ID NO: 1033063 - RNA, 22 nt, Human
ugcagggcuaagucagagccug

SEQ ID NO: 1033064 - RNA, 22 nt, Human
acaguguccuuguggucccugu

SEQ ID NO: 1033065 - RNA, 23 nt, Human
uccagggauuaaugaagucaguc

SEQ ID NO: 1033066 - RNA, 22 nt, Human
ugccuuccuggagcugaaggcu

SEQ ID NO: 1033067 - RNA, 22 nt, Human
gcuggaccaggugugcacaggc

SEQ ID NO: 1033068 - RNA, 22 nt, Human
uggcugggagcuggaacugggc

SEQ ID NO: 1033069 - RNA, 22 nt, Human
gggccuggggacaccaccauga

SEQ ID NO: 1033070 - RNA, 22 nt, Human
ucagaagaagagacuccacagc

SEQ ID NO: 1033071 - RNA, 22 nt, Human
aaacagaaauuuccucaugcuc

SEQ ID NO: 1033072 - RNA, 22 nt, Human
caggaacacaaguucagggaug

SEQ ID NO: 1033073 - RNA, 22 nt, Human
cagggccucuccuccaggaacu

SEQ ID NO: 1033074 - RNA, 20 nt, Human
ugugugcacacaugacauuc

SEQ ID NO: 1033075 - RNA, 22 nt, Human
guggcugcagagggcacagcau

SEQ ID NO: 1033076 - RNA, 22 nt, Human
cagccagguaugggcgugcggg

SEQ ID NO: 1033077 - RNA, 17 nt, Human
aggugcuggagcaucag

SEQ ID NO: 1033078 - RNA, 22 nt, Human
cccagacuccucuggcuggugg

SEQ ID NO: 1033079 - RNA, 22 nt, Human
cagagccagcuguccuuggcau

SEQ ID NO: 1033080 - RNA, 22 nt, Human
agccuggccacucagggccuga

SEQ ID NO: 1033081 - RNA, 22 nt, Human
gaucaaaagcuggguucuaaaa

SEQ ID NO: 1033082 - RNA, 22 nt, Human
auagacuugguuaguaaauuug

SEQ ID NO: 1033083 - RNA, 22 nt, Human
agagccuggggauuggcaaggg

SEQ ID NO: 1033084 - RNA, 22 nt, Human
agcaccuggucuccuggcgcug

SEQ ID NO: 1033085 - RNA, 22 nt, Human
ggugaaggcacaagagggcaag

SEQ ID NO: 1033086 - RNA, 22 nt, Human
caggacaguauaggcuuuagga

SEQ ID NO: 1033087 - RNA, 19 nt, Human
ugaagcaauaccauuuuug

SEQ ID NO: 1033088 - RNA, 22 nt, Human
ugggcucugaagucagucugcu

SEQ ID NO: 1033089 - RNA, 22 nt, Human
agugaaaacacuaguucuugcc

SEQ ID NO: 1033090 - RNA, 22 nt, Human
uccagcucuaacaugcugggcc

SEQ ID NO: 1033091 - RNA, 22 nt, Human
ucagagugaggcgucaacauga

SEQ ID NO: 1033092 - RNA, 22 nt, Human
uccauguggccagacacuggca

SEQ ID NO: 1033093 - RNA, 22 nt, Human
cugccaaggcuggggaggacaa

SEQ ID NO: 1033094 - RNA, 22 nt, Human
uaagaacauaaauucauacggg

SEQ ID NO: 1033095 - RNA, 22 nt, Human
augugaaacugaagcauccaua

SEQ ID NO: 1033096 - RNA, 22 nt, Human
ggcagccagagggcagcuggau

SEQ ID NO: 1033097 - RNA, 22 nt, Human
ugucccagaucacaggagggga

SEQ ID NO: 1033098 - RNA, 22 nt, Human
gugauuucaaauauagagugag

SEQ ID NO: 1033099 - RNA, 22 nt, Human
gauggggaugagaagugagcag

SEQ ID NO: 1033100 - RNA, 19 nt, Human
cucuggagcagacacugga

SEQ ID NO: 1033101 - RNA, 22 nt, Human
ggagacaguauggcuuguagcu

SEQ ID NO: 1033102 - RNA, 20 nt, Human
cagagcuguuauggaugaug

SEQ ID NO: 1033103 - RNA, 19 nt, Human
uugaggggccaggggagau

SEQ ID NO: 1033104 - RNA, 22 nt, Human
ggagccagggaagcugcuuccu

SEQ ID NO: 1033105 - RNA, 21 nt, Human
ggccugaguauaggacaggcc

SEQ ID NO: 1033106 - RNA, 22 nt, Human
cauuccuuaacguggggagucu

SEQ ID NO: 1033107 - RNA, 22 nt, Human
gcugggagccguaccugucacg

SEQ ID NO: 1033108 - RNA, 22 nt, Human
aagcagccuggacuugggcugg

SEQ ID NO: 1033109 - RNA, 22 nt, Human
caggcacuggggaugcugggau

SEQ ID NO: 1033110 - RNA, 22 nt, Human
ccagcagacacacaggcguggg

SEQ ID NO: 1033111 - RNA, 18 nt, Human
aucucccauuggccaagg

SEQ ID NO: 1033112 - RNA, 22 nt, Human
aacuagaaccacuuguauuucc

SEQ ID NO: 1033113 - RNA, 22 nt, Human
gugucaugggagucagaaguga

SEQ ID NO: 1033114 - RNA, 22 nt, Human
cagaaauguuuauauguggugu

SEQ ID NO: 1033115 - RNA, 22 nt, Human
gacaggaggcagagcucaggug

SEQ ID NO: 1033116 - RNA, 22 nt, Human
ccaggcagagugcuccagaaag

SEQ ID NO: 1033117 - RNA, 22 nt, Human
ggugacugguuuaucuggcagu

SEQ ID NO: 1033118 - RNA, 21 nt, Human
aaggcagaagcauggaaugag

SEQ ID NO: 1033119 - RNA, 22 nt, Human
uggggugguaauacaccguucu

SEQ ID NO: 1033120 - RNA, 22 nt, Human
uucagagcaucucuaaagccag

SEQ ID NO: 1033121 - RNA, 22 nt, Human
agccuucagcaguucaggugcc

SEQ ID NO: 1033122 - RNA, 22 nt, Human
gcugucacaagcaucuggggca

SEQ ID NO: 1033123 - RNA, 22 nt, Human
aaugcagugagccauuaaaugg

SEQ ID NO: 1033124 - RNA, 21 nt, Human
aaguaaaucagagaaauaacc

SEQ ID NO: 1033125 - RNA, 20 nt, Human
ucucugcuguccacauuugc

SEQ ID NO: 1033126 - RNA, 22 nt, Human
ccugugucuuccccacuggugu

SEQ ID NO: 1033127 - RNA, 22 nt, Human
acuggcaguggcagcagaaaga

SEQ ID NO: 1033128 - RNA, 22 nt, Human
uucacauugguucuugauagcu

SEQ ID NO: 1033129 - RNA, 22 nt, Human
uggcucaguuucaguccugguu

SEQ ID NO: 1033130 - RNA, 22 nt, Human
caaagccucugauuucacuugu

SEQ ID NO: 1033131 - RNA, 22 nt, Human
gcuuccucgcugggcagaggca

SEQ ID NO: 1033132 - RNA, 22 nt, Human
cugggggcaagcagacagcugu

SEQ ID NO: 1033133 - RNA, 22 nt, Human
agugacugggcagggcagggcc

SEQ ID NO: 1033134 - RNA, 22 nt, Human
agggcuggaggguacuaguuua

SEQ ID NO: 1033135 - RNA, 22 nt, Human
aaaugcaccuugcugugagacu

SEQ ID NO: 1033136 - RNA, 22 nt, Human
uggcucaggccacuucuuuuau

SEQ ID NO: 1033137 - RNA, 22 nt, Human
caggagacaauggcuguggggc

SEQ ID NO: 1033138 - RNA, 22 nt, Human
gagcugucucuauaugaaugcu

SEQ ID NO: 1033139 - RNA, 22 nt, Human
aaucaguuagaaggaagagaau

SEQ ID NO: 1033140 - RNA, 22 nt, Human
agccacagucugaugccugaga

SEQ ID NO: 1033141 - RNA, 22 nt, Human
cuggagccacuuuuuauccuuu

SEQ ID NO: 1033142 - RNA, 22 nt, Human
agcagggcuucugugccugugc

SEQ ID NO: 1033143 - RNA, 21 nt, Human
cagaggggcuagccuggcugc

SEQ ID NO: 1033144 - RNA, 22 nt, Human
ucagaggaccuuacugagaacc

SEQ ID NO: 1033145 - RNA, 22 nt, Human
ucccagagucuucuccuguaau

SEQ ID NO: 1033146 - RNA, 22 nt, Human
caggagugaguuggggucuaca

SEQ ID NO: 1033147 - RNA, 22 nt, Human
ucugagaguacgggcugcgcgc

SEQ ID NO: 1033148 - RNA, 22 nt, Human
gcagagcagugcuugcccagcg

SEQ ID NO: 1033149 - RNA, 22 nt, Human
cugcccuggcagccuaccaugg

SEQ ID NO: 1033150 - RNA, 18 nt, Human
ucagcuggggcugcagcc

SEQ ID NO: 1033151 - RNA, 22 nt, Human
uggaggagggcuggugucugua

SEQ ID NO: 1033152 - RNA, 22 nt, Human
aggugauguccacagcuugcag

SEQ ID NO: 1033153 - RNA, 22 nt, Human
uaaaauguguuucuguaugguu

SEQ ID NO: 1033154 - RNA, 22 nt, Human
gugccuggcaugcgccggugcu

SEQ ID NO: 1033155 - RNA, 22 nt, Human
caaagggcucuagacucagcag

SEQ ID NO: 1033156 - RNA, 22 nt, Human
acaggccugacacacagagggc

SEQ ID NO: 1033157 - RNA, 22 nt, Human
ucaaaguccuugcuuuuucugu

SEQ ID NO: 1033158 - RNA, 22 nt, Human
gcagggucugaggccacagagg

SEQ ID NO: 1033159 - RNA, 22 nt, Human
ggccagggccuggggacugucc

SEQ ID NO: 1033160 - RNA, 20 nt, Human
ggggcccaagcccucuugcc

SEQ ID NO: 1033161 - RNA, 22 nt, Human
cucaggagaugacagaagguau

SEQ ID NO: 1033162 - RNA, 22 nt, Human
aaguucuacuguggguaaaaug

SEQ ID NO: 1033163 - RNA, 22 nt, Human
gcuggggagcuagaccucagca

SEQ ID NO: 1033164 - RNA, 23 nt, Human
cccagcagauuguaaagugucca

SEQ ID NO: 1033165 - RNA, 22 nt, Human
gccuggagcucggcugagggcg

SEQ ID NO: 1033166 - RNA, 22 nt, Human
acagggucaagggugcuacaag

SEQ ID NO: 1033167 - RNA, 22 nt, Human
gcagggccagggcucaggcugu

SEQ ID NO: 1033168 - RNA, 22 nt, Human
aaggucauuuaacaauuuauga

SEQ ID NO: 1033169 - RNA, 22 nt, Human
ccucuccuugcacccgucccgc

SEQ ID NO: 1033170 - RNA, 22 nt, Human
aauguguacaugacagauagaa

SEQ ID NO: 1033171 - RNA, 22 nt, Human
ggccuggcauggggacuaaggg

SEQ ID NO: 1033172 - RNA, 18 nt, Human
gccugggaggaggaaaug

SEQ ID NO: 1033173 - RNA, 22 nt, Human
uuucaugugcaauuagcaauau

SEQ ID NO: 1033174 - RNA, 22 nt, Human
agucccagaucuacaggaggga

SEQ ID NO: 1033175 - RNA, 22 nt, Human
agggugccugcugcagguucag

SEQ ID NO: 1033176 - RNA, 17 nt, Human
ccagguggaaucgugga

SEQ ID NO: 1033177 - RNA, 23 nt, Human
aaggucacagaacuuagcaagcc

SEQ ID NO: 1033178 - RNA, 19 nt, Human
ggcugucuggcguguggau

SEQ ID NO: 1033179 - RNA, 22 nt, Human
ugucucagaauggcucauaaua

SEQ ID NO: 1033180 - RNA, 22 nt, Human
cugugaggcccugggugcugga

SEQ ID NO: 1033181 - RNA, 22 nt, Human
cucuggccgcagcucagcucug

SEQ ID NO: 1033182 - RNA, 22 nt, Human
ggagcugaugacgucaccaugg

SEQ ID NO: 1033183 - RNA, 22 nt, Human
ucaggcugcccguucagggcuc

SEQ ID NO: 1033184 - RNA, 20 nt, Human
cagcccuccaguggaggcag

SEQ ID NO: 1033185 - RNA, 22 nt, Human
uacaaagccugguagauaucug

SEQ ID NO: 1033186 - RNA, 22 nt, Human
cugggccugucagggcuuuuug

SEQ ID NO: 1033187 - RNA, 22 nt, Human
ucaagauaccaccauuauaugu

SEQ ID NO: 1033188 - RNA, 22 nt, Human
ccuguggcugccacuuggguga

SEQ ID NO: 1033189 - RNA, 22 nt, Human
agccaaggagugcagguggcuu

SEQ ID NO: 1033190 - RNA, 22 nt, Human
cugagccauccauaccagcuua

SEQ ID NO: 1033191 - RNA, 19 nt, Human
aggcagcacccaguccuug

SEQ ID NO: 1033192 - RNA, 22 nt, Human
gcaggcaguugcaguuuucuag

SEQ ID NO: 1033193 - RNA, 22 nt, Human
uggacaggaucugagacugaga

SEQ ID NO: 1033194 - RNA, 22 nt, Human
agagcuguggauaguccuggau

SEQ ID NO: 1033195 - RNA, 22 nt, Human
uuguuuugcuaaagggucauca

SEQ ID NO: 1033196 - RNA, 22 nt, Human
auguaacuguuauauuuuguug

SEQ ID NO: 1033197 - RNA, 18 nt, Human
auccuugaugagaggucu

SEQ ID NO: 1033198 - RNA, 22 nt, Human
ccugucuggccuuccacggggg

SEQ ID NO: 1033199 - RNA, 22 nt, Human
gggacugggagauccuccuggc

SEQ ID NO: 1033200 - RNA, 22 nt, Human
ucaaaugcugccuuugugugcc

SEQ ID NO: 1033201 - RNA, 22 nt, Human
ucuuccagcaaugugaaaucac

SEQ ID NO: 1033202 - RNA, 22 nt, Human
auaugcauaugucaaaacuuau

SEQ ID NO: 1033203 - RNA, 22 nt, Human
aggauccuccuuagaaaagacc

SEQ ID NO: 1033204 - RNA, 22 nt, Human
cuccagggggcauccacacagc

SEQ ID NO: 1033205 - RNA, 22 nt, Human
cuguguggacugguugaggccc

SEQ ID NO: 1033206 - RNA, 22 nt, Human
agccagugcaacagcagugaag

SEQ ID NO: 1033207 - RNA, 22 nt, Human
gcccacagcucguuccucuccu

SEQ ID NO: 1033208 - RNA, 18 nt, Human
cccucuccugcuaguggg

SEQ ID NO: 1033209 - RNA, 22 nt, Human
ucucagggcgcagugaggcagu

SEQ ID NO: 1033210 - RNA, 22 nt, Human
gaaugcagauggcugguguaug

SEQ ID NO: 1033211 - RNA, 22 nt, Human
cugagccacugcuuguucagug

SEQ ID NO: 1033212 - RNA, 22 nt, Human
ugccugaguuuaacccucagag

SEQ ID NO: 1033213 - RNA, 22 nt, Human
gugcagugagcagugcagcacc

SEQ ID NO: 1033214 - RNA, 22 nt, Human
aauguguagauguugcauuccu

SEQ ID NO: 1033215 - RNA, 22 nt, Human
acagagaugcaaguguguauuu

SEQ ID NO: 1033216 - RNA, 17 nt, Human
ugaggccugcaucagug

SEQ ID NO: 1033217 - RNA, 22 nt, Human
accagagcagacuacuggaggu

SEQ ID NO: 1033218 - RNA, 22 nt, Human
ugaugcugcugggaguggugcu

SEQ ID NO: 1033219 - RNA, 22 nt, Human
caguacuuugcaucauuccacu

SEQ ID NO: 1033220 - RNA, 22 nt, Human
ccuggcagcaggugggcccgug

SEQ ID NO: 1033221 - RNA, 22 nt, Human
ugaaaucuuuaguuucuguccc

SEQ ID NO: 1033222 - RNA, 17 nt, Human
agcugccagggagugug

SEQ ID NO: 1033223 - RNA, 22 nt, Human
ccagggcagccaacccagaugc

SEQ ID NO: 1033224 - RNA, 22 nt, Human
cucagaauuacaucccauuuua

SEQ ID NO: 1033225 - RNA, 17 nt, Human
ggccuuggggccucagu

SEQ ID NO: 1033226 - RNA, 22 nt, Human
ggcuggagauaugucuggaaca

SEQ ID NO: 1033227 - RNA, 19 nt, Human
aagaagcaauaagcuguga

SEQ ID NO: 1033228 - RNA, 22 nt, Human
acagggucauuuuaugaucugu

SEQ ID NO: 1033229 - RNA, 22 nt, Human
ucaucuaagagucuuacauuua

SEQ ID NO: 1033230 - RNA, 22 nt, Human
caguuucuacgacuuaagcaca

SEQ ID NO: 1033231 - RNA, 22 nt, Human
cuggggacuugcagacacaauu

SEQ ID NO: 1033232 - RNA, 22 nt, Human
gaggaaugucagcacaggccuc

SEQ ID NO: 1033233 - RNA, 22 nt, Human
cugggccugggaggccaggucu

SEQ ID NO: 1033234 - RNA, 22 nt, Human
gcuccuggucuggagcuucaag

SEQ ID NO: 1033235 - RNA, 22 nt, Human
aggaggugacagccugcaucug

SEQ ID NO: 1033236 - RNA, 22 nt, Human
ugcagggcuuccucuuggaguu

SEQ ID NO: 1033237 - RNA, 22 nt, Human
gagagcuguccggcugagcagc

SEQ ID NO: 1033238 - RNA, 22 nt, Human
aucagcugaaaaacaggcagca

SEQ ID NO: 1033239 - RNA, 22 nt, Human
acagccuguuugaucuggugcu

SEQ ID NO: 1033240 - RNA, 22 nt, Human
agacagaacagaauaauuguug

SEQ ID NO: 1033241 - RNA, 22 nt, Human
ugcaagagguaaaaugaaagga

SEQ ID NO: 1033242 - RNA, 22 nt, Human
ccagggccucguguucugagug

SEQ ID NO: 1033243 - RNA, 22 nt, Human
aaaaguguccagauuaugaaga

SEQ ID NO: 1033244 - RNA, 22 nt, Human
ugucucagggcagcagcagggg

SEQ ID NO: 1033245 - RNA, 22 nt, Human
accaucagucacauguagagaa

SEQ ID NO: 1033246 - RNA, 21 nt, Human
ccagcagcucaaggaucucuu

SEQ ID NO: 1033247 - RNA, 22 nt, Human
uagcugucagcaaucaaguggu

SEQ ID NO: 1033248 - RNA, 18 nt, Human
aggccagcccugcuacug

SEQ ID NO: 1033249 - RNA, 22 nt, Human
gagggcaguagccucguacccu

SEQ ID NO: 1033250 - RNA, 22 nt, Human
agggcugccugcucugcauuga

SEQ ID NO: 1033251 - RNA, 22 nt, Human
gaaaaaugcuccaaaucugugg

SEQ ID NO: 1033252 - RNA, 22 nt, Human
auccaggguguggagagagcuc

SEQ ID NO: 1033253 - RNA, 22 nt, Human
auccuugagaaaauaaaugacc

SEQ ID NO: 1033254 - RNA, 22 nt, Human
aggggugauuugggacaggaca

SEQ ID NO: 1033255 - RNA, 21 nt, Human
gugguuauuuucauuagcauc

SEQ ID NO: 1033256 - RNA, 22 nt, Human
gcucccagcauugcuucccagg

SEQ ID NO: 1033257 - RNA, 22 nt, Human
uggcugccuuucaccucaucuc

SEQ ID NO: 1033258 - RNA, 22 nt, Human
cccaaggcauggcaugguggca

SEQ ID NO: 1033259 - RNA, 21 nt, Human
gccugcagaccccaccaggcu

SEQ ID NO: 1033260 - RNA, 20 nt, Human
accauaauguuaauuacaaa

SEQ ID NO: 1033261 - RNA, 22 nt, Human
uacccagcuucaagucaggacu

SEQ ID NO: 1033262 - RNA, 22 nt, Human
aggcuggcgacaucuggcgggc

SEQ ID NO: 1033263 - RNA, 21 nt, Human
gagccuucccucugcccuuuc

SEQ ID NO: 1033264 - RNA, 22 nt, Human
uacaguaucuucuggcaagcau

SEQ ID NO: 1033265 - RNA, 22 nt, Human
aggcucugcagugcuggaggac

SEQ ID NO: 1033266 - RNA, 21 nt, Human
ugauuuccaucuuaaaauaaa

SEQ ID NO: 1033267 - RNA, 22 nt, Human
gggagggaucugcuaggcaaug

SEQ ID NO: 1033268 - RNA, 23 nt, Human
acacaaggguaacugccagccau

SEQ ID NO: 1033269 - RNA, 22 nt, Human
ggcugagccuggagcaucuggu

SEQ ID NO: 1033270 - RNA, 22 nt, Human
caggcagcagaggaguguggga

SEQ ID NO: 1033271 - RNA, 22 nt, Human
agcugccacauggugucacugu

SEQ ID NO: 1033272 - RNA, 22 nt, Human
gaaaugcauggaucuuggcaga

SEQ ID NO: 1033273 - RNA, 17 nt, Human
gagagcugcugcuuccg

SEQ ID NO: 1033274 - RNA, 22 nt, Human
uuuccuuccuugcuagccugag

SEQ ID NO: 1033275 - RNA, 23 nt, Human
uccagcagagccuuccaggaggg

SEQ ID NO: 1033276 - RNA, 22 nt, Human
gcagauggcugagccugcagau

SEQ ID NO: 1033277 - RNA, 22 nt, Human
cagagcugguaagugguagagg

SEQ ID NO: 1033278 - RNA, 22 nt, Human
cuuugcauacaauuuuuagaaa

SEQ ID NO: 1033279 - RNA, 22 nt, Human
cagcuugggaguuugguuuuau

SEQ ID NO: 1033280 - RNA, 22 nt, Human
gcugcucugaaaaugacuguug

SEQ ID NO: 1033281 - RNA, 22 nt, Human
agcuggccuccgggugccuggg

SEQ ID NO: 1033282 - RNA, 19 nt, Human
aguguguacugaaagcacu

SEQ ID NO: 1033283 - RNA, 22 nt, Human
ggcagggcuugucucugugaug

SEQ ID NO: 1033284 - RNA, 22 nt, Human
cuuccugaacaaugccaucaau

SEQ ID NO: 1033285 - RNA, 22 nt, Human
agccaaagaucagugugcaagu

SEQ ID NO: 1033286 - RNA, 22 nt, Human
ccucuugccaaucagcuacaga

SEQ ID NO: 1033287 - RNA, 22 nt, Human
cucugaagggagggccaagccc

SEQ ID NO: 1033288 - RNA, 22 nt, Human
gcagacuggucuucagccuugg

SEQ ID NO: 1033289 - RNA, 22 nt, Human
ccugcagcuguaggagaaggcg

SEQ ID NO: 1033290 - RNA, 22 nt, Human
uguaugugcuugagaagguggg

SEQ ID NO: 1033291 - RNA, 22 nt, Human
ggcaaggccuugcccagcauuc

SEQ ID NO: 1033292 - RNA, 19 nt, Human
ucuaacagaagugucgucc

SEQ ID NO: 1033293 - RNA, 22 nt, Human
aggagagagaacacuugggucc

SEQ ID NO: 1033294 - RNA, 22 nt, Human
ccagggugaggaggcucccacg

SEQ ID NO: 1033295 - RNA, 23 nt, Human
gcugagguacauuuacaggaaga

SEQ ID NO: 1033296 - RNA, 22 nt, Human
cccaggcuggagugcaauggug

SEQ ID NO: 1033297 - RNA, 22 nt, Human
ucuggcuccguguccgcuccca

SEQ ID NO: 1033298 - RNA, 22 nt, Human
agcagcaggcuguguggacuga

SEQ ID NO: 1033299 - RNA, 19 nt, Human
acaggcagaauugggugug

SEQ ID NO: 1033300 - RNA, 22 nt, Human
gccuuccuuuuaccaccagcca

SEQ ID NO: 1033301 - RNA, 22 nt, Human
agccucucuccagcuuggcaga

SEQ ID NO: 1033302 - RNA, 22 nt, Human
uggcuggcaguaggcuaguggc

SEQ ID NO: 1033303 - RNA, 22 nt, Human
gggcuccaacggugagcaugga

SEQ ID NO: 1033304 - RNA, 22 nt, Human
ggcucugcagugacuugagggg

SEQ ID NO: 1033305 - RNA, 22 nt, Human
ccaaaguccuuucuccaccugc

SEQ ID NO: 1033306 - RNA, 22 nt, Human
aaaggucauugaaaaggaggaa

SEQ ID NO: 1033307 - RNA, 22 nt, Human
gaaggagacccugaagaugcug

SEQ ID NO: 1033308 - RNA, 22 nt, Human
augcuuuuccuaaaaugaugcc

SEQ ID NO: 1033309 - RNA, 22 nt, Human
ugaaaaggaguccuuguuuuca

SEQ ID NO: 1033310 - RNA, 22 nt, Human
ccagggcagcagaauuggggca

SEQ ID NO: 1033311 - RNA, 22 nt, Human
caaagugcuggaauuacaggug

SEQ ID NO: 1033312 - RNA, 22 nt, Human
caggugggagcggagacugauu

SEQ ID NO: 1033313 - RNA, 22 nt, Human
agaugcugccucuccucacaag

SEQ ID NO: 1033314 - RNA, 22 nt, Human
aggcucauucuugccucugagc

SEQ ID NO: 1033315 - RNA, 23 nt, Human
aucaaacuggugagaaugucagu

SEQ ID NO: 1033316 - RNA, 22 nt, Human
gagcugccugugugccaugaug

SEQ ID NO: 1033317 - RNA, 22 nt, Human
ggcugugcgggcagccguggga

SEQ ID NO: 1033318 - RNA, 22 nt, Human
aaugaacaucaaaugccuacca

SEQ ID NO: 1033319 - RNA, 22 nt, Human
ggagggagcauccccuugcuga

SEQ ID NO: 1033320 - RNA, 18 nt, Human
agggucagugucacuggc

SEQ ID NO: 1033321 - RNA, 22 nt, Human
uuugcauugccucugacuuaug

SEQ ID NO: 1033322 - RNA, 22 nt, Human
gaggcagcugaaggagugacag

SEQ ID NO: 1033323 - RNA, 22 nt, Human
ccagugcacagccaggcaggug

SEQ ID NO: 1033324 - RNA, 22 nt, Human
gggcacugugcuaggugcugag

SEQ ID NO: 1033325 - RNA, 22 nt, Human
gccuucugaucgcuggacugac

SEQ ID NO: 1033326 - RNA, 22 nt, Human
guggcagcggcccaggccgucu

SEQ ID NO: 1033327 - RNA, 22 nt, Human
agccagcaugaagacagaggcc

SEQ ID NO: 1033328 - RNA, 19 nt, Human
guaagggcuaauggacuau

SEQ ID NO: 1033329 - RNA, 22 nt, Human
ccugucuguauugguuugcuau

SEQ ID NO: 1033330 - RNA, 22 nt, Human
caguagcaggcaggugcuuuug

SEQ ID NO: 1033331 - RNA, 22 nt, Human
ucaggccacggcucacugagac

SEQ ID NO: 1033332 - RNA, 22 nt, Human
ucagaggguggcugggagcauc

SEQ ID NO: 1033333 - RNA, 22 nt, Human
cagcuggcauaccugggcccgg

SEQ ID NO: 1033334 - RNA, 22 nt, Human
uggcagcugaggggaggcuuug

SEQ ID NO: 1033335 - RNA, 22 nt, Human
ugcacacaguucucaggaaaga

SEQ ID NO: 1033336 - RNA, 22 nt, Human
gggugggagucuggcccucaaa

SEQ ID NO: 1033337 - RNA, 22 nt, Human
cacagggcagaggguccguggc

SEQ ID NO: 1033338 - RNA, 22 nt, Human
ccugccucaucaacuugucgug

SEQ ID NO: 1033339 - RNA, 22 nt, Human
ucaguuuuuacggucacaggga

SEQ ID NO: 1033340 - RNA, 22 nt, Human
acagccagggucucaggaggcg

SEQ ID NO: 1033341 - RNA, 22 nt, Human
ugggccugaaggagcugcgccc

SEQ ID NO: 1033342 - RNA, 22 nt, Human
caaauguguuuuuucuucuaca

SEQ ID NO: 1033343 - RNA, 22 nt, Human
acacacaacucauuguguaaua

SEQ ID NO: 1033344 - RNA, 18 nt, Human
agcagaauucuaggguuc

SEQ ID NO: 1033345 - RNA, 22 nt, Human
uuccucuccucccaccagguga

SEQ ID NO: 1033346 - RNA, 22 nt, Human
caggcagcugggucaccguccc

SEQ ID NO: 1033347 - RNA, 21 nt, Human
accaggcuugugggagggagc

SEQ ID NO: 1033348 - RNA, 22 nt, Human
cacugcuuucacaguuuguucc

SEQ ID NO: 1033349 - RNA, 22 nt, Human
aggcacugguccauuuucugca

SEQ ID NO: 1033350 - RNA, 22 nt, Human
gcucugcugagauaucugggag

SEQ ID NO: 1033351 - RNA, 22 nt, Human
uucaagguaugguagcugguca

SEQ ID NO: 1033352 - RNA, 22 nt, Human
ggaaagagcccagcagugcuug

SEQ ID NO: 1033353 - RNA, 22 nt, Human
uccugcagaccucagucagguc

SEQ ID NO: 1033354 - RNA, 22 nt, Human
aagcugcccucauucccagugc

SEQ ID NO: 1033355 - RNA, 22 nt, Human
ugguggccuugauggcaucugc

SEQ ID NO: 1033356 - RNA, 22 nt, Human
ggagugacucucggggccacua

SEQ ID NO: 1033357 - RNA, 23 nt, Human
uuguuuuuagagguggcaugaga

SEQ ID NO: 1033358 - RNA, 22 nt, Human
guguuuccucuagaagccaugg

SEQ ID NO: 1033359 - RNA, 22 nt, Human
cuuauguauaauguuccacaua

SEQ ID NO: 1033360 - RNA, 22 nt, Human
ggcugccauaacugauaccaua

SEQ ID NO: 1033361 - RNA, 22 nt, Human
gaugcugaagugaagugaucuu

SEQ ID NO: 1033362 - RNA, 22 nt, Human
uggccuggugucugcgaggccu

SEQ ID NO: 1033363 - RNA, 22 nt, Human
gcucaagggaugggagugggug

SEQ ID NO: 1033364 - RNA, 22 nt, Human
aggcagcaaagaaaugaugcug

SEQ ID NO: 1033365 - RNA, 22 nt, Human
cagcagaggaaagcaaaucuaa

SEQ ID NO: 1033366 - RNA, 22 nt, Human
uggccuggccacauccagcagg

SEQ ID NO: 1033367 - RNA, 22 nt, Human
cagaaauguucuaaugauucag

SEQ ID NO: 1033368 - RNA, 20 nt, Human
acaggagaucugaggaaagg

SEQ ID NO: 1033369 - RNA, 22 nt, Human
cauuuagacauuugauuugggg

SEQ ID NO: 1033370 - RNA, 22 nt, Human
cacagcagaaauaugaaggcag

SEQ ID NO: 1033371 - RNA, 17 nt, Human
accagccucuccugggg

SEQ ID NO: 1033372 - RNA, 22 nt, Human
uggcacugggacagaugcucuc

SEQ ID NO: 1033373 - RNA, 22 nt, Human
ucucagagcuucaguuauuuuc

SEQ ID NO: 1033374 - RNA, 19 nt, Human
agcauccagucaugggauc

SEQ ID NO: 1033375 - RNA, 22 nt, Human
acugcuuuucagagucugccug

SEQ ID NO: 1033376 - RNA, 22 nt, Human
gcacugcaucuacuggcaagua

SEQ ID NO: 1033377 - RNA, 22 nt, Human
cauuucugucacguucuuuuau

SEQ ID NO: 1033378 - RNA, 22 nt, Human
ugaagccacagagcaucugccu

SEQ ID NO: 1033379 - RNA, 22 nt, Human
ugcagcugaggccagcuaugcc

SEQ ID NO: 1033380 - RNA, 22 nt, Human
gacagagugcagggcuagaaga

SEQ ID NO: 1033381 - RNA, 22 nt, Human
cuugugcaauugacauugaauc

SEQ ID NO: 1033382 - RNA, 22 nt, Human
ggccccugcggacugccuagag

SEQ ID NO: 1033383 - RNA, 22 nt, Human
acaggcugacuuccugccaugu

SEQ ID NO: 1033384 - RNA, 22 nt, Human
guucagggagggacagaugaag

SEQ ID NO: 1033385 - RNA, 22 nt, Human
cugucucucuaggacacugggg

SEQ ID NO: 1033386 - RNA, 22 nt, Human
uuaucguacgcuucagaaauuu

SEQ ID NO: 1033387 - RNA, 22 nt, Human
ugggggugacuaucucgggaau

SEQ ID NO: 1033388 - RNA, 22 nt, Human
uacaguagacaauguuaguaug

SEQ ID NO: 1033389 - RNA, 22 nt, Human
acauuucuaauuuaauguaaca

SEQ ID NO: 1033390 - RNA, 22 nt, Human
cucagggcaguauggcugagag

SEQ ID NO: 1033391 - RNA, 22 nt, Human
uauguacaucguugaauucaaa

SEQ ID NO: 1033392 - RNA, 22 nt, Human
cacaugggcguaauguccaugg

SEQ ID NO: 1033393 - RNA, 20 nt, Human
cuuggccuacuuagcuuugu

SEQ ID NO: 1033394 - RNA, 22 nt, Human
cuucaagaagacagcagagcau

SEQ ID NO: 1033395 - RNA, 22 nt, Human
cacagcugccauggcugcacuu

SEQ ID NO: 1033396 - RNA, 22 nt, Human
gggcacuguacacugugcaugg

SEQ ID NO: 1033397 - RNA, 22 nt, Human
gcagagccugggggucugcgga

SEQ ID NO: 1033398 - RNA, 22 nt, Human
agcugggucuugggccaggaga

SEQ ID NO: 1033399 - RNA, 22 nt, Human
cugucugcuagaacaucuauac

SEQ ID NO: 1033400 - RNA, 20 nt, Human
gcaaauggaucccacaagcc

SEQ ID NO: 1033401 - RNA, 22 nt, Human
caggcagcucgaugccuuguug

SEQ ID NO: 1033402 - RNA, 22 nt, Human
ugucaccagcugcuccucagga

SEQ ID NO: 1033403 - RNA, 22 nt, Human
ugacucuguaccugucugccuu

SEQ ID NO: 1033404 - RNA, 17 nt, Human
agaaagaggauccacag

SEQ ID NO: 1033405 - RNA, 22 nt, Human
uggcagcagccauggaaggccc

SEQ ID NO: 1033406 - RNA, 21 nt, Human
aaauguguuccauaaugcuuu

SEQ ID NO: 1033407 - RNA, 22 nt, Human
gccugaagaacagcugugagga

SEQ ID NO: 1033408 - RNA, 22 nt, Human
caguggaggcucaagugugcuu

SEQ ID NO: 1033409 - RNA, 22 nt, Human
uuucuuauauucugucauuguu

SEQ ID NO: 1033410 - RNA, 22 nt, Human
agcuggcccucgagagccaauu

SEQ ID NO: 1033411 - RNA, 22 nt, Human
gcaggagagucugugccagguu

SEQ ID NO: 1033412 - RNA, 22 nt, Human
ucugucacccagagugcagugg

SEQ ID NO: 1033413 - RNA, 22 nt, Human
gcucuguacgcaggaugagggg

SEQ ID NO: 1033414 - RNA, 22 nt, Human
augaaacaugagaaauggagag

SEQ ID NO: 1033415 - RNA, 22 nt, Human
uguggccuugcagccuggaggu

SEQ ID NO: 1033416 - RNA, 22 nt, Human
ucucaggccccugaguuucucu

SEQ ID NO: 1033417 - RNA, 22 nt, Human
gccaggcugaggcucuggaaga

SEQ ID NO: 1033418 - RNA, 22 nt, Human
cccauuuaaacacaagcuuuca

SEQ ID NO: 1033419 - RNA, 22 nt, Human
cagcuccugcagcugcugccgu

SEQ ID NO: 1033420 - RNA, 22 nt, Human
cccaggccccagggcuugucag

SEQ ID NO: 1033421 - RNA, 22 nt, Human
uuuccucuucuggcaggcaggg

SEQ ID NO: 1033422 - RNA, 22 nt, Human
uagcugcccaucuuuccuuuag

SEQ ID NO: 1033423 - RNA, 22 nt, Human
ggcacagggagccgcaguugca

SEQ ID NO: 1033424 - RNA, 22 nt, Human
ugcagcugauuaaagggcagac

SEQ ID NO: 1033425 - RNA, 22 nt, Human
cagccucuaagcacagccucuc

SEQ ID NO: 1033426 - RNA, 22 nt, Human
agagccugggaauuugcauguu

SEQ ID NO: 1033427 - RNA, 22 nt, Human
uaacagaaaggggacagaaaua

SEQ ID NO: 1033428 - RNA, 22 nt, Human
aagaguuuucuauaaucuuggc

SEQ ID NO: 1033429 - RNA, 22 nt, Human
uccauuuacuauucucauaucg

SEQ ID NO: 1033430 - RNA, 22 nt, Human
auauguguacgugcaguauaua

SEQ ID NO: 1033431 - RNA, 22 nt, Human
agggggcccuugcaggugagcg

SEQ ID NO: 1033432 - RNA, 22 nt, Human
caugggcuuuggaggcuggagg

SEQ ID NO: 1033433 - RNA, 22 nt, Human
ggcugggcucgcugauuggcug

SEQ ID NO: 1033434 - RNA, 22 nt, Human
cagagcuguugcggggcuuggc

SEQ ID NO: 1033435 - RNA, 22 nt, Human
ucccagccuuucuuuucugcug

SEQ ID NO: 1033436 - RNA, 22 nt, Human
agggcugcaggcaagauauggc

SEQ ID NO: 1033437 - RNA, 22 nt, Human
ucuggcuccugaguccaugcuc

SEQ ID NO: 1033438 - RNA, 22 nt, Human
ucaacacuauccaggcaaucuu

SEQ ID NO: 1033439 - RNA, 22 nt, Human
cuguacaucccgagagccagua

SEQ ID NO: 1033440 - RNA, 22 nt, Human
gagcccagguucugcuuccagc

SEQ ID NO: 1033441 - RNA, 18 nt, Human
cuuucagauggauaugcu

SEQ ID NO: 1033442 - RNA, 21 nt, Human
gagugcagcaagguagagucu

SEQ ID NO: 1033443 - RNA, 22 nt, Human
auacaaguugugauaauguaaa

SEQ ID NO: 1033444 - RNA, 21 nt, Human
ucccugcuuucuggcccaguc

SEQ ID NO: 1033445 - RNA, 22 nt, Human
gcugcaggagcuggagcugugg

SEQ ID NO: 1033446 - RNA, 22 nt, Human
cuuggcugucuauaggaaagag

SEQ ID NO: 1033447 - RNA, 22 nt, Human
ccaggcugggcggggaaccugg

SEQ ID NO: 1033448 - RNA, 22 nt, Human
aucuggcugcugugcuuaagcu

SEQ ID NO: 1033449 - RNA, 22 nt, Human
agggccuggcgcguggccgccg

SEQ ID NO: 1033450 - RNA, 22 nt, Human
uauagaaguaagcauugugaug

SEQ ID NO: 1033451 - RNA, 22 nt, Human
ggggagaguccuuuccaguucc

SEQ ID NO: 1033452 - RNA, 22 nt, Human
gccucucucuacccaguaugau

SEQ ID NO: 1033453 - RNA, 22 nt, Human
gcagagcucaagguguucagcu

SEQ ID NO: 1033454 - RNA, 22 nt, Human
cuggcagcuuccuuugcaucug

SEQ ID NO: 1033455 - RNA, 22 nt, Human
gaggaguguauuccacaccacu

SEQ ID NO: 1033456 - RNA, 22 nt, Human
uuccauaaaggugauaguauac

SEQ ID NO: 1033457 - RNA, 22 nt, Human
uuuauguaguuacggacuauca

SEQ ID NO: 1033458 - RNA, 22 nt, Human
uuucagauggagguuuaggaca

SEQ ID NO: 1033459 - RNA, 22 nt, Human
augauacaucuucaugucagug

SEQ ID NO: 1033460 - RNA, 22 nt, Human
gaagcccagggcguggccgggc

SEQ ID NO: 1033461 - RNA, 22 nt, Human
gaagcagcuuucuggugaggag

SEQ ID NO: 1033462 - RNA, 22 nt, Human
ucauccaguuguggagagggaa

SEQ ID NO: 1033463 - RNA, 22 nt, Human
gccucugcggagcuguacauca

SEQ ID NO: 1033464 - RNA, 22 nt, Human
ggugcagaucuuucucuucagg

SEQ ID NO: 1033465 - RNA, 22 nt, Human
gagccugaauuugaccugcuua

SEQ ID NO: 1033466 - RNA, 22 nt, Human
gggaaauugucaacacucucaa

SEQ ID NO: 1033467 - RNA, 22 nt, Human
agcugccugcuuaugagcucca

SEQ ID NO: 1033468 - RNA, 23 nt, Human
uuucuguuggguauauauccaag

SEQ ID NO: 1033469 - RNA, 22 nt, Human
cagcccugccauggagccuccu

SEQ ID NO: 1033470 - RNA, 22 nt, Human
gagagcccugcuccuaucccag

SEQ ID NO: 1033471 - RNA, 19 nt, Human
acagaagcauagaaaagga

SEQ ID NO: 1033472 - RNA, 22 nt, Human
gucuggagccacccuaagcauu

SEQ ID NO: 1033473 - RNA, 22 nt, Human
cugugcaagcccaagauaaaac

SEQ ID NO: 1033474 - RNA, 22 nt, Human
auccugggaagcugacauugaa

SEQ ID NO: 1033475 - RNA, 22 nt, Human
cccaggagguggagguugcagc

SEQ ID NO: 1033476 - RNA, 22 nt, Human
gguucacauauugagaguauuc

SEQ ID NO: 1033477 - RNA, 22 nt, Human
agcuuccucaccucagaggucu

SEQ ID NO: 1033478 - RNA, 22 nt, Human
aaaugucuuucuucugcuacgu

SEQ ID NO: 1033479 - RNA, 22 nt, Human
uauucacaaaaugagguccuca

SEQ ID NO: 1033480 - RNA, 22 nt, Human
ggggcugggauuugaacccagg

SEQ ID NO: 1033481 - RNA, 22 nt, Human
cuuacauugucuuaguuuucaa

SEQ ID NO: 1033482 - RNA, 22 nt, Human
auuucuucaggucagaaauaga

SEQ ID NO: 1033483 - RNA, 22 nt, Human
aggcacugaagaacucuuuuug

SEQ ID NO: 1033484 - RNA, 22 nt, Human
uaaaugugcacuuuacuuuuca

SEQ ID NO: 1033485 - RNA, 22 nt, Human
cuggccagaguuggagggugug

SEQ ID NO: 1033486 - RNA, 22 nt, Human
agagccagccuucucagcuuac

SEQ ID NO: 1033487 - RNA, 22 nt, Human
uuuuaaguuaauauaauugagg

SEQ ID NO: 1033488 - RNA, 20 nt, Human
ugggagcuggugaggucuca

SEQ ID NO: 1033489 - RNA, 17 nt, Human
uggacccuugggccucc

SEQ ID NO: 1033490 - RNA, 18 nt, Human
cagagcagagguggagcg

SEQ ID NO: 1033491 - RNA, 22 nt, Human
ugaaacagucuccagacuugga

SEQ ID NO: 1033492 - RNA, 22 nt, Human
ccagcccugucaccaacuggag

SEQ ID NO: 1033493 - RNA, 22 nt, Human
ggcaaaguuuucaucucauaac

SEQ ID NO: 1033494 - RNA, 22 nt, Human
cuggcuuccucaggagcagugg

SEQ ID NO: 1033495 - RNA, 22 nt, Human
uugggcugaaguagagggcaga

SEQ ID NO: 1033496 - RNA, 22 nt, Human
agcugccuguccuaggccauca

SEQ ID NO: 1033497 - RNA, 22 nt, Human
agcaggguuuggggauuggcac

SEQ ID NO: 1033498 - RNA, 22 nt, Human
guccucugggagccuugagccu

SEQ ID NO: 1033499 - RNA, 22 nt, Human
ugccucuguggaaauggugguc

SEQ ID NO: 1033500 - RNA, 22 nt, Human
agucaguggcuccgagccuggu

SEQ ID NO: 1033501 - RNA, 22 nt, Human
cuggcagguggauggggacucc

SEQ ID NO: 1033502 - RNA, 22 nt, Human
ggcucuggaaaguguccuugau

SEQ ID NO: 1033503 - RNA, 19 nt, Human
ccugugugggguagagauc

SEQ ID NO: 1033504 - RNA, 22 nt, Human
guacuucccugggaggcaagca

SEQ ID NO: 1033505 - RNA, 22 nt, Human
gaaagaagcuuuagauggcuau

SEQ ID NO: 1033506 - RNA, 22 nt, Human
uguauguaaaguuuguaauaga

SEQ ID NO: 1033507 - RNA, 23 nt, Human
ucaugcccaggcuccagauguca

SEQ ID NO: 1033508 - RNA, 22 nt, Human
gaauguaauagucaguagaaca

SEQ ID NO: 1033509 - RNA, 22 nt, Human
caagccugucucaccagugcua

SEQ ID NO: 1033510 - RNA, 22 nt, Human
gaagagcugugauucaggcuua

SEQ ID NO: 1033511 - RNA, 22 nt, Human
guggcccugucccaggccuccu

SEQ ID NO: 1033512 - RNA, 20 nt, Human
ggcucuggaaucuggugggc

SEQ ID NO: 1033513 - RNA, 22 nt, Human
caaauaucuuuggcaaagagaa

SEQ ID NO: 1033514 - RNA, 22 nt, Human
aaaauguaaagcuugaguguag

SEQ ID NO: 1033515 - RNA, 22 nt, Human
cagcaggguuaagugacucacc

SEQ ID NO: 1033516 - RNA, 22 nt, Human
agcagcagauccaaaaaaugug

SEQ ID NO: 1033517 - RNA, 22 nt, Human
acccugggucauauacagugug

SEQ ID NO: 1033518 - RNA, 22 nt, Human
guccucugcuucaugcccugau

SEQ ID NO: 1033519 - RNA, 21 nt, Human
cugugcuucuuccuaagccag

SEQ ID NO: 1033520 - RNA, 21 nt, Human
uucaagauauuuaaaaggugg

SEQ ID NO: 1033521 - RNA, 22 nt, Human
acaaugcaccagcaucuucacc

SEQ ID NO: 1033522 - RNA, 21 nt, Human
gggugggaggacacagcaggc

SEQ ID NO: 1033523 - RNA, 22 nt, Human
gaaaucugaacaacagcuguca

SEQ ID NO: 1033524 - RNA, 22 nt, Human
ucccacucccaggcaggccucu

SEQ ID NO: 1033525 - RNA, 22 nt, Human
aggcacugaaggaagcuugcgc

SEQ ID NO: 1033526 - RNA, 22 nt, Human
ccagggugggguccaggaacca

SEQ ID NO: 1033527 - RNA, 22 nt, Human
agugaaauaaagcugccuaugg

SEQ ID NO: 1033528 - RNA, 22 nt, Human
acugucugcaaaacucauacuc

SEQ ID NO: 1033529 - RNA, 23 nt, Human
uggaccugaaccagugccucugu

SEQ ID NO: 1033530 - RNA, 22 nt, Human
gcucccaccuccagccugaguu

SEQ ID NO: 1033531 - RNA, 22 nt, Human
auugucuucuggucuuaucuuu

SEQ ID NO: 1033532 - RNA, 22 nt, Human
ugucuccucauacugucauauu

SEQ ID NO: 1033533 - RNA, 22 nt, Human
aagugacacauggcacuucuau

SEQ ID NO: 1033534 - RNA, 19 nt, Human
aggcugcaagguggugggc

SEQ ID NO: 1033535 - RNA, 22 nt, Human
ugcccacauggugccauggcca

SEQ ID NO: 1033536 - RNA, 22 nt, Human
uguccucaaggagcuucagucu

SEQ ID NO: 1033537 - RNA, 22 nt, Human
caggggcaagaaugcugucagc

SEQ ID NO: 1033538 - RNA, 22 nt, Human
gugccagcucuccccacaucug

SEQ ID NO: 1033539 - RNA, 22 nt, Human
cugggugaguugaugaaggaga

SEQ ID NO: 1033540 - RNA, 22 nt, Human
cugcagcugucucuacugggca

SEQ ID NO: 1033541 - RNA, 22 nt, Human
aggggugaaagagggcccucaa

SEQ ID NO: 1033542 - RNA, 22 nt, Human
augaagucugcacaugcaugug

SEQ ID NO: 1033543 - RNA, 22 nt, Human
gccugucugcagggcugucauu

SEQ ID NO: 1033544 - RNA, 22 nt, Human
uaaauucccaacucugcucuuc

SEQ ID NO: 1033545 - RNA, 22 nt, Human
agucccagugagaugagccacg

SEQ ID NO: 1033546 - RNA, 23 nt, Human
uagagcagggaaaucugucagag

SEQ ID NO: 1033547 - RNA, 22 nt, Human
ccucuguccuggggaguggagc

SEQ ID NO: 1033548 - RNA, 22 nt, Human
ccagggugcucuguggcgucgc

SEQ ID NO: 1033549 - RNA, 22 nt, Human
uaauguguugaauauuuguaca

SEQ ID NO: 1033550 - RNA, 22 nt, Human
gagguucacaggcuaucacagu

SEQ ID NO: 1033551 - RNA, 22 nt, Human
gauuucuguaacacuucagaua

SEQ ID NO: 1033552 - RNA, 22 nt, Human
gcacccaggcuugggcagcaac

SEQ ID NO: 1033553 - RNA, 22 nt, Human
aggcuucccaagcagcugcaaa

SEQ ID NO: 1033554 - RNA, 22 nt, Human
ggugugccuggggcuuagcugc

SEQ ID NO: 1033555 - RNA, 22 nt, Human
ccucgaccuccccaggcucagg

SEQ ID NO: 1033556 - RNA, 22 nt, Human
cugcucuggcguacucggcauc

SEQ ID NO: 1033557 - RNA, 22 nt, Human
aggugccagaugcacagcugaa

SEQ ID NO: 1033558 - RNA, 22 nt, Human
ugcacagagagaugagacacgu

SEQ ID NO: 1033559 - RNA, 22 nt, Human
accaggggugucaacagcauuu

SEQ ID NO: 1033560 - RNA, 22 nt, Human
cuucaagagaaugcagggaugu

SEQ ID NO: 1033561 - RNA, 22 nt, Human
cuggccacaacuagcccaggac

SEQ ID NO: 1033562 - RNA, 22 nt, Human
aaugauguauuaguacaacaca

SEQ ID NO: 1033563 - RNA, 22 nt, Human
caaaugugacuuuugggcuucu

SEQ ID NO: 1033564 - RNA, 22 nt, Human
caggugggcguggcgagaaggc

SEQ ID NO: 1033565 - RNA, 22 nt, Human
ucugugcucuucucaguaucac

SEQ ID NO: 1033566 - RNA, 20 nt, Human
cucuccuugccgacuuggca

SEQ ID NO: 1033567 - RNA, 22 nt, Human
caggacagagcccagacugugu

SEQ ID NO: 1033568 - RNA, 20 nt, Human
uuguuucugcuauuuucuaa

SEQ ID NO: 1033569 - RNA, 22 nt, Human
agcaggaggguuuuguagaguc

SEQ ID NO: 1033570 - RNA, 22 nt, Human
caauguguuugcauauuaaaau

SEQ ID NO: 1033571 - RNA, 22 nt, Human
gucccagaggcuuuggccacag

SEQ ID NO: 1033572 - RNA, 22 nt, Human
cauggccugccuccuccuggug

SEQ ID NO: 1033573 - RNA, 22 nt, Human
cuggcugguuacuauuucuggu

SEQ ID NO: 1033574 - RNA, 22 nt, Human
ggagccuugggcgcucucccau

SEQ ID NO: 1033575 - RNA, 22 nt, Human
caguggguccuaaguacaguuc

SEQ ID NO: 1033576 - RNA, 22 nt, Human
ugccuucaaucaggauggucuc

SEQ ID NO: 1033577 - RNA, 20 nt, Human
ugaagcagccuugauucugu

SEQ ID NO: 1033578 - RNA, 22 nt, Human
agggcugggcugcuuguuguca

SEQ ID NO: 1033579 - RNA, 23 nt, Human
uugucugugcuuuuccaguugcu

SEQ ID NO: 1033580 - RNA, 17 nt, Human
cucagaguugcuuuguc

SEQ ID NO: 1033581 - RNA, 22 nt, Human
gcugucagaaggugaaggguaa

SEQ ID NO: 1033582 - RNA, 22 nt, Human
ggcacugaaccaggacacaagc

SEQ ID NO: 1033583 - RNA, 22 nt, Human
ucauugcauuuauucacuggca

SEQ ID NO: 1033584 - RNA, 22 nt, Human
uggccugggccugccggugcaa

SEQ ID NO: 1033585 - RNA, 22 nt, Human
gauuucaagcccccagagauuc

SEQ ID NO: 1033586 - RNA, 20 nt, Human
aggaaaaauggaaacuggag

SEQ ID NO: 1033587 - RNA, 22 nt, Human
cagggguggcugcagcagaggu

SEQ ID NO: 1033588 - RNA, 22 nt, Human
cugggccagauccagccucaca

SEQ ID NO: 1033589 - RNA, 22 nt, Human
ucugaggccccugggcaggaug

SEQ ID NO: 1033590 - RNA, 22 nt, Human
aggccugaaguguggagugggg

SEQ ID NO: 1033591 - RNA, 22 nt, Human
acagagcacauagauuggaguu

SEQ ID NO: 1033592 - RNA, 22 nt, Human
agagccuguuuugugggagaug

SEQ ID NO: 1033593 - RNA, 22 nt, Human
uccucugcuccaggcuggacuu

SEQ ID NO: 1033594 - RNA, 22 nt, Human
ucuccuuugaaaguuaggacug

SEQ ID NO: 1033595 - RNA, 22 nt, Human
ggcacugauuccauucaugaag

SEQ ID NO: 1033596 - RNA, 22 nt, Human
uggagcaggugcucaggguaau

SEQ ID NO: 1033597 - RNA, 19 nt, Human
aggaaagguggccuuagca

SEQ ID NO: 1033598 - RNA, 22 nt, Human
gacugucauucuagugcccaug

SEQ ID NO: 1033599 - RNA, 22 nt, Human
cuacauuuguucuauagcuuuu

SEQ ID NO: 1033600 - RNA, 22 nt, Human
cccuggagugugacgaggcauu

SEQ ID NO: 1033601 - RNA, 22 nt, Human
uccugccucacaguugaaguuu

SEQ ID NO: 1033602 - RNA, 20 nt, Human
uaacagaaguagaagugggu

SEQ ID NO: 1033603 - RNA, 22 nt, Human
cuggagagaccgaaagaggcug

SEQ ID NO: 1033604 - RNA, 21 nt, Human
ugcagcagaguaagcagggga

SEQ ID NO: 1033605 - RNA, 22 nt, Human
aucuggcuuucuuaaugacuua

SEQ ID NO: 1033606 - RNA, 23 nt, Human
aggcuuccuaucuuagagcuggg

SEQ ID NO: 1033607 - RNA, 18 nt, Human
auggucucauacugggag

SEQ ID NO: 1033608 - RNA, 21 nt, Human
gcacagggacagaucaucaca

SEQ ID NO: 1033609 - RNA, 22 nt, Human
ccccaccugugcgucugccgca

SEQ ID NO: 1033610 - RNA, 22 nt, Human
uucuucaauuauuggaaagaaa

SEQ ID NO: 1033611 - RNA, 22 nt, Human
agucaguguucuccggagaggc

SEQ ID NO: 1033612 - RNA, 23 nt, Human
augcucugggcugugggaccugc

SEQ ID NO: 1033613 - RNA, 22 nt, Human
cuucacauguuggaguccuuug

SEQ ID NO: 1033614 - RNA, 22 nt, Human
gauuucaaccuaacaguaugac

SEQ ID NO: 1033615 - RNA, 22 nt, Human
augacagaaggccucccugaca

SEQ ID NO: 1033616 - RNA, 22 nt, Human
aaaugcacagguuuuaaauccu

SEQ ID NO: 1033617 - RNA, 23 nt, Human
auucuucauuaucuucuagaaaa

SEQ ID NO: 1033618 - RNA, 22 nt, Human
augcacgccccacacuggugug

SEQ ID NO: 1033619 - RNA, 22 nt, Human
ucuuugcagaauuuaacuuugc

SEQ ID NO: 1033620 - RNA, 22 nt, Human
ugcugaggucaccuugcugcua

SEQ ID NO: 1033621 - RNA, 22 nt, Human
ucagcagcagcucagcauguuu

SEQ ID NO: 1033622 - RNA, 22 nt, Human
gcugagugauugauauuuuagu

SEQ ID NO: 1033623 - RNA, 22 nt, Human
ccucaggggcuuuucguuguug

SEQ ID NO: 1033624 - RNA, 22 nt, Human
aguuauauuccauagauucaga

SEQ ID NO: 1033625 - RNA, 22 nt, Human
agcagccaagguaaccugugcu

SEQ ID NO: 1033626 - RNA, 22 nt, Human
cagaggaggccaccgcauaggc

SEQ ID NO: 1033627 - RNA, 18 nt, Human
uggcucugcagccagaug

SEQ ID NO: 1033628 - RNA, 22 nt, Human
cugggaggcccacguugggaag

SEQ ID NO: 1033629 - RNA, 22 nt, Human
agagaagagcaaugauaaauuu

SEQ ID NO: 1033630 - RNA, 22 nt, Human
uuguuuuggagaugagcuaaaa

SEQ ID NO: 1033631 - RNA, 22 nt, Human
ucccaggaucugagggcagaga

SEQ ID NO: 1033632 - RNA, 23 nt, Human
gggugggccaaauuagguagccu

SEQ ID NO: 1033633 - RNA, 22 nt, Human
uccucagacacccugcuggcuu

SEQ ID NO: 1033634 - RNA, 22 nt, Human
ugcaggagcugugcggugaggg

SEQ ID NO: 1033635 - RNA, 22 nt, Human
ugauuuccaguugcugggugcu

SEQ ID NO: 1033636 - RNA, 22 nt, Human
ugccaggccucaggagucucca

SEQ ID NO: 1033637 - RNA, 22 nt, Human
gggcugcuuuuaagggucucag

SEQ ID NO: 1033638 - RNA, 22 nt, Human
gucccagaggacagggucacau

SEQ ID NO: 1033639 - RNA, 22 nt, Human
uucauguauuuaucauguaaau

SEQ ID NO: 1033640 - RNA, 22 nt, Human
gccucccuguucuuccacaaua

SEQ ID NO: 1033641 - RNA, 22 nt, Human
cccugcagaccaaugccauaga

SEQ ID NO: 1033642 - RNA, 22 nt, Human
uggcagagaacacggcugaucu

SEQ ID NO: 1033643 - RNA, 22 nt, Human
guuugcauaucugugaaaugga

SEQ ID NO: 1033644 - RNA, 22 nt, Human
uggccuguggcuuaaggucugu

SEQ ID NO: 1033645 - RNA, 22 nt, Human
uggccuggaaccuggcagggac

SEQ ID NO: 1033646 - RNA, 22 nt, Human
cuggcucacaggugagaugcau

SEQ ID NO: 1033647 - RNA, 22 nt, Human
gcucccagacugaccagaggug

SEQ ID NO: 1033648 - RNA, 22 nt, Human
cauacauugcucauucaguauc

SEQ ID NO: 1033649 - RNA, 22 nt, Human
cagcccugcacgcugccuccgc

SEQ ID NO: 1033650 - RNA, 22 nt, Human
cgggcagauugggaagguucau

SEQ ID NO: 1033651 - RNA, 22 nt, Human
ugauuucaaguagugacaugcu

SEQ ID NO: 1033652 - RNA, 22 nt, Human
ggcucugcugguaagaugccuc

SEQ ID NO: 1033653 - RNA, 22 nt, Human
aggugagguuugggagguguca

SEQ ID NO: 1033654 - RNA, 22 nt, Human
ugucagugguagacccagaggu

SEQ ID NO: 1033655 - RNA, 22 nt, Human
uaaugcaguacugauauaaaca

SEQ ID NO: 1033656 - RNA, 22 nt, Human
ugggaaauguguuucuggacca

SEQ ID NO: 1033657 - RNA, 22 nt, Human
gcugucugggaugucacugcug

SEQ ID NO: 1033658 - RNA, 22 nt, Human
ggcugcuguacugaugucaguu

SEQ ID NO: 1033659 - RNA, 22 nt, Human
auugaaagaguuuucugcugca

SEQ ID NO: 1033660 - RNA, 22 nt, Human
gaacagaagaggcuggugccac

SEQ ID NO: 1033661 - RNA, 22 nt, Human
agucuccuuggccucaaugccu

SEQ ID NO: 1033662 - RNA, 23 nt, Human
ugcucugggaggcccuggagagc

SEQ ID NO: 1033663 - RNA, 22 nt, Human
gggcuucuagaccagcagugag

SEQ ID NO: 1033664 - RNA, 22 nt, Human
gagcugccagacaugggaauga

SEQ ID NO: 1033665 - RNA, 22 nt, Human
agaugguguuuccccaggugga

SEQ ID NO: 1033666 - RNA, 23 nt, Human
auggagcugguacuagcuaccuc

SEQ ID NO: 1033667 - RNA, 22 nt, Human
aggcccaguuauccuacuuguu

SEQ ID NO: 1033668 - RNA, 22 nt, Human
ugucacagggauaccauggggc

SEQ ID NO: 1033669 - RNA, 22 nt, Human
uacaaaaguaauuacgguuuuu

SEQ ID NO: 1033670 - RNA, 22 nt, Human
gggccagagcuuggcagcuggg

SEQ ID NO: 1033671 - RNA, 19 nt, Human
cugguccugacugaggggu

SEQ ID NO: 1033672 - RNA, 22 nt, Human
gaagcagcuggugagauggagc

SEQ ID NO: 1033673 - RNA, 22 nt, Human
gcucaggacuggaggagcgggg

SEQ ID NO: 1033674 - RNA, 16 nt, Human
gggcugggggauucug

SEQ ID NO: 1033675 - RNA, 22 nt, Human
cacagggcuaaaugaaggguug

SEQ ID NO: 1033676 - RNA, 22 nt, Human
cugggcagagcuaacaccugag

SEQ ID NO: 1033677 - RNA, 22 nt, Human
cuggagccauguauagccuaug

SEQ ID NO: 1033678 - RNA, 22 nt, Human
uacauuaacuuacguccacaug

SEQ ID NO: 1033679 - RNA, 22 nt, Human
ccagcugcagguguuccagaug

SEQ ID NO: 1033680 - RNA, 23 nt, Human
ggccuguguuuugucugaaguac

SEQ ID NO: 1033681 - RNA, 22 nt, Human
ccagcucugccaagcgucagcu

SEQ ID NO: 1033682 - RNA, 22 nt, Human
ucgagucauguucucccauuaa

SEQ ID NO: 1033683 - RNA, 22 nt, Human
cagcaugguggagcugcucuuu

SEQ ID NO: 1033684 - RNA, 22 nt, Human
gggaaccagccgcuuccgccuc

SEQ ID NO: 1033685 - RNA, 21 nt, Human
ugagccaggcugacggcugug

SEQ ID NO: 1033686 - RNA, 22 nt, Human
uggcagcuugaaugcagucuuu

SEQ ID NO: 1033687 - RNA, 22 nt, Human
aaaauaucagcaaagggugaca

SEQ ID NO: 1033688 - RNA, 22 nt, Human
gcagggugccgacuucagggau

SEQ ID NO: 1033689 - RNA, 22 nt, Human
ugaagcaguuacuggguguuaa

SEQ ID NO: 1033690 - RNA, 22 nt, Human
uuccaaagucauguugcugaua

SEQ ID NO: 1033691 - RNA, 22 nt, Human
ccucagaggugaacaucagugc

SEQ ID NO: 1033692 - RNA, 22 nt, Human
cagggcuggcucaugaaaaguu

SEQ ID NO: 1033693 - RNA, 22 nt, Human
agcagcuuacauguggccuauc

SEQ ID NO: 1033694 - RNA, 22 nt, Human
aguugaaauuagaguccuggcu

SEQ ID NO: 1033695 - RNA, 22 nt, Human
uggagugaaguaaagaggacaa

SEQ ID NO: 1033696 - RNA, 22 nt, Human
gcagagccccucaagccagccu

SEQ ID NO: 1033697 - RNA, 22 nt, Human
cagagccccucagcucucuccc

SEQ ID NO: 1033698 - RNA, 22 nt, Human
gagaaccucuccacaagucugg

SEQ ID NO: 1033699 - RNA, 22 nt, Human
ucaucacauaugucaugauuug

SEQ ID NO: 1033700 - RNA, 22 nt, Human
guuugcauuucuugaacuauau

SEQ ID NO: 1033701 - RNA, 22 nt, Human
uguagcucuccagccagcaagg

SEQ ID NO: 1033702 - RNA, 22 nt, Human
cacauuugaaggaauuagcauu

SEQ ID NO: 1033703 - RNA, 22 nt, Human
gauuucaauccagcuuucuucu

SEQ ID NO: 1033704 - RNA, 22 nt, Human
auuuauuaugggauuuggcaca

SEQ ID NO: 1033705 - RNA, 17 nt, Human
agcagcugaagcagcca

SEQ ID NO: 1033706 - RNA, 22 nt, Human
gaugcacugcaguauauacugu

SEQ ID NO: 1033707 - RNA, 22 nt, Human
ggcgaggccgggacaggcugga

SEQ ID NO: 1033708 - RNA, 22 nt, Human
ccaggccuggccaggggaugcc

SEQ ID NO: 1033709 - RNA, 21 nt, Human
ccagcuccaggaccuuggauc

SEQ ID NO: 1033710 - RNA, 22 nt, Human
aggaggccgggauucuggagau

SEQ ID NO: 1033711 - RNA, 22 nt, Human
uaguaaaaguuuaguugaaagu

SEQ ID NO: 1033712 - RNA, 22 nt, Human
guugggaagcagauggaugagc

SEQ ID NO: 1033713 - RNA, 22 nt, Human
gccagcucccaagugagccccu

SEQ ID NO: 1033714 - RNA, 22 nt, Human
cuuucaaugugccugccuuggg

SEQ ID NO: 1033715 - RNA, 22 nt, Human
ccagaccacccuggccaugcac

SEQ ID NO: 1033716 - RNA, 22 nt, Human
aggagcugucagagugccagag

SEQ ID NO: 1033717 - RNA, 22 nt, Human
aagacauuuauuugaaucaauu

SEQ ID NO: 1033718 - RNA, 22 nt, Human
accucugcuucccggguucaag

SEQ ID NO: 1033719 - RNA, 22 nt, Human
gcucagagcaucccagugaaug

SEQ ID NO: 1033720 - RNA, 20 nt, Human
ugggcagcacugcuggcugg

SEQ ID NO: 1033721 - RNA, 22 nt, Human
cccaggagguagagguugcagu

SEQ ID NO: 1033722 - RNA, 22 nt, Human
gaaaggucuuccggucuuccag

SEQ ID NO: 1033723 - RNA, 21 nt, Human
uccauaagagaccaucuccua

SEQ ID NO: 1033724 - RNA, 22 nt, Human
ugcuccuuccucauccugugca

SEQ ID NO: 1033725 - RNA, 19 nt, Human
gagcugccuuuugaagacc

SEQ ID NO: 1033726 - RNA, 22 nt, Human
ucuuaaaaguaugccaauugga

SEQ ID NO: 1033727 - RNA, 22 nt, Human
cacccagccuucacacaggagu

SEQ ID NO: 1033728 - RNA, 22 nt, Human
acaggggaauuuacugucauua

SEQ ID NO: 1033729 - RNA, 22 nt, Human
uuauuuaauuuucucacucaga

SEQ ID NO: 1033730 - RNA, 22 nt, Human
uaaagaacacagggaauagcac

SEQ ID NO: 1033731 - RNA, 22 nt, Human
cugagcuuccaguuccuccagg

SEQ ID NO: 1033732 - RNA, 22 nt, Human
gcugugugacugagagccuggc

SEQ ID NO: 1033733 - RNA, 22 nt, Human
acagaacuuccugcuggagugg

SEQ ID NO: 1033734 - RNA, 22 nt, Human
cagacuggccacaucugcacug

SEQ ID NO: 1033735 - RNA, 18 nt, Human
cccagcuccacuucccuc

SEQ ID NO: 1033736 - RNA, 22 nt, Human
caggugggcuugggagaacacu

SEQ ID NO: 1033737 - RNA, 22 nt, Human
uuggcagggccaggcucucucu

SEQ ID NO: 1033738 - RNA, 22 nt, Human
uguacaaugccgagacuaacuc

SEQ ID NO: 1033739 - RNA, 22 nt, Human
ccuggcuguggcggugcucuca

SEQ ID NO: 1033740 - RNA, 22 nt, Human
cugcagaggccucgccuccucu

SEQ ID NO: 1033741 - RNA, 23 nt, Human
gagugcagaauagacaugcagug

SEQ ID NO: 1033742 - RNA, 22 nt, Human
auggccuggccagagcucugcu

SEQ ID NO: 1033743 - RNA, 22 nt, Human
uaaguucauaagcuuauucuua

SEQ ID NO: 1033744 - RNA, 22 nt, Human
uggucaguugcaucagagaagu

SEQ ID NO: 1033745 - RNA, 22 nt, Human
cccuggcaugcaugucccuggc

SEQ ID NO: 1033746 - RNA, 22 nt, Human
gggaggucagggugccugcugg

SEQ ID NO: 1033747 - RNA, 20 nt, Human
aggaagccaaaggcugucuu

SEQ ID NO: 1033748 - RNA, 22 nt, Human
ugaugggaggugcugcaggacc

SEQ ID NO: 1033749 - RNA, 22 nt, Human
ggggcacacuuuugguagauau

SEQ ID NO: 1033750 - RNA, 22 nt, Human
cuggcaggcagacuucugcaag

SEQ ID NO: 1033751 - RNA, 22 nt, Human
aggcuccuuguucaucauccau

SEQ ID NO: 1033752 - RNA, 22 nt, Human
aaaaaugucauuauggaacuga

SEQ ID NO: 1033753 - RNA, 22 nt, Human
cagggccagccgcagcauccac

SEQ ID NO: 1033754 - RNA, 20 nt, Human
auuccauaguuggcacuuuu

SEQ ID NO: 1033755 - RNA, 22 nt, Human
ugcagcucauugcuggggucug

SEQ ID NO: 1033756 - RNA, 22 nt, Human
ccagggcaaaugagaucauagc

SEQ ID NO: 1033757 - RNA, 22 nt, Human
uagaaaagaauuuuauuugaua

SEQ ID NO: 1033758 - RNA, 22 nt, Human
cugucaggggcggguggagcgg

SEQ ID NO: 1033759 - RNA, 22 nt, Human
cagcccuguccagcagagggug

SEQ ID NO: 1033760 - RNA, 22 nt, Human
agaaagaacgcacuugugcugc

SEQ ID NO: 1033761 - RNA, 22 nt, Human
acuuugcagagccagaagagaa

SEQ ID NO: 1033762 - RNA, 22 nt, Human
gcugccuggagcucagccugcc

SEQ ID NO: 1033763 - RNA, 22 nt, Human
ugcuugggaauguggagucaga

SEQ ID NO: 1033764 - RNA, 22 nt, Human
auggauaagucaaagaguaucc

SEQ ID NO: 1033765 - RNA, 22 nt, Human
cugggccuagaggaagcugaca

SEQ ID NO: 1033766 - RNA, 17 nt, Human
ccagagcuacugagacu

SEQ ID NO: 1033767 - RNA, 22 nt, Human
aagggcuggaucucucugagca

SEQ ID NO: 1033768 - RNA, 22 nt, Human
acauuucucauaggagagccac

SEQ ID NO: 1033769 - RNA, 22 nt, Human
ugagaggccccagcucuuggcc

SEQ ID NO: 1033770 - RNA, 22 nt, Human
gccagggcaggggagcaucugc

SEQ ID NO: 1033771 - RNA, 22 nt, Human
aagcuccccgaaacccaccucu

SEQ ID NO: 1033772 - RNA, 22 nt, Human
ucugguaaccuuuaucccuccu

SEQ ID NO: 1033773 - RNA, 22 nt, Human
ccacccagccagaugcaggaag

SEQ ID NO: 1033774 - RNA, 22 nt, Human
uggcucaguagcagugugguca

SEQ ID NO: 1033775 - RNA, 22 nt, Human
aagcagcuuaaauuagagccug

SEQ ID NO: 1033776 - RNA, 22 nt, Human
agauuucaauggauauugcaag

SEQ ID NO: 1033777 - RNA, 22 nt, Human
cugagcugggacucaguagcaa

SEQ ID NO: 1033778 - RNA, 22 nt, Human
gccugggaagacuaagugggag

SEQ ID NO: 1033779 - RNA, 22 nt, Human
gucagugucuuaacagagauua

SEQ ID NO: 1033780 - RNA, 22 nt, Human
uggcacuggaaucguagccuug

SEQ ID NO: 1033781 - RNA, 22 nt, Human
uagugauuaaaggcagaauguu

SEQ ID NO: 1033782 - RNA, 22 nt, Human
acaagagauuaucuacagauga

SEQ ID NO: 1033783 - RNA, 22 nt, Human
ccugaggacacacgcugcagga

SEQ ID NO: 1033784 - RNA, 22 nt, Human
ggucccaggcugcgggcuggug

SEQ ID NO: 1033785 - RNA, 22 nt, Human
gcucccacgcaauucuuuucag

SEQ ID NO: 1033786 - RNA, 21 nt, Human
aaaguucaugcuuuaauauuc

SEQ ID NO: 1033787 - RNA, 22 nt, Human
ggcuccuggggaggugagcuug

SEQ ID NO: 1033788 - RNA, 22 nt, Human
cugagcugguggaagcaugcag

SEQ ID NO: 1033789 - RNA, 22 nt, Human
auguagcaugaggcacugugcc

SEQ ID NO: 1033790 - RNA, 22 nt, Human
cagcugcccugccuugcccuua

SEQ ID NO: 1033791 - RNA, 23 nt, Human
aaaguguagccagguuaagaacc

SEQ ID NO: 1033792 - RNA, 22 nt, Human
cagccagccucucaaccaugca

SEQ ID NO: 1033793 - RNA, 22 nt, Human
ggccucugcaacuggcuguggc

SEQ ID NO: 1033794 - RNA, 22 nt, Human
aguuucuaccgguacauucagg

SEQ ID NO: 1033795 - RNA, 22 nt, Human
cagggcagcuuccuuuguuagg

SEQ ID NO: 1033796 - RNA, 22 nt, Human
acugaaggucucagcaaggaug

SEQ ID NO: 1033797 - RNA, 22 nt, Human
uggugcugauaauggcaggauu

SEQ ID NO: 1033798 - RNA, 22 nt, Human
guuugcauguauuaagucaaua

SEQ ID NO: 1033799 - RNA, 22 nt, Human
aagauuucucuccuggaaagca

SEQ ID NO: 1033800 - RNA, 21 nt, Human
uucagcaguccucuagagaua

SEQ ID NO: 1033801 - RNA, 22 nt, Human
uccuguaguugcuaaguuuguu

SEQ ID NO: 1033802 - RNA, 22 nt, Human
caggcuugcugcuagagcacuu

SEQ ID NO: 1033803 - RNA, 22 nt, Human
aauguacaaggguuccaguuuu

SEQ ID NO: 1033804 - RNA, 22 nt, Human
ccuggggcucaagauggcgccg

SEQ ID NO: 1033805 - RNA, 22 nt, Human
cugucuccuccacugcauggga

SEQ ID NO: 1033806 - RNA, 22 nt, Human
ugaaauauuuagagaguaaguu

SEQ ID NO: 1033807 - RNA, 22 nt, Human
gguggggcccuggcacugguau

SEQ ID NO: 1033808 - RNA, 22 nt, Human
ugagcccagagaucugagcuau

SEQ ID NO: 1033809 - RNA, 22 nt, Human
ugggcagaguugugaugaacug

SEQ ID NO: 1033810 - RNA, 22 nt, Human
ggagcagacauaaccuuacaga

SEQ ID NO: 1033811 - RNA, 22 nt, Human
aggccuggcaugagaccugaga

SEQ ID NO: 1033812 - RNA, 22 nt, Human
gcucuguguugucagaggcacc

SEQ ID NO: 1033813 - RNA, 22 nt, Human
uucaguuucagucuugcaaaaa

SEQ ID NO: 1033814 - RNA, 22 nt, Human
ucccagcagggccgaccagccu

SEQ ID NO: 1033815 - RNA, 22 nt, Human
uuccucucgcucuccggggccc

SEQ ID NO: 1033816 - RNA, 22 nt, Human
cccugccuacaggguuuucuuu

SEQ ID NO: 1033817 - RNA, 22 nt, Human
ucccaggauguuggcggcaggu

SEQ ID NO: 1033818 - RNA, 22 nt, Human
gcaccuggcugcccagguggag

SEQ ID NO: 1033819 - RNA, 22 nt, Human
ugcugguggagaaaguggaggu

SEQ ID NO: 1033820 - RNA, 22 nt, Human
aaggcugagggcuguaccuggc

SEQ ID NO: 1033821 - RNA, 22 nt, Human
cccugccucugaagcugcucag

SEQ ID NO: 1033822 - RNA, 22 nt, Human
agaaaucucaguaucucaggga

SEQ ID NO: 1033823 - RNA, 22 nt, Human
agcugguggauuaugcuguaca

SEQ ID NO: 1033824 - RNA, 22 nt, Human
acaaacuaccuacagauguuca

SEQ ID NO: 1033825 - RNA, 22 nt, Human
agggucuguggaugcaucuggg

SEQ ID NO: 1033826 - RNA, 22 nt, Human
agcugcagauucuaucuagaag

SEQ ID NO: 1033827 - RNA, 22 nt, Human
uagagcuauuuagagcauuuua

SEQ ID NO: 1033828 - RNA, 22 nt, Human
ggccagaaaguuaagcuguggc

SEQ ID NO: 1033829 - RNA, 22 nt, Human
cuacauggagaagaaaauucuu

SEQ ID NO: 1033830 - RNA, 19 nt, Human
aucuuacagagcagaguac

SEQ ID NO: 1033831 - RNA, 22 nt, Human
gcugccacuuggucaugucaug

SEQ ID NO: 1033832 - RNA, 22 nt, Human
uuagaaaaaggcuguggucuua

SEQ ID NO: 1033833 - RNA, 22 nt, Human
acagagcugggaucugaaccca

SEQ ID NO: 1033834 - RNA, 22 nt, Human
uggcucagauuuuuguaggcuu

SEQ ID NO: 1033835 - RNA, 22 nt, Human
gccuaggaguacagaaugguuu

SEQ ID NO: 1033836 - RNA, 22 nt, Human
agcccuucaaccugccuacucc

SEQ ID NO: 1033837 - RNA, 22 nt, Human
cagagcagugaggaguugugua

SEQ ID NO: 1033838 - RNA, 23 nt, Human
agaaaagcuuggacacauggccu

SEQ ID NO: 1033839 - RNA, 22 nt, Human
acugaaagauaaaucaguuagc

SEQ ID NO: 1033840 - RNA, 22 nt, Human
cuagagaggcagauguccugug

SEQ ID NO: 1033841 - RNA, 22 nt, Human
cagugggaagggcagaggcuuu

SEQ ID NO: 1033842 - RNA, 22 nt, Human
cucaggagacaguguccacaug

SEQ ID NO: 1033843 - RNA, 22 nt, Human
cuccuggacauggagcggagga

SEQ ID NO: 1033844 - RNA, 20 nt, Human
gugugaagcccucaggagga

SEQ ID NO: 1033845 - RNA, 19 nt, Human
uucacauuggaagaaguag

SEQ ID NO: 1033846 - RNA, 22 nt, Human
uguaucaaaccaaauuaauucu

SEQ ID NO: 1033847 - RNA, 17 nt, Human
agaugcuggccacaugu

SEQ ID NO: 1033848 - RNA, 18 nt, Human
aggcuucuuggcucaguc

SEQ ID NO: 1033849 - RNA, 22 nt, Human
cuggcagcugugugaagaacug

SEQ ID NO: 1033850 - RNA, 22 nt, Human
ggugacuggagggacccaggcc

SEQ ID NO: 1033851 - RNA, 22 nt, Human
aaauguauccuacuuccugagu

SEQ ID NO: 1033852 - RNA, 22 nt, Human
cuggggcuggugaggcaggcuc

SEQ ID NO: 1033853 - RNA, 22 nt, Human
aggcuccaugcaaaggcuguuu

SEQ ID NO: 1033854 - RNA, 22 nt, Human
aguguugucaaacggcucagca

SEQ ID NO: 1033855 - RNA, 22 nt, Human
uagcaguggaaucuuuugucca

SEQ ID NO: 1033856 - RNA, 22 nt, Human
cucuuaguuuaucuuugacaaa

SEQ ID NO: 1033857 - RNA, 22 nt, Human
ucgugucagaucagagguuccu

SEQ ID NO: 1033858 - RNA, 22 nt, Human
cauuaucugccauugacaccau

SEQ ID NO: 1033859 - RNA, 22 nt, Human
augcuguagaucuuagccucua

SEQ ID NO: 1033860 - RNA, 22 nt, Human
gggcugcugcugccagcgacac

SEQ ID NO: 1033861 - RNA, 22 nt, Human
gagccaggcccguacuugcugu

SEQ ID NO: 1033862 - RNA, 22 nt, Human
uaaagucaucuuuacaucuuug

SEQ ID NO: 1033863 - RNA, 18 nt, Human
ucacagugcucuugccua

SEQ ID NO: 1033864 - RNA, 22 nt, Human
gucccaggcuuauguggagcuu

SEQ ID NO: 1033865 - RNA, 22 nt, Human
gccuggcuccuaaggacuggcu

SEQ ID NO: 1033866 - RNA, 22 nt, Human
ucccagagcagaugugcuaaag

SEQ ID NO: 1033867 - RNA, 23 nt, Human
cacugcagcguggucuggcagga

SEQ ID NO: 1033868 - RNA, 22 nt, Human
uuuccucuuugugacacagcug

SEQ ID NO: 1033869 - RNA, 17 nt, Human
aggugcagaggcagagc

SEQ ID NO: 1033870 - RNA, 22 nt, Human
caguguacuuggaauguaacag

SEQ ID NO: 1033871 - RNA, 22 nt, Human
cuggcucuaucuccaaggcugg

SEQ ID NO: 1033872 - RNA, 22 nt, Human
uucauuccugagcccauauuua

SEQ ID NO: 1033873 - RNA, 22 nt, Human
auggcucauuuaucuugcagcc

SEQ ID NO: 1033874 - RNA, 22 nt, Human
ugacuucaaaggcucuacuccu

SEQ ID NO: 1033875 - RNA, 18 nt, Human
uggcucuggacuugcucc

SEQ ID NO: 1033876 - RNA, 22 nt, Human
cacugaaggaaggacuacugca

SEQ ID NO: 1033877 - RNA, 22 nt, Human
uggagccuguguuucugcccag

SEQ ID NO: 1033878 - RNA, 22 nt, Human
uguccacaucacucacuuguca

SEQ ID NO: 1033879 - RNA, 22 nt, Human
cacuguaucuuuuccaaagucu

SEQ ID NO: 1033880 - RNA, 22 nt, Human
uuuuuaagcuccuuugauguca

SEQ ID NO: 1033881 - RNA, 22 nt, Human
ccagguggacggcgaguacagg

SEQ ID NO: 1033882 - RNA, 22 nt, Human
cucaaggaaagucuggagaaga

SEQ ID NO: 1033883 - RNA, 19 nt, Human
cacagggcaggucucaugu

SEQ ID NO: 1033884 - RNA, 22 nt, Human
ugaagcagaggggucuugagcu

SEQ ID NO: 1033885 - RNA, 22 nt, Human
aaugcacaugucuuggccucac

SEQ ID NO: 1033886 - RNA, 16 nt, Human
ugggcagaugagaaga

SEQ ID NO: 1033887 - RNA, 23 nt, Human
cccuggagcuagucugagcagag

SEQ ID NO: 1033888 - RNA, 22 nt, Human
uggaagcagugauucuugucug

SEQ ID NO: 1033889 - RNA, 22 nt, Human
ucuguaguagguuguaguucuu

SEQ ID NO: 1033890 - RNA, 22 nt, Human
uucucuucuguucagugcccaa

SEQ ID NO: 1033891 - RNA, 22 nt, Human
caggagcagaggguggucagca

SEQ ID NO: 1033892 - RNA, 22 nt, Human
cagccaggagccucugcaacua

SEQ ID NO: 1033893 - RNA, 22 nt, Human
guccucagggaauguggcgggu

SEQ ID NO: 1033894 - RNA, 22 nt, Human
cuggcucaugugaugagggcaa

SEQ ID NO: 1033895 - RNA, 22 nt, Human
uuguaacacuuuucuauuaaua

SEQ ID NO: 1033896 - RNA, 18 nt, Human
caugggugacagguggau

SEQ ID NO: 1033897 - RNA, 22 nt, Human
gggcugccaagccugccugccu

SEQ ID NO: 1033898 - RNA, 22 nt, Human
aagaacagguucuagaaccauu

SEQ ID NO: 1033899 - RNA, 22 nt, Human
cucucugagugagggacaagcu

SEQ ID NO: 1033900 - RNA, 18 nt, Human
gagacacaagggccugga

SEQ ID NO: 1033901 - RNA, 22 nt, Human
auuguauuuccagcuugaaugu

SEQ ID NO: 1033902 - RNA, 22 nt, Human
gauacaaauucaugucugaauu

SEQ ID NO: 1033903 - RNA, 22 nt, Human
aggcaggggagcuggaagggua

SEQ ID NO: 1033904 - RNA, 22 nt, Human
caagggcuucaaguggccaaga

SEQ ID NO: 1033905 - RNA, 22 nt, Human
gcucugcuggagggaaagagaa

SEQ ID NO: 1033906 - RNA, 22 nt, Human
cuguucaugcugauucuguaug

SEQ ID NO: 1033907 - RNA, 22 nt, Human
caggcugcggucggcucugguc

SEQ ID NO: 1033908 - RNA, 22 nt, Human
cuuguccuuuacuugagacuca

SEQ ID NO: 1033909 - RNA, 22 nt, Human
uccucugccaaagggaguugcc

SEQ ID NO: 1033910 - RNA, 22 nt, Human
ccugccugucccucaguccaca

SEQ ID NO: 1033911 - RNA, 22 nt, Human
ugggccacuugaaaguggaugu

SEQ ID NO: 1033912 - RNA, 22 nt, Human
uggcaggagguuuucuccagga

SEQ ID NO: 1033913 - RNA, 22 nt, Human
gagccugagugcugccuccccu

SEQ ID NO: 1033914 - RNA, 22 nt, Human
accaaggagaaggugcaagcuu

SEQ ID NO: 1033915 - RNA, 22 nt, Human
caugagcugcugggagccuguc

SEQ ID NO: 1033916 - RNA, 22 nt, Human
cucuugggagugcucuggagaa

SEQ ID NO: 1033917 - RNA, 22 nt, Human
aagggaggaggauuuauuguac

SEQ ID NO: 1033918 - RNA, 22 nt, Human
ccaggccuccugugaguggacc

SEQ ID NO: 1033919 - RNA, 22 nt, Human
aggugcagcaugaguccaacgg

SEQ ID NO: 1033920 - RNA, 20 nt, Human
ggaccagguggggcgguggc

SEQ ID NO: 1033921 - RNA, 19 nt, Human
ggcugucucggcccagcca

SEQ ID NO: 1033922 - RNA, 22 nt, Human
ggagccaguauuuaguggucuu

SEQ ID NO: 1033923 - RNA, 22 nt, Human
gacccagcuuaagucacauguu

SEQ ID NO: 1033924 - RNA, 22 nt, Human
caaaguuuggcucucaugacau

SEQ ID NO: 1033925 - RNA, 22 nt, Human
cugggcaggagggcucuaugga

SEQ ID NO: 1033926 - RNA, 22 nt, Human
aagcacuuagaagagugccugc

SEQ ID NO: 1033927 - RNA, 23 nt, Human
uugaaagguagcuggcagcuaga

SEQ ID NO: 1033928 - RNA, 22 nt, Human
uaguccauuuucacacugcuga

SEQ ID NO: 1033929 - RNA, 22 nt, Human
cccuggagggacagcugcucua

SEQ ID NO: 1033930 - RNA, 22 nt, Human
aaguucaaucagaugaaaaagc

SEQ ID NO: 1033931 - RNA, 22 nt, Human
cagucccagacauaguaaggga

SEQ ID NO: 1033932 - RNA, 22 nt, Human
aaggcgacacaggcagcaggcc

SEQ ID NO: 1033933 - RNA, 18 nt, Human
uccucucuuuccccaggg

SEQ ID NO: 1033934 - RNA, 23 nt, Human
gcugucaguuguuuuugucucua

SEQ ID NO: 1033935 - RNA, 22 nt, Human
gcugcccuaauaucacauguua

SEQ ID NO: 1033936 - RNA, 22 nt, Human
augggcuguccuaguccagccc

SEQ ID NO: 1033937 - RNA, 22 nt, Human
aagggcagcugacagaugcuua

SEQ ID NO: 1033938 - RNA, 22 nt, Human
acacagccaggguaguaaggcu

SEQ ID NO: 1033939 - RNA, 22 nt, Human
gaggugggaugugugugcuacu

SEQ ID NO: 1033940 - RNA, 22 nt, Human
uuuuaagaugcuaguauuucag

SEQ ID NO: 1033941 - RNA, 22 nt, Human
ggccucaguuucuucaacugua

SEQ ID NO: 1033942 - RNA, 22 nt, Human
gagggcugauaacaggaauaca

SEQ ID NO: 1033943 - RNA, 22 nt, Human
caggguagacaguaggugucug

SEQ ID NO: 1033944 - RNA, 23 nt, Human
ggacagggcccugcccuauggcc

SEQ ID NO: 1033945 - RNA, 22 nt, Human
ucucaagagggaggcaaucaug

SEQ ID NO: 1033946 - RNA, 22 nt, Human
gggcuggcaucgguugcugaga

SEQ ID NO: 1033947 - RNA, 22 nt, Human
augaugugugcugaucaagcuu

SEQ ID NO: 1033948 - RNA, 22 nt, Human
uuuccucuucgauuaaguuugg

SEQ ID NO: 1033949 - RNA, 22 nt, Human
cucugggcaaagaugccucauc

SEQ ID NO: 1033950 - RNA, 22 nt, Human
cacaguggauugggugaugccc

SEQ ID NO: 1033951 - RNA, 22 nt, Human
ucugaggcccugcaggcagugu

SEQ ID NO: 1033952 - RNA, 22 nt, Human
gcucaggaaaacagucuaguaa

SEQ ID NO: 1033953 - RNA, 21 nt, Human
uggcccuggccacggcugcca

SEQ ID NO: 1033954 - RNA, 22 nt, Human
uuucucugaggcuggccucccu

SEQ ID NO: 1033955 - RNA, 22 nt, Human
accugccuauggagccacaugg

SEQ ID NO: 1033956 - RNA, 22 nt, Human
agaauccugaugaaaaggagag

SEQ ID NO: 1033957 - RNA, 22 nt, Human
cagagcugggcauggugaaagg

SEQ ID NO: 1033958 - RNA, 22 nt, Human
acagccugcugccugcuucuug

SEQ ID NO: 1033959 - RNA, 22 nt, Human
gagcccaggcagagguugcagu

SEQ ID NO: 1033960 - RNA, 22 nt, Human
gccugagccgccugagcggcgg

SEQ ID NO: 1033961 - RNA, 21 nt, Human
gcucucugcaugguggcucag

SEQ ID NO: 1033962 - RNA, 22 nt, Human
accagguggccccagcgugguu

SEQ ID NO: 1033963 - RNA, 19 nt, Human
ccagucccauacaggagau

SEQ ID NO: 1033964 - RNA, 21 nt, Human
ugguuugcggccaaaguuaaa

SEQ ID NO: 1033965 - RNA, 22 nt, Human
cugccagcacugccuccugagg

SEQ ID NO: 1033966 - RNA, 22 nt, Human
ucaggugggaccugcuaggaca

SEQ ID NO: 1033967 - RNA, 22 nt, Human
gagcaggcauucuaguggcuga

SEQ ID NO: 1033968 - RNA, 22 nt, Human
uuggccuucccuaccugggcca

SEQ ID NO: 1033969 - RNA, 22 nt, Human
uggcucuguuuguuaacuagac

SEQ ID NO: 1033970 - RNA, 22 nt, Human
agugacugacaccuguaauccc

SEQ ID NO: 1033971 - RNA, 22 nt, Human
guguccagggccguguugucuu

SEQ ID NO: 1033972 - RNA, 22 nt, Human
gucccugcccuccugggacuca

SEQ ID NO: 1033973 - RNA, 22 nt, Human
ugaauggucacugagcaucugu

SEQ ID NO: 1033974 - RNA, 22 nt, Human
ggaaaaggccauuguuucucug

SEQ ID NO: 1033975 - RNA, 22 nt, Human
ugcuagaaaucugaaacuagca

SEQ ID NO: 1033976 - RNA, 22 nt, Human
gaaaggucaguuccacuuccau

SEQ ID NO: 1033977 - RNA, 22 nt, Human
gcugccugucccaggaugagga

SEQ ID NO: 1033978 - RNA, 19 nt, Human
gccucugcuggggacaggc

SEQ ID NO: 1033979 - RNA, 22 nt, Human
ggagccugugcccaagcccaga

SEQ ID NO: 1033980 - RNA, 17 nt, Human
ugcauuguuggaaauuu

SEQ ID NO: 1033981 - RNA, 22 nt, Human
uggcagcugauuagauggugcc

SEQ ID NO: 1033982 - RNA, 22 nt, Human
gugaggugguacaauauuaacu

SEQ ID NO: 1033983 - RNA, 22 nt, Human
ugggcuggugagggaucauuua

SEQ ID NO: 1033984 - RNA, 22 nt, Human
ucugggagagcugcugucagag

SEQ ID NO: 1033985 - RNA, 22 nt, Human
ggcugccucaaagcucaagcuc

SEQ ID NO: 1033986 - RNA, 18 nt, Human
caggaugagugaugggga

SEQ ID NO: 1033987 - RNA, 22 nt, Human
acugugcaugaaccgaaacaaa

SEQ ID NO: 1033988 - RNA, 22 nt, Human
uucacagggccacuggcaggag

SEQ ID NO: 1033989 - RNA, 22 nt, Human
ugggccuccaauuccagcggga

SEQ ID NO: 1033990 - RNA, 22 nt, Human
aggccagguuccucaaucuuga

SEQ ID NO: 1033991 - RNA, 22 nt, Human
agggggcaucagguccuggcuc

SEQ ID NO: 1033992 - RNA, 22 nt, Human
gaagccaagugcaaaugccuua

SEQ ID NO: 1033993 - RNA, 22 nt, Human
ugacagaaugugacucucagau

SEQ ID NO: 1033994 - RNA, 22 nt, Human
cagcaauaaugucuacaaaucu

SEQ ID NO: 1033995 - RNA, 22 nt, Human
cccagggcccuggacagcuaca

SEQ ID NO: 1033996 - RNA, 22 nt, Human
cagggagaagucuggucagucc

SEQ ID NO: 1033997 - RNA, 22 nt, Human
ugccugucuuggaguccuggcc

SEQ ID NO: 1033998 - RNA, 22 nt, Human
gcugucucauacaaggcccugc

SEQ ID NO: 1033999 - RNA, 22 nt, Human
aagccgggccugagaaaugaca

SEQ ID NO: 1034000 - RNA, 22 nt, Human
acacugaaugcuguuuagaaau

SEQ ID NO: 1034001 - RNA, 22 nt, Human
aggccuggccugggcggcauug

SEQ ID NO: 1034002 - RNA, 22 nt, Human
gcuggcuguuggagguaccugc

SEQ ID NO: 1034003 - RNA, 19 nt, Human
cucagcuguagcucaugug

SEQ ID NO: 1034004 - RNA, 22 nt, Human
uaugaagacaaugauagcauga

SEQ ID NO: 1034005 - RNA, 22 nt, Human
ggcuguccuuggccaaggcacu

SEQ ID NO: 1034006 - RNA, 17 nt, Human
acagagguuauacagac

SEQ ID NO: 1034007 - RNA, 22 nt, Human
ggagcugcauuuagggagccuu

SEQ ID NO: 1034008 - RNA, 18 nt, Human
uggcagccagcugcuccu

SEQ ID NO: 1034009 - RNA, 22 nt, Human
augccuggacugacaugcacug

SEQ ID NO: 1034010 - RNA, 22 nt, Human
uggcucagaggggaagugguuu

SEQ ID NO: 1034011 - RNA, 22 nt, Human
caucacuguccaaaguucaguu

SEQ ID NO: 1034012 - RNA, 22 nt, Human
agucucaggcagaggaaggcua

SEQ ID NO: 1034013 - RNA, 21 nt, Human
ucuuugcaucaguuguuuucu

SEQ ID NO: 1034014 - RNA, 22 nt, Human
ucacauuuuaucuauuuuaagu

SEQ ID NO: 1034015 - RNA, 22 nt, Human
cuucccagacgggguggcagcc

SEQ ID NO: 1034016 - RNA, 22 nt, Human
gaaggcaggcuucugauuaggu

SEQ ID NO: 1034017 - RNA, 22 nt, Human
aagcagccagccaucaugcccg

SEQ ID NO: 1034018 - RNA, 22 nt, Human
ggcuucucucccccagcuccac

SEQ ID NO: 1034019 - RNA, 21 nt, Human
ugugucacuaacuagaggcua

SEQ ID NO: 1034020 - RNA, 22 nt, Human
cugacucuccucaagcauaaau

SEQ ID NO: 1034021 - RNA, 22 nt, Human
uuagaaaucaccucugaagauc

SEQ ID NO: 1034022 - RNA, 22 nt, Human
aaaguguggagauugaacuaaa

SEQ ID NO: 1034023 - RNA, 22 nt, Human
acccacgaagaugagcggcaug

SEQ ID NO: 1034024 - RNA, 22 nt, Human
aagccaggaagagagccuucac

SEQ ID NO: 1034025 - RNA, 22 nt, Human
ucuggagcuuccucauuuacag

SEQ ID NO: 1034026 - RNA, 19 nt, Human
gcagccaggugcucuaccu

SEQ ID NO: 1034027 - RNA, 19 nt, Human
cagcugccuuuucuuugca

SEQ ID NO: 1034028 - RNA, 22 nt, Human
gagcagagacaguacaacuggc

SEQ ID NO: 1034029 - RNA, 22 nt, Human
uguaugcagggcuuguaugcag

SEQ ID NO: 1034030 - RNA, 22 nt, Human
gcaaggcugugcacuuugcauu

SEQ ID NO: 1034031 - RNA, 22 nt, Human
auuguauuagcacaauacaauu

SEQ ID NO: 1034032 - RNA, 22 nt, Human
caguacuuugaagauauuuuag

SEQ ID NO: 1034033 - RNA, 22 nt, Human
agcaguggcugaagauguuccu

SEQ ID NO: 1034034 - RNA, 22 nt, Human
gagagugaggccugggaaucua

SEQ ID NO: 1034035 - RNA, 22 nt, Human
ggaaggagggcggcaaugauga

SEQ ID NO: 1034036 - RNA, 22 nt, Human
cagggccaagccccuuuggcug

SEQ ID NO: 1034037 - RNA, 22 nt, Human
ggccucugaggacagccuuggc

SEQ ID NO: 1034038 - RNA, 22 nt, Human
uaguacuuaucucugucauugu

SEQ ID NO: 1034039 - RNA, 20 nt, Human
gcugccuguuucuguaagua

SEQ ID NO: 1034040 - RNA, 22 nt, Human
ugugcccauuacacagaggcau

SEQ ID NO: 1034041 - RNA, 22 nt, Human
cugcucugcaaggcacagugau

SEQ ID NO: 1034042 - RNA, 22 nt, Human
ggcagccauacucagaccuggg

SEQ ID NO: 1034043 - RNA, 22 nt, Human
cucaggccauucuuccagcugc

SEQ ID NO: 1034044 - RNA, 22 nt, Human
uaaaauguuugcaagagaccag

SEQ ID NO: 1034045 - RNA, 22 nt, Human
agcugggaggugggcagugaga

SEQ ID NO: 1034046 - RNA, 22 nt, Human
augaguaaaaccacuauuuaca

SEQ ID NO: 1034047 - RNA, 22 nt, Human
agccuccuggaguuucugggau

SEQ ID NO: 1034048 - RNA, 23 nt, Human
ucccuggaggcagguccagggcc

SEQ ID NO: 1034049 - RNA, 22 nt, Human
aaucagaauuuauugaaucuuu

SEQ ID NO: 1034050 - RNA, 22 nt, Human
ugggacagggaaucugaucccc

SEQ ID NO: 1034051 - RNA, 22 nt, Human
caaagguauaaguuaauauaca

SEQ ID NO: 1034052 - RNA, 22 nt, Human
aucuggcuuuuacugaauugcu

SEQ ID NO: 1034053 - RNA, 22 nt, Human
aggucacccguuugacuaucca

SEQ ID NO: 1034054 - RNA, 22 nt, Human
uagagcugcuggacuguaacag

SEQ ID NO: 1034055 - RNA, 22 nt, Human
acauuguauaaugauuaucaca

SEQ ID NO: 1034056 - RNA, 22 nt, Human
gcagcguggggacaggagcuca

SEQ ID NO: 1034057 - RNA, 22 nt, Human
aaagccuugcccgucacuggga

SEQ ID NO: 1034058 - RNA, 22 nt, Human
aucuggcuauugacauguuaua

SEQ ID NO: 1034059 - RNA, 22 nt, Human
cugcaggaauucaaagugagcu

SEQ ID NO: 1034060 - RNA, 22 nt, Human
aaaaaugcugugguagcugugu

SEQ ID NO: 1034061 - RNA, 22 nt, Human
uggcucaggggucuggcucugu

SEQ ID NO: 1034062 - RNA, 22 nt, Human
ucugucacuuuuauuuacugaa

SEQ ID NO: 1034063 - RNA, 20 nt, Human
cucugcuuuaggagagucag

SEQ ID NO: 1034064 - RNA, 22 nt, Human
uucuucaaaauccagcaugauu

SEQ ID NO: 1034065 - RNA, 18 nt, Human
cagggcuguggggucacu

SEQ ID NO: 1034066 - RNA, 22 nt, Human
gagagugauucccucccauaga

SEQ ID NO: 1034067 - RNA, 22 nt, Human
aggcucuguuauucuagagggc

SEQ ID NO: 1034068 - RNA, 22 nt, Human
gaaggagggugcggaucugagc

SEQ ID NO: 1034069 - RNA, 22 nt, Human
ugcagcaggcacaggacggaag

SEQ ID NO: 1034070 - RNA, 23 nt, Human
uagggcagcugggagggacaugc

SEQ ID NO: 1034071 - RNA, 22 nt, Human
cugcuucuaagaaccugcagcu

SEQ ID NO: 1034072 - RNA, 20 nt, Human
uauuugaaauggccaagugu

SEQ ID NO: 1034073 - RNA, 22 nt, Human
ucccuggagauaacuucuggga

SEQ ID NO: 1034074 - RNA, 22 nt, Human
ucaggcagagcuguggagcucu

SEQ ID NO: 1034075 - RNA, 22 nt, Human
cagaggcucaccagccuuucac

SEQ ID NO: 1034076 - RNA, 22 nt, Human
auuuccuagccucucuugcagu

SEQ ID NO: 1034077 - RNA, 22 nt, Human
cucaggcccacagcagacccac

SEQ ID NO: 1034078 - RNA, 22 nt, Human
cuccaguaucuguaggaaaagg

SEQ ID NO: 1034079 - RNA, 22 nt, Human
uuuuuccuaagcaguggagcug

SEQ ID NO: 1034080 - RNA, 19 nt, Human
augagcuggcauuucaggu

SEQ ID NO: 1034081 - RNA, 21 nt, Human
uccuuccuugagguccuuucc

SEQ ID NO: 1034082 - RNA, 22 nt, Human
gguuugcaugugauguugggca

SEQ ID NO: 1034083 - RNA, 22 nt, Human
agucaguguagaaagcccaggc

SEQ ID NO: 1034084 - RNA, 22 nt, Human
agugugcugcuuaaacaguugu

SEQ ID NO: 1034085 - RNA, 22 nt, Human
aggcugaggcagguggaucauu

SEQ ID NO: 1034086 - RNA, 22 nt, Human
uacaguaaccagucuacuuaga

SEQ ID NO: 1034087 - RNA, 22 nt, Human
agcuuccuacaaccaucucaga

SEQ ID NO: 1034088 - RNA, 22 nt, Human
ggccuggccuccagaugugggc

SEQ ID NO: 1034089 - RNA, 22 nt, Human
cauugcacucuggcuggaacgg

SEQ ID NO: 1034090 - RNA, 22 nt, Human
acauuucucaucuaguagagua

SEQ ID NO: 1034091 - RNA, 22 nt, Human
uugcaggggaaggagcagagcu

SEQ ID NO: 1034092 - RNA, 22 nt, Human
auuugucuucaguagguucuuc

SEQ ID NO: 1034093 - RNA, 22 nt, Human
ucugagaggauuccugucccga

SEQ ID NO: 1034094 - RNA, 22 nt, Human
ugugcuucagguugucgccacg

SEQ ID NO: 1034095 - RNA, 22 nt, Human
cuaggaggcgggggcugcagua

SEQ ID NO: 1034096 - RNA, 22 nt, Human
uccuggaggggacagcaugggc

SEQ ID NO: 1034097 - RNA, 22 nt, Human
cagggucuuauaaggccaauuu

SEQ ID NO: 1034098 - RNA, 22 nt, Human
ugcguugcgcuccugcagcagg

SEQ ID NO: 1034099 - RNA, 22 nt, Human
ggaaggucgagcugcaucuggc

SEQ ID NO: 1034100 - RNA, 22 nt, Human
ugggcucugugccagguuggug

SEQ ID NO: 1034101 - RNA, 22 nt, Human
agaugcugugaggaagcuagga

SEQ ID NO: 1034102 - RNA, 22 nt, Human
ucugucugcaccuaagcacagu

SEQ ID NO: 1034103 - RNA, 22 nt, Human
aucagcaaucucguguauuagg

SEQ ID NO: 1034104 - RNA, 22 nt, Human
guccagggcuaaaucagguucc

SEQ ID NO: 1034105 - RNA, 22 nt, Human
auguaacaggugaagcucugag

SEQ ID NO: 1034106 - RNA, 22 nt, Human
gccugcuguuaacugcaggaau

SEQ ID NO: 1034107 - RNA, 22 nt, Human
aagaacauuuuguagaaugaca

SEQ ID NO: 1034108 - RNA, 22 nt, Human
ugcucagggacaauggagaggg

SEQ ID NO: 1034109 - RNA, 22 nt, Human
gcugccugcucggcuccuggga

SEQ ID NO: 1034110 - RNA, 22 nt, Human
gggcugacucugcacugagcca

SEQ ID NO: 1034111 - RNA, 22 nt, Human
augggaugcauggcuguggcca

SEQ ID NO: 1034112 - RNA, 22 nt, Human
cagucccaucucccagguggcu

SEQ ID NO: 1034113 - RNA, 22 nt, Human
gcagggucuugagaggcagcca

SEQ ID NO: 1034114 - RNA, 22 nt, Human
guggcugcucgggcuccggccc

SEQ ID NO: 1034115 - RNA, 22 nt, Human
aagagcuggcucuugcagcagc

SEQ ID NO: 1034116 - RNA, 17 nt, Human
aggaaacauuuucuuuc

SEQ ID NO: 1034117 - RNA, 22 nt, Human
ccugucucuuucaaucugagag

SEQ ID NO: 1034118 - RNA, 22 nt, Human
uggccugcagaggcuguggggc

SEQ ID NO: 1034119 - RNA, 22 nt, Human
ucuggcucuguguccccaccca

SEQ ID NO: 1034120 - RNA, 22 nt, Human
ucuggccugggccugccggugc

SEQ ID NO: 1034121 - RNA, 20 nt, Human
ugcuggggacauacagggug

SEQ ID NO: 1034122 - RNA, 22 nt, Human
gggaccaggugggugcauuccg

SEQ ID NO: 1034123 - RNA, 22 nt, Human
acagagccaaaaggacauagua

SEQ ID NO: 1034124 - RNA, 19 nt, Human
gcagcugugggaagagcca

SEQ ID NO: 1034125 - RNA, 22 nt, Human
gggcccacuggcugucugaccc

SEQ ID NO: 1034126 - RNA, 19 nt, Human
cugaagucuuuucagcugg

SEQ ID NO: 1034127 - RNA, 22 nt, Human
auacauguaacugcauuguaau

SEQ ID NO: 1034128 - RNA, 22 nt, Human
uguguacaagaguguuuacugu

SEQ ID NO: 1034129 - RNA, 22 nt, Human
ucugucacaauuugcuuacucu

SEQ ID NO: 1034130 - RNA, 22 nt, Human
aggagccaugagugacaucaca

SEQ ID NO: 1034131 - RNA, 22 nt, Human
caggcacugugcugagcucugc

SEQ ID NO: 1034132 - RNA, 22 nt, Human
gaaagagaaccugggccuagau

SEQ ID NO: 1034133 - RNA, 22 nt, Human
cuugggagacacaagaagacau

SEQ ID NO: 1034134 - RNA, 22 nt, Human
cacccaggcuggagugcagggg

SEQ ID NO: 1034135 - RNA, 21 nt, Human
agagaagaggacuuucucaca

SEQ ID NO: 1034136 - RNA, 22 nt, Human
gagcuuaggccagggacaggga

SEQ ID NO: 1034137 - RNA, 22 nt, Human
gggaguggguuuggccuaggcc

SEQ ID NO: 1034138 - RNA, 22 nt, Human
uacaaaguagaaauucaguaaa

SEQ ID NO: 1034139 - RNA, 22 nt, Human
agcacagauucugaagaguccu

SEQ ID NO: 1034140 - RNA, 22 nt, Human
ggcugagggccagggcuagucu

SEQ ID NO: 1034141 - RNA, 22 nt, Human
aggaagccugcaggugacugcu

SEQ ID NO: 1034142 - RNA, 22 nt, Human
uggcucucaggccugcugcguu

SEQ ID NO: 1034143 - RNA, 22 nt, Human
aagagcauauuaauaguggaga

SEQ ID NO: 1034144 - RNA, 22 nt, Human
gccuucagcccugacuggccag

SEQ ID NO: 1034145 - RNA, 22 nt, Human
ucuucuuccuccacagggccca

SEQ ID NO: 1034146 - RNA, 22 nt, Human
uagugaaauuuaugcacagcua

SEQ ID NO: 1034147 - RNA, 17 nt, Human
auuuccucagggcugag

SEQ ID NO: 1034148 - RNA, 22 nt, Human
cccagcccugaccuauuggaaa

SEQ ID NO: 1034149 - RNA, 22 nt, Human
acagcacaaucugagucccaga

SEQ ID NO: 1034150 - RNA, 22 nt, Human
uucaaugauuuuuagggaucau

SEQ ID NO: 1034151 - RNA, 22 nt, Human
ggcugccaggagaagcucagug

SEQ ID NO: 1034152 - RNA, 22 nt, Human
agugaccaaucaugguuagauu

SEQ ID NO: 1034153 - RNA, 22 nt, Human
guggauggacaugggcaagagg

SEQ ID NO: 1034154 - RNA, 22 nt, Human
ucagcugccuuucccaugcuag

SEQ ID NO: 1034155 - RNA, 22 nt, Human
ugcuugagacacauaugaauuu

SEQ ID NO: 1034156 - RNA, 22 nt, Human
cacagcuggugcacuagcucug

SEQ ID NO: 1034157 - RNA, 22 nt, Human
gugccugguuuggggaauguuc

SEQ ID NO: 1034158 - RNA, 22 nt, Human
cacugaagccacuggaagagga

SEQ ID NO: 1034159 - RNA, 22 nt, Human
caguuucucucaauaagcaucg

SEQ ID NO: 1034160 - RNA, 22 nt, Human
uuacuuuguucucaagauaugu

SEQ ID NO: 1034161 - RNA, 22 nt, Human
agacaaagaaaccguagaagca

SEQ ID NO: 1034162 - RNA, 22 nt, Human
cccacagguccccaugaacucg

SEQ ID NO: 1034163 - RNA, 22 nt, Human
gggaucagcaagccacugcacc

SEQ ID NO: 1034164 - RNA, 22 nt, Human
ugagugaggaagcgguggagga

SEQ ID NO: 1034165 - RNA, 22 nt, Human
ucccagagcucuggagguugga

SEQ ID NO: 1034166 - RNA, 22 nt, Human
cuggguggaaagugcugagaau

SEQ ID NO: 1034167 - RNA, 22 nt, Human
acugagcugugacaaugcuuaa

SEQ ID NO: 1034168 - RNA, 22 nt, Human
ccagagcccagggucaugcagg

SEQ ID NO: 1034169 - RNA, 22 nt, Human
ccggggacuuaaagugaaggaa

SEQ ID NO: 1034170 - RNA, 22 nt, Human
uguagaaagaauauguuucaua

SEQ ID NO: 1034171 - RNA, 22 nt, Human
uaacagaagagcaggcagcccu

SEQ ID NO: 1034172 - RNA, 22 nt, Human
ucuggccauggcaagccgagug

SEQ ID NO: 1034173 - RNA, 22 nt, Human
cagccaucaguaaagacagcuu

SEQ ID NO: 1034174 - RNA, 22 nt, Human
cacaguggcagguguggguugu

SEQ ID NO: 1034175 - RNA, 22 nt, Human
ugcagggccuucuagaccaugg

SEQ ID NO: 1034176 - RNA, 22 nt, Human
ucccagagcucugacaccagcu

SEQ ID NO: 1034177 - RNA, 22 nt, Human
cuggcagcuuagcacucugguu

SEQ ID NO: 1034178 - RNA, 22 nt, Human
gaggggcuugaggcccugaugg

SEQ ID NO: 1034179 - RNA, 22 nt, Human
ccugucugcggaggaguggaag

SEQ ID NO: 1034180 - RNA, 22 nt, Human
agcuggugcugaagcucuugag

SEQ ID NO: 1034181 - RNA, 22 nt, Human
uuggaaggagucaaccagcuga

SEQ ID NO: 1034182 - RNA, 22 nt, Human
uuagauaauguagagauaugag

SEQ ID NO: 1034183 - RNA, 22 nt, Human
gccuuccugcagcucugagcgu

SEQ ID NO: 1034184 - RNA, 22 nt, Human
ggaugcugggagacagcaggca

SEQ ID NO: 1034185 - RNA, 22 nt, Human
ggaggaugagcuacgaggagcu

SEQ ID NO: 1034186 - RNA, 22 nt, Human
gggaguggauuauguggaccca

SEQ ID NO: 1034187 - RNA, 22 nt, Human
agaagccauguuuaguaggaug

SEQ ID NO: 1034188 - RNA, 22 nt, Human
ccugucagaugaaguaauugug

SEQ ID NO: 1034189 - RNA, 22 nt, Human
uagcacaucuggcgcuuauagg

SEQ ID NO: 1034190 - RNA, 22 nt, Human
caggugccgggaaugcagcaau

SEQ ID NO: 1034191 - RNA, 22 nt, Human
uccuugaacagagggccugggu

SEQ ID NO: 1034192 - RNA, 22 nt, Human
agcaggaaagaaaaaucugugu

SEQ ID NO: 1034193 - RNA, 22 nt, Human
uggauaaacucacuguaaguug

SEQ ID NO: 1034194 - RNA, 22 nt, Human
cucucugguacauagaguuugg

SEQ ID NO: 1034195 - RNA, 23 nt, Human
ucccagggaaggugagcgaggcu

SEQ ID NO: 1034196 - RNA, 22 nt, Human
agcucccagcuccuuugagaga

SEQ ID NO: 1034197 - RNA, 22 nt, Human
accaggggaugguuggcacugu

SEQ ID NO: 1034198 - RNA, 22 nt, Human
ugaaagguuauuuaggucugcu

SEQ ID NO: 1034199 - RNA, 22 nt, Human
gugauuucuaaucaucugaaug

SEQ ID NO: 1034200 - RNA, 22 nt, Human
ugcagcagcagggaggaggcuc

SEQ ID NO: 1034201 - RNA, 22 nt, Human
cagcaauaagguaagcuucucc

SEQ ID NO: 1034202 - RNA, 22 nt, Human
ugcccugcagugagugcgucug

SEQ ID NO: 1034203 - RNA, 22 nt, Human
cuugugcauuucauuccucagg

SEQ ID NO: 1034204 - RNA, 22 nt, Human
ccacugucuuuuccaggcugaa

SEQ ID NO: 1034205 - RNA, 22 nt, Human
gagcuggcaggaggcuccccga

SEQ ID NO: 1034206 - RNA, 22 nt, Human
gaggggcuggguagggcaaccc

SEQ ID NO: 1034207 - RNA, 22 nt, Human
ugcuggccaauggcagaggcgg

SEQ ID NO: 1034208 - RNA, 22 nt, Human
ccaaaugcuccacugacuuugg

SEQ ID NO: 1034209 - RNA, 22 nt, Human
ugcucuggaguggcuugugcac

SEQ ID NO: 1034210 - RNA, 22 nt, Human
acagguggcuuauuggcugauu

SEQ ID NO: 1034211 - RNA, 22 nt, Human
auggauaagaacaaauaucuga

SEQ ID NO: 1034212 - RNA, 22 nt, Human
ugcauugcauuugucaugaaga

SEQ ID NO: 1034213 - RNA, 22 nt, Human
agaggccuaaccaagauguccu

SEQ ID NO: 1034214 - RNA, 22 nt, Human
cuugccuucuguuccuauagaa

SEQ ID NO: 1034215 - RNA, 22 nt, Human
uaaauucugaucaaguuccuuc

SEQ ID NO: 1034216 - RNA, 22 nt, Human
gcaggaugccagggcagcagcg

SEQ ID NO: 1034217 - RNA, 22 nt, Human
ucucugcucugugccucaguuu

SEQ ID NO: 1034218 - RNA, 22 nt, Human
cagccuguagaauacaguaaau

SEQ ID NO: 1034219 - RNA, 20 nt, Human
ugucagugccugaggcacag

SEQ ID NO: 1034220 - RNA, 22 nt, Human
ugacagcauaacacuggucuug

SEQ ID NO: 1034221 - RNA, 22 nt, Human
agucagcagccuggccaggaga

SEQ ID NO: 1034222 - RNA, 22 nt, Human
agccauugaguuuuaugugcua

SEQ ID NO: 1034223 - RNA, 22 nt, Human
acagaaagaagguguauuugag

SEQ ID NO: 1034224 - RNA, 22 nt, Human
caguuucuuaucuucaaaauug

SEQ ID NO: 1034225 - RNA, 20 nt, Human
cagggccacgcuccaaggca

SEQ ID NO: 1034226 - RNA, 22 nt, Human
aaaagacauaugugggcauucu

SEQ ID NO: 1034227 - RNA, 22 nt, Human
ucaucacucauuggacaacaga

SEQ ID NO: 1034228 - RNA, 22 nt, Human
cuggcaggcggcagagcccagg

SEQ ID NO: 1034229 - RNA, 22 nt, Human
cagagcuggagggaacccuggc

SEQ ID NO: 1034230 - RNA, 22 nt, Human
uuugaacaugcugcaugauaau

SEQ ID NO: 1034231 - RNA, 22 nt, Human
cuggcagcagcuucuggaucga

SEQ ID NO: 1034232 - RNA, 22 nt, Human
ugagaaagugggugccuagcaa

SEQ ID NO: 1034233 - RNA, 22 nt, Human
agguggaacguucaggugcuag

SEQ ID NO: 1034234 - RNA, 23 nt, Human
gccuggagaaaagcugcaguuca

SEQ ID NO: 1034235 - RNA, 22 nt, Human
gaaauguguuguucauuucuaa

SEQ ID NO: 1034236 - RNA, 22 nt, Human
ugcagccaucuuucuuggagga

SEQ ID NO: 1034237 - RNA, 22 nt, Human
ggcuucaccgcgggguugcagg

SEQ ID NO: 1034238 - RNA, 22 nt, Human
cagcagcaaaucuagaagagga

SEQ ID NO: 1034239 - RNA, 22 nt, Human
uauuucaugugcaccauaauuc

SEQ ID NO: 1034240 - RNA, 21 nt, Human
ugguggagugugcugagcaug

SEQ ID NO: 1034241 - RNA, 17 nt, Human
gagauggguggaucacc

SEQ ID NO: 1034242 - RNA, 22 nt, Human
uucacauuagugguucuauaua

SEQ ID NO: 1034243 - RNA, 22 nt, Human
ggaaccaggaguuacacgaguu

SEQ ID NO: 1034244 - RNA, 22 nt, Human
gccagggagucugggccacaga

SEQ ID NO: 1034245 - RNA, 22 nt, Human
ccugaagagcacucuagaguug

SEQ ID NO: 1034246 - RNA, 22 nt, Human
ggcagcagggcugucucccuac

SEQ ID NO: 1034247 - RNA, 22 nt, Human
gacagacauuuccugauccaau

SEQ ID NO: 1034248 - RNA, 22 nt, Human
ccaggcugcuguugguguccgc

SEQ ID NO: 1034249 - RNA, 22 nt, Human
agagcugaggauccagcugagc

SEQ ID NO: 1034250 - RNA, 17 nt, Human
agcagcuggcacaggag

SEQ ID NO: 1034251 - RNA, 22 nt, Human
ugccagcacaaguuaagagauc

SEQ ID NO: 1034252 - RNA, 21 nt, Human
ucccagagugcuugggacugc

SEQ ID NO: 1034253 - RNA, 22 nt, Human
auggcagcaaaugucuggcugg

SEQ ID NO: 1034254 - RNA, 22 nt, Human
ugaggcaggagguugagaacug

SEQ ID NO: 1034255 - RNA, 22 nt, Human
gcuggccauggccugcgccauc

SEQ ID NO: 1034256 - RNA, 22 nt, Human
caggcagcaucagucugcugua

SEQ ID NO: 1034257 - RNA, 22 nt, Human
cugucuguucagauucauuacu

SEQ ID NO: 1034258 - RNA, 22 nt, Human
gcagcagagaacacaaugaugg

SEQ ID NO: 1034259 - RNA, 22 nt, Human
gcagcccagagcgcaggacccc

SEQ ID NO: 1034260 - RNA, 22 nt, Human
ggcaccugcucaucuggacuca

SEQ ID NO: 1034261 - RNA, 22 nt, Human
ccaaagucugcauuuuaacaug

SEQ ID NO: 1034262 - RNA, 22 nt, Human
uggaagggggaagacagcucug

SEQ ID NO: 1034263 - RNA, 22 nt, Human
guaacacagaaaugaaauucca

SEQ ID NO: 1034264 - RNA, 22 nt, Human
ggucccagcugcucaagaggcu

SEQ ID NO: 1034265 - RNA, 20 nt, Human
ucacaggggaccaggagcag

SEQ ID NO: 1034266 - RNA, 22 nt, Human
ugaacgcagguccacauggcuc

SEQ ID NO: 1034267 - RNA, 22 nt, Human
gcagcagaggcccuacucuuug

SEQ ID NO: 1034268 - RNA, 22 nt, Human
aaggccuggauuuagguuguga

SEQ ID NO: 1034269 - RNA, 22 nt, Human
aaugggagagaacacaaagucc

SEQ ID NO: 1034270 - RNA, 21 nt, Human
gugcucugggcagcagagggc

SEQ ID NO: 1034271 - RNA, 15 nt, Human
ugggcagaucacuug

SEQ ID NO: 1034272 - RNA, 22 nt, Human
gcugggcuucucaaugcugccu

SEQ ID NO: 1034273 - RNA, 22 nt, Human
cuucuugcaauuuucaucuuau

SEQ ID NO: 1034274 - RNA, 22 nt, Human
ucugagggcuugaggggaagua

SEQ ID NO: 1034275 - RNA, 22 nt, Human
cugcagcuccccugagaucaag

SEQ ID NO: 1034276 - RNA, 22 nt, Human
gcugccuuuuaaagccucgcuu

SEQ ID NO: 1034277 - RNA, 22 nt, Human
aacagacagaaaaaugugaucu

SEQ ID NO: 1034278 - RNA, 20 nt, Human
gucaucgccggcagcaaaga

SEQ ID NO: 1034279 - RNA, 22 nt, Human
aggcacuggucuaccccuuagu

SEQ ID NO: 1034280 - RNA, 22 nt, Human
gcucccacaaccuucuugcucc

SEQ ID NO: 1034281 - RNA, 22 nt, Human
guuuuccuucucagccauugcc

SEQ ID NO: 1034282 - RNA, 22 nt, Human
gucaugccuggcuucuuagaca

SEQ ID NO: 1034283 - RNA, 22 nt, Human
uguuuguucccucucuuuccug

SEQ ID NO: 1034284 - RNA, 22 nt, Human
uggguggaauaaaucaguucug

SEQ ID NO: 1034285 - RNA, 22 nt, Human
uccuucagaggacggcagccag

SEQ ID NO: 1034286 - RNA, 22 nt, Human
uggcacugagcagccgcggcag

SEQ ID NO: 1034287 - RNA, 22 nt, Human
aggcugcucugcgaagucagcu

SEQ ID NO: 1034288 - RNA, 17 nt, Human
gcagccagugcagcagg

SEQ ID NO: 1034289 - RNA, 22 nt, Human
ggacacaguggaagacagcuug

SEQ ID NO: 1034290 - RNA, 22 nt, Human
ggccccacgggggaguccuagu

SEQ ID NO: 1034291 - RNA, 22 nt, Human
gccucuggucccucaugcugug

SEQ ID NO: 1034292 - RNA, 19 nt, Human
ugggcuuccccagggcaga

SEQ ID NO: 1034293 - RNA, 22 nt, Human
ccagcagagucuaggaaggagg

SEQ ID NO: 1034294 - RNA, 22 nt, Human
uuccaggaauucagcucucagu

SEQ ID NO: 1034295 - RNA, 22 nt, Human
ucucagagauucagggagaagu

SEQ ID NO: 1034296 - RNA, 22 nt, Human
guggcugggcuccgagcggcuu

SEQ ID NO: 1034297 - RNA, 22 nt, Human
ggcugccucuggaagcuggaga

SEQ ID NO: 1034298 - RNA, 22 nt, Human
cugggggcaauggucagagugu

SEQ ID NO: 1034299 - RNA, 22 nt, Human
acacagggcaaugcuuugaccu

SEQ ID NO: 1034300 - RNA, 23 nt, Human
ccuggcagcaaacgaggagguua

SEQ ID NO: 1034301 - RNA, 22 nt, Human
auguucaaacuuuuuacacacc

SEQ ID NO: 1034302 - RNA, 21 nt, Human
gccagggaagagaguuggcug

SEQ ID NO: 1034303 - RNA, 22 nt, Human
gccaggcaaauuaaggaaugca

SEQ ID NO: 1034304 - RNA, 22 nt, Human
uuugcaaauaccaugaaacuug

SEQ ID NO: 1034305 - RNA, 22 nt, Human
aaaguguaaggaauuuaaguaa

SEQ ID NO: 1034306 - RNA, 22 nt, Human
ugcagcucauugguguccuggu

SEQ ID NO: 1034307 - RNA, 22 nt, Human
gccucugggcucugccccuggc

SEQ ID NO: 1034308 - RNA, 23 nt, Human
cccagcagagaugaggagggguc

SEQ ID NO: 1034309 - RNA, 22 nt, Human
aggacuccauguguccuggaga

SEQ ID NO: 1034310 - RNA, 22 nt, Human
cuggcagggugggcuuugcuuu

SEQ ID NO: 1034311 - RNA, 22 nt, Human
cugggcacauuuugacuagugu

SEQ ID NO: 1034312 - RNA, 22 nt, Human
gcugccuuugugagccaagggg

SEQ ID NO: 1034313 - RNA, 21 nt, Human
acaguucaugauaacuccauc

SEQ ID NO: 1034314 - RNA, 22 nt, Human
augcagcaguuuacaaagcaau

SEQ ID NO: 1034315 - RNA, 22 nt, Human
cacaugcauaaggauaauuacu

SEQ ID NO: 1034316 - RNA, 21 nt, Human
uggcagaguugaguaguuaug

SEQ ID NO: 1034317 - RNA, 22 nt, Human
aauccagguggcggagguugug

SEQ ID NO: 1034318 - RNA, 22 nt, Human
ccaucagcaugggagcaugggc

SEQ ID NO: 1034319 - RNA, 20 nt, Human
cuggcaggagcgagucuacc

SEQ ID NO: 1034320 - RNA, 20 nt, Human
ggcagcucacuacuuucugu

SEQ ID NO: 1034321 - RNA, 22 nt, Human
aggccugagguuccugugcuca

SEQ ID NO: 1034322 - RNA, 22 nt, Human
ccaggcugagcaugauuggagc

SEQ ID NO: 1034323 - RNA, 22 nt, Human
ucacuguauuugcugaugcaua

SEQ ID NO: 1034324 - RNA, 22 nt, Human
gugauuucagguuuuucauacu

SEQ ID NO: 1034325 - RNA, 20 nt, Human
uuuuuccuucucuacaggca

SEQ ID NO: 1034326 - RNA, 22 nt, Human
uccucugcucagcauuccucac

SEQ ID NO: 1034327 - RNA, 19 nt, Human
gcuccugggccucacucau

SEQ ID NO: 1034328 - RNA, 22 nt, Human
cuguuuaucccuuuggucagca

SEQ ID NO: 1034329 - RNA, 22 nt, Human
gagggcaggggucuugcacggu

SEQ ID NO: 1034330 - RNA, 22 nt, Human
acuuucucaggaauucacagac

SEQ ID NO: 1034331 - RNA, 22 nt, Human
ccugcagguugcagaggcggaa

SEQ ID NO: 1034332 - RNA, 22 nt, Human
acagagcaauaacagggagagg

SEQ ID NO: 1034333 - RNA, 22 nt, Human
gcuggccuucugcagaguucug

SEQ ID NO: 1034334 - RNA, 20 nt, Human
aggcacuggggauagguaag

SEQ ID NO: 1034335 - RNA, 22 nt, Human
cagaagcaaaugccuugcugag

SEQ ID NO: 1034336 - RNA, 22 nt, Human
uggugcaagucucugaggaggg

SEQ ID NO: 1034337 - RNA, 22 nt, Human
aagugguaggaagagagcacug

SEQ ID NO: 1034338 - RNA, 23 nt, Human
gugcaugugucuuuacaguagca

SEQ ID NO: 1034339 - RNA, 22 nt, Human
uuauuuuuaaaaguucacacag

SEQ ID NO: 1034340 - RNA, 22 nt, Human
cuuccugcauugugccagaguu

SEQ ID NO: 1034341 - RNA, 22 nt, Human
auuuauguaucuguguagauca

SEQ ID NO: 1034342 - RNA, 22 nt, Human
aacagcagggggaccugcuggu

SEQ ID NO: 1034343 - RNA, 22 nt, Human
caaagugcuaggauuacaggcc

SEQ ID NO: 1034344 - RNA, 22 nt, Human
gagccugaaauacaggucacug

SEQ ID NO: 1034345 - RNA, 20 nt, Human
caggccucugggggcccugg

SEQ ID NO: 1034346 - RNA, 22 nt, Human
caguacuuuucaaccaguauga

SEQ ID NO: 1034347 - RNA, 22 nt, Human
gaaaugcauaaucuuaguagau

SEQ ID NO: 1034348 - RNA, 22 nt, Human
guguccaucagcagccacugug

SEQ ID NO: 1034349 - RNA, 22 nt, Human
gagaagccgagucagcugagcc

SEQ ID NO: 1034350 - RNA, 22 nt, Human
ucaaagucuaucuguaauuacu

SEQ ID NO: 1034351 - RNA, 22 nt, Human
gcaaagguagccaaggagcuca

SEQ ID NO: 1034352 - RNA, 18 nt, Human
uggagcugagugcugugc

SEQ ID NO: 1034353 - RNA, 22 nt, Human
aaugucugagucucuguauccc

SEQ ID NO: 1034354 - RNA, 22 nt, Human
ugcauuaugcuacccagaagcu

SEQ ID NO: 1034355 - RNA, 22 nt, Human
ucacaggguuuggaagccuccu

SEQ ID NO: 1034356 - RNA, 22 nt, Human
gccuucugcgcucgugucuccg

SEQ ID NO: 1034357 - RNA, 17 nt, Human
agagagagcaugccacc

SEQ ID NO: 1034358 - RNA, 22 nt, Human
acauuucugcauguaggguaau

SEQ ID NO: 1034359 - RNA, 22 nt, Human
gcuccugucuuggggcacuggc

SEQ ID NO: 1034360 - RNA, 22 nt, Human
ucagccagugccuugaucuugc

SEQ ID NO: 1034361 - RNA, 22 nt, Human
aaaugcauuuuuaauuagaccc

SEQ ID NO: 1034362 - RNA, 22 nt, Human
ugcugccauggucgcugguguc

SEQ ID NO: 1034363 - RNA, 20 nt, Human
gugcauuucaccuguacugu

SEQ ID NO: 1034364 - RNA, 22 nt, Human
ucucccacagucucccauggcu

SEQ ID NO: 1034365 - RNA, 22 nt, Human
gccagagcaugcacugccugca

SEQ ID NO: 1034366 - RNA, 19 nt, Human
ugucucagugucccuuccu

SEQ ID NO: 1034367 - RNA, 22 nt, Human
ugucccagacauaaguggacau

SEQ ID NO: 1034368 - RNA, 23 nt, Human
ggccucuguguucugcccacaug

SEQ ID NO: 1034369 - RNA, 22 nt, Human
ugggcagagaguagaggcaacg

SEQ ID NO: 1034370 - RNA, 22 nt, Human
uggucucuucuuccaagauggc

SEQ ID NO: 1034371 - RNA, 22 nt, Human
agagccuggcucccagcuaccg

SEQ ID NO: 1034372 - RNA, 20 nt, Human
ggcugcugugggcagagagg

SEQ ID NO: 1034373 - RNA, 22 nt, Human
guggauggauuuugaggaaugg

SEQ ID NO: 1034374 - RNA, 22 nt, Human
gaggcccaguccugcaagcacg

SEQ ID NO: 1034375 - RNA, 22 nt, Human
gcugccaugccacagcacucac

SEQ ID NO: 1034376 - RNA, 22 nt, Human
uugggguguuggauggagcaag

SEQ ID NO: 1034377 - RNA, 22 nt, Human
gagcuuccauggacgccaucug

SEQ ID NO: 1034378 - RNA, 22 nt, Human
caaagucccagcugcuuagaga

SEQ ID NO: 1034379 - RNA, 22 nt, Human
aaaggugacacucugccagcug

SEQ ID NO: 1034380 - RNA, 22 nt, Human
gucccuggggaaucagcuggag

SEQ ID NO: 1034381 - RNA, 19 nt, Human
ggaccagguccugggcagc

SEQ ID NO: 1034382 - RNA, 22 nt, Human
cuagucacucagcacugacaaa

SEQ ID NO: 1034383 - RNA, 23 nt, Human
ggccauggagacuuagaaugggc

SEQ ID NO: 1034384 - RNA, 22 nt, Human
uucagcagugcagacacccagu

SEQ ID NO: 1034385 - RNA, 22 nt, Human
caaaggagguaaugggugugag

SEQ ID NO: 1034386 - RNA, 22 nt, Human
ugcucuguaacaaauugacaug

SEQ ID NO: 1034387 - RNA, 22 nt, Human
ugcagccauuuucugccaaugc

SEQ ID NO: 1034388 - RNA, 22 nt, Human
uuaugacaggaaaaucacagaa

SEQ ID NO: 1034389 - RNA, 22 nt, Human
cagggugggcacccagccucca

SEQ ID NO: 1034390 - RNA, 22 nt, Human
gagaagguggaccugaaggagc

SEQ ID NO: 1034391 - RNA, 22 nt, Human
cugaaauuccauuucagccaca

SEQ ID NO: 1034392 - RNA, 22 nt, Human
cccugggcaagcccuauuuucc

SEQ ID NO: 1034393 - RNA, 22 nt, Human
ugcagcuccucuggcugccuga

SEQ ID NO: 1034394 - RNA, 22 nt, Human
cagcagcugcgugcccaggccg

SEQ ID NO: 1034395 - RNA, 22 nt, Human
uaaguucaguuggucgaaguag

SEQ ID NO: 1034396 - RNA, 22 nt, Human
ugcuuuggccacuagaauucag

SEQ ID NO: 1034397 - RNA, 22 nt, Human
gcucugugcaguucagggacac

SEQ ID NO: 1034398 - RNA, 22 nt, Human
ggggauggaggcgugugguccu

SEQ ID NO: 1034399 - RNA, 22 nt, Human
gcugucugucuucacaucucgc

SEQ ID NO: 1034400 - RNA, 22 nt, Human
uuuuccucaggaaugcuaagcu

SEQ ID NO: 1034401 - RNA, 20 nt, Human
cccagggaccugagcuccau

SEQ ID NO: 1034402 - RNA, 22 nt, Human
caggccagugugcuucccaggc

SEQ ID NO: 1034403 - RNA, 22 nt, Human
caggaaagagcugccaggcagg

SEQ ID NO: 1034404 - RNA, 22 nt, Human
uggagcugacucacaccagcua

SEQ ID NO: 1034405 - RNA, 22 nt, Human
gcuggggucugugaggagggcu

SEQ ID NO: 1034406 - RNA, 22 nt, Human
gcuuccuagaucugugguacuc

SEQ ID NO: 1034407 - RNA, 22 nt, Human
acagaaauauagaagguaggaa

SEQ ID NO: 1034408 - RNA, 22 nt, Human
ggcagcugagcauggcuaccuu

SEQ ID NO: 1034409 - RNA, 22 nt, Human
cucaccaggaacagcugcggag

SEQ ID NO: 1034410 - RNA, 22 nt, Human
uggcucaggauaauuuucccaa

SEQ ID NO: 1034411 - RNA, 22 nt, Human
ccagucugugugccagccugcg

SEQ ID NO: 1034412 - RNA, 22 nt, Human
acacccagagcgccagugccga

SEQ ID NO: 1034413 - RNA, 22 nt, Human
aggaaaaauaaggcagcagggc

SEQ ID NO: 1034414 - RNA, 22 nt, Human
ccagggcugcugugggacucca

SEQ ID NO: 1034415 - RNA, 22 nt, Human
aacucagucauaaagcgaaugc

SEQ ID NO: 1034416 - RNA, 22 nt, Human
gggcugagucugcugccuguca

SEQ ID NO: 1034417 - RNA, 22 nt, Human
uccucaggauguggaguagaau

SEQ ID NO: 1034418 - RNA, 23 nt, Human
ucagagaaguuguaggcugggga

SEQ ID NO: 1034419 - RNA, 22 nt, Human
gugcagcugugugagagcucca

SEQ ID NO: 1034420 - RNA, 22 nt, Human
agcagagcggggccuccggaag

SEQ ID NO: 1034421 - RNA, 17 nt, Human
uggagcugcguguguuc

SEQ ID NO: 1034422 - RNA, 21 nt, Human
aggcucagagaucaaacagua

SEQ ID NO: 1034423 - RNA, 22 nt, Human
ccuggcagguggagguugcagu

SEQ ID NO: 1034424 - RNA, 22 nt, Human
ugcagggcuacaggacuacaac

SEQ ID NO: 1034425 - RNA, 22 nt, Human
agauacauauagaaaacaucaa

SEQ ID NO: 1034426 - RNA, 22 nt, Human
gugccuggcacacagaaggcaa

SEQ ID NO: 1034427 - RNA, 22 nt, Human
ugcauuaucuuuaauguucuca

SEQ ID NO: 1034428 - RNA, 22 nt, Human
uuggcugaagguuaagugcugg

SEQ ID NO: 1034429 - RNA, 22 nt, Human
aaaucuaggcucauccuggucc

SEQ ID NO: 1034430 - RNA, 22 nt, Human
gugagcagaacagguggcuucu

SEQ ID NO: 1034431 - RNA, 22 nt, Human
guccucugggcagcugccccac

SEQ ID NO: 1034432 - RNA, 22 nt, Human
aaagguuaagguguucaagaaa

SEQ ID NO: 1034433 - RNA, 22 nt, Human
gcugccacgaucucugcuguag

SEQ ID NO: 1034434 - RNA, 22 nt, Human
gcucucugccuuucucaaugac

SEQ ID NO: 1034435 - RNA, 22 nt, Human
ucccagaguauuagcaauugcu

SEQ ID NO: 1034436 - RNA, 22 nt, Human
ucaaaagucugcauucuucaca

SEQ ID NO: 1034437 - RNA, 20 nt, Human
uucauucauuccacaacuuc

SEQ ID NO: 1034438 - RNA, 20 nt, Human
ugccaugguaacagagugug

SEQ ID NO: 1034439 - RNA, 22 nt, Human
ucucagggccucccucuguuuc

SEQ ID NO: 1034440 - RNA, 22 nt, Human
gcagccagaagacucagaacaa

SEQ ID NO: 1034441 - RNA, 22 nt, Human
ugcagcagguuccaaaggguua

SEQ ID NO: 1034442 - RNA, 22 nt, Human
ggcagggaggaggugaaaguga

SEQ ID NO: 1034443 - RNA, 20 nt, Human
aagcagaagcugcucucagc

SEQ ID NO: 1034444 - RNA, 20 nt, Human
gugggcagcaggcauacugg

SEQ ID NO: 1034445 - RNA, 22 nt, Human
aguguguguuugggcgguuuau

SEQ ID NO: 1034446 - RNA, 22 nt, Human
cugcuggccuagcccauccucu

SEQ ID NO: 1034447 - RNA, 22 nt, Human
gcaggggcugagcaccagcggg

SEQ ID NO: 1034448 - RNA, 22 nt, Human
auuucuuuucaagagggugcuu

SEQ ID NO: 1034449 - RNA, 22 nt, Human
ccaggaggcggaagguacagug

SEQ ID NO: 1034450 - RNA, 22 nt, Human
ugggcacaaacaucugccuguu

SEQ ID NO: 1034451 - RNA, 22 nt, Human
cagcuggaucccugcagaacuu

SEQ ID NO: 1034452 - RNA, 22 nt, Human
ccugccaggagcuggugcugca

SEQ ID NO: 1034453 - RNA, 22 nt, Human
cagugcauagauccugaggccu

SEQ ID NO: 1034454 - RNA, 22 nt, Human
cucuuuccaggguaccccaggu

SEQ ID NO: 1034455 - RNA, 22 nt, Human
gucugucucucuccagagugca

SEQ ID NO: 1034456 - RNA, 22 nt, Human
caggccucagagaguggcgggg

SEQ ID NO: 1034457 - RNA, 22 nt, Human
acagagcucccagccaucuccu

SEQ ID NO: 1034458 - RNA, 22 nt, Human
gaaggccuagggaugcucugcg

SEQ ID NO: 1034459 - RNA, 22 nt, Human
agucagugaaaacuagaauguu

SEQ ID NO: 1034460 - RNA, 22 nt, Human
cacugccuggaaggagagacau

SEQ ID NO: 1034461 - RNA, 22 nt, Human
gaagcccacguuuggugaugua

SEQ ID NO: 1034462 - RNA, 22 nt, Human
augguuuguguggcccagauga

SEQ ID NO: 1034463 - RNA, 22 nt, Human
ugcugcacaauuggaaaguauc

SEQ ID NO: 1034464 - RNA, 22 nt, Human
ccaggccaaauucagucagcag

SEQ ID NO: 1034465 - RNA, 22 nt, Human
ccagcugguuaaaauagagaaa

SEQ ID NO: 1034466 - RNA, 19 nt, Human
ucccuggcgccucucgggc

SEQ ID NO: 1034467 - RNA, 22 nt, Human
acagcuggaggucugugagcac

SEQ ID NO: 1034468 - RNA, 18 nt, Human
ggagccagucugucucug

SEQ ID NO: 1034469 - RNA, 22 nt, Human
cuccagggaugagacagaguag

SEQ ID NO: 1034470 - RNA, 22 nt, Human
ccugagcuggaagagcuugugc

SEQ ID NO: 1034471 - RNA, 22 nt, Human
ugcaggggcuugucugggccug

SEQ ID NO: 1034472 - RNA, 22 nt, Human
auuauauugaguauaaccagag

SEQ ID NO: 1034473 - RNA, 20 nt, Human
auguagaugaaagcaaaggc

SEQ ID NO: 1034474 - RNA, 22 nt, Human
aaguguguauuguuuaugcugc

SEQ ID NO: 1034475 - RNA, 22 nt, Human
uccagugguacauggagacacu

SEQ ID NO: 1034476 - RNA, 22 nt, Human
aagcgccaugguuccugcgcag

SEQ ID NO: 1034477 - RNA, 22 nt, Human
gaggacagugugaucugccagc

SEQ ID NO: 1034478 - RNA, 22 nt, Human
gugcauauaugcacauaugugu

SEQ ID NO: 1034479 - RNA, 22 nt, Human
gagagcugggggacuguggaug

SEQ ID NO: 1034480 - RNA, 22 nt, Human
gagcuuggugaugccuccuggu

SEQ ID NO: 1034481 - RNA, 22 nt, Human
cucagcagagaccagggaggaa

SEQ ID NO: 1034482 - RNA, 22 nt, Human
ucaggcagcuccaggaauggua

SEQ ID NO: 1034483 - RNA, 22 nt, Human
aauaauuuccagccaacuggaa

SEQ ID NO: 1034484 - RNA, 22 nt, Human
aggaggcccuagagcucuagag

SEQ ID NO: 1034485 - RNA, 17 nt, Human
cucugcagugcauggcu

SEQ ID NO: 1034486 - RNA, 22 nt, Human
uggcucaguuuagcagcucagu

SEQ ID NO: 1034487 - RNA, 22 nt, Human
gcagcugcuguggcaucaagcu

SEQ ID NO: 1034488 - RNA, 22 nt, Human
ucauugucuugauaugauuguc

SEQ ID NO: 1034489 - RNA, 23 nt, Human
caggcaggaugaggacuacacuc

SEQ ID NO: 1034490 - RNA, 22 nt, Human
agauaauuugaguaaauuaauu

SEQ ID NO: 1034491 - RNA, 22 nt, Human
agccaaggcagcuagagcucug

SEQ ID NO: 1034492 - RNA, 22 nt, Human
gguccccagcaguggcugcuuc

SEQ ID NO: 1034493 - RNA, 20 nt, Human
uagauuucauacuucucuuu

SEQ ID NO: 1034494 - RNA, 22 nt, Human
cagggugacugcccuggccacu

SEQ ID NO: 1034495 - RNA, 22 nt, Human
gccucugcaucuucgccgcacu

SEQ ID NO: 1034496 - RNA, 22 nt, Human
gaggaaaauggaguguaauuaa

SEQ ID NO: 1034497 - RNA, 22 nt, Human
cccagacugcagagcgggcaga

SEQ ID NO: 1034498 - RNA, 22 nt, Human
gcagggcuguggacacuuuggu

SEQ ID NO: 1034499 - RNA, 22 nt, Human
ucacugcaaucucugccuucca

SEQ ID NO: 1034500 - RNA, 23 nt, Human
acuuuagauaaauuaugugcaca

SEQ ID NO: 1034501 - RNA, 22 nt, Human
ugccucagcugaggccgcucca

SEQ ID NO: 1034502 - RNA, 22 nt, Human
cugggcugucaauggcccucug

SEQ ID NO: 1034503 - RNA, 20 nt, Human
cugagcccccagccugcagg

SEQ ID NO: 1034504 - RNA, 19 nt, Human
guggccugcgcugggugcg

SEQ ID NO: 1034505 - RNA, 22 nt, Human
gcucaggagcugacagccucaa

SEQ ID NO: 1034506 - RNA, 22 nt, Human
auaaauuuauaauuguuuccug

SEQ ID NO: 1034507 - RNA, 22 nt, Human
ucaaaaguuucacauagagaua

SEQ ID NO: 1034508 - RNA, 22 nt, Human
caggcacuagcagaaugaggcu

SEQ ID NO: 1034509 - RNA, 22 nt, Human
ucccuggccauuccucuaggcc

SEQ ID NO: 1034510 - RNA, 21 nt, Human
acagcaagccuuccuuucagg

SEQ ID NO: 1034511 - RNA, 22 nt, Human
uagggcagccacccaggcugcu

SEQ ID NO: 1034512 - RNA, 22 nt, Human
agauacaugucaagagacuuau

SEQ ID NO: 1034513 - RNA, 18 nt, Human
uccuccuuuggccuuuuc

SEQ ID NO: 1034514 - RNA, 22 nt, Human
uguaggacauguacuuguaaca

SEQ ID NO: 1034515 - RNA, 22 nt, Human
uggcagcaauuagcuagagcug

SEQ ID NO: 1034516 - RNA, 20 nt, Human
ugcuguaagauuagagagcu

SEQ ID NO: 1034517 - RNA, 22 nt, Human
cugagucucccggcaguggagg

SEQ ID NO: 1034518 - RNA, 22 nt, Human
aaagucauguaaugauaugauu

SEQ ID NO: 1034519 - RNA, 22 nt, Human
cagagagcuuagugugcugcau

SEQ ID NO: 1034520 - RNA, 22 nt, Human
ucacaggaaccaucagagaaau

SEQ ID NO: 1034521 - RNA, 22 nt, Human
acaaagucaaauugcagccgcc

SEQ ID NO: 1034522 - RNA, 20 nt, Human
ugcagcugguuucacaggga

SEQ ID NO: 1034523 - RNA, 22 nt, Human
uggggacauagccagucuggcu

SEQ ID NO: 1034524 - RNA, 22 nt, Human
aguggcagccgagcaggagaug

SEQ ID NO: 1034525 - RNA, 22 nt, Human
cuggagcuaggaaguccaagau

SEQ ID NO: 1034526 - RNA, 22 nt, Human
uggcucugugcuucuaguaucu

SEQ ID NO: 1034527 - RNA, 22 nt, Human
acuucucuucauagguggcaau

SEQ ID NO: 1034528 - RNA, 22 nt, Human
gggugacauuucccaaugagcc

SEQ ID NO: 1034529 - RNA, 22 nt, Human
gcuggcugaggucuagcucuuu

SEQ ID NO: 1034530 - RNA, 22 nt, Human
gaaaguuuauagguuauauaau

SEQ ID NO: 1034531 - RNA, 22 nt, Human
agucauauguggcauuuucuaa

SEQ ID NO: 1034532 - RNA, 22 nt, Human
auaauaaaccaggaugggucug

SEQ ID NO: 1034533 - RNA, 22 nt, Human
uggggagugaugccucggauaa

SEQ ID NO: 1034534 - RNA, 22 nt, Human
uagaaagcuugggguguuuaaa

SEQ ID NO: 1034535 - RNA, 22 nt, Human
agcagccacccagcugcucauu

SEQ ID NO: 1034536 - RNA, 22 nt, Human
uccuucaggccucauucucaua

SEQ ID NO: 1034537 - RNA, 22 nt, Human
uggagcaggcaucuuucucucu

SEQ ID NO: 1034538 - RNA, 22 nt, Human
cugucaguucuuccagauagag

SEQ ID NO: 1034539 - RNA, 22 nt, Human
cuccagggagcugcgggagcca

SEQ ID NO: 1034540 - RNA, 23 nt, Human
ugucacauuuaguuggcauuguu

SEQ ID NO: 1034541 - RNA, 21 nt, Human
cugcuuuacuucagaggaucu

SEQ ID NO: 1034542 - RNA, 22 nt, Human
cacugcuuauaaauucuaggca

SEQ ID NO: 1034543 - RNA, 22 nt, Human
uggcugaaggaagauucuucua

SEQ ID NO: 1034544 - RNA, 22 nt, Human
ugacacagaaauuaagcuguca

SEQ ID NO: 1034545 - RNA, 22 nt, Human
ugucccagacacaguaugcgcu

SEQ ID NO: 1034546 - RNA, 22 nt, Human
agcuggagcuucaagcagguaa

SEQ ID NO: 1034547 - RNA, 19 nt, Human
cccuggcaggcaagccugg

SEQ ID NO: 1034548 - RNA, 22 nt, Human
gcagcuguguaaugagcccaca

SEQ ID NO: 1034549 - RNA, 22 nt, Human
gacccaggguuucugcacaggg

SEQ ID NO: 1034550 - RNA, 22 nt, Human
ggcagcagaacuggcccuguau

SEQ ID NO: 1034551 - RNA, 22 nt, Human
ucaccagucuuucuuaccauug

SEQ ID NO: 1034552 - RNA, 22 nt, Human
gggcagagacucagaaacagaa

SEQ ID NO: 1034553 - RNA, 22 nt, Human
ucucacugggucacagcagagg

SEQ ID NO: 1034554 - RNA, 22 nt, Human
uugacaauugggagauauaaag

SEQ ID NO: 1034555 - RNA, 22 nt, Human
cgggcuggcugcagcugcugga

SEQ ID NO: 1034556 - RNA, 23 nt, Human
ucacagggcacuggcugggguug

SEQ ID NO: 1034557 - RNA, 23 nt, Human
uuugcaaauuggacacaaccaca

SEQ ID NO: 1034558 - RNA, 22 nt, Human
uccuugaaaggggcugcagggc

SEQ ID NO: 1034559 - RNA, 22 nt, Human
agcagccagaaauccagaggug

SEQ ID NO: 1034560 - RNA, 21 nt, Human
aacaaagggaugcucaucuuu

SEQ ID NO: 1034561 - RNA, 22 nt, Human
acaugauuggacuccuuccccu

SEQ ID NO: 1034562 - RNA, 22 nt, Human
ucccagccacagguguagcccu

SEQ ID NO: 1034563 - RNA, 22 nt, Human
uucuuuaaaauagugagaaaga

SEQ ID NO: 1034564 - RNA, 22 nt, Human
ugagagugaaaugucacauguc

SEQ ID NO: 1034565 - RNA, 22 nt, Human
agcagggcagcugaugcgcacg

SEQ ID NO: 1034566 - RNA, 22 nt, Human
accucugcaacccuggaauggg

SEQ ID NO: 1034567 - RNA, 22 nt, Human
uggcugaauaaaauaugguguu

SEQ ID NO: 1034568 - RNA, 22 nt, Human
cagagccucagaauccugugga

SEQ ID NO: 1034569 - RNA, 21 nt, Human
cucaggaucuuauauauuagu

SEQ ID NO: 1034570 - RNA, 22 nt, Human
gcugucacacaugggaucucag

SEQ ID NO: 1034571 - RNA, 21 nt, Human
agacagaacaacugcucucca

SEQ ID NO: 1034572 - RNA, 22 nt, Human
cacagaagaaucaugcuguguu

SEQ ID NO: 1034573 - RNA, 22 nt, Human
agagcuguagcuuccuagagcc

SEQ ID NO: 1034574 - RNA, 22 nt, Human
aggcugucaucuuugcaggcag

SEQ ID NO: 1034575 - RNA, 22 nt, Human
ggagagcaggguccugagauac

SEQ ID NO: 1034576 - RNA, 22 nt, Human
gcugccugcacagagcugcuuu

SEQ ID NO: 1034577 - RNA, 22 nt, Human
cagucccaccaggaucgcucuu

SEQ ID NO: 1034578 - RNA, 22 nt, Human
gcagccacugggagugcuuaua

SEQ ID NO: 1034579 - RNA, 22 nt, Human
ggcacugagaacaggcugacuu

SEQ ID NO: 1034580 - RNA, 22 nt, Human
ucuuucucucuaaucaagcaca

SEQ ID NO: 1034581 - RNA, 22 nt, Human
cugagccaaaaagcagagcuug

SEQ ID NO: 1034582 - RNA, 22 nt, Human
cuggggugagcagaaacagggg

SEQ ID NO: 1034583 - RNA, 22 nt, Human
agcauuuaguuaguaaauguuu

SEQ ID NO: 1034584 - RNA, 22 nt, Human
gggccuccggggugagcugugg

SEQ ID NO: 1034585 - RNA, 22 nt, Human
acaaagucuuuuacaacaguca

SEQ ID NO: 1034586 - RNA, 22 nt, Human
uuacaucuaaacugugaacaau

SEQ ID NO: 1034587 - RNA, 22 nt, Human
acuuucucaaaucagacuuuaa

SEQ ID NO: 1034588 - RNA, 22 nt, Human
aagcuuccugaaugcucauuua

SEQ ID NO: 1034589 - RNA, 22 nt, Human
ugggcugccggcaggcucugcc

SEQ ID NO: 1034590 - RNA, 20 nt, Human
uugcauuggaugugcaggug

SEQ ID NO: 1034591 - RNA, 22 nt, Human
ccagucacagguguguuuauau

SEQ ID NO: 1034592 - RNA, 22 nt, Human
ggccuagggaguggccaugccu

SEQ ID NO: 1034593 - RNA, 22 nt, Human
ucugccuguucaagucuucuag

SEQ ID NO: 1034594 - RNA, 22 nt, Human
cccagcccaucucaaaggucua

SEQ ID NO: 1034595 - RNA, 22 nt, Human
auugucuguacuuuaaaaaugu

SEQ ID NO: 1034596 - RNA, 22 nt, Human
ucagaggaauaaugcugcauuu

SEQ ID NO: 1034597 - RNA, 22 nt, Human
cugaggccucucuccugggcuu

SEQ ID NO: 1034598 - RNA, 22 nt, Human
cugcagugaaaucaggaagcaa

SEQ ID NO: 1034599 - RNA, 22 nt, Human
gugcuuccugccuggugccuuu

SEQ ID NO: 1034600 - RNA, 22 nt, Human
uuugcauuuuagauuuaggccu

SEQ ID NO: 1034601 - RNA, 22 nt, Human
uucauuccuucuguaccuugcc

SEQ ID NO: 1034602 - RNA, 22 nt, Human
auugacaaauggauguugacau

SEQ ID NO: 1034603 - RNA, 22 nt, Human
acucucagaggguggcagcaau

SEQ ID NO: 1034604 - RNA, 17 nt, Human
gcuggcugacccaugcc

SEQ ID NO: 1034605 - RNA, 22 nt, Human
auguuauuuuggaaaauacaaa

SEQ ID NO: 1034606 - RNA, 22 nt, Human
agccagcaggugagugcagccu

SEQ ID NO: 1034607 - RNA, 22 nt, Human
uagccuucucaagacaaaguug

SEQ ID NO: 1034608 - RNA, 22 nt, Human
cugggacacccaaggaaagagc

SEQ ID NO: 1034609 - RNA, 22 nt, Human
aggagcugcauggauaccuggu

SEQ ID NO: 1034610 - RNA, 18 nt, Human
ucaagacaucaugaaaua

SEQ ID NO: 1034611 - RNA, 22 nt, Human
aagauuuagggccaguuuacau

SEQ ID NO: 1034612 - RNA, 23 nt, Human
uaagaacagacaagcauuuacau

SEQ ID NO: 1034613 - RNA, 22 nt, Human
ucuaaaaaagucuguucacuug

SEQ ID NO: 1034614 - RNA, 20 nt, Human
ggccuuggguuucgccuguu

SEQ ID NO: 1034615 - RNA, 22 nt, Human
ccugucuguccucucaugagcc

SEQ ID NO: 1034616 - RNA, 22 nt, Human
agucccagcuacucaagaggcu

SEQ ID NO: 1034617 - RNA, 22 nt, Human
aaaugaccagaauacaggcuuc

SEQ ID NO: 1034618 - RNA, 22 nt, Human
acauuucuugaugccucuguga

SEQ ID NO: 1034619 - RNA, 22 nt, Human
gagccuggauugucaccgacuu

SEQ ID NO: 1034620 - RNA, 22 nt, Human
ugcaauaaggaguaauaguaaa

SEQ ID NO: 1034621 - RNA, 22 nt, Human
gcugugcagccaagugccucug

SEQ ID NO: 1034622 - RNA, 22 nt, Human
gaaggaaaucugugauuuaugc

SEQ ID NO: 1034623 - RNA, 22 nt, Human
ggaggcaggaaagacagguuca

SEQ ID NO: 1034624 - RNA, 22 nt, Human
uacuuugucauucuaaccuucc

SEQ ID NO: 1034625 - RNA, 22 nt, Human
gugucccagccccacaggccug

SEQ ID NO: 1034626 - RNA, 22 nt, Human
agucccaguucgguucuuccuc

SEQ ID NO: 1034627 - RNA, 22 nt, Human
ugggccacaagccaugggacca

SEQ ID NO: 1034628 - RNA, 22 nt, Human
ugccagaagauucucuaucaga

SEQ ID NO: 1034629 - RNA, 23 nt, Human
ucuuuacauacugaugaguucuc

SEQ ID NO: 1034630 - RNA, 22 nt, Human
aaguauauuuuuugaagcauau

SEQ ID NO: 1034631 - RNA, 22 nt, Human
ggaggaugccaagcugugcaca

SEQ ID NO: 1034632 - RNA, 22 nt, Human
uguggcugacuccuggucccca

SEQ ID NO: 1034633 - RNA, 20 nt, Human
agauggugaaggccagggag

SEQ ID NO: 1034634 - RNA, 22 nt, Human
aagcccaguuucacacugagac

SEQ ID NO: 1034635 - RNA, 22 nt, Human
gucaaguuuauccgcucauuca

SEQ ID NO: 1034636 - RNA, 22 nt, Human
gagcaggcucugccuguguguc

SEQ ID NO: 1034637 - RNA, 19 nt, Human
gcuguauuaaagauacaug

SEQ ID NO: 1034638 - RNA, 22 nt, Human
gcugccaguguggcaugaugca

SEQ ID NO: 1034639 - RNA, 22 nt, Human
agccaggaaugcaugcucugcu

SEQ ID NO: 1034640 - RNA, 22 nt, Human
ugccugucuucaggagugucac

SEQ ID NO: 1034641 - RNA, 22 nt, Human
ggagaccagaaggaagcuucga

SEQ ID NO: 1034642 - RNA, 22 nt, Human
aggacuucuccgauaagucaga

SEQ ID NO: 1034643 - RNA, 22 nt, Human
uccugggcugugugccacucug

SEQ ID NO: 1034644 - RNA, 22 nt, Human
gaggucagucagaccaggguuu

SEQ ID NO: 1034645 - RNA, 22 nt, Human
gggugggccugucuggccaugu

SEQ ID NO: 1034646 - RNA, 22 nt, Human
uaugaguacaaggacucugucu

SEQ ID NO: 1034647 - RNA, 22 nt, Human
aagagcugcccaaggugaacag

SEQ ID NO: 1034648 - RNA, 22 nt, Human
agggugcagaaggagccuagga

SEQ ID NO: 1034649 - RNA, 22 nt, Human
uugcaccauuucacuuccauua

SEQ ID NO: 1034650 - RNA, 22 nt, Human
cacagaguggaggcuuggccug

SEQ ID NO: 1034651 - RNA, 22 nt, Human
caugaagcuugaagcaguccac

SEQ ID NO: 1034652 - RNA, 22 nt, Human
caucacugacgcugagauucca

SEQ ID NO: 1034653 - RNA, 22 nt, Human
acagggcauuuccucuaugugu

SEQ ID NO: 1034654 - RNA, 22 nt, Human
ugggccuggagcccuggagagu

SEQ ID NO: 1034655 - RNA, 22 nt, Human
cuguuuauuacacuggauagca

SEQ ID NO: 1034656 - RNA, 22 nt, Human
gcagccacagaggagggaugca

SEQ ID NO: 1034657 - RNA, 22 nt, Human
accaggcuggagugcaguggcg

SEQ ID NO: 1034658 - RNA, 22 nt, Human
aaaggucaagcuggacucaggu

SEQ ID NO: 1034659 - RNA, 22 nt, Human
auggaaaggcuguggaaacuua

SEQ ID NO: 1034660 - RNA, 19 nt, Human
caguggagauuggaggagg

SEQ ID NO: 1034661 - RNA, 22 nt, Human
ccuggcagcuaagugcuuugag

SEQ ID NO: 1034662 - RNA, 22 nt, Human
cugagguggaacagaggugaag

SEQ ID NO: 1034663 - RNA, 22 nt, Human
gagggauggugugagaggcuca

SEQ ID NO: 1034664 - RNA, 22 nt, Human
aaaugcacaauaaaguaaaggc

SEQ ID NO: 1034665 - RNA, 22 nt, Human
gcugccacucugagcuugcuuc

SEQ ID NO: 1034666 - RNA, 22 nt, Human
cauugcucaggcccagcaggaa

SEQ ID NO: 1034667 - RNA, 22 nt, Human
gccuccugagaagccacaggcu

SEQ ID NO: 1034668 - RNA, 22 nt, Human
guuauugcaguauagaggucua

SEQ ID NO: 1034669 - RNA, 22 nt, Human
gccuggaggggacagucucugg

SEQ ID NO: 1034670 - RNA, 22 nt, Human
uccucaggcugccuggaagacu

SEQ ID NO: 1034671 - RNA, 22 nt, Human
gagcacagccaaaguaagaagg

SEQ ID NO: 1034672 - RNA, 22 nt, Human
gccaggugcauggcugagucuc

SEQ ID NO: 1034673 - RNA, 22 nt, Human
uggaagcacuuggguuuuguug

SEQ ID NO: 1034674 - RNA, 22 nt, Human
gccugggagagggauagugcag

SEQ ID NO: 1034675 - RNA, 22 nt, Human
agcagcauucucugguaugggg

SEQ ID NO: 1034676 - RNA, 22 nt, Human
aaucaguuaaauauugaguaca

SEQ ID NO: 1034677 - RNA, 22 nt, Human
uccucucagugugguuguggga

SEQ ID NO: 1034678 - RNA, 22 nt, Human
augcacuugcguguuugcaaau

SEQ ID NO: 1034679 - RNA, 22 nt, Human
ggcugccugugcccaggcacac

SEQ ID NO: 1034680 - RNA, 22 nt, Human
gaagagcugcaguuuccugggc

SEQ ID NO: 1034681 - RNA, 22 nt, Human
gcagggugaaggucacauagaa

SEQ ID NO: 1034682 - RNA, 22 nt, Human
ucuccuucgaggcccagcuccc

SEQ ID NO: 1034683 - RNA, 22 nt, Human
aggccugaggaccuucuggagg

SEQ ID NO: 1034684 - RNA, 22 nt, Human
aggagcugacuuguaaagcauu

SEQ ID NO: 1034685 - RNA, 22 nt, Human
cauucauuagaauagauaugua

SEQ ID NO: 1034686 - RNA, 22 nt, Human
acagggccagccugggaccugg

SEQ ID NO: 1034687 - RNA, 19 nt, Human
cugaggugcaguaagaggc

SEQ ID NO: 1034688 - RNA, 20 nt, Human
ucagggcaugggacagcccc

SEQ ID NO: 1034689 - RNA, 22 nt, Human
cugccucaugcugccugcagcc

SEQ ID NO: 1034690 - RNA, 22 nt, Human
ugggcugcugucugcacaugcu

SEQ ID NO: 1034691 - RNA, 22 nt, Human
ugccuggguucccaccccaaag

SEQ ID NO: 1034692 - RNA, 22 nt, Human
ucagcuccucaugcaggggaua

SEQ ID NO: 1034693 - RNA, 22 nt, Human
uuaugcuaaaugaaucaaguca

SEQ ID NO: 1034694 - RNA, 22 nt, Human
agcagcugguaggaguggccac

SEQ ID NO: 1034695 - RNA, 22 nt, Human
uauuucuggcuuugagggugau

SEQ ID NO: 1034696 - RNA, 22 nt, Human
uacauguaauuuucauaguaag

SEQ ID NO: 1034697 - RNA, 22 nt, Human
ugccugucucugacugccauua

SEQ ID NO: 1034698 - RNA, 22 nt, Human
ucuguuccaguagaaaggugca

SEQ ID NO: 1034699 - RNA, 22 nt, Human
ccagcuugaagaugugcugguu

SEQ ID NO: 1034700 - RNA, 22 nt, Human
ugaacccaggagguugcaguga

SEQ ID NO: 1034701 - RNA, 21 nt, Human
cauuucuauugaugagaaaag

SEQ ID NO: 1034702 - RNA, 22 nt, Human
cugcagagcauaaaucugaaua

SEQ ID NO: 1034703 - RNA, 22 nt, Human
aauuccugucuuaacaguucug

SEQ ID NO: 1034704 - RNA, 22 nt, Human
gcugucccgaaccccugguaau

SEQ ID NO: 1034705 - RNA, 22 nt, Human
ccgggccucgggacaccgggua

SEQ ID NO: 1034706 - RNA, 20 nt, Human
gcccacucuaauccacuguc

SEQ ID NO: 1034707 - RNA, 22 nt, Human
cagggccuuauccugccauuga

SEQ ID NO: 1034708 - RNA, 22 nt, Human
agcagcugucccuuaacaucag

SEQ ID NO: 1034709 - RNA, 22 nt, Human
cccaggaggcagagcuugcagu

SEQ ID NO: 1034710 - RNA, 22 nt, Human
augcagagacagauguggcaug

SEQ ID NO: 1034711 - RNA, 22 nt, Human
ugccugucuccucugcagggug

SEQ ID NO: 1034712 - RNA, 22 nt, Human
ugucuucaguaaaauacacuau

SEQ ID NO: 1034713 - RNA, 22 nt, Human
uauaagaaacaaggcaaauuuu

SEQ ID NO: 1034714 - RNA, 22 nt, Human
auaauuuaaauuaguaugugau

SEQ ID NO: 1034715 - RNA, 22 nt, Human
ggaggaccccagcagcucccca

SEQ ID NO: 1034716 - RNA, 22 nt, Human
caggcaccccaggugagcacug

SEQ ID NO: 1034717 - RNA, 23 nt, Human
uuacaguaggaguuggaaaacca

SEQ ID NO: 1034718 - RNA, 22 nt, Human
ugucccagucaaggcugucauc

SEQ ID NO: 1034719 - RNA, 22 nt, Human
ucccugggccacagcugugagc

SEQ ID NO: 1034720 - RNA, 22 nt, Human
ucccagcauaacaaacugcccg

SEQ ID NO: 1034721 - RNA, 22 nt, Human
gacagaagaggaacuuggacag

SEQ ID NO: 1034722 - RNA, 22 nt, Human
ggcuucagugacuggugcccuc

SEQ ID NO: 1034723 - RNA, 22 nt, Human
aaugcacauauauguguauaca

SEQ ID NO: 1034724 - RNA, 22 nt, Human
ucccagaggcuccagucucuau

SEQ ID NO: 1034725 - RNA, 22 nt, Human
gucccagaaacauauugcuggu

SEQ ID NO: 1034726 - RNA, 18 nt, Human
ggcugccuguuccugaag

SEQ ID NO: 1034727 - RNA, 22 nt, Human
cugucaccuguucacugcagca

SEQ ID NO: 1034728 - RNA, 22 nt, Human
cugccugugccaaugcuccuuu

SEQ ID NO: 1034729 - RNA, 22 nt, Human
ugcugccuccaacuccugggcu

SEQ ID NO: 1034730 - RNA, 22 nt, Human
agggcagcuaaggugcugacug

SEQ ID NO: 1034731 - RNA, 22 nt, Human
acuuccuguuaugugugccucu

SEQ ID NO: 1034732 - RNA, 22 nt, Human
ccuggagauuauuugguccaau

SEQ ID NO: 1034733 - RNA, 22 nt, Human
aggccuguuccuuccugggcac

SEQ ID NO: 1034734 - RNA, 22 nt, Human
augggcagcagcugccauucau

SEQ ID NO: 1034735 - RNA, 22 nt, Human
gagcagggccacuucuguaccu

SEQ ID NO: 1034736 - RNA, 22 nt, Human
guuccacaaaauguacccaguu

SEQ ID NO: 1034737 - RNA, 22 nt, Human
uuguccuuggaugaagcuggga

SEQ ID NO: 1034738 - RNA, 22 nt, Human
ugcuggaggggccugaccagga

SEQ ID NO: 1034739 - RNA, 22 nt, Human
gacaugcaacaauuuggcauuu

SEQ ID NO: 1034740 - RNA, 22 nt, Human
acuuugaaacuaaaauucauua

SEQ ID NO: 1034741 - RNA, 22 nt, Human
agccuccaaaugucaggucccg

SEQ ID NO: 1034742 - RNA, 22 nt, Human
cugugcaagacuuacuuuaaua

SEQ ID NO: 1034743 - RNA, 22 nt, Human
ucuuccucuagaucugaggccc

SEQ ID NO: 1034744 - RNA, 22 nt, Human
caucacuguccucagcauucca

SEQ ID NO: 1034745 - RNA, 22 nt, Human
gccaggcucucagugacugccc

SEQ ID NO: 1034746 - RNA, 22 nt, Human
ucuggagcuuguuucagauggu

SEQ ID NO: 1034747 - RNA, 22 nt, Human
auugaaagguuuugagcagaua

SEQ ID NO: 1034748 - RNA, 22 nt, Human
aaggcacuuuuccugagaugau

SEQ ID NO: 1034749 - RNA, 22 nt, Human
agggagacacaugaggaaguca

SEQ ID NO: 1034750 - RNA, 22 nt, Human
aagggcuggcccugggaagagu

SEQ ID NO: 1034751 - RNA, 22 nt, Human
gaacagcugcuagagaucugug

SEQ ID NO: 1034752 - RNA, 22 nt, Human
ggccugcacagagguggcucua

SEQ ID NO: 1034753 - RNA, 22 nt, Human
caggccugagacaucugagaua

SEQ ID NO: 1034754 - RNA, 22 nt, Human
aggagaaagacuggacagccaa

SEQ ID NO: 1034755 - RNA, 22 nt, Human
gagcagcugagcuggaaugaga

SEQ ID NO: 1034756 - RNA, 22 nt, Human
ucagggcauucaagaggccugg

SEQ ID NO: 1034757 - RNA, 20 nt, Human
uccaguuuuggagacauucu

SEQ ID NO: 1034758 - RNA, 22 nt, Human
cucuuccucucaugcggucaua

SEQ ID NO: 1034759 - RNA, 22 nt, Human
aggguauaaagagcaagcagaa

SEQ ID NO: 1034760 - RNA, 22 nt, Human
acagccaggaauucuggagaag

SEQ ID NO: 1034761 - RNA, 22 nt, Human
ugggccugaguuugggaacugg

SEQ ID NO: 1034762 - RNA, 22 nt, Human
gcucagagauggggaaugaaaa

SEQ ID NO: 1034763 - RNA, 22 nt, Human
gcugagggcuguaacagcagag

SEQ ID NO: 1034764 - RNA, 22 nt, Human
aagcagccucauuugugguaag

SEQ ID NO: 1034765 - RNA, 22 nt, Human
aggcccuguccauggugcugaa

SEQ ID NO: 1034766 - RNA, 22 nt, Human
ugcucuucggggccacugcuug

SEQ ID NO: 1034767 - RNA, 23 nt, Human
agcagggccagaauacuugcugu

SEQ ID NO: 1034768 - RNA, 22 nt, Human
gagaaagauguaggcugggagg

SEQ ID NO: 1034769 - RNA, 22 nt, Human
gccuucugauugcuggacugac

SEQ ID NO: 1034770 - RNA, 22 nt, Human
uggcucugucaaacugcacaca

SEQ ID NO: 1034771 - RNA, 23 nt, Human
agagcuuucuaaaauguaaaucu

SEQ ID NO: 1034772 - RNA, 22 nt, Human
ggguccagaguugaagagguua

SEQ ID NO: 1034773 - RNA, 22 nt, Human
ggcaggcuggcuuuguuccagg

SEQ ID NO: 1034774 - RNA, 22 nt, Human
ugagccaggcucaagugauccu

SEQ ID NO: 1034775 - RNA, 19 nt, Human
agguggucuaggcuggaga

SEQ ID NO: 1034776 - RNA, 22 nt, Human
gcugccaguaguuggagcucca

SEQ ID NO: 1034777 - RNA, 23 nt, Human
aagcugccuucgcaguuggucug

SEQ ID NO: 1034778 - RNA, 22 nt, Human
caggccaggcugcauuugcccc

SEQ ID NO: 1034779 - RNA, 22 nt, Human
gcacuaaaccaacauguaauaa

SEQ ID NO: 1034780 - RNA, 22 nt, Human
ugagugccugaacauagaguag

SEQ ID NO: 1034781 - RNA, 22 nt, Human
ccaaggagcucauauucuuguu

SEQ ID NO: 1034782 - RNA, 22 nt, Human
agccccacacucucucugagaa

SEQ ID NO: 1034783 - RNA, 22 nt, Human
gccaggccugcaagugcuggug

SEQ ID NO: 1034784 - RNA, 22 nt, Human
agagaacacgugcaucugcaau

SEQ ID NO: 1034785 - RNA, 22 nt, Human
cagcugaauucuucagacucca

SEQ ID NO: 1034786 - RNA, 22 nt, Human
guguguccaggcgggagucaag

SEQ ID NO: 1034787 - RNA, 22 nt, Human
cucuggagaacuccuugugucu

SEQ ID NO: 1034788 - RNA, 22 nt, Human
agggacacacuccaguguuauu

SEQ ID NO: 1034789 - RNA, 22 nt, Human
cuggcucauuuuagcaucaggu

SEQ ID NO: 1034790 - RNA, 22 nt, Human
uccucaggcggugaggaggggc

SEQ ID NO: 1034791 - RNA, 22 nt, Human
cccagcagaaucugaugagggc

SEQ ID NO: 1034792 - RNA, 22 nt, Human
aacagaaaucauuuagggcucu

SEQ ID NO: 1034793 - RNA, 22 nt, Human
gaaaucugaacucuguauccuu

SEQ ID NO: 1034794 - RNA, 22 nt, Human
uccaggcuggacaugaggcggg

SEQ ID NO: 1034795 - RNA, 22 nt, Human
cugccugugccaccgccucauu

SEQ ID NO: 1034796 - RNA, 22 nt, Human
gaaacccaaacuaagacaguag

SEQ ID NO: 1034797 - RNA, 22 nt, Human
ugcaggccucacaccuggcacc

SEQ ID NO: 1034798 - RNA, 22 nt, Human
uucacauuggugauauguuucu

SEQ ID NO: 1034799 - RNA, 22 nt, Human
gaaaugcaaauucucucucgcu

SEQ ID NO: 1034800 - RNA, 22 nt, Human
cagggagaaaucuccaggaggu

SEQ ID NO: 1034801 - RNA, 22 nt, Human
ugugucagagguagagauggca

SEQ ID NO: 1034802 - RNA, 22 nt, Human
gcuggccuugugucugaggaag

SEQ ID NO: 1034803 - RNA, 22 nt, Human
acugagcucuugacugggaguu

SEQ ID NO: 1034804 - RNA, 22 nt, Human
uuauuuucagcuaggaaagcca

SEQ ID NO: 1034805 - RNA, 22 nt, Human
uuagaaaucugcugccaugcaa

SEQ ID NO: 1034806 - RNA, 22 nt, Human
cuguccuguggaccugaggacg

SEQ ID NO: 1034807 - RNA, 22 nt, Human
ggcggggguccaggagccugca

SEQ ID NO: 1034808 - RNA, 22 nt, Human
cccagggucccugcucucugug

SEQ ID NO: 1034809 - RNA, 22 nt, Human
ggccagagagccgcuguuagga

SEQ ID NO: 1034810 - RNA, 22 nt, Human
agcaucuggucaugagugagaa

SEQ ID NO: 1034811 - RNA, 22 nt, Human
ucucuggaagcgcagaucuguu

SEQ ID NO: 1034812 - RNA, 22 nt, Human
uggcagugccccuugaccagug

SEQ ID NO: 1034813 - RNA, 22 nt, Human
ucaguggauauuucuguggcug

SEQ ID NO: 1034814 - RNA, 22 nt, Human
cagcuucugagcaagccagggg

SEQ ID NO: 1034815 - RNA, 22 nt, Human
aaucagucauuagcucugaccu

SEQ ID NO: 1034816 - RNA, 19 nt, Human
aggucauugauagugcagg

SEQ ID NO: 1034817 - RNA, 22 nt, Human
ggcugccugcuccuccugcacg

SEQ ID NO: 1034818 - RNA, 22 nt, Human
gaggccuggaccagccacagag

SEQ ID NO: 1034819 - RNA, 22 nt, Human
acauacuuuuuaaaagauugcu

SEQ ID NO: 1034820 - RNA, 22 nt, Human
ccccuuccuuccucagacagcc

SEQ ID NO: 1034821 - RNA, 23 nt, Human
aucaaaguggaaaucaauuaucu

SEQ ID NO: 1034822 - RNA, 22 nt, Human
aaggccaugaccacuugcugug

SEQ ID NO: 1034823 - RNA, 22 nt, Human
gagccugggacugggggucaug

SEQ ID NO: 1034824 - RNA, 22 nt, Human
gccuuucaguuccaucaaagga

SEQ ID NO: 1034825 - RNA, 19 nt, Human
ucauaaggagagaggaaau

SEQ ID NO: 1034826 - RNA, 22 nt, Human
agagcccucuucacugccccuu

SEQ ID NO: 1034827 - RNA, 22 nt, Human
cacucccuucaggagccuagga

SEQ ID NO: 1034828 - RNA, 22 nt, Human
agcagggcuuugcagacuuggg

SEQ ID NO: 1034829 - RNA, 22 nt, Human
gcuggggcugggcugaggaaga

SEQ ID NO: 1034830 - RNA, 20 nt, Human
aggcugccaggucucacauc

SEQ ID NO: 1034831 - RNA, 22 nt, Human
ccaggaaugaaauguagauaaa

SEQ ID NO: 1034832 - RNA, 22 nt, Human
aaggcugccucugccagaggag

SEQ ID NO: 1034833 - RNA, 22 nt, Human
cagcugagaccagaaugcaggu

SEQ ID NO: 1034834 - RNA, 22 nt, Human
ggagggcaucaaucaggccugg

SEQ ID NO: 1034835 - RNA, 22 nt, Human
aguuuuucuccccuggcuucau

SEQ ID NO: 1034836 - RNA, 22 nt, Human
ucccucuguguugggcaugccu

SEQ ID NO: 1034837 - RNA, 22 nt, Human
gucucagaguccuacuuauucc

SEQ ID NO: 1034838 - RNA, 22 nt, Human
aggcacuguacuagguacaggg

SEQ ID NO: 1034839 - RNA, 22 nt, Human
ccacaggaccagaggagaucac

SEQ ID NO: 1034840 - RNA, 22 nt, Human
caagcagacaguaggccuagaa

SEQ ID NO: 1034841 - RNA, 16 nt, Human
cagaguguaaacagga

SEQ ID NO: 1034842 - RNA, 22 nt, Human
ucugcuguaaagaauuucugcc

SEQ ID NO: 1034843 - RNA, 22 nt, Human
ggccuguccagccugccuggcu

SEQ ID NO: 1034844 - RNA, 22 nt, Human
ucugccuggguguggagcagag

SEQ ID NO: 1034845 - RNA, 22 nt, Human
cccucccaagcacucugacaua

SEQ ID NO: 1034846 - RNA, 22 nt, Human
acagggccauuaucuguucuag

SEQ ID NO: 1034847 - RNA, 22 nt, Human
aaguucaaggaagccuccaguu

SEQ ID NO: 1034848 - RNA, 22 nt, Human
cuuccaaacccaggguaugggc

SEQ ID NO: 1034849 - RNA, 22 nt, Human
augucacagucugacucaguga

SEQ ID NO: 1034850 - RNA, 22 nt, Human
gccagagccggcuucacaggau

SEQ ID NO: 1034851 - RNA, 22 nt, Human
ugcaauaacccaguaucuguga

SEQ ID NO: 1034852 - RNA, 22 nt, Human
ccaggcuggagugcaauggugc

SEQ ID NO: 1034853 - RNA, 22 nt, Human
aaaucaguuagugguaggauug

SEQ ID NO: 1034854 - RNA, 22 nt, Human
ccugccagauccccugagcuga

SEQ ID NO: 1034855 - RNA, 20 nt, Human
ugaaaggugggaauuguggg

SEQ ID NO: 1034856 - RNA, 23 nt, Human
ccugcagcugcuggggcuccacc

SEQ ID NO: 1034857 - RNA, 18 nt, Human
acagaaauagcugugccu

SEQ ID NO: 1034858 - RNA, 20 nt, Human
acugccuugguucaguaggu

SEQ ID NO: 1034859 - RNA, 22 nt, Human
cucaggacccgguccagguggg

SEQ ID NO: 1034860 - RNA, 20 nt, Human
ggccugagcauggcuggcag

SEQ ID NO: 1034861 - RNA, 22 nt, Human
uugugaaacauucauggauuug

SEQ ID NO: 1034862 - RNA, 22 nt, Human
aacaguaaugugguguuggguu

SEQ ID NO: 1034863 - RNA, 22 nt, Human
gccuggcuccuaagagcacaac

SEQ ID NO: 1034864 - RNA, 22 nt, Human
augacacaauuuuagagcugaa

SEQ ID NO: 1034865 - RNA, 22 nt, Human
caaaauguucuggcaccuuuaa

SEQ ID NO: 1034866 - RNA, 22 nt, Human
ucagggcaagucucagaagguu

SEQ ID NO: 1034867 - RNA, 22 nt, Human
ucuucacaccgggcagcaggaa

SEQ ID NO: 1034868 - RNA, 22 nt, Human
uggagcaggaagucuauggcug

SEQ ID NO: 1034869 - RNA, 22 nt, Human
ugaccaaaggugguuuauuugg

SEQ ID NO: 1034870 - RNA, 22 nt, Human
aggccugggacgggagccguga

SEQ ID NO: 1034871 - RNA, 22 nt, Human
uccucuucugcccaucagaggc

SEQ ID NO: 1034872 - RNA, 22 nt, Human
uggcucagagccuugagagcug

SEQ ID NO: 1034873 - RNA, 22 nt, Human
aaauguguuuagaugguuuauu

SEQ ID NO: 1034874 - RNA, 20 nt, Human
acaauagauuugagcaaagu

SEQ ID NO: 1034875 - RNA, 22 nt, Human
aguauguagugcaaucagucag

SEQ ID NO: 1034876 - RNA, 22 nt, Human
gcucagagaugucugcugccuu

SEQ ID NO: 1034877 - RNA, 22 nt, Human
gcugccaauccagcugugggag

SEQ ID NO: 1034878 - RNA, 22 nt, Human
gcagugaaacaauaggaucaaa

SEQ ID NO: 1034879 - RNA, 22 nt, Human
uugaaaggugcugugugcugau

SEQ ID NO: 1034880 - RNA, 22 nt, Human
agagccagcaacucuagcccug

SEQ ID NO: 1034881 - RNA, 22 nt, Human
gaggcugccccuuccucagcug

SEQ ID NO: 1034882 - RNA, 22 nt, Human
cugccucuugacagaucguggc

SEQ ID NO: 1034883 - RNA, 22 nt, Human
cagccccucacagagcuguccu

SEQ ID NO: 1034884 - RNA, 22 nt, Human
aguguuucuggcaaaugaaagu

SEQ ID NO: 1034885 - RNA, 22 nt, Human
cagcugccccauaaaucacagu

SEQ ID NO: 1034886 - RNA, 22 nt, Human
gccucugcgccucagccgaccu

SEQ ID NO: 1034887 - RNA, 22 nt, Human
agccucucuuuauucccagcua

SEQ ID NO: 1034888 - RNA, 23 nt, Human
uggcccugugcaugcugcuuccc

SEQ ID NO: 1034889 - RNA, 22 nt, Human
ugaaggaaaugacggcagaaga

SEQ ID NO: 1034890 - RNA, 22 nt, Human
ggagaugguggaagcuggugca

SEQ ID NO: 1034891 - RNA, 22 nt, Human
uggccuggggaagaccaugggc

SEQ ID NO: 1034892 - RNA, 23 nt, Human
uugcuucugugcaauucaguacu

SEQ ID NO: 1034893 - RNA, 22 nt, Human
cugcagccucaaccuccugagc

SEQ ID NO: 1034894 - RNA, 22 nt, Human
uuagaaaggaaucuucauuuca

SEQ ID NO: 1034895 - RNA, 22 nt, Human
cuggagaggcugggaacagguu

SEQ ID NO: 1034896 - RNA, 22 nt, Human
gcucacugccauucucuagaug

SEQ ID NO: 1034897 - RNA, 22 nt, Human
aggcagagagcaguggccgucu

SEQ ID NO: 1034898 - RNA, 22 nt, Human
cugaaggaagcagaagcgaggu

SEQ ID NO: 1034899 - RNA, 22 nt, Human
acaggcagcgucauugcugcuc

SEQ ID NO: 1034900 - RNA, 22 nt, Human
ggcugcagcggauuggggauug

SEQ ID NO: 1034901 - RNA, 22 nt, Human
cuggccagacuacacaugugug

SEQ ID NO: 1034902 - RNA, 22 nt, Human
gccagagccacuuuugggugau

SEQ ID NO: 1034903 - RNA, 22 nt, Human
ccuggccucagccuagggcuga

SEQ ID NO: 1034904 - RNA, 22 nt, Human
cguguacagucuaucuuuuuuc

SEQ ID NO: 1034905 - RNA, 22 nt, Human
cuggccucauagccaagcugug

SEQ ID NO: 1034906 - RNA, 22 nt, Human
gugucccaggccucuggaauua

SEQ ID NO: 1034907 - RNA, 22 nt, Human
agaauucugacaauagaauugg

SEQ ID NO: 1034908 - RNA, 22 nt, Human
agggccagcugaugagaaugag

SEQ ID NO: 1034909 - RNA, 22 nt, Human
ucacugcaaggaggcuucucaa

SEQ ID NO: 1034910 - RNA, 22 nt, Human
uagugaaacaguuaucaaucug

SEQ ID NO: 1034911 - RNA, 22 nt, Human
cuuccucccccacacacucacu

SEQ ID NO: 1034912 - RNA, 22 nt, Human
cagagccaggguugcaccccug

SEQ ID NO: 1034913 - RNA, 22 nt, Human
ccugagugaauucccucacugu

SEQ ID NO: 1034914 - RNA, 22 nt, Human
ccagcuccgggaguugcugcug

SEQ ID NO: 1034915 - RNA, 22 nt, Human
aggagcccugcgggaggcagag

SEQ ID NO: 1034916 - RNA, 22 nt, Human
ggugggcacauucagucucugu

SEQ ID NO: 1034917 - RNA, 22 nt, Human
gaauuguacgcuuuacauaggu

SEQ ID NO: 1034918 - RNA, 22 nt, Human
cagagcugcagauugaaggcau

SEQ ID NO: 1034919 - RNA, 22 nt, Human
uggugaagucagcggagcccgg

SEQ ID NO: 1034920 - RNA, 22 nt, Human
cucugagaaagcugugagcuaa

SEQ ID NO: 1034921 - RNA, 22 nt, Human
uggcucaggccuacgacgccuu

SEQ ID NO: 1034922 - RNA, 22 nt, Human
caggcagcagccacucugguau

SEQ ID NO: 1034923 - RNA, 22 nt, Human
aauauuucuccuucguuauagc

SEQ ID NO: 1034924 - RNA, 22 nt, Human
auuugucuuuggaccugugaga

SEQ ID NO: 1034925 - RNA, 22 nt, Human
acuucauuguaauauuauagca

SEQ ID NO: 1034926 - RNA, 22 nt, Human
aaugcugcucucauaauuauag

SEQ ID NO: 1034927 - RNA, 22 nt, Human
auuucacucuuaauugcuuccu

SEQ ID NO: 1034928 - RNA, 22 nt, Human
guggagcccugccuugcucaug

SEQ ID NO: 1034929 - RNA, 22 nt, Human
gaggggcugggguugacuccaa

SEQ ID NO: 1034930 - RNA, 23 nt, Human
ggccuccuggucuaggcuagacu

SEQ ID NO: 1034931 - RNA, 22 nt, Human
gagcaggccagcaauggaaggg

SEQ ID NO: 1034932 - RNA, 22 nt, Human
ucagcuggcaguucagaggcug

SEQ ID NO: 1034933 - RNA, 22 nt, Human
gccuucaggaggguuccagaca

SEQ ID NO: 1034934 - RNA, 22 nt, Human
caagagcugaggcuggagaggu

SEQ ID NO: 1034935 - RNA, 19 nt, Human
gagcagcugcacccauuga

SEQ ID NO: 1034936 - RNA, 21 nt, Human
uaaauaauaaguugcugagau

SEQ ID NO: 1034937 - RNA, 22 nt, Human
gccaggcagccacccucugcga

SEQ ID NO: 1034938 - RNA, 22 nt, Human
auugaaaguccuaucuaaggga

SEQ ID NO: 1034939 - RNA, 22 nt, Human
gagcucugacugcugggugaca

SEQ ID NO: 1034940 - RNA, 20 nt, Human
agugacagagacuguguggc

SEQ ID NO: 1034941 - RNA, 22 nt, Human
ucaggggagguugaaucgucuc

SEQ ID NO: 1034942 - RNA, 22 nt, Human
gaaaucugcccagugcacuggu

SEQ ID NO: 1034943 - RNA, 22 nt, Human
cagccugcuagggcaaugccuu

SEQ ID NO: 1034944 - RNA, 22 nt, Human
agugucauuccagggacccucg

SEQ ID NO: 1034945 - RNA, 22 nt, Human
ggagccugugggaugagaugug

SEQ ID NO: 1034946 - RNA, 22 nt, Human
agagccugcagcugugaagaaa

SEQ ID NO: 1034947 - RNA, 22 nt, Human
uuggccuuguuaaggaggcccu

SEQ ID NO: 1034948 - RNA, 22 nt, Human
ccugggcucuauccugacccag

SEQ ID NO: 1034949 - RNA, 22 nt, Human
uuaaacaguguuucaugugggg

SEQ ID NO: 1034950 - RNA, 22 nt, Human
ugauuuccuagcugacaugaaa

SEQ ID NO: 1034951 - RNA, 22 nt, Human
gcagcuuuuuggaugucaguua

SEQ ID NO: 1034952 - RNA, 18 nt, Human
gucauugcaacauacugu

SEQ ID NO: 1034953 - RNA, 22 nt, Human
cugaggucaauuaaucaacaac

SEQ ID NO: 1034954 - RNA, 22 nt, Human
gcccaggcuagcguagagugca

SEQ ID NO: 1034955 - RNA, 22 nt, Human
aaagaggaaccaagagcacgug

SEQ ID NO: 1034956 - RNA, 22 nt, Human
ucagccagguaauguggagaug

SEQ ID NO: 1034957 - RNA, 23 nt, Human
aggauccugguacaggagcagag

SEQ ID NO: 1034958 - RNA, 22 nt, Human
agcucagggcgaucugucucgg

SEQ ID NO: 1034959 - RNA, 22 nt, Human
ccagggcuccauugcucauccu

SEQ ID NO: 1034960 - RNA, 22 nt, Human
ccagacuguggaguuccuggug

SEQ ID NO: 1034961 - RNA, 22 nt, Human
cugccuggagcauucugaaggu

SEQ ID NO: 1034962 - RNA, 22 nt, Human
aaaugguauuuacucuguauua

SEQ ID NO: 1034963 - RNA, 22 nt, Human
gcccagcugcacccuggugggu

SEQ ID NO: 1034964 - RNA, 22 nt, Human
accuuaaaacugacacauggag

SEQ ID NO: 1034965 - RNA, 22 nt, Human
gcucugugggugaguagaaucu

SEQ ID NO: 1034966 - RNA, 18 nt, Human
uccagagguguuggagcc

SEQ ID NO: 1034967 - RNA, 22 nt, Human
ucucugucugagccuggcagac

SEQ ID NO: 1034968 - RNA, 21 nt, Human
gggccuggcugcgcaggacgg

SEQ ID NO: 1034969 - RNA, 22 nt, Human
cucugugggggagaggcagcug

SEQ ID NO: 1034970 - RNA, 22 nt, Human
ugcagccaggaaauauuugcug

SEQ ID NO: 1034971 - RNA, 22 nt, Human
uaauuuauuucaacugccaagg

SEQ ID NO: 1034972 - RNA, 22 nt, Human
augaugguuguccuaggugcau

SEQ ID NO: 1034973 - RNA, 22 nt, Human
ucucaggggauucacuggcacc

SEQ ID NO: 1034974 - RNA, 22 nt, Human
aaagaacaucggagugggcggg

SEQ ID NO: 1034975 - RNA, 22 nt, Human
ucaggaucaggggccuuuccuu

SEQ ID NO: 1034976 - RNA, 22 nt, Human
cuuauguaaaacggaaagggaa

SEQ ID NO: 1034977 - RNA, 22 nt, Human
uacaaagucaccagcuucuugc

SEQ ID NO: 1034978 - RNA, 22 nt, Human
uauagagguggaaacugagguu

SEQ ID NO: 1034979 - RNA, 21 nt, Human
ggccuuggcgggggccgaauu

SEQ ID NO: 1034980 - RNA, 22 nt, Human
ccagggccaguaagauuggcau

SEQ ID NO: 1034981 - RNA, 22 nt, Human
cacauaaguggguuccauugca

SEQ ID NO: 1034982 - RNA, 22 nt, Human
agcagcugccagagagaguucc

SEQ ID NO: 1034983 - RNA, 22 nt, Human
ugcugucccccgugucugggcu

SEQ ID NO: 1034984 - RNA, 22 nt, Human
uuugugaaaugaagucacaacu

SEQ ID NO: 1034985 - RNA, 22 nt, Human
gccaaagcagucuugccucugc

SEQ ID NO: 1034986 - RNA, 22 nt, Human
cccugcagccggccagcucauu

SEQ ID NO: 1034987 - RNA, 22 nt, Human
agagugaaguaauuguuaggau

SEQ ID NO: 1034988 - RNA, 22 nt, Human
agauuucacaugcugcucuauu

SEQ ID NO: 1034989 - RNA, 22 nt, Human
aagcagccuggcaugaugcuuu

SEQ ID NO: 1034990 - RNA, 22 nt, Human
ggagcugucuguagggcacagg

SEQ ID NO: 1034991 - RNA, 21 nt, Human
agaaaaguagaguuuucagag

SEQ ID NO: 1034992 - RNA, 22 nt, Human
caaugauggcuaggcagcugcu

SEQ ID NO: 1034993 - RNA, 22 nt, Human
aaguuuuaacaaguacuuacua

SEQ ID NO: 1034994 - RNA, 22 nt, Human
acauuucuuagccuaguuccag

SEQ ID NO: 1034995 - RNA, 22 nt, Human
cucagcagcagggaagagguca

SEQ ID NO: 1034996 - RNA, 22 nt, Human
uuccucagaaaauacuguccaa

SEQ ID NO: 1034997 - RNA, 22 nt, Human
ggccucgcggcuucugguggcu

SEQ ID NO: 1034998 - RNA, 22 nt, Human
acagacauuuucuguauugccu

SEQ ID NO: 1034999 - RNA, 22 nt, Human
aaucaguuguccaaaguucaca

SEQ ID NO: 1035000 - RNA, 22 nt, Human
agucuucagagaaauuaacucu

SEQ ID NO: 1035001 - RNA, 22 nt, Human
ggcugcuggaagacugaacaag

SEQ ID NO: 1035002 - RNA, 22 nt, Human
ucugucaggagauuggcagcug

SEQ ID NO: 1035003 - RNA, 22 nt, Human
aaaucaguucacguucugaggu

SEQ ID NO: 1035004 - RNA, 21 nt, Human
cccuugccugcacuccucggc

SEQ ID NO: 1035005 - RNA, 22 nt, Human
uuaugggagcaauuggggaggu

SEQ ID NO: 1035006 - RNA, 22 nt, Human
ucauuucuccgaccugcugucc

SEQ ID NO: 1035007 - RNA, 22 nt, Human
guuugucuuaauuaggcaucga

SEQ ID NO: 1035008 - RNA, 17 nt, Human
ugcauguccuuuguucc

SEQ ID NO: 1035009 - RNA, 22 nt, Human
gaguccaguuguucacagaggc

SEQ ID NO: 1035010 - RNA, 22 nt, Human
ggcucuggagacauguggagag

SEQ ID NO: 1035011 - RNA, 22 nt, Human
gugugccagacaugaugcuaug

SEQ ID NO: 1035012 - RNA, 23 nt, Human
cauggcagcaagagcucauggcc

SEQ ID NO: 1035013 - RNA, 22 nt, Human
aggaagcucggagagggcaaau

SEQ ID NO: 1035014 - RNA, 22 nt, Human
cacaugggugugccuggaggaa

SEQ ID NO: 1035015 - RNA, 22 nt, Human
gcagccagccccucugaccucu

SEQ ID NO: 1035016 - RNA, 22 nt, Human
ggcccagcacagugcuuggggg

SEQ ID NO: 1035017 - RNA, 22 nt, Human
ugucucugccagcuagcagaau

SEQ ID NO: 1035018 - RNA, 22 nt, Human
caugugucaaaugauguagcug

SEQ ID NO: 1035019 - RNA, 21 nt, Human
augacagaugcugcagaucgu

SEQ ID NO: 1035020 - RNA, 22 nt, Human
uccugucagugaggcagaugaa

SEQ ID NO: 1035021 - RNA, 22 nt, Human
cugguuuagcuguaagguuccc

SEQ ID NO: 1035022 - RNA, 22 nt, Human
gggccaggucggugaaugguca

SEQ ID NO: 1035023 - RNA, 21 nt, Human
guggcccugguguggcugcac

SEQ ID NO: 1035024 - RNA, 22 nt, Human
cugcuuuguguggucccuccag

SEQ ID NO: 1035025 - RNA, 22 nt, Human
ugcucuggagggugaagcuuuu

SEQ ID NO: 1035026 - RNA, 22 nt, Human
ucugucuccucugaggugccag

SEQ ID NO: 1035027 - RNA, 22 nt, Human
ccagggugugagaaggaaguag

SEQ ID NO: 1035028 - RNA, 20 nt, Human
gacaucauguacacauugcc

SEQ ID NO: 1035029 - RNA, 22 nt, Human
cugccagccaggccagguaggc

SEQ ID NO: 1035030 - RNA, 22 nt, Human
cucuggcuucuaccuugcaguu

SEQ ID NO: 1035031 - RNA, 22 nt, Human
acugugcacaauucuaaguccu

SEQ ID NO: 1035032 - RNA, 22 nt, Human
uugcauuguaggauguuagaag

SEQ ID NO: 1035033 - RNA, 22 nt, Human
ugugaaagauacuaggcagagg

SEQ ID NO: 1035034 - RNA, 22 nt, Human
uacauucuggaaaggcacagac

SEQ ID NO: 1035035 - RNA, 22 nt, Human
aggcugccucgugagcucgcug

SEQ ID NO: 1035036 - RNA, 22 nt, Human
agggagaacaguugcagcagac

SEQ ID NO: 1035037 - RNA, 22 nt, Human
aggcuggaguacaguggcuauu

SEQ ID NO: 1035038 - RNA, 22 nt, Human
ucuguggauuuuaguguucaug

SEQ ID NO: 1035039 - RNA, 22 nt, Human
agccugguguggggcugcagag

SEQ ID NO: 1035040 - RNA, 22 nt, Human
gagaaacuuggaguuauucugg

SEQ ID NO: 1035041 - RNA, 22 nt, Human
uccagccaagccuugguagcug

SEQ ID NO: 1035042 - RNA, 22 nt, Human
cagcaguggccaucuguguggu

SEQ ID NO: 1035043 - RNA, 21 nt, Human
ucuccaguauccuucucugag

SEQ ID NO: 1035044 - RNA, 22 nt, Human
gucuugaucuccugaccuugug

SEQ ID NO: 1035045 - RNA, 22 nt, Human
uaugcacagaaguuugcugaau

SEQ ID NO: 1035046 - RNA, 22 nt, Human
cugagccagcgggcucacuuuu

SEQ ID NO: 1035047 - RNA, 22 nt, Human
uuuuccucuguauuugaaaugc

SEQ ID NO: 1035048 - RNA, 22 nt, Human
ugcaggugugguuccucagcca

SEQ ID NO: 1035049 - RNA, 22 nt, Human
uccagggaucuuuagagucuuu

SEQ ID NO: 1035050 - RNA, 22 nt, Human
agagccagguguagucucggag

SEQ ID NO: 1035051 - RNA, 22 nt, Human
ugcuguagcccugcacagugca

SEQ ID NO: 1035052 - RNA, 22 nt, Human
cugcccugucugcagccuggcu

SEQ ID NO: 1035053 - RNA, 22 nt, Human
acccagaggcggagguugcagu

SEQ ID NO: 1035054 - RNA, 22 nt, Human
gcacacagccagcugagggcua

SEQ ID NO: 1035055 - RNA, 19 nt, Human
gagcacagcggcauuuggu

SEQ ID NO: 1035056 - RNA, 22 nt, Human
acagaauauugguuacuguugc

SEQ ID NO: 1035057 - RNA, 22 nt, Human
agccucugguccucccucagcu

SEQ ID NO: 1035058 - RNA, 21 nt, Human
ucagaguguguuacagcaagc

SEQ ID NO: 1035059 - RNA, 22 nt, Human
ugcugggggugucucaccaggc

SEQ ID NO: 1035060 - RNA, 22 nt, Human
uaaugaauaaacuugagaguca

SEQ ID NO: 1035061 - RNA, 22 nt, Human
caggccacaaguuggguucaag

SEQ ID NO: 1035062 - RNA, 19 nt, Human
cccucaggucugagcaguc

SEQ ID NO: 1035063 - RNA, 22 nt, Human
aggccagggucccacacucgca

SEQ ID NO: 1035064 - RNA, 22 nt, Human
cucagagaaaaggagcaagggu

SEQ ID NO: 1035065 - RNA, 20 nt, Human
gguagcagcugcugucaucc

SEQ ID NO: 1035066 - RNA, 22 nt, Human
ucuagaaaaaaacugcugugga

SEQ ID NO: 1035067 - RNA, 22 nt, Human
uggugccuugggccuacagcgc

SEQ ID NO: 1035068 - RNA, 22 nt, Human
uuguggcucgugagauguuagg

SEQ ID NO: 1035069 - RNA, 22 nt, Human
agaagccauugaagcagaccuc

SEQ ID NO: 1035070 - RNA, 22 nt, Human
uguguacuugaaagggcagguc

SEQ ID NO: 1035071 - RNA, 22 nt, Human
uggcccugacacgugguacugg

SEQ ID NO: 1035072 - RNA, 22 nt, Human
uugcauugggagugaggagacc

SEQ ID NO: 1035073 - RNA, 22 nt, Human
aggcaaaauuacaaaguuauua

SEQ ID NO: 1035074 - RNA, 22 nt, Human
agggcuggcuaggugcguuccc

SEQ ID NO: 1035075 - RNA, 22 nt, Human
uggcucagcugacucggcuucu

SEQ ID NO: 1035076 - RNA, 22 nt, Human
ugaggaggucagagucuggcug

SEQ ID NO: 1035077 - RNA, 19 nt, Human
caggagagcaugcacuuug

SEQ ID NO: 1035078 - RNA, 21 nt, Human
cagaggcugagagggcaaucu

SEQ ID NO: 1035079 - RNA, 22 nt, Human
gccaggcuggugcaaggauauu

SEQ ID NO: 1035080 - RNA, 22 nt, Human
cuccuuccccuacucagcaucc

SEQ ID NO: 1035081 - RNA, 22 nt, Human
uugaagcaggaaaauuucuauu

SEQ ID NO: 1035082 - RNA, 22 nt, Human
aaaugucuuucaauagagaaau

SEQ ID NO: 1035083 - RNA, 22 nt, Human
ccugucuguaucgguucagagu

SEQ ID NO: 1035084 - RNA, 22 nt, Human
caugcuccaaaaacaagagaau

SEQ ID NO: 1035085 - RNA, 22 nt, Human
aaaugcaggaaauuaugcuuuu

SEQ ID NO: 1035086 - RNA, 21 nt, Human
gacaggggaagaagcaaggag

SEQ ID NO: 1035087 - RNA, 22 nt, Human
aggcucugugacaaucaagcug

SEQ ID NO: 1035088 - RNA, 22 nt, Human
gcagcugcaggcaggcuugcug

SEQ ID NO: 1035089 - RNA, 18 nt, Human
gguggcaggucagaugcc

SEQ ID NO: 1035090 - RNA, 22 nt, Human
acuguguggaaauuugugaggg

SEQ ID NO: 1035091 - RNA, 22 nt, Human
ugaaaggugacauuucuuggau

SEQ ID NO: 1035092 - RNA, 22 nt, Human
ccagcagcagcguccaaggaga

SEQ ID NO: 1035093 - RNA, 22 nt, Human
gggaguggagagcaauggauga

SEQ ID NO: 1035094 - RNA, 22 nt, Human
ccugggcaaaugccagagacaa

SEQ ID NO: 1035095 - RNA, 22 nt, Human
caggcugcagcagcaguggccc

SEQ ID NO: 1035096 - RNA, 17 nt, Human
uccuggcucugccacug

SEQ ID NO: 1035097 - RNA, 22 nt, Human
ccauggaguuccucuggucuau

SEQ ID NO: 1035098 - RNA, 22 nt, Human
ucuguuuaggcaaaauagcuac

SEQ ID NO: 1035099 - RNA, 22 nt, Human
agguggggccaaaugcuacagu

SEQ ID NO: 1035100 - RNA, 22 nt, Human
uacuuuuugucucuuugaaugu

SEQ ID NO: 1035101 - RNA, 22 nt, Human
gcauccagucuuggcuccugga

SEQ ID NO: 1035102 - RNA, 23 nt, Human
uggcucucucagugcugcagagg

SEQ ID NO: 1035103 - RNA, 22 nt, Human
gagauucuguagucaggcaucu

SEQ ID NO: 1035104 - RNA, 22 nt, Human
ugggcuacucugggagccuaac

SEQ ID NO: 1035105 - RNA, 22 nt, Human
cucucccagucaggcucaggau

SEQ ID NO: 1035106 - RNA, 22 nt, Human
ugaggcuguucuaccagggcca

SEQ ID NO: 1035107 - RNA, 22 nt, Human
cagccaucccagccugugguuc

SEQ ID NO: 1035108 - RNA, 22 nt, Human
cuggccacaugugugcugagca

SEQ ID NO: 1035109 - RNA, 22 nt, Human
ggcagugguuagaaacaugagc

SEQ ID NO: 1035110 - RNA, 21 nt, Human
aggccucuucauggccaugau

SEQ ID NO: 1035111 - RNA, 22 nt, Human
agggauguaaauucuucuucuu

SEQ ID NO: 1035112 - RNA, 22 nt, Human
uaaaugcagauuccugagccua

SEQ ID NO: 1035113 - RNA, 22 nt, Human
ugucacaaacauacauuauaga

SEQ ID NO: 1035114 - RNA, 22 nt, Human
gugcccugaguggguaggagag

SEQ ID NO: 1035115 - RNA, 22 nt, Human
uucuggagagaaaccuuacaaa

SEQ ID NO: 1035116 - RNA, 22 nt, Human
caguagcagggauuauuuuagg

SEQ ID NO: 1035117 - RNA, 22 nt, Human
auggauaauggugauaguugca

SEQ ID NO: 1035118 - RNA, 22 nt, Human
ccucagcugcuucccuggagcc

SEQ ID NO: 1035119 - RNA, 22 nt, Human
cugcccugaccugccucagagu

SEQ ID NO: 1035120 - RNA, 22 nt, Human
gagagaagaaagccaugguccu

SEQ ID NO: 1035121 - RNA, 22 nt, Human
uuguuucugaguuuucauguau

SEQ ID NO: 1035122 - RNA, 22 nt, Human
ggcugcagagcugggugggccu

SEQ ID NO: 1035123 - RNA, 22 nt, Human
agugaggcuaauaggcaauggu

SEQ ID NO: 1035124 - RNA, 22 nt, Human
gcaaggcuuugugaauuuuaaa

SEQ ID NO: 1035125 - RNA, 22 nt, Human
ucuucagagacucugagccccu

SEQ ID NO: 1035126 - RNA, 22 nt, Human
ucagaacagaagaaggaacacg

SEQ ID NO: 1035127 - RNA, 22 nt, Human
cacucaggcugugucaggagga

SEQ ID NO: 1035128 - RNA, 22 nt, Human
uuagugucuucuucauccucug

SEQ ID NO: 1035129 - RNA, 18 nt, Human
uggagcagguaggcauga

SEQ ID NO: 1035130 - RNA, 22 nt, Human
ucuggccaacaaaaacuaaguc

SEQ ID NO: 1035131 - RNA, 22 nt, Human
aaguuauugcagcaauccaagu

SEQ ID NO: 1035132 - RNA, 19 nt, Human
auuugaaagcugugcuugc

SEQ ID NO: 1035133 - RNA, 22 nt, Human
aagagcuguaugccauaugauu

SEQ ID NO: 1035134 - RNA, 22 nt, Human
gugucccaaagauuagaaauca

SEQ ID NO: 1035135 - RNA, 22 nt, Human
aauuucaaugcacucaugguug

SEQ ID NO: 1035136 - RNA, 22 nt, Human
gcugugcuggaaggggaccugc

SEQ ID NO: 1035137 - RNA, 22 nt, Human
cucugcagaggcccaaggcuga

SEQ ID NO: 1035138 - RNA, 22 nt, Human
aaguugaagcaugaaccaaggu

SEQ ID NO: 1035139 - RNA, 22 nt, Human
ucugcgcugccuugauccuugg

SEQ ID NO: 1035140 - RNA, 22 nt, Human
uaagaacauuuucggaaagaua

SEQ ID NO: 1035141 - RNA, 22 nt, Human
acauuuaggauguuuugagaga

SEQ ID NO: 1035142 - RNA, 22 nt, Human
cugcccugacugaccuuuugaa

SEQ ID NO: 1035143 - RNA, 22 nt, Human
agcucuccacacauaggacuag

SEQ ID NO: 1035144 - RNA, 22 nt, Human
agaauuguaagcaauuugauua

SEQ ID NO: 1035145 - RNA, 20 nt, Human
gcagagcuguucugugggga

SEQ ID NO: 1035146 - RNA, 22 nt, Human
cucucugggggccaugccaaga

SEQ ID NO: 1035147 - RNA, 21 nt, Human
aggcagaaagagcccaggcug

SEQ ID NO: 1035148 - RNA, 22 nt, Human
agcagcauguugggaugugaaa

SEQ ID NO: 1035149 - RNA, 22 nt, Human
uggagcaggugccaggugugug

SEQ ID NO: 1035150 - RNA, 22 nt, Human
gcagauggaaagugcuugaggg

SEQ ID NO: 1035151 - RNA, 22 nt, Human
ucugucuccugccagugccucu

SEQ ID NO: 1035152 - RNA, 22 nt, Human
cagggccuuuuagcaucuucuc

SEQ ID NO: 1035153 - RNA, 22 nt, Human
gggcuggaggaccggccucgga

SEQ ID NO: 1035154 - RNA, 22 nt, Human
guccacauaggaacccagcuuc

SEQ ID NO: 1035155 - RNA, 17 nt, Human
auuucacuuagcaugag

SEQ ID NO: 1035156 - RNA, 22 nt, Human
caggcuugggagcagagccacu

SEQ ID NO: 1035157 - RNA, 22 nt, Human
uccugcaggccuguucccagua

SEQ ID NO: 1035158 - RNA, 22 nt, Human
acaaagucacaauaauuaaccu

SEQ ID NO: 1035159 - RNA, 22 nt, Human
ucagagcuuaucucuugcugga

SEQ ID NO: 1035160 - RNA, 23 nt, Human
guggccuccccggaaugccucgc

SEQ ID NO: 1035161 - RNA, 22 nt, Human
aaagauuuaugaaguucaauua

SEQ ID NO: 1035162 - RNA, 22 nt, Human
cagcauggggaucacuguaggc

SEQ ID NO: 1035163 - RNA, 22 nt, Human
ucugucacucccugaugaugaa

SEQ ID NO: 1035164 - RNA, 22 nt, Human
ccaggacuuauuacaguauaac

SEQ ID NO: 1035165 - RNA, 22 nt, Human
acugugcaaugaguaauaaacu

SEQ ID NO: 1035166 - RNA, 22 nt, Human
cuggugagacgguugacaggag

SEQ ID NO: 1035167 - RNA, 22 nt, Human
gcucagccgaacuucagagcag

SEQ ID NO: 1035168 - RNA, 22 nt, Human
uggcucagcagguuagaaacua

SEQ ID NO: 1035169 - RNA, 22 nt, Human
gcuggccuccugcuagauggaa

SEQ ID NO: 1035170 - RNA, 22 nt, Human
gagugcagaugaacagaagauu

SEQ ID NO: 1035171 - RNA, 22 nt, Human
auguuacagaaagcaaagauga

SEQ ID NO: 1035172 - RNA, 22 nt, Human
uuaucauugucgcagucuaauu

SEQ ID NO: 1035173 - RNA, 22 nt, Human
gccuggcaggccuguuggggcu

SEQ ID NO: 1035174 - RNA, 22 nt, Human
caucacagauguuguguggagu

SEQ ID NO: 1035175 - RNA, 22 nt, Human
agcuguccuggcucaggcugug

SEQ ID NO: 1035176 - RNA, 17 nt, Human
ugagaaguaggcaucau

SEQ ID NO: 1035177 - RNA, 22 nt, Human
gcacagggccuggcacauaaga

SEQ ID NO: 1035178 - RNA, 22 nt, Human
ugaaagcacucacuucugcucu

SEQ ID NO: 1035179 - RNA, 22 nt, Human
ucagcaguguaguuuaucauuc

SEQ ID NO: 1035180 - RNA, 22 nt, Human
agcugauuccacuuuuucccca

SEQ ID NO: 1035181 - RNA, 22 nt, Human
ggcugcagaaguacuuccggau

SEQ ID NO: 1035182 - RNA, 22 nt, Human
acauuaucccuggcacaacugc

SEQ ID NO: 1035183 - RNA, 22 nt, Human
ggccuucacgugaccuggcgug

SEQ ID NO: 1035184 - RNA, 22 nt, Human
ucucagaggucuucagccucug

SEQ ID NO: 1035185 - RNA, 22 nt, Human
ugggauggcauccugggccuug

SEQ ID NO: 1035186 - RNA, 22 nt, Human
cagcugagcaucacuagucugg

SEQ ID NO: 1035187 - RNA, 22 nt, Human
agagaugaaaaguggagacugg

SEQ ID NO: 1035188 - RNA, 22 nt, Human
ucagaagcaaacaucacucuag

SEQ ID NO: 1035189 - RNA, 22 nt, Human
ugaagcaacuggacaaguuggc

SEQ ID NO: 1035190 - RNA, 22 nt, Human
ggcugccugaacuuuggggaaa

SEQ ID NO: 1035191 - RNA, 22 nt, Human
aaucuggcucagaagaagauga

SEQ ID NO: 1035192 - RNA, 22 nt, Human
ggcagauggaagaggcuggguc

SEQ ID NO: 1035193 - RNA, 22 nt, Human
caccaucagcagcaggugucaa

SEQ ID NO: 1035194 - RNA, 22 nt, Human
ggcugcugaguuggccaggaga

SEQ ID NO: 1035195 - RNA, 22 nt, Human
cagcagggcccccgggugcgcc

SEQ ID NO: 1035196 - RNA, 22 nt, Human
agccaggauuggcugagccuua

SEQ ID NO: 1035197 - RNA, 21 nt, Human
uaaaugugagcagggcugggc

SEQ ID NO: 1035198 - RNA, 22 nt, Human
ugaaagaacuagcaucuucaag

SEQ ID NO: 1035199 - RNA, 22 nt, Human
uucagaaagugaaucuuguuau

SEQ ID NO: 1035200 - RNA, 20 nt, Human
gccagcacagggagcaguuc

SEQ ID NO: 1035201 - RNA, 17 nt, Human
uucaaugauuaaugcau

SEQ ID NO: 1035202 - RNA, 22 nt, Human
ugccucuguugagccuuggcug

SEQ ID NO: 1035203 - RNA, 22 nt, Human
ugucccauggauaccaggcuau

SEQ ID NO: 1035204 - RNA, 22 nt, Human
cugugagcuggguggccaggac

SEQ ID NO: 1035205 - RNA, 22 nt, Human
uggaaggagcuaaggaccuggg

SEQ ID NO: 1035206 - RNA, 22 nt, Human
aauaauuuuagcucagaguugu

SEQ ID NO: 1035207 - RNA, 22 nt, Human
aaaugucuguuagucauaucau

SEQ ID NO: 1035208 - RNA, 22 nt, Human
cuggcuccaucacugggugaug

SEQ ID NO: 1035209 - RNA, 22 nt, Human
ggucucagcuggaguccuuggu

SEQ ID NO: 1035210 - RNA, 22 nt, Human
cagcucucuaaggucuugcuuu

SEQ ID NO: 1035211 - RNA, 20 nt, Human
auaauuuacccugcaccacu

SEQ ID NO: 1035212 - RNA, 22 nt, Human
agcuggccuuagugagcaccug

SEQ ID NO: 1035213 - RNA, 21 nt, Human
ugggcacugagggugcugcuc

SEQ ID NO: 1035214 - RNA, 22 nt, Human
cuggccuggggccucagcugcu

SEQ ID NO: 1035215 - RNA, 22 nt, Human
aggggccugguuggccucuguu

SEQ ID NO: 1035216 - RNA, 21 nt, Human
agcugggccucagccugcagu

SEQ ID NO: 1035217 - RNA, 22 nt, Human
uuauacauguguuuugagauga

SEQ ID NO: 1035218 - RNA, 22 nt, Human
aaggcacuuaacgugggaggau

SEQ ID NO: 1035219 - RNA, 22 nt, Human
ucacaugcucaccuaagccaca

SEQ ID NO: 1035220 - RNA, 22 nt, Human
agggaagaagcugguaguaggu

SEQ ID NO: 1035221 - RNA, 22 nt, Human
uucuggagcuaaaguccacucu

SEQ ID NO: 1035222 - RNA, 22 nt, Human
aaaguuucaauagaggaagugg

SEQ ID NO: 1035223 - RNA, 22 nt, Human
cacagaaguuucauagucucga

SEQ ID NO: 1035224 - RNA, 22 nt, Human
gagggcugcaaugagacagaga

SEQ ID NO: 1035225 - RNA, 19 nt, Human
ucaguuuuagucaucaguu

SEQ ID NO: 1035226 - RNA, 22 nt, Human
uucugaggcacuggcucuccca

SEQ ID NO: 1035227 - RNA, 22 nt, Human
gaaaucugcuucuugcauagua

SEQ ID NO: 1035228 - RNA, 22 nt, Human
cagagcagggugcaccuugggc

SEQ ID NO: 1035229 - RNA, 22 nt, Human
ucucuggagggcuccaggcggg

SEQ ID NO: 1035230 - RNA, 22 nt, Human
cuugaaagucacaugcagcccu

SEQ ID NO: 1035231 - RNA, 22 nt, Human
guguuuccucacuucucugacu

SEQ ID NO: 1035232 - RNA, 22 nt, Human
gguggccugcccugaucccugg

SEQ ID NO: 1035233 - RNA, 22 nt, Human
ucagguguuagaagaaauuuca

SEQ ID NO: 1035234 - RNA, 22 nt, Human
ucugucugcgcuugcccuggug

SEQ ID NO: 1035235 - RNA, 22 nt, Human
cucaggauguacuacagaaggc

SEQ ID NO: 1035236 - RNA, 22 nt, Human
ggugcagcugcagccugggagc

SEQ ID NO: 1035237 - RNA, 22 nt, Human
agacagcaggggagucugguuu

SEQ ID NO: 1035238 - RNA, 22 nt, Human
augccaggccccacgcugggca

SEQ ID NO: 1035239 - RNA, 22 nt, Human
agcagccacagucugggacagg

SEQ ID NO: 1035240 - RNA, 22 nt, Human
cugggagcggcugucacugguu

SEQ ID NO: 1035241 - RNA, 22 nt, Human
cugagguguugaugaccuaugc

SEQ ID NO: 1035242 - RNA, 22 nt, Human
ucuggcucucaacaaauauuua

SEQ ID NO: 1035243 - RNA, 22 nt, Human
uggccucuuaggacauccucua

SEQ ID NO: 1035244 - RNA, 22 nt, Human
ucccagaggaaauggcagcuga

SEQ ID NO: 1035245 - RNA, 20 nt, Human
ugccagggccagcagaggcu

SEQ ID NO: 1035246 - RNA, 22 nt, Human
ggcaugggccgaggugccuccu

SEQ ID NO: 1035247 - RNA, 22 nt, Human
agcuuccugaugcaagagggcu

SEQ ID NO: 1035248 - RNA, 22 nt, Human
cccuggagggauuucucaauca

SEQ ID NO: 1035249 - RNA, 22 nt, Human
caggcagaagaaguggaaggac

SEQ ID NO: 1035250 - RNA, 22 nt, Human
gcagggaggaagagaugcuucc

SEQ ID NO: 1035251 - RNA, 22 nt, Human
ccucccucuuucagucccacag

SEQ ID NO: 1035252 - RNA, 22 nt, Human
ccagccagccuugaucugagua

SEQ ID NO: 1035253 - RNA, 22 nt, Human
gauccuugcacuugacuuggca

SEQ ID NO: 1035254 - RNA, 22 nt, Human
cuguuuuugugcugugucuccc

SEQ ID NO: 1035255 - RNA, 17 nt, Human
aggcuggcucacaggga

SEQ ID NO: 1035256 - RNA, 22 nt, Human
uucaaucauuagaaucucaggc

SEQ ID NO: 1035257 - RNA, 22 nt, Human
ucccagggucaguggugaggcc

SEQ ID NO: 1035258 - RNA, 22 nt, Human
cccuggcaaaacacucucuuga

SEQ ID NO: 1035259 - RNA, 22 nt, Human
aagcucugcucagcagacuagg

SEQ ID NO: 1035260 - RNA, 22 nt, Human
agcugcucccuauccuuuccuu

SEQ ID NO: 1035261 - RNA, 22 nt, Human
ugucaugcuuauguuacauacu

SEQ ID NO: 1035262 - RNA, 22 nt, Human
cugucuguuuuaccuucuccag

SEQ ID NO: 1035263 - RNA, 22 nt, Human
ugcugccaagcccgugcuccug

SEQ ID NO: 1035264 - RNA, 21 nt, Human
agcuuccugcagugggagguc

SEQ ID NO: 1035265 - RNA, 22 nt, Human
cuuuggcaaugaaacacaagaa

SEQ ID NO: 1035266 - RNA, 23 nt, Human
uugaaggagaaagcuuucuuggu

SEQ ID NO: 1035267 - RNA, 22 nt, Human
cuggagcccaggccuggugucu

SEQ ID NO: 1035268 - RNA, 22 nt, Human
cucuggagugcagccugguggc

SEQ ID NO: 1035269 - RNA, 22 nt, Human
cagccagcugaauguaccauga

SEQ ID NO: 1035270 - RNA, 22 nt, Human
uagagugguuaacaguuuagaa

SEQ ID NO: 1035271 - RNA, 22 nt, Human
cagggcugaaaucaagguguag

SEQ ID NO: 1035272 - RNA, 22 nt, Human
ucagcugccucucccuggaaga

SEQ ID NO: 1035273 - RNA, 22 nt, Human
ggcucagggaaugaggaagaau

SEQ ID NO: 1035274 - RNA, 22 nt, Human
acacuuuacagcuuccuuugca

SEQ ID NO: 1035275 - RNA, 22 nt, Human
agccuucaguaaauccacugug

SEQ ID NO: 1035276 - RNA, 22 nt, Human
cagguggguacaucacagagac

SEQ ID NO: 1035277 - RNA, 22 nt, Human
gcacagaacuucucuuaguagg

SEQ ID NO: 1035278 - RNA, 22 nt, Human
uggcccugcuuaugucucucuu

SEQ ID NO: 1035279 - RNA, 19 nt, Human
ccagcagacacagcugccc

SEQ ID NO: 1035280 - RNA, 22 nt, Human
cgcagaagagguugucuagucc

SEQ ID NO: 1035281 - RNA, 20 nt, Human
gcagagccucacugcaaggg

SEQ ID NO: 1035282 - RNA, 22 nt, Human
gagcagugaagacagaaguaca

SEQ ID NO: 1035283 - RNA, 20 nt, Human
caccaggcgcucugagaaca

SEQ ID NO: 1035284 - RNA, 19 nt, Human
ggaagagaggaaaggugga

SEQ ID NO: 1035285 - RNA, 22 nt, Human
acagagcuucccagccugagca

SEQ ID NO: 1035286 - RNA, 22 nt, Human
augucacagcucccauuccucc

SEQ ID NO: 1035287 - RNA, 22 nt, Human
augauggugagguugagcacag

SEQ ID NO: 1035288 - RNA, 23 nt, Human
aaguaacagggauaauagcaguu

SEQ ID NO: 1035289 - RNA, 22 nt, Human
agggccugucagcgguguccug

SEQ ID NO: 1035290 - RNA, 22 nt, Human
agacaucagcuugugugcaggg

SEQ ID NO: 1035291 - RNA, 22 nt, Human
uacauagcaaggaaaugacaga

SEQ ID NO: 1035292 - RNA, 22 nt, Human
caugcacuuaccugaaauucaa

SEQ ID NO: 1035293 - RNA, 22 nt, Human
cugaagagcucuccuguccccu

SEQ ID NO: 1035294 - RNA, 22 nt, Human
ggcugccugcucaggugcggcg

SEQ ID NO: 1035295 - RNA, 22 nt, Human
uggccugcuuucauuugaugcu

SEQ ID NO: 1035296 - RNA, 21 nt, Human
gagcauggcuuacaucagcag

SEQ ID NO: 1035297 - RNA, 22 nt, Human
cugagcuuggccaggaaugaau

SEQ ID NO: 1035298 - RNA, 21 nt, Human
gagugucuaauccaggcuguc

SEQ ID NO: 1035299 - RNA, 22 nt, Human
uguacuuccccaaugacagcac

SEQ ID NO: 1035300 - RNA, 22 nt, Human
ucccagagcccaaguuggagag

SEQ ID NO: 1035301 - RNA, 22 nt, Human
gccuggcaggccugggccagca

SEQ ID NO: 1035302 - RNA, 22 nt, Human
aaaguggucaccuucucauuuc

SEQ ID NO: 1035303 - RNA, 22 nt, Human
agcauuuaggagaauuugagaa

SEQ ID NO: 1035304 - RNA, 22 nt, Human
gaggccuggcugggaggaggug

SEQ ID NO: 1035305 - RNA, 22 nt, Human
uccguauuugacuauugcaccg

SEQ ID NO: 1035306 - RNA, 22 nt, Human
ucccagaaaaaggaggcuauga

SEQ ID NO: 1035307 - RNA, 22 nt, Human
agcaguggagcgagauguuuaa

SEQ ID NO: 1035308 - RNA, 21 nt, Human
ccagagccugcugagcccccu

SEQ ID NO: 1035309 - RNA, 19 nt, Human
auagucuuuccaauuauac

SEQ ID NO: 1035310 - RNA, 22 nt, Human
cucaggggaccuggcuccgagu

SEQ ID NO: 1035311 - RNA, 22 nt, Human
cagcucccagagugaccagcag

SEQ ID NO: 1035312 - RNA, 22 nt, Human
agaugcugucacacacacuguu

SEQ ID NO: 1035313 - RNA, 22 nt, Human
uuuguaaaaggaggaagcaugg

SEQ ID NO: 1035314 - RNA, 22 nt, Human
ccaucuccacugucccugucaa

SEQ ID NO: 1035315 - RNA, 22 nt, Human
cucaggaucgcuugcccuaggg

SEQ ID NO: 1035316 - RNA, 22 nt, Human
aagaaaugcagaaaugugcugg

SEQ ID NO: 1035317 - RNA, 22 nt, Human
aaaaguuaccucuguaauauaa

SEQ ID NO: 1035318 - RNA, 21 nt, Human
agcugcuuucagcuccuagag

SEQ ID NO: 1035319 - RNA, 22 nt, Human
aaaugcagauuuugaugcagca

SEQ ID NO: 1035320 - RNA, 22 nt, Human
accugccucuaagcagcaggug

SEQ ID NO: 1035321 - RNA, 22 nt, Human
uccucacagucaacacuuugag

SEQ ID NO: 1035322 - RNA, 22 nt, Human
caagggcucacggucugcuggg

SEQ ID NO: 1035323 - RNA, 22 nt, Human
uagaacagaggguugcccagau

SEQ ID NO: 1035324 - RNA, 22 nt, Human
ccaggcucugucuggucagaag

SEQ ID NO: 1035325 - RNA, 22 nt, Human
gccaugccugugucuccaggcc

SEQ ID NO: 1035326 - RNA, 22 nt, Human
cucuccagaucugcugagccag

SEQ ID NO: 1035327 - RNA, 22 nt, Human
cuccugggcucaagugauccuc

SEQ ID NO: 1035328 - RNA, 22 nt, Human
ccucauggaccucagacugucc

SEQ ID NO: 1035329 - RNA, 22 nt, Human
ugaggcagcuuuuucugugugu

SEQ ID NO: 1035330 - RNA, 21 nt, Human
ccugugugucugacugggcua

SEQ ID NO: 1035331 - RNA, 22 nt, Human
cucugugcccuacugcucagcu

SEQ ID NO: 1035332 - RNA, 22 nt, Human
agcaggagagcagugcgugguc

SEQ ID NO: 1035333 - RNA, 22 nt, Human
auguaucagaaauagcauuggc

SEQ ID NO: 1035334 - RNA, 22 nt, Human
gaggccugggagccuguccucc

SEQ ID NO: 1035335 - RNA, 22 nt, Human
auucacagggacaaugggagag

SEQ ID NO: 1035336 - RNA, 22 nt, Human
uggccugauuuugcuaagagaa

SEQ ID NO: 1035337 - RNA, 22 nt, Human
caagggugguauugggagcaua

SEQ ID NO: 1035338 - RNA, 22 nt, Human
agggcagcuagcuguagaaaga

SEQ ID NO: 1035339 - RNA, 22 nt, Human
cagcaucuaaucuucaugccgg

SEQ ID NO: 1035340 - RNA, 22 nt, Human
gcucagaaaagugaggcucagu

SEQ ID NO: 1035341 - RNA, 22 nt, Human
ugucucaguacacuccgauguu

SEQ ID NO: 1035342 - RNA, 22 nt, Human
cugagccaaggggacagugaca

SEQ ID NO: 1035343 - RNA, 22 nt, Human
uuugacagauccuuaacucagc

SEQ ID NO: 1035344 - RNA, 22 nt, Human
gagauuggauuuaauggccaaa

SEQ ID NO: 1035345 - RNA, 22 nt, Human
aagcaaaagguuacacuucugg

SEQ ID NO: 1035346 - RNA, 22 nt, Human
ucugaggcuaagagacagaggc

SEQ ID NO: 1035347 - RNA, 22 nt, Human
gcccagcaggacagagugguuu

SEQ ID NO: 1035348 - RNA, 22 nt, Human
ccucucccacguggcagaggcu

SEQ ID NO: 1035349 - RNA, 22 nt, Human
uuguggaaauacagacuccaag

SEQ ID NO: 1035350 - RNA, 22 nt, Human
aucugacaaccuauugacuuga

SEQ ID NO: 1035351 - RNA, 22 nt, Human
cagagcuguccaaacccugaca

SEQ ID NO: 1035352 - RNA, 22 nt, Human
agagcuggauggucaagauggc

SEQ ID NO: 1035353 - RNA, 22 nt, Human
uaaguucaaugaacucaguucu

SEQ ID NO: 1035354 - RNA, 22 nt, Human
aggagcugagggagcgcccuug

SEQ ID NO: 1035355 - RNA, 22 nt, Human
aauuuagaauucgcuagcuaau

SEQ ID NO: 1035356 - RNA, 22 nt, Human
ugaaaaggagccuuagguaggu

SEQ ID NO: 1035357 - RNA, 22 nt, Human
aucuggcuauuucuggucgggg

SEQ ID NO: 1035358 - RNA, 22 nt, Human
aucuuugaagaggacuugaagu

SEQ ID NO: 1035359 - RNA, 22 nt, Human
cccugaggggaguggugaggug

SEQ ID NO: 1035360 - RNA, 22 nt, Human
cuacauuucccagcugccuucc

SEQ ID NO: 1035361 - RNA, 22 nt, Human
ccaaggagaaaugcugugcuuu

SEQ ID NO: 1035362 - RNA, 22 nt, Human
cagcaggguagguuguaucagu

SEQ ID NO: 1035363 - RNA, 22 nt, Human
ggaagaagggucauuggcagcc

SEQ ID NO: 1035364 - RNA, 22 nt, Human
agagugaaguucaucgugcagc

SEQ ID NO: 1035365 - RNA, 22 nt, Human
cugccuggaaggagcaagggga

SEQ ID NO: 1035366 - RNA, 22 nt, Human
gaguuauuuguagggauuauau

SEQ ID NO: 1035367 - RNA, 22 nt, Human
gcacagagggcagugagccucu

SEQ ID NO: 1035368 - RNA, 22 nt, Human
uaaccauauuuuccauuaaguu

SEQ ID NO: 1035369 - RNA, 22 nt, Human
caguuucuguuuuaaauagcag

SEQ ID NO: 1035370 - RNA, 22 nt, Human
ugcagaggagucagccugggca

SEQ ID NO: 1035371 - RNA, 22 nt, Human
caggaggaggugagguagaacu

SEQ ID NO: 1035372 - RNA, 22 nt, Human
ugucucuggcccaugagcagag

SEQ ID NO: 1035373 - RNA, 22 nt, Human
cgcugccaggauccccugccgg

SEQ ID NO: 1035374 - RNA, 22 nt, Human
uucuguguggguagcuccuguu

SEQ ID NO: 1035375 - RNA, 22 nt, Human
uccuucagggcugaccacaggc

SEQ ID NO: 1035376 - RNA, 22 nt, Human
acaggcugcccgcuccccaccu

SEQ ID NO: 1035377 - RNA, 22 nt, Human
cccaggcucccaggugggacaa

SEQ ID NO: 1035378 - RNA, 22 nt, Human
cagacagaccugcaagggcaca

SEQ ID NO: 1035379 - RNA, 23 nt, Human
ggaaagagaggaguugugcauag

SEQ ID NO: 1035380 - RNA, 22 nt, Human
cuccauugaacauccucucaga

SEQ ID NO: 1035381 - RNA, 22 nt, Human
ugccucugugggccuuccuggc

SEQ ID NO: 1035382 - RNA, 22 nt, Human
aggcacuguggguguggccgga

SEQ ID NO: 1035383 - RNA, 22 nt, Human
aaggcagauauaaagacuagag

SEQ ID NO: 1035384 - RNA, 22 nt, Human
acuccugguuuguguccuggcu

SEQ ID NO: 1035385 - RNA, 22 nt, Human
ggcagcugaccuagcaccaucc

SEQ ID NO: 1035386 - RNA, 22 nt, Human
ccaggcaggcgauggugcagug

SEQ ID NO: 1035387 - RNA, 22 nt, Human
gcugccuguguggccacucacu

SEQ ID NO: 1035388 - RNA, 22 nt, Human
ccuugcaggggaacaggcagug

SEQ ID NO: 1035389 - RNA, 22 nt, Human
gcuugcucaacccccgucucuc

SEQ ID NO: 1035390 - RNA, 22 nt, Human
aacaaauguguuuuguaauuaa

SEQ ID NO: 1035391 - RNA, 22 nt, Human
ccuguggcucucuuuggagguc

SEQ ID NO: 1035392 - RNA, 22 nt, Human
aaggacuccaauucuuucaucu

SEQ ID NO: 1035393 - RNA, 17 nt, Human
uggcucugaggcugaau

SEQ ID NO: 1035394 - RNA, 22 nt, Human
uggcagagcccagaacugagca

SEQ ID NO: 1035395 - RNA, 22 nt, Human
ucucacugcaaauauuauguau

SEQ ID NO: 1035396 - RNA, 22 nt, Human
cuccaggccauggcugcggagg

SEQ ID NO: 1035397 - RNA, 22 nt, Human
uggcagggccugaaucuuauac

SEQ ID NO: 1035398 - RNA, 17 nt, Human
acagggcagaaacagcu

SEQ ID NO: 1035399 - RNA, 22 nt, Human
ucucagagcaucauuuucuuag

SEQ ID NO: 1035400 - RNA, 21 nt, Human
ucaggcaggcgcagagggaag

SEQ ID NO: 1035401 - RNA, 22 nt, Human
accuuuuuucagaacucuaaag

SEQ ID NO: 1035402 - RNA, 22 nt, Human
uccucaggagagcuccuaugcc

SEQ ID NO: 1035403 - RNA, 22 nt, Human
gccucugcaucaucacuccagc

SEQ ID NO: 1035404 - RNA, 22 nt, Human
auaaaaguaggaccaacuuaca

SEQ ID NO: 1035405 - RNA, 22 nt, Human
uagucucuggagacucuagggg

SEQ ID NO: 1035406 - RNA, 22 nt, Human
agacagcaugauacaugaugcu

SEQ ID NO: 1035407 - RNA, 22 nt, Human
uccuucaguuaucacaguacug

SEQ ID NO: 1035408 - RNA, 22 nt, Human
gcacugaaugccaaaguguagg

SEQ ID NO: 1035409 - RNA, 22 nt, Human
aaggagucucagcugggccuga

SEQ ID NO: 1035410 - RNA, 22 nt, Human
gcagcugagagaagaacagggc

SEQ ID NO: 1035411 - RNA, 22 nt, Human
cccaggcugauguucagcgggu

SEQ ID NO: 1035412 - RNA, 22 nt, Human
uaggccaguggcagguugugug

SEQ ID NO: 1035413 - RNA, 22 nt, Human
cagggccagccauccugcuggg

SEQ ID NO: 1035414 - RNA, 22 nt, Human
agcagccaguucucugugguag

SEQ ID NO: 1035415 - RNA, 22 nt, Human
aagccagccagugccagucuua

SEQ ID NO: 1035416 - RNA, 22 nt, Human
ucagcagauggguuguguuggc

SEQ ID NO: 1035417 - RNA, 22 nt, Human
cccagggagguagcaggagaaa

SEQ ID NO: 1035418 - RNA, 22 nt, Human
ugcagaagaauguaggcauaag

SEQ ID NO: 1035419 - RNA, 22 nt, Human
ucugagagcuguagaagccuau

SEQ ID NO: 1035420 - RNA, 22 nt, Human
agcccagaggcugggcgugcau

SEQ ID NO: 1035421 - RNA, 22 nt, Human
aucaguuuaaaugggcuguugg

SEQ ID NO: 1035422 - RNA, 22 nt, Human
gggagggauuaguucugccugg

SEQ ID NO: 1035423 - RNA, 21 nt, Human
uggcagggguaguaguacagc

SEQ ID NO: 1035424 - RNA, 23 nt, Human
uccaagggcuacaaacacagacc

SEQ ID NO: 1035425 - RNA, 22 nt, Human
uguggcugucuguucuccuagg

SEQ ID NO: 1035426 - RNA, 22 nt, Human
ucacuugccuagcccaguucag

SEQ ID NO: 1035427 - RNA, 22 nt, Human
agccaggacguugcucagcucc

SEQ ID NO: 1035428 - RNA, 22 nt, Human
uaguaucuuucuauauuuccca

SEQ ID NO: 1035429 - RNA, 22 nt, Human
gguggguauaguuagggccucu

SEQ ID NO: 1035430 - RNA, 22 nt, Human
agggcagcauugccuuucucca

SEQ ID NO: 1035431 - RNA, 22 nt, Human
uggcugggugcuauccaguacu

SEQ ID NO: 1035432 - RNA, 22 nt, Human
cagcagagcauuugguaggagg

SEQ ID NO: 1035433 - RNA, 22 nt, Human
auaguauuuaauaguuagcuca

SEQ ID NO: 1035434 - RNA, 22 nt, Human
cagugcauaaucuaaauggggg

SEQ ID NO: 1035435 - RNA, 22 nt, Human
ugggagcucagaaagggagguc

SEQ ID NO: 1035436 - RNA, 18 nt, Human
cguuuuuccgggauugca

SEQ ID NO: 1035437 - RNA, 22 nt, Human
uggcaggggaggugcuugcuua

SEQ ID NO: 1035438 - RNA, 19 nt, Human
ccuuccuccccagggccau

SEQ ID NO: 1035439 - RNA, 22 nt, Human
ugggguggauagaaagugaugu

SEQ ID NO: 1035440 - RNA, 22 nt, Human
ugccugggccuucccaccucug

SEQ ID NO: 1035441 - RNA, 23 nt, Human
gggggcugguugacucucugcag

SEQ ID NO: 1035442 - RNA, 22 nt, Human
augcugcacaagccacauguag

SEQ ID NO: 1035443 - RNA, 22 nt, Human
gcugccucugcgacucugggcg

SEQ ID NO: 1035444 - RNA, 20 nt, Human
cuuagaaauuuuuacccugg

SEQ ID NO: 1035445 - RNA, 22 nt, Human
gcacugaaugcuuuuacuguaa

SEQ ID NO: 1035446 - RNA, 22 nt, Human
auuuguagugaagugaaaauaa

SEQ ID NO: 1035447 - RNA, 22 nt, Human
agaggggcucauauccugucau

SEQ ID NO: 1035448 - RNA, 22 nt, Human
auuucacucucccugccacuua

SEQ ID NO: 1035449 - RNA, 20 nt, Human
agggcagagggauuacaggc

SEQ ID NO: 1035450 - RNA, 22 nt, Human
aagcugccagcugagcugaggc

SEQ ID NO: 1035451 - RNA, 22 nt, Human
ugggacugcucuugcugggguc

SEQ ID NO: 1035452 - RNA, 22 nt, Human
uggcacugccuggcagggcccc

SEQ ID NO: 1035453 - RNA, 19 nt, Human
acacugaauguagaauugg

SEQ ID NO: 1035454 - RNA, 22 nt, Human
agggcagagaaauguaguugag

SEQ ID NO: 1035455 - RNA, 23 nt, Human
cuggcucauccugguugcagugg

SEQ ID NO: 1035456 - RNA, 21 nt, Human
uaagaacauuaucuucuuccu

SEQ ID NO: 1035457 - RNA, 22 nt, Human
gagcugaguuaccuccagauca

SEQ ID NO: 1035458 - RNA, 22 nt, Human
uuccauuguuucugucuucacu

SEQ ID NO: 1035459 - RNA, 22 nt, Human
ucugagaguccaucuccaagcc

SEQ ID NO: 1035460 - RNA, 22 nt, Human
ccucugcagcagagagccagag

SEQ ID NO: 1035461 - RNA, 22 nt, Human
aagcagcagaccugauuuugaa

SEQ ID NO: 1035462 - RNA, 22 nt, Human
agugggcaugaucuggugucug

SEQ ID NO: 1035463 - RNA, 22 nt, Human
ccugugugucugucacugcaca

SEQ ID NO: 1035464 - RNA, 19 nt, Human
gagaggccugugcuugaag

SEQ ID NO: 1035465 - RNA, 22 nt, Human
gugacagaguuuuagaucucau

SEQ ID NO: 1035466 - RNA, 22 nt, Human
cuguacaucucugaggacagua

SEQ ID NO: 1035467 - RNA, 22 nt, Human
accacugcccauggugaaaacu

SEQ ID NO: 1035468 - RNA, 22 nt, Human
ggcugcugggaauaugccagcu

SEQ ID NO: 1035469 - RNA, 22 nt, Human
ucccugggccuccugcuaugca

SEQ ID NO: 1035470 - RNA, 22 nt, Human
ccagcuccugggucuuagucag

SEQ ID NO: 1035471 - RNA, 22 nt, Human
ugggcugcuguuacaggggcug

SEQ ID NO: 1035472 - RNA, 22 nt, Human
uggcucugucacugugagcuau

SEQ ID NO: 1035473 - RNA, 22 nt, Human
uggccuccccuaacagccucuu

SEQ ID NO: 1035474 - RNA, 22 nt, Human
ccucagccuuggccccaggcag

SEQ ID NO: 1035475 - RNA, 22 nt, Human
ucugggcacugcugagccugua

SEQ ID NO: 1035476 - RNA, 22 nt, Human
gaaaagcuaggccaguucagcu

SEQ ID NO: 1035477 - RNA, 19 nt, Human
ucccgcccacugagcgugc

SEQ ID NO: 1035478 - RNA, 22 nt, Human
ucagccugcuccaagugcugcc

SEQ ID NO: 1035479 - RNA, 22 nt, Human
gcagggaccugccacugcuguc

SEQ ID NO: 1035480 - RNA, 22 nt, Human
uacaugaacaaaauagcagaaa

SEQ ID NO: 1035481 - RNA, 21 nt, Human
gagugcaggucugaugccauc

SEQ ID NO: 1035482 - RNA, 22 nt, Human
cccucugcaggcuggaccugcc

SEQ ID NO: 1035483 - RNA, 22 nt, Human
ggccucagugggccgcugcagg

SEQ ID NO: 1035484 - RNA, 22 nt, Human
ggagugggcagcacugcccugu

SEQ ID NO: 1035485 - RNA, 22 nt, Human
cugaaggauguguggugggagu

SEQ ID NO: 1035486 - RNA, 22 nt, Human
ggccucuguucugcauuccucc

SEQ ID NO: 1035487 - RNA, 22 nt, Human
cacacaggagagugcuggaggu

SEQ ID NO: 1035488 - RNA, 22 nt, Human
gcacagggaggcuggccuggcc

SEQ ID NO: 1035489 - RNA, 22 nt, Human
aaugcacauaaauauggucuua

SEQ ID NO: 1035490 - RNA, 22 nt, Human
auccaaagcccuaaguuaacug

SEQ ID NO: 1035491 - RNA, 22 nt, Human
uguauauucugccuaaaagcuu

SEQ ID NO: 1035492 - RNA, 22 nt, Human
cacaagucuguggucuccaaca

SEQ ID NO: 1035493 - RNA, 22 nt, Human
ccugccugcagaaaguaucucc

SEQ ID NO: 1035494 - RNA, 21 nt, Human
aagggagauaggaaucaggcc

SEQ ID NO: 1035495 - RNA, 22 nt, Human
uugaagcaaggcgaaucuugug

SEQ ID NO: 1035496 - RNA, 22 nt, Human
aagggccuccuggggagccugg

SEQ ID NO: 1035497 - RNA, 22 nt, Human
guaucuuucccaccaaucacaa

SEQ ID NO: 1035498 - RNA, 22 nt, Human
gcugccagcucacucuccugag

SEQ ID NO: 1035499 - RNA, 22 nt, Human
ugucagugaguuaguugcaagu

SEQ ID NO: 1035500 - RNA, 22 nt, Human
uuaacagagaacauagaaguag

SEQ ID NO: 1035501 - RNA, 20 nt, Human
cucugcagcaaggccugggu

SEQ ID NO: 1035502 - RNA, 22 nt, Human
aguaggaggcgggagcaugaag

SEQ ID NO: 1035503 - RNA, 22 nt, Human
ugugcaguuucuauguugucca

SEQ ID NO: 1035504 - RNA, 22 nt, Human
aguggggacuuaugccagcauu

SEQ ID NO: 1035505 - RNA, 18 nt, Human
cagaaguccuucaaggcc

SEQ ID NO: 1035506 - RNA, 22 nt, Human
uaugagcuuccaguguugcaug

SEQ ID NO: 1035507 - RNA, 22 nt, Human
agccagcagggcuuagaggaca

SEQ ID NO: 1035508 - RNA, 22 nt, Human
cauugcuguuaauugucucuag

SEQ ID NO: 1035509 - RNA, 22 nt, Human
ugcuuuauuuauaaaauagcaa

SEQ ID NO: 1035510 - RNA, 22 nt, Human
cugcucucuguuccccuggauc

SEQ ID NO: 1035511 - RNA, 20 nt, Human
gcugccagugccugaugcuu

SEQ ID NO: 1035512 - RNA, 22 nt, Human
uugggcucaggaguuugagacc

SEQ ID NO: 1035513 - RNA, 22 nt, Human
ugauuuccuaggucuggagaag

SEQ ID NO: 1035514 - RNA, 22 nt, Human
gcagagugauggaaugugggug

SEQ ID NO: 1035515 - RNA, 22 nt, Human
gcuggcugcgucaucacagggc

SEQ ID NO: 1035516 - RNA, 22 nt, Human
uugaagcaaauucugugcagua

SEQ ID NO: 1035517 - RNA, 22 nt, Human
ugcuuuauguuaucagaagggu

SEQ ID NO: 1035518 - RNA, 22 nt, Human
gcagccaggaaagcuggacccu

SEQ ID NO: 1035519 - RNA, 22 nt, Human
uggcucugaucagauguccagu

SEQ ID NO: 1035520 - RNA, 22 nt, Human
cuggccugaggucggcuguagg

SEQ ID NO: 1035521 - RNA, 22 nt, Human
agagcagcacguuguccccaca

SEQ ID NO: 1035522 - RNA, 22 nt, Human
ggcucaggacacagugguuuag

SEQ ID NO: 1035523 - RNA, 22 nt, Human
gccuggaguuguggugaagcca

SEQ ID NO: 1035524 - RNA, 19 nt, Human
uccaaaggacccaccucca

SEQ ID NO: 1035525 - RNA, 22 nt, Human
uagcagggccaggcugggaacc

SEQ ID NO: 1035526 - RNA, 22 nt, Human
aacagugagaagguggacagga

SEQ ID NO: 1035527 - RNA, 22 nt, Human
ggagccuggccuggcucugugu

SEQ ID NO: 1035528 - RNA, 22 nt, Human
gagguagccacagauagagacu

SEQ ID NO: 1035529 - RNA, 22 nt, Human
cagggacauugguggccagguu

SEQ ID NO: 1035530 - RNA, 22 nt, Human
ccugucuggaacauggccuguu

SEQ ID NO: 1035531 - RNA, 22 nt, Human
ucaggugguccuaagugccauc

SEQ ID NO: 1035532 - RNA, 22 nt, Human
cagagcugagaauguugaugcu

SEQ ID NO: 1035533 - RNA, 22 nt, Human
uuaauaaaguaugaauuggaaa

SEQ ID NO: 1035534 - RNA, 23 nt, Human
cagggcugggcuugguguuaggc

SEQ ID NO: 1035535 - RNA, 20 nt, Human
ccagagcagccacugaaguu

SEQ ID NO: 1035536 - RNA, 22 nt, Human
gcagggcucaacaggacacccc

SEQ ID NO: 1035537 - RNA, 22 nt, Human
gagcugcugguugcuggugccu

SEQ ID NO: 1035538 - RNA, 18 nt, Human
uccagcgugcuccagggc

SEQ ID NO: 1035539 - RNA, 22 nt, Human
ugagccuggcggaagcagcgug

SEQ ID NO: 1035540 - RNA, 22 nt, Human
caggggcugugggcggagccuc

SEQ ID NO: 1035541 - RNA, 22 nt, Human
auugagaauccauuugagauga

SEQ ID NO: 1035542 - RNA, 22 nt, Human
aauaauuuugagagccuggaaa

SEQ ID NO: 1035543 - RNA, 22 nt, Human
uccaggcugggcugaagggugc

SEQ ID NO: 1035544 - RNA, 22 nt, Human
ugagccagucugucugggugaa

SEQ ID NO: 1035545 - RNA, 22 nt, Human
agccugccuugggcugcuugag

SEQ ID NO: 1035546 - RNA, 22 nt, Human
agcagggcugcagugugucuuu

SEQ ID NO: 1035547 - RNA, 22 nt, Human
gcugccacauuuucaggacuaa

SEQ ID NO: 1035548 - RNA, 20 nt, Human
cccugagaccagagagcagc

SEQ ID NO: 1035549 - RNA, 22 nt, Human
gaagcccuauccucuccuggga

SEQ ID NO: 1035550 - RNA, 22 nt, Human
uggccugccccgagauccuggc

SEQ ID NO: 1035551 - RNA, 22 nt, Human
cugggagggguagccaauccua

SEQ ID NO: 1035552 - RNA, 22 nt, Human
caugggagguuggcuuggcaug

SEQ ID NO: 1035553 - RNA, 22 nt, Human
agggcacaucugcugggaaugg

SEQ ID NO: 1035554 - RNA, 22 nt, Human
agcugcccuggcggagcugcuc

SEQ ID NO: 1035555 - RNA, 22 nt, Human
agcucccagaaggcccugcgcc

SEQ ID NO: 1035556 - RNA, 19 nt, Human
gcugugugaccuugggcaa

SEQ ID NO: 1035557 - RNA, 22 nt, Human
ugcaggugcguuuucaagccuc

SEQ ID NO: 1035558 - RNA, 22 nt, Human
agaggugacauaggagaggcuc

SEQ ID NO: 1035559 - RNA, 22 nt, Human
agugaguggacccugcaaggaa

SEQ ID NO: 1035560 - RNA, 22 nt, Human
aguuacuugagacguuuaugaa

SEQ ID NO: 1035561 - RNA, 22 nt, Human
gcugucuggaggcucugaggga

SEQ ID NO: 1035562 - RNA, 22 nt, Human
ggcuccuguccuccuggagcuc

SEQ ID NO: 1035563 - RNA, 22 nt, Human
ggagccuguggccgucacgacu

SEQ ID NO: 1035564 - RNA, 22 nt, Human
ugguggcuucugaggauggcga

SEQ ID NO: 1035565 - RNA, 23 nt, Human
gccucugcagccuaguuaguguc

SEQ ID NO: 1035566 - RNA, 22 nt, Human
caggccagguggcaggcaaaac

SEQ ID NO: 1035567 - RNA, 21 nt, Human
cagagcuguccaaacccugac

SEQ ID NO: 1035568 - RNA, 22 nt, Human
gacacagcacuguacaaggaau

SEQ ID NO: 1035569 - RNA, 22 nt, Human
uaacagaauagcagaaacagaa

SEQ ID NO: 1035570 - RNA, 22 nt, Human
agccaaggacacggagccuccu

SEQ ID NO: 1035571 - RNA, 21 nt, Human
agcagccauggaugguaugua

SEQ ID NO: 1035572 - RNA, 22 nt, Human
uucacagggcagcagcugagcc

SEQ ID NO: 1035573 - RNA, 22 nt, Human
uuccauaauaaccugagagaaa

SEQ ID NO: 1035574 - RNA, 22 nt, Human
uaugcacaauaugaucuauuug

SEQ ID NO: 1035575 - RNA, 22 nt, Human
uguguguauaugcauuuaucua

SEQ ID NO: 1035576 - RNA, 22 nt, Human
ggaggccaaggcagguggaucg

SEQ ID NO: 1035577 - RNA, 22 nt, Human
ccaggcuggauuuugcaguuca

SEQ ID NO: 1035578 - RNA, 22 nt, Human
agcaggaguuugaugcuuuuau

SEQ ID NO: 1035579 - RNA, 22 nt, Human
agcaggcuccuuccuucucugg

SEQ ID NO: 1035580 - RNA, 22 nt, Human
uugcauaaaugcuuaaaauuug

SEQ ID NO: 1035581 - RNA, 21 nt, Human
gcaggcuggucaaaccucagu

SEQ ID NO: 1035582 - RNA, 22 nt, Human
cagaagcacuaggaggaaacgu

SEQ ID NO: 1035583 - RNA, 22 nt, Human
cagagcuggguuugggaaaccu

SEQ ID NO: 1035584 - RNA, 22 nt, Human
uuuucucuacaaaauaaccagc

SEQ ID NO: 1035585 - RNA, 22 nt, Human
gaagagcuuagacagaaucaaa

SEQ ID NO: 1035586 - RNA, 21 nt, Human
cugaggcagcacagcuaguca

SEQ ID NO: 1035587 - RNA, 22 nt, Human
guccucuggccuuucccaggac

SEQ ID NO: 1035588 - RNA, 22 nt, Human
ggcugcuggcauugagguaggu

SEQ ID NO: 1035589 - RNA, 22 nt, Human
ccagggugagugucauggguua

SEQ ID NO: 1035590 - RNA, 22 nt, Human
gcuguuccugcuuagaggucgg

SEQ ID NO: 1035591 - RNA, 20 nt, Human
ugugcccaauguccagguuc

SEQ ID NO: 1035592 - RNA, 22 nt, Human
gccaccucuuugucucugccgc

SEQ ID NO: 1035593 - RNA, 22 nt, Human
gcucuguguccacagcuggaaa

SEQ ID NO: 1035594 - RNA, 22 nt, Human
uggaggaugagugugggcucug

SEQ ID NO: 1035595 - RNA, 22 nt, Human
guaagagcacugucuccugcug

SEQ ID NO: 1035596 - RNA, 22 nt, Human
caggcagcugcuggguucagcc

SEQ ID NO: 1035597 - RNA, 22 nt, Human
uaaggcaccauaauauauuuaa

SEQ ID NO: 1035598 - RNA, 22 nt, Human
gaaaugcagaaccugagaccau

SEQ ID NO: 1035599 - RNA, 22 nt, Human
ccaggcucaggugcgagagaca

SEQ ID NO: 1035600 - RNA, 22 nt, Human
agggcucugggguggcagagau

SEQ ID NO: 1035601 - RNA, 22 nt, Human
ggccugagucacaucaggagag

SEQ ID NO: 1035602 - RNA, 22 nt, Human
ggaggccaucuggcuggaggcu

SEQ ID NO: 1035603 - RNA, 22 nt, Human
uuccagaauuuuguucugcuug

SEQ ID NO: 1035604 - RNA, 22 nt, Human
gcccucucggcauagcaggggc

SEQ ID NO: 1035605 - RNA, 18 nt, Human
uggcucagauggcuuuaa

SEQ ID NO: 1035606 - RNA, 22 nt, Human
uggcuagcccuuguggggagag

SEQ ID NO: 1035607 - RNA, 22 nt, Human
uugccuugauucuucucaugug

SEQ ID NO: 1035608 - RNA, 22 nt, Human
cugggcugcagcgggagcgacg

SEQ ID NO: 1035609 - RNA, 22 nt, Human
cauugcuuugugcauauuuaaa

SEQ ID NO: 1035610 - RNA, 22 nt, Human
uggcucagugcauucacaguaa

SEQ ID NO: 1035611 - RNA, 22 nt, Human
ugcaauaacuacuuuaauguug

SEQ ID NO: 1035612 - RNA, 22 nt, Human
cucccaagggguaagggagcug

SEQ ID NO: 1035613 - RNA, 22 nt, Human
ugggccugauucuugaauccug

SEQ ID NO: 1035614 - RNA, 22 nt, Human
ucacaggguaucugggauggau

SEQ ID NO: 1035615 - RNA, 22 nt, Human
ggcuucuccccuuugagucuuc

SEQ ID NO: 1035616 - RNA, 22 nt, Human
gcugucacaaauauuucucagc

SEQ ID NO: 1035617 - RNA, 22 nt, Human
ccuuucucuuggauaccgauug

SEQ ID NO: 1035618 - RNA, 17 nt, Human
uguggccuucugagcuu

SEQ ID NO: 1035619 - RNA, 22 nt, Human
aaugcuagugugauauguaagg

SEQ ID NO: 1035620 - RNA, 22 nt, Human
ggccugcuucucagugagcuug

SEQ ID NO: 1035621 - RNA, 22 nt, Human
ugugcccaucccucuggagugu

SEQ ID NO: 1035622 - RNA, 22 nt, Human
cauugaaaccuaacauaggcug

SEQ ID NO: 1035623 - RNA, 22 nt, Human
agcccccaaaagugcuuaugau

SEQ ID NO: 1035624 - RNA, 22 nt, Human
ugaagccagcuuuggaagacac

SEQ ID NO: 1035625 - RNA, 22 nt, Human
gcaggagccaggccgagcuggu

SEQ ID NO: 1035626 - RNA, 22 nt, Human
uagaggugucacuuugggaagu

SEQ ID NO: 1035627 - RNA, 22 nt, Human
uuucuagaggcuccaggggagu

SEQ ID NO: 1035628 - RNA, 22 nt, Human
acagaccaaguuuccagcaggu

SEQ ID NO: 1035629 - RNA, 22 nt, Human
ugccaggcccagcuccagagcu

SEQ ID NO: 1035630 - RNA, 22 nt, Human
cugaagccacgauagcuuccua

SEQ ID NO: 1035631 - RNA, 22 nt, Human
gggcuuggcacaugggcucagc

SEQ ID NO: 1035632 - RNA, 22 nt, Human
gccuggaguagcauggcaagcc

SEQ ID NO: 1035633 - RNA, 22 nt, Human
gaggagcacaugaggcugaggg

SEQ ID NO: 1035634 - RNA, 22 nt, Human
agucucagcaagcauggcuagu

SEQ ID NO: 1035635 - RNA, 22 nt, Human
caaaggcaacauauacuuguuu

SEQ ID NO: 1035636 - RNA, 22 nt, Human
ugggcuggcguggagaguuuag

SEQ ID NO: 1035637 - RNA, 22 nt, Human
ucuggauggucagcucuuccug

SEQ ID NO: 1035638 - RNA, 22 nt, Human
cacagguguaugaauaugucca

SEQ ID NO: 1035639 - RNA, 22 nt, Human
uagaaauccccagucucauagu

SEQ ID NO: 1035640 - RNA, 22 nt, Human
aaaaagguugauccagauuagg

SEQ ID NO: 1035641 - RNA, 22 nt, Human
uuccucucucuugccagaaugu

SEQ ID NO: 1035642 - RNA, 22 nt, Human
ucccagaguucaaugggaaggu

SEQ ID NO: 1035643 - RNA, 22 nt, Human
ucuggagagucacagugccaga

SEQ ID NO: 1035644 - RNA, 22 nt, Human
aaugauggucauggcaacuuuu

SEQ ID NO: 1035645 - RNA, 22 nt, Human
cacagaggaaaggcaguuggua

SEQ ID NO: 1035646 - RNA, 22 nt, Human
agggugggcuagacucuucccc

SEQ ID NO: 1035647 - RNA, 20 nt, Human
ccuggcugcauucaggacgg

SEQ ID NO: 1035648 - RNA, 22 nt, Human
auguguagaacuguaaugccca

SEQ ID NO: 1035649 - RNA, 22 nt, Human
ucugcucuaguugcuuccugcc

SEQ ID NO: 1035650 - RNA, 22 nt, Human
gagguacagaguguuccaaugu

SEQ ID NO: 1035651 - RNA, 22 nt, Human
auaaacacuucuagggcacaca

SEQ ID NO: 1035652 - RNA, 22 nt, Human
cugccugggccggccacccucu

SEQ ID NO: 1035653 - RNA, 22 nt, Human
auuuuuaugacaaaccauccuc

SEQ ID NO: 1035654 - RNA, 20 nt, Human
aggcucagcugagcucuugg

SEQ ID NO: 1035655 - RNA, 22 nt, Human
gggcugcacguauucugcucac

SEQ ID NO: 1035656 - RNA, 22 nt, Human
uugaaaggaauacagaggccua

SEQ ID NO: 1035657 - RNA, 17 nt, Human
agcagaagucagaggga

SEQ ID NO: 1035658 - RNA, 22 nt, Human
aaugcacaugccacauguggua

SEQ ID NO: 1035659 - RNA, 22 nt, Human
ugcagcucugaacagucaugaa

SEQ ID NO: 1035660 - RNA, 22 nt, Human
aucucagacauguuguccauga

SEQ ID NO: 1035661 - RNA, 22 nt, Human
auagucuuagucuauaguuuug

SEQ ID NO: 1035662 - RNA, 23 nt, Human
ucucaggacacacaugucuauca

SEQ ID NO: 1035663 - RNA, 22 nt, Human
aucuagaaguggcaugaauuac

SEQ ID NO: 1035664 - RNA, 22 nt, Human
ugccugggggacuaaggccaaa

SEQ ID NO: 1035665 - RNA, 22 nt, Human
acaguaaugauucugagucucu

SEQ ID NO: 1035666 - RNA, 22 nt, Human
uggugcuguggaggggcagaag

SEQ ID NO: 1035667 - RNA, 22 nt, Human
aagauuuccauuucuagcucau

SEQ ID NO: 1035668 - RNA, 22 nt, Human
gcugcucucucccuaaguuggg

SEQ ID NO: 1035669 - RNA, 22 nt, Human
ucuggcuccacaccucacugca

SEQ ID NO: 1035670 - RNA, 22 nt, Human
cugccacuagcuuucacaucuu

SEQ ID NO: 1035671 - RNA, 22 nt, Human
cucugggcaaguuucuucauga

SEQ ID NO: 1035672 - RNA, 22 nt, Human
acuguguggaccacucugaggc

SEQ ID NO: 1035673 - RNA, 20 nt, Human
cacaggcuauaugagagcca

SEQ ID NO: 1035674 - RNA, 22 nt, Human
cuggcaggaagaggaaagguca

SEQ ID NO: 1035675 - RNA, 22 nt, Human
gugccuggagcuaauguguaua

SEQ ID NO: 1035676 - RNA, 19 nt, Human
cugucaggggcuggauguu

SEQ ID NO: 1035677 - RNA, 22 nt, Human
gguggcagaggugcaucagccc

SEQ ID NO: 1035678 - RNA, 22 nt, Human
gacaggguacgggcuaggcaca

SEQ ID NO: 1035679 - RNA, 22 nt, Human
aggaggccgcugaugggcuccc

SEQ ID NO: 1035680 - RNA, 17 nt, Human
cagugcagagcccuuuc

SEQ ID NO: 1035681 - RNA, 22 nt, Human
ugccugcucuuaccacucuccc

SEQ ID NO: 1035682 - RNA, 22 nt, Human
ugucccagguccuagaugacca

SEQ ID NO: 1035683 - RNA, 22 nt, Human
aucaguuugauaauaaggcuug

SEQ ID NO: 1035684 - RNA, 22 nt, Human
aaaaguaauugaugcaaucgua

SEQ ID NO: 1035685 - RNA, 22 nt, Human
cuggagcaggcuugucccagcu

SEQ ID NO: 1035686 - RNA, 22 nt, Human
aguaacaagugccaacguuaga

SEQ ID NO: 1035687 - RNA, 22 nt, Human
guaggcagauaggagugcagcc

SEQ ID NO: 1035688 - RNA, 22 nt, Human
uguaagauauucagcuuauuga

SEQ ID NO: 1035689 - RNA, 22 nt, Human
ccaggagcaggagcuggacaga

SEQ ID NO: 1035690 - RNA, 22 nt, Human
aggcugggaaauguagucuucc

SEQ ID NO: 1035691 - RNA, 22 nt, Human
cacugggcguguccugggugag

SEQ ID NO: 1035692 - RNA, 22 nt, Human
gccucugcucggacuuugccuc

SEQ ID NO: 1035693 - RNA, 22 nt, Human
gccagagcagaauagaguggcc

SEQ ID NO: 1035694 - RNA, 22 nt, Human
acacugcagaugaaagcauaag

SEQ ID NO: 1035695 - RNA, 22 nt, Human
cugcucugaguauuaacggagg

SEQ ID NO: 1035696 - RNA, 22 nt, Human
aagggcagcuuaaauugguagc

SEQ ID NO: 1035697 - RNA, 22 nt, Human
gccaggggacgcggagcgacga

SEQ ID NO: 1035698 - RNA, 22 nt, Human
ucaggauccauagacucccaaa

SEQ ID NO: 1035699 - RNA, 22 nt, Human
uggccugccucccggcuucuuu

SEQ ID NO: 1035700 - RNA, 22 nt, Human
ggagauggcucugcaaggucua

SEQ ID NO: 1035701 - RNA, 22 nt, Human
gcagcccaauggacugagacag

SEQ ID NO: 1035702 - RNA, 22 nt, Human
agguggguccuggcucugccau

SEQ ID NO: 1035703 - RNA, 22 nt, Human
guggauggauugaggcaguggg

SEQ ID NO: 1035704 - RNA, 22 nt, Human
gagaaagacguaggcugggagg

SEQ ID NO: 1035705 - RNA, 22 nt, Human
gguggcaggcccugagcauccc

SEQ ID NO: 1035706 - RNA, 22 nt, Human
ucccagaggucucugcugguuc

SEQ ID NO: 1035707 - RNA, 22 nt, Human
uagcuuuacaaagugcugcacc

SEQ ID NO: 1035708 - RNA, 22 nt, Human
gcagcuggggccacacuuaggc

SEQ ID NO: 1035709 - RNA, 22 nt, Human
cagucccacuagugccaauacc

SEQ ID NO: 1035710 - RNA, 22 nt, Human
aagauuuccuggauguaauucc

SEQ ID NO: 1035711 - RNA, 22 nt, Human
ccuggcugaaccaaugaagugg

SEQ ID NO: 1035712 - RNA, 22 nt, Human
ccaggcauccauugcuuccucu

SEQ ID NO: 1035713 - RNA, 22 nt, Human
aagccagcauuuucccauuccu

SEQ ID NO: 1035714 - RNA, 22 nt, Human
cacuggcaugugaggcgguggc

SEQ ID NO: 1035715 - RNA, 20 nt, Human
gaggcugcggacugcuggac

SEQ ID NO: 1035716 - RNA, 22 nt, Human
ugugacaugugucaucuuuucu

SEQ ID NO: 1035717 - RNA, 22 nt, Human
agcauggggcuccgcaaugaac

SEQ ID NO: 1035718 - RNA, 22 nt, Human
uggcccugccacucacugcuga

SEQ ID NO: 1035719 - RNA, 22 nt, Human
gggaucagaaacauagcccuga

SEQ ID NO: 1035720 - RNA, 22 nt, Human
aaggcaggaugcggacccaucu

SEQ ID NO: 1035721 - RNA, 22 nt, Human
agcaggugacagggcuguggug

SEQ ID NO: 1035722 - RNA, 22 nt, Human
ucccagaguuuccuguguccca

SEQ ID NO: 1035723 - RNA, 22 nt, Human
ucacagaauagcacuguaagcg

SEQ ID NO: 1035724 - RNA, 22 nt, Human
gcugugcacuaccuauacaucc

SEQ ID NO: 1035725 - RNA, 21 nt, Human
acaggcucuggggaugcuggg

SEQ ID NO: 1035726 - RNA, 22 nt, Human
aaagcaguauauugguaguugu

SEQ ID NO: 1035727 - RNA, 22 nt, Human
gagccuggccuccugccucagc

SEQ ID NO: 1035728 - RNA, 22 nt, Human
auuuaaaugcuuaagaggguuu

SEQ ID NO: 1035729 - RNA, 22 nt, Human
gcuuccugauauucauacuguu

SEQ ID NO: 1035730 - RNA, 22 nt, Human
cggcuggggcuguccccaugac

SEQ ID NO: 1035731 - RNA, 22 nt, Human
uccagggaccucccugagagcu

SEQ ID NO: 1035732 - RNA, 22 nt, Human
ucucuggguuuuuguccuguac

SEQ ID NO: 1035733 - RNA, 18 nt, Human
ucuggcucaggacugaac

SEQ ID NO: 1035734 - RNA, 22 nt, Human
caggucagaggcgcagccccca

SEQ ID NO: 1035735 - RNA, 23 nt, Human
aggagccaggaaccagcuucccc

SEQ ID NO: 1035736 - RNA, 22 nt, Human
ugcucccaggcauucucuguug

SEQ ID NO: 1035737 - RNA, 22 nt, Human
gggcugugagaguggggcugcu

SEQ ID NO: 1035738 - RNA, 22 nt, Human
uaguccaguaaaacagcuaacg

SEQ ID NO: 1035739 - RNA, 22 nt, Human
cagaacugggcagggagcagag

SEQ ID NO: 1035740 - RNA, 22 nt, Human
cagucccaaggaggaagcaguc

SEQ ID NO: 1035741 - RNA, 22 nt, Human
gcugucugacuccaaguuggag

SEQ ID NO: 1035742 - RNA, 22 nt, Human
ggugcagugguguggcaaaggg

SEQ ID NO: 1035743 - RNA, 22 nt, Human
cugcuuugaggggcucuguaua

SEQ ID NO: 1035744 - RNA, 22 nt, Human
uuauguacucugcaauguuuga

SEQ ID NO: 1035745 - RNA, 22 nt, Human
ccaggccucccuuuuccagcca

SEQ ID NO: 1035746 - RNA, 22 nt, Human
ggagggcucaauugacuccuga

SEQ ID NO: 1035747 - RNA, 22 nt, Human
cuggugugauugagcccaggug

SEQ ID NO: 1035748 - RNA, 22 nt, Human
uggccuggaaaaaugcagaugg

SEQ ID NO: 1035749 - RNA, 22 nt, Human
cccaggcagucuggcucuaaag

SEQ ID NO: 1035750 - RNA, 22 nt, Human
gauuuccuagacauggggcaga

SEQ ID NO: 1035751 - RNA, 19 nt, Human
cugugcuuuaaacuccuau

SEQ ID NO: 1035752 - RNA, 22 nt, Human
agaagcugccuacaugaccagc

SEQ ID NO: 1035753 - RNA, 22 nt, Human
gccauccucugagcacuaggca

SEQ ID NO: 1035754 - RNA, 22 nt, Human
uggcucugugucucccagcagc

SEQ ID NO: 1035755 - RNA, 22 nt, Human
ccuggcugcauuuugcuggaug

SEQ ID NO: 1035756 - RNA, 22 nt, Human
cuggcucccagcuuucagggag

SEQ ID NO: 1035757 - RNA, 22 nt, Human
gcucucuguuauuaagaucuuu

SEQ ID NO: 1035758 - RNA, 22 nt, Human
auaucacaaacaagucuguacu

SEQ ID NO: 1035759 - RNA, 20 nt, Human
ccacaggaguccagucgacc

SEQ ID NO: 1035760 - RNA, 22 nt, Human
ggcaggagaauggcgugaacuc

SEQ ID NO: 1035761 - RNA, 22 nt, Human
ucugcaggacugaggccuguuu

SEQ ID NO: 1035762 - RNA, 22 nt, Human
cucugcugcccaggccugcuag

SEQ ID NO: 1035763 - RNA, 20 nt, Human
aggcacuguugucuguaucc

SEQ ID NO: 1035764 - RNA, 22 nt, Human
ccaggagcauuaagagaacaua

SEQ ID NO: 1035765 - RNA, 22 nt, Human
gaagcagcucagauugacugaa

SEQ ID NO: 1035766 - RNA, 22 nt, Human
aggaagccaugguggacgucua

SEQ ID NO: 1035767 - RNA, 22 nt, Human
agcugccaaguuggaguagcaa

SEQ ID NO: 1035768 - RNA, 22 nt, Human
acagaauucucucugcagaggc

SEQ ID NO: 1035769 - RNA, 22 nt, Human
acagugucugacacauuguagc

SEQ ID NO: 1035770 - RNA, 22 nt, Human
cagcugccaagaaucuuuucua

SEQ ID NO: 1035771 - RNA, 22 nt, Human
caggagcccguugcuccggcgg

SEQ ID NO: 1035772 - RNA, 22 nt, Human
aucagugcuaaagcaaaugccc

SEQ ID NO: 1035773 - RNA, 22 nt, Human
cagccaggacagggaaacuagu

SEQ ID NO: 1035774 - RNA, 22 nt, Human
agcagagucugugugcacuuua

SEQ ID NO: 1035775 - RNA, 22 nt, Human
cccagagcugagucugauauau

SEQ ID NO: 1035776 - RNA, 22 nt, Human
gccugccugcugugugcaaguu

SEQ ID NO: 1035777 - RNA, 22 nt, Human
cuggcuccauccuugagcucug

SEQ ID NO: 1035778 - RNA, 17 nt, Human
aggcauggucuggggug

SEQ ID NO: 1035779 - RNA, 22 nt, Human
augguguagcaugugauaugac

SEQ ID NO: 1035780 - RNA, 22 nt, Human
acugggaggcaucuggagcuga

SEQ ID NO: 1035781 - RNA, 22 nt, Human
uauagaagagacaugugcauag

SEQ ID NO: 1035782 - RNA, 22 nt, Human
agagaagacuuacagccacagu

SEQ ID NO: 1035783 - RNA, 20 nt, Human
guggccuguccuguuguggg

SEQ ID NO: 1035784 - RNA, 22 nt, Human
caggagcaaggagcagugggau

SEQ ID NO: 1035785 - RNA, 22 nt, Human
gccccagcucugccacaacuag

SEQ ID NO: 1035786 - RNA, 23 nt, Human
auacauacagucuuacugacuuu

SEQ ID NO: 1035787 - RNA, 22 nt, Human
aucuggcucccuuggaauccgu

SEQ ID NO: 1035788 - RNA, 20 nt, Human
agggucaguagcacagagcu

SEQ ID NO: 1035789 - RNA, 22 nt, Human
ugauuucccucaucauaacaga

SEQ ID NO: 1035790 - RNA, 22 nt, Human
uggagcugaacuuugaggccag

SEQ ID NO: 1035791 - RNA, 22 nt, Human
gagggugguggcuuaaggugcu

SEQ ID NO: 1035792 - RNA, 22 nt, Human
ucagaggacgcacuaggguugu

SEQ ID NO: 1035793 - RNA, 22 nt, Human
ccucuggcuguaccacuggcac

SEQ ID NO: 1035794 - RNA, 22 nt, Human
uugaacagcuguuacauuguua

SEQ ID NO: 1035795 - RNA, 22 nt, Human
agagccugugggagaugcagcu

SEQ ID NO: 1035796 - RNA, 22 nt, Human
aaugcacacauuugguacugaa

SEQ ID NO: 1035797 - RNA, 22 nt, Human
cccugcaggggaccugcagccu

SEQ ID NO: 1035798 - RNA, 21 nt, Human
gggaaauuaggauugcucauc

SEQ ID NO: 1035799 - RNA, 19 nt, Human
ccuggguccacucagacua

SEQ ID NO: 1035800 - RNA, 22 nt, Human
uaagaacagugucugucucaca

SEQ ID NO: 1035801 - RNA, 22 nt, Human
cagagccaaaugcugugguuau

SEQ ID NO: 1035802 - RNA, 20 nt, Human
ggcugugcccuuccguggcc

SEQ ID NO: 1035803 - RNA, 22 nt, Human
aggcaguguauugcuagcggcu

SEQ ID NO: 1035804 - RNA, 22 nt, Human
gccugccuuuguaugacccuga

SEQ ID NO: 1035805 - RNA, 22 nt, Human
gcugagcuagcuaucucagucu

SEQ ID NO: 1035806 - RNA, 22 nt, Human
ucccacacagcccgcucaccgg

SEQ ID NO: 1035807 - RNA, 22 nt, Human
gcaaugauauugaagugaugaa

SEQ ID NO: 1035808 - RNA, 22 nt, Human
gcucuguccagcgugcacagaa

SEQ ID NO: 1035809 - RNA, 22 nt, Human
cacugcaggucugagauggggg

SEQ ID NO: 1035810 - RNA, 22 nt, Human
uagcuuuaccauagaagaguau

SEQ ID NO: 1035811 - RNA, 22 nt, Human
uggugcugacaguucugagugc

SEQ ID NO: 1035812 - RNA, 22 nt, Human
aaagccuucaaguagauguaag

SEQ ID NO: 1035813 - RNA, 20 nt, Human
gcacugaaauucaauguuug

SEQ ID NO: 1035814 - RNA, 22 nt, Human
uauuuccugcauggugauguaa

SEQ ID NO: 1035815 - RNA, 22 nt, Human
agauuuagugguggaauuuugg

SEQ ID NO: 1035816 - RNA, 22 nt, Human
ucuggcucucauacucgccagu

SEQ ID NO: 1035817 - RNA, 22 nt, Human
gccucugcaacuccgccuuggu

SEQ ID NO: 1035818 - RNA, 22 nt, Human
cacugcaguuccccagugcgca

SEQ ID NO: 1035819 - RNA, 20 nt, Human
uccugagauuuaagggguuc

SEQ ID NO: 1035820 - RNA, 22 nt, Human
agucucagcuacuugggaggcu

SEQ ID NO: 1035821 - RNA, 22 nt, Human
gugcagcagggggaagacagug

SEQ ID NO: 1035822 - RNA, 22 nt, Human
uccuucagggggccgccugcac

SEQ ID NO: 1035823 - RNA, 22 nt, Human
uagagcaguuggcagcuguauu

SEQ ID NO: 1035824 - RNA, 22 nt, Human
ccaggccugcaucugcugcgca

SEQ ID NO: 1035825 - RNA, 22 nt, Human
cagaguguuagcgcugguuggg

SEQ ID NO: 1035826 - RNA, 23 nt, Human
ucccagccucuucucuugcauac

SEQ ID NO: 1035827 - RNA, 22 nt, Human
gaggggcuggcacgauggcugc

SEQ ID NO: 1035828 - RNA, 22 nt, Human
gagcagcucgagaaggaagcag

SEQ ID NO: 1035829 - RNA, 22 nt, Human
gaggccacgguuuuccuugggg

SEQ ID NO: 1035830 - RNA, 22 nt, Human
gcuggcucccauugguccuucc

SEQ ID NO: 1035831 - RNA, 22 nt, Human
ggucccaguugcccaggucagg

SEQ ID NO: 1035832 - RNA, 22 nt, Human
guggccugccgugugguauggg

SEQ ID NO: 1035833 - RNA, 22 nt, Human
cucugagagagcuggugagcac

SEQ ID NO: 1035834 - RNA, 22 nt, Human
caggcacucauucagagaggug

SEQ ID NO: 1035835 - RNA, 22 nt, Human
gcucugagccgggggccugucc

SEQ ID NO: 1035836 - RNA, 22 nt, Human
cauguacauucuguagauggag

SEQ ID NO: 1035837 - RNA, 19 nt, Human
agcagagcagggccguggg

SEQ ID NO: 1035838 - RNA, 22 nt, Human
gagauggggaauaggagcaagc

SEQ ID NO: 1035839 - RNA, 22 nt, Human
uacaggaggauuaucaaaggau

SEQ ID NO: 1035840 - RNA, 22 nt, Human
aagagagaacucccuucgccag

SEQ ID NO: 1035841 - RNA, 19 nt, Human
ggcuccuguggcugcagcc

SEQ ID NO: 1035842 - RNA, 22 nt, Human
acugggaggcaaagagcaagga

SEQ ID NO: 1035843 - RNA, 22 nt, Human
caaaguccauaguuuacaauag

SEQ ID NO: 1035844 - RNA, 22 nt, Human
ccaguggguaggccauggugag

SEQ ID NO: 1035845 - RNA, 22 nt, Human
ggcucugcaugugagugggugg

SEQ ID NO: 1035846 - RNA, 22 nt, Human
ucucuucuagcuucuugugguu

SEQ ID NO: 1035847 - RNA, 22 nt, Human
gccagccccuuagggcucuccc

SEQ ID NO: 1035848 - RNA, 22 nt, Human
guuauaaaugacugcaaaaguu

SEQ ID NO: 1035849 - RNA, 22 nt, Human
acugaaggaaacuuuuguguuu

SEQ ID NO: 1035850 - RNA, 22 nt, Human
gccaagagaaugugagagaaau

SEQ ID NO: 1035851 - RNA, 22 nt, Human
cccaggccagaacuugguugcu

SEQ ID NO: 1035852 - RNA, 22 nt, Human
gaggccagaaugagcugaaugc

SEQ ID NO: 1035853 - RNA, 22 nt, Human
ugugcccauuccacuugaguac

SEQ ID NO: 1035854 - RNA, 22 nt, Human
gccuucugauaucucuuggcau

SEQ ID NO: 1035855 - RNA, 22 nt, Human
cagccagggagggcaaaugaga

SEQ ID NO: 1035856 - RNA, 22 nt, Human
gcaggcaguuauuuaguagaau

SEQ ID NO: 1035857 - RNA, 22 nt, Human
uaucuuugcaaauaucucuaag

SEQ ID NO: 1035858 - RNA, 22 nt, Human
gucacuggggccacaugcagaa

SEQ ID NO: 1035859 - RNA, 22 nt, Human
uauuucugauugcucaugaggc

SEQ ID NO: 1035860 - RNA, 22 nt, Human
agggccagaaucccucagucua

SEQ ID NO: 1035861 - RNA, 22 nt, Human
gcugucuuccuugcuccaaggg

SEQ ID NO: 1035862 - RNA, 22 nt, Human
uggcagaggagaauuaagauua

SEQ ID NO: 1035863 - RNA, 22 nt, Human
ucagccacuacccaccuuaaca

SEQ ID NO: 1035864 - RNA, 22 nt, Human
cagccagagaaagggcacugcc

SEQ ID NO: 1035865 - RNA, 22 nt, Human
cucaggauuaaggaaucuaaau

SEQ ID NO: 1035866 - RNA, 22 nt, Human
auucuguauggaaaagcacuau

SEQ ID NO: 1035867 - RNA, 22 nt, Human
ggcuucagugagcugagcucac

SEQ ID NO: 1035868 - RNA, 22 nt, Human
agggagguaggagcuucuagcu

SEQ ID NO: 1035869 - RNA, 22 nt, Human
aggugaaguugaggaggcagaa

SEQ ID NO: 1035870 - RNA, 20 nt, Human
cagaccugcacccacuucga

SEQ ID NO: 1035871 - RNA, 22 nt, Human
cguuggagacacuugaggacuu

SEQ ID NO: 1035872 - RNA, 22 nt, Human
caugcacagugauaucugaaga

SEQ ID NO: 1035873 - RNA, 22 nt, Human
ggaugcuggggaccaaucucug

SEQ ID NO: 1035874 - RNA, 22 nt, Human
aagggccauaacuugcaguguu

SEQ ID NO: 1035875 - RNA, 22 nt, Human
uauuaucauugguaauaugguc

SEQ ID NO: 1035876 - RNA, 22 nt, Human
cccagccagccucuucccauau

SEQ ID NO: 1035877 - RNA, 22 nt, Human
agaaaugugagccccuuaucaa

SEQ ID NO: 1035878 - RNA, 22 nt, Human
ugggccuggacaaggccacuag

SEQ ID NO: 1035879 - RNA, 22 nt, Human
gaaaugcaggcuuggauucagc

SEQ ID NO: 1035880 - RNA, 22 nt, Human
caugucuguguacacaugcaca

SEQ ID NO: 1035881 - RNA, 19 nt, Human
cccagagcauccugaacuu

SEQ ID NO: 1035882 - RNA, 22 nt, Human
uggaggagaauuuauggucgaa

SEQ ID NO: 1035883 - RNA, 19 nt, Human
auaaggcagugacuuuuuu

SEQ ID NO: 1035884 - RNA, 22 nt, Human
uuuuccuaguaggccuauuaga

SEQ ID NO: 1035885 - RNA, 22 nt, Human
uggggcuggcuauugucucccu

SEQ ID NO: 1035886 - RNA, 22 nt, Human
cuggugccauucuguggccuag

SEQ ID NO: 1035887 - RNA, 22 nt, Human
ggaggccaaggugggcggauca

SEQ ID NO: 1035888 - RNA, 22 nt, Human
agagcagauggagcuggaagag

SEQ ID NO: 1035889 - RNA, 22 nt, Human
aacucaguucuuuccacaaugc

SEQ ID NO: 1035890 - RNA, 23 nt, Human
cccagagcacagccuccagaugc

SEQ ID NO: 1035891 - RNA, 22 nt, Human
aucuacagugcacaggacagcc

SEQ ID NO: 1035892 - RNA, 22 nt, Human
aggugcuggagucugggcagga

SEQ ID NO: 1035893 - RNA, 22 nt, Human
ugccaaggguaugggcaagaua

SEQ ID NO: 1035894 - RNA, 22 nt, Human
cauuuagagucuugcaauuuua

SEQ ID NO: 1035895 - RNA, 22 nt, Human
gccaggcucagcagucaaccug

SEQ ID NO: 1035896 - RNA, 22 nt, Human
gcugucugucucugucccacca

SEQ ID NO: 1035897 - RNA, 22 nt, Human
ggcugcagggcagcuggugugg

SEQ ID NO: 1035898 - RNA, 22 nt, Human
uccugcagccacugcaggcaga

SEQ ID NO: 1035899 - RNA, 22 nt, Human
ccucuccaguuuuaacgugacc

SEQ ID NO: 1035900 - RNA, 22 nt, Human
ggccuugggcuggcugcaguau

SEQ ID NO: 1035901 - RNA, 22 nt, Human
uagaaacucaggauacucuucc

SEQ ID NO: 1035902 - RNA, 22 nt, Human
aaguguuaaaagauuaaaugcu

SEQ ID NO: 1035903 - RNA, 22 nt, Human
gggcucugguacuuccuggcuc

SEQ ID NO: 1035904 - RNA, 22 nt, Human
cagcagcuuugccaagucagcc

SEQ ID NO: 1035905 - RNA, 22 nt, Human
ggcucaggccuguaauccuagc

SEQ ID NO: 1035906 - RNA, 22 nt, Human
ugccagccagguucugaggcua

SEQ ID NO: 1035907 - RNA, 22 nt, Human
auaacagaugugaagugcuaau

SEQ ID NO: 1035908 - RNA, 22 nt, Human
uaaauucuacaacuucaaagau

SEQ ID NO: 1035909 - RNA, 22 nt, Human
uaaauguguuagucaugguuuu

SEQ ID NO: 1035910 - RNA, 22 nt, Human
cccuggagcuagucugagcaga

SEQ ID NO: 1035911 - RNA, 22 nt, Human
gcugucacacauggccccagcu

SEQ ID NO: 1035912 - RNA, 22 nt, Human
gugcuuuccauccucccugcug

SEQ ID NO: 1035913 - RNA, 22 nt, Human
cauagcaacagcaucaagucaa

SEQ ID NO: 1035914 - RNA, 22 nt, Human
ucccagggcagcuguccagaag

SEQ ID NO: 1035915 - RNA, 19 nt, Human
gggcuccuugggccucucu

SEQ ID NO: 1035916 - RNA, 19 nt, Human
uuuggcacucugaaguguu

SEQ ID NO: 1035917 - RNA, 23 nt, Human
ucacacagcuggucagguacaga

SEQ ID NO: 1035918 - RNA, 22 nt, Human
gaacagcuucuugggagcuggg

SEQ ID NO: 1035919 - RNA, 22 nt, Human
gccuucaguaguauccucauga

SEQ ID NO: 1035920 - RNA, 22 nt, Human
cucucuggaagggggagcugau

SEQ ID NO: 1035921 - RNA, 22 nt, Human
cuacauuuugugauuaugaaau

SEQ ID NO: 1035922 - RNA, 21 nt, Human
ccagccucagaucagggagcu

SEQ ID NO: 1035923 - RNA, 22 nt, Human
agccacagugcaagagagaaaa

SEQ ID NO: 1035924 - RNA, 22 nt, Human
uaauaaaugaaagugcuggcau

SEQ ID NO: 1035925 - RNA, 22 nt, Human
ucugcagcuuuuugguggggug

SEQ ID NO: 1035926 - RNA, 22 nt, Human
agagguagagguugcagugagc

SEQ ID NO: 1035927 - RNA, 22 nt, Human
aagaaauuaaggaaugcaacga

SEQ ID NO: 1035928 - RNA, 20 nt, Human
agcccaggccugugugaguc

SEQ ID NO: 1035929 - RNA, 22 nt, Human
cccagccucagcuuuacuucca

SEQ ID NO: 1035930 - RNA, 23 nt, Human
aacaccaaggcucagagagauaa

SEQ ID NO: 1035931 - RNA, 22 nt, Human
ggucucagacuggcaggcagug

SEQ ID NO: 1035932 - RNA, 22 nt, Human
ucagaaauagucuuuaaaauga

SEQ ID NO: 1035933 - RNA, 22 nt, Human
uuacugaaaauucuucaggauu

SEQ ID NO: 1035934 - RNA, 22 nt, Human
ugggcugcugagaaugagagag

SEQ ID NO: 1035935 - RNA, 22 nt, Human
gggccacacagaaccuccuggu

SEQ ID NO: 1035936 - RNA, 22 nt, Human
uuugucagucaugucugcuuuu

SEQ ID NO: 1035937 - RNA, 22 nt, Human
uuccuguauuuugcgaauuuuc

SEQ ID NO: 1035938 - RNA, 22 nt, Human
aggcccugggcaguucuguagc

SEQ ID NO: 1035939 - RNA, 22 nt, Human
acaggcagggaccuuggcuaag

SEQ ID NO: 1035940 - RNA, 20 nt, Human
cccugcagccaugggagugg

SEQ ID NO: 1035941 - RNA, 22 nt, Human
agccagagagccccagguucua

SEQ ID NO: 1035942 - RNA, 22 nt, Human
gccaggcagcagcgaggauggu

SEQ ID NO: 1035943 - RNA, 22 nt, Human
uucucuggaacugaaacaagau

SEQ ID NO: 1035944 - RNA, 22 nt, Human
caguacuuguccucagguguua

SEQ ID NO: 1035945 - RNA, 22 nt, Human
uucauguaauuccauaagguaa

SEQ ID NO: 1035946 - RNA, 22 nt, Human
gagcuggugugugcccgagcac

SEQ ID NO: 1035947 - RNA, 22 nt, Human
ugcagggccgcuggaggucaug

SEQ ID NO: 1035948 - RNA, 22 nt, Human
cucuguccuugcacaguuccua

SEQ ID NO: 1035949 - RNA, 22 nt, Human
ugauacagucagcucacaauug

SEQ ID NO: 1035950 - RNA, 22 nt, Human
uccagggaugguaaugagcagu

SEQ ID NO: 1035951 - RNA, 23 nt, Human
gccugccugaccugugcaaaguc

SEQ ID NO: 1035952 - RNA, 20 nt, Human
cucucuggaaggugggagcc

SEQ ID NO: 1035953 - RNA, 22 nt, Human
gccaggcuggucuugaacuccu

SEQ ID NO: 1035954 - RNA, 22 nt, Human
uccugggcuguggccccgggca

SEQ ID NO: 1035955 - RNA, 22 nt, Human
uccugaggaaaguucaugaaug

SEQ ID NO: 1035956 - RNA, 22 nt, Human
cugccacuuacuaggcauggug

SEQ ID NO: 1035957 - RNA, 23 nt, Human
uggcucagggucucuuaugaagu

SEQ ID NO: 1035958 - RNA, 22 nt, Human
agcagcauagaagcugggagga

SEQ ID NO: 1035959 - RNA, 22 nt, Human
uccugccuucauacugcuguau

SEQ ID NO: 1035960 - RNA, 22 nt, Human
aaggagagguuguccguguugu

SEQ ID NO: 1035961 - RNA, 22 nt, Human
gcaagcugcuuaagcucauugu

SEQ ID NO: 1035962 - RNA, 22 nt, Human
gcaugcugcaccagagccucuc

SEQ ID NO: 1035963 - RNA, 22 nt, Human
gggcacugaaugccaagcuagg

SEQ ID NO: 1035964 - RNA, 22 nt, Human
aaguccaucucugccccacaca

SEQ ID NO: 1035965 - RNA, 20 nt, Human
agcuggagaagggcccuucc

SEQ ID NO: 1035966 - RNA, 22 nt, Human
gagcucauucauucauugccug

SEQ ID NO: 1035967 - RNA, 22 nt, Human
uagacacaucaaguauaguuaa

SEQ ID NO: 1035968 - RNA, 22 nt, Human
aggcccuggguuagggcccacu

SEQ ID NO: 1035969 - RNA, 22 nt, Human
ugggaauggaugcuaagugcua

SEQ ID NO: 1035970 - RNA, 22 nt, Human
uacagauacagaucuagauaca

SEQ ID NO: 1035971 - RNA, 22 nt, Human
cagcugggagcuccauuagaua

SEQ ID NO: 1035972 - RNA, 17 nt, Human
uuccucucacauuuuuu

SEQ ID NO: 1035973 - RNA, 22 nt, Human
cuggagcugcuguccuugggug

SEQ ID NO: 1035974 - RNA, 22 nt, Human
caggauccccaggucgccgucc

SEQ ID NO: 1035975 - RNA, 22 nt, Human
gggcugagggguaucucauggg

SEQ ID NO: 1035976 - RNA, 18 nt, Human
gcagagugcgucucugug

SEQ ID NO: 1035977 - RNA, 22 nt, Human
uagcagggaaggugugcugagc

SEQ ID NO: 1035978 - RNA, 22 nt, Human
ccugccugggcucacuugccag

SEQ ID NO: 1035979 - RNA, 22 nt, Human
uacuuccagcaaucugcauauu

SEQ ID NO: 1035980 - RNA, 23 nt, Human
augcaguauaugucaguaguuua

SEQ ID NO: 1035981 - RNA, 22 nt, Human
cagcccagcagucuuagccugc

SEQ ID NO: 1035982 - RNA, 22 nt, Human
uggagcagagaugggagcccaa

SEQ ID NO: 1035983 - RNA, 22 nt, Human
cagagagagugggguguggauu

SEQ ID NO: 1035984 - RNA, 22 nt, Human
cugagccauaagggaggcuggg

SEQ ID NO: 1035985 - RNA, 22 nt, Human
aggagcagaacuguuguggagg

SEQ ID NO: 1035986 - RNA, 22 nt, Human
ucuggagauaagacagacagau

SEQ ID NO: 1035987 - RNA, 18 nt, Human
cugaggcuggcaggagcc

SEQ ID NO: 1035988 - RNA, 22 nt, Human
gcucaggaaauaguuuaguguu

SEQ ID NO: 1035989 - RNA, 22 nt, Human
aagugacaccucuucccuuucc

SEQ ID NO: 1035990 - RNA, 22 nt, Human
ggaaggaggaugcucuggccuu

SEQ ID NO: 1035991 - RNA, 23 nt, Human
uucaagauacgguuuccaggcug

SEQ ID NO: 1035992 - RNA, 19 nt, Human
cccaaggcccugggcaggc

SEQ ID NO: 1035993 - RNA, 22 nt, Human
aggucauuggggacuaucuccg

SEQ ID NO: 1035994 - RNA, 22 nt, Human
ucagagugugacuuggucauga

SEQ ID NO: 1035995 - RNA, 22 nt, Human
aaaaguauuggccaccauuucu

SEQ ID NO: 1035996 - RNA, 22 nt, Human
ugagcuucuuuauuuggccaga

SEQ ID NO: 1035997 - RNA, 22 nt, Human
agaaugcaagauaaacuuuauu

SEQ ID NO: 1035998 - RNA, 22 nt, Human
uaauuuacuugcaaauaacaau

SEQ ID NO: 1035999 - RNA, 22 nt, Human
augugcauuaaaugucaauguu

SEQ ID NO: 1036000 - RNA, 22 nt, Human
ucuugccucuuccccuuuccau

SEQ ID NO: 1036001 - RNA, 22 nt, Human
cacagcuucuccuugauaucgc

SEQ ID NO: 1036002 - RNA, 17 nt, Human
cccugccaccaggaagc

SEQ ID NO: 1036003 - RNA, 20 nt, Human
uguucacaguaguugcugcu

SEQ ID NO: 1036004 - RNA, 22 nt, Human
uugggugcugucauggggcacg

SEQ ID NO: 1036005 - RNA, 22 nt, Human
agccacagagcaggagaccuuu

SEQ ID NO: 1036006 - RNA, 22 nt, Human
ggucauuguucuuuucugugau

SEQ ID NO: 1036007 - RNA, 18 nt, Human
cuuuaugugcagagcuuu

SEQ ID NO: 1036008 - RNA, 22 nt, Human
ggaguuggugagcaccaggcuu

SEQ ID NO: 1036009 - RNA, 22 nt, Human
agauacauugaguuuccuccug

SEQ ID NO: 1036010 - RNA, 22 nt, Human
gcuggcuguaucaccuggccag

SEQ ID NO: 1036011 - RNA, 22 nt, Human
ucugggagcacacgcagugauc

SEQ ID NO: 1036012 - RNA, 22 nt, Human
cugaaggagaaggccacuguuc

SEQ ID NO: 1036013 - RNA, 18 nt, Human
ugucucaggcugaaacag

SEQ ID NO: 1036014 - RNA, 22 nt, Human
agcaggcuaagggaccuguuua

SEQ ID NO: 1036015 - RNA, 22 nt, Human
gggcuggucuggcuuagucagg

SEQ ID NO: 1036016 - RNA, 22 nt, Human
aggucauuacaauuaucauuuu

SEQ ID NO: 1036017 - RNA, 22 nt, Human
acacacagguaaaggagccugg

SEQ ID NO: 1036018 - RNA, 22 nt, Human
uccauuuucaucucauguauaa

SEQ ID NO: 1036019 - RNA, 22 nt, Human
uggagcugggaguccugggcug

SEQ ID NO: 1036020 - RNA, 22 nt, Human
ucugaagaacugaguaaacaug

SEQ ID NO: 1036021 - RNA, 22 nt, Human
guggccagcaagugcugccucu

SEQ ID NO: 1036022 - RNA, 22 nt, Human
cagggcugagaauuuagagaca

SEQ ID NO: 1036023 - RNA, 22 nt, Human
cacagggccuugugugacugca

SEQ ID NO: 1036024 - RNA, 22 nt, Human
aggcucagcaucugauucauau

SEQ ID NO: 1036025 - RNA, 22 nt, Human
gcaguggcaugaugugggcuca

SEQ ID NO: 1036026 - RNA, 21 nt, Human
cuccugggcuaagauauagug

SEQ ID NO: 1036027 - RNA, 22 nt, Human
guacauuuuacuuuguuugaau

SEQ ID NO: 1036028 - RNA, 22 nt, Human
cagaggccaccuguggccacug

SEQ ID NO: 1036029 - RNA, 22 nt, Human
agggacacugaugagaaauucu

SEQ ID NO: 1036030 - RNA, 22 nt, Human
gagacagaguuucacucuuguu

SEQ ID NO: 1036031 - RNA, 22 nt, Human
aggcugagauagguggaucauu

SEQ ID NO: 1036032 - RNA, 22 nt, Human
aggguggcaguuacuggagcaa

SEQ ID NO: 1036033 - RNA, 22 nt, Human
caggcugcagugcaguggcuau

SEQ ID NO: 1036034 - RNA, 22 nt, Human
cuuaacagcaagaucuguguca

SEQ ID NO: 1036035 - RNA, 22 nt, Human
ccugucucccuggcauggcuca

SEQ ID NO: 1036036 - RNA, 22 nt, Human
ugcuggcugggcugcuggagac

SEQ ID NO: 1036037 - RNA, 22 nt, Human
ccacagggauaggaauggggcu

SEQ ID NO: 1036038 - RNA, 22 nt, Human
ucccuggcuguguucaggugcg

SEQ ID NO: 1036039 - RNA, 21 nt, Human
ugaaaguuggagucaaaugua

SEQ ID NO: 1036040 - RNA, 22 nt, Human
uggcucagccuggcccuuucau

SEQ ID NO: 1036041 - RNA, 22 nt, Human
ccugccagcauggcuuaucucc

SEQ ID NO: 1036042 - RNA, 22 nt, Human
ugcugugcuggcggcagaggcc

SEQ ID NO: 1036043 - RNA, 22 nt, Human
uagcugccuaugugauaagaga

SEQ ID NO: 1036044 - RNA, 22 nt, Human
auggaaagggaagcaaggaaca

SEQ ID NO: 1036045 - RNA, 22 nt, Human
gucccacaccuugaggggucuu

SEQ ID NO: 1036046 - RNA, 22 nt, Human
uggguagagcaggcuggggcuu

SEQ ID NO: 1036047 - RNA, 20 nt, Human
gcugucuggauuagaagccu

SEQ ID NO: 1036048 - RNA, 22 nt, Human
cagagggcucuuggcugccugc

SEQ ID NO: 1036049 - RNA, 22 nt, Human
acuggcagccacaacuggcagg

SEQ ID NO: 1036050 - RNA, 22 nt, Human
guggccuggauagacuccaucu

SEQ ID NO: 1036051 - RNA, 22 nt, Human
aacuuuaaggcuauaaauuaug

SEQ ID NO: 1036052 - RNA, 22 nt, Human
ugcauuguuugauaggugaauu

SEQ ID NO: 1036053 - RNA, 22 nt, Human
ggagagagaugccgccuugcuc

SEQ ID NO: 1036054 - RNA, 20 nt, Human
accuugaacccgccagccau

SEQ ID NO: 1036055 - RNA, 22 nt, Human
caggaguggugugagggacucc

SEQ ID NO: 1036056 - RNA, 22 nt, Human
ucuguggcacgauugcacugca

SEQ ID NO: 1036057 - RNA, 23 nt, Human
uggagcugacagucagagggagg

SEQ ID NO: 1036058 - RNA, 22 nt, Human
uguacacugcaggaugcauugc

SEQ ID NO: 1036059 - RNA, 22 nt, Human
aaguuguauauaccgcuuuaag

SEQ ID NO: 1036060 - RNA, 22 nt, Human
aagggaggccagagguuuugca

SEQ ID NO: 1036061 - RNA, 22 nt, Human
ccagucugaggccuggugaggg

SEQ ID NO: 1036062 - RNA, 22 nt, Human
uggccugccugggagcagcagg

SEQ ID NO: 1036063 - RNA, 22 nt, Human
gcaggagucacugacuuggucc

SEQ ID NO: 1036064 - RNA, 22 nt, Human
cagagaaacucagauagcugau

SEQ ID NO: 1036065 - RNA, 22 nt, Human
ugucuagggagcugcucaggcu

SEQ ID NO: 1036066 - RNA, 22 nt, Human
aagaacaguguccugggacucg

SEQ ID NO: 1036067 - RNA, 22 nt, Human
gcagccacuuugcaaccaagag

SEQ ID NO: 1036068 - RNA, 22 nt, Human
ucugccuuccccauaaucugau

SEQ ID NO: 1036069 - RNA, 22 nt, Human
caaaaugugagucccaccucaa

SEQ ID NO: 1036070 - RNA, 22 nt, Human
uagggcuauaagagaauaagac

SEQ ID NO: 1036071 - RNA, 22 nt, Human
cagagccaggccugcccucuuu

SEQ ID NO: 1036072 - RNA, 22 nt, Human
agcugccugggcuuguacaccu

SEQ ID NO: 1036073 - RNA, 22 nt, Human
cauaccuuucucaagcacaugu

SEQ ID NO: 1036074 - RNA, 22 nt, Human
acagcuguggccacuugcaucc

SEQ ID NO: 1036075 - RNA, 22 nt, Human
ucacugaagacugggcucuaaa

SEQ ID NO: 1036076 - RNA, 22 nt, Human
ugguccugccccgugcacagag

SEQ ID NO: 1036077 - RNA, 22 nt, Human
gggcagagagcuggaacuccuu

SEQ ID NO: 1036078 - RNA, 22 nt, Human
ccagagcugauuccugggacuu

SEQ ID NO: 1036079 - RNA, 22 nt, Human
guccucaguaagagggccucug

SEQ ID NO: 1036080 - RNA, 22 nt, Human
aauaacaggcucaucagaugcu

SEQ ID NO: 1036081 - RNA, 22 nt, Human
gccuugccucagccauggaaac

SEQ ID NO: 1036082 - RNA, 22 nt, Human
uggaaagaaaaacaggccauga

SEQ ID NO: 1036083 - RNA, 20 nt, Human
gugggcagaugugugcaugg

SEQ ID NO: 1036084 - RNA, 22 nt, Human
cauugcccaguaggaucaccag

SEQ ID NO: 1036085 - RNA, 22 nt, Human
uucacaggauauaugugcaggg

SEQ ID NO: 1036086 - RNA, 22 nt, Human
guucauauuacuuugagugcag

SEQ ID NO: 1036087 - RNA, 22 nt, Human
gcacagcaauuucuauaagcuc

SEQ ID NO: 1036088 - RNA, 22 nt, Human
uaacagaaguuguucauugugg

SEQ ID NO: 1036089 - RNA, 22 nt, Human
auucuccagcucacuguccaua

SEQ ID NO: 1036090 - RNA, 22 nt, Human
gggcuggcaucaguugccgaga

SEQ ID NO: 1036091 - RNA, 22 nt, Human
auuauaaagaacaugugugugg

SEQ ID NO: 1036092 - RNA, 22 nt, Human
cauaagaaauaaugaugaugac

SEQ ID NO: 1036093 - RNA, 22 nt, Human
ucuggagcuggcagggcccugg

SEQ ID NO: 1036094 - RNA, 19 nt, Human
ggcugggucuggcagguuc

SEQ ID NO: 1036095 - RNA, 22 nt, Human
augcaagauguauagaagacuu

SEQ ID NO: 1036096 - RNA, 22 nt, Human
agaaaugugaauuucauuuccu

SEQ ID NO: 1036097 - RNA, 22 nt, Human
aaguucaaguguaaucuuuauu

SEQ ID NO: 1036098 - RNA, 22 nt, Human
acauguuagaaaugcagaaucu

SEQ ID NO: 1036099 - RNA, 22 nt, Human
cauucugugauucuaaaucccu

SEQ ID NO: 1036100 - RNA, 22 nt, Human
agaccacagucaggcuccuggu

SEQ ID NO: 1036101 - RNA, 22 nt, Human
gggcuggcucugucuagaaagg

SEQ ID NO: 1036102 - RNA, 22 nt, Human
gcccuuccuuagacagcaggau

SEQ ID NO: 1036103 - RNA, 22 nt, Human
uagccucuggaauccuuucucu

SEQ ID NO: 1036104 - RNA, 22 nt, Human
uccuucagugucccgcucaggu

SEQ ID NO: 1036105 - RNA, 22 nt, Human
cacacauugaauucauucuugu

SEQ ID NO: 1036106 - RNA, 22 nt, Human
auuuaucaccaguuagcugacu

SEQ ID NO: 1036107 - RNA, 22 nt, Human
agaugcugugucuguucccuug

SEQ ID NO: 1036108 - RNA, 22 nt, Human
gugggccuugcagggugcaggg

SEQ ID NO: 1036109 - RNA, 22 nt, Human
aacaugaaaguugcuaagugca

SEQ ID NO: 1036110 - RNA, 19 nt, Human
agcaaauauaauaguguuc

SEQ ID NO: 1036111 - RNA, 22 nt, Human
ugagguguguccccagggaggu

SEQ ID NO: 1036112 - RNA, 22 nt, Human
guauuugauagauuucaaagga

SEQ ID NO: 1036113 - RNA, 22 nt, Human
cugagcuggucuauggacuugg

SEQ ID NO: 1036114 - RNA, 22 nt, Human
ccuggggagaagagcuuccccc

SEQ ID NO: 1036115 - RNA, 22 nt, Human
uuucacaaguaaaguccuaagu

SEQ ID NO: 1036116 - RNA, 22 nt, Human
aaugaacacagcccucuacuuu

SEQ ID NO: 1036117 - RNA, 22 nt, Human
ccucagcucuucccugugcaca

SEQ ID NO: 1036118 - RNA, 22 nt, Human
ccaggccuuucuucuuggucug

SEQ ID NO: 1036119 - RNA, 22 nt, Human
aaaguguugauaugugacaucc

SEQ ID NO: 1036120 - RNA, 22 nt, Human
ugcugcuccccagcacacagca

SEQ ID NO: 1036121 - RNA, 22 nt, Human
ugcagaagaaugagcuuggagu

SEQ ID NO: 1036122 - RNA, 22 nt, Human
caggcugucugaauggaggccc

SEQ ID NO: 1036123 - RNA, 22 nt, Human
accagagcuggcagaguaucaa

SEQ ID NO: 1036124 - RNA, 22 nt, Human
agagccuggucugagauaggac

SEQ ID NO: 1036125 - RNA, 22 nt, Human
cugaggccucuguucaccagaa

SEQ ID NO: 1036126 - RNA, 22 nt, Human
cgccugggaguccacaccugcu

SEQ ID NO: 1036127 - RNA, 22 nt, Human
auaaggcagugacuucaucuau

SEQ ID NO: 1036128 - RNA, 22 nt, Human
cuggcagcccaaccuagagucu

SEQ ID NO: 1036129 - RNA, 22 nt, Human
caguggcgugaucucugcucac

SEQ ID NO: 1036130 - RNA, 22 nt, Human
agccuucauaaucuugggcuuu

SEQ ID NO: 1036131 - RNA, 22 nt, Human
ucugggcucuuaguguacccuc

SEQ ID NO: 1036132 - RNA, 22 nt, Human
caguugcuacaguucaagugug

SEQ ID NO: 1036133 - RNA, 20 nt, Human
cagaaggucuaagcuuuaga

SEQ ID NO: 1036134 - RNA, 22 nt, Human
acugucucucuagcaguucagg

SEQ ID NO: 1036135 - RNA, 22 nt, Human
ggccucucuggcauggcugccc

SEQ ID NO: 1036136 - RNA, 19 nt, Human
ccucccacggauuccuucc

SEQ ID NO: 1036137 - RNA, 22 nt, Human
uaucuuuaacuugcaguauuua

SEQ ID NO: 1036138 - RNA, 22 nt, Human
ggagagcugguagcuggcucca

SEQ ID NO: 1036139 - RNA, 22 nt, Human
ugggcugcccugaugguccuca

SEQ ID NO: 1036140 - RNA, 19 nt, Human
cagcaauaaugccagaugg

SEQ ID NO: 1036141 - RNA, 22 nt, Human
gcacccagcccagggcgugaug

SEQ ID NO: 1036142 - RNA, 22 nt, Human
agggauggaagcucgucugcaa

SEQ ID NO: 1036143 - RNA, 22 nt, Human
ugggagaagcagcagccaagug

SEQ ID NO: 1036144 - RNA, 22 nt, Human
gacucagugauuugacaugccu

SEQ ID NO: 1036145 - RNA, 22 nt, Human
ugaagccaucaggaagccagca

SEQ ID NO: 1036146 - RNA, 22 nt, Human
auugacaagugagcugggcugc

SEQ ID NO: 1036147 - RNA, 23 nt, Human
gcagauggccccagagugcugcc

SEQ ID NO: 1036148 - RNA, 22 nt, Human
ggcaggguggcccuccagugag

SEQ ID NO: 1036149 - RNA, 22 nt, Human
cauuucugugacacuuccaucu

SEQ ID NO: 1036150 - RNA, 22 nt, Human
cucugggcaaguaugauagaaa

SEQ ID NO: 1036151 - RNA, 22 nt, Human
aagcagaauuucccacuaguug

SEQ ID NO: 1036152 - RNA, 19 nt, Human
cugaggcccauguaccaug

SEQ ID NO: 1036153 - RNA, 22 nt, Human
caagagcuuuagaaaugcucau

SEQ ID NO: 1036154 - RNA, 22 nt, Human
ccagcuccccucagcagguaau

SEQ ID NO: 1036155 - RNA, 19 nt, Human
uuucaauggcuuagagaaa

SEQ ID NO: 1036156 - RNA, 22 nt, Human
aaaugcacacaccaggaaacua

SEQ ID NO: 1036157 - RNA, 21 nt, Human
ccugccaggaaacugaguguc

SEQ ID NO: 1036158 - RNA, 22 nt, Human
agaggcagcagucauacuacag

SEQ ID NO: 1036159 - RNA, 22 nt, Human
cuggagggugagccucaucucu

SEQ ID NO: 1036160 - RNA, 22 nt, Human
ucagggcauccauugccuguug

SEQ ID NO: 1036161 - RNA, 22 nt, Human
ugaugggacugccagcugcuga

SEQ ID NO: 1036162 - RNA, 22 nt, Human
cggcagcuccgcgccguaggac

SEQ ID NO: 1036163 - RNA, 22 nt, Human
accucugccacuuucuaacucu

SEQ ID NO: 1036164 - RNA, 22 nt, Human
ccagggcuggguuugucggugu

SEQ ID NO: 1036165 - RNA, 22 nt, Human
cagggacugagauccagacugu

SEQ ID NO: 1036166 - RNA, 22 nt, Human
gcagagugggagcccagggcug

SEQ ID NO: 1036167 - RNA, 22 nt, Human
acagagauggcacagagaaggu

SEQ ID NO: 1036168 - RNA, 22 nt, Human
agcugcucucacuggacgccug

SEQ ID NO: 1036169 - RNA, 19 nt, Human
acauuuagaauguacuugc

SEQ ID NO: 1036170 - RNA, 22 nt, Human
ggcagccaugucccagggcuuc

SEQ ID NO: 1036171 - RNA, 22 nt, Human
guccucuguagggcugggccac

SEQ ID NO: 1036172 - RNA, 21 nt, Human
aguucauacugaguaacaaaa

SEQ ID NO: 1036173 - RNA, 22 nt, Human
guuccaggcaagugggauagga

SEQ ID NO: 1036174 - RNA, 22 nt, Human
ugagccagauaagggcucacgc

SEQ ID NO: 1036175 - RNA, 22 nt, Human
uacauguauugauuucucuucu

SEQ ID NO: 1036176 - RNA, 22 nt, Human
gccugagagucugcauuucuaa

SEQ ID NO: 1036177 - RNA, 22 nt, Human
uccugagauucugcauuucuaa

SEQ ID NO: 1036178 - RNA, 22 nt, Human
ugaaggaagaauaggcaguguu

SEQ ID NO: 1036179 - RNA, 23 nt, Human
aguuccagaaaaaugcucaagca

SEQ ID NO: 1036180 - RNA, 22 nt, Human
ggaggccaaggcgggcggauca

SEQ ID NO: 1036181 - RNA, 22 nt, Human
uaggaaaaauacagaauuauau

SEQ ID NO: 1036182 - RNA, 22 nt, Human
gcucaggauuucauccaugugu

SEQ ID NO: 1036183 - RNA, 22 nt, Human
aggcucagcugguggugaucgc

SEQ ID NO: 1036184 - RNA, 22 nt, Human
cacugcuucuggaggaauuugg

SEQ ID NO: 1036185 - RNA, 22 nt, Human
aggugcagcugguggagucugg

SEQ ID NO: 1036186 - RNA, 22 nt, Human
ccuggccucagacagagggugg

SEQ ID NO: 1036187 - RNA, 22 nt, Human
gcuggcuuugcacugggugcau

SEQ ID NO: 1036188 - RNA, 22 nt, Human
aaauugugcucacacugauauu

SEQ ID NO: 1036189 - RNA, 22 nt, Human
accccagcccugcuucugggag

SEQ ID NO: 1036190 - RNA, 22 nt, Human
cucccaggguagggagagacua

SEQ ID NO: 1036191 - RNA, 22 nt, Human
guaggcagucucucaggugauc

SEQ ID NO: 1036192 - RNA, 22 nt, Human
cuggagaggccccaagauauuu

SEQ ID NO: 1036193 - RNA, 22 nt, Human
cuggcaggagcauucacagagg

SEQ ID NO: 1036194 - RNA, 18 nt, Human
gagcccugagucugcaca

SEQ ID NO: 1036195 - RNA, 22 nt, Human
acagagccuccaggagugcugg

SEQ ID NO: 1036196 - RNA, 22 nt, Human
gggacagacccaugggccaggu

SEQ ID NO: 1036197 - RNA, 22 nt, Human
ggaggcccagagaggugaagug

SEQ ID NO: 1036198 - RNA, 22 nt, Human
cacugugucaguuugguuagac

SEQ ID NO: 1036199 - RNA, 22 nt, Human
aggucagaagugccagggaauu

SEQ ID NO: 1036200 - RNA, 22 nt, Human
gccuccuggauuuuagugccau

SEQ ID NO: 1036201 - RNA, 22 nt, Human
cagcauggugccagugagucca

SEQ ID NO: 1036202 - RNA, 21 nt, Human
gcaggaugcaucuuggugucu

SEQ ID NO: 1036203 - RNA, 22 nt, Human
ccaccagcuuugccacccugcu

SEQ ID NO: 1036204 - RNA, 22 nt, Human
cuggccgguauuugccucuggg

SEQ ID NO: 1036205 - RNA, 22 nt, Human
augaugguggguaauguguaaa

SEQ ID NO: 1036206 - RNA, 22 nt, Human
ucaggcaguagaauugcuugaa

SEQ ID NO: 1036207 - RNA, 22 nt, Human
acaggcugcugagccauuugcu

SEQ ID NO: 1036208 - RNA, 23 nt, Human
ucacaggggccagcgcucugugg

SEQ ID NO: 1036209 - RNA, 20 nt, Human
cuaucuccuggcgugccuuc

SEQ ID NO: 1036210 - RNA, 19 nt, Human
agacacacuugauaugugu

SEQ ID NO: 1036211 - RNA, 22 nt, Human
acucugccuuucagcagaugaa

SEQ ID NO: 1036212 - RNA, 22 nt, Human
uggggugccgacagggagggca

SEQ ID NO: 1036213 - RNA, 22 nt, Human
acagaagagcacauuuaguaug

SEQ ID NO: 1036214 - RNA, 22 nt, Human
cagggccacuguagaugaggag

SEQ ID NO: 1036215 - RNA, 22 nt, Human
ucugucacuauuggccagaaca

SEQ ID NO: 1036216 - RNA, 22 nt, Human
aucuggcucauucagggaacgg

SEQ ID NO: 1036217 - RNA, 17 nt, Human
guuugcaugguguuaac

SEQ ID NO: 1036218 - RNA, 22 nt, Human
cagagcugcucaugguggccag

SEQ ID NO: 1036219 - RNA, 22 nt, Human
cauuucuguucucuuccuguac

SEQ ID NO: 1036220 - RNA, 19 nt, Human
ggcucucuuaaagcuguuu

SEQ ID NO: 1036221 - RNA, 22 nt, Human
ggaggugggagacauaggcggc

SEQ ID NO: 1036222 - RNA, 22 nt, Human
cagaaugagauaacccagauug

SEQ ID NO: 1036223 - RNA, 22 nt, Human
ugauggcuaucccuggaagggc

SEQ ID NO: 1036224 - RNA, 22 nt, Human
accagagcuggcucugagcacc

SEQ ID NO: 1036225 - RNA, 22 nt, Human
ggucccaggaaucuguguucua

SEQ ID NO: 1036226 - RNA, 22 nt, Human
cucacagguaccagcacccucc

SEQ ID NO: 1036227 - RNA, 22 nt, Human
cugccagcucaaagcgcagcua

SEQ ID NO: 1036228 - RNA, 22 nt, Human
aagauucuacaguagguacauu

SEQ ID NO: 1036229 - RNA, 22 nt, Human
aggagccuccuucucaugugca

SEQ ID NO: 1036230 - RNA, 22 nt, Human
gcagagccaggcuggggcaggu

SEQ ID NO: 1036231 - RNA, 19 nt, Human
augauacaggugaaaauug

SEQ ID NO: 1036232 - RNA, 22 nt, Human
cggggcugcgcucuuccugccg

SEQ ID NO: 1036233 - RNA, 22 nt, Human
ccuggcagacugugagggcagg

SEQ ID NO: 1036234 - RNA, 22 nt, Human
gccuggcaggggccugggagug

SEQ ID NO: 1036235 - RNA, 22 nt, Human
agcaugaaagcauaggacaguc

SEQ ID NO: 1036236 - RNA, 22 nt, Human
cugucacacugauaucaggcuu

SEQ ID NO: 1036237 - RNA, 22 nt, Human
cuggccacuggagguggcaccc

SEQ ID NO: 1036238 - RNA, 22 nt, Human
gagagcugcauucucagacaca

SEQ ID NO: 1036239 - RNA, 20 nt, Human
ggcucugcuugugagcagcc

SEQ ID NO: 1036240 - RNA, 22 nt, Human
aggccugaaggaagaugagcug

SEQ ID NO: 1036241 - RNA, 22 nt, Human
cugcccuggucccauggcugau

SEQ ID NO: 1036242 - RNA, 22 nt, Human
ggcugcagauagccagccacca

SEQ ID NO: 1036243 - RNA, 22 nt, Human
cagagccauuauggagacuugc

SEQ ID NO: 1036244 - RNA, 22 nt, Human
gucccugggaugcccuucuggg

SEQ ID NO: 1036245 - RNA, 22 nt, Human
ucuggcucuauaacuccuagcu

SEQ ID NO: 1036246 - RNA, 23 nt, Human
agcuggaggcugucuacucccaa

SEQ ID NO: 1036247 - RNA, 22 nt, Human
uuuccucuuccgagggggaggc

SEQ ID NO: 1036248 - RNA, 20 nt, Human
cccucccagaugcuucccaa

SEQ ID NO: 1036249 - RNA, 22 nt, Human
gcugguuaggugagggugcgcc

SEQ ID NO: 1036250 - RNA, 19 nt, Human
cagaguacaccagauagga

SEQ ID NO: 1036251 - RNA, 19 nt, Human
acagggcagcaauaggaua

SEQ ID NO: 1036252 - RNA, 22 nt, Human
uauuuuguuaauaauccagucc

SEQ ID NO: 1036253 - RNA, 22 nt, Human
uggcugggggugcuauagcugc

SEQ ID NO: 1036254 - RNA, 22 nt, Human
gucagaggggcagcugccaggc

SEQ ID NO: 1036255 - RNA, 22 nt, Human
agugaguggguuacagauggga

SEQ ID NO: 1036256 - RNA, 22 nt, Human
agguccagcuguugcagccucc

SEQ ID NO: 1036257 - RNA, 22 nt, Human
cugggcacagcguugggcucuu

SEQ ID NO: 1036258 - RNA, 22 nt, Human
aaggagcuuguucgccuuccuc

SEQ ID NO: 1036259 - RNA, 22 nt, Human
gguggcuggaggagcugaugga

SEQ ID NO: 1036260 - RNA, 22 nt, Human
uuucuucugagaucagggagaa

SEQ ID NO: 1036261 - RNA, 22 nt, Human
caguguguggauccucccagga

SEQ ID NO: 1036262 - RNA, 19 nt, Human
uggcagcauugguaccuug

SEQ ID NO: 1036263 - RNA, 22 nt, Human
aagggcugaaugaaggguugaa

SEQ ID NO: 1036264 - RNA, 23 nt, Human
uugcauguagcccaugaguaacu

SEQ ID NO: 1036265 - RNA, 23 nt, Human
gggcugcuccaggccaaggcugg

SEQ ID NO: 1036266 - RNA, 22 nt, Human
cuggcagguccagcuggacuca

SEQ ID NO: 1036267 - RNA, 22 nt, Human
acugcaggagacacagcugcug

SEQ ID NO: 1036268 - RNA, 18 nt, Human
aguaguggguuuagcuuc

SEQ ID NO: 1036269 - RNA, 22 nt, Human
aggcugcagugcagguaggauu

SEQ ID NO: 1036270 - RNA, 22 nt, Human
ugcugccacauuuaaagagggg

SEQ ID NO: 1036271 - RNA, 22 nt, Human
aguguggguuuuauggagcccu

SEQ ID NO: 1036272 - RNA, 22 nt, Human
uggccuuguguuuuagagaaag

SEQ ID NO: 1036273 - RNA, 22 nt, Human
agccuucacugggaccuuggau

SEQ ID NO: 1036274 - RNA, 20 nt, Human
ccugucugcaauggagguca

SEQ ID NO: 1036275 - RNA, 22 nt, Human
gacaucauagggugggaggaaa

SEQ ID NO: 1036276 - RNA, 22 nt, Human
gcauacagagaggauguggcau

SEQ ID NO: 1036277 - RNA, 22 nt, Human
aaauguauugcauaggauauuu

SEQ ID NO: 1036278 - RNA, 22 nt, Human
gcagauggugccaugucuugug

SEQ ID NO: 1036279 - RNA, 22 nt, Human
gggacagaaggaagugagcaca

SEQ ID NO: 1036280 - RNA, 22 nt, Human
gggcaguggguggcugcagccu

SEQ ID NO: 1036281 - RNA, 22 nt, Human
cuggggugugcucagagcaggg

SEQ ID NO: 1036282 - RNA, 22 nt, Human
gcaggcucuucuuucugcccag

SEQ ID NO: 1036283 - RNA, 22 nt, Human
cuguggcuaugguguacauacu

SEQ ID NO: 1036284 - RNA, 22 nt, Human
ccagcugcuugggaaaaugucu

SEQ ID NO: 1036285 - RNA, 19 nt, Human
cugcucaggucagucuguc

SEQ ID NO: 1036286 - RNA, 22 nt, Human
uuauuuauggcacuguuggugg

SEQ ID NO: 1036287 - RNA, 22 nt, Human
uuucaguggguuuauuucaugu

SEQ ID NO: 1036288 - RNA, 21 nt, Human
ugcaugcuauguuuuuauuuc

SEQ ID NO: 1036289 - RNA, 16 nt, Human
gagccaggugccuuga

SEQ ID NO: 1036290 - RNA, 22 nt, Human
uccauuggucucugugcccagg

SEQ ID NO: 1036291 - RNA, 22 nt, Human
ccagggcagcgccccuccacgc

SEQ ID NO: 1036292 - RNA, 22 nt, Human
aaaugcuugcucuugauuauuu

SEQ ID NO: 1036293 - RNA, 20 nt, Human
aauaaaagaagccuucaccc

SEQ ID NO: 1036294 - RNA, 22 nt, Human
agguagagcuccaguagaaaau

SEQ ID NO: 1036295 - RNA, 22 nt, Human
cagcagcccacgcgugcugucc

SEQ ID NO: 1036296 - RNA, 18 nt, Human
uaaaugcauguuaauaac

SEQ ID NO: 1036297 - RNA, 22 nt, Human
cagcugcccaggccaccuggag

SEQ ID NO: 1036298 - RNA, 22 nt, Human
gcagcaggcuuuucauaccuug

SEQ ID NO: 1036299 - RNA, 22 nt, Human
cagcagguauguuuguucagca

SEQ ID NO: 1036300 - RNA, 22 nt, Human
cugaagaugucugagaugcuca

SEQ ID NO: 1036301 - RNA, 22 nt, Human
ugccucugugugcaggugagca

SEQ ID NO: 1036302 - RNA, 22 nt, Human
ggcccaaggcccaggucgagcu

SEQ ID NO: 1036303 - RNA, 22 nt, Human
cagcaguguacaaggugucaga

SEQ ID NO: 1036304 - RNA, 23 nt, Human
cagugcagggcaacucagacucc

SEQ ID NO: 1036305 - RNA, 22 nt, Human
aggggaggagcuuuucuugccu

SEQ ID NO: 1036306 - RNA, 22 nt, Human
ucaaggugcugugcugugcuag

SEQ ID NO: 1036307 - RNA, 22 nt, Human
ucugucucaaguucuugcacuc

SEQ ID NO: 1036308 - RNA, 22 nt, Human
ccugggaggcuguuuccagccu

SEQ ID NO: 1036309 - RNA, 21 nt, Human
aggcuguccuuugccagcccu

SEQ ID NO: 1036310 - RNA, 22 nt, Human
caggcagagugagguggucuaa

SEQ ID NO: 1036311 - RNA, 22 nt, Human
ggcugccuugacccuggcuccg

SEQ ID NO: 1036312 - RNA, 19 nt, Human
gccugggaugggcagaacu

SEQ ID NO: 1036313 - RNA, 22 nt, Human
agcaccaucagaugcaauaucu

SEQ ID NO: 1036314 - RNA, 22 nt, Human
ucacagacaauuguuuuggugu

SEQ ID NO: 1036315 - RNA, 22 nt, Human
cucacaggagaaagucaugguc

SEQ ID NO: 1036316 - RNA, 22 nt, Human
ugcaucuuacguuuugaaaggg

SEQ ID NO: 1036317 - RNA, 22 nt, Human
uguuaaucaaucaacaguauua

SEQ ID NO: 1036318 - RNA, 22 nt, Human
ugucaugccaggaaauaguccc

SEQ ID NO: 1036319 - RNA, 22 nt, Human
gcucugcugcuuacuagauggu

SEQ ID NO: 1036320 - RNA, 22 nt, Human
acugucuuccaggucuggaggu

SEQ ID NO: 1036321 - RNA, 22 nt, Human
agaaugcauuuuguguagcuau

SEQ ID NO: 1036322 - RNA, 22 nt, Human
uggcccugacuuggaggccuga

SEQ ID NO: 1036323 - RNA, 22 nt, Human
gccagagcugagacacgagucc

SEQ ID NO: 1036324 - RNA, 22 nt, Human
aggggccucgcaggaccgcucc

SEQ ID NO: 1036325 - RNA, 22 nt, Human
augcaguacagauaauucuaca

SEQ ID NO: 1036326 - RNA, 22 nt, Human
gccucugcacuguggcacacca

SEQ ID NO: 1036327 - RNA, 22 nt, Human
gccucugccaagggggcugcgg

SEQ ID NO: 1036328 - RNA, 22 nt, Human
uggagcuggaauuugagcugga

SEQ ID NO: 1036329 - RNA, 22 nt, Human
ccucaugguacuuacuguagcu

SEQ ID NO: 1036330 - RNA, 22 nt, Human
uugcagcagggugaauucacuc

SEQ ID NO: 1036331 - RNA, 22 nt, Human
cugggaugucuauagaacacuu

SEQ ID NO: 1036332 - RNA, 22 nt, Human
ggcugccugggagcccuccucu

SEQ ID NO: 1036333 - RNA, 22 nt, Human
gccccucccagucaggagcacu

SEQ ID NO: 1036334 - RNA, 22 nt, Human
aagagggcugcaaucuuauugc

SEQ ID NO: 1036335 - RNA, 22 nt, Human
cugaggcaugaaugugggcuuu

SEQ ID NO: 1036336 - RNA, 22 nt, Human
uuuuccucuguuauuaguguga

SEQ ID NO: 1036337 - RNA, 22 nt, Human
gcccagcacauugcugaggacc

SEQ ID NO: 1036338 - RNA, 22 nt, Human
cuguucucuggcgguggcuguu

SEQ ID NO: 1036339 - RNA, 22 nt, Human
ccuuuggguucaaucucggucu

SEQ ID NO: 1036340 - RNA, 22 nt, Human
gccugccugcugucaucugccu

SEQ ID NO: 1036341 - RNA, 22 nt, Human
ugucacauaauuuaucuguagg

SEQ ID NO: 1036342 - RNA, 22 nt, Human
cagaggccauauuucuucacuc

SEQ ID NO: 1036343 - RNA, 22 nt, Human
cccagguggguuggccucuguc

SEQ ID NO: 1036344 - RNA, 22 nt, Human
uggggcuggcacagucucuauu

SEQ ID NO: 1036345 - RNA, 22 nt, Human
uauuucuugaguggucaguuuc

SEQ ID NO: 1036346 - RNA, 22 nt, Human
aggugaguugguaggaaguuug

SEQ ID NO: 1036347 - RNA, 22 nt, Human
caagaaaugggauuugacugcc

SEQ ID NO: 1036348 - RNA, 22 nt, Human
ggucaugcugugaaucagugcu

SEQ ID NO: 1036349 - RNA, 22 nt, Human
uccugagaugagacagugcugc

SEQ ID NO: 1036350 - RNA, 22 nt, Human
gggagagagaaaacguggcgca

SEQ ID NO: 1036351 - RNA, 22 nt, Human
aagguacaccaaaguucaaguu

SEQ ID NO: 1036352 - RNA, 20 nt, Human
agucccuuuggucagguauu

SEQ ID NO: 1036353 - RNA, 22 nt, Human
gagagugaggcaucaggggcag

SEQ ID NO: 1036354 - RNA, 22 nt, Human
cuggacuuuggcccaucugcca

SEQ ID NO: 1036355 - RNA, 19 nt, Human
gcucagagggcccugugcu

SEQ ID NO: 1036356 - RNA, 22 nt, Human
auaauuaauuucaguaaucucc

SEQ ID NO: 1036357 - RNA, 22 nt, Human
ucagaggucccuagcaggagug

SEQ ID NO: 1036358 - RNA, 22 nt, Human
uaacacugguauuucauuuagu

SEQ ID NO: 1036359 - RNA, 22 nt, Human
acaugcuuucuagguccuucug

SEQ ID NO: 1036360 - RNA, 22 nt, Human
aaaaguaauugcaauuuuguag

SEQ ID NO: 1036361 - RNA, 22 nt, Human
ugggcagaaugugggauccaga

SEQ ID NO: 1036362 - RNA, 22 nt, Human
agccccaguccgcugcgggcgg

SEQ ID NO: 1036363 - RNA, 22 nt, Human
gcugcucuuuucagagaugaga

SEQ ID NO: 1036364 - RNA, 22 nt, Human
augaguaagaccauaauuuuug

SEQ ID NO: 1036365 - RNA, 22 nt, Human
cccagcuugcccaggacugagg

SEQ ID NO: 1036366 - RNA, 18 nt, Human
gaugggagcaagagaaga

SEQ ID NO: 1036367 - RNA, 22 nt, Human
gaugcacaugugaguauagaag

SEQ ID NO: 1036368 - RNA, 22 nt, Human
cuugcaggcagggccuccugga

SEQ ID NO: 1036369 - RNA, 22 nt, Human
uagauuucucauucauagauug

SEQ ID NO: 1036370 - RNA, 17 nt, Human
agugacuuggaaagagc

SEQ ID NO: 1036371 - RNA, 22 nt, Human
ugcagggcacacgcacgggugu

SEQ ID NO: 1036372 - RNA, 22 nt, Human
ggcagagcugcaugagcacuca

SEQ ID NO: 1036373 - RNA, 22 nt, Human
uggcucagcaagacauugaccu

SEQ ID NO: 1036374 - RNA, 19 nt, Human
cagagccucagagcuagaa

SEQ ID NO: 1036375 - RNA, 22 nt, Human
cauacuuugggauaagagugga

SEQ ID NO: 1036376 - RNA, 22 nt, Human
cugugcuugacagugggaagca

SEQ ID NO: 1036377 - RNA, 22 nt, Human
ggugggcaggucacucugccuc

SEQ ID NO: 1036378 - RNA, 22 nt, Human
cccugccuuguuggagccuaug

SEQ ID NO: 1036379 - RNA, 21 nt, Human
aacugcuggucuuuucugucu

SEQ ID NO: 1036380 - RNA, 22 nt, Human
uacaguauuaugagugauugaa

SEQ ID NO: 1036381 - RNA, 22 nt, Human
ggcagcaggcgacuucccuauu

SEQ ID NO: 1036382 - RNA, 22 nt, Human
gggccucucccuucucacgcau

SEQ ID NO: 1036383 - RNA, 22 nt, Human
ggcuuccuaauacucccuacac

SEQ ID NO: 1036384 - RNA, 22 nt, Human
gcagugguggagcuuacauauc

SEQ ID NO: 1036385 - RNA, 21 nt, Human
agcagccauuucacagagacu

SEQ ID NO: 1036386 - RNA, 22 nt, Human
aaugaugguauugaugagcuaa

SEQ ID NO: 1036387 - RNA, 22 nt, Human
ugucccagcacuuugggagucu

SEQ ID NO: 1036388 - RNA, 22 nt, Human
caggcagcauuuacucugauga

SEQ ID NO: 1036389 - RNA, 22 nt, Human
cuggagccccagacagggagag

SEQ ID NO: 1036390 - RNA, 22 nt, Human
cuagagggauguuaggauagca

SEQ ID NO: 1036391 - RNA, 22 nt, Human
cuggcccuucucuugcuuccug

SEQ ID NO: 1036392 - RNA, 22 nt, Human
gaggccuggcucugcccuccug

SEQ ID NO: 1036393 - RNA, 22 nt, Human
agccagccgggggaccacagug

SEQ ID NO: 1036394 - RNA, 22 nt, Human
gauuuauuggucuuucauuggu

SEQ ID NO: 1036395 - RNA, 22 nt, Human
gcaggcuggaggcuguucuggg

SEQ ID NO: 1036396 - RNA, 22 nt, Human
ugccugugucacagugauguuu

SEQ ID NO: 1036397 - RNA, 22 nt, Human
gccuuggccaacaccuugcaaa

SEQ ID NO: 1036398 - RNA, 22 nt, Human
uucacaggcuuggagguggggg

SEQ ID NO: 1036399 - RNA, 22 nt, Human
aucuuccuucacuuucucccac

SEQ ID NO: 1036400 - RNA, 22 nt, Human
cagcagcuggugagacacagcc

SEQ ID NO: 1036401 - RNA, 22 nt, Human
agcugcugcgccucacccuggc

SEQ ID NO: 1036402 - RNA, 22 nt, Human
aauaauguugacgauagucuua

SEQ ID NO: 1036403 - RNA, 22 nt, Human
guuuagaauucuaacuuuaagg

SEQ ID NO: 1036404 - RNA, 22 nt, Human
gccaggcagcaggaagccagug

SEQ ID NO: 1036405 - RNA, 22 nt, Human
cagagcagcagagcuuccaugg

SEQ ID NO: 1036406 - RNA, 22 nt, Human
ccuggcagcauugguagagauu

SEQ ID NO: 1036407 - RNA, 22 nt, Human
ccuggcaguggugaagaagagg

SEQ ID NO: 1036408 - RNA, 22 nt, Human
acuucuggugucauacugcauu

SEQ ID NO: 1036409 - RNA, 22 nt, Human
cagagugaaauaggggaucaag

SEQ ID NO: 1036410 - RNA, 22 nt, Human
ucagaagacuacuaggacacau

SEQ ID NO: 1036411 - RNA, 22 nt, Human
agaauaaaucaaauguccugag

SEQ ID NO: 1036412 - RNA, 22 nt, Human
gcucugcuguguuuguucagca

SEQ ID NO: 1036413 - RNA, 22 nt, Human
gagcaggcuugcagagaagggg

SEQ ID NO: 1036414 - RNA, 22 nt, Human
ccugccagcccgcguucaugcc

SEQ ID NO: 1036415 - RNA, 22 nt, Human
uuuuccucugagcuuugaauaa

SEQ ID NO: 1036416 - RNA, 22 nt, Human
auucuaggcuugaaacaugaag

SEQ ID NO: 1036417 - RNA, 22 nt, Human
uaacagaaauauuuccagguga

SEQ ID NO: 1036418 - RNA, 20 nt, Human
aaagucuuaugguuaauuuu

SEQ ID NO: 1036419 - RNA, 23 nt, Human
aagcugccagucugaagccuggg

SEQ ID NO: 1036420 - RNA, 23 nt, Human
acuuaaaugguucuuuaucucag

SEQ ID NO: 1036421 - RNA, 22 nt, Human
cuguccuaugaguacucacuag

SEQ ID NO: 1036422 - RNA, 22 nt, Human
uucuccgcuaaguucucugcag

SEQ ID NO: 1036423 - RNA, 22 nt, Human
cagcugccugucuggaggcaau

SEQ ID NO: 1036424 - RNA, 19 nt, Human
gcccugcaggagguggggc

SEQ ID NO: 1036425 - RNA, 22 nt, Human
gugccugggguugagcuaugaa

SEQ ID NO: 1036426 - RNA, 22 nt, Human
gcaugugucuccccaguggagg

SEQ ID NO: 1036427 - RNA, 22 nt, Human
guggagacuucuacuagagacc

SEQ ID NO: 1036428 - RNA, 22 nt, Human
caaauguguaaggaaguguuag

SEQ ID NO: 1036429 - RNA, 19 nt, Human
ccucugccagcccgccucu

SEQ ID NO: 1036430 - RNA, 21 nt, Human
ccaccaggucuucugcucggg

SEQ ID NO: 1036431 - RNA, 22 nt, Human
ccagggcacguugggacaguac

SEQ ID NO: 1036432 - RNA, 22 nt, Human
caaagugcugagauuacaggua

SEQ ID NO: 1036433 - RNA, 18 nt, Human
guucaaggucaagagaga

SEQ ID NO: 1036434 - RNA, 22 nt, Human
agcagugaugcaugacagccua

SEQ ID NO: 1036435 - RNA, 22 nt, Human
gggucucucucggcuccacgcg

SEQ ID NO: 1036436 - RNA, 22 nt, Human
cauugcacuccaucuugggcaa

SEQ ID NO: 1036437 - RNA, 22 nt, Human
aauaugugagguauguucagug

SEQ ID NO: 1036438 - RNA, 22 nt, Human
gaggaggcuggcgccgccugcc

SEQ ID NO: 1036439 - RNA, 21 nt, Human
cagagguggccugaccucuga

SEQ ID NO: 1036440 - RNA, 22 nt, Human
ccaaaguccauaguuuacauua

SEQ ID NO: 1036441 - RNA, 22 nt, Human
aaggcugagagucacaguccua

SEQ ID NO: 1036442 - RNA, 23 nt, Human
ugggggugcacgggccacaucuu

SEQ ID NO: 1036443 - RNA, 22 nt, Human
gggcuucucuuuagugagcuga

SEQ ID NO: 1036444 - RNA, 22 nt, Human
uccaggaggguuuucugccuuc

SEQ ID NO: 1036445 - RNA, 22 nt, Human
aaaguuugaaugauauauuagu

SEQ ID NO: 1036446 - RNA, 22 nt, Human
guggccuuuccugaagaaauga

SEQ ID NO: 1036447 - RNA, 22 nt, Human
ugcaggcuuuagccccauggcu

SEQ ID NO: 1036448 - RNA, 22 nt, Human
caggccugauacacugaacucu

SEQ ID NO: 1036449 - RNA, 22 nt, Human
ggagcuguaacgagccauugcu

SEQ ID NO: 1036450 - RNA, 22 nt, Human
agcccagccggauucccaguuc

SEQ ID NO: 1036451 - RNA, 22 nt, Human
cugcugggaaggucugcucagu

SEQ ID NO: 1036452 - RNA, 22 nt, Human
uguccucuuccagugcuccuuc

SEQ ID NO: 1036453 - RNA, 22 nt, Human
gugagcaggauuucauggugua

SEQ ID NO: 1036454 - RNA, 22 nt, Human
uuacaguauuguuaaacucuuu

SEQ ID NO: 1036455 - RNA, 22 nt, Human
uucaaugaggauagaacuggau

SEQ ID NO: 1036456 - RNA, 22 nt, Human
ggcucaggaccugggauugcca

SEQ ID NO: 1036457 - RNA, 22 nt, Human
aaaggcuaugagauagaagaua

SEQ ID NO: 1036458 - RNA, 17 nt, Human
agguggguggaucaccu

SEQ ID NO: 1036459 - RNA, 22 nt, Human
gugcugcucacaucuggaggua

SEQ ID NO: 1036460 - RNA, 18 nt, Human
caugucugcgccacaagg

SEQ ID NO: 1036461 - RNA, 22 nt, Human
gcagaggcaaucagguaugugg

SEQ ID NO: 1036462 - RNA, 22 nt, Human
cucuuuccucagccacagucua

SEQ ID NO: 1036463 - RNA, 22 nt, Human
aagggcaggugggcauuucugg

SEQ ID NO: 1036464 - RNA, 22 nt, Human
ggaggccaccugaccugcuguu

SEQ ID NO: 1036465 - RNA, 21 nt, Human
ggugggcacaggagagcagag

SEQ ID NO: 1036466 - RNA, 21 nt, Human
gccacugcacuccagccuggg

SEQ ID NO: 1036467 - RNA, 22 nt, Human
uuuaccaagcuuuaauuacaua

SEQ ID NO: 1036468 - RNA, 22 nt, Human
cucaggaugcaauuccaucaag

SEQ ID NO: 1036469 - RNA, 22 nt, Human
aaggacagaaacagauugcugg

SEQ ID NO: 1036470 - RNA, 23 nt, Human
gccucugcucugcguuggggacu

SEQ ID NO: 1036471 - RNA, 22 nt, Human
ggugauuuucgaguuucauguu

SEQ ID NO: 1036472 - RNA, 22 nt, Human
cacagggcuucucauggggugc

SEQ ID NO: 1036473 - RNA, 22 nt, Human
gggauggggagcuggaaagggg

SEQ ID NO: 1036474 - RNA, 22 nt, Human
guuuuauaggugaaauauuacu

SEQ ID NO: 1036475 - RNA, 22 nt, Human
gagccauacaaccuauaaagug

SEQ ID NO: 1036476 - RNA, 22 nt, Human
uaugcacauucacacaaaaaug

SEQ ID NO: 1036477 - RNA, 22 nt, Human
aucaguuuggaacauucaggcc

SEQ ID NO: 1036478 - RNA, 22 nt, Human
auguguacaaccaagcacuaaa

SEQ ID NO: 1036479 - RNA, 22 nt, Human
ugcagaagcagagccgguggcc

SEQ ID NO: 1036480 - RNA, 22 nt, Human
uuuccucugacugcuccccugc

SEQ ID NO: 1036481 - RNA, 22 nt, Human
uagaaacauauaggauggcagg

SEQ ID NO: 1036482 - RNA, 22 nt, Human
gccagcagguggagagaucaag

SEQ ID NO: 1036483 - RNA, 22 nt, Human
gguagcacauugcauuaggaga

SEQ ID NO: 1036484 - RNA, 22 nt, Human
aagcccagaugggagcauuuca

SEQ ID NO: 1036485 - RNA, 22 nt, Human
cccagcucaucaggagccgccc

SEQ ID NO: 1036486 - RNA, 22 nt, Human
guuggccugaauggucaagagg

SEQ ID NO: 1036487 - RNA, 22 nt, Human
gcauuucuuccuggugugagcc

SEQ ID NO: 1036488 - RNA, 22 nt, Human
gcagacagccagacugcacugg

SEQ ID NO: 1036489 - RNA, 22 nt, Human
cccagcaguuguuggugcacau

SEQ ID NO: 1036490 - RNA, 22 nt, Human
aggucaaggccaaaagaguggu

SEQ ID NO: 1036491 - RNA, 19 nt, Human
agggaaggauucugucauu

SEQ ID NO: 1036492 - RNA, 20 nt, Human
cugagcgucuaagaggugag

SEQ ID NO: 1036493 - RNA, 20 nt, Human
gcacugaagguuccagggga

SEQ ID NO: 1036494 - RNA, 21 nt, Human
agcugccacccuagcuucuga

SEQ ID NO: 1036495 - RNA, 23 nt, Human
cauuucugggagauuuauaaaau

SEQ ID NO: 1036496 - RNA, 22 nt, Human
gaggggcagaaugugaucaggg

SEQ ID NO: 1036497 - RNA, 22 nt, Human
auuaaaagcuucccaagaguua

SEQ ID NO: 1036498 - RNA, 22 nt, Human
gccugagcuacuagggagucug

SEQ ID NO: 1036499 - RNA, 23 nt, Human
aggagccaggugcagcccuugug

SEQ ID NO: 1036500 - RNA, 22 nt, Human
uguagcauguaaauugguuauu

SEQ ID NO: 1036501 - RNA, 22 nt, Human
caggaucccuggccuccgccca

SEQ ID NO: 1036502 - RNA, 22 nt, Human
ugugacaucgcugugucuguuu

SEQ ID NO: 1036503 - RNA, 22 nt, Human
acugcuuuucuaagauucugug

SEQ ID NO: 1036504 - RNA, 22 nt, Human
ggugcagaaggaagggagcugg

SEQ ID NO: 1036505 - RNA, 22 nt, Human
auauacuuggagacuaucauug

SEQ ID NO: 1036506 - RNA, 22 nt, Human
ucucaccaaagccuugaccaua

SEQ ID NO: 1036507 - RNA, 22 nt, Human
gcugcagcuuuaggauccagug

SEQ ID NO: 1036508 - RNA, 22 nt, Human
caaaugcuaacuucuuuccaaa

SEQ ID NO: 1036509 - RNA, 21 nt, Human
ccuucucuugcuucagcuuca

SEQ ID NO: 1036510 - RNA, 22 nt, Human
cagaccugagguugaguaccag

SEQ ID NO: 1036511 - RNA, 22 nt, Human
ccugggucuugguucaugcucu

SEQ ID NO: 1036512 - RNA, 19 nt, Human
cuggcagccugucuguguc

SEQ ID NO: 1036513 - RNA, 19 nt, Human
ucaggacugacuugaaguc

SEQ ID NO: 1036514 - RNA, 22 nt, Human
cagggcaggaugcugugauuau

SEQ ID NO: 1036515 - RNA, 22 nt, Human
agggacacaugugauuauuuau

SEQ ID NO: 1036516 - RNA, 22 nt, Human
gagauuggccuggcuugccaac

SEQ ID NO: 1036517 - RNA, 23 nt, Human
agaauuguaaauagaauauaccu

SEQ ID NO: 1036518 - RNA, 21 nt, Human
agggagcuauuuauaguaagc

SEQ ID NO: 1036519 - RNA, 22 nt, Human
guuagaaacacauucuuauuga

SEQ ID NO: 1036520 - RNA, 22 nt, Human
agagcuguucaacguagcaaug

SEQ ID NO: 1036521 - RNA, 22 nt, Human
ucagcugaaguggagaagcaga

SEQ ID NO: 1036522 - RNA, 22 nt, Human
agggcagaaaucgauuacaccu

SEQ ID NO: 1036523 - RNA, 20 nt, Human
agugucuggugcagggccuc

SEQ ID NO: 1036524 - RNA, 22 nt, Human
gagugagggcagcaggggcugc

SEQ ID NO: 1036525 - RNA, 22 nt, Human
cuggcagccaagugggauacuc

SEQ ID NO: 1036526 - RNA, 22 nt, Human
auacauguucguguacauguuc

SEQ ID NO: 1036527 - RNA, 23 nt, Human
aggaggaaaaguuaucugcugag

SEQ ID NO: 1036528 - RNA, 22 nt, Human
aaagaacaaaugauauaugguu

SEQ ID NO: 1036529 - RNA, 22 nt, Human
agccauugaauuuagugccuuu

SEQ ID NO: 1036530 - RNA, 22 nt, Human
cacagcagagggagccauugaa

SEQ ID NO: 1036531 - RNA, 22 nt, Human
agaacagaugugggcagaccug

SEQ ID NO: 1036532 - RNA, 22 nt, Human
acagagcaauucuuggguguuu

SEQ ID NO: 1036533 - RNA, 22 nt, Human
cuguggcugcagccuugguccu

SEQ ID NO: 1036534 - RNA, 21 nt, Human
ccaggcuccugaggcugguca

SEQ ID NO: 1036535 - RNA, 22 nt, Human
aggcugggaagguaaaguugua

SEQ ID NO: 1036536 - RNA, 23 nt, Human
ccagcccuccaccagcucuaggc

SEQ ID NO: 1036537 - RNA, 22 nt, Human
ggaggccaaggaggagcuugcc

SEQ ID NO: 1036538 - RNA, 22 nt, Human
aagucauuaucucuucuaaucu

SEQ ID NO: 1036539 - RNA, 22 nt, Human
uacauuugcuuugauuuucagc

SEQ ID NO: 1036540 - RNA, 22 nt, Human
acagagcacugcccugugccgc

SEQ ID NO: 1036541 - RNA, 22 nt, Human
aagggcuggccacauucugggu

SEQ ID NO: 1036542 - RNA, 22 nt, Human
cucuccuugcagauggcugccu

SEQ ID NO: 1036543 - RNA, 22 nt, Human
auaucuuuguaugguucagcag

SEQ ID NO: 1036544 - RNA, 22 nt, Human
aggaggcugguucaggccauau

SEQ ID NO: 1036545 - RNA, 22 nt, Human
uccacuuuagcaaugauugaau

SEQ ID NO: 1036546 - RNA, 22 nt, Human
agcauggggcaaugcaugugcu

SEQ ID NO: 1036547 - RNA, 22 nt, Human
uauuucuguaugcauaaaagga

SEQ ID NO: 1036548 - RNA, 18 nt, Human
ccugagcccugcuuacuu

SEQ ID NO: 1036549 - RNA, 21 nt, Human
ggcagcugaccgcgcggugca

SEQ ID NO: 1036550 - RNA, 19 nt, Human
cugccuguuauggagagaa

SEQ ID NO: 1036551 - RNA, 20 nt, Human
uggcccuguuuucuccaggc

SEQ ID NO: 1036552 - RNA, 22 nt, Human
auaugaagucagacaaacuggg

SEQ ID NO: 1036553 - RNA, 22 nt, Human
aagaacugugcuccaggcucca

SEQ ID NO: 1036554 - RNA, 22 nt, Human
uucuuucagaacacaagugauu

SEQ ID NO: 1036555 - RNA, 20 nt, Human
uccaggagaacugggagccg

SEQ ID NO: 1036556 - RNA, 22 nt, Human
ugaagcagcuucuuucugucaa

SEQ ID NO: 1036557 - RNA, 22 nt, Human
uguuccuaaauaugaauggaga

SEQ ID NO: 1036558 - RNA, 22 nt, Human
ccucagagccuccagaaggaau

SEQ ID NO: 1036559 - RNA, 22 nt, Human
cagagcucagagcagggcacuc

SEQ ID NO: 1036560 - RNA, 22 nt, Human
aggagagaauguuccaggcuug

SEQ ID NO: 1036561 - RNA, 18 nt, Human
uggagccagcucuaggau

SEQ ID NO: 1036562 - RNA, 22 nt, Human
gcugcccauuccacuggauggu

SEQ ID NO: 1036563 - RNA, 22 nt, Human
ucccagaggcaguugguaacuu

SEQ ID NO: 1036564 - RNA, 22 nt, Human
gcagcagcccagggcucucaga

SEQ ID NO: 1036565 - RNA, 20 nt, Human
uugcagcagugaggugaagg

SEQ ID NO: 1036566 - RNA, 22 nt, Human
gacauuucaaucucauuauggg

SEQ ID NO: 1036567 - RNA, 19 nt, Human
gggaaauucacuugcuucc

SEQ ID NO: 1036568 - RNA, 22 nt, Human
ucaucaaagucaaagaaugacu

SEQ ID NO: 1036569 - RNA, 22 nt, Human
acuggcaguuugagaaugcauu

SEQ ID NO: 1036570 - RNA, 22 nt, Human
uaagugcaauguuuuacuuaaa

SEQ ID NO: 1036571 - RNA, 22 nt, Human
aggccugaggaccagauaaaug

SEQ ID NO: 1036572 - RNA, 22 nt, Human
gggugaggagcugccagucaug

SEQ ID NO: 1036573 - RNA, 22 nt, Human
gcugagguggagauugcaguga

SEQ ID NO: 1036574 - RNA, 22 nt, Human
auaauguagguauguguauuua

SEQ ID NO: 1036575 - RNA, 22 nt, Human
agucccagcucagaaccacuag

SEQ ID NO: 1036576 - RNA, 23 nt, Human
ugcucccaggugacgcugcuguu

SEQ ID NO: 1036577 - RNA, 22 nt, Human
cacagaauuaagggagaaauau

SEQ ID NO: 1036578 - RNA, 22 nt, Human
aggacuucaucaccuguauaaa

SEQ ID NO: 1036579 - RNA, 22 nt, Human
gucuuguuugggauguggaugg

SEQ ID NO: 1036580 - RNA, 22 nt, Human
cuggccaggcuugggacagaca

SEQ ID NO: 1036581 - RNA, 15 nt, Human
cagucccagggaccc

SEQ ID NO: 1036582 - RNA, 20 nt, Human
caggcacacucauuccugcu

SEQ ID NO: 1036583 - RNA, 23 nt, Human
ucugucaccuauggcugcucuuc

SEQ ID NO: 1036584 - RNA, 22 nt, Human
auagucuuagaucagauaaagu

SEQ ID NO: 1036585 - RNA, 22 nt, Human
uguggcucucagauccuccaau

SEQ ID NO: 1036586 - RNA, 22 nt, Human
cuuuggcaugguccucacuaua

SEQ ID NO: 1036587 - RNA, 22 nt, Human
agugaaauagcauuuaugaagc

SEQ ID NO: 1036588 - RNA, 22 nt, Human
cuucuaggcuucucagggggca

SEQ ID NO: 1036589 - RNA, 22 nt, Human
cagguggguguaugaaugcaaa

SEQ ID NO: 1036590 - RNA, 22 nt, Human
gcaaggcagcgcggaguagcua

SEQ ID NO: 1036591 - RNA, 22 nt, Human
acaggcugccuaccaaguauca

SEQ ID NO: 1036592 - RNA, 22 nt, Human
agaauucucuuccauugaaaca

SEQ ID NO: 1036593 - RNA, 22 nt, Human
cucugagcuccuggaagcgugc

SEQ ID NO: 1036594 - RNA, 22 nt, Human
caguagccacuagacacaugua

SEQ ID NO: 1036595 - RNA, 22 nt, Human
agugcagccgagaucaggugcu

SEQ ID NO: 1036596 - RNA, 22 nt, Human
aguguuucccaguaggaugaaa

SEQ ID NO: 1036597 - RNA, 22 nt, Human
ccuccaggcugaauaucuagaa

SEQ ID NO: 1036598 - RNA, 22 nt, Human
aggcugggcuccgcccaacucc

SEQ ID NO: 1036599 - RNA, 22 nt, Human
aguuacaaccaugacacaagca

SEQ ID NO: 1036600 - RNA, 22 nt, Human
ggccagaggccauccuccugcu

SEQ ID NO: 1036601 - RNA, 22 nt, Human
acagcagcauaaacugacuaag

SEQ ID NO: 1036602 - RNA, 22 nt, Human
acagaaauaacuuuuuauguuu

SEQ ID NO: 1036603 - RNA, 23 nt, Human
auaauaacgucugucuugucucu

SEQ ID NO: 1036604 - RNA, 22 nt, Human
gucucagauucagacaucuaca

SEQ ID NO: 1036605 - RNA, 22 nt, Human
agcuuuaugggagcuuagauaa

SEQ ID NO: 1036606 - RNA, 19 nt, Human
uccccagcaccucugaguc

SEQ ID NO: 1036607 - RNA, 22 nt, Human
uggguggcacuucuggggucca

SEQ ID NO: 1036608 - RNA, 22 nt, Human
cagcaggguauacagggaauuu

SEQ ID NO: 1036609 - RNA, 22 nt, Human
ugagagagccugaaucucuuac

SEQ ID NO: 1036610 - RNA, 22 nt, Human
ccugcuggccaguggagggcug

SEQ ID NO: 1036611 - RNA, 22 nt, Human
cugccucucagccugaccgcca

SEQ ID NO: 1036612 - RNA, 22 nt, Human
ugcugcacgauaaauaauuucu

SEQ ID NO: 1036613 - RNA, 19 nt, Human
ccugcagggaugagagguu

SEQ ID NO: 1036614 - RNA, 19 nt, Human
ucuggagcugaugcaggug

SEQ ID NO: 1036615 - RNA, 20 nt, Human
gucagaggacccuagagcga

SEQ ID NO: 1036616 - RNA, 22 nt, Human
gaguggggucugggcaucaguc

SEQ ID NO: 1036617 - RNA, 20 nt, Human
ccugccugccucggcucauu

SEQ ID NO: 1036618 - RNA, 19 nt, Human
agaggcugucaccuguagc

SEQ ID NO: 1036619 - RNA, 22 nt, Human
aagggaaaucauauggugcagu

SEQ ID NO: 1036620 - RNA, 22 nt, Human
caggacaguuugcuuugcccug

SEQ ID NO: 1036621 - RNA, 23 nt, Human
gugauuucagggaacagaaucag

SEQ ID NO: 1036622 - RNA, 22 nt, Human
caggaggcuccuagggcucugu

SEQ ID NO: 1036623 - RNA, 22 nt, Human
gacacagagauaggccuguguu

SEQ ID NO: 1036624 - RNA, 22 nt, Human
caguagcacuagauaugugugg

SEQ ID NO: 1036625 - RNA, 22 nt, Human
ggugaaggucuacugugugcca

SEQ ID NO: 1036626 - RNA, 22 nt, Human
gggguggauuccuacaggucca

SEQ ID NO: 1036627 - RNA, 22 nt, Human
ggcuggucacaccacugcaggg

SEQ ID NO: 1036628 - RNA, 22 nt, Human
ucaguuuuucuauacuuuguag

SEQ ID NO: 1036629 - RNA, 22 nt, Human
gauuucuucauucauuagaugg

SEQ ID NO: 1036630 - RNA, 22 nt, Human
cagaggccuuucuacagugaua

SEQ ID NO: 1036631 - RNA, 22 nt, Human
uggcugccuagucccucagccu

SEQ ID NO: 1036632 - RNA, 22 nt, Human
ucaguuuugaaaacauugaaug

SEQ ID NO: 1036633 - RNA, 23 nt, Human
uccagcagccaagaaggguagaa

SEQ ID NO: 1036634 - RNA, 22 nt, Human
cugggcucagcccaugcugucc

SEQ ID NO: 1036635 - RNA, 22 nt, Human
ccagagacgucggucagggcgc

SEQ ID NO: 1036636 - RNA, 22 nt, Human
aucuggcugacuuugugggaca

SEQ ID NO: 1036637 - RNA, 21 nt, Human
agcuggcagauauggugucug

SEQ ID NO: 1036638 - RNA, 22 nt, Human
uucacauugugcagauuauggu

SEQ ID NO: 1036639 - RNA, 22 nt, Human
auaaacagcuccauuuagugcc

SEQ ID NO: 1036640 - RNA, 21 nt, Human
ggucagggggugccuccaggu

SEQ ID NO: 1036641 - RNA, 22 nt, Human
gugauugcccagcaccauuguu

SEQ ID NO: 1036642 - RNA, 22 nt, Human
ggccugcuuuccgagccugcag

SEQ ID NO: 1036643 - RNA, 22 nt, Human
cuguccuguagcuccaucaguc

SEQ ID NO: 1036644 - RNA, 22 nt, Human
ucccagccuuccagucugguuu

SEQ ID NO: 1036645 - RNA, 22 nt, Human
uuugaguugcuuauuuaauagg

SEQ ID NO: 1036646 - RNA, 22 nt, Human
ggucacaggggagaagagugau

SEQ ID NO: 1036647 - RNA, 22 nt, Human
ugcagaagcagagaguugccaa

SEQ ID NO: 1036648 - RNA, 22 nt, Human
gaaaauguuagcuucauaguca

SEQ ID NO: 1036649 - RNA, 22 nt, Human
ugccagggugucaggagagcua

SEQ ID NO: 1036650 - RNA, 22 nt, Human
uccugucugucuuuggucccuu

SEQ ID NO: 1036651 - RNA, 22 nt, Human
ugauuucccuguagccucugaa

SEQ ID NO: 1036652 - RNA, 22 nt, Human
ucugucugacaggguaugaacu

SEQ ID NO: 1036653 - RNA, 21 nt, Human
gccagagcaguacaaugaggu

SEQ ID NO: 1036654 - RNA, 22 nt, Human
gcagaagcugggcagcgaggug

SEQ ID NO: 1036655 - RNA, 22 nt, Human
agugccuggaccccaugacaua

SEQ ID NO: 1036656 - RNA, 19 nt, Human
uguuuuguuaaagcagucc

SEQ ID NO: 1036657 - RNA, 22 nt, Human
gucuggggaagucagggcauca

SEQ ID NO: 1036658 - RNA, 22 nt, Human
gcacacccucucaccagcacug

SEQ ID NO: 1036659 - RNA, 22 nt, Human
ugggacaguuguccuccacucu

SEQ ID NO: 1036660 - RNA, 22 nt, Human
guuugcauaaaguggaugcagg

SEQ ID NO: 1036661 - RNA, 22 nt, Human
gccuggagaaaggaagguggga

SEQ ID NO: 1036662 - RNA, 22 nt, Human
accucaggauguggacacagaa

SEQ ID NO: 1036663 - RNA, 22 nt, Human
agccuggagaggcgccauacac

SEQ ID NO: 1036664 - RNA, 20 nt, Human
uccagccacuuccgcugguc

SEQ ID NO: 1036665 - RNA, 22 nt, Human
agagaaggucacuaaggaccca

SEQ ID NO: 1036666 - RNA, 22 nt, Human
ccugggaggcggagguugcagu

SEQ ID NO: 1036667 - RNA, 22 nt, Human
acagagcaguucuggagcuggc

SEQ ID NO: 1036668 - RNA, 22 nt, Human
guggcucuaggugagcauggag

SEQ ID NO: 1036669 - RNA, 22 nt, Human
ugaagcaguucucagaaguggg

SEQ ID NO: 1036670 - RNA, 22 nt, Human
ucacugggagaugugggaaggg

SEQ ID NO: 1036671 - RNA, 22 nt, Human
ccaaggagcugcaggcacuugu

SEQ ID NO: 1036672 - RNA, 22 nt, Human
gccuggagacaaggacaaaggg

SEQ ID NO: 1036673 - RNA, 22 nt, Human
ucauccaguaccauggaaggca

SEQ ID NO: 1036674 - RNA, 22 nt, Human
auggccugggcccgcuucagau

SEQ ID NO: 1036675 - RNA, 22 nt, Human
cuuugaaagcucccaggacuua

SEQ ID NO: 1036676 - RNA, 22 nt, Human
gcucugggaacugacugccuuc

SEQ ID NO: 1036677 - RNA, 22 nt, Human
uugauaaaaugauaucuucuuu

SEQ ID NO: 1036678 - RNA, 22 nt, Human
gaaaugugugacaaguuucaau

SEQ ID NO: 1036679 - RNA, 22 nt, Human
gccuccugguugcuucuccaac

SEQ ID NO: 1036680 - RNA, 22 nt, Human
ugcauuauuugcaugugccugu

SEQ ID NO: 1036681 - RNA, 22 nt, Human
gaugugagugguagcugggauu

SEQ ID NO: 1036682 - RNA, 22 nt, Human
gccuggccgcuccgagcuccgc

SEQ ID NO: 1036683 - RNA, 22 nt, Human
acccaggccugagagacaggag

SEQ ID NO: 1036684 - RNA, 22 nt, Human
cucugcagaauuugagcugcuc

SEQ ID NO: 1036685 - RNA, 22 nt, Human
cagugucuuauuuguagcucag

SEQ ID NO: 1036686 - RNA, 22 nt, Human
cccagggauuauaaaggugaaa

SEQ ID NO: 1036687 - RNA, 22 nt, Human
cugaagcaaaugaaacagcucu

SEQ ID NO: 1036688 - RNA, 22 nt, Human
ugucaugcagguuuguuauaga

SEQ ID NO: 1036689 - RNA, 22 nt, Human
auaaaaacugacccauccuuug

SEQ ID NO: 1036690 - RNA, 22 nt, Human
ucccacugugaauccaaggccu

SEQ ID NO: 1036691 - RNA, 22 nt, Human
cugugccaggcccagcugacuu

SEQ ID NO: 1036692 - RNA, 22 nt, Human
cagagccuuccuagcagacucu

SEQ ID NO: 1036693 - RNA, 22 nt, Human
cgaugguucuggcugcuuguau

SEQ ID NO: 1036694 - RNA, 17 nt, Human
uuuucucucuuggauuc

SEQ ID NO: 1036695 - RNA, 22 nt, Human
uccuugaaaaucuugguuuaga

SEQ ID NO: 1036696 - RNA, 22 nt, Human
aaauguguuucgaaaacuggug

SEQ ID NO: 1036697 - RNA, 22 nt, Human
uugcauugaaugcacauuuuua

SEQ ID NO: 1036698 - RNA, 22 nt, Human
gcuggccucuggagaagggcuu

SEQ ID NO: 1036699 - RNA, 22 nt, Human
acauuucuuccacaugcugcug

SEQ ID NO: 1036700 - RNA, 22 nt, Human
ggcagccauggacacuggcuag

SEQ ID NO: 1036701 - RNA, 22 nt, Human
acacugaagagcacuuucaaag

SEQ ID NO: 1036702 - RNA, 22 nt, Human
gagugcaucguggccauuuuaa

SEQ ID NO: 1036703 - RNA, 22 nt, Human
gcagugguccaguucacaccca

SEQ ID NO: 1036704 - RNA, 22 nt, Human
ugagguaggugguaagagauac

SEQ ID NO: 1036705 - RNA, 21 nt, Human
gcacagcaugaguguuggcau

SEQ ID NO: 1036706 - RNA, 22 nt, Human
auguaucaugcaggguccauga

SEQ ID NO: 1036707 - RNA, 19 nt, Human
ugcucauggggacuucucc

SEQ ID NO: 1036708 - RNA, 22 nt, Human
ucaagcaggguagcaagcuggu

SEQ ID NO: 1036709 - RNA, 21 nt, Human
accucaagcaacaaccaaggu

SEQ ID NO: 1036710 - RNA, 22 nt, Human
uggcucagcgguggcagcagac

SEQ ID NO: 1036711 - RNA, 22 nt, Human
gagaggcugaaaucacaggagc

SEQ ID NO: 1036712 - RNA, 22 nt, Human
ccaggugguucaggucaccaua

SEQ ID NO: 1036713 - RNA, 22 nt, Human
caggguccggcugccuggcugu

SEQ ID NO: 1036714 - RNA, 22 nt, Human
ugacacagauuagagacauacc

SEQ ID NO: 1036715 - RNA, 22 nt, Human
uauucacauguacauaugcuca

SEQ ID NO: 1036716 - RNA, 22 nt, Human
gccagcucagaugcaggaagga

SEQ ID NO: 1036717 - RNA, 22 nt, Human
gccugguggugugcucaagugg

SEQ ID NO: 1036718 - RNA, 22 nt, Human
agggcagaggcggacacggaag

SEQ ID NO: 1036719 - RNA, 22 nt, Human
uggcugcucaagggaggaggcu

SEQ ID NO: 1036720 - RNA, 22 nt, Human
uuuacuuugugucaagucaaga

SEQ ID NO: 1036721 - RNA, 22 nt, Human
agguggggaaaccagcgauccc

SEQ ID NO: 1036722 - RNA, 22 nt, Human
gucuggaggaggaagaaggcac

SEQ ID NO: 1036723 - RNA, 22 nt, Human
ucugggagguaaccaugcugau

SEQ ID NO: 1036724 - RNA, 22 nt, Human
cagagaccccgcugcccuucug

SEQ ID NO: 1036725 - RNA, 22 nt, Human
gcuggcagucccaucagcuggg

SEQ ID NO: 1036726 - RNA, 22 nt, Human
aaggucauuguugcauguucuc

SEQ ID NO: 1036727 - RNA, 22 nt, Human
uuugcauuaguuuagauuucaa

SEQ ID NO: 1036728 - RNA, 22 nt, Human
ucauacaucuuguauaucuauc

SEQ ID NO: 1036729 - RNA, 22 nt, Human
guccuggggauacagaagugaa

SEQ ID NO: 1036730 - RNA, 22 nt, Human
ucccuggcagcuaagggugguc

SEQ ID NO: 1036731 - RNA, 22 nt, Human
aaugggagguaguaugggaggu

SEQ ID NO: 1036732 - RNA, 22 nt, Human
gggucagcugcugggggcugac

SEQ ID NO: 1036733 - RNA, 22 nt, Human
gggggcuguccugugcauugua

SEQ ID NO: 1036734 - RNA, 22 nt, Human
gcauuuauuucuuuacugcauc

SEQ ID NO: 1036735 - RNA, 22 nt, Human
caguccaggccuggaggagcca

SEQ ID NO: 1036736 - RNA, 22 nt, Human
gcacagggagacagccguggcc

SEQ ID NO: 1036737 - RNA, 22 nt, Human
uaugcauauagaugcacacaca

SEQ ID NO: 1036738 - RNA, 22 nt, Human
ugccucugcugcuguggcauca

SEQ ID NO: 1036739 - RNA, 22 nt, Human
gccuaggaguggggauggcggu

SEQ ID NO: 1036740 - RNA, 22 nt, Human
ccaccagcuucagcagccgcgg

SEQ ID NO: 1036741 - RNA, 22 nt, Human
ugagcccagucugucugacaug

SEQ ID NO: 1036742 - RNA, 22 nt, Human
uccuugaauauaauaacaguag

SEQ ID NO: 1036743 - RNA, 22 nt, Human
ggagccagaggcugcugcugug

SEQ ID NO: 1036744 - RNA, 22 nt, Human
cagggcagggauguugcggcag

SEQ ID NO: 1036745 - RNA, 22 nt, Human
gcauguguggaggagaugugcu

SEQ ID NO: 1036746 - RNA, 22 nt, Human
agaguguuuuucugucaaggac

SEQ ID NO: 1036747 - RNA, 22 nt, Human
ugcaaacaggagaguaaguaua

SEQ ID NO: 1036748 - RNA, 22 nt, Human
uggcagggaguugcaggauuuc

SEQ ID NO: 1036749 - RNA, 22 nt, Human
gaaaauguuuguccggagcuga

SEQ ID NO: 1036750 - RNA, 17 nt, Human
gcacugaacaauccugu

SEQ ID NO: 1036751 - RNA, 22 nt, Human
acauuucucauucuccccuaac

SEQ ID NO: 1036752 - RNA, 21 nt, Human
cugguguagcacucaggugcu

SEQ ID NO: 1036753 - RNA, 22 nt, Human
uggcagagguauauugggagga

SEQ ID NO: 1036754 - RNA, 22 nt, Human
auaaagaggauguauuuacagc

SEQ ID NO: 1036755 - RNA, 22 nt, Human
auguagcagaagauguuuuccu

SEQ ID NO: 1036756 - RNA, 22 nt, Human
uuuauuaugauggacaccuucg

SEQ ID NO: 1036757 - RNA, 22 nt, Human
ucaguuuucucaucuguaauuu

SEQ ID NO: 1036758 - RNA, 22 nt, Human
uuuaucuuuaggacuuugcaga

SEQ ID NO: 1036759 - RNA, 22 nt, Human
auccuugacacacuccaguacu

SEQ ID NO: 1036760 - RNA, 22 nt, Human
gcaggcugaugacuggaguugg

SEQ ID NO: 1036761 - RNA, 22 nt, Human
ggaggagacaguaaaaagcacg

SEQ ID NO: 1036762 - RNA, 22 nt, Human
accugccuucucaaggacauga

SEQ ID NO: 1036763 - RNA, 22 nt, Human
gagcagugggaaggaacagggu

SEQ ID NO: 1036764 - RNA, 22 nt, Human
gcccagcuggcuuccagcacau

SEQ ID NO: 1036765 - RNA, 19 nt, Human
uuacaucugcaacacuggu

SEQ ID NO: 1036766 - RNA, 22 nt, Human
cugccucuguugggcauggucu

SEQ ID NO: 1036767 - RNA, 22 nt, Human
cuguggugagcaacugacugaa

SEQ ID NO: 1036768 - RNA, 22 nt, Human
ugguccugagcaccagccugac

SEQ ID NO: 1036769 - RNA, 22 nt, Human
aggggcuguggaaaccaacucu

SEQ ID NO: 1036770 - RNA, 22 nt, Human
ggcuggccuguguggccgccac

SEQ ID NO: 1036771 - RNA, 22 nt, Human
cagcuccagcccaggcagcucc

SEQ ID NO: 1036772 - RNA, 22 nt, Human
uuugcauuguuucaaaagugaa

SEQ ID NO: 1036773 - RNA, 22 nt, Human
ggccaggagcaagccaggcucu

SEQ ID NO: 1036774 - RNA, 22 nt, Human
ucaguggagcuaagcaugagau

SEQ ID NO: 1036775 - RNA, 22 nt, Human
gucugcugcagagcauggcuuu

SEQ ID NO: 1036776 - RNA, 22 nt, Human
cagguaagagacggauuggccc

SEQ ID NO: 1036777 - RNA, 17 nt, Human
ggugagaccucccacuc

SEQ ID NO: 1036778 - RNA, 22 nt, Human
cagaggcucuuccucacugccc

SEQ ID NO: 1036779 - RNA, 22 nt, Human
gagccagcgccuugccucuggg

SEQ ID NO: 1036780 - RNA, 18 nt, Human
ggcugagguugacuagaa

SEQ ID NO: 1036781 - RNA, 19 nt, Human
ucagaggauuuggcuauga

SEQ ID NO: 1036782 - RNA, 22 nt, Human
aagcccagcaucccugcaccag

SEQ ID NO: 1036783 - RNA, 22 nt, Human
aaggcacuacgcugcuggggcg

SEQ ID NO: 1036784 - RNA, 22 nt, Human
aaugaugggaaggagaaaagca

SEQ ID NO: 1036785 - RNA, 22 nt, Human
ggcugucucugugacugccacc

SEQ ID NO: 1036786 - RNA, 22 nt, Human
cuggccugggagcugcuagcgu

SEQ ID NO: 1036787 - RNA, 22 nt, Human
gcagagccugugucugagcaaa

SEQ ID NO: 1036788 - RNA, 22 nt, Human
gcucucugucguuaugcuucau

SEQ ID NO: 1036789 - RNA, 22 nt, Human
agugaaauuccuggucuuuguu

SEQ ID NO: 1036790 - RNA, 22 nt, Human
ccuuggagcggucagcacuggu

SEQ ID NO: 1036791 - RNA, 22 nt, Human
uaggccaggacagagcuuccag

SEQ ID NO: 1036792 - RNA, 22 nt, Human
ucccagacaaucauuggccacc

SEQ ID NO: 1036793 - RNA, 22 nt, Human
uggcucagaguucaucuuuuag

SEQ ID NO: 1036794 - RNA, 22 nt, Human
cagcagcuacuuggagcagcag

SEQ ID NO: 1036795 - RNA, 22 nt, Human
aggcucugcagaccccagcugu

SEQ ID NO: 1036796 - RNA, 21 nt, Human
ugagagccuccaaccggcuac

SEQ ID NO: 1036797 - RNA, 22 nt, Human
augcaguaaauguucuaguuug

SEQ ID NO: 1036798 - RNA, 23 nt, Human
ggcucugugcugggccugcagga

SEQ ID NO: 1036799 - RNA, 22 nt, Human
agagcugcccacacagcagauu

SEQ ID NO: 1036800 - RNA, 22 nt, Human
uugcauugauguuccuucuugc

SEQ ID NO: 1036801 - RNA, 22 nt, Human
acagcagcacuauugacauuuu

SEQ ID NO: 1036802 - RNA, 22 nt, Human
ggggcugguggugguuucucca

SEQ ID NO: 1036803 - RNA, 18 nt, Human
ccagguggugacagagau

SEQ ID NO: 1036804 - RNA, 19 nt, Human
agagaggcugugugaggga

SEQ ID NO: 1036805 - RNA, 22 nt, Human
uggcucaguuccaucaucugga

SEQ ID NO: 1036806 - RNA, 22 nt, Human
uguggccucaaggcugcccuca

SEQ ID NO: 1036807 - RNA, 22 nt, Human
cacacuagucuauccauuagcu

SEQ ID NO: 1036808 - RNA, 19 nt, Human
uugcauuguaguuggacug

SEQ ID NO: 1036809 - RNA, 23 nt, Human
uggcucugugucacauacaggau

SEQ ID NO: 1036810 - RNA, 19 nt, Human
acaaagcugugagcagcuu

SEQ ID NO: 1036811 - RNA, 21 nt, Human
gcaugccugcaucuuaguguu

SEQ ID NO: 1036812 - RNA, 22 nt, Human
cuagaaaugcucaagagaaagu

SEQ ID NO: 1036813 - RNA, 22 nt, Human
uagggcaguuauaacauuagug

SEQ ID NO: 1036814 - RNA, 22 nt, Human
caggagacuauggcccaaggcc

SEQ ID NO: 1036815 - RNA, 22 nt, Human
ugugugcauucacaugcaugcc

SEQ ID NO: 1036816 - RNA, 22 nt, Human
uguauuuuuaggaaugcgcuau

SEQ ID NO: 1036817 - RNA, 19 nt, Human
aggcucugagcuccuggag

SEQ ID NO: 1036818 - RNA, 23 nt, Human
cuguggcugaguccuguuggagu

SEQ ID NO: 1036819 - RNA, 22 nt, Human
uuuauuguuguuagucauaagu

SEQ ID NO: 1036820 - RNA, 22 nt, Human
ucauugcagugauguuguaugu

SEQ ID NO: 1036821 - RNA, 22 nt, Human
ggagugaaucacuagaugcaga

SEQ ID NO: 1036822 - RNA, 22 nt, Human
cauugcaccacauugcaucccu

SEQ ID NO: 1036823 - RNA, 20 nt, Human
cuuugccuauucucugccug

SEQ ID NO: 1036824 - RNA, 22 nt, Human
uagcugccauugcuccaggaag

SEQ ID NO: 1036825 - RNA, 21 nt, Human
ugcaggcaggcagagaugcug

SEQ ID NO: 1036826 - RNA, 22 nt, Human
gcugaagcccacguggcuugua

SEQ ID NO: 1036827 - RNA, 22 nt, Human
aaugcuguauaucuuagcuaau

SEQ ID NO: 1036828 - RNA, 22 nt, Human
gcugagcugcuguucauccugc

SEQ ID NO: 1036829 - RNA, 22 nt, Human
uuuccuuccagguuccuaaggc

SEQ ID NO: 1036830 - RNA, 22 nt, Human
gcugaguguaaugauggcagag

SEQ ID NO: 1036831 - RNA, 22 nt, Human
ugggaguguucuuggcuugcuu

SEQ ID NO: 1036832 - RNA, 22 nt, Human
ccacaggggucucuguagcuga

SEQ ID NO: 1036833 - RNA, 18 nt, Human
gguggccuugacuucucu

SEQ ID NO: 1036834 - RNA, 22 nt, Human
gcugcaggcauuuuccugggca

SEQ ID NO: 1036835 - RNA, 22 nt, Human
gcaggauggugcccuuucugcc

SEQ ID NO: 1036836 - RNA, 22 nt, Human
ucuggcuccaccuccuuuacua

SEQ ID NO: 1036837 - RNA, 23 nt, Human
gacagagugagaccuugucuuac

SEQ ID NO: 1036838 - RNA, 22 nt, Human
cauuagaagaacaguuauauua

SEQ ID NO: 1036839 - RNA, 22 nt, Human
ggggcagagagaaggaagcuug

SEQ ID NO: 1036840 - RNA, 22 nt, Human
uuaugcuaagugcaacaagcca

SEQ ID NO: 1036841 - RNA, 22 nt, Human
ucugggugaugaaaugcacugu

SEQ ID NO: 1036842 - RNA, 22 nt, Human
aaaugcagguucuugagccaag

SEQ ID NO: 1036843 - RNA, 22 nt, Human
aucccugcccucauggagcuua

SEQ ID NO: 1036844 - RNA, 22 nt, Human
gccuuccuuacaccugcucagc

SEQ ID NO: 1036845 - RNA, 22 nt, Human
uuggcuucucuuaacccuaaag

SEQ ID NO: 1036846 - RNA, 22 nt, Human
auauucguggucaaguaaggcc

SEQ ID NO: 1036847 - RNA, 22 nt, Human
caccaggcuggagugcagaggu

SEQ ID NO: 1036848 - RNA, 22 nt, Human
cugcaggcucgaagacacggau

SEQ ID NO: 1036849 - RNA, 22 nt, Human
ugagcccaggaguuggagaccg

SEQ ID NO: 1036850 - RNA, 22 nt, Human
uggcagcauguuauguaaggaa

SEQ ID NO: 1036851 - RNA, 22 nt, Human
cagcucugugggagcguaugug

SEQ ID NO: 1036852 - RNA, 22 nt, Human
uacaaacuuguuuuaaguaagu

SEQ ID NO: 1036853 - RNA, 22 nt, Human
ggcuucugccacgagagggaag

SEQ ID NO: 1036854 - RNA, 22 nt, Human
cacagggcagugauuguccaca

SEQ ID NO: 1036855 - RNA, 17 nt, Human
cgagggcuugcuggcuc

SEQ ID NO: 1036856 - RNA, 17 nt, Human
aggagucucagaugagc

SEQ ID NO: 1036857 - RNA, 22 nt, Human
agcauugccugccuauugcuaa

SEQ ID NO: 1036858 - RNA, 22 nt, Human
cagaacauucacucauaugugg

SEQ ID NO: 1036859 - RNA, 22 nt, Human
uccaugugccaaggggcagagg

SEQ ID NO: 1036860 - RNA, 22 nt, Human
agcaggaguguccccuggcugu

SEQ ID NO: 1036861 - RNA, 22 nt, Human
ccugucugcaugaucccugcca

SEQ ID NO: 1036862 - RNA, 22 nt, Human
agcagcucuggcacuguagcau

SEQ ID NO: 1036863 - RNA, 22 nt, Human
acacagccgugaaucugcuucu

SEQ ID NO: 1036864 - RNA, 22 nt, Human
ccugggagagucuguggucucc

SEQ ID NO: 1036865 - RNA, 22 nt, Human
aaaugcaauuguauguacucca

SEQ ID NO: 1036866 - RNA, 22 nt, Human
uuuccucugucaugacagcuga

SEQ ID NO: 1036867 - RNA, 22 nt, Human
ugcaguggaaucuggagagcag

SEQ ID NO: 1036868 - RNA, 22 nt, Human
cagggagcuggcuggcgugagu

SEQ ID NO: 1036869 - RNA, 22 nt, Human
cugucccucaucaccucugggu

SEQ ID NO: 1036870 - RNA, 20 nt, Human
aagaaacuugaaaguacaag

SEQ ID NO: 1036871 - RNA, 22 nt, Human
ggggcuggcucacuaagagacu

SEQ ID NO: 1036872 - RNA, 22 nt, Human
acuuccugcaaucguccacucc

SEQ ID NO: 1036873 - RNA, 22 nt, Human
uuagagaaauucugguaaugua

SEQ ID NO: 1036874 - RNA, 22 nt, Human
auguccuucuccucuuaccugc

SEQ ID NO: 1036875 - RNA, 22 nt, Human
gaaguucaggugggaauugagc

SEQ ID NO: 1036876 - RNA, 22 nt, Human
auuuguacaaauuuauguuagu

SEQ ID NO: 1036877 - RNA, 22 nt, Human
cauuacauuucaaaauguuucc

SEQ ID NO: 1036878 - RNA, 22 nt, Human
aaaggucagcugccaucguucu

SEQ ID NO: 1036879 - RNA, 22 nt, Human
uuacuuuggauggucaagaaag

SEQ ID NO: 1036880 - RNA, 22 nt, Human
ccacacugaaccucagugucuu

SEQ ID NO: 1036881 - RNA, 22 nt, Human
ggcacugaaguggguguugggu

SEQ ID NO: 1036882 - RNA, 22 nt, Human
gcuggccugucuagagccuuac

SEQ ID NO: 1036883 - RNA, 22 nt, Human
ggaccagagcucgggcuucuca

SEQ ID NO: 1036884 - RNA, 22 nt, Human
cagggcaguaccgcccucuggc

SEQ ID NO: 1036885 - RNA, 22 nt, Human
ucagagaaguaagguggggugc

SEQ ID NO: 1036886 - RNA, 22 nt, Human
gcagagaaaguuuuguccucag

SEQ ID NO: 1036887 - RNA, 22 nt, Human
ggggcagagucuggacuguugu

SEQ ID NO: 1036888 - RNA, 22 nt, Human
uccugugccuccaccugcuccg

SEQ ID NO: 1036889 - RNA, 22 nt, Human
aagauacugaugauguaggcua

SEQ ID NO: 1036890 - RNA, 22 nt, Human
ccuggcugcuuucacuauggag

SEQ ID NO: 1036891 - RNA, 22 nt, Human
cuggcucauccagguguugcuc

SEQ ID NO: 1036892 - RNA, 22 nt, Human
agaaaacauuacauaggugugu

SEQ ID NO: 1036893 - RNA, 22 nt, Human
caggccugggcuucggggcuga

SEQ ID NO: 1036894 - RNA, 22 nt, Human
uucuuuccaaccagauauuggu

SEQ ID NO: 1036895 - RNA, 22 nt, Human
gcaguggcaccgcuggcucugg

SEQ ID NO: 1036896 - RNA, 22 nt, Human
gcucugcuggaaguucucugga

SEQ ID NO: 1036897 - RNA, 22 nt, Human
cagagcugucauuugccaguga

SEQ ID NO: 1036898 - RNA, 22 nt, Human
aagagcuggcccaaucugagca

SEQ ID NO: 1036899 - RNA, 22 nt, Human
gaguguuccagaaacuggcccu

SEQ ID NO: 1036900 - RNA, 22 nt, Human
ucccagccuuccuuguggugaa

SEQ ID NO: 1036901 - RNA, 22 nt, Human
cagcuccugccugggcagcugu

SEQ ID NO: 1036902 - RNA, 22 nt, Human
agcugcucuugggugacuucaa

SEQ ID NO: 1036903 - RNA, 23 nt, Human
aguguuccaguugguugagagug

SEQ ID NO: 1036904 - RNA, 22 nt, Human
cccagaggugcuucagaggugc

SEQ ID NO: 1036905 - RNA, 22 nt, Human
ggagccaggcaaucuguacuuu

SEQ ID NO: 1036906 - RNA, 22 nt, Human
ggcccugagcugaaguacugug

SEQ ID NO: 1036907 - RNA, 22 nt, Human
ucagcagaggggaaggcaucug

SEQ ID NO: 1036908 - RNA, 22 nt, Human
uggcucaggcuugaaaauagau

SEQ ID NO: 1036909 - RNA, 22 nt, Human
caagaugccccugguagggauc

SEQ ID NO: 1036910 - RNA, 20 nt, Human
gccuggaggcaaugggaaga

SEQ ID NO: 1036911 - RNA, 21 nt, Human
uggcugcuggcccucucucca

SEQ ID NO: 1036912 - RNA, 22 nt, Human
cagcucucacacccuccuccca

SEQ ID NO: 1036913 - RNA, 20 nt, Human
aggcagacaaggagucuguu

SEQ ID NO: 1036914 - RNA, 22 nt, Human
acagcugggugcugcucagagc

SEQ ID NO: 1036915 - RNA, 22 nt, Human
cagcauggcuugaguguuuccu

SEQ ID NO: 1036916 - RNA, 22 nt, Human
gccacugcacuccagcccaggc

SEQ ID NO: 1036917 - RNA, 18 nt, Human
ucuuggaguaaugaucaa

SEQ ID NO: 1036918 - RNA, 22 nt, Human
aggccuagaggaauggccaggg

SEQ ID NO: 1036919 - RNA, 22 nt, Human
guucuccauucagcuuccugug

SEQ ID NO: 1036920 - RNA, 19 nt, Human
aacuagaaagguuuugaga

SEQ ID NO: 1036921 - RNA, 22 nt, Human
aaugaacaggugaaugucagau

SEQ ID NO: 1036922 - RNA, 22 nt, Human
aggcacuguucccaguuauccu

SEQ ID NO: 1036923 - RNA, 22 nt, Human
ucacaggcuccagggccuggau

SEQ ID NO: 1036924 - RNA, 22 nt, Human
acagugucaugucguguucccc

SEQ ID NO: 1036925 - RNA, 22 nt, Human
gccugagcaggcguggaccaug

SEQ ID NO: 1036926 - RNA, 22 nt, Human
cugucucugucuuaacucccag

SEQ ID NO: 1036927 - RNA, 22 nt, Human
uggguggcggccugguucugag

SEQ ID NO: 1036928 - RNA, 21 nt, Human
cugagggccgcagcugggcuc

SEQ ID NO: 1036929 - RNA, 22 nt, Human
caugaagcauguuuugucauga

SEQ ID NO: 1036930 - RNA, 22 nt, Human
uuauccaaacuggugaaucauu

SEQ ID NO: 1036931 - RNA, 22 nt, Human
gaagaacaagcagugcuuuccu

SEQ ID NO: 1036932 - RNA, 22 nt, Human
ggcugaguugagaggauuacuu

SEQ ID NO: 1036933 - RNA, 19 nt, Human
gguaaaagugagcuucagg

SEQ ID NO: 1036934 - RNA, 17 nt, Human
aaaauucuguaaagagg

SEQ ID NO: 1036935 - RNA, 22 nt, Human
cugcagcuauauuuucccacag

SEQ ID NO: 1036936 - RNA, 21 nt, Human
gcagcaguguucuagaauacu

SEQ ID NO: 1036937 - RNA, 22 nt, Human
ucauucagguugggcaaguguc

SEQ ID NO: 1036938 - RNA, 22 nt, Human
gguggccaggccagcucuggcc

SEQ ID NO: 1036939 - RNA, 22 nt, Human
ccagccuucugagcugccugga

SEQ ID NO: 1036940 - RNA, 22 nt, Human
gggcaggaugcaguuucagaga

SEQ ID NO: 1036941 - RNA, 22 nt, Human
gacccuguuucuacaaauaauu

SEQ ID NO: 1036942 - RNA, 22 nt, Human
agucucugcacaguaagaagca

SEQ ID NO: 1036943 - RNA, 22 nt, Human
gggggcucugacucccucagcu

SEQ ID NO: 1036944 - RNA, 22 nt, Human
ggcaguggaggacccugugucu

SEQ ID NO: 1036945 - RNA, 22 nt, Human
uggaagagggagcuggguggcc

SEQ ID NO: 1036946 - RNA, 20 nt, Human
gaaaugugaccucuucugug

SEQ ID NO: 1036947 - RNA, 22 nt, Human
uaaacauggauucugaucacag

SEQ ID NO: 1036948 - RNA, 22 nt, Human
ccugccugauuccaggauggcu

SEQ ID NO: 1036949 - RNA, 22 nt, Human
acauguggucaaucuguguagg

SEQ ID NO: 1036950 - RNA, 16 nt, Human
ggagagugucugcaaa

SEQ ID NO: 1036951 - RNA, 16 nt, Human
uggaaggggucuccgg

SEQ ID NO: 1036952 - RNA, 22 nt, Human
ggcagaagaaaggcuaagucuc

SEQ ID NO: 1036953 - RNA, 22 nt, Human
acucugaggcaggucagggcag

SEQ ID NO: 1036954 - RNA, 18 nt, Human
aggcacuggaauuaaggg

SEQ ID NO: 1036955 - RNA, 22 nt, Human
agcagcucugagaggccagcac

SEQ ID NO: 1036956 - RNA, 20 nt, Human
guccugggagccacagcaca

SEQ ID NO: 1036957 - RNA, 22 nt, Human
uauuucuuguuauucucguuga

SEQ ID NO: 1036958 - RNA, 22 nt, Human
cagguccccuccccuaccaggc

SEQ ID NO: 1036959 - RNA, 22 nt, Human
ccacagagagugucagccuuug

SEQ ID NO: 1036960 - RNA, 22 nt, Human
ucaagagacaggacguguuuca

SEQ ID NO: 1036961 - RNA, 22 nt, Human
aagauuuccuucaguagagcua

SEQ ID NO: 1036962 - RNA, 22 nt, Human
agaggccaucugcucugugggg

SEQ ID NO: 1036963 - RNA, 22 nt, Human
cagagcuguuacuauucaugaa

SEQ ID NO: 1036964 - RNA, 22 nt, Human
cugaugcuauaagccacagugg

SEQ ID NO: 1036965 - RNA, 22 nt, Human
uccuuuuuauaguuagagaaac

SEQ ID NO: 1036966 - RNA, 22 nt, Human
uaagaagcuucugcuaaugccu

SEQ ID NO: 1036967 - RNA, 22 nt, Human
acuguguguuugucuagcacag

SEQ ID NO: 1036968 - RNA, 22 nt, Human
agcagugggggaguguuaguuu

SEQ ID NO: 1036969 - RNA, 22 nt, Human
ccagcagcucccucaggguccg

SEQ ID NO: 1036970 - RNA, 22 nt, Human
gcugucuucacuuccugguuuc

SEQ ID NO: 1036971 - RNA, 18 nt, Human
ggagagugacagagucgu

SEQ ID NO: 1036972 - RNA, 22 nt, Human
ugugcucuggaguugccuucac

SEQ ID NO: 1036973 - RNA, 22 nt, Human
cugaagccaugugcucacuggu

SEQ ID NO: 1036974 - RNA, 22 nt, Human
ugguggcaauguccuggagaag

SEQ ID NO: 1036975 - RNA, 22 nt, Human
uccugcagagacagaggccuca

SEQ ID NO: 1036976 - RNA, 22 nt, Human
uggcuuccugcauggauccucu

SEQ ID NO: 1036977 - RNA, 22 nt, Human
gaaaucugaaucuucuguuggu

SEQ ID NO: 1036978 - RNA, 22 nt, Human
agacaaaggauuaaugaugaug

SEQ ID NO: 1036979 - RNA, 17 nt, Human
cucuccuuccucugagg

SEQ ID NO: 1036980 - RNA, 22 nt, Human
acccagagccagggucaggagc

SEQ ID NO: 1036981 - RNA, 22 nt, Human
ucugucacugagcucaggauuc

SEQ ID NO: 1036982 - RNA, 22 nt, Human
uaagacauuugaaaugugaucc

SEQ ID NO: 1036983 - RNA, 22 nt, Human
cuuaagaauauugaaguugugg

SEQ ID NO: 1036984 - RNA, 22 nt, Human
ccuggcaggccccuccuggauu

SEQ ID NO: 1036985 - RNA, 22 nt, Human
uccagccaugacucggacagug

SEQ ID NO: 1036986 - RNA, 22 nt, Human
gagcagcugguaggugaaccca

SEQ ID NO: 1036987 - RNA, 22 nt, Human
agggcagaaauauugauacugu

SEQ ID NO: 1036988 - RNA, 22 nt, Human
gugucaugcacacucaguguug

SEQ ID NO: 1036989 - RNA, 22 nt, Human
aauguguagcauuuaaugcagu

SEQ ID NO: 1036990 - RNA, 22 nt, Human
cugccuguuagucuagcaguua

SEQ ID NO: 1036991 - RNA, 22 nt, Human
ccucugcugcuguugagcaccg

SEQ ID NO: 1036992 - RNA, 22 nt, Human
cugggcagugguggcccuuccc

SEQ ID NO: 1036993 - RNA, 22 nt, Human
ccacagccauuccagggaggcu

SEQ ID NO: 1036994 - RNA, 22 nt, Human
cucuggacacuggcaugggguc

SEQ ID NO: 1036995 - RNA, 22 nt, Human
cuggagcuaauaauccaucuga

SEQ ID NO: 1036996 - RNA, 22 nt, Human
cccuggaguccggagcucaccu

SEQ ID NO: 1036997 - RNA, 22 nt, Human
aucagcaagcaugguuaggugu

SEQ ID NO: 1036998 - RNA, 22 nt, Human
aggcacugcuucuaaguaggaa

SEQ ID NO: 1036999 - RNA, 22 nt, Human
aauugugcuaugauuaugaaag

SEQ ID NO: 1037000 - RNA, 22 nt, Human
aaaguguugggaagaaagugca

SEQ ID NO: 1037001 - RNA, 22 nt, Human
cucuggagcauuucaccuacau

SEQ ID NO: 1037002 - RNA, 22 nt, Human
ggggcagaaagcccacagagug

SEQ ID NO: 1037003 - RNA, 22 nt, Human
cccccaggcucugacacaggag

SEQ ID NO: 1037004 - RNA, 21 nt, Human
acaugucucuaaucucaguga

SEQ ID NO: 1037005 - RNA, 22 nt, Human
gaagaacacuucaugauucauu

SEQ ID NO: 1037006 - RNA, 22 nt, Human
uggcuggacagugggcagugga

SEQ ID NO: 1037007 - RNA, 21 nt, Human
uccuccuucaaguccuggccu

SEQ ID NO: 1037008 - RNA, 20 nt, Human
agccugccagcuggcccaga

SEQ ID NO: 1037009 - RNA, 22 nt, Human
cuugaaagcuuugcgucuucua

SEQ ID NO: 1037010 - RNA, 22 nt, Human
aguguuccacacaucuggggaa

SEQ ID NO: 1037011 - RNA, 21 nt, Human
acagcagggcuggcaugacag

SEQ ID NO: 1037012 - RNA, 22 nt, Human
aggccugggucucgugccuacc

SEQ ID NO: 1037013 - RNA, 22 nt, Human
ggcuucccuuuccgagaggaga

SEQ ID NO: 1037014 - RNA, 22 nt, Human
augggaggcagcagagcccagc

SEQ ID NO: 1037015 - RNA, 22 nt, Human
caggggcagucugugugcgugg

SEQ ID NO: 1037016 - RNA, 20 nt, Human
aggaacuggaagggaggaaa

SEQ ID NO: 1037017 - RNA, 22 nt, Human
uacauuguuuuuucuugccauc

SEQ ID NO: 1037018 - RNA, 22 nt, Human
cucagggucugguccuuagauu

SEQ ID NO: 1037019 - RNA, 22 nt, Human
cuucccugauaagagccucaga

SEQ ID NO: 1037020 - RNA, 22 nt, Human
ccugcaggggagagacuucuag

SEQ ID NO: 1037021 - RNA, 22 nt, Human
guuguauagagggcaugaaucu

SEQ ID NO: 1037022 - RNA, 22 nt, Human
ggagcagagcauuucacagccu

SEQ ID NO: 1037023 - RNA, 22 nt, Human
augcauaauguauguauugacu

SEQ ID NO: 1037024 - RNA, 20 nt, Human
caaugcacacagcugcuucu

SEQ ID NO: 1037025 - RNA, 19 nt, Human
ucucagagcccuagaggcc

SEQ ID NO: 1037026 - RNA, 22 nt, Human
cuucaagauauuucuagaauca

SEQ ID NO: 1037027 - RNA, 22 nt, Human
ucuggccaggauggcaagacca

SEQ ID NO: 1037028 - RNA, 22 nt, Human
ccugagcugaacuaagcaguuu

SEQ ID NO: 1037029 - RNA, 22 nt, Human
agugggcagugcgcucggaugc

SEQ ID NO: 1037030 - RNA, 22 nt, Human
gccuuugcaccaucagugcaau

SEQ ID NO: 1037031 - RNA, 22 nt, Human
aggcccuguuaugagccacugu

SEQ ID NO: 1037032 - RNA, 22 nt, Human
gugccugugcggacucagggaa

SEQ ID NO: 1037033 - RNA, 22 nt, Human
uccagggauguccuguagcacu

SEQ ID NO: 1037034 - RNA, 22 nt, Human
caaaugcuggcccugcuacuua

SEQ ID NO: 1037035 - RNA, 22 nt, Human
ccucacuggccagccaggggug

SEQ ID NO: 1037036 - RNA, 18 nt, Human
aaugcacacauuuacucc

SEQ ID NO: 1037037 - RNA, 22 nt, Human
agcugcugaaugacacugcaag

SEQ ID NO: 1037038 - RNA, 20 nt, Human
aaucagaaagugugagcucu

SEQ ID NO: 1037039 - RNA, 22 nt, Human
ccugucaggguuugccucagaa

SEQ ID NO: 1037040 - RNA, 22 nt, Human
uggcagagcaaaaagauagaau

SEQ ID NO: 1037041 - RNA, 22 nt, Human
gaguuauuaauggcugaguuug

SEQ ID NO: 1037042 - RNA, 22 nt, Human
cagcccucagguccucagcagc

SEQ ID NO: 1037043 - RNA, 22 nt, Human
ucugccugagggagcugaggaa

SEQ ID NO: 1037044 - RNA, 22 nt, Human
gucucagagagcuacucucuua

SEQ ID NO: 1037045 - RNA, 22 nt, Human
aucuggcuuggguguggguagc

SEQ ID NO: 1037046 - RNA, 18 nt, Human
agugugugcccuuucagg

SEQ ID NO: 1037047 - RNA, 17 nt, Human
uugggagagaaagguau

SEQ ID NO: 1037048 - RNA, 22 nt, Human
gcugagcugggacaguccuggg

SEQ ID NO: 1037049 - RNA, 22 nt, Human
ggcuagaacuuuacacuuugca

SEQ ID NO: 1037050 - RNA, 22 nt, Human
cgcuggccauagccuccugugu

SEQ ID NO: 1037051 - RNA, 22 nt, Human
aaaugugcuugugaucagcugu

SEQ ID NO: 1037052 - RNA, 19 nt, Human
uggcuccugccugccuucu

SEQ ID NO: 1037053 - RNA, 22 nt, Human
cugaaugucgaucagcuugggu

SEQ ID NO: 1037054 - RNA, 22 nt, Human
agaaauguuuauggcugccuau

SEQ ID NO: 1037055 - RNA, 22 nt, Human
cuuauguauauuuggaacguac

SEQ ID NO: 1037056 - RNA, 21 nt, Human
agaaauguaucauucuuuucc

SEQ ID NO: 1037057 - RNA, 22 nt, Human
gggcugcugcccaggaggcacc

SEQ ID NO: 1037058 - RNA, 22 nt, Human
cacagguggcuccaaguuagag

SEQ ID NO: 1037059 - RNA, 22 nt, Human
caccuggcuggaagugcuccgg

SEQ ID NO: 1037060 - RNA, 22 nt, Human
agaaauguggaucguuuuaaaa

SEQ ID NO: 1037061 - RNA, 22 nt, Human
aguguuguaugggaugacugcu

SEQ ID NO: 1037062 - RNA, 22 nt, Human
acauuuaaugauccuacuguga

SEQ ID NO: 1037063 - RNA, 22 nt, Human
gagcuuccacucuagaaggagu

SEQ ID NO: 1037064 - RNA, 22 nt, Human
ccuggcagacagcacugaagcu

SEQ ID NO: 1037065 - RNA, 22 nt, Human
gcaguccucucauuggccuccu

SEQ ID NO: 1037066 - RNA, 22 nt, Human
ugcugugagguugagaaggaag

SEQ ID NO: 1037067 - RNA, 22 nt, Human
gucaccagucccagcuccugaa

SEQ ID NO: 1037068 - RNA, 22 nt, Human
ggcucuggucagugaggggccu

SEQ ID NO: 1037069 - RNA, 22 nt, Human
uugaagcauuucuuugagcuuc

SEQ ID NO: 1037070 - RNA, 22 nt, Human
ccugggcauaaaucacuccaag

SEQ ID NO: 1037071 - RNA, 22 nt, Human
uagggaggcuacuucuuguagg

SEQ ID NO: 1037072 - RNA, 22 nt, Human
gggcugcuguagagaacauguu

SEQ ID NO: 1037073 - RNA, 23 nt, Human
gagcugggauacaggcuuacugc

SEQ ID NO: 1037074 - RNA, 21 nt, Human
ccucugcucgggcaugcguuu

SEQ ID NO: 1037075 - RNA, 22 nt, Human
ucucagagugguggucccucug

SEQ ID NO: 1037076 - RNA, 22 nt, Human
ccagaggcuggguucaccucag

SEQ ID NO: 1037077 - RNA, 22 nt, Human
agcuucuguucaucuuccaggc

SEQ ID NO: 1037078 - RNA, 22 nt, Human
agugaccaacaaugcugagaag

SEQ ID NO: 1037079 - RNA, 22 nt, Human
ucugagagagggucagaugcua

SEQ ID NO: 1037080 - RNA, 22 nt, Human
uauguacaguccuuaacuuaaa

SEQ ID NO: 1037081 - RNA, 22 nt, Human
caggguggaaaagcuaguugga

SEQ ID NO: 1037082 - RNA, 22 nt, Human
cagcagcugauggggaagugau

SEQ ID NO: 1037083 - RNA, 22 nt, Human
gacagggccgcagauggagacu

SEQ ID NO: 1037084 - RNA, 22 nt, Human
ugcaggugccucuugagcuugu

SEQ ID NO: 1037085 - RNA, 22 nt, Human
gugggcuggacccuccugcucc

SEQ ID NO: 1037086 - RNA, 23 nt, Human
auuuccuacuauaaaagagguaa

SEQ ID NO: 1037087 - RNA, 22 nt, Human
gcuggccacacugcugauggag

SEQ ID NO: 1037088 - RNA, 22 nt, Human
uuggaaggugagucccuggguu

SEQ ID NO: 1037089 - RNA, 22 nt, Human
cuguccuuacugcuucuggcuu

SEQ ID NO: 1037090 - RNA, 22 nt, Human
ggaggcuccacugcucuuccug

SEQ ID NO: 1037091 - RNA, 22 nt, Human
aguaaugucccuuaaauguggu

SEQ ID NO: 1037092 - RNA, 22 nt, Human
gaggccugcagcguggucccug

SEQ ID NO: 1037093 - RNA, 22 nt, Human
ccacagggucagccacucugca

SEQ ID NO: 1037094 - RNA, 22 nt, Human
uguuaacaucuuggacucguga

SEQ ID NO: 1037095 - RNA, 20 nt, Human
agaaucugacccagagagac

SEQ ID NO: 1037096 - RNA, 22 nt, Human
uagaucugauacaauucaucug

SEQ ID NO: 1037097 - RNA, 18 nt, Human
agcuggggccucuggucc

SEQ ID NO: 1037098 - RNA, 22 nt, Human
ggcuggcuuucucuccgcaccu

SEQ ID NO: 1037099 - RNA, 22 nt, Human
ggugaggcccagugaucugugu

SEQ ID NO: 1037100 - RNA, 23 nt, Human
cugcagucgccggccugggugcc

SEQ ID NO: 1037101 - RNA, 22 nt, Human
gagacugauggggcucccagaa

SEQ ID NO: 1037102 - RNA, 22 nt, Human
gcaggggaguggcaggcccgga

SEQ ID NO: 1037103 - RNA, 22 nt, Human
cuaaaugccuuuccuaccuaac

SEQ ID NO: 1037104 - RNA, 22 nt, Human
uacauuguucaugcaugagaaa

SEQ ID NO: 1037105 - RNA, 22 nt, Human
auccccagaaaauaggugccua

SEQ ID NO: 1037106 - RNA, 22 nt, Human
agagcuuauaucuuggccaucc

SEQ ID NO: 1037107 - RNA, 22 nt, Human
agguggagacccagagaaggcg

SEQ ID NO: 1037108 - RNA, 22 nt, Human
acacaugcauaagccuucccuu

SEQ ID NO: 1037109 - RNA, 22 nt, Human
uccucagaugcucuuggacgcc

SEQ ID NO: 1037110 - RNA, 22 nt, Human
ucaccugggagggcugugguag

SEQ ID NO: 1037111 - RNA, 22 nt, Human
aggcagccagauggcagccugc

SEQ ID NO: 1037112 - RNA, 22 nt, Human
uuccugagggacuuuugagauu

SEQ ID NO: 1037113 - RNA, 22 nt, Human
cacaaaaguaggaggcaggcgg

SEQ ID NO: 1037114 - RNA, 21 nt, Human
agcagcugggcaacauggagg

SEQ ID NO: 1037115 - RNA, 20 nt, Human
gaagcagcuucauguagaca

SEQ ID NO: 1037116 - RNA, 22 nt, Human
ugcccugucuaagcugucagua

SEQ ID NO: 1037117 - RNA, 22 nt, Human
ugguuuauuucucugaaagguu

SEQ ID NO: 1037118 - RNA, 22 nt, Human
uggccugcccagagcagcucug

SEQ ID NO: 1037119 - RNA, 22 nt, Human
acauuugucuucuuucagauua

SEQ ID NO: 1037120 - RNA, 22 nt, Human
guggcucucgccagccugcggg

SEQ ID NO: 1037121 - RNA, 22 nt, Human
uagaaaugcaguguacuguguc

SEQ ID NO: 1037122 - RNA, 22 nt, Human
uuuugaaagccagguuuguaug

SEQ ID NO: 1037123 - RNA, 22 nt, Human
ucucagagaggggccgggccuu

SEQ ID NO: 1037124 - RNA, 22 nt, Human
ugcuguuauacuuagcugguua

SEQ ID NO: 1037125 - RNA, 18 nt, Human
cugcugcaggcacucagg

SEQ ID NO: 1037126 - RNA, 22 nt, Human
cuggcuggccggagcgaggcgg

SEQ ID NO: 1037127 - RNA, 22 nt, Human
cagaguguugaccauaagccca

SEQ ID NO: 1037128 - RNA, 19 nt, Human
cucugccucuggcuguggc

SEQ ID NO: 1037129 - RNA, 22 nt, Human
gggaaauugugugagaucuuug

SEQ ID NO: 1037130 - RNA, 22 nt, Human
aaaugcuguaacugauauucug

SEQ ID NO: 1037131 - RNA, 22 nt, Human
gccugagacagugugguccaau

SEQ ID NO: 1037132 - RNA, 22 nt, Human
ucuggccacccgaggccccugc

SEQ ID NO: 1037133 - RNA, 21 nt, Human
ucccacucuaaauggacugaa

SEQ ID NO: 1037134 - RNA, 22 nt, Human
cugcucuggucucuucauguuu

SEQ ID NO: 1037135 - RNA, 22 nt, Human
cauugcacuuuggguccaggac

SEQ ID NO: 1037136 - RNA, 22 nt, Human
agcagcugcagagggcuccccc

SEQ ID NO: 1037137 - RNA, 21 nt, Human
cugugcuuuuuaagugugaug

SEQ ID NO: 1037138 - RNA, 22 nt, Human
ggagucagccugucagagugua

SEQ ID NO: 1037139 - RNA, 22 nt, Human
uagcugccaaaagggugggcua

SEQ ID NO: 1037140 - RNA, 20 nt, Human
ugaugguucuuuccggguug

SEQ ID NO: 1037141 - RNA, 22 nt, Human
uggaugcuguaggacacgcucu

SEQ ID NO: 1037142 - RNA, 22 nt, Human
ugagggaggcccuuugagcaga

SEQ ID NO: 1037143 - RNA, 20 nt, Human
gggaguggugguagccugug

SEQ ID NO: 1037144 - RNA, 22 nt, Human
agagggcauuaacucugucuug

SEQ ID NO: 1037145 - RNA, 22 nt, Human
uaugaagaaguucugugaaaug

SEQ ID NO: 1037146 - RNA, 22 nt, Human
aggcacuggguaauuaguagcu

SEQ ID NO: 1037147 - RNA, 22 nt, Human
gccaggcuggccagcaccuucu

SEQ ID NO: 1037148 - RNA, 22 nt, Human
ccuggagggcgccgcacagucc

SEQ ID NO: 1037149 - RNA, 22 nt, Human
aucuggcucaccuggguaaaua

SEQ ID NO: 1037150 - RNA, 22 nt, Human
ccuggaaguuggagguugcagu

SEQ ID NO: 1037151 - RNA, 22 nt, Human
uggcucuggggacaguaagucc

SEQ ID NO: 1037152 - RNA, 22 nt, Human
uggggccuggucagagcugcac

SEQ ID NO: 1037153 - RNA, 22 nt, Human
ggcagagguagcuggaaccagg

SEQ ID NO: 1037154 - RNA, 22 nt, Human
aggaagcccuugucauuucugu

SEQ ID NO: 1037155 - RNA, 22 nt, Human
cucucugggcccaguuggcacc

SEQ ID NO: 1037156 - RNA, 22 nt, Human
uccagucauuuccauuguuccc

SEQ ID NO: 1037157 - RNA, 22 nt, Human
ugcuggggguucagaugaguaa

SEQ ID NO: 1037158 - RNA, 22 nt, Human
gcugggcugagcuagacuuggc

SEQ ID NO: 1037159 - RNA, 22 nt, Human
gugucccaggagaggagacaau

SEQ ID NO: 1037160 - RNA, 22 nt, Human
ugaucagucccaugaucuucca

SEQ ID NO: 1037161 - RNA, 22 nt, Human
agaggcuccuucacucuggcac

SEQ ID NO: 1037162 - RNA, 22 nt, Human
ugcugcucuguaaagugaugag

SEQ ID NO: 1037163 - RNA, 22 nt, Human
agccaucauuucugucacuggc

SEQ ID NO: 1037164 - RNA, 22 nt, Human
uggcuucaucugcagcacugcc

SEQ ID NO: 1037165 - RNA, 18 nt, Human
uguuccaaggaaggaauc

SEQ ID NO: 1037166 - RNA, 20 nt, Human
aaaaacaguaaugcugaaga

SEQ ID NO: 1037167 - RNA, 22 nt, Human
ccuggccucuccgaguaaccug

SEQ ID NO: 1037168 - RNA, 22 nt, Human
ugggccugccccaggcuucagc

SEQ ID NO: 1037169 - RNA, 22 nt, Human
agaaggccuaacuugggggcaa

SEQ ID NO: 1037170 - RNA, 22 nt, Human
uugacaauguccuuugaauuuc

SEQ ID NO: 1037171 - RNA, 22 nt, Human
uuugacagacauuuacuacauu

SEQ ID NO: 1037172 - RNA, 22 nt, Human
auuauguagcuaaaaauugugu

SEQ ID NO: 1037173 - RNA, 22 nt, Human
uugauacagcagccugugaucc

SEQ ID NO: 1037174 - RNA, 22 nt, Human
aggcuucuaggguuggcagcgg

SEQ ID NO: 1037175 - RNA, 22 nt, Human
cugggcugucccaaccccaucc

SEQ ID NO: 1037176 - RNA, 22 nt, Human
cuggugucugcucccucacagc

SEQ ID NO: 1037177 - RNA, 23 nt, Human
gggagaauaugaggaugauggug

SEQ ID NO: 1037178 - RNA, 18 nt, Human
gcagcugcaguuguagcu

SEQ ID NO: 1037179 - RNA, 18 nt, Human
ccucaggggaccuggcag

SEQ ID NO: 1037180 - RNA, 22 nt, Human
gaagaagcaggaguguguagca

SEQ ID NO: 1037181 - RNA, 22 nt, Human
ugcauuguugaccaguugugca

SEQ ID NO: 1037182 - RNA, 22 nt, Human
ugugggcaggcccgggucugag

SEQ ID NO: 1037183 - RNA, 19 nt, Human
uuagaaacuguugacacug

SEQ ID NO: 1037184 - RNA, 22 nt, Human
caggaugggauguagugggccc

SEQ ID NO: 1037185 - RNA, 22 nt, Human
cauugcacuccacccuaggcaa

SEQ ID NO: 1037186 - RNA, 22 nt, Human
ggcagggagagcaugcugauaa

SEQ ID NO: 1037187 - RNA, 22 nt, Human
ccagcucucagcgggagacuca

SEQ ID NO: 1037188 - RNA, 22 nt, Human
cccucccagaugggcuugaggu

SEQ ID NO: 1037189 - RNA, 22 nt, Human
ucuggcucauacaagccugcaa

SEQ ID NO: 1037190 - RNA, 23 nt, Human
ggaguuggauuguacuugcugcu

SEQ ID NO: 1037191 - RNA, 22 nt, Human
agccucugcacgggcacgggug

SEQ ID NO: 1037192 - RNA, 22 nt, Human
agaaaucuaagaugcucaagga

SEQ ID NO: 1037193 - RNA, 22 nt, Human
cagcugugcuguauuaagcucu

SEQ ID NO: 1037194 - RNA, 22 nt, Human
cccuggagcugcuugcauguug

SEQ ID NO: 1037195 - RNA, 23 nt, Human
agcuggguggccugcgugaagcu

SEQ ID NO: 1037196 - RNA, 22 nt, Human
caggaagagaacauggaggcug

SEQ ID NO: 1037197 - RNA, 21 nt, Human
uuagcaaagcaaacacaugcu

SEQ ID NO: 1037198 - RNA, 22 nt, Human
acacaggggaaaguggagcuga

SEQ ID NO: 1037199 - RNA, 22 nt, Human
gggugcugacuggggccugaaa

SEQ ID NO: 1037200 - RNA, 22 nt, Human
aggagucagauaugggaaaguu

SEQ ID NO: 1037201 - RNA, 22 nt, Human
gcugcucuugaggggcucacug

SEQ ID NO: 1037202 - RNA, 22 nt, Human
gcccagcagaucucagugucuc

SEQ ID NO: 1037203 - RNA, 22 nt, Human
gccugggugucgaucacuagug

SEQ ID NO: 1037204 - RNA, 22 nt, Human
ucagagugggagaaugugccaa

SEQ ID NO: 1037205 - RNA, 22 nt, Human
gcuuccuggagggagagagcug

SEQ ID NO: 1037206 - RNA, 22 nt, Human
agcucccagggcugggcaaguu

SEQ ID NO: 1037207 - RNA, 22 nt, Human
uuucuuaggcucuaaaaugacu

SEQ ID NO: 1037208 - RNA, 21 nt, Human
aggcugcuggcucaggguccu

SEQ ID NO: 1037209 - RNA, 22 nt, Human
ucagcaaugugauacugugcaa

SEQ ID NO: 1037210 - RNA, 22 nt, Human
aaguguauauaugacuuauaaa

SEQ ID NO: 1037211 - RNA, 22 nt, Human
cccuucagcugagugggacagc

SEQ ID NO: 1037212 - RNA, 22 nt, Human
agccccugggaguagcugcugc

SEQ ID NO: 1037213 - RNA, 22 nt, Human
uccaggacuagcauuucugaua

SEQ ID NO: 1037214 - RNA, 22 nt, Human
caaugauguuuagauaaaaucc

SEQ ID NO: 1037215 - RNA, 22 nt, Human
agccacagcgaaccucucuucc

SEQ ID NO: 1037216 - RNA, 22 nt, Human
guggagcccugguagggacccc

SEQ ID NO: 1037217 - RNA, 22 nt, Human
gccuggaguacuccuugaagug

SEQ ID NO: 1037218 - RNA, 22 nt, Human
ugcagcuucuuguccugugauu

SEQ ID NO: 1037219 - RNA, 22 nt, Human
cgcugccaggucaccaggggua

SEQ ID NO: 1037220 - RNA, 22 nt, Human
aagagagagcauucuucuguua

SEQ ID NO: 1037221 - RNA, 22 nt, Human
uauuugaaaguguacaaaaacu

SEQ ID NO: 1037222 - RNA, 22 nt, Human
ugaacauauucaccucuaaaua

SEQ ID NO: 1037223 - RNA, 19 nt, Human
uggcucugucgaaggcaca

SEQ ID NO: 1037224 - RNA, 22 nt, Human
gccaccagguuagauccagccu

SEQ ID NO: 1037225 - RNA, 22 nt, Human
ugcuuuuaagaacaaugcugcu

SEQ ID NO: 1037226 - RNA, 22 nt, Human
agugucauaugccacugcaucc

SEQ ID NO: 1037227 - RNA, 22 nt, Human
gugcaguggcagauccuagcuc

SEQ ID NO: 1037228 - RNA, 22 nt, Human
gcagcuggggaggucgugggga

SEQ ID NO: 1037229 - RNA, 22 nt, Human
gagcagaacuacucacauaucg

SEQ ID NO: 1037230 - RNA, 22 nt, Human
uucauuacugcgguagucacac

SEQ ID NO: 1037231 - RNA, 22 nt, Human
cugggcacaaguggcccuggau

SEQ ID NO: 1037232 - RNA, 19 nt, Human
uggcagggagaguuugaag

SEQ ID NO: 1037233 - RNA, 22 nt, Human
ggagccuguggcugcuugaagc

SEQ ID NO: 1037234 - RNA, 22 nt, Human
auguacaaaaugccacugaauu

SEQ ID NO: 1037235 - RNA, 22 nt, Human
aacagacaacuccuguggcuca

SEQ ID NO: 1037236 - RNA, 22 nt, Human
uaaucacaucaggguaaauggg

SEQ ID NO: 1037237 - RNA, 22 nt, Human
gagaugaauguaaacaaaggca

SEQ ID NO: 1037238 - RNA, 22 nt, Human
agcucccauuaucuucugaaac

SEQ ID NO: 1037239 - RNA, 22 nt, Human
uccugccuguuuaccuguacuu

SEQ ID NO: 1037240 - RNA, 22 nt, Human
cuggccaguuguccuggcuugg

SEQ ID NO: 1037241 - RNA, 22 nt, Human
uguaauggaagugggauugcau

SEQ ID NO: 1037242 - RNA, 22 nt, Human
gcaggguaggugacagguaguc

SEQ ID NO: 1037243 - RNA, 22 nt, Human
uguuuaagcugaugagguaucg

SEQ ID NO: 1037244 - RNA, 22 nt, Human
ucucacucauuuccuaggucuu

SEQ ID NO: 1037245 - RNA, 22 nt, Human
aggcacugacucaagggagcca

SEQ ID NO: 1037246 - RNA, 21 nt, Human
agugaaaugaaguguaugcuc

SEQ ID NO: 1037247 - RNA, 22 nt, Human
gccucugcugacaagauggaca

SEQ ID NO: 1037248 - RNA, 22 nt, Human
aucaaaaugcuccagugauggu

SEQ ID NO: 1037249 - RNA, 22 nt, Human
aagggcaggcacccacccucac

SEQ ID NO: 1037250 - RNA, 22 nt, Human
gccugaggaaugcuccugacuu

SEQ ID NO: 1037251 - RNA, 22 nt, Human
agccucugucaagcuuuucaaa

SEQ ID NO: 1037252 - RNA, 22 nt, Human
augaugguaaauucaguauccg

SEQ ID NO: 1037253 - RNA, 19 nt, Human
ggccaggcugacugugguc

SEQ ID NO: 1037254 - RNA, 22 nt, Human
ugcugccacugguagucucauu

SEQ ID NO: 1037255 - RNA, 22 nt, Human
uagggcagauucgguggaguuu

SEQ ID NO: 1037256 - RNA, 23 nt, Human
cugaggccugcugcguucagguu

SEQ ID NO: 1037257 - RNA, 22 nt, Human
gaaccaaguaggauacaaggag

SEQ ID NO: 1037258 - RNA, 19 nt, Human
gaguuauugccagggcaug

SEQ ID NO: 1037259 - RNA, 22 nt, Human
ugggcugcagggguugagagcu

SEQ ID NO: 1037260 - RNA, 21 nt, Human
gccuggcagguggaagggcuc

SEQ ID NO: 1037261 - RNA, 22 nt, Human
uggugugggcguggcaggcaag

SEQ ID NO: 1037262 - RNA, 23 nt, Human
cuccucguaacucuguggugggu

SEQ ID NO: 1037263 - RNA, 22 nt, Human
cacugaguucccugacauuuca

SEQ ID NO: 1037264 - RNA, 22 nt, Human
uuaacagagugccuggcaugua

SEQ ID NO: 1037265 - RNA, 22 nt, Human
cugcagaggucuugcugauggu

SEQ ID NO: 1037266 - RNA, 22 nt, Human
ucaggagauggucuuuauaggc

SEQ ID NO: 1037267 - RNA, 22 nt, Human
ucaguauccacaaaugcucaaa

SEQ ID NO: 1037268 - RNA, 22 nt, Human
aagcagaaguugaucuaccaua

SEQ ID NO: 1037269 - RNA, 21 nt, Human
agagucugcauuucugacaag

SEQ ID NO: 1037270 - RNA, 22 nt, Human
aagaauguucuuguagucauga

SEQ ID NO: 1037271 - RNA, 22 nt, Human
ggagugaguacuggaguagcug

SEQ ID NO: 1037272 - RNA, 20 nt, Human
cagcaggaaaagugccucag

SEQ ID NO: 1037273 - RNA, 22 nt, Human
guguggcugugggagauguuca

SEQ ID NO: 1037274 - RNA, 22 nt, Human
agccagcugccuuucacaucug

SEQ ID NO: 1037275 - RNA, 22 nt, Human
caggccugucugcacaugaggc

SEQ ID NO: 1037276 - RNA, 22 nt, Human
caucuggcuagcuaucauugug

SEQ ID NO: 1037277 - RNA, 22 nt, Human
auguaaggcugccuaugacacu

SEQ ID NO: 1037278 - RNA, 19 nt, Human
ucugcuggcagaauucccu

SEQ ID NO: 1037279 - RNA, 20 nt, Human
caguagcaauaauuagaagc

SEQ ID NO: 1037280 - RNA, 17 nt, Human
ucagcaggggccaagcu

SEQ ID NO: 1037281 - RNA, 22 nt, Human
ccaaggcuggagugcaguggcg

SEQ ID NO: 1037282 - RNA, 22 nt, Human
acaaagugcacaagaugagaac

SEQ ID NO: 1037283 - RNA, 22 nt, Human
ugcagcugcuugauucaucuug

SEQ ID NO: 1037284 - RNA, 22 nt, Human
aggagaguucacacuggucaga

SEQ ID NO: 1037285 - RNA, 22 nt, Human
acucugccccgaguucugggaa

SEQ ID NO: 1037286 - RNA, 22 nt, Human
ccaaagucuggagcagcagagc

SEQ ID NO: 1037287 - RNA, 22 nt, Human
gcagauggcagcccaggcuggg

SEQ ID NO: 1037288 - RNA, 23 nt, Human
ggcuggcccggggcugcuccuga

SEQ ID NO: 1037289 - RNA, 22 nt, Human
acugccaggauggcacuagagg

SEQ ID NO: 1037290 - RNA, 20 nt, Human
gcucccagccugcagucccc

SEQ ID NO: 1037291 - RNA, 22 nt, Human
ucuucuccagugcuucugcaca

SEQ ID NO: 1037292 - RNA, 22 nt, Human
agaaauguacgauguuaugcag

SEQ ID NO: 1037293 - RNA, 18 nt, Human
agcagcugucagaaugcc

SEQ ID NO: 1037294 - RNA, 22 nt, Human
gggcaguggcucacgccuguaa

SEQ ID NO: 1037295 - RNA, 22 nt, Human
agcuugccucuuaaucaccuca

SEQ ID NO: 1037296 - RNA, 22 nt, Human
gcucugagagugggugauucug

SEQ ID NO: 1037297 - RNA, 22 nt, Human
ggcaaaaaccgcaauaacuucu

SEQ ID NO: 1037298 - RNA, 22 nt, Human
ucagcagucacauguuguccca

SEQ ID NO: 1037299 - RNA, 22 nt, Human
ccucccuggccagagcagcagc

SEQ ID NO: 1037300 - RNA, 22 nt, Human
aaaaaugugaccacaggguguu

SEQ ID NO: 1037301 - RNA, 22 nt, Human
aggugcuuggcucgugcacaca

SEQ ID NO: 1037302 - RNA, 22 nt, Human
cccagccugugacagccguccu

SEQ ID NO: 1037303 - RNA, 22 nt, Human
gucucagaccacccucuuuggc

SEQ ID NO: 1037304 - RNA, 22 nt, Human
guggcugcuacagagcuggagg

SEQ ID NO: 1037305 - RNA, 22 nt, Human
gaaggagcuaaagggagcccug

SEQ ID NO: 1037306 - RNA, 23 nt, Human
uguagcaucucuuauuucucagc

SEQ ID NO: 1037307 - RNA, 22 nt, Human
ggggugggguuacucauugugc

SEQ ID NO: 1037308 - RNA, 22 nt, Human
uauguacaccggggaagguggg

SEQ ID NO: 1037309 - RNA, 22 nt, Human
uugaaucauuacaauagauaag

SEQ ID NO: 1037310 - RNA, 22 nt, Human
ccugcuucagggaugauggcac

SEQ ID NO: 1037311 - RNA, 22 nt, Human
aagaugauaggacuugcuuaag

SEQ ID NO: 1037312 - RNA, 22 nt, Human
caggagacaaguuagcagcuga

SEQ ID NO: 1037313 - RNA, 22 nt, Human
cgagaguggacagggcgcagcu

SEQ ID NO: 1037314 - RNA, 22 nt, Human
cagcugccaugacauguccugc

SEQ ID NO: 1037315 - RNA, 22 nt, Human
cuccucuggaaauuccucugcc

SEQ ID NO: 1037316 - RNA, 22 nt, Human
ucagugcuucggcgagcaccua

SEQ ID NO: 1037317 - RNA, 18 nt, Human
ugcuggcaacuacuauug

SEQ ID NO: 1037318 - RNA, 22 nt, Human
cagcuggguuuaguggggugug

SEQ ID NO: 1037319 - RNA, 22 nt, Human
ccugccugcuuucugcuuugca

SEQ ID NO: 1037320 - RNA, 22 nt, Human
cagccaggagcucccccugcuc

SEQ ID NO: 1037321 - RNA, 22 nt, Human
ccugggagcuguggaaaggcug

SEQ ID NO: 1037322 - RNA, 22 nt, Human
ugggcugcagagcccggccuuc

SEQ ID NO: 1037323 - RNA, 22 nt, Human
gugcagugacccuggagagcug

SEQ ID NO: 1037324 - RNA, 19 nt, Human
aagggcugggcaccucacu

SEQ ID NO: 1037325 - RNA, 20 nt, Human
gccugcagagaaggucagag

SEQ ID NO: 1037326 - RNA, 21 nt, Human
ugaggcuguuguaccagggag

SEQ ID NO: 1037327 - RNA, 20 nt, Human
guaaaauauggucuuugggu

SEQ ID NO: 1037328 - RNA, 22 nt, Human
uuauuuauuguguaccuacugu

SEQ ID NO: 1037329 - RNA, 22 nt, Human
uggggcugaggagccucacucu

SEQ ID NO: 1037330 - RNA, 22 nt, Human
auacaugucaucauauguuugu

SEQ ID NO: 1037331 - RNA, 21 nt, Human
ccagacuggccuaugugguag

SEQ ID NO: 1037332 - RNA, 22 nt, Human
uaaguuuaaauguacaugaagc

SEQ ID NO: 1037333 - RNA, 22 nt, Human
uccaucagauucccuccugaga

SEQ ID NO: 1037334 - RNA, 22 nt, Human
uauugaaaugaaugacagugau

SEQ ID NO: 1037335 - RNA, 22 nt, Human
gcccacacaccagcucaggagg

SEQ ID NO: 1037336 - RNA, 22 nt, Human
ccuggugcuuaccagagcuuuu

SEQ ID NO: 1037337 - RNA, 22 nt, Human
ucagcagugcagggugaggcag

SEQ ID NO: 1037338 - RNA, 22 nt, Human
agaggggcucaagcaguggucu

SEQ ID NO: 1037339 - RNA, 22 nt, Human
caaagguauucucauuuuggaa

SEQ ID NO: 1037340 - RNA, 22 nt, Human
gccacaggcacuuaagggcugg

SEQ ID NO: 1037341 - RNA, 22 nt, Human
aagaggaagucuccauggagag

SEQ ID NO: 1037342 - RNA, 22 nt, Human
ucauguaaguauagaaagcagu

SEQ ID NO: 1037343 - RNA, 22 nt, Human
ggacagcccauacacaugucug

SEQ ID NO: 1037344 - RNA, 22 nt, Human
aaauauguauggaguucaugaa

SEQ ID NO: 1037345 - RNA, 22 nt, Human
aagcaauaagccagauuuggau

SEQ ID NO: 1037346 - RNA, 22 nt, Human
acagggccucagcugauucugg

SEQ ID NO: 1037347 - RNA, 22 nt, Human
ugcugucuguuuacuggcuaua

SEQ ID NO: 1037348 - RNA, 22 nt, Human
gaggggcuggcuguggucccau

SEQ ID NO: 1037349 - RNA, 22 nt, Human
acagaaugcguagugcauguug

SEQ ID NO: 1037350 - RNA, 22 nt, Human
gauaccagacagggagggagaa

SEQ ID NO: 1037351 - RNA, 22 nt, Human
gggcagagaaauggacaguugg

SEQ ID NO: 1037352 - RNA, 22 nt, Human
gaggcugcccaacuggagugga

SEQ ID NO: 1037353 - RNA, 22 nt, Human
ucugggcagcagcagcuaguag

SEQ ID NO: 1037354 - RNA, 22 nt, Human
uccaagggcagccauagaacuu

SEQ ID NO: 1037355 - RNA, 23 nt, Human
acagcaagaggaccagaugugag

SEQ ID NO: 1037356 - RNA, 22 nt, Human
uccuuggcaugccgucuucucc

SEQ ID NO: 1037357 - RNA, 22 nt, Human
ucagcugagcuccagcucauag

SEQ ID NO: 1037358 - RNA, 22 nt, Human
caggaaaggugugucaugaugg

SEQ ID NO: 1037359 - RNA, 22 nt, Human
cagcagcucccauccgcugagc

SEQ ID NO: 1037360 - RNA, 22 nt, Human
ucuguccucuuugaagcugcuc

SEQ ID NO: 1037361 - RNA, 22 nt, Human
ugcagaccucccauggcugccu

SEQ ID NO: 1037362 - RNA, 22 nt, Human
caggcugaucagggcugggaug

SEQ ID NO: 1037363 - RNA, 22 nt, Human
uuacaugguuguuggaaaugcu

SEQ ID NO: 1037364 - RNA, 22 nt, Human
gagagcugggaaagccguggag

SEQ ID NO: 1037365 - RNA, 22 nt, Human
aaauguguuucuuugugaaugg

SEQ ID NO: 1037366 - RNA, 22 nt, Human
aaggcacugaaaaauugugugu

SEQ ID NO: 1037367 - RNA, 22 nt, Human
auugacaauguauuuguaucug

SEQ ID NO: 1037368 - RNA, 22 nt, Human
ugcuggcuacugauggcaggcc

SEQ ID NO: 1037369 - RNA, 22 nt, Human
gaagagcuaaaggcacaggcuu

SEQ ID NO: 1037370 - RNA, 22 nt, Human
uacaaagcuguauagccugguc

SEQ ID NO: 1037371 - RNA, 22 nt, Human
aaugcaguuucauuuguagaau

SEQ ID NO: 1037372 - RNA, 22 nt, Human
uggcucuggcgugaagcccaga

SEQ ID NO: 1037373 - RNA, 23 nt, Human
ugcaggggaggcuuaaagcaggu

SEQ ID NO: 1037374 - RNA, 22 nt, Human
gagcuggcuccgccaugcugcu

SEQ ID NO: 1037375 - RNA, 22 nt, Human
ccuuuccuuuuuagugugggag

SEQ ID NO: 1037376 - RNA, 22 nt, Human
aggcucaguuugguuuccauug

SEQ ID NO: 1037377 - RNA, 22 nt, Human
ucccuggcugggggcugccuug

SEQ ID NO: 1037378 - RNA, 22 nt, Human
cuggcucucugagauauugagu

SEQ ID NO: 1037379 - RNA, 22 nt, Human
uguccugcaacugaaggagaag

SEQ ID NO: 1037380 - RNA, 21 nt, Human
ggagcugcaggagccgaaggc

SEQ ID NO: 1037381 - RNA, 22 nt, Human
agcuggcauacuuugcuaggaa

SEQ ID NO: 1037382 - RNA, 22 nt, Human
ucugucugagggagugacauuu

SEQ ID NO: 1037383 - RNA, 22 nt, Human
agaggucagaacaggaaagugu

SEQ ID NO: 1037384 - RNA, 22 nt, Human
ugggcucugcugcguaccaguu

SEQ ID NO: 1037385 - RNA, 22 nt, Human
gacuguguccaugugcuggauu

SEQ ID NO: 1037386 - RNA, 22 nt, Human
augcaucauggaaaacucaguu

SEQ ID NO: 1037387 - RNA, 17 nt, Human
agauggcaggaggcaga

SEQ ID NO: 1037388 - RNA, 22 nt, Human
uucuuacagcccuauuacuaaa

SEQ ID NO: 1037389 - RNA, 22 nt, Human
uccagccuuucuacucacugag

SEQ ID NO: 1037390 - RNA, 22 nt, Human
agcacagguacggagaugcuac

SEQ ID NO: 1037391 - RNA, 22 nt, Human
ccacagaggacaacugccuggc

SEQ ID NO: 1037392 - RNA, 22 nt, Human
gccuggagggauagaaugcaag

SEQ ID NO: 1037393 - RNA, 22 nt, Human
cuggcucaccuccgcuccagca

SEQ ID NO: 1037394 - RNA, 22 nt, Human
ggagacagugacuuagagacug

SEQ ID NO: 1037395 - RNA, 20 nt, Human
ccucucugaagaggucaucu

SEQ ID NO: 1037396 - RNA, 22 nt, Human
guggagaccuccuaggaugugu

SEQ ID NO: 1037397 - RNA, 22 nt, Human
agucccuguacuuuccacugcc

SEQ ID NO: 1037398 - RNA, 22 nt, Human
cagcauggagacaaagugggca

SEQ ID NO: 1037399 - RNA, 22 nt, Human
uggccucaagucugagggccuu

SEQ ID NO: 1037400 - RNA, 22 nt, Human
ucaaaccaccuuguuacugggg

SEQ ID NO: 1037401 - RNA, 22 nt, Human
agaacagaagggaggaaggccu

SEQ ID NO: 1037402 - RNA, 22 nt, Human
uggcuggcaaggcuggagucag

SEQ ID NO: 1037403 - RNA, 22 nt, Human
cagaguguaucuguguaagcau

SEQ ID NO: 1037404 - RNA, 22 nt, Human
aggguagggcccggagacagac

SEQ ID NO: 1037405 - RNA, 22 nt, Human
cuuacauugugugcaugagggg

SEQ ID NO: 1037406 - RNA, 22 nt, Human
ggcugcugugaccucaggugau

SEQ ID NO: 1037407 - RNA, 22 nt, Human
ugaagcagauggucuggucauu

SEQ ID NO: 1037408 - RNA, 22 nt, Human
ggcacugauaauguccucucuc

SEQ ID NO: 1037409 - RNA, 22 nt, Human
agcaauauaaauguuggguaga

SEQ ID NO: 1037410 - RNA, 22 nt, Human
ggaaccaguggaaugauaugcu

SEQ ID NO: 1037411 - RNA, 22 nt, Human
aggucaaguuuagauagaguua

SEQ ID NO: 1037412 - RNA, 22 nt, Human
cauugcacuccagcuugggcaa

SEQ ID NO: 1037413 - RNA, 22 nt, Human
agcuucuugaccaagccuguaa

SEQ ID NO: 1037414 - RNA, 22 nt, Human
ucaaguguaguggugucagguc

SEQ ID NO: 1037415 - RNA, 22 nt, Human
guggugcaggccagcaggggcg

SEQ ID NO: 1037416 - RNA, 22 nt, Human
aaaguguugggauuacaggugu

SEQ ID NO: 1037417 - RNA, 22 nt, Human
ucugcuggccuuagcaggucua

SEQ ID NO: 1037418 - RNA, 22 nt, Human
gcccagcagcugguggagaagg

SEQ ID NO: 1037419 - RNA, 22 nt, Human
cuucuuuacuuucuagaaauaa

SEQ ID NO: 1037420 - RNA, 22 nt, Human
aggcacugagaggcuguguugc

SEQ ID NO: 1037421 - RNA, 22 nt, Human
augaccccuaaaauuuacuguc

SEQ ID NO: 1037422 - RNA, 17 nt, Human
gcucccugaggacagcu

SEQ ID NO: 1037423 - RNA, 22 nt, Human
cugaggucuagacaccccaggg

SEQ ID NO: 1037424 - RNA, 17 nt, Human
ucuguccagggagugug

SEQ ID NO: 1037425 - RNA, 22 nt, Human
aggcacugugcuucuuauaugu

SEQ ID NO: 1037426 - RNA, 22 nt, Human
uccucagggcggccuccgucuu

SEQ ID NO: 1037427 - RNA, 23 nt, Human
caugggagugagaaugccagcuc

SEQ ID NO: 1037428 - RNA, 22 nt, Human
ggcuggaaguccaagaucaagg

SEQ ID NO: 1037429 - RNA, 21 nt, Human
gccugccugcgugacccucuu

SEQ ID NO: 1037430 - RNA, 22 nt, Human
uacauuaucuuguuaucuuuca

SEQ ID NO: 1037431 - RNA, 21 nt, Human
gcugucucuggcuccugggaa

SEQ ID NO: 1037432 - RNA, 20 nt, Human
uguuccaugacuauuuggau

SEQ ID NO: 1037433 - RNA, 22 nt, Human
cugggccauggaagucucugcc

SEQ ID NO: 1037434 - RNA, 22 nt, Human
accugccuaucagcugccugcu

SEQ ID NO: 1037435 - RNA, 22 nt, Human
ggacacagcugcagccacaccc

SEQ ID NO: 1037436 - RNA, 21 nt, Human
agcucagccgggcacaguggc

SEQ ID NO: 1037437 - RNA, 22 nt, Human
gcucagagauguucaguagcuu

SEQ ID NO: 1037438 - RNA, 22 nt, Human
ugucucagauacgccaucaagg

SEQ ID NO: 1037439 - RNA, 22 nt, Human
cagcugccccgcuggcugacca

SEQ ID NO: 1037440 - RNA, 22 nt, Human
uggggcuguccuuagucugaga

SEQ ID NO: 1037441 - RNA, 22 nt, Human
gccuggagugcaguggcgugau

SEQ ID NO: 1037442 - RNA, 22 nt, Human
ggucccagguugacagggagac

SEQ ID NO: 1037443 - RNA, 22 nt, Human
gccuggcugagguggggaggca

SEQ ID NO: 1037444 - RNA, 22 nt, Human
ugggcucuccuggaggacaaca

SEQ ID NO: 1037445 - RNA, 20 nt, Human
ccugccuguguuugugauga

SEQ ID NO: 1037446 - RNA, 22 nt, Human
aggccuggguguucaccagaag

SEQ ID NO: 1037447 - RNA, 22 nt, Human
aaagaaauagauggcauuuaaa

SEQ ID NO: 1037448 - RNA, 20 nt, Human
gcugggggugugcugaguga

SEQ ID NO: 1037449 - RNA, 22 nt, Human
ccagggcaucacauccaguguu

SEQ ID NO: 1037450 - RNA, 22 nt, Human
cauggacucugguuuggggagc

SEQ ID NO: 1037451 - RNA, 22 nt, Human
cuguccuggagggcauaggacg

SEQ ID NO: 1037452 - RNA, 22 nt, Human
aaacuuuaagacaguccucaag

SEQ ID NO: 1037453 - RNA, 22 nt, Human
gaaggagagggucaaggauaau

SEQ ID NO: 1037454 - RNA, 22 nt, Human
gccagccugugcuuggccaggc

SEQ ID NO: 1037455 - RNA, 19 nt, Human
cucuggccucuggaugcug

SEQ ID NO: 1037456 - RNA, 22 nt, Human
gaugguuugguaaaaguauguu

SEQ ID NO: 1037457 - RNA, 22 nt, Human
ggcacugagaggcucuuccuaa

SEQ ID NO: 1037458 - RNA, 22 nt, Human
aucuggcucacuuagucuagga

SEQ ID NO: 1037459 - RNA, 19 nt, Human
cagcugcaccgugaccauc

SEQ ID NO: 1037460 - RNA, 22 nt, Human
cugggagcugucaggagcgugu

SEQ ID NO: 1037461 - RNA, 22 nt, Human
ggcugcucuucuuggcgaccuc

SEQ ID NO: 1037462 - RNA, 22 nt, Human
caggcacuucugcugcuugucu

SEQ ID NO: 1037463 - RNA, 22 nt, Human
agugcacagcgugauguauugg

SEQ ID NO: 1037464 - RNA, 22 nt, Human
acuuccuggcugggugaccugg

SEQ ID NO: 1037465 - RNA, 22 nt, Human
agagccugcaucaggcuugggg

SEQ ID NO: 1037466 - RNA, 22 nt, Human
gccuaauaugcaaaauugauac

SEQ ID NO: 1037467 - RNA, 22 nt, Human
gcacaugagcugcugggauggg

SEQ ID NO: 1037468 - RNA, 21 nt, Human
ggagucagggucuggcugggg

SEQ ID NO: 1037469 - RNA, 22 nt, Human
cacagcuuguuuagugacucac

SEQ ID NO: 1037470 - RNA, 22 nt, Human
ggcugaaguguaguggcucacu

SEQ ID NO: 1037471 - RNA, 22 nt, Human
ggcuccucucuggccgcucccg

SEQ ID NO: 1037472 - RNA, 22 nt, Human
cucacaggcaucucaucaggcu

SEQ ID NO: 1037473 - RNA, 22 nt, Human
aggucccaggcauagcuggucu

SEQ ID NO: 1037474 - RNA, 22 nt, Human
uggcucaguuaggucagaaaca

SEQ ID NO: 1037475 - RNA, 22 nt, Human
ggcuuucuagaucuagcucugu

SEQ ID NO: 1037476 - RNA, 20 nt, Human
ccagagcugauggcugcccg

SEQ ID NO: 1037477 - RNA, 22 nt, Human
ucuuuccuagaggcugaugagu

SEQ ID NO: 1037478 - RNA, 22 nt, Human
gggcuacagacaugcucuaagc

SEQ ID NO: 1037479 - RNA, 22 nt, Human
aaggcagagggcuggaucagag

SEQ ID NO: 1037480 - RNA, 22 nt, Human
uggcagcugucuguggggucuc

SEQ ID NO: 1037481 - RNA, 22 nt, Human
cacaggggcaaacuguagggga

SEQ ID NO: 1037482 - RNA, 22 nt, Human
caggucccgccccgggcugacc

SEQ ID NO: 1037483 - RNA, 22 nt, Human
agucucugagguucagaugccu

SEQ ID NO: 1037484 - RNA, 22 nt, Human
cugcccugggauggucugugcg

SEQ ID NO: 1037485 - RNA, 22 nt, Human
auggggcucugcggcugcuccc

SEQ ID NO: 1037486 - RNA, 22 nt, Human
aaaucaguuggaacacaagcag

SEQ ID NO: 1037487 - RNA, 22 nt, Human
gcuggugagcaaaggagaagga

SEQ ID NO: 1037488 - RNA, 19 nt, Human
ucgagucaagacacuaggc

SEQ ID NO: 1037489 - RNA, 22 nt, Human
agucccagacuccaguuuucug

SEQ ID NO: 1037490 - RNA, 22 nt, Human
agaacagcagcacgucaagcug

SEQ ID NO: 1037491 - RNA, 21 nt, Human
agcugcuccagggagcucagg

SEQ ID NO: 1037492 - RNA, 22 nt, Human
ucaaaugcuucuacuccuaaga

SEQ ID NO: 1037493 - RNA, 22 nt, Human
cugagagucagcuucuccuccu

SEQ ID NO: 1037494 - RNA, 22 nt, Human
aaggcacugacugugcagggga

SEQ ID NO: 1037495 - RNA, 22 nt, Human
cacagggccacuuucccaguaa

SEQ ID NO: 1037496 - RNA, 22 nt, Human
ccagggagccuggugugucagc

SEQ ID NO: 1037497 - RNA, 22 nt, Human
cagagccagcccacuguucccg

SEQ ID NO: 1037498 - RNA, 22 nt, Human
gcucugggauuaccagccuuag

SEQ ID NO: 1037499 - RNA, 19 nt, Human
aggugaugugacucuagaa

SEQ ID NO: 1037500 - RNA, 22 nt, Human
ugagccagccuugcagcugugc

SEQ ID NO: 1037501 - RNA, 22 nt, Human
ccugugcccucagccuggcucu

SEQ ID NO: 1037502 - RNA, 22 nt, Human
agcaccuguggcucaugcucgu

SEQ ID NO: 1037503 - RNA, 22 nt, Human
aggagccccucuucaguccugg

SEQ ID NO: 1037504 - RNA, 22 nt, Human
agucccagagaggucggggcca

SEQ ID NO: 1037505 - RNA, 22 nt, Human
uccuccagugucuggggccuug

SEQ ID NO: 1037506 - RNA, 22 nt, Human
aagucacacuagacaacugagg

SEQ ID NO: 1037507 - RNA, 22 nt, Human
uggcucaguggcagccgcagcu

SEQ ID NO: 1037508 - RNA, 22 nt, Human
gucccucugugucccugcaguc

SEQ ID NO: 1037509 - RNA, 22 nt, Human
ugcugccagccaggccauggag

SEQ ID NO: 1037510 - RNA, 22 nt, Human
cugggaguugacgaggcuugua

SEQ ID NO: 1037511 - RNA, 22 nt, Human
agcagcuguggaaaaguaacua

SEQ ID NO: 1037512 - RNA, 22 nt, Human
aguggcaguagaugagcugguu

SEQ ID NO: 1037513 - RNA, 22 nt, Human
ugggaggacuugugggcuucau

SEQ ID NO: 1037514 - RNA, 22 nt, Human
agcaugcacaugacuggcuuaa

SEQ ID NO: 1037515 - RNA, 22 nt, Human
ucacauuuuccuugguaucugu

SEQ ID NO: 1037516 - RNA, 22 nt, Human
gcuggcagaagagcugguucaa

SEQ ID NO: 1037517 - RNA, 21 nt, Human
auuauuauuucuguguccagc

SEQ ID NO: 1037518 - RNA, 22 nt, Human
cccuggaguagcacugggucgc

SEQ ID NO: 1037519 - RNA, 22 nt, Human
gugcuucucuucacacccaacu

SEQ ID NO: 1037520 - RNA, 22 nt, Human
gcuggcuguguuucaucucuga

SEQ ID NO: 1037521 - RNA, 22 nt, Human
aggcaagggggcgccaccuucc

SEQ ID NO: 1037522 - RNA, 22 nt, Human
acuuccugggcaugcagagucc

SEQ ID NO: 1037523 - RNA, 22 nt, Human
ugaggccaaugacccugggcag

SEQ ID NO: 1037524 - RNA, 22 nt, Human
cucagggggaaucaggucacag

SEQ ID NO: 1037525 - RNA, 21 nt, Human
uggcucuguucaauauaugga

SEQ ID NO: 1037526 - RNA, 22 nt, Human
ucucagaguaauucuuuaaggu

SEQ ID NO: 1037527 - RNA, 22 nt, Human
uggcucagcugucacagccugg

SEQ ID NO: 1037528 - RNA, 22 nt, Human
agaaugcuccagagcugaaaga

SEQ ID NO: 1037529 - RNA, 22 nt, Human
ccagcccugaacccugcugcau

SEQ ID NO: 1037530 - RNA, 22 nt, Human
cuuuauguucaguacaaugcuu

SEQ ID NO: 1037531 - RNA, 22 nt, Human
gggccacauugaagggugggua

SEQ ID NO: 1037532 - RNA, 22 nt, Human
ugaaguccuagaacuccuggua

SEQ ID NO: 1037533 - RNA, 20 nt, Human
aagagaagaagucuuugaaa

SEQ ID NO: 1037534 - RNA, 22 nt, Human
uugucugaaagaucauuacauu

SEQ ID NO: 1037535 - RNA, 22 nt, Human
auguguauacuugugcuuacuc

SEQ ID NO: 1037536 - RNA, 22 nt, Human
caaaguauauuggauugaaugg

SEQ ID NO: 1037537 - RNA, 22 nt, Human
ccuuagagaguacugggcugcc

SEQ ID NO: 1037538 - RNA, 22 nt, Human
ggcacugacugugcagcgcacc

SEQ ID NO: 1037539 - RNA, 22 nt, Human
augugucaauuuucaaaugcuu

SEQ ID NO: 1037540 - RNA, 22 nt, Human
uagccggguguugugucaugca

SEQ ID NO: 1037541 - RNA, 22 nt, Human
agaucucaccucuguguauuau

SEQ ID NO: 1037542 - RNA, 22 nt, Human
agccuggauccauguggcuacc

SEQ ID NO: 1037543 - RNA, 22 nt, Human
uaaauuguuuucuagaaguugu

SEQ ID NO: 1037544 - RNA, 22 nt, Human
ggaugcaggacggcauggaugu

SEQ ID NO: 1037545 - RNA, 22 nt, Human
ugccuuggugcuucuucaugug

SEQ ID NO: 1037546 - RNA, 22 nt, Human
agagcuggaaucagaccucagg

SEQ ID NO: 1037547 - RNA, 22 nt, Human
ccacagggccuuuccugcuggc

SEQ ID NO: 1037548 - RNA, 22 nt, Human
gccuggagcuacuggacacuga

SEQ ID NO: 1037549 - RNA, 22 nt, Human
gagggcagugaauuuugaagcu

SEQ ID NO: 1037550 - RNA, 22 nt, Human
aggugagugugacugcaagaga

SEQ ID NO: 1037551 - RNA, 22 nt, Human
agcucucaagauaagaaagaac

SEQ ID NO: 1037552 - RNA, 22 nt, Human
cugcuggggucagagcacuggg

SEQ ID NO: 1037553 - RNA, 22 nt, Human
aauuucaagucuugaagaagua

SEQ ID NO: 1037554 - RNA, 22 nt, Human
cagagguaccagcagccucugg

SEQ ID NO: 1037555 - RNA, 22 nt, Human
agcagccagaaagggcagucga

SEQ ID NO: 1037556 - RNA, 22 nt, Human
ucaggcagaggauggggagcgu

SEQ ID NO: 1037557 - RNA, 22 nt, Human
agggagccagaguugggagcuc

SEQ ID NO: 1037558 - RNA, 22 nt, Human
cugguccuugacgcgugggagg

SEQ ID NO: 1037559 - RNA, 22 nt, Human
ggagucccagcaaagccuuccc

SEQ ID NO: 1037560 - RNA, 22 nt, Human
uaaagcaggccacauaugugau

SEQ ID NO: 1037561 - RNA, 22 nt, Human
uuuggaaaguugucacuuuaga

SEQ ID NO: 1037562 - RNA, 22 nt, Human
aggggacacggcuucuccaggg

SEQ ID NO: 1037563 - RNA, 22 nt, Human
aaacaaguguaaacuagucugu

SEQ ID NO: 1037564 - RNA, 22 nt, Human
agcugccacaugcccaagggca

SEQ ID NO: 1037565 - RNA, 22 nt, Human
aauguacaauaagacaaagagg

SEQ ID NO: 1037566 - RNA, 22 nt, Human
uuuugaaagaguccugcuacag

SEQ ID NO: 1037567 - RNA, 22 nt, Human
acacagaaccucauagccucuc

SEQ ID NO: 1037568 - RNA, 22 nt, Human
ccucagagaaagguauggcuga

SEQ ID NO: 1037569 - RNA, 22 nt, Human
gggcugcugccaccagguggau

SEQ ID NO: 1037570 - RNA, 22 nt, Human
agcucccagcagagcuggccac

SEQ ID NO: 1037571 - RNA, 22 nt, Human
gcucccaccaggcagaccuacc

SEQ ID NO: 1037572 - RNA, 22 nt, Human
ccuggcaggcuggggacagugc

SEQ ID NO: 1037573 - RNA, 22 nt, Human
aggccuguuggcgugggcucua

SEQ ID NO: 1037574 - RNA, 22 nt, Human
aggagccaagauggggcaagua

SEQ ID NO: 1037575 - RNA, 22 nt, Human
agggaaggaaaagcugucgcuu

SEQ ID NO: 1037576 - RNA, 22 nt, Human
gcacagaagagcuuuggaauga

SEQ ID NO: 1037577 - RNA, 22 nt, Human
gacagguggggaaacuaaggua

SEQ ID NO: 1037578 - RNA, 21 nt, Human
cagaggcagguccugggacgg

SEQ ID NO: 1037579 - RNA, 21 nt, Human
ccagaggccucucuuggccac

SEQ ID NO: 1037580 - RNA, 22 nt, Human
ugcugcauuuaucuucucaaac

SEQ ID NO: 1037581 - RNA, 22 nt, Human
ccuggagcucacugggagccgg

SEQ ID NO: 1037582 - RNA, 22 nt, Human
ggguggggcccaggaaaucuau

SEQ ID NO: 1037583 - RNA, 22 nt, Human
ggcucugcccagaugaagagga

SEQ ID NO: 1037584 - RNA, 22 nt, Human
ggggcagaguagcuggggugug

SEQ ID NO: 1037585 - RNA, 22 nt, Human
auggggugagacuaggauuaaa

SEQ ID NO: 1037586 - RNA, 22 nt, Human
gagcagcugcagugcagacccu

SEQ ID NO: 1037587 - RNA, 22 nt, Human
cucugagcugaaacaugagcau

SEQ ID NO: 1037588 - RNA, 22 nt, Human
cugccuguuuucugauagauuu

SEQ ID NO: 1037589 - RNA, 22 nt, Human
uggagcugagagccaggcuggc

SEQ ID NO: 1037590 - RNA, 20 nt, Human
aggcugggguguuuugccca

SEQ ID NO: 1037591 - RNA, 22 nt, Human
ccugggcagggcuggacucuca

SEQ ID NO: 1037592 - RNA, 22 nt, Human
augaagauaagaccaggcugga

SEQ ID NO: 1037593 - RNA, 22 nt, Human
gcagcugauggaaguccuauug

SEQ ID NO: 1037594 - RNA, 22 nt, Human
ucccugcucagcucaccuggca

SEQ ID NO: 1037595 - RNA, 22 nt, Human
gcucugcugucuucuugcaggc

SEQ ID NO: 1037596 - RNA, 22 nt, Human
acacugaauguuuaagaacuug

SEQ ID NO: 1037597 - RNA, 22 nt, Human
gcugcucuggcucugcaguguc

SEQ ID NO: 1037598 - RNA, 20 nt, Human
cagagccaagagcagcaucu

SEQ ID NO: 1037599 - RNA, 22 nt, Human
agcugagcugcagaugacugua

SEQ ID NO: 1037600 - RNA, 22 nt, Human
agcuggcuccagaaggagucgu

SEQ ID NO: 1037601 - RNA, 22 nt, Human
uggccucuggcugaggacuaac

SEQ ID NO: 1037602 - RNA, 22 nt, Human
uuuguaaagucuguucugaguu

SEQ ID NO: 1037603 - RNA, 22 nt, Human
cacagcagaaaguguaggagga

SEQ ID NO: 1037604 - RNA, 20 nt, Human
cacaagagaauacacacugg

SEQ ID NO: 1037605 - RNA, 20 nt, Human
acauguacuaaugaauacag

SEQ ID NO: 1037606 - RNA, 22 nt, Human
aaaguucaugguguuauagaaa

SEQ ID NO: 1037607 - RNA, 22 nt, Human
ucagagcuaaggggagagcaaa

SEQ ID NO: 1037608 - RNA, 22 nt, Human
agggagcugcucugcuuccgug

SEQ ID NO: 1037609 - RNA, 22 nt, Human
cucacugcaaguuccaccuacc

SEQ ID NO: 1037610 - RNA, 20 nt, Human
cccaggagugagcagcuuua

SEQ ID NO: 1037611 - RNA, 22 nt, Human
uuucaaauggagucgugaaaug

SEQ ID NO: 1037612 - RNA, 22 nt, Human
acagggcagagaggcaggcuug

SEQ ID NO: 1037613 - RNA, 22 nt, Human
uuuccucugggcccugccaccc

SEQ ID NO: 1037614 - RNA, 22 nt, Human
gcucucuggaggccauggacag

SEQ ID NO: 1037615 - RNA, 22 nt, Human
aacagaaaagguagguggcuuu

SEQ ID NO: 1037616 - RNA, 22 nt, Human
uauugacaauaggcaacugagg

SEQ ID NO: 1037617 - RNA, 22 nt, Human
augaagcugaccuugucuugcu

SEQ ID NO: 1037618 - RNA, 20 nt, Human
cagcugccuggcucugggau

SEQ ID NO: 1037619 - RNA, 22 nt, Human
uagcagagcagggaucagagcc

SEQ ID NO: 1037620 - RNA, 22 nt, Human
aguuuuucugcuggucucacua

SEQ ID NO: 1037621 - RNA, 20 nt, Human
uaggcagagcugugcagccu

SEQ ID NO: 1037622 - RNA, 22 nt, Human
uggcagcacuugaacuugagcc

SEQ ID NO: 1037623 - RNA, 22 nt, Human
aggcuccuugcucacaggcuca

SEQ ID NO: 1037624 - RNA, 22 nt, Human
auccuugagccuuaucuuuugu

SEQ ID NO: 1037625 - RNA, 22 nt, Human
cugugcccuggccaggccucuc

SEQ ID NO: 1037626 - RNA, 22 nt, Human
ugccucagagugggcuugcuau

SEQ ID NO: 1037627 - RNA, 23 nt, Human
ucuggcuccauccuuggggaucc

SEQ ID NO: 1037628 - RNA, 22 nt, Human
gggcuccagcccgggaccaggu

SEQ ID NO: 1037629 - RNA, 20 nt, Human
agugcaagaaagcacagcug

SEQ ID NO: 1037630 - RNA, 22 nt, Human
cccugagaugccucacccuagu

SEQ ID NO: 1037631 - RNA, 18 nt, Human
ugacucacccugucagug

SEQ ID NO: 1037632 - RNA, 22 nt, Human
ccacugggcguuucuguccaau

SEQ ID NO: 1037633 - RNA, 22 nt, Human
cugugucccaguaccuugggua

SEQ ID NO: 1037634 - RNA, 22 nt, Human
ccuuuuucccuggagggacagc

SEQ ID NO: 1037635 - RNA, 22 nt, Human
aggcucugaucagguggcugug

SEQ ID NO: 1037636 - RNA, 22 nt, Human
gcugucuugcucacucuugcag

SEQ ID NO: 1037637 - RNA, 22 nt, Human
acuuuggaucugauguaaucag

SEQ ID NO: 1037638 - RNA, 22 nt, Human
ccagcccuucccaacuggccag

SEQ ID NO: 1037639 - RNA, 22 nt, Human
gcaggccuuggcaaugagccug

SEQ ID NO: 1037640 - RNA, 22 nt, Human
gcaaaugcucuccuuggucagg

SEQ ID NO: 1037641 - RNA, 22 nt, Human
uuuucauuuuuguagaugcaag

SEQ ID NO: 1037642 - RNA, 22 nt, Human
gcugccuccugaaagcgcucug

SEQ ID NO: 1037643 - RNA, 22 nt, Human
gggcugugcugaguaggaggug

SEQ ID NO: 1037644 - RNA, 22 nt, Human
cugcagagaauuguggggcuuc

SEQ ID NO: 1037645 - RNA, 22 nt, Human
gagggcugccacguugggcgag

SEQ ID NO: 1037646 - RNA, 22 nt, Human
ggacucagcagccaggaguggc

SEQ ID NO: 1037647 - RNA, 22 nt, Human
ugccucagucuaaagucucuca

SEQ ID NO: 1037648 - RNA, 22 nt, Human
caccaggcugaaccagagggga

SEQ ID NO: 1037649 - RNA, 22 nt, Human
ucaugacaacuauauuauucca

SEQ ID NO: 1037650 - RNA, 22 nt, Human
gcugggagccccgagccagcgc

SEQ ID NO: 1037651 - RNA, 22 nt, Human
caggauggucagaugcauuguc

SEQ ID NO: 1037652 - RNA, 22 nt, Human
guauuugauacaugaaauggug

SEQ ID NO: 1037653 - RNA, 22 nt, Human
cccaggagagaggccaguuggc

SEQ ID NO: 1037654 - RNA, 22 nt, Human
ccagcucuuggugcacuuacau

SEQ ID NO: 1037655 - RNA, 22 nt, Human
cagcagugucuccagcaucaca

SEQ ID NO: 1037656 - RNA, 22 nt, Human
uccucaggugacuagguaucuu

SEQ ID NO: 1037657 - RNA, 22 nt, Human
cugugcuggagaugggccagag

SEQ ID NO: 1037658 - RNA, 22 nt, Human
uaaggcacccuucugaguagag

SEQ ID NO: 1037659 - RNA, 22 nt, Human
ccugggugacccgugagcgucc

SEQ ID NO: 1037660 - RNA, 22 nt, Human
cagguggcaugacugccuacaa

SEQ ID NO: 1037661 - RNA, 22 nt, Human
cccaucaggaacccaggagccc

SEQ ID NO: 1037662 - RNA, 22 nt, Human
uuuauuauguacaggcacuaua

SEQ ID NO: 1037663 - RNA, 23 nt, Human
agcccagcagagaaccuaggucc

SEQ ID NO: 1037664 - RNA, 22 nt, Human
aaggccugggaggccucucuuc

SEQ ID NO: 1037665 - RNA, 20 nt, Human
gcugaccccugcugucaugc

SEQ ID NO: 1037666 - RNA, 22 nt, Human
ggccucggcccacugcugcggu

SEQ ID NO: 1037667 - RNA, 22 nt, Human
ccagaggucuccugcacgggau

SEQ ID NO: 1037668 - RNA, 22 nt, Human
ggcagagcuugcagugagccga

SEQ ID NO: 1037669 - RNA, 22 nt, Human
cucagaguccauaguuuacagu

SEQ ID NO: 1037670 - RNA, 22 nt, Human
gggcagcucuggcugugggaag

SEQ ID NO: 1037671 - RNA, 22 nt, Human
agggccucugacgcccccagcc

SEQ ID NO: 1037672 - RNA, 16 nt, Human
gagggcagaggcggaa

SEQ ID NO: 1037673 - RNA, 22 nt, Human
gcuaccugagcaagagcuucaa

SEQ ID NO: 1037674 - RNA, 22 nt, Human
agccucucuguuagucacuggg

SEQ ID NO: 1037675 - RNA, 22 nt, Human
gaagcagcaaguauaggacagg

SEQ ID NO: 1037676 - RNA, 22 nt, Human
gaggcaggcacuguuaucagca

SEQ ID NO: 1037677 - RNA, 22 nt, Human
ucugggagacguguguugucag

SEQ ID NO: 1037678 - RNA, 22 nt, Human
gagucaguaauggauaugucau

SEQ ID NO: 1037679 - RNA, 22 nt, Human
cagaagcauugacuccuugcuc

SEQ ID NO: 1037680 - RNA, 22 nt, Human
gcuggcucuucaguggagauag

SEQ ID NO: 1037681 - RNA, 20 nt, Human
ucacauccucucccaacaug

SEQ ID NO: 1037682 - RNA, 22 nt, Human
agcagacaacccagaugaccca

SEQ ID NO: 1037683 - RNA, 22 nt, Human
gccuggagcccaguguggggcu

SEQ ID NO: 1037684 - RNA, 22 nt, Human
agagaaaagaguucaggcuuug

SEQ ID NO: 1037685 - RNA, 22 nt, Human
ugcuagaauaccuaccuggagg

SEQ ID NO: 1037686 - RNA, 20 nt, Human
ggcagagcuaugucuguugc

SEQ ID NO: 1037687 - RNA, 22 nt, Human
aguguuccuugcuuucccagag

SEQ ID NO: 1037688 - RNA, 22 nt, Human
gcugcucuccauggccgugagu

SEQ ID NO: 1037689 - RNA, 18 nt, Human
gaagggagcuggaaugca

SEQ ID NO: 1037690 - RNA, 19 nt, Human
gcauaaaaugucaaugugu

SEQ ID NO: 1037691 - RNA, 22 nt, Human
uccagggagauacuggcugcca

SEQ ID NO: 1037692 - RNA, 22 nt, Human
uuacauuagacccacuuucaug

SEQ ID NO: 1037693 - RNA, 22 nt, Human
ggcuucuguccucuggaucugu

SEQ ID NO: 1037694 - RNA, 22 nt, Human
caguauuuauggcuugaguauu

SEQ ID NO: 1037695 - RNA, 22 nt, Human
aaggcucucugauggcagcagu

SEQ ID NO: 1037696 - RNA, 22 nt, Human
aggaaaaagaguugcugccuuc

SEQ ID NO: 1037697 - RNA, 18 nt, Human
ccuggcagccaugcgcgc

SEQ ID NO: 1037698 - RNA, 22 nt, Human
cacugcauggaugauggcugua

SEQ ID NO: 1037699 - RNA, 22 nt, Human
ugacccugcuucuuggugcagg

SEQ ID NO: 1037700 - RNA, 21 nt, Human
acagggcaugcagcuggcugu

SEQ ID NO: 1037701 - RNA, 22 nt, Human
ccagggugagaaaaggcuggau

SEQ ID NO: 1037702 - RNA, 22 nt, Human
ucaggggcugugcauuucccag

SEQ ID NO: 1037703 - RNA, 22 nt, Human
cugcccugucuuuuucugauga

SEQ ID NO: 1037704 - RNA, 22 nt, Human
uccuucagccaugggcucucca

SEQ ID NO: 1037705 - RNA, 22 nt, Human
aguguauugauuggaacagccu

SEQ ID NO: 1037706 - RNA, 22 nt, Human
ggucccaggagaauaggugcaa

SEQ ID NO: 1037707 - RNA, 22 nt, Human
gaggaugugucuggucugggca

SEQ ID NO: 1037708 - RNA, 22 nt, Human
ccaggagcagggcuggcugcac

SEQ ID NO: 1037709 - RNA, 20 nt, Human
agugccagggcaggugagag

SEQ ID NO: 1037710 - RNA, 22 nt, Human
uggcuuccacugugugcccccu

SEQ ID NO: 1037711 - RNA, 22 nt, Human
uggcuuccugcacagugucugc

SEQ ID NO: 1037712 - RNA, 22 nt, Human
aagcacaaugaacaucuuagau

SEQ ID NO: 1037713 - RNA, 22 nt, Human
acugggccuggauuggcguguc

SEQ ID NO: 1037714 - RNA, 22 nt, Human
uauuuagaacagacaauagaaa

SEQ ID NO: 1037715 - RNA, 22 nt, Human
uggguaaacugggucuggagag

SEQ ID NO: 1037716 - RNA, 22 nt, Human
aauguguguucggggcccagag

SEQ ID NO: 1037717 - RNA, 22 nt, Human
ccugggaggcugugggucugcu

SEQ ID NO: 1037718 - RNA, 22 nt, Human
uguggccagcagguggcugugu

SEQ ID NO: 1037719 - RNA, 22 nt, Human
gagcagaugugugccaggaugc

SEQ ID NO: 1037720 - RNA, 17 nt, Human
gagugcugguggagcuc

SEQ ID NO: 1037721 - RNA, 22 nt, Human
ugacacauuaaaugcucacaaa

SEQ ID NO: 1037722 - RNA, 22 nt, Human
aggguggagggagucccugagc

SEQ ID NO: 1037723 - RNA, 22 nt, Human
ccucucucuccugcacacacac

SEQ ID NO: 1037724 - RNA, 22 nt, Human
gcucucugccauaugaggauac

SEQ ID NO: 1037725 - RNA, 22 nt, Human
uccagggagauggcagaggcug

SEQ ID NO: 1037726 - RNA, 22 nt, Human
guuauguauugggaaauccaag

SEQ ID NO: 1037727 - RNA, 23 nt, Human
gccucagagaaacagcugcacac

SEQ ID NO: 1037728 - RNA, 22 nt, Human
ugugccuggaucucugugacaa

SEQ ID NO: 1037729 - RNA, 22 nt, Human
cugcagaguggagccucggcug

SEQ ID NO: 1037730 - RNA, 22 nt, Human
guucauuuuacuguaaauagca

SEQ ID NO: 1037731 - RNA, 22 nt, Human
guccucaggaaagcagauaaca

SEQ ID NO: 1037732 - RNA, 22 nt, Human
agcccaugcaacaggccuagcg

SEQ ID NO: 1037733 - RNA, 22 nt, Human
cauuuacagugagaguuuuuac

SEQ ID NO: 1037734 - RNA, 22 nt, Human
uaacagaaacagauaaguguaa

SEQ ID NO: 1037735 - RNA, 22 nt, Human
ugaagcugugggcaguggagcc

SEQ ID NO: 1037736 - RNA, 23 nt, Human
ccucagcauggcaggagcccagc

SEQ ID NO: 1037737 - RNA, 22 nt, Human
guaucuuuugguggaaaaauaa

SEQ ID NO: 1037738 - RNA, 22 nt, Human
acagggcaugugcaagagacau

SEQ ID NO: 1037739 - RNA, 22 nt, Human
uccuuugacuucuugcagucca

SEQ ID NO: 1037740 - RNA, 22 nt, Human
agagccagcaagugaauaguga

SEQ ID NO: 1037741 - RNA, 22 nt, Human
ccuggcugggguagaagugagg

SEQ ID NO: 1037742 - RNA, 22 nt, Human
ccagcucccugaagccuggucu

SEQ ID NO: 1037743 - RNA, 22 nt, Human
cugcccugcuugaugacagcga

SEQ ID NO: 1037744 - RNA, 22 nt, Human
ugcccaaguguuuggcugaguc

SEQ ID NO: 1037745 - RNA, 22 nt, Human
uuucuguagggauuucacaguu

SEQ ID NO: 1037746 - RNA, 22 nt, Human
uaaacagaaagcagauguacuu

SEQ ID NO: 1037747 - RNA, 22 nt, Human
uucaggagcuggcugcgaagga

SEQ ID NO: 1037748 - RNA, 22 nt, Human
cagcccuggugccaagguuccc

SEQ ID NO: 1037749 - RNA, 22 nt, Human
gggacuggcacagggcugggag

SEQ ID NO: 1037750 - RNA, 20 nt, Human
ucugcccaccccggcuccca

SEQ ID NO: 1037751 - RNA, 17 nt, Human
uccuucagggccucaca

SEQ ID NO: 1037752 - RNA, 22 nt, Human
aaagaugucauacacauuaaga

SEQ ID NO: 1037753 - RNA, 22 nt, Human
aguaauaauuuauauuagggag

SEQ ID NO: 1037754 - RNA, 18 nt, Human
gggcucugauccuucacc

SEQ ID NO: 1037755 - RNA, 22 nt, Human
uacauguaagacaugagacucu

SEQ ID NO: 1037756 - RNA, 18 nt, Human
gggcuguguucaugccca

SEQ ID NO: 1037757 - RNA, 22 nt, Human
aaguuugagaagcuuauagaua

SEQ ID NO: 1037758 - RNA, 22 nt, Human
ucuggcccagccccugagguca

SEQ ID NO: 1037759 - RNA, 22 nt, Human
ugucagggcaugcgguccagcc

SEQ ID NO: 1037760 - RNA, 22 nt, Human
aggcagugcagaguccucuucu

SEQ ID NO: 1037761 - RNA, 22 nt, Human
agaauucuuggugguuagaaua

SEQ ID NO: 1037762 - RNA, 22 nt, Human
ugccacccagccaggaguggga

SEQ ID NO: 1037763 - RNA, 22 nt, Human
agagcagagggcucugggacaa

SEQ ID NO: 1037764 - RNA, 22 nt, Human
uggggaggacgggcgccuuccu

SEQ ID NO: 1037765 - RNA, 22 nt, Human
guaaaguucuacuagaaucaac

SEQ ID NO: 1037766 - RNA, 22 nt, Human
aaaugcacucugcuucugugac

SEQ ID NO: 1037767 - RNA, 22 nt, Human
uuucaauguaugucuuucugag

SEQ ID NO: 1037768 - RNA, 22 nt, Human
cagcuggcguggagugauugca

SEQ ID NO: 1037769 - RNA, 22 nt, Human
cagcugccacaggacuuucuga

SEQ ID NO: 1037770 - RNA, 22 nt, Human
caggauccuggcugcauggacg

SEQ ID NO: 1037771 - RNA, 22 nt, Human
gccuucugugcuccuggccuuu

SEQ ID NO: 1037772 - RNA, 22 nt, Human
cuggcagcaguuaugaaacaau

SEQ ID NO: 1037773 - RNA, 22 nt, Human
ccugggaggcagagguugcagu

SEQ ID NO: 1037774 - RNA, 22 nt, Human
gggcucuguccauuccuucaua

SEQ ID NO: 1037775 - RNA, 22 nt, Human
cugugcauugucuugucuguag

SEQ ID NO: 1037776 - RNA, 22 nt, Human
uguauagaguuggaagaugacu

SEQ ID NO: 1037777 - RNA, 22 nt, Human
uaaaugcagcaguuucuguucu

SEQ ID NO: 1037778 - RNA, 22 nt, Human
guguaucaaagcacagacuuca

SEQ ID NO: 1037779 - RNA, 20 nt, Human
cucaggauugucuagccccu

SEQ ID NO: 1037780 - RNA, 22 nt, Human
ccugccugaaggucagccaccc

SEQ ID NO: 1037781 - RNA, 22 nt, Human
gcccaggccggagagcagugcu

SEQ ID NO: 1037782 - RNA, 19 nt, Human
ugcaggaggacugagcaga

SEQ ID NO: 1037783 - RNA, 22 nt, Human
acagaguauuggaaaggcagug

SEQ ID NO: 1037784 - RNA, 22 nt, Human
agccucucuuucugguggcuaa

SEQ ID NO: 1037785 - RNA, 22 nt, Human
cuggcucaauaaauauuagcug

SEQ ID NO: 1037786 - RNA, 22 nt, Human
cuuauguacacacauauauugu

SEQ ID NO: 1037787 - RNA, 22 nt, Human
cauggccucaaaggacugcaga

SEQ ID NO: 1037788 - RNA, 22 nt, Human
ucauuacagagauauaaucuac

SEQ ID NO: 1037789 - RNA, 22 nt, Human
uagaaaucagcaggcauaugua

SEQ ID NO: 1037790 - RNA, 22 nt, Human
cuuucucugugugguaaagggc

SEQ ID NO: 1037791 - RNA, 19 nt, Human
caucuggaugauucuccug

SEQ ID NO: 1037792 - RNA, 22 nt, Human
caguacuugggaaugcugggga

SEQ ID NO: 1037793 - RNA, 22 nt, Human
aggccuggccuuuauguucaag

SEQ ID NO: 1037794 - RNA, 21 nt, Human
ugcuccuuagcugccccugcc

SEQ ID NO: 1037795 - RNA, 22 nt, Human
gcagaaggucuggcacuucagg

SEQ ID NO: 1037796 - RNA, 22 nt, Human
ucaagagauugaauaauaacug

SEQ ID NO: 1037797 - RNA, 22 nt, Human
ucccagggacucucugccuucc

SEQ ID NO: 1037798 - RNA, 22 nt, Human
cagucccagaagagccugggag

SEQ ID NO: 1037799 - RNA, 22 nt, Human
cauggcaggugcagauucugug

SEQ ID NO: 1037800 - RNA, 22 nt, Human
cucuguccuaugcuugauagaa

SEQ ID NO: 1037801 - RNA, 22 nt, Human
ugggcaggauaauaucucaugu

SEQ ID NO: 1037802 - RNA, 22 nt, Human
gauuucaaggaguuuucacagu

SEQ ID NO: 1037803 - RNA, 22 nt, Human
ggggccugcgagguucaacuuc

SEQ ID NO: 1037804 - RNA, 22 nt, Human
accaucaguacuggaugcugac

SEQ ID NO: 1037805 - RNA, 22 nt, Human
gggcuggggcucaauaauuugu

SEQ ID NO: 1037806 - RNA, 22 nt, Human
ucucagagaagugaugagcaau

SEQ ID NO: 1037807 - RNA, 22 nt, Human
ugagagucucagaccuccuggu

SEQ ID NO: 1037808 - RNA, 22 nt, Human
ccugcagaccacacucaguccu

SEQ ID NO: 1037809 - RNA, 22 nt, Human
gcucccagauuucagccuugug

SEQ ID NO: 1037810 - RNA, 22 nt, Human
ugcucugugguccaagauggcu

SEQ ID NO: 1037811 - RNA, 22 nt, Human
uauguacaugauuucauuugcu

SEQ ID NO: 1037812 - RNA, 22 nt, Human
cagacagacagccguggccacc

SEQ ID NO: 1037813 - RNA, 22 nt, Human
guggccuggaguuugauguagg

SEQ ID NO: 1037814 - RNA, 22 nt, Human
ccagagaccagaacauggggau

SEQ ID NO: 1037815 - RNA, 22 nt, Human
cucacugcccugaaguuggguu

SEQ ID NO: 1037816 - RNA, 22 nt, Human
aaaagggacuacucucagcucc

SEQ ID NO: 1037817 - RNA, 22 nt, Human
uuuucuuacugucugugauccu

SEQ ID NO: 1037818 - RNA, 20 nt, Human
uuucagugguuugugccuag

SEQ ID NO: 1037819 - RNA, 22 nt, Human
cacaggagguuaggaagugguc

SEQ ID NO: 1037820 - RNA, 22 nt, Human
gaggcugcggggaggagccugc

SEQ ID NO: 1037821 - RNA, 22 nt, Human
acuuccugcagcuucucagccc

SEQ ID NO: 1037822 - RNA, 22 nt, Human
cacauacaaugguguuauuugg

SEQ ID NO: 1037823 - RNA, 22 nt, Human
gcagggagguuugcugaccugg

SEQ ID NO: 1037824 - RNA, 22 nt, Human
agagccuugaagaucuggaaaa

SEQ ID NO: 1037825 - RNA, 22 nt, Human
agggccugagcuggcugaccuc

SEQ ID NO: 1037826 - RNA, 22 nt, Human
uccuugaagcaacgugcagaca

SEQ ID NO: 1037827 - RNA, 22 nt, Human
agguuauaugucauacugaagu

SEQ ID NO: 1037828 - RNA, 22 nt, Human
agggcugguauguccaugaaag

SEQ ID NO: 1037829 - RNA, 22 nt, Human
cugagggcaugaacauuccaua

SEQ ID NO: 1037830 - RNA, 22 nt, Human
uggaagccaggcccgcuccuaa

SEQ ID NO: 1037831 - RNA, 22 nt, Human
auugacaagcaguaugucuuag

SEQ ID NO: 1037832 - RNA, 22 nt, Human
uauugacagagggucagaagag

SEQ ID NO: 1037833 - RNA, 21 nt, Human
gcacagugccaggcacacagu

SEQ ID NO: 1037834 - RNA, 21 nt, Human
ucucuggaguuagcagagaga

SEQ ID NO: 1037835 - RNA, 22 nt, Human
ggcagcuuuuaucccugacaga

SEQ ID NO: 1037836 - RNA, 22 nt, Human
ggggcagaaguagugccccuga

SEQ ID NO: 1037837 - RNA, 22 nt, Human
ggcaggagaaaggucucuucuu

SEQ ID NO: 1037838 - RNA, 22 nt, Human
ucagccugcgucauggugacac

SEQ ID NO: 1037839 - RNA, 22 nt, Human
cagggccugccugguuccugga

SEQ ID NO: 1037840 - RNA, 22 nt, Human
ugugaugguucacugggcauga

SEQ ID NO: 1037841 - RNA, 22 nt, Human
gcucccugcacucugcagcccu

SEQ ID NO: 1037842 - RNA, 22 nt, Human
agguuuucagcuguauccugag

SEQ ID NO: 1037843 - RNA, 22 nt, Human
gccugagauucccggagccgug

SEQ ID NO: 1037844 - RNA, 23 nt, Human
acaguuauagcugugaauaacau

SEQ ID NO: 1037845 - RNA, 22 nt, Human
agaauuagucacaauuauagga

SEQ ID NO: 1037846 - RNA, 18 nt, Human
cuuguucuucucuuggcg

SEQ ID NO: 1037847 - RNA, 22 nt, Human
cugaggcuuugugugcaugccu

SEQ ID NO: 1037848 - RNA, 22 nt, Human
ugggacagagugagcuuuggcc

SEQ ID NO: 1037849 - RNA, 22 nt, Human
gcaccugggacccagaggcacc

SEQ ID NO: 1037850 - RNA, 20 nt, Human
ugggccugagccugugggcu

SEQ ID NO: 1037851 - RNA, 22 nt, Human
gaggcuggugguuaguuccauu

SEQ ID NO: 1037852 - RNA, 22 nt, Human
agccauggcgccacuagaggga

SEQ ID NO: 1037853 - RNA, 22 nt, Human
ccuuggaggacugcugcuucuu

SEQ ID NO: 1037854 - RNA, 22 nt, Human
uggaaagagguagaggaucugg

SEQ ID NO: 1037855 - RNA, 22 nt, Human
ucccagcauuaaugccugucag

SEQ ID NO: 1037856 - RNA, 22 nt, Human
ucugggugcccuuugcucuguu

SEQ ID NO: 1037857 - RNA, 22 nt, Human
uuccuguaugucagugaagagc

SEQ ID NO: 1037858 - RNA, 22 nt, Human
caugggcucuucuggacugcac

SEQ ID NO: 1037859 - RNA, 22 nt, Human
augcugagacuggagcagcugg

SEQ ID NO: 1037860 - RNA, 22 nt, Human
ugucuguaagguguuuauguua

SEQ ID NO: 1037861 - RNA, 22 nt, Human
uggggacacagagguucguugg

SEQ ID NO: 1037862 - RNA, 22 nt, Human
aguggcaggaaaguggaagaga

SEQ ID NO: 1037863 - RNA, 22 nt, Human
uagaaauguuagauguauugag

SEQ ID NO: 1037864 - RNA, 22 nt, Human
ugccaggcuaaguggaggacuu

SEQ ID NO: 1037865 - RNA, 20 nt, Human
guucucacugaucugcaggg

SEQ ID NO: 1037866 - RNA, 22 nt, Human
aagcugccuagaguugaauguc

SEQ ID NO: 1037867 - RNA, 22 nt, Human
uaggaaaagucuagauugauga

SEQ ID NO: 1037868 - RNA, 22 nt, Human
agggccugcucuaucacucuca

SEQ ID NO: 1037869 - RNA, 22 nt, Human
gaggccugguuuccagcauccu

SEQ ID NO: 1037870 - RNA, 22 nt, Human
cuggcucaguucuugguuuuca

SEQ ID NO: 1037871 - RNA, 22 nt, Human
guacaaaguggaccugauagua

SEQ ID NO: 1037872 - RNA, 22 nt, Human
ccugggagugugccaucucugu

SEQ ID NO: 1037873 - RNA, 22 nt, Human
ccuuucucuuugcugaucaugu

SEQ ID NO: 1037874 - RNA, 22 nt, Human
uagauuuccucuuccucauucc

SEQ ID NO: 1037875 - RNA, 22 nt, Human
ggcugaaacagauuucaagaca

SEQ ID NO: 1037876 - RNA, 22 nt, Human
ucagaggacaagcucccuggug

SEQ ID NO: 1037877 - RNA, 22 nt, Human
cagcucccaguggcagcuccuu

SEQ ID NO: 1037878 - RNA, 22 nt, Human
gagaggccaaaaucccugcccc

SEQ ID NO: 1037879 - RNA, 22 nt, Human
agggagcuguggucagcucagu

SEQ ID NO: 1037880 - RNA, 22 nt, Human
uaugcacauuaucuaauccauu

SEQ ID NO: 1037881 - RNA, 22 nt, Human
ucucagagauuuauggaaaacu

SEQ ID NO: 1037882 - RNA, 17 nt, Human
agcuccugcccauggcu

SEQ ID NO: 1037883 - RNA, 22 nt, Human
cagagcugugauaaauagauau

SEQ ID NO: 1037884 - RNA, 22 nt, Human
ugaagcaggguggccagauugu

SEQ ID NO: 1037885 - RNA, 22 nt, Human
auccaaagauggaaagaacuuu

SEQ ID NO: 1037886 - RNA, 23 nt, Human
ugggccuggccucccaguccagc

SEQ ID NO: 1037887 - RNA, 22 nt, Human
acagcuguggggacucuugccc

SEQ ID NO: 1037888 - RNA, 22 nt, Human
uggcccugaggggcugugcccc

SEQ ID NO: 1037889 - RNA, 22 nt, Human
ugggccuguggcuuggcucuag

SEQ ID NO: 1037890 - RNA, 22 nt, Human
aggcugccuguuccaaucuccu

SEQ ID NO: 1037891 - RNA, 22 nt, Human
gcccucagaugggaaaggaggg

SEQ ID NO: 1037892 - RNA, 22 nt, Human
aaucuggcauuugagaguagga

SEQ ID NO: 1037893 - RNA, 22 nt, Human
ucaaacuagccugacugguauu

SEQ ID NO: 1037894 - RNA, 22 nt, Human
cucugagcccgcugcagcccca

SEQ ID NO: 1037895 - RNA, 22 nt, Human
gcuuggaaguaggauugggaga

SEQ ID NO: 1037896 - RNA, 22 nt, Human
uagucuuuuuaauaaauaaugc

SEQ ID NO: 1037897 - RNA, 22 nt, Human
agccucugcuggcccuggcacu

SEQ ID NO: 1037898 - RNA, 22 nt, Human
uauaguacauggaaucuucaua

SEQ ID NO: 1037899 - RNA, 18 nt, Human
uggugaaggguggaggag

SEQ ID NO: 1037900 - RNA, 20 nt, Human
uucaggauucuagaccacac

SEQ ID NO: 1037901 - RNA, 22 nt, Human
cugggaggugcagcaaaaauca

SEQ ID NO: 1037902 - RNA, 22 nt, Human
cagggccaguucucgcagcagu

SEQ ID NO: 1037903 - RNA, 22 nt, Human
gcaaagucugcaucuggaucag

SEQ ID NO: 1037904 - RNA, 22 nt, Human
cacugcuuaguugguaaaugug

SEQ ID NO: 1037905 - RNA, 22 nt, Human
cagugcagaacacauggaaaau

SEQ ID NO: 1037906 - RNA, 22 nt, Human
cucuggaguucucaugaggaac

SEQ ID NO: 1037907 - RNA, 22 nt, Human
cugcugcauuacucuucucaag

SEQ ID NO: 1037908 - RNA, 22 nt, Human
caggugggagcgaggagcuacu

SEQ ID NO: 1037909 - RNA, 22 nt, Human
uguaaucauuacaguacaugga

SEQ ID NO: 1037910 - RNA, 22 nt, Human
gagaagcaaucaguggccaccc

SEQ ID NO: 1037911 - RNA, 22 nt, Human
gaggucaggcuugcagcagggu

SEQ ID NO: 1037912 - RNA, 22 nt, Human
caaggaaaaagcgagcucgggg

SEQ ID NO: 1037913 - RNA, 22 nt, Human
auuguacaaugccuggaacauu

SEQ ID NO: 1037914 - RNA, 22 nt, Human
uuccuuccgggcaccaggcacu

SEQ ID NO: 1037915 - RNA, 22 nt, Human
gaggcagcagggcugguuccuu

SEQ ID NO: 1037916 - RNA, 22 nt, Human
caguggguggcuaaguggcuga

SEQ ID NO: 1037917 - RNA, 22 nt, Human
augcuauacucaaagaaauuca

SEQ ID NO: 1037918 - RNA, 22 nt, Human
cugccuggccugaucuccacgc

SEQ ID NO: 1037919 - RNA, 21 nt, Human
aagccucaagcagaagacaga

SEQ ID NO: 1037920 - RNA, 22 nt, Human
cagcccaggccgacaguuccuc

SEQ ID NO: 1037921 - RNA, 21 nt, Human
ccuggcagaagccugauaugc

SEQ ID NO: 1037922 - RNA, 22 nt, Human
ucaauuaugccauugcaauauu

SEQ ID NO: 1037923 - RNA, 22 nt, Human
cugggguggugcaggccucaug

SEQ ID NO: 1037924 - RNA, 22 nt, Human
ugcaccauuaauuuaugugaga

SEQ ID NO: 1037925 - RNA, 22 nt, Human
gucugagaaucuugcauaucau

SEQ ID NO: 1037926 - RNA, 22 nt, Human
gccuggcacauugcaguggauu

SEQ ID NO: 1037927 - RNA, 22 nt, Human
cugggcuacguguugacagcau

SEQ ID NO: 1037928 - RNA, 22 nt, Human
caggcagcguccugcuuccugu

SEQ ID NO: 1037929 - RNA, 22 nt, Human
ccugcacuaccuggggcugcug

SEQ ID NO: 1037930 - RNA, 22 nt, Human
uuuagaguugaguauucauugg

SEQ ID NO: 1037931 - RNA, 20 nt, Human
caccacagaauuggggacag

SEQ ID NO: 1037932 - RNA, 22 nt, Human
ucuggagccuuggaugggaaag

SEQ ID NO: 1037933 - RNA, 22 nt, Human
gcuguccagagcaugggagcaa

SEQ ID NO: 1037934 - RNA, 22 nt, Human
ggcuuccuggagaaggucugag

SEQ ID NO: 1037935 - RNA, 22 nt, Human
aucugguuuggggauccuugug

SEQ ID NO: 1037936 - RNA, 22 nt, Human
cggcagcaaaggaagccagguc

SEQ ID NO: 1037937 - RNA, 22 nt, Human
uggccuggggaccugugagacc

SEQ ID NO: 1037938 - RNA, 20 nt, Human
ucucaggccccaguuuucuu

SEQ ID NO: 1037939 - RNA, 22 nt, Human
ugaaaucugucccacuuuagcu

SEQ ID NO: 1037940 - RNA, 22 nt, Human
ucacauuuucauauucucugag

SEQ ID NO: 1037941 - RNA, 22 nt, Human
cagcugccccuccagggcuggg

SEQ ID NO: 1037942 - RNA, 22 nt, Human
gcuguauuuaacaacuggcuca

SEQ ID NO: 1037943 - RNA, 22 nt, Human
acacagggggcauucuaggagu

SEQ ID NO: 1037944 - RNA, 22 nt, Human
uugaagauggaucgccacucuc

SEQ ID NO: 1037945 - RNA, 22 nt, Human
cagcugccugcaacacaagcuu

SEQ ID NO: 1037946 - RNA, 22 nt, Human
ccagcagcgauagggugagugc

SEQ ID NO: 1037947 - RNA, 22 nt, Human
uaagauaugguaggaaguuugg

SEQ ID NO: 1037948 - RNA, 22 nt, Human
uccuggaguauuucuguggugu

SEQ ID NO: 1037949 - RNA, 22 nt, Human
uuagucuucuuccuuauauguu

SEQ ID NO: 1037950 - RNA, 22 nt, Human
ucacagugaugacgugggagca

SEQ ID NO: 1037951 - RNA, 22 nt, Human
gugcagggagcccagaaggucc

SEQ ID NO: 1037952 - RNA, 22 nt, Human
aaaagagucuuaggcagucaua

SEQ ID NO: 1037953 - RNA, 22 nt, Human
gcacagaacagagaaauagcca

SEQ ID NO: 1037954 - RNA, 20 nt, Human
accccagccccucuaucuga

SEQ ID NO: 1037955 - RNA, 22 nt, Human
ugagagugguucagcucagaag

SEQ ID NO: 1037956 - RNA, 22 nt, Human
cccuggaggcggauguugcagu

SEQ ID NO: 1037957 - RNA, 22 nt, Human
uacaguucacaguaucauaaau

SEQ ID NO: 1037958 - RNA, 22 nt, Human
aagugaguggccuggagaggug

SEQ ID NO: 1037959 - RNA, 22 nt, Human
ugggagagugcucaaugugcaa

SEQ ID NO: 1037960 - RNA, 22 nt, Human
gugccuuccccgguggucuguu

SEQ ID NO: 1037961 - RNA, 22 nt, Human
acccaggguagagugcaguggc

SEQ ID NO: 1037962 - RNA, 22 nt, Human
agcugcaguaaagcucuccagg

SEQ ID NO: 1037963 - RNA, 22 nt, Human
gaacaguaaauuuaugcagcac

SEQ ID NO: 1037964 - RNA, 18 nt, Human
uccugccugugccccagg

SEQ ID NO: 1037965 - RNA, 22 nt, Human
aagggagguaaagcuauuuaaa

SEQ ID NO: 1037966 - RNA, 18 nt, Human
ucucagaggccauccuag

SEQ ID NO: 1037967 - RNA, 22 nt, Human
acauuucugucuuagggacugu

SEQ ID NO: 1037968 - RNA, 22 nt, Human
cacagcuugggcucugacaaua

SEQ ID NO: 1037969 - RNA, 22 nt, Human
uuaaacagagucugaaauguaa

SEQ ID NO: 1037970 - RNA, 22 nt, Human
cugccucuauaggaguccacca

SEQ ID NO: 1037971 - RNA, 20 nt, Human
cugggaggucuuccaaauca

SEQ ID NO: 1037972 - RNA, 22 nt, Human
uaugcacaguuacaagaauauc

SEQ ID NO: 1037973 - RNA, 22 nt, Human
ccaaggaggccccaggucagcu

SEQ ID NO: 1037974 - RNA, 22 nt, Human
cagggcuggauccuccagacuc

SEQ ID NO: 1037975 - RNA, 22 nt, Human
uccugggcugcagggaagagca

SEQ ID NO: 1037976 - RNA, 22 nt, Human
ucaagagaaggggaaauagacu

SEQ ID NO: 1037977 - RNA, 22 nt, Human
cagcuccccaugguuccugaag

SEQ ID NO: 1037978 - RNA, 22 nt, Human
ccaggguggggcaggcccacug

SEQ ID NO: 1037979 - RNA, 22 nt, Human
uaugagaaaauaaauaucuguu

SEQ ID NO: 1037980 - RNA, 22 nt, Human
ucucagagugacaaugagaauu

SEQ ID NO: 1037981 - RNA, 21 nt, Human
agagagaaggccauauggucc

SEQ ID NO: 1037982 - RNA, 22 nt, Human
uucauucauuacgugccaggca

SEQ ID NO: 1037983 - RNA, 22 nt, Human
aguuauucauuuauucuguaca

SEQ ID NO: 1037984 - RNA, 22 nt, Human
uccuugaauggacauuacacug

SEQ ID NO: 1037985 - RNA, 22 nt, Human
guggcugcagcccagcggcacg

SEQ ID NO: 1037986 - RNA, 22 nt, Human
ugucugagugugccugggcauu

SEQ ID NO: 1037987 - RNA, 22 nt, Human
ccagcaccuugaucuuggaguu

SEQ ID NO: 1037988 - RNA, 22 nt, Human
gggcucugggauucagagcaag

SEQ ID NO: 1037989 - RNA, 22 nt, Human
gcagagcucuguucuuaucucc

SEQ ID NO: 1037990 - RNA, 22 nt, Human
acaggcagcacuaaucucuggu

SEQ ID NO: 1037991 - RNA, 22 nt, Human
gcccuuccaacccagagggcaa

SEQ ID NO: 1037992 - RNA, 22 nt, Human
ggcucaggccagaccacgacuc

SEQ ID NO: 1037993 - RNA, 22 nt, Human
gcugucaguuuuacccacagac

SEQ ID NO: 1037994 - RNA, 22 nt, Human
uagacagauuucuuguuagaca

SEQ ID NO: 1037995 - RNA, 22 nt, Human
cagucccaugagcccagaacau

SEQ ID NO: 1037996 - RNA, 22 nt, Human
cagggccuccccggcagucuuu

SEQ ID NO: 1037997 - RNA, 22 nt, Human
cugggcacuuuggggagccuac

SEQ ID NO: 1037998 - RNA, 22 nt, Human
gcugggcuugguuucccugcuu

SEQ ID NO: 1037999 - RNA, 22 nt, Human
guucucucugcuuccaagaugg

SEQ ID NO: 1038000 - RNA, 20 nt, Human
agguggcuccugcugggggu

SEQ ID NO: 1038001 - RNA, 22 nt, Human
agcagccauccuuagagaaaga

SEQ ID NO: 1038002 - RNA, 22 nt, Human
gccaggcugcuccagggaggcc

SEQ ID NO: 1038003 - RNA, 22 nt, Human
uaguccagccuuggguguagcc

SEQ ID NO: 1038004 - RNA, 17 nt, Human
ccucccacaccgcccug

SEQ ID NO: 1038005 - RNA, 22 nt, Human
ugcagaagauggucugagcacc

SEQ ID NO: 1038006 - RNA, 22 nt, Human
ggcacugacacuagcauggcac

SEQ ID NO: 1038007 - RNA, 22 nt, Human
uacauggugguggcacuugacu

SEQ ID NO: 1038008 - RNA, 22 nt, Human
uuauguacaauguuaauguaaa

SEQ ID NO: 1038009 - RNA, 22 nt, Human
aacauacagugagcaguggacu

SEQ ID NO: 1038010 - RNA, 22 nt, Human
cucacugucuguacuagcugau

SEQ ID NO: 1038011 - RNA, 22 nt, Human
cagggagggacaauugucaccu

SEQ ID NO: 1038012 - RNA, 22 nt, Human
ugcagggccagacuggguugga

SEQ ID NO: 1038013 - RNA, 23 nt, Human
ccuggcuggauucucugcauuca

SEQ ID NO: 1038014 - RNA, 22 nt, Human
uagcugugagcacccaggcugu

SEQ ID NO: 1038015 - RNA, 22 nt, Human
aggcccaguagugcugccuuua

SEQ ID NO: 1038016 - RNA, 21 nt, Human
cuggacugaggagacagucgc

SEQ ID NO: 1038017 - RNA, 22 nt, Human
uugaaagggauauaucuuucug

SEQ ID NO: 1038018 - RNA, 19 nt, Human
ccucugcgcuguccugcuc

SEQ ID NO: 1038019 - RNA, 22 nt, Human
auuuacagaugaugcuauuuga

SEQ ID NO: 1038020 - RNA, 22 nt, Human
ucucagaguuugaaucuggagu

SEQ ID NO: 1038021 - RNA, 22 nt, Human
uagauuucgcugcaucucaauc

SEQ ID NO: 1038022 - RNA, 22 nt, Human
gcucucagguacaaagcugugu

SEQ ID NO: 1038023 - RNA, 22 nt, Human
uagggcagaguccaggaugggc

SEQ ID NO: 1038024 - RNA, 22 nt, Human
ugcauuguugaauauuucauag

SEQ ID NO: 1038025 - RNA, 18 nt, Human
gccugccuagagcuugcc

SEQ ID NO: 1038026 - RNA, 22 nt, Human
agggcacaagacucugagcccc

SEQ ID NO: 1038027 - RNA, 19 nt, Human
uugguggugguuuugguuc

SEQ ID NO: 1038028 - RNA, 21 nt, Human
cacucaggguaugugccaggc

SEQ ID NO: 1038029 - RNA, 22 nt, Human
uagcagcugugaguaaaagcca

SEQ ID NO: 1038030 - RNA, 19 nt, Human
uguagcaguuuaaaacaac

SEQ ID NO: 1038031 - RNA, 22 nt, Human
cugggccaucagaggggcugga

SEQ ID NO: 1038032 - RNA, 22 nt, Human
ggagccuguuaguugagugcuc

SEQ ID NO: 1038033 - RNA, 22 nt, Human
agcagggcagugaucagaaagg

SEQ ID NO: 1038034 - RNA, 20 nt, Human
uacugggcaagcccacagac

SEQ ID NO: 1038035 - RNA, 22 nt, Human
ccagggcacuuaggcccagccc

SEQ ID NO: 1038036 - RNA, 22 nt, Human
ucaaugauaucagcaggaugug

SEQ ID NO: 1038037 - RNA, 22 nt, Human
cugaggccagcugcagagcucu

SEQ ID NO: 1038038 - RNA, 22 nt, Human
auacagaaaaugaugcagaguu

SEQ ID NO: 1038039 - RNA, 22 nt, Human
ugcugcacucaccaacagauaa

SEQ ID NO: 1038040 - RNA, 22 nt, Human
uuucauaaugucacagucaaaa

SEQ ID NO: 1038041 - RNA, 22 nt, Human
acacagggucuagaguuaggcc

SEQ ID NO: 1038042 - RNA, 22 nt, Human
cuugccuucuuuuccuauagaa

SEQ ID NO: 1038043 - RNA, 22 nt, Human
ccugggcaacauagugagaccc

SEQ ID NO: 1038044 - RNA, 22 nt, Human
gcuggucacucugggagcugcu

SEQ ID NO: 1038045 - RNA, 22 nt, Human
gcccucugcuggccucaccucg

SEQ ID NO: 1038046 - RNA, 22 nt, Human
cccucugccugggaccaagucc

SEQ ID NO: 1038047 - RNA, 22 nt, Human
ggcucaggacugcagcguagag

SEQ ID NO: 1038048 - RNA, 22 nt, Human
aaaucaguaaauguucauuaac

SEQ ID NO: 1038049 - RNA, 22 nt, Human
aaggagaaaugguagaugugca

SEQ ID NO: 1038050 - RNA, 22 nt, Human
gauggcagguaguggucucauc

SEQ ID NO: 1038051 - RNA, 17 nt, Human
ucugggcuucagugguc

SEQ ID NO: 1038052 - RNA, 21 nt, Human
ugauuuccagaaaauuggccc

SEQ ID NO: 1038053 - RNA, 22 nt, Human
ggucucagcaguugcuuugacu

SEQ ID NO: 1038054 - RNA, 20 nt, Human
uucuuucaucuacacguugu

SEQ ID NO: 1038055 - RNA, 22 nt, Human
caggccuccacuccacgcagac

SEQ ID NO: 1038056 - RNA, 22 nt, Human
cccuggagguggagguugcagg

SEQ ID NO: 1038057 - RNA, 22 nt, Human
acaagagacaagagguucuucu

SEQ ID NO: 1038058 - RNA, 19 nt, Human
gccacuccugaugcugccc

SEQ ID NO: 1038059 - RNA, 22 nt, Human
aacccuggggcagcugcuaggg

SEQ ID NO: 1038060 - RNA, 22 nt, Human
aacugcauuugcauaaguccau

SEQ ID NO: 1038061 - RNA, 22 nt, Human
agccaggaaccagcuacagucu

SEQ ID NO: 1038062 - RNA, 22 nt, Human
agcuggagaucaugcugauacu

SEQ ID NO: 1038063 - RNA, 22 nt, Human
ucucaggggccuggaguccugg

SEQ ID NO: 1038064 - RNA, 17 nt, Human
gccucugcuugugucau

SEQ ID NO: 1038065 - RNA, 22 nt, Human
acagggcagagggcaguuggua

SEQ ID NO: 1038066 - RNA, 22 nt, Human
guggcagagguuccucagugug

SEQ ID NO: 1038067 - RNA, 22 nt, Human
gcugucugagaacaugguggaa

SEQ ID NO: 1038068 - RNA, 22 nt, Human
ggcugcuucucacucauuugca

SEQ ID NO: 1038069 - RNA, 23 nt, Human
cuggcucuguagguggcauccuu

SEQ ID NO: 1038070 - RNA, 22 nt, Human
ucagggacauuuagacacugau

SEQ ID NO: 1038071 - RNA, 22 nt, Human
ccagccugaaaugccucauccu

SEQ ID NO: 1038072 - RNA, 22 nt, Human
cacaggguuguucugaggauuc

SEQ ID NO: 1038073 - RNA, 22 nt, Human
guagcccaccuggggagggcga

SEQ ID NO: 1038074 - RNA, 22 nt, Human
caguuauuaugaggucauuagg

SEQ ID NO: 1038075 - RNA, 19 nt, Human
ggcuggcaagugacagugu

SEQ ID NO: 1038076 - RNA, 22 nt, Human
cacuacuugaaagaauuacaga

SEQ ID NO: 1038077 - RNA, 22 nt, Human
uggaaagaugaagauguuuaag

SEQ ID NO: 1038078 - RNA, 22 nt, Human
cucuggccagagccugcgggaa

SEQ ID NO: 1038079 - RNA, 22 nt, Human
ggcagcucacugauuagcaauu

SEQ ID NO: 1038080 - RNA, 22 nt, Human
ucauucuccucuggaaaaggca

SEQ ID NO: 1038081 - RNA, 22 nt, Human
ugcucacagcccagaacauaau

SEQ ID NO: 1038082 - RNA, 22 nt, Human
agagcuguuuggacaucugagu

SEQ ID NO: 1038083 - RNA, 22 nt, Human
uagaaaucauuuagaaguauug

SEQ ID NO: 1038084 - RNA, 22 nt, Human
gggcccuggggccugauuugca

SEQ ID NO: 1038085 - RNA, 22 nt, Human
cuucccagaccuuagagugcag

SEQ ID NO: 1038086 - RNA, 22 nt, Human
ccucccaccauuuagagagagc

SEQ ID NO: 1038087 - RNA, 22 nt, Human
uaaaucccuacaucuguguuuu

SEQ ID NO: 1038088 - RNA, 22 nt, Human
cgucuuccucuuacgaugcgcu

SEQ ID NO: 1038089 - RNA, 22 nt, Human
uccagccaccaccuugauugcc

SEQ ID NO: 1038090 - RNA, 22 nt, Human
gggcugucaugugucagugacc

SEQ ID NO: 1038091 - RNA, 21 nt, Human
agaagccuggguggagguggg

SEQ ID NO: 1038092 - RNA, 22 nt, Human
auugcacaaacacagucagacu

SEQ ID NO: 1038093 - RNA, 22 nt, Human
gaggccugguagccgagcccca

SEQ ID NO: 1038094 - RNA, 22 nt, Human
guucacaucacuucacugaacc

SEQ ID NO: 1038095 - RNA, 22 nt, Human
ccagagcugcauccagcagguu

SEQ ID NO: 1038096 - RNA, 22 nt, Human
uuuugaaagggugauuuggcuu

SEQ ID NO: 1038097 - RNA, 21 nt, Human
uuugcauuuuacaugugggga

SEQ ID NO: 1038098 - RNA, 22 nt, Human
aauuagagaucaguucuuugac

SEQ ID NO: 1038099 - RNA, 22 nt, Human
uugaaaggugaacaugaugcac

SEQ ID NO: 1038100 - RNA, 22 nt, Human
ccuggcagcuccuccccggcgg

SEQ ID NO: 1038101 - RNA, 22 nt, Human
guacauuuugagguuaaaacaa

SEQ ID NO: 1038102 - RNA, 22 nt, Human
uuguuuuuaugaacauccagga

SEQ ID NO: 1038103 - RNA, 22 nt, Human
ggaccugccagaacucaggcua

SEQ ID NO: 1038104 - RNA, 22 nt, Human
ugguuucccauuaucugcagga

SEQ ID NO: 1038105 - RNA, 22 nt, Human
ccagggcuggugggagaugcug

SEQ ID NO: 1038106 - RNA, 22 nt, Human
aaagagcuaacauugccgagau

SEQ ID NO: 1038107 - RNA, 22 nt, Human
ccagcuccucuucccaguguca

SEQ ID NO: 1038108 - RNA, 22 nt, Human
cugggccagcaacugcaaugga

SEQ ID NO: 1038109 - RNA, 22 nt, Human
ugcugccuuagcagccaggcaa

SEQ ID NO: 1038110 - RNA, 22 nt, Human
aucagcaaaaaugccuucagaa

SEQ ID NO: 1038111 - RNA, 22 nt, Human
ccuggcaguuuugcccaggauu

SEQ ID NO: 1038112 - RNA, 22 nt, Human
ugcuggcccuggcucagggaac

SEQ ID NO: 1038113 - RNA, 22 nt, Human
gcugucuguggugucagcugac

SEQ ID NO: 1038114 - RNA, 22 nt, Human
gagccucguggcggccacugcg

SEQ ID NO: 1038115 - RNA, 22 nt, Human
cccugccugugggcaucaacau

SEQ ID NO: 1038116 - RNA, 22 nt, Human
auaauuuacaacugcuuuuaau

SEQ ID NO: 1038117 - RNA, 22 nt, Human
uguucaauccccagguccugaa

SEQ ID NO: 1038118 - RNA, 22 nt, Human
ucugucacccgagcaggcgaga

SEQ ID NO: 1038119 - RNA, 22 nt, Human
gucccagggaagaaggcagcac

SEQ ID NO: 1038120 - RNA, 22 nt, Human
ugaagcagagaauuugacaguc

SEQ ID NO: 1038121 - RNA, 22 nt, Human
gugcagguguuuuggcugccag

SEQ ID NO: 1038122 - RNA, 22 nt, Human
uuccaaaggaauggggagcuau

SEQ ID NO: 1038123 - RNA, 22 nt, Human
gcugcagccaaauucauuguca

SEQ ID NO: 1038124 - RNA, 22 nt, Human
uuccauaauuaaguggagagaa

SEQ ID NO: 1038125 - RNA, 22 nt, Human
cugaaggauuuaguucuuugcu

SEQ ID NO: 1038126 - RNA, 22 nt, Human
agagcagugcugaagaguaggg

SEQ ID NO: 1038127 - RNA, 22 nt, Human
uuacaaagagugccagagugug

SEQ ID NO: 1038128 - RNA, 22 nt, Human
cacugcuuuuuuggcuauguac

SEQ ID NO: 1038129 - RNA, 22 nt, Human
gcuccacuugcagcuaggcuug

SEQ ID NO: 1038130 - RNA, 22 nt, Human
gagggacagcuaaagagaaauu

SEQ ID NO: 1038131 - RNA, 23 nt, Human
aggagaagagauuuccacaugca

SEQ ID NO: 1038132 - RNA, 22 nt, Human
ucuguaucacccguucccagaa

SEQ ID NO: 1038133 - RNA, 22 nt, Human
agauggguaacuggagucugcu

SEQ ID NO: 1038134 - RNA, 22 nt, Human
acagauauaaacuauaguagug

SEQ ID NO: 1038135 - RNA, 22 nt, Human
aagugguagacaaagauaauug

SEQ ID NO: 1038136 - RNA, 22 nt, Human
aauguauaaaguguuaauaacu

SEQ ID NO: 1038137 - RNA, 22 nt, Human
uuguuuucuccacugcaucuua

SEQ ID NO: 1038138 - RNA, 22 nt, Human
ucuuugcaaauguuauuaucuu

SEQ ID NO: 1038139 - RNA, 21 nt, Human
ggggcagagcuaggcccugca

SEQ ID NO: 1038140 - RNA, 22 nt, Human
augcccaaugucacaauuuuug

SEQ ID NO: 1038141 - RNA, 22 nt, Human
gcugggcaccggagagacccca

SEQ ID NO: 1038142 - RNA, 22 nt, Human
cagagacaguuucacagggucu

SEQ ID NO: 1038143 - RNA, 22 nt, Human
agcaaagucaguggaaccaucc

SEQ ID NO: 1038144 - RNA, 22 nt, Human
ggcuggcuggcugguagacaag

SEQ ID NO: 1038145 - RNA, 22 nt, Human
cccagcacuuugaauaugucac

SEQ ID NO: 1038146 - RNA, 22 nt, Human
cugcuggagguuggagcaugca

SEQ ID NO: 1038147 - RNA, 22 nt, Human
gcagcugaaagggaucucuaca

SEQ ID NO: 1038148 - RNA, 22 nt, Human
ugacagcugagccccaggcaag

SEQ ID NO: 1038149 - RNA, 22 nt, Human
gggcucagccccauugaaccag

SEQ ID NO: 1038150 - RNA, 22 nt, Human
gcuguccugggaacaggcacua

SEQ ID NO: 1038151 - RNA, 22 nt, Human
gggagggaagguaccuguguga

SEQ ID NO: 1038152 - RNA, 23 nt, Human
ucugcucugaaguucggcugagc

SEQ ID NO: 1038153 - RNA, 22 nt, Human
acucaagauagggaaaguacaa

SEQ ID NO: 1038154 - RNA, 22 nt, Human
ucaguuuuuaagaguuaugcga

SEQ ID NO: 1038155 - RNA, 19 nt, Human
ccugggagucagcugaagg

SEQ ID NO: 1038156 - RNA, 22 nt, Human
uccuggaguugugcagugcaca

SEQ ID NO: 1038157 - RNA, 22 nt, Human
aagccagauagaagaacucauu

SEQ ID NO: 1038158 - RNA, 19 nt, Human
gggcucuggccucaguggg

SEQ ID NO: 1038159 - RNA, 22 nt, Human
uugggcugaacccugcagcuga

SEQ ID NO: 1038160 - RNA, 22 nt, Human
gcagcuggugcaaaugucacuc

SEQ ID NO: 1038161 - RNA, 22 nt, Human
ugagccuguggggugacaacca

SEQ ID NO: 1038162 - RNA, 22 nt, Human
gcccagaaguugaggcugcagu

SEQ ID NO: 1038163 - RNA, 22 nt, Human
gcccaucaucacuguggaggcu

SEQ ID NO: 1038164 - RNA, 22 nt, Human
cugaggagagaucacguggugu

SEQ ID NO: 1038165 - RNA, 22 nt, Human
ucagaggaaaggucagauggcu

SEQ ID NO: 1038166 - RNA, 22 nt, Human
ccugagggaggguauaggcugu

SEQ ID NO: 1038167 - RNA, 22 nt, Human
auugaaagagaauguagcucuu

SEQ ID NO: 1038168 - RNA, 22 nt, Human
acaaggaggucuggggggcccu

SEQ ID NO: 1038169 - RNA, 22 nt, Human
ugggggacugcacuggcgucag

SEQ ID NO: 1038170 - RNA, 19 nt, Human
aagcagcccuggcaagagc

SEQ ID NO: 1038171 - RNA, 21 nt, Human
uccucugcucucauaccacaa

SEQ ID NO: 1038172 - RNA, 22 nt, Human
cgugucaucugagccuugggcg

SEQ ID NO: 1038173 - RNA, 22 nt, Human
uguggccuggaaggggcugcuc

SEQ ID NO: 1038174 - RNA, 22 nt, Human
uccagagguauguagagaguau

SEQ ID NO: 1038175 - RNA, 21 nt, Human
gagacagacuuucguccccug

SEQ ID NO: 1038176 - RNA, 22 nt, Human
agcugccagaugacagugcuau

SEQ ID NO: 1038177 - RNA, 22 nt, Human
cugggacuuuacccuguggccc

SEQ ID NO: 1038178 - RNA, 22 nt, Human
aggugcagaaaaaaguccuuua

SEQ ID NO: 1038179 - RNA, 22 nt, Human
gcuuuccuggcccugucccugc

SEQ ID NO: 1038180 - RNA, 18 nt, Human
ucagagguacagaaaagu

SEQ ID NO: 1038181 - RNA, 21 nt, Human
uuucaauguguucuuuguagu

SEQ ID NO: 1038182 - RNA, 22 nt, Human
uuuccucugagugagcugggag

SEQ ID NO: 1038183 - RNA, 22 nt, Human
ccuguguggccaggcuggaguc

SEQ ID NO: 1038184 - RNA, 22 nt, Human
aggcuucccagcugagcucagc

SEQ ID NO: 1038185 - RNA, 22 nt, Human
aaggagugcaugacucagagua

SEQ ID NO: 1038186 - RNA, 22 nt, Human
ggccugagcucuggggaggcaa

SEQ ID NO: 1038187 - RNA, 22 nt, Human
uggcugaacuaaugugcuguuu

SEQ ID NO: 1038188 - RNA, 22 nt, Human
gcagggacaacugugcaccuga

SEQ ID NO: 1038189 - RNA, 22 nt, Human
gcaccaggcuuagagccccagg

SEQ ID NO: 1038190 - RNA, 22 nt, Human
ugucccaguuuaucugggacug

SEQ ID NO: 1038191 - RNA, 22 nt, Human
gcaaggcugagcacauuugcau

SEQ ID NO: 1038192 - RNA, 22 nt, Human
acucugccaucccaggugcugu

SEQ ID NO: 1038193 - RNA, 22 nt, Human
ggacuggacucucaggcucaca

SEQ ID NO: 1038194 - RNA, 22 nt, Human
uaaauguaccuucugccuuacu

SEQ ID NO: 1038195 - RNA, 22 nt, Human
aguacuuugcacuuugcucaga

SEQ ID NO: 1038196 - RNA, 22 nt, Human
ucugccuggauuuuggaaagcu

SEQ ID NO: 1038197 - RNA, 22 nt, Human
caaaugcauaguuuauaagaag

SEQ ID NO: 1038198 - RNA, 22 nt, Human
cagcccugagaaggaggaucuc

SEQ ID NO: 1038199 - RNA, 22 nt, Human
ucccaggguccucuucuggaau

SEQ ID NO: 1038200 - RNA, 22 nt, Human
ggguuggggcccagcagucugc

SEQ ID NO: 1038201 - RNA, 22 nt, Human
aagggcagaauagagaagaugg

SEQ ID NO: 1038202 - RNA, 22 nt, Human
ggagcugcuccuucagccaagu

SEQ ID NO: 1038203 - RNA, 22 nt, Human
ccuccaggauaagucagggccu

SEQ ID NO: 1038204 - RNA, 22 nt, Human
ccaccaggacagcccugagggg

SEQ ID NO: 1038205 - RNA, 22 nt, Human
ggucucaggagacuggagagca

SEQ ID NO: 1038206 - RNA, 22 nt, Human
gagccagguuugaaucucaguc

SEQ ID NO: 1038207 - RNA, 22 nt, Human
aaaaacuguaauuacuuuugca

SEQ ID NO: 1038208 - RNA, 22 nt, Human
ucugccuuuucacugccacuaa

SEQ ID NO: 1038209 - RNA, 22 nt, Human
gccagcucagugccaggccccu

SEQ ID NO: 1038210 - RNA, 22 nt, Human
ccugccuggaucagccauccug

SEQ ID NO: 1038211 - RNA, 22 nt, Human
ggagauuuauagcacacuucag

SEQ ID NO: 1038212 - RNA, 20 nt, Human
gacauucauaguuauuacca

SEQ ID NO: 1038213 - RNA, 22 nt, Human
ucaggagaaucagggcuguccu

SEQ ID NO: 1038214 - RNA, 22 nt, Human
agcccagcagaaaguccagccu

SEQ ID NO: 1038215 - RNA, 22 nt, Human
agggagcaugggugaagcaggc

SEQ ID NO: 1038216 - RNA, 22 nt, Human
gugccugccccacuccucagca

SEQ ID NO: 1038217 - RNA, 22 nt, Human
agcugccagggacugggcaugg

SEQ ID NO: 1038218 - RNA, 22 nt, Human
aggcaggugggucacuugaguc

SEQ ID NO: 1038219 - RNA, 22 nt, Human
acuacuuugggccauuuguuua

SEQ ID NO: 1038220 - RNA, 22 nt, Human
uggagggcaucuguggucaggc

SEQ ID NO: 1038221 - RNA, 22 nt, Human
caggcagauuugcugcccucca

SEQ ID NO: 1038222 - RNA, 22 nt, Human
gcagcuuggauuucuguaguuu

SEQ ID NO: 1038223 - RNA, 22 nt, Human
agguaaggcuguaagcuaagcc

SEQ ID NO: 1038224 - RNA, 22 nt, Human
agggcugcugcuccgggcccag

SEQ ID NO: 1038225 - RNA, 22 nt, Human
agacaaagacagcaucucaggu

SEQ ID NO: 1038226 - RNA, 21 nt, Human
uggcucaguugcugggcacag

SEQ ID NO: 1038227 - RNA, 19 nt, Human
gugaggauacugcucagag

SEQ ID NO: 1038228 - RNA, 22 nt, Human
ggcucugcuucagaaggcucau

SEQ ID NO: 1038229 - RNA, 22 nt, Human
cuggccuggcagggagggcaug

SEQ ID NO: 1038230 - RNA, 22 nt, Human
agcuggaggauaacucacuucu

SEQ ID NO: 1038231 - RNA, 22 nt, Human
ucuggcuccaggaccgggcaca

SEQ ID NO: 1038232 - RNA, 22 nt, Human
aaugccaguguguugauuccag

SEQ ID NO: 1038233 - RNA, 22 nt, Human
acucagaguuugcguuccauac

SEQ ID NO: 1038234 - RNA, 22 nt, Human
agaauaguggcaaugacugcac

SEQ ID NO: 1038235 - RNA, 22 nt, Human
cugggacagcugagacaggaga

SEQ ID NO: 1038236 - RNA, 22 nt, Human
uggagcagccaugaugacagag

SEQ ID NO: 1038237 - RNA, 22 nt, Human
ucagagugaggcccagcaaucu

SEQ ID NO: 1038238 - RNA, 22 nt, Human
ggcugcaggcaggguauccacu

SEQ ID NO: 1038239 - RNA, 22 nt, Human
gcaggagcagucaggggcagcu

SEQ ID NO: 1038240 - RNA, 22 nt, Human
ccugggaguggcacucacagca

SEQ ID NO: 1038241 - RNA, 23 nt, Human
ccaggcaguagcuauugaaguga

SEQ ID NO: 1038242 - RNA, 22 nt, Human
ugggccuggcccuguggaggag

SEQ ID NO: 1038243 - RNA, 19 nt, Human
ggcugcugguuacagaggc

SEQ ID NO: 1038244 - RNA, 22 nt, Human
agcuucucaggagucugaggca

SEQ ID NO: 1038245 - RNA, 22 nt, Human
uggcucagucauggaugaguaa

SEQ ID NO: 1038246 - RNA, 22 nt, Human
ggccuuggggaggauggugucc

SEQ ID NO: 1038247 - RNA, 20 nt, Human
uauuuagauucaaguaugga

SEQ ID NO: 1038248 - RNA, 22 nt, Human
gcccagcacagcuggaagaguc

SEQ ID NO: 1038249 - RNA, 21 nt, Human
ugaagccugaggcauagcccc

SEQ ID NO: 1038250 - RNA, 22 nt, Human
uuauugccugauugaggucauu

SEQ ID NO: 1038251 - RNA, 23 nt, Human
cugcagccgcguggggacgugga

SEQ ID NO: 1038252 - RNA, 22 nt, Human
cucacuggcaagacuacaggug

SEQ ID NO: 1038253 - RNA, 22 nt, Human
uuacaaagaguguucuuuucca

SEQ ID NO: 1038254 - RNA, 22 nt, Human
ggaggccaaggcagguggauca

SEQ ID NO: 1038255 - RNA, 22 nt, Human
uucuuccucagcagggcugccu

SEQ ID NO: 1038256 - RNA, 21 nt, Human
auggagccuaagaguggaggu

SEQ ID NO: 1038257 - RNA, 22 nt, Human
cugcaggggccucgagcacagg

SEQ ID NO: 1038258 - RNA, 22 nt, Human
agaaaugcucuuccugaccaga

SEQ ID NO: 1038259 - RNA, 20 nt, Human
auacacauauucuugcaacu

SEQ ID NO: 1038260 - RNA, 18 nt, Human
cagcagagacauucaaaa

SEQ ID NO: 1038261 - RNA, 22 nt, Human
ccacagcugaccgcaggugagc

SEQ ID NO: 1038262 - RNA, 22 nt, Human
uccagagcagguggucagaagg

SEQ ID NO: 1038263 - RNA, 22 nt, Human
uaaugugugucaucaguagagu

SEQ ID NO: 1038264 - RNA, 22 nt, Human
gcagugggagcuuaggcagugc

SEQ ID NO: 1038265 - RNA, 22 nt, Human
gggugggccacugagcagcgug

SEQ ID NO: 1038266 - RNA, 22 nt, Human
gacagccucaugaggagcaaaa

SEQ ID NO: 1038267 - RNA, 22 nt, Human
aaguucuaauuuugcauucagg

SEQ ID NO: 1038268 - RNA, 22 nt, Human
ucacauuuguuccucugcacuu

SEQ ID NO: 1038269 - RNA, 22 nt, Human
ggcugccuccugcugggcugga

SEQ ID NO: 1038270 - RNA, 22 nt, Human
cugcuuugauuagaagaguaca

SEQ ID NO: 1038271 - RNA, 22 nt, Human
uauuucugaauccaaaagguca

SEQ ID NO: 1038272 - RNA, 22 nt, Human
uuugacagcuuguuacaaaguu

SEQ ID NO: 1038273 - RNA, 22 nt, Human
uagcugccagaccauucuuacu

SEQ ID NO: 1038274 - RNA, 22 nt, Human
uauguuaaauguuugauguuua

SEQ ID NO: 1038275 - RNA, 22 nt, Human
cuucuccucugaguccugggag

SEQ ID NO: 1038276 - RNA, 22 nt, Human
uuaaacagguuuuugaauggcc

SEQ ID NO: 1038277 - RNA, 22 nt, Human
agcacagaguugcagagagcgu

SEQ ID NO: 1038278 - RNA, 22 nt, Human
caggccugcaggaaaggcuccc

SEQ ID NO: 1038279 - RNA, 22 nt, Human
uuccuccacgugacaggagcca

SEQ ID NO: 1038280 - RNA, 22 nt, Human
ugguuuugcuccaguauaaaua

SEQ ID NO: 1038281 - RNA, 22 nt, Human
uccuggaggcaaaugagcacau

SEQ ID NO: 1038282 - RNA, 22 nt, Human
gaaggaaaggucucaugccuuu

SEQ ID NO: 1038283 - RNA, 22 nt, Human
agcucauggugcuaucucaggg

SEQ ID NO: 1038284 - RNA, 23 nt, Human
cuggcuccgaagacuccaggauc

SEQ ID NO: 1038285 - RNA, 22 nt, Human
ugcuggcuguauaugugagagu

SEQ ID NO: 1038286 - RNA, 22 nt, Human
cuccucugucuggcccugagcc

SEQ ID NO: 1038287 - RNA, 22 nt, Human
ugcugucuuccaggauggugaa

SEQ ID NO: 1038288 - RNA, 22 nt, Human
aggagcugagucagcccgacag

SEQ ID NO: 1038289 - RNA, 22 nt, Human
caggggcuuuuccucuauaagg

SEQ ID NO: 1038290 - RNA, 22 nt, Human
acaggggcuccgaaggugaggg

SEQ ID NO: 1038291 - RNA, 22 nt, Human
uccugccugcaaucccagcacu

SEQ ID NO: 1038292 - RNA, 22 nt, Human
ucagaaauuuucucaguaguuc

SEQ ID NO: 1038293 - RNA, 22 nt, Human
auuguguaauuuucagcucaua

SEQ ID NO: 1038294 - RNA, 22 nt, Human
cugccuuccaaccccagacucc

SEQ ID NO: 1038295 - RNA, 22 nt, Human
aagcagccacuggccaguuaua

SEQ ID NO: 1038296 - RNA, 22 nt, Human
auaguacacauccuacaauguu

SEQ ID NO: 1038297 - RNA, 22 nt, Human
ucaguaacuuacuuauucaccu

SEQ ID NO: 1038298 - RNA, 22 nt, Human
gugcugcagagucucgugccgc

SEQ ID NO: 1038299 - RNA, 22 nt, Human
cugggagaugacucagagcagg

SEQ ID NO: 1038300 - RNA, 22 nt, Human
agaaggaguguacaggucaugc

SEQ ID NO: 1038301 - RNA, 22 nt, Human
gagggcugaugcuuacuuauuu

SEQ ID NO: 1038302 - RNA, 22 nt, Human
cucaggaggaggaaguucauug

SEQ ID NO: 1038303 - RNA, 22 nt, Human
uauucacaggcuggagugaugu

SEQ ID NO: 1038304 - RNA, 22 nt, Human
agcugagagguggcaagcugua

SEQ ID NO: 1038305 - RNA, 22 nt, Human
gcugccugauguccagcaggac

SEQ ID NO: 1038306 - RNA, 22 nt, Human
cccuggguucuggcugggcugc

SEQ ID NO: 1038307 - RNA, 18 nt, Human
cagaugagaugcaaucuc

SEQ ID NO: 1038308 - RNA, 23 nt, Human
aguacauucgaaaaauucuguga

SEQ ID NO: 1038309 - RNA, 22 nt, Human
ccagcuggaagagugcagaacu

SEQ ID NO: 1038310 - RNA, 22 nt, Human
ugggggagauugugcaucucua

SEQ ID NO: 1038311 - RNA, 19 nt, Human
ucucuggggacacuuucac

SEQ ID NO: 1038312 - RNA, 22 nt, Human
cuggcuggcaaguagaacacaa

SEQ ID NO: 1038313 - RNA, 22 nt, Human
cagggcccaagacacaaugagg

SEQ ID NO: 1038314 - RNA, 22 nt, Human
cagagcugggaucccaugggcg

SEQ ID NO: 1038315 - RNA, 22 nt, Human
agaaaucugacugcugugcaca

SEQ ID NO: 1038316 - RNA, 22 nt, Human
gguguccaucaggcugugcuuc

SEQ ID NO: 1038317 - RNA, 22 nt, Human
aggcugcuggcaggcguggacg

SEQ ID NO: 1038318 - RNA, 22 nt, Human
gguggccuccagggcauaggug

SEQ ID NO: 1038319 - RNA, 22 nt, Human
cccagccucuguuugcuccucu

SEQ ID NO: 1038320 - RNA, 22 nt, Human
uuucaaagguggaagagugaau

SEQ ID NO: 1038321 - RNA, 22 nt, Human
gccaggcuguuuuuauuacugu

SEQ ID NO: 1038322 - RNA, 22 nt, Human
aaggccugaacaugaggagaug

SEQ ID NO: 1038323 - RNA, 23 nt, Human
aguuuuucugcaugguucuguau

SEQ ID NO: 1038324 - RNA, 22 nt, Human
uccagccacucagcagggauug

SEQ ID NO: 1038325 - RNA, 22 nt, Human
aggaaagcucccaguagggcuc

SEQ ID NO: 1038326 - RNA, 22 nt, Human
augucuuucgcaucaguagcua

SEQ ID NO: 1038327 - RNA, 21 nt, Human
agagaauugccuuagauguuc

SEQ ID NO: 1038328 - RNA, 22 nt, Human
ccugggcuugcaucugugcugg

SEQ ID NO: 1038329 - RNA, 23 nt, Human
uggcucagcuaguuuuccauuuc

SEQ ID NO: 1038330 - RNA, 22 nt, Human
ugugcagggaagggcaugcuau

SEQ ID NO: 1038331 - RNA, 22 nt, Human
aaggcacuuuucuaaagaccuu

SEQ ID NO: 1038332 - RNA, 22 nt, Human
ucuggcugcugcgugagugcuu

SEQ ID NO: 1038333 - RNA, 22 nt, Human
ucuggcucauaggaaggccauu

SEQ ID NO: 1038334 - RNA, 22 nt, Human
ucuggagaacuugcaagaggau

SEQ ID NO: 1038335 - RNA, 22 nt, Human
agaggcuguuacacucccagau

SEQ ID NO: 1038336 - RNA, 22 nt, Human
uggcagagagacucuccuugau

SEQ ID NO: 1038337 - RNA, 22 nt, Human
gggcagcucucacagcagccaa

SEQ ID NO: 1038338 - RNA, 19 nt, Human
agccuggagggcuggucac

SEQ ID NO: 1038339 - RNA, 22 nt, Human
augcaguaaaauaggagguaau

SEQ ID NO: 1038340 - RNA, 22 nt, Human
gcuguucugcgucccaggcugg

SEQ ID NO: 1038341 - RNA, 19 nt, Human
acaagggcaggcaagguga

SEQ ID NO: 1038342 - RNA, 22 nt, Human
gcucccaguucccaaagugacc

SEQ ID NO: 1038343 - RNA, 22 nt, Human
agccuggaggccaggagacagu

SEQ ID NO: 1038344 - RNA, 22 nt, Human
ucagagugcagggaguagcagc

SEQ ID NO: 1038345 - RNA, 22 nt, Human
guuauguaugggggccuuauga

SEQ ID NO: 1038346 - RNA, 22 nt, Human
gagccagccgcaagagcuguga

SEQ ID NO: 1038347 - RNA, 22 nt, Human
agggacagaugaaugacugagu

SEQ ID NO: 1038348 - RNA, 22 nt, Human
cuggcagcauggagccugugcu

SEQ ID NO: 1038349 - RNA, 22 nt, Human
ccagcagcccacaggcgucccu

SEQ ID NO: 1038350 - RNA, 22 nt, Human
agcagcugcagggagggucugc

SEQ ID NO: 1038351 - RNA, 22 nt, Human
ccacagagacagagcccagggu

SEQ ID NO: 1038352 - RNA, 22 nt, Human
auggaaagcuaagccauuuacc

SEQ ID NO: 1038353 - RNA, 21 nt, Human
ccuggcugcacaguugcuggu

SEQ ID NO: 1038354 - RNA, 22 nt, Human
ugccaggaggaggugggacaga

SEQ ID NO: 1038355 - RNA, 22 nt, Human
acagugucuccugguacccagu

SEQ ID NO: 1038356 - RNA, 22 nt, Human
ccucaggguggcaucagaucuu

SEQ ID NO: 1038357 - RNA, 22 nt, Human
ugcuuccuugagcucuccaauc

SEQ ID NO: 1038358 - RNA, 22 nt, Human
agauguguuucuaguuccugca

SEQ ID NO: 1038359 - RNA, 20 nt, Human
uccagggcuagggagcucau

SEQ ID NO: 1038360 - RNA, 22 nt, Human
gagaggcugacuggcuguccug

SEQ ID NO: 1038361 - RNA, 22 nt, Human
auugcagcuggucaggguaauu

SEQ ID NO: 1038362 - RNA, 22 nt, Human
gcucaggagcucuugguggcgc

SEQ ID NO: 1038363 - RNA, 22 nt, Human
cagaguacugggagaacagaag

SEQ ID NO: 1038364 - RNA, 22 nt, Human
cagccagcuucagauccaagcc

SEQ ID NO: 1038365 - RNA, 22 nt, Human
cagcagagcuuauguuggguca

SEQ ID NO: 1038366 - RNA, 22 nt, Human
uggcacugccaaccugcuaggu

SEQ ID NO: 1038367 - RNA, 22 nt, Human
cuggggccacaacggcgcacgc

SEQ ID NO: 1038368 - RNA, 22 nt, Human
auucaguuaaaaacuguacuuc

SEQ ID NO: 1038369 - RNA, 23 nt, Human
ucuccagugucucuucauugagu

SEQ ID NO: 1038370 - RNA, 19 nt, Human
ucccagagucuagagguug

SEQ ID NO: 1038371 - RNA, 22 nt, Human
cuacugaguccuucagcugcca

SEQ ID NO: 1038372 - RNA, 22 nt, Human
cugugugcugaaaugcagugag

SEQ ID NO: 1038373 - RNA, 22 nt, Human
ccaggagccacucaggcccaca

SEQ ID NO: 1038374 - RNA, 22 nt, Human
aaccaggacaauuugaauagaa

SEQ ID NO: 1038375 - RNA, 22 nt, Human
acauuucuuccuaauuaucccu

SEQ ID NO: 1038376 - RNA, 22 nt, Human
uggagcaggccggaaguggcuu

SEQ ID NO: 1038377 - RNA, 22 nt, Human
ggcagcaugagccuggugaauu

SEQ ID NO: 1038378 - RNA, 22 nt, Human
ggccccuggcaccaggcugauu

SEQ ID NO: 1038379 - RNA, 23 nt, Human
ccugggcauuggcugcagcuucu

SEQ ID NO: 1038380 - RNA, 22 nt, Human
uggcagggccugcucaucaucc

SEQ ID NO: 1038381 - RNA, 22 nt, Human
uccaguucuaggucacucucug

SEQ ID NO: 1038382 - RNA, 21 nt, Human
uccacaaguuagaaggaaauu

SEQ ID NO: 1038383 - RNA, 22 nt, Human
aucaguuugagugcugugucaa

SEQ ID NO: 1038384 - RNA, 22 nt, Human
guggagccaggggcuguaggua

SEQ ID NO: 1038385 - RNA, 22 nt, Human
uauuucugucagccagauaugg

SEQ ID NO: 1038386 - RNA, 22 nt, Human
gcucccagcuggagccucaaca

SEQ ID NO: 1038387 - RNA, 21 nt, Human
gggagcuggaaacugggugac

SEQ ID NO: 1038388 - RNA, 20 nt, Human
uguacacaguacuuuacaau

SEQ ID NO: 1038389 - RNA, 23 nt, Human
cagagcuggcucagagcugccug

SEQ ID NO: 1038390 - RNA, 22 nt, Human
gaggggcugggcagucccugga

SEQ ID NO: 1038391 - RNA, 22 nt, Human
uagcagggaagaugaucagaau

SEQ ID NO: 1038392 - RNA, 22 nt, Human
uuugggaagaggaaucucugga

SEQ ID NO: 1038393 - RNA, 22 nt, Human
cacucugacuggcccugcagga

SEQ ID NO: 1038394 - RNA, 22 nt, Human
ggagggagucagcugauuagaa

SEQ ID NO: 1038395 - RNA, 22 nt, Human
auaaaaguuuccaaucaugccu

SEQ ID NO: 1038396 - RNA, 17 nt, Human
uagagcugguucaggag

SEQ ID NO: 1038397 - RNA, 22 nt, Human
ccccuuccacagugcuuccuaa

SEQ ID NO: 1038398 - RNA, 22 nt, Human
aauuugcaugaugagaacaaua

SEQ ID NO: 1038399 - RNA, 22 nt, Human
gccaggcuccaggcccuccuga

SEQ ID NO: 1038400 - RNA, 22 nt, Human
ugccugucuuuccucccucgua

SEQ ID NO: 1038401 - RNA, 22 nt, Human
aacagaauaguugauguacagu

SEQ ID NO: 1038402 - RNA, 19 nt, Human
ggccuggauuuagggcucc

SEQ ID NO: 1038403 - RNA, 22 nt, Human
gcuuagucaauuauaaauaggc

SEQ ID NO: 1038404 - RNA, 22 nt, Human
gaguggggcccacugcugggug

SEQ ID NO: 1038405 - RNA, 22 nt, Human
gcaggggaguggaugauggauu

SEQ ID NO: 1038406 - RNA, 22 nt, Human
ugccaggcccugugcuggaugc

SEQ ID NO: 1038407 - RNA, 22 nt, Human
cugggagagaagcgaagcuggg

SEQ ID NO: 1038408 - RNA, 22 nt, Human
ugucuuuucuacuguaagcaua

SEQ ID NO: 1038409 - RNA, 22 nt, Human
acaaaggugcgucccuucagcu

SEQ ID NO: 1038410 - RNA, 22 nt, Human
gcugcccugugguccagcaggu

SEQ ID NO: 1038411 - RNA, 22 nt, Human
ccugucagcugauggcuaugua

SEQ ID NO: 1038412 - RNA, 22 nt, Human
uugggcuggcagagguggucuu

SEQ ID NO: 1038413 - RNA, 22 nt, Human
uggcuuccuccagagcaggagg

SEQ ID NO: 1038414 - RNA, 22 nt, Human
agaacuuaggaacaacagcuua

SEQ ID NO: 1038415 - RNA, 22 nt, Human
ucacuuauaaaaugcaagaucu

SEQ ID NO: 1038416 - RNA, 22 nt, Human
acaguaauaaguguuggugagg

SEQ ID NO: 1038417 - RNA, 18 nt, Human
aaggcuucaaagaguaga

SEQ ID NO: 1038418 - RNA, 22 nt, Human
uuucauuacguguuugacuugu

SEQ ID NO: 1038419 - RNA, 19 nt, Human
gccugccuggguuucugag

SEQ ID NO: 1038420 - RNA, 22 nt, Human
agagcagguggcaacucuggga

SEQ ID NO: 1038421 - RNA, 22 nt, Human
guguacauauugagucugcuga

SEQ ID NO: 1038422 - RNA, 17 nt, Human
ggcugcugugcuggugc

SEQ ID NO: 1038423 - RNA, 22 nt, Human
auauguguauuugguuagccua

SEQ ID NO: 1038424 - RNA, 22 nt, Human
ccagaggugccacagaaagagc

SEQ ID NO: 1038425 - RNA, 22 nt, Human
ugucacuucaggaaugcaggga

SEQ ID NO: 1038426 - RNA, 18 nt, Human
acauuucuaugcuucugg

SEQ ID NO: 1038427 - RNA, 22 nt, Human
uuccagaaaucuuucagcucaa

SEQ ID NO: 1038428 - RNA, 22 nt, Human
aagcugccacacggugaguacu

SEQ ID NO: 1038429 - RNA, 22 nt, Human
agauggggcagaauggagccau

SEQ ID NO: 1038430 - RNA, 22 nt, Human
aaggagagagcuuugcuggaac

SEQ ID NO: 1038431 - RNA, 22 nt, Human
ucucagagggaggauuacugcc

SEQ ID NO: 1038432 - RNA, 22 nt, Human
ugcacacacaugaaguagcaug

SEQ ID NO: 1038433 - RNA, 19 nt, Human
ccaguagagacagcugcag

SEQ ID NO: 1038434 - RNA, 22 nt, Human
augauuuccaguuguugcuaag

SEQ ID NO: 1038435 - RNA, 23 nt, Human
cauguacagaguuugauaaagug

SEQ ID NO: 1038436 - RNA, 22 nt, Human
ggucaggguuccagguaucuuc

SEQ ID NO: 1038437 - RNA, 22 nt, Human
gccuccugaaaggaagagcucc

SEQ ID NO: 1038438 - RNA, 22 nt, Human
aaacucuggagauguuuaugca

SEQ ID NO: 1038439 - RNA, 22 nt, Human
cugccuggaccggcagcccucc

SEQ ID NO: 1038440 - RNA, 22 nt, Human
cccucuggcucuucucaggccg

SEQ ID NO: 1038441 - RNA, 22 nt, Human
aagggcugcuguagaagcagag

SEQ ID NO: 1038442 - RNA, 22 nt, Human
ugggcagacuaaggucaaagcu

SEQ ID NO: 1038443 - RNA, 22 nt, Human
ugcagugccucggcagugcagc

SEQ ID NO: 1038444 - RNA, 22 nt, Human
uggggcugucccgguuuggcga

SEQ ID NO: 1038445 - RNA, 22 nt, Human
agggcugcccagugugagagcu

SEQ ID NO: 1038446 - RNA, 22 nt, Human
uuagauauguuuuugcuaaugc

SEQ ID NO: 1038447 - RNA, 22 nt, Human
ucugagaggcagaccuuccuaa

SEQ ID NO: 1038448 - RNA, 22 nt, Human
aaaugcauguagaauaauagag

SEQ ID NO: 1038449 - RNA, 22 nt, Human
caaggaaacaugaaaugcauug

SEQ ID NO: 1038450 - RNA, 22 nt, Human
auuuuucucucacacuuaccag

SEQ ID NO: 1038451 - RNA, 22 nt, Human
cucuggagguugagcccagcaa

SEQ ID NO: 1038452 - RNA, 22 nt, Human
ggccucugcccucacuccuguc

SEQ ID NO: 1038453 - RNA, 22 nt, Human
gggccugugcacaguucuguua

SEQ ID NO: 1038454 - RNA, 22 nt, Human
cagcaauaguguguuuguuuca

SEQ ID NO: 1038455 - RNA, 22 nt, Human
cagcaggcccaggugcugguga

SEQ ID NO: 1038456 - RNA, 22 nt, Human
caacagaagguguacuacugaa

SEQ ID NO: 1038457 - RNA, 22 nt, Human
uguauuuucugaagauaaucaa

SEQ ID NO: 1038458 - RNA, 22 nt, Human
gggauggggucaacauguaccu

SEQ ID NO: 1038459 - RNA, 22 nt, Human
gagaggagucccuaucacaguu

SEQ ID NO: 1038460 - RNA, 22 nt, Human
aaucuuucccuauuaaaugugg

SEQ ID NO: 1038461 - RNA, 22 nt, Human
uuuaaaaaacuagucugagucu

SEQ ID NO: 1038462 - RNA, 22 nt, Human
cugcucugacccuuucaccuuc

SEQ ID NO: 1038463 - RNA, 18 nt, Human
aagaggaggagcagguug

SEQ ID NO: 1038464 - RNA, 22 nt, Human
cagcuugggucaggugccugcu

SEQ ID NO: 1038465 - RNA, 22 nt, Human
gaaggaaaaauacucuguaagg

SEQ ID NO: 1038466 - RNA, 22 nt, Human
agcagccagagaaugaugcagu

SEQ ID NO: 1038467 - RNA, 22 nt, Human
cuucucucugcauaggcauggg

SEQ ID NO: 1038468 - RNA, 22 nt, Human
cagcuggcgggcagagccgcca

SEQ ID NO: 1038469 - RNA, 22 nt, Human
uguccugggaaugggaugcagu

SEQ ID NO: 1038470 - RNA, 22 nt, Human
ccugucugaaggcagggggaug

SEQ ID NO: 1038471 - RNA, 22 nt, Human
agcagaagaaagccacaugacu

SEQ ID NO: 1038472 - RNA, 22 nt, Human
ggcaggaggugaguggcgggug

SEQ ID NO: 1038473 - RNA, 22 nt, Human
gcucugucauuuugcagacacu

SEQ ID NO: 1038474 - RNA, 22 nt, Human
cuauugaauuaacuauuaaagu

SEQ ID NO: 1038475 - RNA, 22 nt, Human
cagcaucaccgccauuucugau

SEQ ID NO: 1038476 - RNA, 22 nt, Human
cacaaugcguacauauaucaaa

SEQ ID NO: 1038477 - RNA, 22 nt, Human
aagaaauguagagccuaguaaa

SEQ ID NO: 1038478 - RNA, 22 nt, Human
acagcuggcaggggggcaugaa

SEQ ID NO: 1038479 - RNA, 22 nt, Human
uggccucugcaauggauucacc

SEQ ID NO: 1038480 - RNA, 22 nt, Human
cagggccacccucugcugggug

SEQ ID NO: 1038481 - RNA, 22 nt, Human
cuguccauuuucgugccuccuu

SEQ ID NO: 1038482 - RNA, 22 nt, Human
uccagggacacagaguccuucu

SEQ ID NO: 1038483 - RNA, 22 nt, Human
ucucuucuugauuuucacugga

SEQ ID NO: 1038484 - RNA, 22 nt, Human
uacaguagaauuuuuaguaacu

SEQ ID NO: 1038485 - RNA, 22 nt, Human
cugcagcuuuggaaaccuguuu

SEQ ID NO: 1038486 - RNA, 22 nt, Human
ugcugucugcaacaguacuaca

SEQ ID NO: 1038487 - RNA, 22 nt, Human
uuccucucaacaugccugccgg

SEQ ID NO: 1038488 - RNA, 22 nt, Human
ucucuggaauuggcugaggcaa

SEQ ID NO: 1038489 - RNA, 22 nt, Human
aauacaaucaaauucacuagca

SEQ ID NO: 1038490 - RNA, 22 nt, Human
ucagaggagccaaaguucugag

SEQ ID NO: 1038491 - RNA, 22 nt, Human
ggcagggaaacagcugauccca

SEQ ID NO: 1038492 - RNA, 21 nt, Human
agccuggcccagggggaggcu

SEQ ID NO: 1038493 - RNA, 20 nt, Human
uacuugaauguugcagcagu

SEQ ID NO: 1038494 - RNA, 22 nt, Human
gccugggagggcagcagugugg

SEQ ID NO: 1038495 - RNA, 22 nt, Human
cagcuggcuccaccucugggcu

SEQ ID NO: 1038496 - RNA, 22 nt, Human
cucuccagaauaugccgccgug

SEQ ID NO: 1038497 - RNA, 22 nt, Human
cuccugagcucugaggaagcuu

SEQ ID NO: 1038498 - RNA, 22 nt, Human
cugggcagugcagcuauagaac

SEQ ID NO: 1038499 - RNA, 22 nt, Human
auucuccacacauccagaccuu

SEQ ID NO: 1038500 - RNA, 22 nt, Human
uagaaaugcccagauucugcua

SEQ ID NO: 1038501 - RNA, 22 nt, Human
gaggcagagugcaccccaggag

SEQ ID NO: 1038502 - RNA, 22 nt, Human
ccugccuguaagauggguacaa

SEQ ID NO: 1038503 - RNA, 22 nt, Human
uugcacagaugagggugaugcu

SEQ ID NO: 1038504 - RNA, 22 nt, Human
gagguauguaugcuacauucuu

SEQ ID NO: 1038505 - RNA, 22 nt, Human
aguguuucucagaagggccuau

SEQ ID NO: 1038506 - RNA, 22 nt, Human
uggcucagaagaaaagguaaac

SEQ ID NO: 1038507 - RNA, 22 nt, Human
gggcuucucuuaugcuaacugg

SEQ ID NO: 1038508 - RNA, 22 nt, Human
guuugcauuccaauuuagggga

SEQ ID NO: 1038509 - RNA, 22 nt, Human
caggcagggagcuggaaaggau

SEQ ID NO: 1038510 - RNA, 19 nt, Human
gcaggcacagcccugggug

SEQ ID NO: 1038511 - RNA, 22 nt, Human
gaggcagaggaagguggucucu

SEQ ID NO: 1038512 - RNA, 22 nt, Human
aagggagacaguugugugagga

SEQ ID NO: 1038513 - RNA, 22 nt, Human
acugcaucugaaacauggguca

SEQ ID NO: 1038514 - RNA, 22 nt, Human
gggcagccucggugccugcugc

SEQ ID NO: 1038515 - RNA, 19 nt, Human
auaaggcaauuggauuugg

SEQ ID NO: 1038516 - RNA, 22 nt, Human
caagauggacauaaggagagaa

SEQ ID NO: 1038517 - RNA, 22 nt, Human
gcucugcucuaacauuccugac

SEQ ID NO: 1038518 - RNA, 22 nt, Human
uggccucuuacgacauagccuu

SEQ ID NO: 1038519 - RNA, 22 nt, Human
cauuaagauuuuuuucuacugg

SEQ ID NO: 1038520 - RNA, 22 nt, Human
cagccugcauuuguaucuguau

SEQ ID NO: 1038521 - RNA, 22 nt, Human
uggccugaggcucggcaugggu

SEQ ID NO: 1038522 - RNA, 22 nt, Human
uaaagguaacaugaacugcuuu

SEQ ID NO: 1038523 - RNA, 22 nt, Human
uuagauaauguuauuguaauuu

SEQ ID NO: 1038524 - RNA, 22 nt, Human
gcaaaugaguuguaacauaaaa

SEQ ID NO: 1038525 - RNA, 22 nt, Human
agcuuuauauuuaaugaauucu

SEQ ID NO: 1038526 - RNA, 22 nt, Human
cuggccaacuugcuuguuggca

SEQ ID NO: 1038527 - RNA, 22 nt, Human
ugccuggcaacuguggugggcu

SEQ ID NO: 1038528 - RNA, 22 nt, Human
ggugggcagcucuuggcaggca

SEQ ID NO: 1038529 - RNA, 22 nt, Human
uauuuugucuucugcucaucac

SEQ ID NO: 1038530 - RNA, 22 nt, Human
acauuucuggaguuucucaaca

SEQ ID NO: 1038531 - RNA, 22 nt, Human
aggcagcagccacaaggccuga

SEQ ID NO: 1038532 - RNA, 18 nt, Human
gugacagcugcuagcuca

SEQ ID NO: 1038533 - RNA, 22 nt, Human
aagugagauuauauguacggga

SEQ ID NO: 1038534 - RNA, 22 nt, Human
uaguaacagauuuauacagucu

SEQ ID NO: 1038535 - RNA, 22 nt, Human
ucccaguguggcaggccaugga

SEQ ID NO: 1038536 - RNA, 22 nt, Human
guuuggggucugcagagcggcg

SEQ ID NO: 1038537 - RNA, 21 nt, Human
aacauuucaggauccaaauug

SEQ ID NO: 1038538 - RNA, 22 nt, Human
gcuggccugggcagccugucgg

SEQ ID NO: 1038539 - RNA, 22 nt, Human
aagaugauagaucugucaaugu

SEQ ID NO: 1038540 - RNA, 23 nt, Human
agcagccauagggaagcaauaca

SEQ ID NO: 1038541 - RNA, 22 nt, Human
agggccugggauguccuccuag

SEQ ID NO: 1038542 - RNA, 22 nt, Human
uguguacauaucuauccuagau

SEQ ID NO: 1038543 - RNA, 22 nt, Human
uccucagaaaccccugugaggu

SEQ ID NO: 1038544 - RNA, 22 nt, Human
gcagccacacuguuacagaaug

SEQ ID NO: 1038545 - RNA, 17 nt, Human
acacagccagguucucc

SEQ ID NO: 1038546 - RNA, 19 nt, Human
cucugccucccuccugggu

SEQ ID NO: 1038547 - RNA, 22 nt, Human
ccagggcauguccaagacuuag

SEQ ID NO: 1038548 - RNA, 22 nt, Human
ggcucagguuuaaagugcuuua

SEQ ID NO: 1038549 - RNA, 22 nt, Human
acagaacugcaggaggaaaagc

SEQ ID NO: 1038550 - RNA, 22 nt, Human
acauuucuauagugcaucuguu

SEQ ID NO: 1038551 - RNA, 22 nt, Human
gggagggaaggaggcgccgugu

SEQ ID NO: 1038552 - RNA, 22 nt, Human
gaaucacgguauucugcacggg

SEQ ID NO: 1038553 - RNA, 22 nt, Human
uuccaguucccaugaggauuaa

SEQ ID NO: 1038554 - RNA, 22 nt, Human
gugucccacucuggaggugaag

SEQ ID NO: 1038555 - RNA, 22 nt, Human
ccaggccuagccccugagggua

SEQ ID NO: 1038556 - RNA, 21 nt, Human
aagagcugucaggaaggcugc

SEQ ID NO: 1038557 - RNA, 22 nt, Human
uccagggaaggugugaggcugg

SEQ ID NO: 1038558 - RNA, 22 nt, Human
uccugcagagccgcccucaggu

SEQ ID NO: 1038559 - RNA, 22 nt, Human
acauucuagaagucuuugcaau

SEQ ID NO: 1038560 - RNA, 22 nt, Human
ucagagaaaugaaguagggauu

SEQ ID NO: 1038561 - RNA, 22 nt, Human
gaggccuggaauuccagccugg

SEQ ID NO: 1038562 - RNA, 22 nt, Human
gcagcccaaaaaagagguagau

SEQ ID NO: 1038563 - RNA, 20 nt, Human
agccagaagaaggcuggaga

SEQ ID NO: 1038564 - RNA, 20 nt, Human
ucccuggaggugguggcauc

SEQ ID NO: 1038565 - RNA, 22 nt, Human
cugccagcucgccacaaugaca

SEQ ID NO: 1038566 - RNA, 22 nt, Human
ugaaccagagucuccagugguu

SEQ ID NO: 1038567 - RNA, 22 nt, Human
gcagggcaugggcccugucugc

SEQ ID NO: 1038568 - RNA, 23 nt, Human
aaguucaagucacagccugucuu

SEQ ID NO: 1038569 - RNA, 23 nt, Human
ggcagcucucaucugaugacuga

SEQ ID NO: 1038570 - RNA, 22 nt, Human
ugggcugccagcucuccagaug

SEQ ID NO: 1038571 - RNA, 22 nt, Human
cacaagacuuauuuguguagaa

SEQ ID NO: 1038572 - RNA, 22 nt, Human
ccugagaggcccucucacuguc

SEQ ID NO: 1038573 - RNA, 22 nt, Human
ggccugucucacccccgggugc

SEQ ID NO: 1038574 - RNA, 22 nt, Human
caaagguaaagaucugcugugg

SEQ ID NO: 1038575 - RNA, 22 nt, Human
cacauuucugugagucaauauu

SEQ ID NO: 1038576 - RNA, 22 nt, Human
auggaagguccuacagagcgca

SEQ ID NO: 1038577 - RNA, 22 nt, Human
ccagcuucucucugaugcagcu

SEQ ID NO: 1038578 - RNA, 22 nt, Human
uaaugcacagaauugacauggg

SEQ ID NO: 1038579 - RNA, 22 nt, Human
gaagccccaaacccucgccauc

SEQ ID NO: 1038580 - RNA, 22 nt, Human
ugggugggagcgcccugucugg

SEQ ID NO: 1038581 - RNA, 22 nt, Human
guggccugucagaagccguggg

SEQ ID NO: 1038582 - RNA, 22 nt, Human
cugcugggcagaggcugcauga

SEQ ID NO: 1038583 - RNA, 22 nt, Human
acugggccggugcagaguaguu

SEQ ID NO: 1038584 - RNA, 22 nt, Human
cugggccuagcaacagaggagu

SEQ ID NO: 1038585 - RNA, 20 nt, Human
gucugaggagcagugggaaa

SEQ ID NO: 1038586 - RNA, 22 nt, Human
aucaaaguucguaacugauaac

SEQ ID NO: 1038587 - RNA, 22 nt, Human
aggaccugacuggcuccugcuu

SEQ ID NO: 1038588 - RNA, 22 nt, Human
auuuugaaaagcauuugaguaa

SEQ ID NO: 1038589 - RNA, 22 nt, Human
ugcccacaggaagacaccagcg

SEQ ID NO: 1038590 - RNA, 22 nt, Human
gcaggugggggucggugcaucu

SEQ ID NO: 1038591 - RNA, 23 nt, Human
gccagccuugcucuccugcagcc

SEQ ID NO: 1038592 - RNA, 22 nt, Human
cugagccagagggagucggguc

SEQ ID NO: 1038593 - RNA, 22 nt, Human
uccucaggaugugggguagaau

SEQ ID NO: 1038594 - RNA, 22 nt, Human
cugaagaggacgcagcagcaag

SEQ ID NO: 1038595 - RNA, 22 nt, Human
gccugccugaaggcuguaccag

SEQ ID NO: 1038596 - RNA, 22 nt, Human
gcuggccaguguggugaccacc

SEQ ID NO: 1038597 - RNA, 22 nt, Human
uugacagcuauuuugcuuugau

SEQ ID NO: 1038598 - RNA, 22 nt, Human
agcugcugagccaggcugaugu

SEQ ID NO: 1038599 - RNA, 21 nt, Human
ugggcagauggcaguguggcu

SEQ ID NO: 1038600 - RNA, 22 nt, Human
uacauaguauucacauuguuuu

SEQ ID NO: 1038601 - RNA, 22 nt, Human
ccuggcugccgagugugcagcg

SEQ ID NO: 1038602 - RNA, 22 nt, Human
uaaaaguuuuaguuguacauaa

SEQ ID NO: 1038603 - RNA, 22 nt, Human
augucuuuauaaauguauaaug

SEQ ID NO: 1038604 - RNA, 22 nt, Human
ugggcacuguagcuggugcugg

SEQ ID NO: 1038605 - RNA, 17 nt, Human
acaagcaguggccaugg

SEQ ID NO: 1038606 - RNA, 22 nt, Human
ggcagggugccuggcuccuguu

SEQ ID NO: 1038607 - RNA, 22 nt, Human
ugggcagaaggaagagccaccu

SEQ ID NO: 1038608 - RNA, 22 nt, Human
agaggccagguccagaguuugu

SEQ ID NO: 1038609 - RNA, 22 nt, Human
gaggcugcuuugaugacaggag

SEQ ID NO: 1038610 - RNA, 22 nt, Human
uccucaugccgggucucacgcu

SEQ ID NO: 1038611 - RNA, 22 nt, Human
acagcuguauccccagagcuca

SEQ ID NO: 1038612 - RNA, 22 nt, Human
caagggccuccaccuugcucgu

SEQ ID NO: 1038613 - RNA, 22 nt, Human
ucagaacauuuaaaaagugguu

SEQ ID NO: 1038614 - RNA, 22 nt, Human
guaagcaucugucucuucugca

SEQ ID NO: 1038615 - RNA, 23 nt, Human
ccucccaccuauuucacuuucuu

SEQ ID NO: 1038616 - RNA, 22 nt, Human
gagcagcuuaugucaagccaga

SEQ ID NO: 1038617 - RNA, 22 nt, Human
agggaauguagcaagaugccaa

SEQ ID NO: 1038618 - RNA, 22 nt, Human
ucucugggauaaacugggccag

SEQ ID NO: 1038619 - RNA, 22 nt, Human
cagcagcuucuguugaucagaa

SEQ ID NO: 1038620 - RNA, 22 nt, Human
uuugcuauuuuucugugcagcu

SEQ ID NO: 1038621 - RNA, 22 nt, Human
uuuuucaugagacuagaaguca

SEQ ID NO: 1038622 - RNA, 22 nt, Human
caaauguguagagcuuuugggg

SEQ ID NO: 1038623 - RNA, 22 nt, Human
gauuuccuugcauauugguaau

SEQ ID NO: 1038624 - RNA, 22 nt, Human
uuugcauuuauaaguuggugga

SEQ ID NO: 1038625 - RNA, 22 nt, Human
accuggccauccagcuggcauc

SEQ ID NO: 1038626 - RNA, 22 nt, Human
uggagcagagaugguggccuuc

SEQ ID NO: 1038627 - RNA, 22 nt, Human
cuggguggaucgcagccccagg

SEQ ID NO: 1038628 - RNA, 20 nt, Human
cccuggagagaagcuccacg

SEQ ID NO: 1038629 - RNA, 22 nt, Human
ccuggagcuuggucacgcugcg

SEQ ID NO: 1038630 - RNA, 22 nt, Human
cccugcagaaccacagacaaac

SEQ ID NO: 1038631 - RNA, 22 nt, Human
agagaauuacagaagaauguca

SEQ ID NO: 1038632 - RNA, 22 nt, Human
ucaguuuucauuucaugagcag

SEQ ID NO: 1038633 - RNA, 22 nt, Human
ccugccagugaagcugacgggc

SEQ ID NO: 1038634 - RNA, 18 nt, Human
ggcugugcguggaggcug

SEQ ID NO: 1038635 - RNA, 22 nt, Human
agcagcuccugccaugagugcu

SEQ ID NO: 1038636 - RNA, 22 nt, Human
ucaaauguucccuguacuggcc

SEQ ID NO: 1038637 - RNA, 21 nt, Human
ugucagaaauaagcaugugau

SEQ ID NO: 1038638 - RNA, 22 nt, Human
ccaggagucuggaugagguguc

SEQ ID NO: 1038639 - RNA, 22 nt, Human
gucucagggacugcuucugggg

SEQ ID NO: 1038640 - RNA, 22 nt, Human
gacagcaggagaucaugauaga

SEQ ID NO: 1038641 - RNA, 22 nt, Human
agauuucagguuggggcagaag

SEQ ID NO: 1038642 - RNA, 22 nt, Human
ucugccuucgcugcucccugaa

SEQ ID NO: 1038643 - RNA, 22 nt, Human
uccugagauguggagcuccaug

SEQ ID NO: 1038644 - RNA, 22 nt, Human
gcccugggauuggguggaggcu

SEQ ID NO: 1038645 - RNA, 20 nt, Human
cucaguguggccugaguguu

SEQ ID NO: 1038646 - RNA, 20 nt, Human
uacauucaaaacaaacucug

SEQ ID NO: 1038647 - RNA, 23 nt, Human
uggccugcagaguuucugcuggg

SEQ ID NO: 1038648 - RNA, 22 nt, Human
gggcaugguggcaggcaccugu

SEQ ID NO: 1038649 - RNA, 19 nt, Human
gagguggguccccgcagcc

SEQ ID NO: 1038650 - RNA, 22 nt, Human
aaaugcauaucaaagacuugaa

SEQ ID NO: 1038651 - RNA, 22 nt, Human
ucugggcucugucagcaccucu

SEQ ID NO: 1038652 - RNA, 22 nt, Human
cagaauaugacaagauuuuccu

SEQ ID NO: 1038653 - RNA, 22 nt, Human
uuccuguaguugugcaauguac

SEQ ID NO: 1038654 - RNA, 22 nt, Human
ccauuugucaccucugcacucc

SEQ ID NO: 1038655 - RNA, 22 nt, Human
acuggaagccaguugacaauca

SEQ ID NO: 1038656 - RNA, 22 nt, Human
caggagcucuuaaggaugugau

SEQ ID NO: 1038657 - RNA, 22 nt, Human
ugucucagaguaucccugaacu

SEQ ID NO: 1038658 - RNA, 22 nt, Human
ccagucagccaagcugcagcgg

SEQ ID NO: 1038659 - RNA, 22 nt, Human
gcucugggcugcccucuggaca

SEQ ID NO: 1038660 - RNA, 23 nt, Human
gcucugagggcuuaucccuccca

SEQ ID NO: 1038661 - RNA, 22 nt, Human
uguaggauuuucaccagaccuu

SEQ ID NO: 1038662 - RNA, 22 nt, Human
uggcucagucuggguugacuga

SEQ ID NO: 1038663 - RNA, 22 nt, Human
ccaccuccaccuauugccagcc

SEQ ID NO: 1038664 - RNA, 22 nt, Human
gggaggcuggcucuggccacag

SEQ ID NO: 1038665 - RNA, 22 nt, Human
caugggaggucugcaaggugcu

SEQ ID NO: 1038666 - RNA, 22 nt, Human
ucaggcugaggucaucugcauc

SEQ ID NO: 1038667 - RNA, 22 nt, Human
ccuguccuccaagagcacaucu

SEQ ID NO: 1038668 - RNA, 22 nt, Human
cacaggcugcccgcagcuggga

SEQ ID NO: 1038669 - RNA, 22 nt, Human
aggcuccuaucgcuuucagcaa

SEQ ID NO: 1038670 - RNA, 22 nt, Human
cugaggcucaagggcagguggg

SEQ ID NO: 1038671 - RNA, 22 nt, Human
agguauagaauugaaaggguuu

SEQ ID NO: 1038672 - RNA, 22 nt, Human
ucuguggccuguguccaagugc

SEQ ID NO: 1038673 - RNA, 22 nt, Human
ucuggcucugaauucacuucug

SEQ ID NO: 1038674 - RNA, 20 nt, Human
aggcacuggauuucuuauau

SEQ ID NO: 1038675 - RNA, 22 nt, Human
ggauggagaugaccauggugac

SEQ ID NO: 1038676 - RNA, 22 nt, Human
auuuuucucuccacuccauuaa

SEQ ID NO: 1038677 - RNA, 22 nt, Human
cuuaacagagagaaguguugcu

SEQ ID NO: 1038678 - RNA, 22 nt, Human
cccagccugucuuucccaauga

SEQ ID NO: 1038679 - RNA, 22 nt, Human
cucaggauuuacuaauuucaag

SEQ ID NO: 1038680 - RNA, 19 nt, Human
uccauaagcuuguguucau

SEQ ID NO: 1038681 - RNA, 22 nt, Human
aagggcagggaguuugugucua

SEQ ID NO: 1038682 - RNA, 22 nt, Human
aaggcacugagccagccgucuc

SEQ ID NO: 1038683 - RNA, 22 nt, Human
agggcagcagcuccuccuagcu

SEQ ID NO: 1038684 - RNA, 22 nt, Human
uaugcacacauguaugcaugug

SEQ ID NO: 1038685 - RNA, 18 nt, Human
uucacaggaaaugucuuu

SEQ ID NO: 1038686 - RNA, 22 nt, Human
gucucccaaccccugugcccag

SEQ ID NO: 1038687 - RNA, 22 nt, Human
ccaggacucaguggggaaaggg

SEQ ID NO: 1038688 - RNA, 22 nt, Human
ucauaaaacacaccagguaguu

SEQ ID NO: 1038689 - RNA, 22 nt, Human
gcaggaagaugagcucagguaa

SEQ ID NO: 1038690 - RNA, 22 nt, Human
uuuucuaacaucuaguaauuug

SEQ ID NO: 1038691 - RNA, 22 nt, Human
gcaggcaggcuuccuugaacug

SEQ ID NO: 1038692 - RNA, 22 nt, Human
ggcagagacuggguuggcagag

SEQ ID NO: 1038693 - RNA, 22 nt, Human
caggaccuggaaugcuugugaa

SEQ ID NO: 1038694 - RNA, 22 nt, Human
agccagcuggugggucagcugg

SEQ ID NO: 1038695 - RNA, 22 nt, Human
cagggcuccccgcaccgcagcc

SEQ ID NO: 1038696 - RNA, 22 nt, Human
uguuccaucaguuuuugguuga

SEQ ID NO: 1038697 - RNA, 22 nt, Human
agagccuggaccugagcuacaa

SEQ ID NO: 1038698 - RNA, 22 nt, Human
ugaggcagcaauuguauuguau

SEQ ID NO: 1038699 - RNA, 22 nt, Human
ccugacucuggccaggccagcu

SEQ ID NO: 1038700 - RNA, 22 nt, Human
ucucagagcucacaccuccugg

SEQ ID NO: 1038701 - RNA, 21 nt, Human
aaagagguuaauauuguaagu

SEQ ID NO: 1038702 - RNA, 22 nt, Human
ggcugagcucaggggcagcagg

SEQ ID NO: 1038703 - RNA, 22 nt, Human
gggcagaggggcgcuucccucu

SEQ ID NO: 1038704 - RNA, 22 nt, Human
auucagcaguuccugcuucagu

SEQ ID NO: 1038705 - RNA, 21 nt, Human
uccaggaguggcugggcaggg

SEQ ID NO: 1038706 - RNA, 22 nt, Human
gccugccuuugugaggaagcgg

SEQ ID NO: 1038707 - RNA, 22 nt, Human
ggaaagaccugagauaggaaua

SEQ ID NO: 1038708 - RNA, 22 nt, Human
ugaagcaggaaacuucuuguuu

SEQ ID NO: 1038709 - RNA, 22 nt, Human
uauccaauucaccauugauggg

SEQ ID NO: 1038710 - RNA, 22 nt, Human
cagagcugcuucccaguuugug

SEQ ID NO: 1038711 - RNA, 22 nt, Human
gcugggagcaaguacucaucuu

SEQ ID NO: 1038712 - RNA, 22 nt, Human
ccagggcagggaccacgugucu

SEQ ID NO: 1038713 - RNA, 22 nt, Human
cugccagcucucuggaggcucu

SEQ ID NO: 1038714 - RNA, 22 nt, Human
gccaggaguucagaugcauguu

SEQ ID NO: 1038715 - RNA, 22 nt, Human
aaaguuuuagaacuaggaagca

SEQ ID NO: 1038716 - RNA, 22 nt, Human
gugccugcagcaauccauggca

SEQ ID NO: 1038717 - RNA, 22 nt, Human
cucccagagaccaagcugagaa

SEQ ID NO: 1038718 - RNA, 22 nt, Human
cuggccugaggccgccuucaga

SEQ ID NO: 1038719 - RNA, 22 nt, Human
gcuuucucuucacugauguuca

SEQ ID NO: 1038720 - RNA, 22 nt, Human
agcagcucacaggauuccugaa

SEQ ID NO: 1038721 - RNA, 22 nt, Human
uucugggacaucuggacaguuu

SEQ ID NO: 1038722 - RNA, 22 nt, Human
cucagagcaaugaacaugcaaa

SEQ ID NO: 1038723 - RNA, 22 nt, Human
uauucacaguugauuuacaguu

SEQ ID NO: 1038724 - RNA, 22 nt, Human
ggcugcuuuaucggcugcugaa

SEQ ID NO: 1038725 - RNA, 22 nt, Human
cuuuggaagugaccacaauccu

SEQ ID NO: 1038726 - RNA, 22 nt, Human
uggcagaguuauggguauuuau

SEQ ID NO: 1038727 - RNA, 22 nt, Human
agggcuggccacaugauuuggu

SEQ ID NO: 1038728 - RNA, 22 nt, Human
aagauguaucaguuaagucuuc

SEQ ID NO: 1038729 - RNA, 22 nt, Human
acucccacuccagaguagaagc

SEQ ID NO: 1038730 - RNA, 22 nt, Human
uccauuuuguagguaugcuaca

SEQ ID NO: 1038731 - RNA, 22 nt, Human
cucaggauagcugcgcagccug

SEQ ID NO: 1038732 - RNA, 22 nt, Human
ggccgggcaggucucagccagc

SEQ ID NO: 1038733 - RNA, 22 nt, Human
caagagcuggagaggcagucua

SEQ ID NO: 1038734 - RNA, 22 nt, Human
cugcagcuguagaggacagugg

SEQ ID NO: 1038735 - RNA, 22 nt, Human
ucccaagugucuuggaccaggg

SEQ ID NO: 1038736 - RNA, 22 nt, Human
ugccagcaguagcaguaggcca

SEQ ID NO: 1038737 - RNA, 19 nt, Human
aggacucuggaggcaugag

SEQ ID NO: 1038738 - RNA, 22 nt, Human
acccagagcugggcuuggcaaa

SEQ ID NO: 1038739 - RNA, 22 nt, Human
uacaugcuccacuuucuccugu

SEQ ID NO: 1038740 - RNA, 22 nt, Human
auucaagagcccauguuuccug

SEQ ID NO: 1038741 - RNA, 20 nt, Human
ucagugauuaucucugagug

SEQ ID NO: 1038742 - RNA, 22 nt, Human
aaaaucugcuuccuuuuacaga

SEQ ID NO: 1038743 - RNA, 22 nt, Human
ucacagggcauuauggcuccag

SEQ ID NO: 1038744 - RNA, 22 nt, Human
ccauaagguuuggggccaugca

SEQ ID NO: 1038745 - RNA, 22 nt, Human
agcuccugcacccagccuugag

SEQ ID NO: 1038746 - RNA, 22 nt, Human
ggagaaggaagaaagcuacuau

SEQ ID NO: 1038747 - RNA, 22 nt, Human
acauauuuccaugcagcauguc

SEQ ID NO: 1038748 - RNA, 21 nt, Human
gcucuuggaaggggcucagcu

SEQ ID NO: 1038749 - RNA, 22 nt, Human
cagcacugcuucgcagccaggg

SEQ ID NO: 1038750 - RNA, 22 nt, Human
ucugcagcgugcaggcuggugc

SEQ ID NO: 1038751 - RNA, 22 nt, Human
cauggccuugagugacugcacu

SEQ ID NO: 1038752 - RNA, 22 nt, Human
cccaagaucuuucgugcacuaa

SEQ ID NO: 1038753 - RNA, 22 nt, Human
cugggaggcaccgcgucgugcu

SEQ ID NO: 1038754 - RNA, 22 nt, Human
uccuucagcucucuauuuagau

SEQ ID NO: 1038755 - RNA, 22 nt, Human
aggagccaguuccaccccagga

SEQ ID NO: 1038756 - RNA, 22 nt, Human
ggccuuggugcucuguguugca

SEQ ID NO: 1038757 - RNA, 22 nt, Human
uacuuuggauccuuacaauagc

SEQ ID NO: 1038758 - RNA, 22 nt, Human
uauguguacaucugguugagca

SEQ ID NO: 1038759 - RNA, 22 nt, Human
cagcuugcaguacuuguuuuug

SEQ ID NO: 1038760 - RNA, 22 nt, Human
accaguccgcggagcuccgggg

SEQ ID NO: 1038761 - RNA, 22 nt, Human
ugugccuggcauucugggcuuc

SEQ ID NO: 1038762 - RNA, 22 nt, Human
gaaagaggaaggagauguauua

SEQ ID NO: 1038763 - RNA, 22 nt, Human
auaugugugccauuucagcagu

SEQ ID NO: 1038764 - RNA, 22 nt, Human
uggcucagccagcccuaggaac

SEQ ID NO: 1038765 - RNA, 22 nt, Human
gagccaggcaccuucuguguug

SEQ ID NO: 1038766 - RNA, 22 nt, Human
caggcacuguguuaggcacugu

SEQ ID NO: 1038767 - RNA, 22 nt, Human
cagggcuggcuguggcaaucuc

SEQ ID NO: 1038768 - RNA, 22 nt, Human
agagccugcuguguaagucaca

SEQ ID NO: 1038769 - RNA, 22 nt, Human
auuauguagguuaggugguugu

SEQ ID NO: 1038770 - RNA, 17 nt, Human
guccugggaggagagag

SEQ ID NO: 1038771 - RNA, 22 nt, Human
ggcccaucucuugcucuggguu

SEQ ID NO: 1038772 - RNA, 21 nt, Human
cagaggccucaugcucugugc

SEQ ID NO: 1038773 - RNA, 22 nt, Human
cugagaggcacaaggcauuucg

SEQ ID NO: 1038774 - RNA, 22 nt, Human
ggccugagcagacagcaugaug

SEQ ID NO: 1038775 - RNA, 22 nt, Human
cagacaggcuagccagacucac

SEQ ID NO: 1038776 - RNA, 22 nt, Human
ggagugacucacagcugggaca

SEQ ID NO: 1038777 - RNA, 22 nt, Human
ucagggcacauucugcaguggc

SEQ ID NO: 1038778 - RNA, 22 nt, Human
ggcaguggguuccccaaggcac

SEQ ID NO: 1038779 - RNA, 22 nt, Human
gggaugucacugugccuggcac

SEQ ID NO: 1038780 - RNA, 22 nt, Human
uuucacauaaauauuaugccua

SEQ ID NO: 1038781 - RNA, 22 nt, Human
uugucugucccagcuugugcau

SEQ ID NO: 1038782 - RNA, 22 nt, Human
ugcccaaguccuccaccgaggu

SEQ ID NO: 1038783 - RNA, 21 nt, Human
ucacuuauaauguauuugcug

SEQ ID NO: 1038784 - RNA, 22 nt, Human
ugcucuguauucuauggcaguu

SEQ ID NO: 1038785 - RNA, 22 nt, Human
gccaggcauuuguuaggugcug

SEQ ID NO: 1038786 - RNA, 22 nt, Human
aguccuucaagaaaucuggaaa

SEQ ID NO: 1038787 - RNA, 21 nt, Human
uuacuuuugcagcaaccuaau

SEQ ID NO: 1038788 - RNA, 22 nt, Human
ucccagcagucagagcuaugug

SEQ ID NO: 1038789 - RNA, 22 nt, Human
ugggaggcagguaggugaugau

SEQ ID NO: 1038790 - RNA, 22 nt, Human
uggggacacagagccaaacuau

SEQ ID NO: 1038791 - RNA, 22 nt, Human
uggcuggggagccccgacuccc

SEQ ID NO: 1038792 - RNA, 22 nt, Human
uaugugaauacagcaguggaug

SEQ ID NO: 1038793 - RNA, 22 nt, Human
acagaaauauucguggugcuug

SEQ ID NO: 1038794 - RNA, 22 nt, Human
gcaggcaguuugcuuuucccuc

SEQ ID NO: 1038795 - RNA, 22 nt, Human
accagccugucugagucguggg

SEQ ID NO: 1038796 - RNA, 22 nt, Human
aagcagcugauuucacagcuca

SEQ ID NO: 1038797 - RNA, 22 nt, Human
aguuuauguagaauuggcaaua

SEQ ID NO: 1038798 - RNA, 22 nt, Human
cauacauuuugcauauuuacca

SEQ ID NO: 1038799 - RNA, 22 nt, Human
agaaguaggcagggcuguauca

SEQ ID NO: 1038800 - RNA, 22 nt, Human
uaagcauucaaugcuuagcacu

SEQ ID NO: 1038801 - RNA, 22 nt, Human
gggcacuguggggcccaugcug

SEQ ID NO: 1038802 - RNA, 22 nt, Human
uaguuuuuucaacaaauggugc

SEQ ID NO: 1038803 - RNA, 22 nt, Human
agggucccgaaggagacagcaa

SEQ ID NO: 1038804 - RNA, 22 nt, Human
gcucccugacucaguuccugag

SEQ ID NO: 1038805 - RNA, 22 nt, Human
gcugggcagccccuacagagag

SEQ ID NO: 1038806 - RNA, 22 nt, Human
uggacagcgaaagugccuggga

SEQ ID NO: 1038807 - RNA, 22 nt, Human
gcucccagggaccgcagggcag

SEQ ID NO: 1038808 - RNA, 22 nt, Human
uaucuacaggugucagguaaga

SEQ ID NO: 1038809 - RNA, 22 nt, Human
auacaucuaugccuuucugaca

SEQ ID NO: 1038810 - RNA, 22 nt, Human
acauguguauagccuguauaga

SEQ ID NO: 1038811 - RNA, 22 nt, Human
gcaggggaguccacucuaugca

SEQ ID NO: 1038812 - RNA, 22 nt, Human
caaugugucaggaaaagggcca

SEQ ID NO: 1038813 - RNA, 22 nt, Human
accucugcaguagggcugugcc

SEQ ID NO: 1038814 - RNA, 22 nt, Human
aagaaugucguugguauuuuaa

SEQ ID NO: 1038815 - RNA, 22 nt, Human
aggcacugaccugcuuccuuga

SEQ ID NO: 1038816 - RNA, 22 nt, Human
cagcaauaagccagguuagaca

SEQ ID NO: 1038817 - RNA, 22 nt, Human
cauugacaucaggcuuggccaa

SEQ ID NO: 1038818 - RNA, 22 nt, Human
caggaacacaaugagucucaaa

SEQ ID NO: 1038819 - RNA, 22 nt, Human
uuugcauuuguucaaguauuga

SEQ ID NO: 1038820 - RNA, 22 nt, Human
agugucauuuuguccaucuucu

SEQ ID NO: 1038821 - RNA, 22 nt, Human
ucaguuuuuguuugccagauag

SEQ ID NO: 1038822 - RNA, 22 nt, Human
gcagggugauagugaggcucag

SEQ ID NO: 1038823 - RNA, 22 nt, Human
aagaacaacugcuuuaaaagca

SEQ ID NO: 1038824 - RNA, 22 nt, Human
agaggcuggauugagcauagac

SEQ ID NO: 1038825 - RNA, 22 nt, Human
gagcuuccugaugccgaccagu

SEQ ID NO: 1038826 - RNA, 22 nt, Human
cccugccuugggguccacaccg

SEQ ID NO: 1038827 - RNA, 22 nt, Human
cugcucuguuucuuagcugggu

SEQ ID NO: 1038828 - RNA, 17 nt, Human
ugagcaguagaagaugc

SEQ ID NO: 1038829 - RNA, 22 nt, Human
ggauggagguucucagaugcuc

SEQ ID NO: 1038830 - RNA, 22 nt, Human
uauguacauaacaugaaaugca

SEQ ID NO: 1038831 - RNA, 22 nt, Human
ucucacuggguauaaaugagua

SEQ ID NO: 1038832 - RNA, 22 nt, Human
ugucauguguucuuaaauacau

SEQ ID NO: 1038833 - RNA, 22 nt, Human
gcacacagauuaggaaacagaa

SEQ ID NO: 1038834 - RNA, 22 nt, Human
cagcugccacuugcucucggcu

SEQ ID NO: 1038835 - RNA, 22 nt, Human
accaucagagcacaguccgugc

SEQ ID NO: 1038836 - RNA, 22 nt, Human
ccugagggcgccgagcucccag

SEQ ID NO: 1038837 - RNA, 22 nt, Human
gugucauggaaaauugcaaugg

SEQ ID NO: 1038838 - RNA, 22 nt, Human
ugcagucuggauguccucagau

SEQ ID NO: 1038839 - RNA, 22 nt, Human
guguuuccuaguuuaaugaaug

SEQ ID NO: 1038840 - RNA, 22 nt, Human
uacuuuaaaaacugauaauuca

SEQ ID NO: 1038841 - RNA, 22 nt, Human
cccugcugucaggugcugggag

SEQ ID NO: 1038842 - RNA, 22 nt, Human
gugucccaaucuacuuuucccu

SEQ ID NO: 1038843 - RNA, 21 nt, Human
ggccugagcaccuguccaccu

SEQ ID NO: 1038844 - RNA, 22 nt, Human
guccucagucaguuuggugggg

SEQ ID NO: 1038845 - RNA, 22 nt, Human
agugagggaugaagaacugcgg

SEQ ID NO: 1038846 - RNA, 22 nt, Human
aggcuggggaauugaauuugcu

SEQ ID NO: 1038847 - RNA, 22 nt, Human
guggccugccagcagauggcgc

SEQ ID NO: 1038848 - RNA, 22 nt, Human
agcccagcaaagggagguucag

SEQ ID NO: 1038849 - RNA, 20 nt, Human
uaugaguauuacuuucagga

SEQ ID NO: 1038850 - RNA, 22 nt, Human
cugccagcaaugugaccaugcu

SEQ ID NO: 1038851 - RNA, 22 nt, Human
uccaaacacccuccaugcugca

SEQ ID NO: 1038852 - RNA, 22 nt, Human
ccuguguggaaaccgcaugacg

SEQ ID NO: 1038853 - RNA, 22 nt, Human
uccuggagauaauugcagugaa

SEQ ID NO: 1038854 - RNA, 22 nt, Human
ggcucuggugcccuggcuccca

SEQ ID NO: 1038855 - RNA, 22 nt, Human
caugucuggguauaugcauaug

SEQ ID NO: 1038856 - RNA, 22 nt, Human
gaggccugguuugcaugagaau

SEQ ID NO: 1038857 - RNA, 22 nt, Human
aaaucaaaagacauguguuuua

SEQ ID NO: 1038858 - RNA, 22 nt, Human
aacaggagaguaaauauaugau

SEQ ID NO: 1038859 - RNA, 22 nt, Human
agggcccauagaucgucagcuu

SEQ ID NO: 1038860 - RNA, 22 nt, Human
cacagaaaaaggcuugaaaauc

SEQ ID NO: 1038861 - RNA, 22 nt, Human
cugccugcuucugagccagagg

SEQ ID NO: 1038862 - RNA, 22 nt, Human
cagcugaguguuggcauguuca

SEQ ID NO: 1038863 - RNA, 22 nt, Human
uggccacagccucugccaguuc

SEQ ID NO: 1038864 - RNA, 22 nt, Human
acaguaauauugaugcucguca

SEQ ID NO: 1038865 - RNA, 22 nt, Human
uccucagacuucccuuugugua

SEQ ID NO: 1038866 - RNA, 22 nt, Human
cugggcugugguguggcccaaa

SEQ ID NO: 1038867 - RNA, 22 nt, Human
auuuuuccaugauacuuaucug

SEQ ID NO: 1038868 - RNA, 22 nt, Human
acugucaccaucagagcgggaa

SEQ ID NO: 1038869 - RNA, 22 nt, Human
gacucugcuacaggccgagguu

SEQ ID NO: 1038870 - RNA, 22 nt, Human
ugccugggguuggcaaacugcu

SEQ ID NO: 1038871 - RNA, 21 nt, Human
acaugcauagagagauuucug

SEQ ID NO: 1038872 - RNA, 22 nt, Human
uacagucuuuggaaagagauag

SEQ ID NO: 1038873 - RNA, 22 nt, Human
uauguacagggauagaacuuga

SEQ ID NO: 1038874 - RNA, 22 nt, Human
acugggccuugccauggcagcc

SEQ ID NO: 1038875 - RNA, 22 nt, Human
cccagcaucuccaggcauggcc

SEQ ID NO: 1038876 - RNA, 22 nt, Human
ccagguggugaaagugggcccu

SEQ ID NO: 1038877 - RNA, 22 nt, Human
ucuggagcgaggucccugucug

SEQ ID NO: 1038878 - RNA, 22 nt, Human
ugggcccugacuucaagcaucc

SEQ ID NO: 1038879 - RNA, 22 nt, Human
aaacauugcuaaauaaugcugc

SEQ ID NO: 1038880 - RNA, 17 nt, Human
cugcuuugugcaacgcu

SEQ ID NO: 1038881 - RNA, 22 nt, Human
cccuggaggucagaggccuggg

SEQ ID NO: 1038882 - RNA, 22 nt, Human
uauucacagcugccgcacucag

SEQ ID NO: 1038883 - RNA, 22 nt, Human
aaguucaauggaaaagcuuuag

SEQ ID NO: 1038884 - RNA, 22 nt, Human
cuuugcaauagaggcacacaug

SEQ ID NO: 1038885 - RNA, 22 nt, Human
ccuuccuggagcccaugcagau

SEQ ID NO: 1038886 - RNA, 22 nt, Human
auuuaugacuggugaauagaac

SEQ ID NO: 1038887 - RNA, 22 nt, Human
cagagguagccgagugcaaucg

SEQ ID NO: 1038888 - RNA, 22 nt, Human
ccaucagcuccaguaucuucug

SEQ ID NO: 1038889 - RNA, 22 nt, Human
gaagcagcaaaucugcaguauc

SEQ ID NO: 1038890 - RNA, 22 nt, Human
ucugucacccaggcuggagugc

SEQ ID NO: 1038891 - RNA, 19 nt, Human
acccagagcccuuugcagg

SEQ ID NO: 1038892 - RNA, 21 nt, Human
uaaagaagaugaaugugauca

SEQ ID NO: 1038893 - RNA, 22 nt, Human
gcagcugcagguggucccaugc

SEQ ID NO: 1038894 - RNA, 22 nt, Human
ggcagagcuuguuccuucuguu

SEQ ID NO: 1038895 - RNA, 22 nt, Human
ugcuggggagugauugaccauc

SEQ ID NO: 1038896 - RNA, 18 nt, Human
aaagaaggauuggagagc

SEQ ID NO: 1038897 - RNA, 22 nt, Human
agggagcuuccgaacuacagcu

SEQ ID NO: 1038898 - RNA, 22 nt, Human
gaggcucagagggagcaugguc

SEQ ID NO: 1038899 - RNA, 21 nt, Human
ugcaggagucugugagucagg

SEQ ID NO: 1038900 - RNA, 22 nt, Human
gugcagagaaaugagaagucga

SEQ ID NO: 1038901 - RNA, 22 nt, Human
agcccagguugaggcugcagug

SEQ ID NO: 1038902 - RNA, 23 nt, Human
uguaaaaugggguaguguuacca

SEQ ID NO: 1038903 - RNA, 22 nt, Human
ugcaugcagcuggugauaagaa

SEQ ID NO: 1038904 - RNA, 22 nt, Human
gccuggagacagcagaggcggc

SEQ ID NO: 1038905 - RNA, 22 nt, Human
cuauugaauagcccaaaucauu

SEQ ID NO: 1038906 - RNA, 22 nt, Human
uuccgcuggggccgccuggcgg

SEQ ID NO: 1038907 - RNA, 21 nt, Human
agcuggugucagagcucuggg

SEQ ID NO: 1038908 - RNA, 22 nt, Human
acauuuaaauaugccuuauauu

SEQ ID NO: 1038909 - RNA, 22 nt, Human
uaagaacagugacagccaacau

SEQ ID NO: 1038910 - RNA, 22 nt, Human
gcugccuguugaagggucugug

SEQ ID NO: 1038911 - RNA, 22 nt, Human
aggcacuguggaagacaugguu

SEQ ID NO: 1038912 - RNA, 22 nt, Human
gcaggagcucguuuccaggcug

SEQ ID NO: 1038913 - RNA, 22 nt, Human
ugggccaggauuucaagacccu

SEQ ID NO: 1038914 - RNA, 22 nt, Human
aagaugcuuauugcuccugcag

SEQ ID NO: 1038915 - RNA, 22 nt, Human
cugucagguuggucucagagcu

SEQ ID NO: 1038916 - RNA, 19 nt, Human
gccaggagggcucuggcug

SEQ ID NO: 1038917 - RNA, 22 nt, Human
acugagcugcaagucagggagg

SEQ ID NO: 1038918 - RNA, 22 nt, Human
ucugggagauccaagcagaacu

SEQ ID NO: 1038919 - RNA, 22 nt, Human
gggcagcagcaggaggucucug

SEQ ID NO: 1038920 - RNA, 22 nt, Human
cagcagugugcaggugugcugg

SEQ ID NO: 1038921 - RNA, 22 nt, Human
gggugggguguaucggauccua

SEQ ID NO: 1038922 - RNA, 22 nt, Human
gaacagaauuaccgaagaucug

SEQ ID NO: 1038923 - RNA, 22 nt, Human
cucuggagcgcugcuucccgcg

SEQ ID NO: 1038924 - RNA, 22 nt, Human
gagagcugugguuugaccaggc

SEQ ID NO: 1038925 - RNA, 22 nt, Human
uuauuaaugaguacaaguuauu

SEQ ID NO: 1038926 - RNA, 22 nt, Human
acagcagcuaaccccugggcca

SEQ ID NO: 1038927 - RNA, 22 nt, Human
caguacuuauuucuauuuaggg

SEQ ID NO: 1038928 - RNA, 19 nt, Human
acagagcucucugcuucug

SEQ ID NO: 1038929 - RNA, 22 nt, Human
uggaggcaucagagugcuuggc

SEQ ID NO: 1038930 - RNA, 22 nt, Human
gcaggcugauagaggauuccau

SEQ ID NO: 1038931 - RNA, 22 nt, Human
aaucgguugaacccaggaagug

SEQ ID NO: 1038932 - RNA, 22 nt, Human
cccacucccugcacgccugccg

SEQ ID NO: 1038933 - RNA, 22 nt, Human
cagacaugauguaagcagaggc

SEQ ID NO: 1038934 - RNA, 22 nt, Human
gugugccaccagucaaggugaa

SEQ ID NO: 1038935 - RNA, 22 nt, Human
ggcccugggcagaggagugggc

SEQ ID NO: 1038936 - RNA, 19 nt, Human
cugugcaggccgggcugag

SEQ ID NO: 1038937 - RNA, 22 nt, Human
gccugugacucgucuugggcca

SEQ ID NO: 1038938 - RNA, 22 nt, Human
uccugccuugccugggacauca

SEQ ID NO: 1038939 - RNA, 22 nt, Human
aaauucuuucauggcuaauaag

SEQ ID NO: 1038940 - RNA, 20 nt, Human
uucuggaggcuacaagucug

SEQ ID NO: 1038941 - RNA, 22 nt, Human
uauuacugagguuuuauggagu

SEQ ID NO: 1038942 - RNA, 22 nt, Human
aagaguuaagcaacagauacca

SEQ ID NO: 1038943 - RNA, 22 nt, Human
gagagugaugaaugguuaaaca

SEQ ID NO: 1038944 - RNA, 22 nt, Human
agggcucugagugggaaagagg

SEQ ID NO: 1038945 - RNA, 21 nt, Human
agaugaggauacugaggccua

SEQ ID NO: 1038946 - RNA, 22 nt, Human
acugaaggcuuaacucuuucau

SEQ ID NO: 1038947 - RNA, 22 nt, Human
gcugcucugcuguguaagcagg

SEQ ID NO: 1038948 - RNA, 22 nt, Human
ggcugcuguuucagagacuguu

SEQ ID NO: 1038949 - RNA, 22 nt, Human
gaugaggggucauuggcuggga

SEQ ID NO: 1038950 - RNA, 22 nt, Human
ugucccaggcugaaguacagug

SEQ ID NO: 1038951 - RNA, 22 nt, Human
cugcccugcccaggccuugggc

SEQ ID NO: 1038952 - RNA, 22 nt, Human
agggcagacuaggauggaagug

SEQ ID NO: 1038953 - RNA, 22 nt, Human
agggcugccugacuccagagcc

SEQ ID NO: 1038954 - RNA, 22 nt, Human
uuuagaaauugcagagugggug

SEQ ID NO: 1038955 - RNA, 22 nt, Human
ggaggugaggccguagggugug

SEQ ID NO: 1038956 - RNA, 20 nt, Human
ccagguggugccuggagagg

SEQ ID NO: 1038957 - RNA, 22 nt, Human
uggaggcaccacuggcugcccg

SEQ ID NO: 1038958 - RNA, 22 nt, Human
gcucacagccggcuggcagggg

SEQ ID NO: 1038959 - RNA, 22 nt, Human
cagacacaccaggcccauucug

SEQ ID NO: 1038960 - RNA, 22 nt, Human
gccaccucggcuuucucugcuc

SEQ ID NO: 1038961 - RNA, 22 nt, Human
ccaggacuuuaaguccagcacu

SEQ ID NO: 1038962 - RNA, 22 nt, Human
cuuccucugcggcgccgggcgc

SEQ ID NO: 1038963 - RNA, 17 nt, Human
gcaaucucagucuccuu

SEQ ID NO: 1038964 - RNA, 22 nt, Human
agcagggguaacagaaggaaag

SEQ ID NO: 1038965 - RNA, 22 nt, Human
uuacaaagcguugagacaagua

SEQ ID NO: 1038966 - RNA, 22 nt, Human
aggaaaaaccuguuaaugguag

SEQ ID NO: 1038967 - RNA, 22 nt, Human
ccugagagagaagcgaccuggu

SEQ ID NO: 1038968 - RNA, 21 nt, Human
aggugccaaggagaagcaggc

SEQ ID NO: 1038969 - RNA, 22 nt, Human
gcagcugccuauucagggcuug

SEQ ID NO: 1038970 - RNA, 22 nt, Human
acccucccauuuccauguagca

SEQ ID NO: 1038971 - RNA, 22 nt, Human
cacauuucuaggaaauuaaaug

SEQ ID NO: 1038972 - RNA, 22 nt, Human
caggaaugacugcagauggggc

SEQ ID NO: 1038973 - RNA, 22 nt, Human
ggcugucugugguggagcguug

SEQ ID NO: 1038974 - RNA, 22 nt, Human
aggacccagaggcagaggacgu

SEQ ID NO: 1038975 - RNA, 20 nt, Human
gccugccucagcuagcugag

SEQ ID NO: 1038976 - RNA, 22 nt, Human
agaaaagggcaggagggauaca

SEQ ID NO: 1038977 - RNA, 22 nt, Human
aggauccuuuggccacuucuua

SEQ ID NO: 1038978 - RNA, 22 nt, Human
gcugccugccuaguuccacagu

SEQ ID NO: 1038979 - RNA, 22 nt, Human
aagcagugcgcucaucuaaggg

SEQ ID NO: 1038980 - RNA, 22 nt, Human
gcagagcugggucuguauccaa

SEQ ID NO: 1038981 - RNA, 22 nt, Human
uauguacacauacacuuguaau

SEQ ID NO: 1038982 - RNA, 22 nt, Human
agggaggagaauggacuccuuc

SEQ ID NO: 1038983 - RNA, 22 nt, Human
ugggcagagaucuggaucaaac

SEQ ID NO: 1038984 - RNA, 22 nt, Human
ggcuggaaaagacaaagcuauu

SEQ ID NO: 1038985 - RNA, 22 nt, Human
gcugucacauuuggagcacugg

SEQ ID NO: 1038986 - RNA, 22 nt, Human
ggagcuguugcgcaugcgcucg

SEQ ID NO: 1038987 - RNA, 22 nt, Human
agcaggguauguuagagcugua

SEQ ID NO: 1038988 - RNA, 22 nt, Human
auauucuuccaaaacaucauuu

SEQ ID NO: 1038989 - RNA, 22 nt, Human
acagguggaggcuuuaggaggu

SEQ ID NO: 1038990 - RNA, 22 nt, Human
cuguguccugcgucaagccaau

SEQ ID NO: 1038991 - RNA, 22 nt, Human
cugaaggacuuggugauaguug

SEQ ID NO: 1038992 - RNA, 22 nt, Human
cuuugaaaacuuaaauaacagc

SEQ ID NO: 1038993 - RNA, 22 nt, Human
ugcagcaggagccaggccuggu

SEQ ID NO: 1038994 - RNA, 22 nt, Human
gcucccugcagcugagaguucc

SEQ ID NO: 1038995 - RNA, 22 nt, Human
uccaggcuagguuuacaggaca

SEQ ID NO: 1038996 - RNA, 23 nt, Human
ugucccagagggagggauaggcu

SEQ ID NO: 1038997 - RNA, 22 nt, Human
ccaggcagccaagugugugugu

SEQ ID NO: 1038998 - RNA, 22 nt, Human
uacauugugauguuucaauaca

SEQ ID NO: 1038999 - RNA, 22 nt, Human
ucagagugguagccuauuuucu

SEQ ID NO: 1039000 - RNA, 18 nt, Human
gaaaugugauucuagggc

SEQ ID NO: 1039001 - RNA, 22 nt, Human
auucuguauuucuaauaagauc

SEQ ID NO: 1039002 - RNA, 22 nt, Human
caagcagagacuagauagcugu

SEQ ID NO: 1039003 - RNA, 23 nt, Human
uggcagcagaucuuaaagugacc

SEQ ID NO: 1039004 - RNA, 22 nt, Human
cugggagguggagguugcauug

SEQ ID NO: 1039005 - RNA, 22 nt, Human
gguagcagggcugugagucaga

SEQ ID NO: 1039006 - RNA, 22 nt, Human
cuccaggagcugugucuuucuu

SEQ ID NO: 1039007 - RNA, 22 nt, Human
ggccucagaccggagcuggcca

SEQ ID NO: 1039008 - RNA, 17 nt, Human
ucaugcccaacuauuac

SEQ ID NO: 1039009 - RNA, 22 nt, Human
cugagggcccugaagcuuggca

SEQ ID NO: 1039010 - RNA, 22 nt, Human
uuaaaaugcagauucugauuca

SEQ ID NO: 1039011 - RNA, 22 nt, Human
gcagggcucugcuguaguccua

SEQ ID NO: 1039012 - RNA, 22 nt, Human
ggcaggugcucugugggccugg

SEQ ID NO: 1039013 - RNA, 22 nt, Human
ccagccagcugcccuuggggcc

SEQ ID NO: 1039014 - RNA, 22 nt, Human
uaaugcacaugacugaacuauu

SEQ ID NO: 1039015 - RNA, 22 nt, Human
ugggggugaaagucuggacagu

SEQ ID NO: 1039016 - RNA, 22 nt, Human
cugugcugauucagcacaggcc

SEQ ID NO: 1039017 - RNA, 22 nt, Human
cagagacagggcagggagugug

SEQ ID NO: 1039018 - RNA, 22 nt, Human
aucagcaaucaaauugcagagu

SEQ ID NO: 1039019 - RNA, 22 nt, Human
ugacaugcuuguuuuccuugaa

SEQ ID NO: 1039020 - RNA, 22 nt, Human
caguggcuguuucuggaaggca

SEQ ID NO: 1039021 - RNA, 22 nt, Human
acauagcuuaaaugagaagaua

SEQ ID NO: 1039022 - RNA, 22 nt, Human
gaagcagcuaggaucuucauuu

SEQ ID NO: 1039023 - RNA, 22 nt, Human
guuccauaucacagcagacgaa

SEQ ID NO: 1039024 - RNA, 22 nt, Human
ucauugcaguagggagagaccc

SEQ ID NO: 1039025 - RNA, 22 nt, Human
gcagcugggacacugaggccag

SEQ ID NO: 1039026 - RNA, 22 nt, Human
uccucugcuguucugguucuuu

SEQ ID NO: 1039027 - RNA, 22 nt, Human
acagaauuaaugaaaauuacaa

SEQ ID NO: 1039028 - RNA, 22 nt, Human
uaccugagcccagugcagcaua

SEQ ID NO: 1039029 - RNA, 22 nt, Human
aggcaguguguagcuggaagag

SEQ ID NO: 1039030 - RNA, 22 nt, Human
uggcagcuggagggcaauggcc

SEQ ID NO: 1039031 - RNA, 22 nt, Human
ugaagcagagugaaggugaauu

SEQ ID NO: 1039032 - RNA, 22 nt, Human
uggagggaacccaggcugcucu

SEQ ID NO: 1039033 - RNA, 22 nt, Human
aaagguuaguucuuagaagugc

SEQ ID NO: 1039034 - RNA, 22 nt, Human
ccagagcuccagggcuacagaa

SEQ ID NO: 1039035 - RNA, 18 nt, Human
acugugguuuauguguag

SEQ ID NO: 1039036 - RNA, 21 nt, Human
ugcccacagcaaaugcagagg

SEQ ID NO: 1039037 - RNA, 22 nt, Human
ucugggcugggagcguguggac

SEQ ID NO: 1039038 - RNA, 23 nt, Human
agucaguguaaguuuggaaugca

SEQ ID NO: 1039039 - RNA, 22 nt, Human
ccugaggggcugcaggccagcu

SEQ ID NO: 1039040 - RNA, 22 nt, Human
uccagucaucucccuucacauu

SEQ ID NO: 1039041 - RNA, 23 nt, Human
cauguacacacagcuguacagug

SEQ ID NO: 1039042 - RNA, 22 nt, Human
aggcaugugacccuggacucag

SEQ ID NO: 1039043 - RNA, 22 nt, Human
caagcccaggauuccccaguua

SEQ ID NO: 1039044 - RNA, 22 nt, Human
aaugcacagcuaaagugguucc

SEQ ID NO: 1039045 - RNA, 22 nt, Human
uggagcagggcaucacugugcg

SEQ ID NO: 1039046 - RNA, 22 nt, Human
acaacaggguaaggcaggccau

SEQ ID NO: 1039047 - RNA, 22 nt, Human
aggagcugaagucucugcacuc

SEQ ID NO: 1039048 - RNA, 22 nt, Human
cacccacccacugcucauuggc

SEQ ID NO: 1039049 - RNA, 22 nt, Human
aauguguagggugccuguuuuu

SEQ ID NO: 1039050 - RNA, 22 nt, Human
guguaauugaaauugagaacca

SEQ ID NO: 1039051 - RNA, 22 nt, Human
aucuuucaguuucauaccaauu

SEQ ID NO: 1039052 - RNA, 22 nt, Human
agccacagcuccuugguggaga

SEQ ID NO: 1039053 - RNA, 22 nt, Human
ccugggugaaaucucuccugca

SEQ ID NO: 1039054 - RNA, 22 nt, Human
auguaguauuuggaaauguaaa

SEQ ID NO: 1039055 - RNA, 22 nt, Human
aagccaggcaugcuuggacagu

SEQ ID NO: 1039056 - RNA, 22 nt, Human
gguucacacuuucaugauuuca

SEQ ID NO: 1039057 - RNA, 22 nt, Human
ugcagcugcuggcccaggugcu

SEQ ID NO: 1039058 - RNA, 23 nt, Human
aggcugcagaagaauagggucau

SEQ ID NO: 1039059 - RNA, 19 nt, Human
agaaaucucgagauuuguu

SEQ ID NO: 1039060 - RNA, 22 nt, Human
cacauguaguaagcaggcaaug

SEQ ID NO: 1039061 - RNA, 22 nt, Human
agagccuggacuuuucugagcc

SEQ ID NO: 1039062 - RNA, 22 nt, Human
aauaaauguuaagauugucuca

SEQ ID NO: 1039063 - RNA, 22 nt, Human
cuguuuauacgacagguggagg

SEQ ID NO: 1039064 - RNA, 17 nt, Human
ugcauuguaggcuagcc

SEQ ID NO: 1039065 - RNA, 22 nt, Human
cucagagucugcauuucuguca

SEQ ID NO: 1039066 - RNA, 22 nt, Human
guguaauuauauaaagaucuac

SEQ ID NO: 1039067 - RNA, 22 nt, Human
auuuaaauuuucugauggagag

SEQ ID NO: 1039068 - RNA, 22 nt, Human
gaaaagagaacaucugaggauc

SEQ ID NO: 1039069 - RNA, 22 nt, Human
gcugggagaggcccugaaguga

SEQ ID NO: 1039070 - RNA, 22 nt, Human
uccuuucccuuuccauccuggc

SEQ ID NO: 1039071 - RNA, 22 nt, Human
acuccagggcuccaucccuugu

SEQ ID NO: 1039072 - RNA, 22 nt, Human
aacaaaugauaccaguucucaa

SEQ ID NO: 1039073 - RNA, 22 nt, Human
agugaaauccuggucaacaggu

SEQ ID NO: 1039074 - RNA, 22 nt, Human
aggggccauuguucugcccgcu

SEQ ID NO: 1039075 - RNA, 21 nt, Human
guggcucugccaggacugaaa

SEQ ID NO: 1039076 - RNA, 20 nt, Human
ucagaggcugccagcugggg

SEQ ID NO: 1039077 - RNA, 22 nt, Human
ugcagaagugagucaugaggaa

SEQ ID NO: 1039078 - RNA, 22 nt, Human
caucugcuguuccuuggacuca

SEQ ID NO: 1039079 - RNA, 22 nt, Human
auagugguuggauaugucagag

SEQ ID NO: 1039080 - RNA, 22 nt, Human
ugcccuguuccugccuccagcu

SEQ ID NO: 1039081 - RNA, 22 nt, Human
cuucccuuggugaacagagcau

SEQ ID NO: 1039082 - RNA, 21 nt, Human
ugcauaaagaaauacaaauac

SEQ ID NO: 1039083 - RNA, 22 nt, Human
cacuggggugggccugguagag

SEQ ID NO: 1039084 - RNA, 22 nt, Human
gggucccaggaaggagcagugu

SEQ ID NO: 1039085 - RNA, 22 nt, Human
ccacccugagccgcaagagcag

SEQ ID NO: 1039086 - RNA, 22 nt, Human
uccuccuucgggacugcuugac

SEQ ID NO: 1039087 - RNA, 22 nt, Human
aucuggcucuuccuggaguucc

SEQ ID NO: 1039088 - RNA, 23 nt, Human
ccugucugugcuggguggacaca

SEQ ID NO: 1039089 - RNA, 22 nt, Human
cggcagagcuuccugcucagcg

SEQ ID NO: 1039090 - RNA, 22 nt, Human
uggcucugcaccucaguguacc

SEQ ID NO: 1039091 - RNA, 22 nt, Human
gggccuggggugacguaccccu

SEQ ID NO: 1039092 - RNA, 22 nt, Human
uuagucaauagugaauauagag

SEQ ID NO: 1039093 - RNA, 22 nt, Human
ccaaagugcugggguuacaggc

SEQ ID NO: 1039094 - RNA, 22 nt, Human
ccuggcagcgccgaagcuggcc

SEQ ID NO: 1039095 - RNA, 23 nt, Human
uggccucuccccaccuggcagaa

SEQ ID NO: 1039096 - RNA, 22 nt, Human
aguacauuuauuaaugguaaaa

SEQ ID NO: 1039097 - RNA, 22 nt, Human
augcccgauaccuaguuaacuc

SEQ ID NO: 1039098 - RNA, 22 nt, Human
auucauucugaccucaagagaa

SEQ ID NO: 1039099 - RNA, 22 nt, Human
ucucugggugauggcagggcac

SEQ ID NO: 1039100 - RNA, 22 nt, Human
ccagaaaaugcagaacauagaa

SEQ ID NO: 1039101 - RNA, 22 nt, Human
caagaacaguuugccaaauugg

SEQ ID NO: 1039102 - RNA, 22 nt, Human
ucaggggcccuucccucagcag

SEQ ID NO: 1039103 - RNA, 23 nt, Human
aggugcagcccuggaccugcccc

SEQ ID NO: 1039104 - RNA, 22 nt, Human
ccaaggagcaaguuuacaccug

SEQ ID NO: 1039105 - RNA, 22 nt, Human
gccagggaggcuguaggguccu

SEQ ID NO: 1039106 - RNA, 22 nt, Human
uggacagguugaguaggaggag

SEQ ID NO: 1039107 - RNA, 22 nt, Human
ggaagagagggcugggccucaa

SEQ ID NO: 1039108 - RNA, 18 nt, Human
caggucagccuggccuca

SEQ ID NO: 1039109 - RNA, 19 nt, Human
ggucacagggguuacaagg

SEQ ID NO: 1039110 - RNA, 22 nt, Human
ggggacugccuuccacagacac

SEQ ID NO: 1039111 - RNA, 22 nt, Human
ucuggcucugacacuacuguua

SEQ ID NO: 1039112 - RNA, 22 nt, Human
gaaaaaugagcugaugucaggg

SEQ ID NO: 1039113 - RNA, 22 nt, Human
acuucuugggacccuggcaccg

SEQ ID NO: 1039114 - RNA, 18 nt, Human
guccugagcucugcugua

SEQ ID NO: 1039115 - RNA, 22 nt, Human
gccacguugccacccgggugac

SEQ ID NO: 1039116 - RNA, 22 nt, Human
gcucccacugcagcccugagcc

SEQ ID NO: 1039117 - RNA, 22 nt, Human
gaugauggacaaagcauuggug

SEQ ID NO: 1039118 - RNA, 20 nt, Human
aggagccauugacugcagca

SEQ ID NO: 1039119 - RNA, 22 nt, Human
agagagcccgggccagggcaca

SEQ ID NO: 1039120 - RNA, 22 nt, Human
gcaggcuccaggccggccccuu

SEQ ID NO: 1039121 - RNA, 22 nt, Human
aaaucuggccccuugccuauuu

SEQ ID NO: 1039122 - RNA, 22 nt, Human
acagguggagugguuagcaggc

SEQ ID NO: 1039123 - RNA, 22 nt, Human
ggcugccugaggcugaggcccg

SEQ ID NO: 1039124 - RNA, 22 nt, Human
gugggggcaggcagugcuagga

SEQ ID NO: 1039125 - RNA, 22 nt, Human
cagcuuccaucuccacugcccu

SEQ ID NO: 1039126 - RNA, 22 nt, Human
gcagagugaggaagagcuucca

SEQ ID NO: 1039127 - RNA, 22 nt, Human
uggcucagcuuacuuuugaggg

SEQ ID NO: 1039128 - RNA, 22 nt, Human
cauuacaugguccaggauauau

SEQ ID NO: 1039129 - RNA, 22 nt, Human
guggcugcuaagucuccuuccu

SEQ ID NO: 1039130 - RNA, 22 nt, Human
gcagagacuccacugucuugug

SEQ ID NO: 1039131 - RNA, 19 nt, Human
agugucaucagcuacucag

SEQ ID NO: 1039132 - RNA, 22 nt, Human
cacagggcuuugauggcugagu

SEQ ID NO: 1039133 - RNA, 22 nt, Human
cucuccuggggagcacacacac

SEQ ID NO: 1039134 - RNA, 22 nt, Human
cuccagaagacccauccucaug

SEQ ID NO: 1039135 - RNA, 22 nt, Human
ucugagccaauuucugugucca

SEQ ID NO: 1039136 - RNA, 22 nt, Human
cauuuagaaacuguuuuuaaca

SEQ ID NO: 1039137 - RNA, 22 nt, Human
gggcucuggaaggugcaccaug

SEQ ID NO: 1039138 - RNA, 22 nt, Human
cuucagaggggacucaaaguca

SEQ ID NO: 1039139 - RNA, 22 nt, Human
agugacagcugggaaggugaaa

SEQ ID NO: 1039140 - RNA, 22 nt, Human
cuucucuucccagggacacagg

SEQ ID NO: 1039141 - RNA, 22 nt, Human
ccugucugaggaggugcucuuu

SEQ ID NO: 1039142 - RNA, 20 nt, Human
aggagaugauccagagucag

SEQ ID NO: 1039143 - RNA, 22 nt, Human
cuccccagguucaggagguggg

SEQ ID NO: 1039144 - RNA, 22 nt, Human
uggcagcuccggguaggggcug

SEQ ID NO: 1039145 - RNA, 22 nt, Human
uaagacaauucuucagucacaa

SEQ ID NO: 1039146 - RNA, 22 nt, Human
ccuguggcacaugcagggauuc

SEQ ID NO: 1039147 - RNA, 22 nt, Human
aggggagccccugguccuggug

SEQ ID NO: 1039148 - RNA, 22 nt, Human
aucaaaguggaaguuuacuagg

SEQ ID NO: 1039149 - RNA, 22 nt, Human
acagaauacuacagacugguua

SEQ ID NO: 1039150 - RNA, 22 nt, Human
ggcugcugcccaccccugcaug

SEQ ID NO: 1039151 - RNA, 22 nt, Human
uguacauuuagagcucaauaga

SEQ ID NO: 1039152 - RNA, 22 nt, Human
uacagaguggugagaucuuuug

SEQ ID NO: 1039153 - RNA, 22 nt, Human
cuccucuggcuuccuggaggca

SEQ ID NO: 1039154 - RNA, 22 nt, Human
uucaaucauuuuuacauagucc

SEQ ID NO: 1039155 - RNA, 22 nt, Human
gagauuucuuuugaugccuguc

SEQ ID NO: 1039156 - RNA, 18 nt, Human
gcuccuggaccaggucac

SEQ ID NO: 1039157 - RNA, 22 nt, Human
agcugagcuaguaguuccagug

SEQ ID NO: 1039158 - RNA, 22 nt, Human
cugagccagcuggcaugugcua

SEQ ID NO: 1039159 - RNA, 22 nt, Human
aguaaaaucuuaagcacagugg

SEQ ID NO: 1039160 - RNA, 22 nt, Human
cugcagggcccgccugagcccu

SEQ ID NO: 1039161 - RNA, 22 nt, Human
auauucacugagcauaaagcca

SEQ ID NO: 1039162 - RNA, 22 nt, Human
cucaggauagauuguccucuca

SEQ ID NO: 1039163 - RNA, 22 nt, Human
ggugcagaggagccagcugggg

SEQ ID NO: 1039164 - RNA, 22 nt, Human
cacugaaggcuaggauuagaug

SEQ ID NO: 1039165 - RNA, 22 nt, Human
uauguguaggaggaggacaggg

SEQ ID NO: 1039166 - RNA, 22 nt, Human
uacuuagagcgauaauuuauac

SEQ ID NO: 1039167 - RNA, 22 nt, Human
ccuuucucauuuuaagcauuag

SEQ ID NO: 1039168 - RNA, 23 nt, Human
gaagcagaugucugaguaggcag

SEQ ID NO: 1039169 - RNA, 22 nt, Human
uggcagagaauaaaucuugacu

SEQ ID NO: 1039170 - RNA, 22 nt, Human
aguuaaagucugaaauagagaa

SEQ ID NO: 1039171 - RNA, 22 nt, Human
uggcccugacagguccugggca

SEQ ID NO: 1039172 - RNA, 22 nt, Human
augucuaaaagauaaaguuuaa

SEQ ID NO: 1039173 - RNA, 22 nt, Human
gcuguccucuuggacucagggc

SEQ ID NO: 1039174 - RNA, 22 nt, Human
ggcugcugguggaaugguaggc

SEQ ID NO: 1039175 - RNA, 22 nt, Human
cguguggucccggcaaggcaag

SEQ ID NO: 1039176 - RNA, 22 nt, Human
gggcucuggauggagccugcag

SEQ ID NO: 1039177 - RNA, 22 nt, Human
cugcugggcuccucaugugacu

SEQ ID NO: 1039178 - RNA, 22 nt, Human
gugcauuugugcaugcacaugu

SEQ ID NO: 1039179 - RNA, 22 nt, Human
uaucuacuccucuuucagaugc

SEQ ID NO: 1039180 - RNA, 22 nt, Human
gggaagggagggaccucagucu

SEQ ID NO: 1039181 - RNA, 22 nt, Human
ucacaggagggagagacaccca

SEQ ID NO: 1039182 - RNA, 22 nt, Human
cugcugagcccuggcacaggug

SEQ ID NO: 1039183 - RNA, 22 nt, Human
ucuuuccuacuuuauugugaac

SEQ ID NO: 1039184 - RNA, 19 nt, Human
cuugguuaugguaugaugc

SEQ ID NO: 1039185 - RNA, 22 nt, Human
agacccugcaccucucgugggc

SEQ ID NO: 1039186 - RNA, 22 nt, Human
aggccucacauugggcuucaag

SEQ ID NO: 1039187 - RNA, 22 nt, Human
gcauggcagugaggauggugcu

SEQ ID NO: 1039188 - RNA, 22 nt, Human
ccugccuggcugucagcagagc

SEQ ID NO: 1039189 - RNA, 22 nt, Human
cuccugggaauuuaguugugag

SEQ ID NO: 1039190 - RNA, 22 nt, Human
cugccgaguacagccauagaaa

SEQ ID NO: 1039191 - RNA, 22 nt, Human
uuugcuauaaaagggucacacg

SEQ ID NO: 1039192 - RNA, 22 nt, Human
auuuuucucuuuccacugagau

SEQ ID NO: 1039193 - RNA, 18 nt, Human
agcagagcccaugcauuc

SEQ ID NO: 1039194 - RNA, 22 nt, Human
ggcugccauaacagaguaccac

SEQ ID NO: 1039195 - RNA, 22 nt, Human
agagaggcugggcguagggcuu

SEQ ID NO: 1039196 - RNA, 22 nt, Human
uagucuuuugagaaguauaucu

SEQ ID NO: 1039197 - RNA, 22 nt, Human
cucccucugucuuguccagaaa

SEQ ID NO: 1039198 - RNA, 22 nt, Human
ucacagugagccaugucagaga

SEQ ID NO: 1039199 - RNA, 22 nt, Human
aaaguucagugccuucuauaca

SEQ ID NO: 1039200 - RNA, 22 nt, Human
cuggagccaugucuugacugcu

SEQ ID NO: 1039201 - RNA, 22 nt, Human
ugucucugauaaguaguucagu

SEQ ID NO: 1039202 - RNA, 22 nt, Human
ggcugugccucaaggcuacuca

SEQ ID NO: 1039203 - RNA, 22 nt, Human
cugagcugaaacuugagaggcu

SEQ ID NO: 1039204 - RNA, 22 nt, Human
augagcugugggauuccagagg

SEQ ID NO: 1039205 - RNA, 22 nt, Human
cucugaacucuugggcagcaug

SEQ ID NO: 1039206 - RNA, 23 nt, Human
gcauugucuccccacuucugggc

SEQ ID NO: 1039207 - RNA, 22 nt, Human
uggcagagucucuccuuuccag

SEQ ID NO: 1039208 - RNA, 22 nt, Human
agcagaaccugcagaccugucu

SEQ ID NO: 1039209 - RNA, 22 nt, Human
caagccucagaaucuucuccau

SEQ ID NO: 1039210 - RNA, 22 nt, Human
agggucugacuccucuggcaag

SEQ ID NO: 1039211 - RNA, 22 nt, Human
uuggaggcaaugggaaggaggc

SEQ ID NO: 1039212 - RNA, 22 nt, Human
caaugguggugucagaagagau

SEQ ID NO: 1039213 - RNA, 18 nt, Human
ugcucuguuuaaugauuu

SEQ ID NO: 1039214 - RNA, 22 nt, Human
augcaguacugauacaugccac

SEQ ID NO: 1039215 - RNA, 22 nt, Human
augucccagcugagagacaacu

SEQ ID NO: 1039216 - RNA, 22 nt, Human
aaagcccauguggaaguacagg

SEQ ID NO: 1039217 - RNA, 22 nt, Human
ucugagcauugaauuuucuucc

SEQ ID NO: 1039218 - RNA, 22 nt, Human
caggaccccauauucacugaac

SEQ ID NO: 1039219 - RNA, 22 nt, Human
auguguaggugaaucgaggcug

SEQ ID NO: 1039220 - RNA, 18 nt, Human
agcagcugugccacacug

SEQ ID NO: 1039221 - RNA, 22 nt, Human
aggcacugcagauuacaggcgc

SEQ ID NO: 1039222 - RNA, 22 nt, Human
ugcugccagagagacagggacu

SEQ ID NO: 1039223 - RNA, 22 nt, Human
caagagcuagacuuugucagga

SEQ ID NO: 1039224 - RNA, 19 nt, Human
ugcagaagacacaguggug

SEQ ID NO: 1039225 - RNA, 22 nt, Human
aaguuucauguggagguagacu

SEQ ID NO: 1039226 - RNA, 22 nt, Human
ggcugccuacuuucccagaguu

SEQ ID NO: 1039227 - RNA, 22 nt, Human
cuacauuuuaauaagcugcuua

SEQ ID NO: 1039228 - RNA, 22 nt, Human
gguuggggcgagcuggaggccc

SEQ ID NO: 1039229 - RNA, 22 nt, Human
uccucuggcucuuucccuagga

SEQ ID NO: 1039230 - RNA, 22 nt, Human
ucucagagagaugaaacuucca

SEQ ID NO: 1039231 - RNA, 22 nt, Human
caggggcaggugugagaucauc

SEQ ID NO: 1039232 - RNA, 22 nt, Human
ucccagagacagagccuccucc

SEQ ID NO: 1039233 - RNA, 23 nt, Human
ccaggccucucagagggugugcc

SEQ ID NO: 1039234 - RNA, 21 nt, Human
cacaggugggucagugaggcc

SEQ ID NO: 1039235 - RNA, 22 nt, Human
ugaacagauggcccagcagagg

SEQ ID NO: 1039236 - RNA, 22 nt, Human
uauacagaaccgccugaagucu

SEQ ID NO: 1039237 - RNA, 22 nt, Human
guuauaaaggugauaaugguca

SEQ ID NO: 1039238 - RNA, 22 nt, Human
gcaguggggaaugcuggggaga

SEQ ID NO: 1039239 - RNA, 22 nt, Human
guggcccaggcuuggcgcuggc

SEQ ID NO: 1039240 - RNA, 22 nt, Human
augagcuucccagacaggaugg

SEQ ID NO: 1039241 - RNA, 22 nt, Human
ugguggcuguugcagaacugag

SEQ ID NO: 1039242 - RNA, 22 nt, Human
uucacauuugcccuuaugugug

SEQ ID NO: 1039243 - RNA, 21 nt, Human
ggcccugguuacgccuccucu

SEQ ID NO: 1039244 - RNA, 18 nt, Human
ucugggcuucccgaggcu

SEQ ID NO: 1039245 - RNA, 22 nt, Human
gaggccugaggcugccuggagc

SEQ ID NO: 1039246 - RNA, 22 nt, Human
uccuugaaugaauguucucucc

SEQ ID NO: 1039247 - RNA, 22 nt, Human
gagaaggggugauguggguaau

SEQ ID NO: 1039248 - RNA, 22 nt, Human
gagaagcaauuuccaacugugc

SEQ ID NO: 1039249 - RNA, 22 nt, Human
cuggcagcgugagcagcaucca

SEQ ID NO: 1039250 - RNA, 22 nt, Human
cucuucagauaaaagggauauu

SEQ ID NO: 1039251 - RNA, 22 nt, Human
gcuuccugucccucagccauga

SEQ ID NO: 1039252 - RNA, 22 nt, Human
cuggugcaggaaggagcuggca

SEQ ID NO: 1039253 - RNA, 22 nt, Human
augacagaggagugcaggugau

SEQ ID NO: 1039254 - RNA, 22 nt, Human
caucaaauggcaagugaaagcu

SEQ ID NO: 1039255 - RNA, 21 nt, Human
ccaggcagagcugugaguucu

SEQ ID NO: 1039256 - RNA, 20 nt, Human
uaagaacaagacuaggaagc

SEQ ID NO: 1039257 - RNA, 22 nt, Human
gaagaacaccugcugcccagug

SEQ ID NO: 1039258 - RNA, 18 nt, Human
gaggccugagaaccaggu

SEQ ID NO: 1039259 - RNA, 22 nt, Human
cugggcagccucacacaauguu

SEQ ID NO: 1039260 - RNA, 22 nt, Human
augggaggaucacuugaggcca

SEQ ID NO: 1039261 - RNA, 22 nt, Human
uuugaacaagagcuucacauua

SEQ ID NO: 1039262 - RNA, 22 nt, Human
aaguuaugaaauuuggacagcu

SEQ ID NO: 1039263 - RNA, 22 nt, Human
uggcagucggacuucuaucuca

SEQ ID NO: 1039264 - RNA, 22 nt, Human
uauauuaacacccacuugccuc

SEQ ID NO: 1039265 - RNA, 22 nt, Human
ccaaggagcaaggcucaacaag

SEQ ID NO: 1039266 - RNA, 22 nt, Human
ugccugaugcaggaguaucaga

SEQ ID NO: 1039267 - RNA, 22 nt, Human
cugaaggagcauagucaguuuu

SEQ ID NO: 1039268 - RNA, 22 nt, Human
cuggcagcucuacucagagccu

SEQ ID NO: 1039269 - RNA, 22 nt, Human
ucuacuuuucccuauacaguuu

SEQ ID NO: 1039270 - RNA, 22 nt, Human
cuccucugucuaccacgagggu

SEQ ID NO: 1039271 - RNA, 22 nt, Human
gucuggaguggggccugagaau

SEQ ID NO: 1039272 - RNA, 22 nt, Human
auuuagaaauuccaaaaguauu

SEQ ID NO: 1039273 - RNA, 22 nt, Human
cccagccucugggcucacccaa

SEQ ID NO: 1039274 - RNA, 22 nt, Human
ccucucuguguggccucuccau

SEQ ID NO: 1039275 - RNA, 22 nt, Human
caaaggcaguuacugaaugaag

SEQ ID NO: 1039276 - RNA, 22 nt, Human
aaaaugugcaguuuuuaagcug

SEQ ID NO: 1039277 - RNA, 22 nt, Human
acagagaaagugggcugaagau

SEQ ID NO: 1039278 - RNA, 19 nt, Human
ugacaggcuguugccuuga

SEQ ID NO: 1039279 - RNA, 22 nt, Human
caugggcuacagaagcaugcug

SEQ ID NO: 1039280 - RNA, 22 nt, Human
gccugaugagcuuccagcugag

SEQ ID NO: 1039281 - RNA, 22 nt, Human
ccagagccuaagaucugauccu

SEQ ID NO: 1039282 - RNA, 20 nt, Human
uggagcuccagcguccaugu

SEQ ID NO: 1039283 - RNA, 20 nt, Human
agaggcuuccuugggaggag

SEQ ID NO: 1039284 - RNA, 22 nt, Human
acuuugcaaugggcagaaccca

SEQ ID NO: 1039285 - RNA, 22 nt, Human
cccaggcuggagugcaauggca

SEQ ID NO: 1039286 - RNA, 22 nt, Human
gccugcagaggugcugcuagcu

SEQ ID NO: 1039287 - RNA, 22 nt, Human
cugggcucagaugagaggaagg

SEQ ID NO: 1039288 - RNA, 19 nt, Human
ggaugagggucaggcauag

SEQ ID NO: 1039289 - RNA, 22 nt, Human
auggggcugggauucuccucgg

SEQ ID NO: 1039290 - RNA, 22 nt, Human
ggcuggcuugccaagcucaggg

SEQ ID NO: 1039291 - RNA, 22 nt, Human
uguuuauaccuugguauaacca

SEQ ID NO: 1039292 - RNA, 22 nt, Human
ucugccuugagguccucagcuc

SEQ ID NO: 1039293 - RNA, 22 nt, Human
agcaggagcugugggaagaugg

SEQ ID NO: 1039294 - RNA, 18 nt, Human
gccugcaggcacgggggu

SEQ ID NO: 1039295 - RNA, 22 nt, Human
agcagcugggcucagagcuggg

SEQ ID NO: 1039296 - RNA, 22 nt, Human
auaugccauuagcuagaaauaa

SEQ ID NO: 1039297 - RNA, 22 nt, Human
ugcaggagaaaguacggagcgu

SEQ ID NO: 1039298 - RNA, 22 nt, Human
gcagccuguuguaccagccugu

SEQ ID NO: 1039299 - RNA, 22 nt, Human
cugugcaguaggucagggcugg

SEQ ID NO: 1039300 - RNA, 22 nt, Human
gccuucaggaaaucaguccuug

SEQ ID NO: 1039301 - RNA, 22 nt, Human
caggaacagcaccaggagcuag

SEQ ID NO: 1039302 - RNA, 22 nt, Human
ugugaggagaggcccagcuccc

SEQ ID NO: 1039303 - RNA, 22 nt, Human
uagccucucuccuccacaaccu

SEQ ID NO: 1039304 - RNA, 21 nt, Human
ggagggcagcccagacuggcu

SEQ ID NO: 1039305 - RNA, 22 nt, Human
cagggacaugacuggucucugu

SEQ ID NO: 1039306 - RNA, 22 nt, Human
gcagagugagccgaggcugcuc

SEQ ID NO: 1039307 - RNA, 22 nt, Human
ccacugggggcugcaggcacuc

SEQ ID NO: 1039308 - RNA, 22 nt, Human
agcagcuucuuucacuccugga

SEQ ID NO: 1039309 - RNA, 22 nt, Human
auguguaaaaagugcuuaauau

SEQ ID NO: 1039310 - RNA, 22 nt, Human
cuggccucaccucagacuuacu

SEQ ID NO: 1039311 - RNA, 22 nt, Human
agaaaucaauaucuauauguug

SEQ ID NO: 1039312 - RNA, 22 nt, Human
gcugaagggagugcugagucug

SEQ ID NO: 1039313 - RNA, 22 nt, Human
ugauuuccccagucuugcugcu

SEQ ID NO: 1039314 - RNA, 22 nt, Human
caggaaaaaugccaggagucag

SEQ ID NO: 1039315 - RNA, 22 nt, Human
agcugguucauucauucauggu

SEQ ID NO: 1039316 - RNA, 22 nt, Human
uccuucaguuaaagaucucaca

SEQ ID NO: 1039317 - RNA, 22 nt, Human
cugugucggacgugggcagcag

SEQ ID NO: 1039318 - RNA, 22 nt, Human
aggcccugaagucggccccuca

SEQ ID NO: 1039319 - RNA, 22 nt, Human
ugcucucucaggccuggcccac

SEQ ID NO: 1039320 - RNA, 22 nt, Human
cccaggagauggagguugcagu

SEQ ID NO: 1039321 - RNA, 22 nt, Human
gcaggcagagaaggaacauuua

SEQ ID NO: 1039322 - RNA, 22 nt, Human
uuacaggggacauuggggacau

SEQ ID NO: 1039323 - RNA, 22 nt, Human
gaggcccaggucaagcagccac

SEQ ID NO: 1039324 - RNA, 22 nt, Human
ucuggcucaaaauacguacucu

SEQ ID NO: 1039325 - RNA, 22 nt, Human
uuucagugcuucuguuuaccgg

SEQ ID NO: 1039326 - RNA, 22 nt, Human
cagagccagaacuagaccuugu

SEQ ID NO: 1039327 - RNA, 22 nt, Human
ucucagggagggcgagucagcg

SEQ ID NO: 1039328 - RNA, 22 nt, Human
gagacauggcaaaagcacuggu

SEQ ID NO: 1039329 - RNA, 22 nt, Human
cugccugugugugccugcagaa

SEQ ID NO: 1039330 - RNA, 22 nt, Human
ugcaggugaaaauuaugaggau

SEQ ID NO: 1039331 - RNA, 22 nt, Human
gccuggugguauccuggcaaga

SEQ ID NO: 1039332 - RNA, 19 nt, Human
gaucuuugccaauuuaagc

SEQ ID NO: 1039333 - RNA, 22 nt, Human
uuucacauacaguguauaguag

SEQ ID NO: 1039334 - RNA, 22 nt, Human
agagacaggguuuugucguguu

SEQ ID NO: 1039335 - RNA, 22 nt, Human
uagucaaaccucagaauacccc

SEQ ID NO: 1039336 - RNA, 22 nt, Human
uagacagauuuaaaggaaugga

SEQ ID NO: 1039337 - RNA, 20 nt, Human
cagccuccacucacucagcu

SEQ ID NO: 1039338 - RNA, 22 nt, Human
ggagagugggagcaacuguugc

SEQ ID NO: 1039339 - RNA, 22 nt, Human
ugagccugguugcagugucugg

SEQ ID NO: 1039340 - RNA, 22 nt, Human
accacuguaucuccagcacauu

SEQ ID NO: 1039341 - RNA, 22 nt, Human
aagccaggggcugcuuaggaga

SEQ ID NO: 1039342 - RNA, 22 nt, Human
uguguacacaaugauugcagag

SEQ ID NO: 1039343 - RNA, 22 nt, Human
accagagaaaacacagcaggcu

SEQ ID NO: 1039344 - RNA, 22 nt, Human
acaggugugagaacaugccuug

SEQ ID NO: 1039345 - RNA, 22 nt, Human
ggggcccagcaccccuccucgc

SEQ ID NO: 1039346 - RNA, 22 nt, Human
acaguaauuaaaauggaucugc

SEQ ID NO: 1039347 - RNA, 22 nt, Human
cuggcaggucucgcugacgugu

SEQ ID NO: 1039348 - RNA, 22 nt, Human
ucagggcaagauugguuaauaa

SEQ ID NO: 1039349 - RNA, 22 nt, Human
aaucaguuucuuggcaaguuua

SEQ ID NO: 1039350 - RNA, 22 nt, Human
uucuaguguccuuggacuugcu

SEQ ID NO: 1039351 - RNA, 22 nt, Human
caguuuuucaaaauuacaugau

SEQ ID NO: 1039352 - RNA, 21 nt, Human
acccuggguucuccauacccu

SEQ ID NO: 1039353 - RNA, 17 nt, Human
ucuggccuuccugaacu

SEQ ID NO: 1039354 - RNA, 22 nt, Human
gccuggagaagauggaacuagc

SEQ ID NO: 1039355 - RNA, 22 nt, Human
ccaggcaucacgggcauguggc

SEQ ID NO: 1039356 - RNA, 22 nt, Human
uggcagaguaggauggcccugu

SEQ ID NO: 1039357 - RNA, 22 nt, Human
aggucauuccagccauuccccu

SEQ ID NO: 1039358 - RNA, 22 nt, Human
ucucugcugagaagggcuggca

SEQ ID NO: 1039359 - RNA, 23 nt, Human
ugcagagggacugaagccagcuu

SEQ ID NO: 1039360 - RNA, 22 nt, Human
ucuccaagcagggcugcaaggc

SEQ ID NO: 1039361 - RNA, 22 nt, Human
guccucugggcuuugagcaguc

SEQ ID NO: 1039362 - RNA, 22 nt, Human
agugaaaugauucugagcaaga

SEQ ID NO: 1039363 - RNA, 23 nt, Human
agggcugaugccauugcagcucu

SEQ ID NO: 1039364 - RNA, 22 nt, Human
ugcagcugguuuagaacuagau

SEQ ID NO: 1039365 - RNA, 22 nt, Human
gggagcugguuccugcccucca

SEQ ID NO: 1039366 - RNA, 22 nt, Human
cugugugugucugcagcauacu

SEQ ID NO: 1039367 - RNA, 22 nt, Human
gaguuauuggguggaaagguag

SEQ ID NO: 1039368 - RNA, 21 nt, Human
cagcaaaucauugggcagacu

SEQ ID NO: 1039369 - RNA, 18 nt, Human
accugccuguucuucucu

SEQ ID NO: 1039370 - RNA, 22 nt, Human
uggcccugugugcaggcugcac

SEQ ID NO: 1039371 - RNA, 22 nt, Human
ccugggaagagcugacaggagg

SEQ ID NO: 1039372 - RNA, 22 nt, Human
cagagagagucaaaucuuugcu

SEQ ID NO: 1039373 - RNA, 17 nt, Human
uuagcaaaauagcacuu

SEQ ID NO: 1039374 - RNA, 22 nt, Human
gcugccucuguagcuuuggacc

SEQ ID NO: 1039375 - RNA, 22 nt, Human
ugggcagacgcuguuggaaggc

SEQ ID NO: 1039376 - RNA, 22 nt, Human
caggagccccaggcugacaaua

SEQ ID NO: 1039377 - RNA, 22 nt, Human
acugccuuauaugcugugugug

SEQ ID NO: 1039378 - RNA, 22 nt, Human
augucuuuggcuuugacauggc

SEQ ID NO: 1039379 - RNA, 22 nt, Human
ugagccugcugucgcuggaccc

SEQ ID NO: 1039380 - RNA, 22 nt, Human
ucaguuuuaagguuugagaauu

SEQ ID NO: 1039381 - RNA, 22 nt, Human
cagagcugcacauucuaugaug

SEQ ID NO: 1039382 - RNA, 23 nt, Human
ggagugcaauggcgccaucucgg

SEQ ID NO: 1039383 - RNA, 22 nt, Human
agaauuguugggguaauaaaag

SEQ ID NO: 1039384 - RNA, 22 nt, Human
agggcucuguccccagaggccc

SEQ ID NO: 1039385 - RNA, 22 nt, Human
cucucugguuucagcgaagggg

SEQ ID NO: 1039386 - RNA, 22 nt, Human
gggcuggcgggaaaggcaauuc

SEQ ID NO: 1039387 - RNA, 22 nt, Human
ugcauuguugaugaguugaaua

SEQ ID NO: 1039388 - RNA, 22 nt, Human
cacucugcgcugggcgccagcg

SEQ ID NO: 1039389 - RNA, 22 nt, Human
aagauuuaccacuuuauucaag

SEQ ID NO: 1039390 - RNA, 22 nt, Human
aagcaauauacugauaugauua

SEQ ID NO: 1039391 - RNA, 22 nt, Human
gcuuuguguagaaggaggaugg

SEQ ID NO: 1039392 - RNA, 22 nt, Human
agcaucuggugagggccuaguu

SEQ ID NO: 1039393 - RNA, 22 nt, Human
ggcuccugaaagacuaugggaa

SEQ ID NO: 1039394 - RNA, 22 nt, Human
uacaguaaagcugcuaugaauu

SEQ ID NO: 1039395 - RNA, 21 nt, Human
uucaaagagugggcauuguca

SEQ ID NO: 1039396 - RNA, 22 nt, Human
agagugggccucugagucccag

SEQ ID NO: 1039397 - RNA, 22 nt, Human
ccagugggugcugggcucugcc

SEQ ID NO: 1039398 - RNA, 22 nt, Human
uccugccuagcaggugaccuau

SEQ ID NO: 1039399 - RNA, 22 nt, Human
agcagagccaggucucucugua

SEQ ID NO: 1039400 - RNA, 22 nt, Human
uuugcaauuugugcugcaaaug

SEQ ID NO: 1039401 - RNA, 22 nt, Human
uuugcauugcagugguuuacag

SEQ ID NO: 1039402 - RNA, 22 nt, Human
aggcucagauucacauuugguu

SEQ ID NO: 1039403 - RNA, 22 nt, Human
gcugaaggaggcucugguacua

SEQ ID NO: 1039404 - RNA, 22 nt, Human
uacaugcucaguaacuuucagu

SEQ ID NO: 1039405 - RNA, 22 nt, Human
ccucagggaggccucuguggcu

SEQ ID NO: 1039406 - RNA, 22 nt, Human
gaacagcccuguuaagucuguu

SEQ ID NO: 1039407 - RNA, 22 nt, Human
aagacaagcaucaaaucaggca

SEQ ID NO: 1039408 - RNA, 22 nt, Human
acuuucuccagaaaaccaagga

SEQ ID NO: 1039409 - RNA, 22 nt, Human
cacuucaauuaacuucagcauu

SEQ ID NO: 1039410 - RNA, 22 nt, Human
cagggguguuuuuggccaggag

SEQ ID NO: 1039411 - RNA, 22 nt, Human
ccagccuccauguagauagcug

SEQ ID NO: 1039412 - RNA, 22 nt, Human
caggguacagaguuuucuaaac

SEQ ID NO: 1039413 - RNA, 23 nt, Human
ggucccaguggagaggccucacc

SEQ ID NO: 1039414 - RNA, 22 nt, Human
ccagucccagcucugccaugcu

SEQ ID NO: 1039415 - RNA, 22 nt, Human
agagggcccauguugggcugcu

SEQ ID NO: 1039416 - RNA, 22 nt, Human
ugcagccaccaccucugcugaa

SEQ ID NO: 1039417 - RNA, 22 nt, Human
gcuggccucaucacugacuucu

SEQ ID NO: 1039418 - RNA, 22 nt, Human
ucugcagcuucuugccagagag

SEQ ID NO: 1039419 - RNA, 22 nt, Human
acacugaauaauugagaguuga

SEQ ID NO: 1039420 - RNA, 22 nt, Human
ggguacaaagauuucauaagau

SEQ ID NO: 1039421 - RNA, 22 nt, Human
ggaggccaaggagggcggauca

SEQ ID NO: 1039422 - RNA, 21 nt, Human
uggagcugaauuuuuggcauc

SEQ ID NO: 1039423 - RNA, 22 nt, Human
ccugggagugucagacuugcuu

SEQ ID NO: 1039424 - RNA, 22 nt, Human
gaggagagagggacugucugca

SEQ ID NO: 1039425 - RNA, 22 nt, Human
agggccagcacuccuggcagga

SEQ ID NO: 1039426 - RNA, 22 nt, Human
aacaaauggaacacaaaucuuu

SEQ ID NO: 1039427 - RNA, 22 nt, Human
aaacuguaagagaauaaacuac

SEQ ID NO: 1039428 - RNA, 22 nt, Human
ccuucugcucccuggccagggc

SEQ ID NO: 1039429 - RNA, 22 nt, Human
cugcugcucgaccagucccagg

SEQ ID NO: 1039430 - RNA, 22 nt, Human
acacaggggcucggcugggugc

SEQ ID NO: 1039431 - RNA, 22 nt, Human
cccucagcuccacccucagcag

SEQ ID NO: 1039432 - RNA, 22 nt, Human
uugcagggcaggaccauggaca

SEQ ID NO: 1039433 - RNA, 22 nt, Human
acagagcuguacaugugccaug

SEQ ID NO: 1039434 - RNA, 22 nt, Human
ccagcuccagguagaugggcag

SEQ ID NO: 1039435 - RNA, 22 nt, Human
aggaccagaggccagagucagc

SEQ ID NO: 1039436 - RNA, 22 nt, Human
cagagccauccaggugccuguu

SEQ ID NO: 1039437 - RNA, 22 nt, Human
gaugggaggaaccugggucccu

SEQ ID NO: 1039438 - RNA, 22 nt, Human
acaauucucucauaucuuauua

SEQ ID NO: 1039439 - RNA, 20 nt, Human
ugcugcaguuucaugggacu

SEQ ID NO: 1039440 - RNA, 22 nt, Human
gcugucaggccaugugggccuu

SEQ ID NO: 1039441 - RNA, 22 nt, Human
uccuuggcagcagggagcauga

SEQ ID NO: 1039442 - RNA, 22 nt, Human
ugguccuggggaucugcaguga

SEQ ID NO: 1039443 - RNA, 22 nt, Human
ggaugcugcuaucaggcuucga

SEQ ID NO: 1039444 - RNA, 22 nt, Human
uggcucuguucgccaucaggag

SEQ ID NO: 1039445 - RNA, 23 nt, Human
cucccuggaguuucuggaagaug

SEQ ID NO: 1039446 - RNA, 22 nt, Human
gugcuuaauacaugucaauaac

SEQ ID NO: 1039447 - RNA, 22 nt, Human
ggcccucccugagccagguggg

SEQ ID NO: 1039448 - RNA, 19 nt, Human
ccuggaggugaagguucuc

SEQ ID NO: 1039449 - RNA, 22 nt, Human
acauuucucuugaugucucuau

SEQ ID NO: 1039450 - RNA, 22 nt, Human
guggcagcaaaauccugcauuc

SEQ ID NO: 1039451 - RNA, 22 nt, Human
ggccugccucacagucagcacc

SEQ ID NO: 1039452 - RNA, 22 nt, Human
gcugucacucuccggccuuccc

SEQ ID NO: 1039453 - RNA, 22 nt, Human
gcagggacaucuuugucuagua

SEQ ID NO: 1039454 - RNA, 22 nt, Human
aaauguguuugauaggaauauu

SEQ ID NO: 1039455 - RNA, 22 nt, Human
uaauuuaauccaaguguuacau

SEQ ID NO: 1039456 - RNA, 22 nt, Human
gaauucuuuucuuucugaaagu

SEQ ID NO: 1039457 - RNA, 22 nt, Human
ugaagcagcaaaugaugggaga

SEQ ID NO: 1039458 - RNA, 22 nt, Human
gauuuagagaauguuuuguaag

SEQ ID NO: 1039459 - RNA, 22 nt, Human
ugccuugguucucuacuuggag

SEQ ID NO: 1039460 - RNA, 22 nt, Human
uagccaggcgaggucagugucg

SEQ ID NO: 1039461 - RNA, 22 nt, Human
aaguuauuuccucgugacugaa

SEQ ID NO: 1039462 - RNA, 22 nt, Human
gcugccuggaauaacggcuggc

SEQ ID NO: 1039463 - RNA, 22 nt, Human
auggcagccuguggacagucaa

SEQ ID NO: 1039464 - RNA, 20 nt, Human
ggguggaguugcggucugug

SEQ ID NO: 1039465 - RNA, 22 nt, Human
cugacccauauaagaguggagg

SEQ ID NO: 1039466 - RNA, 22 nt, Human
ugaaagguguccaauauuucuc

SEQ ID NO: 1039467 - RNA, 20 nt, Human
agcagcuguguuuucauccu

SEQ ID NO: 1039468 - RNA, 17 nt, Human
gccuuccuuccuccaca

SEQ ID NO: 1039469 - RNA, 22 nt, Human
ugaagguggcauaggagagaug

SEQ ID NO: 1039470 - RNA, 22 nt, Human
ccuccagcugccucagucucuu

SEQ ID NO: 1039471 - RNA, 22 nt, Human
auucccaucgucaacuucacug

SEQ ID NO: 1039472 - RNA, 20 nt, Human
gagagcuggggaugaggcug

SEQ ID NO: 1039473 - RNA, 19 nt, Human
aucagcaagguaggaugug

SEQ ID NO: 1039474 - RNA, 22 nt, Human
cucccuggcuuuguccugaggc

SEQ ID NO: 1039475 - RNA, 23 nt, Human
gcccaugcuguugggcccgagca

SEQ ID NO: 1039476 - RNA, 22 nt, Human
ggacagaggguugacagaguau

SEQ ID NO: 1039477 - RNA, 22 nt, Human
agcagcaacuuauuuuucuuau

SEQ ID NO: 1039478 - RNA, 22 nt, Human
agcccucauggaacagcuccua

SEQ ID NO: 1039479 - RNA, 22 nt, Human
cacugaagcuuucauucucuug

SEQ ID NO: 1039480 - RNA, 22 nt, Human
ggacaggguaaguacuagugug

SEQ ID NO: 1039481 - RNA, 22 nt, Human
ggcccacuugaaauggagcuca

SEQ ID NO: 1039482 - RNA, 22 nt, Human
cccccaaggccaggcugagacc

SEQ ID NO: 1039483 - RNA, 22 nt, Human
cagaccuggaaaacaggcuugc

SEQ ID NO: 1039484 - RNA, 22 nt, Human
gugcccugguccccagcauaua

SEQ ID NO: 1039485 - RNA, 22 nt, Human
cucuuccuacagucugcuaugc

SEQ ID NO: 1039486 - RNA, 22 nt, Human
ucaagcaucuuggucuacgauc

SEQ ID NO: 1039487 - RNA, 22 nt, Human
ccugccugacagagaagguuca

SEQ ID NO: 1039488 - RNA, 18 nt, Human
ccagagcuggcuccucgc

SEQ ID NO: 1039489 - RNA, 22 nt, Human
guuugcauauuugcacaggaau

SEQ ID NO: 1039490 - RNA, 22 nt, Human
aggaugggccugggauaugcuu

SEQ ID NO: 1039491 - RNA, 22 nt, Human
ccaaggaguagagcaggaagcu

SEQ ID NO: 1039492 - RNA, 22 nt, Human
gcugggagugggcaagaugaga

SEQ ID NO: 1039493 - RNA, 22 nt, Human
ccugagagcauuccacacugaa

SEQ ID NO: 1039494 - RNA, 22 nt, Human
aucucccagccacagcauucuu

SEQ ID NO: 1039495 - RNA, 22 nt, Human
cagggcaguaacgggaacaucu

SEQ ID NO: 1039496 - RNA, 19 nt, Human
agucccaggcccgaaagag

SEQ ID NO: 1039497 - RNA, 19 nt, Human
uguuggugcggauguggag

SEQ ID NO: 1039498 - RNA, 23 nt, Human
uggggagaguuacccuggaagcg

SEQ ID NO: 1039499 - RNA, 22 nt, Human
gccuggagugguccugcugccc

SEQ ID NO: 1039500 - RNA, 22 nt, Human
aaaugcacagaaaggaugugga

SEQ ID NO: 1039501 - RNA, 22 nt, Human
gggcugugggacccggcacuuu

SEQ ID NO: 1039502 - RNA, 22 nt, Human
caggaaagaaaugagaacacca

SEQ ID NO: 1039503 - RNA, 22 nt, Human
uucccaguauuaccuucaggaa

SEQ ID NO: 1039504 - RNA, 22 nt, Human
cagucccagacccagaaggugg

SEQ ID NO: 1039505 - RNA, 22 nt, Human
cuccucacacccacugcaacca

SEQ ID NO: 1039506 - RNA, 22 nt, Human
ggcccacacugacagcugagcu

SEQ ID NO: 1039507 - RNA, 22 nt, Human
ucccagagucagagguggggcc

SEQ ID NO: 1039508 - RNA, 22 nt, Human
gcuggagccaagcugcucuugg

SEQ ID NO: 1039509 - RNA, 20 nt, Human
acauugauuauguuuguaga

SEQ ID NO: 1039510 - RNA, 21 nt, Human
auacuuugaauuacagccuug

SEQ ID NO: 1039511 - RNA, 22 nt, Human
uccagccuaauguucuucccac

SEQ ID NO: 1039512 - RNA, 22 nt, Human
acagagauguggaugagggauu

SEQ ID NO: 1039513 - RNA, 22 nt, Human
aucuggcuuuuaccccacggcc

SEQ ID NO: 1039514 - RNA, 22 nt, Human
uuuccucuuauacaguguuuau

SEQ ID NO: 1039515 - RNA, 23 nt, Human
cccuggccuuggggcacaggcug

SEQ ID NO: 1039516 - RNA, 22 nt, Human
ggcccugugguuuugcaaaguc

SEQ ID NO: 1039517 - RNA, 22 nt, Human
uuuccuucaucaucugagagcu

SEQ ID NO: 1039518 - RNA, 22 nt, Human
uggaggaaucagggcuuaggcu

SEQ ID NO: 1039519 - RNA, 22 nt, Human
acauuucuaucauccuguaaug

SEQ ID NO: 1039520 - RNA, 22 nt, Human
aaagauuucagaagccugugcc

SEQ ID NO: 1039521 - RNA, 22 nt, Human
cgcuggggcuuuuugcuugaga

SEQ ID NO: 1039522 - RNA, 22 nt, Human
ucagaggauugccucagcgagc

SEQ ID NO: 1039523 - RNA, 22 nt, Human
guuauguaaucuaacacucagu

SEQ ID NO: 1039524 - RNA, 22 nt, Human
agucccagccuguaggauuggg

SEQ ID NO: 1039525 - RNA, 22 nt, Human
cagcccaaagccccaggcuaga

SEQ ID NO: 1039526 - RNA, 22 nt, Human
cagccagggagcaaagaguuga

SEQ ID NO: 1039527 - RNA, 22 nt, Human
aagcagcacaguaauauuggug

SEQ ID NO: 1039528 - RNA, 22 nt, Human
gaaaauguuuccuguuauuugc

SEQ ID NO: 1039529 - RNA, 22 nt, Human
cauggcccucuucuggagcaau

SEQ ID NO: 1039530 - RNA, 22 nt, Human
aacaaauguaaaaugcagaugc

SEQ ID NO: 1039531 - RNA, 22 nt, Human
acagaguaggugcugucgacug

SEQ ID NO: 1039532 - RNA, 22 nt, Human
uguggccuccccacuucugggg

SEQ ID NO: 1039533 - RNA, 22 nt, Human
cacagaggacuguagcggggag

SEQ ID NO: 1039534 - RNA, 22 nt, Human
uauuucuguaacucagggucug

SEQ ID NO: 1039535 - RNA, 22 nt, Human
agccacagagagggagcugcaa

SEQ ID NO: 1039536 - RNA, 22 nt, Human
aagauacauaaagguagagucu

SEQ ID NO: 1039537 - RNA, 22 nt, Human
caggaaagggaugggcugccac

SEQ ID NO: 1039538 - RNA, 22 nt, Human
cagcugccuguauuguccucau

SEQ ID NO: 1039539 - RNA, 22 nt, Human
agguggguaucaugagagauua

SEQ ID NO: 1039540 - RNA, 22 nt, Human
accuuucacgguaucagacauc

SEQ ID NO: 1039541 - RNA, 22 nt, Human
uggcagaaguacacaagcaugc

SEQ ID NO: 1039542 - RNA, 22 nt, Human
gccaccaggagcccaguccaaa

SEQ ID NO: 1039543 - RNA, 22 nt, Human
cagacagcugcuuucuugcugu

SEQ ID NO: 1039544 - RNA, 22 nt, Human
ucucauucauacccuacaugcu

SEQ ID NO: 1039545 - RNA, 22 nt, Human
agcugguuagcaaucuaaguga

SEQ ID NO: 1039546 - RNA, 22 nt, Human
ggcucacgcaauuaucccggcc

SEQ ID NO: 1039547 - RNA, 22 nt, Human
uuccaguugguagaauguaagg

SEQ ID NO: 1039548 - RNA, 22 nt, Human
acaaaugcagcauaaagugaac

SEQ ID NO: 1039549 - RNA, 23 nt, Human
cagguggcuccacgagggguggg

SEQ ID NO: 1039550 - RNA, 22 nt, Human
cccucccaggaguggccagaga

SEQ ID NO: 1039551 - RNA, 22 nt, Human
cuuggcagcuuuuggaggagcc

SEQ ID NO: 1039552 - RNA, 22 nt, Human
ugcugccuugaccuccugggcu

SEQ ID NO: 1039553 - RNA, 22 nt, Human
cccacaggcuagggguagggca

SEQ ID NO: 1039554 - RNA, 22 nt, Human
cccuggagggcagacagaugcc

SEQ ID NO: 1039555 - RNA, 22 nt, Human
agugugggugagggaggcccuc

SEQ ID NO: 1039556 - RNA, 22 nt, Human
aacaaaugaccugauuucuucc

SEQ ID NO: 1039557 - RNA, 22 nt, Human
uguuacuuaucucacgugaugc

SEQ ID NO: 1039558 - RNA, 22 nt, Human
uguaucaaggguuuauguaagc

SEQ ID NO: 1039559 - RNA, 22 nt, Human
cugggagcccgcguccuggugg

SEQ ID NO: 1039560 - RNA, 21 nt, Human
aagcuucccugcucuccaggg

SEQ ID NO: 1039561 - RNA, 21 nt, Human
cucuggagucaagagcuucca

SEQ ID NO: 1039562 - RNA, 22 nt, Human
gcagcugaagcugcaguuccag

SEQ ID NO: 1039563 - RNA, 22 nt, Human
augcucuggaguacgugaaauu

SEQ ID NO: 1039564 - RNA, 22 nt, Human
caccugagugucaguauucuca

SEQ ID NO: 1039565 - RNA, 22 nt, Human
aacauuuaugguagucauugca

SEQ ID NO: 1039566 - RNA, 21 nt, Human
ucucugggcccuccugugggg

SEQ ID NO: 1039567 - RNA, 22 nt, Human
gcauuuguguucuuccuagagc

SEQ ID NO: 1039568 - RNA, 22 nt, Human
cccagcucuuuuagcggcaucu

SEQ ID NO: 1039569 - RNA, 22 nt, Human
uccugccucuccaugcuaacua

SEQ ID NO: 1039570 - RNA, 19 nt, Human
ccagcccugucacuucuug

SEQ ID NO: 1039571 - RNA, 22 nt, Human
aguggggagguccaggccaccc

SEQ ID NO: 1039572 - RNA, 22 nt, Human
ccagcuggucugugcucauguu

SEQ ID NO: 1039573 - RNA, 22 nt, Human
guggcaggucccauuggagcag

SEQ ID NO: 1039574 - RNA, 22 nt, Human
cuguccuccggccaccuacagu

SEQ ID NO: 1039575 - RNA, 22 nt, Human
ccugggcaucucaugcaccugc

SEQ ID NO: 1039576 - RNA, 22 nt, Human
ucucccaggugggugccuggag

SEQ ID NO: 1039577 - RNA, 22 nt, Human
ccuccugggacaggcuggcaca

SEQ ID NO: 1039578 - RNA, 22 nt, Human
guuugcauuuauuagucuucug

SEQ ID NO: 1039579 - RNA, 22 nt, Human
gcauuuagcuuuaaaauauuuc

SEQ ID NO: 1039580 - RNA, 22 nt, Human
uagagcugauaaugaggccaag

SEQ ID NO: 1039581 - RNA, 22 nt, Human
cagagugagggccugcaccugc

SEQ ID NO: 1039582 - RNA, 22 nt, Human
cccaggagguggagguugcagu

SEQ ID NO: 1039583 - RNA, 22 nt, Human
uggaaggggagcuggaaagggg

SEQ ID NO: 1039584 - RNA, 22 nt, Human
cuagaaauacaggcacgugcca

SEQ ID NO: 1039585 - RNA, 21 nt, Human
ugcuuuaugggaaaaauguca

SEQ ID NO: 1039586 - RNA, 22 nt, Human
ugccuggcaagaggggcuggcu

SEQ ID NO: 1039587 - RNA, 22 nt, Human
gagccagguuggaggcugcagu

SEQ ID NO: 1039588 - RNA, 22 nt, Human
acagcagagugugagauagcca

SEQ ID NO: 1039589 - RNA, 22 nt, Human
auggacagugugucuguuucca

SEQ ID NO: 1039590 - RNA, 22 nt, Human
uggcagagcuggcugcggauga

SEQ ID NO: 1039591 - RNA, 22 nt, Human
agaugaagauaucugcaggggc

SEQ ID NO: 1039592 - RNA, 22 nt, Human
gggcagauggggcacaggcuga

SEQ ID NO: 1039593 - RNA, 22 nt, Human
acugugugggccgcucacuggg

SEQ ID NO: 1039594 - RNA, 22 nt, Human
uuccuuguuuguagcucuggga

SEQ ID NO: 1039595 - RNA, 22 nt, Human
ccucugggagacugcuacugag

SEQ ID NO: 1039596 - RNA, 22 nt, Human
ugcacacacgcggcacaucugu

SEQ ID NO: 1039597 - RNA, 17 nt, Human
ugccagccugucccagg

SEQ ID NO: 1039598 - RNA, 22 nt, Human
agcuccugaaaagcgcuugcuu

SEQ ID NO: 1039599 - RNA, 23 nt, Human
cagcugaagcagccugggcugga

SEQ ID NO: 1039600 - RNA, 22 nt, Human
aguuuuauuccaaugugcagca

SEQ ID NO: 1039601 - RNA, 22 nt, Human
ucccagcagagccagcaagccg

SEQ ID NO: 1039602 - RNA, 22 nt, Human
gucaggggccaugggccaagga

SEQ ID NO: 1039603 - RNA, 22 nt, Human
ucuucucccaucuccaggcagg

SEQ ID NO: 1039604 - RNA, 22 nt, Human
aaaauacacauacuaggggaaa

SEQ ID NO: 1039605 - RNA, 22 nt, Human
cagcaggcccagaguuucaugg

SEQ ID NO: 1039606 - RNA, 22 nt, Human
gccacagggcagaugcgcagag

SEQ ID NO: 1039607 - RNA, 22 nt, Human
ggacacagauaaucacacagau

SEQ ID NO: 1039608 - RNA, 19 nt, Human
cuggcucuuggguggagga

SEQ ID NO: 1039609 - RNA, 22 nt, Human
agggcuggcaucucuaaugcug

SEQ ID NO: 1039610 - RNA, 22 nt, Human
cucaccacagagccuguccagc

SEQ ID NO: 1039611 - RNA, 22 nt, Human
gcaggggcugcugggaacucgg

SEQ ID NO: 1039612 - RNA, 19 nt, Human
ugagaaggcaguggggagc

SEQ ID NO: 1039613 - RNA, 22 nt, Human
ugcugggcuaggguggagcucu

SEQ ID NO: 1039614 - RNA, 22 nt, Human
uggaaagacauucagccgcugg

SEQ ID NO: 1039615 - RNA, 22 nt, Human
uccuugaagaaugauucuugga

SEQ ID NO: 1039616 - RNA, 21 nt, Human
ggucuuccaaauaaggagaaa

SEQ ID NO: 1039617 - RNA, 22 nt, Human
uuguuuguaugcugagaagaau

SEQ ID NO: 1039618 - RNA, 22 nt, Human
gucaccaggucugaugcagcca

SEQ ID NO: 1039619 - RNA, 22 nt, Human
agcaguggccuggggcucugug

SEQ ID NO: 1039620 - RNA, 22 nt, Human
ccucugagaccagcucugcacc

SEQ ID NO: 1039621 - RNA, 22 nt, Human
gccuccccugcaauuguccuug

SEQ ID NO: 1039622 - RNA, 22 nt, Human
uggaaggcaugggaacuguucu

SEQ ID NO: 1039623 - RNA, 22 nt, Human
gauggcagucaaccaggugagg

SEQ ID NO: 1039624 - RNA, 22 nt, Human
auuuuuccaauuaggauaaaga

SEQ ID NO: 1039625 - RNA, 22 nt, Human
uagggcuauucugaguaauaau

SEQ ID NO: 1039626 - RNA, 22 nt, Human
ccaaaguccauaguuuacauaa

SEQ ID NO: 1039627 - RNA, 22 nt, Human
gcuguggcuguacagagaccau

SEQ ID NO: 1039628 - RNA, 22 nt, Human
gcuggagccauuggcuuggccu

SEQ ID NO: 1039629 - RNA, 22 nt, Human
gccugugcauagcagcggacuc

SEQ ID NO: 1039630 - RNA, 22 nt, Human
cccaggucuaugccagcucuga

SEQ ID NO: 1039631 - RNA, 22 nt, Human
uggagcugauacagcuggcuuu

SEQ ID NO: 1039632 - RNA, 22 nt, Human
cagacagaaggcuccuugaggu

SEQ ID NO: 1039633 - RNA, 22 nt, Human
aagccaggcugcacuugcuggg

SEQ ID NO: 1039634 - RNA, 22 nt, Human
gugcucacugugagacguccug

SEQ ID NO: 1039635 - RNA, 20 nt, Human
cccucugcuacacugggagc

SEQ ID NO: 1039636 - RNA, 22 nt, Human
agcugggagcagagccacagcc

SEQ ID NO: 1039637 - RNA, 22 nt, Human
uuuauuccaugugucuaugacc

SEQ ID NO: 1039638 - RNA, 22 nt, Human
ugcuccauucucuagccagugc

SEQ ID NO: 1039639 - RNA, 20 nt, Human
ucagagucaucaaagauggu

SEQ ID NO: 1039640 - RNA, 22 nt, Human
ccugagaccaaguugcagccau

SEQ ID NO: 1039641 - RNA, 22 nt, Human
cacagcuuccauuagaaugaga

SEQ ID NO: 1039642 - RNA, 22 nt, Human
uuugacaguaauaaagcacaag

SEQ ID NO: 1039643 - RNA, 22 nt, Human
ggcaaaaacagcaaugacuuuu

SEQ ID NO: 1039644 - RNA, 22 nt, Human
ucacaucuuauuagaguaucuc

SEQ ID NO: 1039645 - RNA, 22 nt, Human
aaugcacagcguuccaugcuug

SEQ ID NO: 1039646 - RNA, 22 nt, Human
uaagcuauuccugaagaagguu

SEQ ID NO: 1039647 - RNA, 22 nt, Human
guggcugcagagccagcaagcu

SEQ ID NO: 1039648 - RNA, 22 nt, Human
agcugguucagaaauuagaugg

SEQ ID NO: 1039649 - RNA, 22 nt, Human
ccuccaggaacuugagagacac

SEQ ID NO: 1039650 - RNA, 22 nt, Human
uuaaacagucccagaggcugac

SEQ ID NO: 1039651 - RNA, 22 nt, Human
cugggugguucuaacuguugau

SEQ ID NO: 1039652 - RNA, 22 nt, Human
ggucccaguccucucccugcua

SEQ ID NO: 1039653 - RNA, 22 nt, Human
acagaauucuaguauguggcuu

SEQ ID NO: 1039654 - RNA, 22 nt, Human
gcauuucugugcauacacauga

SEQ ID NO: 1039655 - RNA, 22 nt, Human
gccuuggccuuccuaggccuga

SEQ ID NO: 1039656 - RNA, 22 nt, Human
gcagccccaggagacgcccagg

SEQ ID NO: 1039657 - RNA, 22 nt, Human
gcugggaggaauuuggggaaua

SEQ ID NO: 1039658 - RNA, 22 nt, Human
ggcuccugauaggagaaugcgg

SEQ ID NO: 1039659 - RNA, 22 nt, Human
ccuggaagauucaccacuacca

SEQ ID NO: 1039660 - RNA, 22 nt, Human
cccuggaagguucucuggcuca

SEQ ID NO: 1039661 - RNA, 22 nt, Human
agggcagcagcggcccaggccu

SEQ ID NO: 1039662 - RNA, 23 nt, Human
ucucagaggauuccugggccuug

SEQ ID NO: 1039663 - RNA, 22 nt, Human
agagcucaagacgcucacagua

SEQ ID NO: 1039664 - RNA, 22 nt, Human
ucagcugcucuguugagcugaa

SEQ ID NO: 1039665 - RNA, 22 nt, Human
uggcuucagacuucugcuacgu

SEQ ID NO: 1039666 - RNA, 22 nt, Human
acugucugcccugagaugccag

SEQ ID NO: 1039667 - RNA, 22 nt, Human
uuccucaugggguuccuucaga

SEQ ID NO: 1039668 - RNA, 22 nt, Human
uucagcagucguccaggaaaag

SEQ ID NO: 1039669 - RNA, 22 nt, Human
agaaauguauucuguauguuuu

SEQ ID NO: 1039670 - RNA, 22 nt, Human
caguugaugggacucauguggg

SEQ ID NO: 1039671 - RNA, 22 nt, Human
ccugcccagcuucaccucaggc

SEQ ID NO: 1039672 - RNA, 22 nt, Human
ccagccagucccgcaugaccgc

SEQ ID NO: 1039673 - RNA, 22 nt, Human
uagcugccuuugggcuccugcu

SEQ ID NO: 1039674 - RNA, 22 nt, Human
aggggagcuaacaccagagccc

SEQ ID NO: 1039675 - RNA, 22 nt, Human
agcugcugugugcucaggcagg

SEQ ID NO: 1039676 - RNA, 22 nt, Human
uuuauguacauauccacaagga

SEQ ID NO: 1039677 - RNA, 22 nt, Human
gccagcagguugucaaggagcu

SEQ ID NO: 1039678 - RNA, 22 nt, Human
cagcaucuuucucuucuggagu

SEQ ID NO: 1039679 - RNA, 22 nt, Human
acucugcuuauugcugcaggca

SEQ ID NO: 1039680 - RNA, 22 nt, Human
gcccagcuccucugcagacccu

SEQ ID NO: 1039681 - RNA, 22 nt, Human
cuccagggaaaggggcguccgc

SEQ ID NO: 1039682 - RNA, 22 nt, Human
auggccuggggagcaugggaag

SEQ ID NO: 1039683 - RNA, 22 nt, Human
agccuggcacugaggcagggcg

SEQ ID NO: 1039684 - RNA, 22 nt, Human
aagacauuacuggaaucugacu

SEQ ID NO: 1039685 - RNA, 22 nt, Human
aucaguuucacuugcuugcaaa

SEQ ID NO: 1039686 - RNA, 22 nt, Human
aggaagccuggggcugcccucg

SEQ ID NO: 1039687 - RNA, 22 nt, Human
aggccaggcaacauucugaagu

SEQ ID NO: 1039688 - RNA, 22 nt, Human
cugcaggcccccuuccuggagu

SEQ ID NO: 1039689 - RNA, 22 nt, Human
caggaacaauguaagucucauu

SEQ ID NO: 1039690 - RNA, 22 nt, Human
uggggcuggggaucuugagccu

SEQ ID NO: 1039691 - RNA, 22 nt, Human
agcagccauagauagcaugcaa

SEQ ID NO: 1039692 - RNA, 22 nt, Human
guccuggcccacuggcaggcug

SEQ ID NO: 1039693 - RNA, 22 nt, Human
uaaggcagaaauaugagcaggg

SEQ ID NO: 1039694 - RNA, 22 nt, Human
aggugaguuacaggaggagguc

SEQ ID NO: 1039695 - RNA, 22 nt, Human
agggccagaggcaccuugcagc

SEQ ID NO: 1039696 - RNA, 22 nt, Human
cacauguacagaagcaggcugg

SEQ ID NO: 1039697 - RNA, 22 nt, Human
acaguggagaaggcaugaggcu

SEQ ID NO: 1039698 - RNA, 22 nt, Human
uuccaugugaguacacugugau

SEQ ID NO: 1039699 - RNA, 19 nt, Human
agcagcuggagguggagug

SEQ ID NO: 1039700 - RNA, 22 nt, Human
gaggagcuggcagcgucuccgc

SEQ ID NO: 1039701 - RNA, 22 nt, Human
aucuggguucaccaugcuccug

SEQ ID NO: 1039702 - RNA, 21 nt, Human
guauugcagaguuaugugcuc

SEQ ID NO: 1039703 - RNA, 23 nt, Human
agucucagcuggaaacauguguc

SEQ ID NO: 1039704 - RNA, 22 nt, Human
cagaaauggaauuuuccaucac

SEQ ID NO: 1039705 - RNA, 22 nt, Human
aggccugagcagaggaguggac

SEQ ID NO: 1039706 - RNA, 22 nt, Human
ugauuuccaaaaggcuucuaag

SEQ ID NO: 1039707 - RNA, 22 nt, Human
ccagagccucgcccggagccuc

SEQ ID NO: 1039708 - RNA, 20 nt, Human
acaaaugcauucugugacau

SEQ ID NO: 1039709 - RNA, 22 nt, Human
aggcugggcaccguuuugaucc

SEQ ID NO: 1039710 - RNA, 22 nt, Human
caaaugcagucccuuuguugcu

SEQ ID NO: 1039711 - RNA, 22 nt, Human
aguuuuaugcaguguucugaua

SEQ ID NO: 1039712 - RNA, 22 nt, Human
uccuucaaagcuccuagugagc

SEQ ID NO: 1039713 - RNA, 22 nt, Human
cccuuucccuucuggcucaggg

SEQ ID NO: 1039714 - RNA, 22 nt, Human
agagcagccugugaugaugcac

SEQ ID NO: 1039715 - RNA, 22 nt, Human
ugccagggcugcuacuggcuga

SEQ ID NO: 1039716 - RNA, 20 nt, Human
gcugccuuguccugcuuggu

SEQ ID NO: 1039717 - RNA, 22 nt, Human
gaugcacagugacccugccagu

SEQ ID NO: 1039718 - RNA, 18 nt, Human
cagggccccagaauuauc

SEQ ID NO: 1039719 - RNA, 22 nt, Human
ucacaacuugaagcugauuuaa

SEQ ID NO: 1039720 - RNA, 22 nt, Human
gaggggcucuuuaauaguaaca

SEQ ID NO: 1039721 - RNA, 22 nt, Human
uggccuugggcagguggccugc

SEQ ID NO: 1039722 - RNA, 22 nt, Human
ccucuggggugagugggccacu

SEQ ID NO: 1039723 - RNA, 17 nt, Human
uuccccugaccaagccu

SEQ ID NO: 1039724 - RNA, 22 nt, Human
agcagggcagugcuucagcucu

SEQ ID NO: 1039725 - RNA, 22 nt, Human
acugcagccuugaacucugggc

SEQ ID NO: 1039726 - RNA, 22 nt, Human
uacauacacaaauauacuguuu

SEQ ID NO: 1039727 - RNA, 22 nt, Human
auacaucuuccuuuuaaaaugc

SEQ ID NO: 1039728 - RNA, 19 nt, Human
ucaaggcucccugagggau

SEQ ID NO: 1039729 - RNA, 22 nt, Human
cagcagagacgguaagcagaac

SEQ ID NO: 1039730 - RNA, 21 nt, Human
aagaagcaauuuauuggaagg

SEQ ID NO: 1039731 - RNA, 22 nt, Human
ugaggcagaaauuccuguuuuc

SEQ ID NO: 1039732 - RNA, 22 nt, Human
aagacuuucucccaaauccuca

SEQ ID NO: 1039733 - RNA, 22 nt, Human
cugcagccuaggugcagcuggg

SEQ ID NO: 1039734 - RNA, 22 nt, Human
ucucuggccgagagucccuggg

SEQ ID NO: 1039735 - RNA, 22 nt, Human
ucaggccacuucacaggugauu

SEQ ID NO: 1039736 - RNA, 22 nt, Human
aggaaaaaagucugugauuaua

SEQ ID NO: 1039737 - RNA, 22 nt, Human
gccuggugugcgccgcgcagcu

SEQ ID NO: 1039738 - RNA, 22 nt, Human
gcacagccacugagugagaacc

SEQ ID NO: 1039739 - RNA, 22 nt, Human
gcuggugccuuguuguuguuac

SEQ ID NO: 1039740 - RNA, 22 nt, Human
acacagggaggaggugcugugc

SEQ ID NO: 1039741 - RNA, 22 nt, Human
gguggccuuucaguggaucagg

SEQ ID NO: 1039742 - RNA, 20 nt, Human
ccuccaggcacacccaugug

SEQ ID NO: 1039743 - RNA, 22 nt, Human
ucucagggugaggaaagaauuu

SEQ ID NO: 1039744 - RNA, 22 nt, Human
ggucagggcucuuccaguggcu

SEQ ID NO: 1039745 - RNA, 22 nt, Human
uggcagcaaaaccagaaucaga

SEQ ID NO: 1039746 - RNA, 22 nt, Human
ccugaggcccuggcugugcuga

SEQ ID NO: 1039747 - RNA, 22 nt, Human
uagaaacugauagucuugugcu

SEQ ID NO: 1039748 - RNA, 23 nt, Human
gugugccaagcacugugccagga

SEQ ID NO: 1039749 - RNA, 20 nt, Human
ugcuccaucuaaagugauua

SEQ ID NO: 1039750 - RNA, 18 nt, Human
gcugagguggugucagag

SEQ ID NO: 1039751 - RNA, 22 nt, Human
ucacauacacuaggauauuuuu

SEQ ID NO: 1039752 - RNA, 22 nt, Human
uuuguuuucaaugugucauuca

SEQ ID NO: 1039753 - RNA, 22 nt, Human
ggcagugacuguucagacgucc

SEQ ID NO: 1039754 - RNA, 22 nt, Human
uccuggagccacggagcuuuca

SEQ ID NO: 1039755 - RNA, 22 nt, Human
ggcacucagagauucaggcugu

SEQ ID NO: 1039756 - RNA, 22 nt, Human
gggggcuggaauauccaucaac

SEQ ID NO: 1039757 - RNA, 22 nt, Human
uuugcauuaucucacuuauaua

SEQ ID NO: 1039758 - RNA, 22 nt, Human
ugcuucucccaaccagggccug

SEQ ID NO: 1039759 - RNA, 22 nt, Human
ugguaaagaaggcuagaucuga

SEQ ID NO: 1039760 - RNA, 15 nt, Human
ugauuuccuacuaac

SEQ ID NO: 1039761 - RNA, 22 nt, Human
ccagaagucaggaaugagucuu

SEQ ID NO: 1039762 - RNA, 22 nt, Human
ggcaggaggaagaguuagcacc

SEQ ID NO: 1039763 - RNA, 22 nt, Human
aaagagcuucauuuccauuuau

SEQ ID NO: 1039764 - RNA, 22 nt, Human
caaggagauaaaauguugagcu

SEQ ID NO: 1039765 - RNA, 22 nt, Human
auaugaagaauuccaauuugga

SEQ ID NO: 1039766 - RNA, 22 nt, Human
cagggagaggcaucauagggaa

SEQ ID NO: 1039767 - RNA, 22 nt, Human
cagguggggcgcccucaggcag

SEQ ID NO: 1039768 - RNA, 22 nt, Human
uagcagcucacagccucccauu

SEQ ID NO: 1039769 - RNA, 22 nt, Human
agucucagaguaccugagggac

SEQ ID NO: 1039770 - RNA, 22 nt, Human
acaggcuucucacagaaaaggg

SEQ ID NO: 1039771 - RNA, 22 nt, Human
ugccugccaugcagaaagcuga

SEQ ID NO: 1039772 - RNA, 22 nt, Human
cagguggaucucuaaggacuga

SEQ ID NO: 1039773 - RNA, 20 nt, Human
ugcagcuucaccugugucau

SEQ ID NO: 1039774 - RNA, 22 nt, Human
caggccuggcccccggcacacc

SEQ ID NO: 1039775 - RNA, 22 nt, Human
auuauguaacugugguucagca

SEQ ID NO: 1039776 - RNA, 22 nt, Human
ugugcuucuugcagcuccugua

SEQ ID NO: 1039777 - RNA, 22 nt, Human
ucccagcagcauagcucagaau

SEQ ID NO: 1039778 - RNA, 22 nt, Human
ccaguccagugccaugcauggc

SEQ ID NO: 1039779 - RNA, 22 nt, Human
agcagccaaaugaagauuuuac

SEQ ID NO: 1039780 - RNA, 22 nt, Human
augggaggaagagaagaugucu

SEQ ID NO: 1039781 - RNA, 20 nt, Human
ccaccuggccaaggcugugc

SEQ ID NO: 1039782 - RNA, 22 nt, Human
ugaaaucuucacuaagucucuu

SEQ ID NO: 1039783 - RNA, 22 nt, Human
cccagguggcagaagcugcagu

SEQ ID NO: 1039784 - RNA, 22 nt, Human
cacugucuuuugugaagacaau

SEQ ID NO: 1039785 - RNA, 22 nt, Human
uccagggcuuggcugggacggu

SEQ ID NO: 1039786 - RNA, 22 nt, Human
guauuuauaggggaaugagagu

SEQ ID NO: 1039787 - RNA, 22 nt, Human
cagauggccagaggcagcugca

SEQ ID NO: 1039788 - RNA, 22 nt, Human
ugucucaguauacgaaacacuu

SEQ ID NO: 1039789 - RNA, 22 nt, Human
acauuuguaugcguuuuuacug

SEQ ID NO: 1039790 - RNA, 22 nt, Human
uuuuuccuagcgauuugucagc

SEQ ID NO: 1039791 - RNA, 22 nt, Human
acauuguagacuuuucauaugu

SEQ ID NO: 1039792 - RNA, 22 nt, Human
gggcugggcaugguguucccuc

SEQ ID NO: 1039793 - RNA, 22 nt, Human
ggccuggaaugcuuuccuacca

SEQ ID NO: 1039794 - RNA, 22 nt, Human
caguaugucuacuggacaaagu

SEQ ID NO: 1039795 - RNA, 22 nt, Human
gcccugucccuuggcuucuagg

SEQ ID NO: 1039796 - RNA, 22 nt, Human
agaaauguauagugaauuuuuc

SEQ ID NO: 1039797 - RNA, 22 nt, Human
ccagcuccaggacugggagcug

SEQ ID NO: 1039798 - RNA, 22 nt, Human
acugaaauacugcucuuggauu

SEQ ID NO: 1039799 - RNA, 22 nt, Human
ucagaccauccugcuguuagug

SEQ ID NO: 1039800 - RNA, 22 nt, Human
ucuggcucaucucuccagguaa

SEQ ID NO: 1039801 - RNA, 22 nt, Human
ucagggcaggacaguguaggcc

SEQ ID NO: 1039802 - RNA, 18 nt, Human
cagaaaucacaccagcac

SEQ ID NO: 1039803 - RNA, 22 nt, Human
gccagcuggagacuggcagggg

SEQ ID NO: 1039804 - RNA, 22 nt, Human
uggccugggugcugcugacauc

SEQ ID NO: 1039805 - RNA, 22 nt, Human
agguaagggucacaguucauau

SEQ ID NO: 1039806 - RNA, 22 nt, Human
cauacuuuugcccugacauucu

SEQ ID NO: 1039807 - RNA, 21 nt, Human
gaaaggucuuaacuuacagag

SEQ ID NO: 1039808 - RNA, 22 nt, Human
aggggcucaguuacuuuggcag

SEQ ID NO: 1039809 - RNA, 22 nt, Human
gggcugcugccaaucacagccu

SEQ ID NO: 1039810 - RNA, 22 nt, Human
cccaggucugugccagcucuga

SEQ ID NO: 1039811 - RNA, 22 nt, Human
ccaggagcagauauggacauaa

SEQ ID NO: 1039812 - RNA, 22 nt, Human
auguuacacauaggcauaaaug

SEQ ID NO: 1039813 - RNA, 22 nt, Human
gcacccagaauaaggacaggac

SEQ ID NO: 1039814 - RNA, 22 nt, Human
acaaagucugaaaccugaggca

SEQ ID NO: 1039815 - RNA, 22 nt, Human
ugggccugggucuuugcugcca

SEQ ID NO: 1039816 - RNA, 22 nt, Human
uggagcccagacacuggcauug

SEQ ID NO: 1039817 - RNA, 22 nt, Human
gugcauuuggugacucucaccc

SEQ ID NO: 1039818 - RNA, 22 nt, Human
uaugcauaauuggauaaguaga

SEQ ID NO: 1039819 - RNA, 22 nt, Human
ccuggcugguggcagcgacaag

SEQ ID NO: 1039820 - RNA, 20 nt, Human
gugaccagaagacagugggu

SEQ ID NO: 1039821 - RNA, 22 nt, Human
ugagcccaggaguaugaggcug

SEQ ID NO: 1039822 - RNA, 22 nt, Human
gucucuggguuaagcagugcau

SEQ ID NO: 1039823 - RNA, 22 nt, Human
ccagcuuguuugaagcucguca

SEQ ID NO: 1039824 - RNA, 22 nt, Human
cccuuccucccaggcuucugug

SEQ ID NO: 1039825 - RNA, 22 nt, Human
cucuccagccacagaagcugcu

SEQ ID NO: 1039826 - RNA, 23 nt, Human
agggguggucaguacccgcagug

SEQ ID NO: 1039827 - RNA, 22 nt, Human
caagcuccuuacauccacaggg

SEQ ID NO: 1039828 - RNA, 22 nt, Human
cugggagucuggccucuggucc

SEQ ID NO: 1039829 - RNA, 22 nt, Human
agggccuggaacugugggcagg

SEQ ID NO: 1039830 - RNA, 22 nt, Human
ugcugucaguuggcaggaugag

SEQ ID NO: 1039831 - RNA, 22 nt, Human
gcagaagcccggucagcgcacg

SEQ ID NO: 1039832 - RNA, 22 nt, Human
augggaggaugcucgggugcuc

SEQ ID NO: 1039833 - RNA, 22 nt, Human
ugcaccauguaaguggccacgu

SEQ ID NO: 1039834 - RNA, 22 nt, Human
acagguggcauaggcaguuuga

SEQ ID NO: 1039835 - RNA, 22 nt, Human
uggcagagucugggcuugggca

SEQ ID NO: 1039836 - RNA, 22 nt, Human
gucucccacuuucuggccucuu

SEQ ID NO: 1039837 - RNA, 22 nt, Human
ggcaugggguguauguggcacg

SEQ ID NO: 1039838 - RNA, 22 nt, Human
gcauaauauacaugcuugaucc

SEQ ID NO: 1039839 - RNA, 22 nt, Human
cagggcagccaggccccguggg

SEQ ID NO: 1039840 - RNA, 22 nt, Human
aggagcugaaacuucucauaug

SEQ ID NO: 1039841 - RNA, 22 nt, Human
gguggccucugcaggccucgac

SEQ ID NO: 1039842 - RNA, 22 nt, Human
ugaagccuuguguggccucucu

SEQ ID NO: 1039843 - RNA, 22 nt, Human
gcagagcuguuaauggagcuga

SEQ ID NO: 1039844 - RNA, 22 nt, Human
gagcccuccauggagccaggca

SEQ ID NO: 1039845 - RNA, 22 nt, Human
acacaguaugaaaagucuaguu

SEQ ID NO: 1039846 - RNA, 22 nt, Human
cuggagccggaccagggacggu

SEQ ID NO: 1039847 - RNA, 22 nt, Human
ucucucagucagaugcuaaaga

SEQ ID NO: 1039848 - RNA, 20 nt, Human
gagccuuccccucaccacug

SEQ ID NO: 1039849 - RNA, 22 nt, Human
ucugucaccauucagcuugaau

SEQ ID NO: 1039850 - RNA, 22 nt, Human
uggagaugaauauguguaccug

SEQ ID NO: 1039851 - RNA, 23 nt, Human
gcugucugucaucucugcgggag

SEQ ID NO: 1039852 - RNA, 22 nt, Human
ucuuugcaugugcuucuuggcc

SEQ ID NO: 1039853 - RNA, 22 nt, Human
cugggcugcaggaguggggcaa

SEQ ID NO: 1039854 - RNA, 22 nt, Human
uccaaagggaagcgcuuucugu

SEQ ID NO: 1039855 - RNA, 22 nt, Human
aacuagaacgucuaguugcugg

SEQ ID NO: 1039856 - RNA, 22 nt, Human
aaagguuugcauggaauuuacc

SEQ ID NO: 1039857 - RNA, 22 nt, Human
aaaaaugcuuggacuuaauaaa

SEQ ID NO: 1039858 - RNA, 23 nt, Human
cagaccuggcagucauccucaac

SEQ ID NO: 1039859 - RNA, 22 nt, Human
aagaaaagaaaccugaggcuuu

SEQ ID NO: 1039860 - RNA, 22 nt, Human
gcagccacuaguuuuccuguuu

SEQ ID NO: 1039861 - RNA, 22 nt, Human
uaugugcaguuugcucuuaaca

SEQ ID NO: 1039862 - RNA, 22 nt, Human
ugggacacccucacgccugcac

SEQ ID NO: 1039863 - RNA, 22 nt, Human
accuuuuuguucuguucucagc

SEQ ID NO: 1039864 - RNA, 22 nt, Human
cuacauuaaauuggcuuacuua

SEQ ID NO: 1039865 - RNA, 22 nt, Human
auuagcugaccucuaaggagcc

SEQ ID NO: 1039866 - RNA, 22 nt, Human
ccugggcaggaugggcccggug

SEQ ID NO: 1039867 - RNA, 17 nt, Human
gccuggcccagccuggc

SEQ ID NO: 1039868 - RNA, 22 nt, Human
gggcucucaugaguguguggua

SEQ ID NO: 1039869 - RNA, 22 nt, Human
ggcugcuugcuguuucuuggau

SEQ ID NO: 1039870 - RNA, 22 nt, Human
auuguaauuuuagagaaagugg

SEQ ID NO: 1039871 - RNA, 18 nt, Human
acaaauguagugucuuaa

SEQ ID NO: 1039872 - RNA, 22 nt, Human
agggccaggaacaccugaaggg

SEQ ID NO: 1039873 - RNA, 18 nt, Human
gagaggcccggcugugcc

SEQ ID NO: 1039874 - RNA, 22 nt, Human
gcagcaggagaguuuguccugc

SEQ ID NO: 1039875 - RNA, 22 nt, Human
gccaggcuggaaagaacagaca

SEQ ID NO: 1039876 - RNA, 22 nt, Human
cuguggcuaggaagcuguggga

SEQ ID NO: 1039877 - RNA, 22 nt, Human
uugcagagaucagcagguuuga

SEQ ID NO: 1039878 - RNA, 17 nt, Human
gucugggcuuuagagac

SEQ ID NO: 1039879 - RNA, 22 nt, Human
cucugggcaccaaagagcagcu

SEQ ID NO: 1039880 - RNA, 22 nt, Human
cugagaggugacagcgugcugg

SEQ ID NO: 1039881 - RNA, 22 nt, Human
agucuucccugugccagagugu

SEQ ID NO: 1039882 - RNA, 22 nt, Human
cuucaagauccauagauauugc

SEQ ID NO: 1039883 - RNA, 22 nt, Human
ucagaggucacacagcaaguuu

SEQ ID NO: 1039884 - RNA, 21 nt, Human
ucagcagcuuuugcagucccu

SEQ ID NO: 1039885 - RNA, 20 nt, Human
agaagcugauacugauggaa

SEQ ID NO: 1039886 - RNA, 23 nt, Human
uccuuccuuugagaggcuccauc

SEQ ID NO: 1039887 - RNA, 22 nt, Human
gcaggaugagugaguacauuua

SEQ ID NO: 1039888 - RNA, 21 nt, Human
ggacuuacauagguaaggggu

SEQ ID NO: 1039889 - RNA, 22 nt, Human
gccaggcuggcaaaaggaaacc

SEQ ID NO: 1039890 - RNA, 22 nt, Human
ugcuccagugagcuggccaucc

SEQ ID NO: 1039891 - RNA, 22 nt, Human
aggaggcuguggagcacuccau

SEQ ID NO: 1039892 - RNA, 22 nt, Human
ggaggggccggcugccugccac

SEQ ID NO: 1039893 - RNA, 22 nt, Human
uuacaguaugaucaacuuuuca

SEQ ID NO: 1039894 - RNA, 22 nt, Human
ucugucugcucauuuaccucag

SEQ ID NO: 1039895 - RNA, 22 nt, Human
cuggaaggcucugcugccuguc

SEQ ID NO: 1039896 - RNA, 22 nt, Human
ggccagagaauaugccuuacgu

SEQ ID NO: 1039897 - RNA, 22 nt, Human
uggcacugaccccaggccugug

SEQ ID NO: 1039898 - RNA, 22 nt, Human
ucccagagacaucauuucuccg

SEQ ID NO: 1039899 - RNA, 22 nt, Human
ccagagccugcugagccccauu

SEQ ID NO: 1039900 - RNA, 22 nt, Human
cagagccaugguaugggcuugu

SEQ ID NO: 1039901 - RNA, 22 nt, Human
acauuucuucccuuuagcagaa

SEQ ID NO: 1039902 - RNA, 22 nt, Human
gaggcagcaaaauauaucauaa

SEQ ID NO: 1039903 - RNA, 22 nt, Human
cuucuugcugggggccucagug

SEQ ID NO: 1039904 - RNA, 22 nt, Human
gcagggacaaggcagguguucu

SEQ ID NO: 1039905 - RNA, 22 nt, Human
uccaguggagugugggggugaa

SEQ ID NO: 1039906 - RNA, 22 nt, Human
acuguacuguguauuguagaau

SEQ ID NO: 1039907 - RNA, 22 nt, Human
caagugucuauaucagugcuug

SEQ ID NO: 1039908 - RNA, 22 nt, Human
agagucugaggcagcugcagcc

SEQ ID NO: 1039909 - RNA, 22 nt, Human
ugugaagcuggauccuggagcu

SEQ ID NO: 1039910 - RNA, 22 nt, Human
guaagggauuugaacauagguu

SEQ ID NO: 1039911 - RNA, 20 nt, Human
ccuggaagagcuccccaggc

SEQ ID NO: 1039912 - RNA, 23 nt, Human
ggggccugcaccggucugcgcgg

SEQ ID NO: 1039913 - RNA, 22 nt, Human
gcucaggaccgaggggugggaa

SEQ ID NO: 1039914 - RNA, 22 nt, Human
ugcugccucagcuuccugggcu

SEQ ID NO: 1039915 - RNA, 22 nt, Human
aggagccaagcagaacuaagga

SEQ ID NO: 1039916 - RNA, 18 nt, Human
ggcucaggcuauccuaac

SEQ ID NO: 1039917 - RNA, 22 nt, Human
acugcagccuuugggcucauaa

SEQ ID NO: 1039918 - RNA, 22 nt, Human
cuggugggagcagcaggcagcu

SEQ ID NO: 1039919 - RNA, 22 nt, Human
auuuugaaaccaaguuauuucc

SEQ ID NO: 1039920 - RNA, 22 nt, Human
aucagcaagauugugucuugua

SEQ ID NO: 1039921 - RNA, 22 nt, Human
cagaggcuaagaugagugggug

SEQ ID NO: 1039922 - RNA, 23 nt, Human
agaggccaacuucuugccccucc

SEQ ID NO: 1039923 - RNA, 20 nt, Human
cagcuuggaugagaggcuga

SEQ ID NO: 1039924 - RNA, 23 nt, Human
ucugagagaacaaugccuccuau

SEQ ID NO: 1039925 - RNA, 19 nt, Human
gggcuuggggcugaagccu

SEQ ID NO: 1039926 - RNA, 22 nt, Human
aguuuagaguucaaauuaguuc

SEQ ID NO: 1039927 - RNA, 21 nt, Human
agcagagugcuuugacuuugu

SEQ ID NO: 1039928 - RNA, 22 nt, Human
cucuggaguggguggccgggag

SEQ ID NO: 1039929 - RNA, 22 nt, Human
uuuuauuggagugauaccaagc

SEQ ID NO: 1039930 - RNA, 22 nt, Human
aggcuggcuggcaggggacaca

SEQ ID NO: 1039931 - RNA, 22 nt, Human
ggcauggcuggguucuggugag

SEQ ID NO: 1039932 - RNA, 21 nt, Human
agcugagcccagaagacuggu

SEQ ID NO: 1039933 - RNA, 22 nt, Human
uccuuggcuuucuggagcuucu

SEQ ID NO: 1039934 - RNA, 22 nt, Human
ugccugggaaccaauccuggcu

SEQ ID NO: 1039935 - RNA, 22 nt, Human
caggccuggagugcaauggcac

SEQ ID NO: 1039936 - RNA, 23 nt, Human
ccuccugggcacaggccugaugg

SEQ ID NO: 1039937 - RNA, 22 nt, Human
ccauaagguugaaaacuguaca

SEQ ID NO: 1039938 - RNA, 22 nt, Human
ucacuguaucauguugcacuua

SEQ ID NO: 1039939 - RNA, 22 nt, Human
augcaguagauaggcacuuuua

SEQ ID NO: 1039940 - RNA, 22 nt, Human
aucauaaagugcuaucugauug

SEQ ID NO: 1039941 - RNA, 22 nt, Human
uggccugguuauauugcuauca

SEQ ID NO: 1039942 - RNA, 22 nt, Human
aggaguguggccagggcucugg

SEQ ID NO: 1039943 - RNA, 23 nt, Human
uggcucugagcuuccugguggcc

SEQ ID NO: 1039944 - RNA, 22 nt, Human
cugggagcccugacuagccugg

SEQ ID NO: 1039945 - RNA, 21 nt, Human
gcagcuggucucagagcuugc

SEQ ID NO: 1039946 - RNA, 22 nt, Human
uaaauguguaaaccuccauuac

SEQ ID NO: 1039947 - RNA, 22 nt, Human
uuguaacagcugcuuaauagag

SEQ ID NO: 1039948 - RNA, 22 nt, Human
augugcaugcacuuacaugugu

SEQ ID NO: 1039949 - RNA, 22 nt, Human
ggaagggcaaaagagaugaacu

SEQ ID NO: 1039950 - RNA, 22 nt, Human
gugcugucguggaacugggcug

SEQ ID NO: 1039951 - RNA, 22 nt, Human
uugaaggacaucuuguuucuag

SEQ ID NO: 1039952 - RNA, 22 nt, Human
auacuuuggggguuaguguaga

SEQ ID NO: 1039953 - RNA, 22 nt, Human
uggagcaggugggaugucguga

SEQ ID NO: 1039954 - RNA, 22 nt, Human
gauucugagcugguguuuuacg

SEQ ID NO: 1039955 - RNA, 22 nt, Human
gccugcagaacugugaggcaau

SEQ ID NO: 1039956 - RNA, 22 nt, Human
ccacacagggggaugaguuauu

SEQ ID NO: 1039957 - RNA, 22 nt, Human
ucuccucugcgcggcagugccc

SEQ ID NO: 1039958 - RNA, 20 nt, Human
agcaggaaugaugcuuucau

SEQ ID NO: 1039959 - RNA, 22 nt, Human
gcugagugagguccagagcuug

SEQ ID NO: 1039960 - RNA, 22 nt, Human
aagaugcagcuuccacuuuugc

SEQ ID NO: 1039961 - RNA, 22 nt, Human
uauugaaauccauuacguucuu

SEQ ID NO: 1039962 - RNA, 22 nt, Human
uggcucagagcagggacucugg

SEQ ID NO: 1039963 - RNA, 22 nt, Human
cuaucuuucgauucuagcuuaa

SEQ ID NO: 1039964 - RNA, 22 nt, Human
ucaaaugcuguauuguaguaau

SEQ ID NO: 1039965 - RNA, 22 nt, Human
gugcugucaauugcuuucagua

SEQ ID NO: 1039966 - RNA, 22 nt, Human
acaaagcuagagaagagaauug

SEQ ID NO: 1039967 - RNA, 22 nt, Human
uucuggaguauuccuggcaccu

SEQ ID NO: 1039968 - RNA, 22 nt, Human
caggcugggaacgccacccgcu

SEQ ID NO: 1039969 - RNA, 22 nt, Human
uauucacauucucaggccuggu

SEQ ID NO: 1039970 - RNA, 22 nt, Human
uugaccauaccuccaggcaguu

SEQ ID NO: 1039971 - RNA, 21 nt, Human
uuacuuuugcaccaaccuaau

SEQ ID NO: 1039972 - RNA, 22 nt, Human
ggcuucccaaggagccaggaug

SEQ ID NO: 1039973 - RNA, 19 nt, Human
gagcccucuccauggccac

SEQ ID NO: 1039974 - RNA, 22 nt, Human
cugugccuggggggcagagcug

SEQ ID NO: 1039975 - RNA, 22 nt, Human
uucaagauccagcacaacagug

SEQ ID NO: 1039976 - RNA, 22 nt, Human
auugacaaggaaacuauaccag

SEQ ID NO: 1039977 - RNA, 22 nt, Human
aacucaguuacauauuagaaua

SEQ ID NO: 1039978 - RNA, 22 nt, Human
ccugaagcaaggguaggcaggu

SEQ ID NO: 1039979 - RNA, 21 nt, Human
aacauuucugggagaacucac

SEQ ID NO: 1039980 - RNA, 22 nt, Human
agccagaggccagccugccuca

SEQ ID NO: 1039981 - RNA, 22 nt, Human
ugggcagagucauacaggagac

SEQ ID NO: 1039982 - RNA, 22 nt, Human
gcaccugcaggaugagccaggg

SEQ ID NO: 1039983 - RNA, 22 nt, Human
acaaaguuugugguauuccaag

SEQ ID NO: 1039984 - RNA, 22 nt, Human
uugcacuccagcccgagcaaca

SEQ ID NO: 1039985 - RNA, 22 nt, Human
cucaggauauugggcuggagca

SEQ ID NO: 1039986 - RNA, 22 nt, Human
guuuuuaucuaauagcaguuau

SEQ ID NO: 1039987 - RNA, 22 nt, Human
acaggugguaaaauggacuguc

SEQ ID NO: 1039988 - RNA, 22 nt, Human
gcugagcucccagcaguaucug

SEQ ID NO: 1039989 - RNA, 22 nt, Human
uccuugaaugaagagaggugac

SEQ ID NO: 1039990 - RNA, 22 nt, Human
uacaaaguuugagaaugcuuuc

SEQ ID NO: 1039991 - RNA, 22 nt, Human
uaggagcuaaaauauuuuauau

SEQ ID NO: 1039992 - RNA, 22 nt, Human
cauguacaaaaggcaaaugccu

SEQ ID NO: 1039993 - RNA, 19 nt, Human
ccugggaggcggagguugc

SEQ ID NO: 1039994 - RNA, 22 nt, Human
ucuggcucuaacuaggcaucag

SEQ ID NO: 1039995 - RNA, 21 nt, Human
gaggccacuaauaggggcaga

SEQ ID NO: 1039996 - RNA, 23 nt, Human
ugcucugugaauaguuggugacu

SEQ ID NO: 1039997 - RNA, 22 nt, Human
aauguuaaaaccuucagugcuu

SEQ ID NO: 1039998 - RNA, 22 nt, Human
gcugggaggaucucucccuguc

SEQ ID NO: 1039999 - RNA, 22 nt, Human
caggaggaaaugugacccugcu

SEQ ID NO: 1040000 - RNA, 22 nt, Human
uugacagcaaagauugugccua

SEQ ID NO: 1040001 - RNA, 22 nt, Human
caggccugaguguggaagucuu

SEQ ID NO: 1040002 - RNA, 22 nt, Human
ggagggcugccagguggagcgg

SEQ ID NO: 1040003 - RNA, 22 nt, Human
uggcugcugcuuggucuucuuc

SEQ ID NO: 1040004 - RNA, 23 nt, Human
agaugaaagcuucccaucacagu

SEQ ID NO: 1040005 - RNA, 22 nt, Human
uguaggaguccaaucaggagac

SEQ ID NO: 1040006 - RNA, 17 nt, Human
gguggccugcaguggcu

SEQ ID NO: 1040007 - RNA, 22 nt, Human
uugaagcacaaugucuuuuauc

SEQ ID NO: 1040008 - RNA, 22 nt, Human
gaagcagcgaaguggaagggac

SEQ ID NO: 1040009 - RNA, 22 nt, Human
uugcucuguaauaaucuggggu

SEQ ID NO: 1040010 - RNA, 22 nt, Human
gagccuggggacccuccugagu

SEQ ID NO: 1040011 - RNA, 22 nt, Human
ugcaggugguuuggacacugcu

SEQ ID NO: 1040012 - RNA, 22 nt, Human
ugagguggcuagggaggcacuc

SEQ ID NO: 1040013 - RNA, 22 nt, Human
ugcagccaauucauucauucuu

SEQ ID NO: 1040014 - RNA, 22 nt, Human
cugcagggcagggccuccuggc

SEQ ID NO: 1040015 - RNA, 22 nt, Human
cagaagcauuccagcaaauagu

SEQ ID NO: 1040016 - RNA, 22 nt, Human
aauguguguauuucuaggcgag

SEQ ID NO: 1040017 - RNA, 22 nt, Human
ccugccugguguaagucuaagg

SEQ ID NO: 1040018 - RNA, 22 nt, Human
ggagucaggagcaggcugggcu

SEQ ID NO: 1040019 - RNA, 22 nt, Human
cuuccaaagcacuuuauggacc

SEQ ID NO: 1040020 - RNA, 22 nt, Human
ugccugaggagucagggcaggu

SEQ ID NO: 1040021 - RNA, 22 nt, Human
gugacucacacaggccugggcu

SEQ ID NO: 1040022 - RNA, 22 nt, Human
acccagaggugucuagcaagcu

SEQ ID NO: 1040023 - RNA, 22 nt, Human
ucagggacuaggugcugccuga

SEQ ID NO: 1040024 - RNA, 22 nt, Human
cuuuuuccagcuucaggguggg

SEQ ID NO: 1040025 - RNA, 22 nt, Human
ccuggcagguggcgcccucggc

SEQ ID NO: 1040026 - RNA, 22 nt, Human
uuccauaacugaccgaaugcau

SEQ ID NO: 1040027 - RNA, 22 nt, Human
ugaaggaaugagggaguggguc

SEQ ID NO: 1040028 - RNA, 21 nt, Human
gccaccucgucucggagcagc

SEQ ID NO: 1040029 - RNA, 22 nt, Human
aaauguguauaugaaacaugau

SEQ ID NO: 1040030 - RNA, 22 nt, Human
agugaccauuuucagcuagagg

SEQ ID NO: 1040031 - RNA, 22 nt, Human
aguuuuuccugauuuuacagaa

SEQ ID NO: 1040032 - RNA, 22 nt, Human
auugacaauuagcccuuaggug

SEQ ID NO: 1040033 - RNA, 22 nt, Human
gcugcagcccggcgcgccugag

SEQ ID NO: 1040034 - RNA, 22 nt, Human
agggcuggagccacagcuggga

SEQ ID NO: 1040035 - RNA, 22 nt, Human
ugagcccagagcccuuguaggg

SEQ ID NO: 1040036 - RNA, 22 nt, Human
ccuggaaggugaugguacagca

SEQ ID NO: 1040037 - RNA, 22 nt, Human
aagaugauguuguguuuucacu

SEQ ID NO: 1040038 - RNA, 22 nt, Human
acgcagaagggccuggcgugcc

SEQ ID NO: 1040039 - RNA, 22 nt, Human
gugaccaucagagaauaacaaa

SEQ ID NO: 1040040 - RNA, 22 nt, Human
accagagcgcucaagccuuccc

SEQ ID NO: 1040041 - RNA, 22 nt, Human
cauggggagacaccuagggaaa

SEQ ID NO: 1040042 - RNA, 20 nt, Human
ccugaggguuuguguucuuu

SEQ ID NO: 1040043 - RNA, 22 nt, Human
caccagcuuugcccacugccca

SEQ ID NO: 1040044 - RNA, 22 nt, Human
acagaauugaaaguauaaucug

SEQ ID NO: 1040045 - RNA, 22 nt, Human
uguauuagagcaguagaauuau

SEQ ID NO: 1040046 - RNA, 19 nt, Human
gaagaagcuugagaaguag

SEQ ID NO: 1040047 - RNA, 22 nt, Human
cuggaagaggaagccagcugga

SEQ ID NO: 1040048 - RNA, 22 nt, Human
accaggaggccuggagcacaaa

SEQ ID NO: 1040049 - RNA, 22 nt, Human
gggcauggaggucugucugcag

SEQ ID NO: 1040050 - RNA, 22 nt, Human
cugaggugagcuucccugggcu

SEQ ID NO: 1040051 - RNA, 22 nt, Human
uaagcauaacuaaaaaugauuu

SEQ ID NO: 1040052 - RNA, 22 nt, Human
uggaccugcuggaugggcaggu

SEQ ID NO: 1040053 - RNA, 22 nt, Human
uaaaucacuccuaauaaucagu

SEQ ID NO: 1040054 - RNA, 22 nt, Human
cugaaggacacgugaggagcca

SEQ ID NO: 1040055 - RNA, 21 nt, Human
ucugggcccaugcugccucac

SEQ ID NO: 1040056 - RNA, 22 nt, Human
gucagcaggguccccuugagug

SEQ ID NO: 1040057 - RNA, 22 nt, Human
caggucagagucccccuguccu

SEQ ID NO: 1040058 - RNA, 22 nt, Human
aagggcagccugacucacgguc

SEQ ID NO: 1040059 - RNA, 22 nt, Human
uccuucagcuuauuucuuagga

SEQ ID NO: 1040060 - RNA, 18 nt, Human
gggaucaggcugccuagg

SEQ ID NO: 1040061 - RNA, 22 nt, Human
aucagcaaguccuguuaauucu

SEQ ID NO: 1040062 - RNA, 22 nt, Human
cacacaugagucuccccauugg

SEQ ID NO: 1040063 - RNA, 22 nt, Human
aagcacagaaaaggagcaugga

SEQ ID NO: 1040064 - RNA, 22 nt, Human
ugcagaguaaaagcagaugcua

SEQ ID NO: 1040065 - RNA, 23 nt, Human
ugacacauuuccuuuccacugca

SEQ ID NO: 1040066 - RNA, 22 nt, Human
agagucuuccaggcagccugag

SEQ ID NO: 1040067 - RNA, 22 nt, Human
gugugcaugcauagacaccaca

SEQ ID NO: 1040068 - RNA, 22 nt, Human
ugucccaguucccaggguugcu

SEQ ID NO: 1040069 - RNA, 22 nt, Human
ucuggccuauuucugucagauc

SEQ ID NO: 1040070 - RNA, 22 nt, Human
ucagggacuuacaaaccagaag

SEQ ID NO: 1040071 - RNA, 22 nt, Human
cuggugccuccucccugugcuu

SEQ ID NO: 1040072 - RNA, 19 nt, Human
ggacacagaaagcugcauu

SEQ ID NO: 1040073 - RNA, 22 nt, Human
ucacuggggccuuuggucagga

SEQ ID NO: 1040074 - RNA, 22 nt, Human
ggcuggguuauuuauggccaag

SEQ ID NO: 1040075 - RNA, 22 nt, Human
ccugggugaugugcugcccucg

SEQ ID NO: 1040076 - RNA, 22 nt, Human
ccagcugagaaguguaaaguga

SEQ ID NO: 1040077 - RNA, 22 nt, Human
ggcugggcuccgggagcaugcg

SEQ ID NO: 1040078 - RNA, 22 nt, Human
ugaaagguagcuggccucauag

SEQ ID NO: 1040079 - RNA, 22 nt, Human
gcagcuuggugaaaggugaugg

SEQ ID NO: 1040080 - RNA, 22 nt, Human
gaugcagaaaguagacaccauc

SEQ ID NO: 1040081 - RNA, 22 nt, Human
ggcucugcuggauugaggccag

SEQ ID NO: 1040082 - RNA, 22 nt, Human
agggcagagcugucuaaauggc

SEQ ID NO: 1040083 - RNA, 22 nt, Human
ucagaagcugguguccuuugaa

SEQ ID NO: 1040084 - RNA, 22 nt, Human
agugguaacuaaguccugcuua

SEQ ID NO: 1040085 - RNA, 19 nt, Human
acucaagucuaaugaaauc

SEQ ID NO: 1040086 - RNA, 22 nt, Human
ccagcugaggcagccacacagg

SEQ ID NO: 1040087 - RNA, 22 nt, Human
uccucaggaucuaggagugcuu

SEQ ID NO: 1040088 - RNA, 22 nt, Human
gaaggaagugcucauacuaguu

SEQ ID NO: 1040089 - RNA, 23 nt, Human
cccagcgcugagcccugcaggca

SEQ ID NO: 1040090 - RNA, 22 nt, Human
ugcaccccauuuuacauuuaca

SEQ ID NO: 1040091 - RNA, 22 nt, Human
ccuggcagcagcacaugccuuc

SEQ ID NO: 1040092 - RNA, 22 nt, Human
agagcuggguggacuuguaguu

SEQ ID NO: 1040093 - RNA, 22 nt, Human
agauacauuguucuaagcauug

SEQ ID NO: 1040094 - RNA, 22 nt, Human
caaggcugcugcgggucgcacc

SEQ ID NO: 1040095 - RNA, 22 nt, Human
gggagccaugcuggucuucuuu

SEQ ID NO: 1040096 - RNA, 21 nt, Human
cucuggaggcaagggagagug

SEQ ID NO: 1040097 - RNA, 22 nt, Human
auuugucugcuugcugccuucc

SEQ ID NO: 1040098 - RNA, 22 nt, Human
uggcucagaaggcugccuucac

SEQ ID NO: 1040099 - RNA, 22 nt, Human
caggccugugaguugaggcccc

SEQ ID NO: 1040100 - RNA, 22 nt, Human
ugggugggagcacccugucugg

SEQ ID NO: 1040101 - RNA, 20 nt, Human
ccagacagcaccugccuggu

SEQ ID NO: 1040102 - RNA, 22 nt, Human
accucuggccuucaggcaucau

SEQ ID NO: 1040103 - RNA, 22 nt, Human
acugaaggaaagccuuugcaug

SEQ ID NO: 1040104 - RNA, 22 nt, Human
ggcacugagcgggcucugagcg

SEQ ID NO: 1040105 - RNA, 22 nt, Human
ggcagcuggccuccucgcccac

SEQ ID NO: 1040106 - RNA, 22 nt, Human
caggagugucuccacacagcaa

SEQ ID NO: 1040107 - RNA, 22 nt, Human
agaggaugguugaggaagaccu

SEQ ID NO: 1040108 - RNA, 22 nt, Human
uaugcacaccuggguccuuguc

SEQ ID NO: 1040109 - RNA, 22 nt, Human
ggcaguagccagggacuggcag

SEQ ID NO: 1040110 - RNA, 22 nt, Human
uccccagccgugaaggagagga

SEQ ID NO: 1040111 - RNA, 22 nt, Human
ucuuccucucuaauugaucaga

SEQ ID NO: 1040112 - RNA, 22 nt, Human
uacccaggagaaacagcagggc

SEQ ID NO: 1040113 - RNA, 22 nt, Human
ggcagaggaagcuggaaguggg

SEQ ID NO: 1040114 - RNA, 22 nt, Human
agagcagaggcauggccguggg

SEQ ID NO: 1040115 - RNA, 22 nt, Human
caauagcagcuucugaaugcaa

SEQ ID NO: 1040116 - RNA, 17 nt, Human
gggcagggacuccuggg

SEQ ID NO: 1040117 - RNA, 22 nt, Human
gcaaggaccuuugagcgugcca

SEQ ID NO: 1040118 - RNA, 22 nt, Human
aagauuucagaguuugggggaa

SEQ ID NO: 1040119 - RNA, 22 nt, Human
acuuuuuacaggguguauacca

SEQ ID NO: 1040120 - RNA, 21 nt, Human
cagugcucaaucugacagugg

SEQ ID NO: 1040121 - RNA, 22 nt, Human
agaguguuucagucuuccuaga

SEQ ID NO: 1040122 - RNA, 22 nt, Human
ccacagggugucaucagcuuga

SEQ ID NO: 1040123 - RNA, 22 nt, Human
uccaguggguugcugagggagg

SEQ ID NO: 1040124 - RNA, 22 nt, Human
acauuucucuuagaguuggacu

SEQ ID NO: 1040125 - RNA, 22 nt, Human
ugccucugaggaagauuguguu

SEQ ID NO: 1040126 - RNA, 22 nt, Human
ccugggaggcggagguugcagg

SEQ ID NO: 1040127 - RNA, 22 nt, Human
agagccaggacugugucucacu

SEQ ID NO: 1040128 - RNA, 20 nt, Human
gugccuggagaagaggcugu

SEQ ID NO: 1040129 - RNA, 22 nt, Human
ggagauagacuuggugagccac

SEQ ID NO: 1040130 - RNA, 22 nt, Human
ggaggccaaggcaggcggauca

SEQ ID NO: 1040131 - RNA, 22 nt, Human
cuuauguaugcuacuuuguggu

SEQ ID NO: 1040132 - RNA, 22 nt, Human
gccaccagugggggccugggca

SEQ ID NO: 1040133 - RNA, 22 nt, Human
acaaaguccugguguauggcca

SEQ ID NO: 1040134 - RNA, 22 nt, Human
ccugagacaugaaccaggcucc

SEQ ID NO: 1040135 - RNA, 22 nt, Human
aggacuuagaacauuauguacu

SEQ ID NO: 1040136 - RNA, 22 nt, Human
guccugucccccaaggcugugg

SEQ ID NO: 1040137 - RNA, 22 nt, Human
aaugaugguuucaucacuugaa

SEQ ID NO: 1040138 - RNA, 22 nt, Human
uggcuucugggacuugugagca

SEQ ID NO: 1040139 - RNA, 22 nt, Human
gauuucaccugaucuugucauc

SEQ ID NO: 1040140 - RNA, 22 nt, Human
ucacaggguguacaucaccuau

SEQ ID NO: 1040141 - RNA, 22 nt, Human
aagucacagcuaaauagcuaag

SEQ ID NO: 1040142 - RNA, 22 nt, Human
aaugcacaaaaauuguauguaa

SEQ ID NO: 1040143 - RNA, 22 nt, Human
gcugcuuccuuuccugcugacc

SEQ ID NO: 1040144 - RNA, 22 nt, Human
ugcuucaggaagaaacgccagg

SEQ ID NO: 1040145 - RNA, 22 nt, Human
aacacaaagaagcugcaggauc

SEQ ID NO: 1040146 - RNA, 22 nt, Human
agagggaucacccuguuucugg

SEQ ID NO: 1040147 - RNA, 22 nt, Human
aggaccuguaccucagcaucua

SEQ ID NO: 1040148 - RNA, 19 nt, Human
gucacauuugucucccagg

SEQ ID NO: 1040149 - RNA, 22 nt, Human
agaagauuuagguugacgcuau

SEQ ID NO: 1040150 - RNA, 22 nt, Human
gagucacauuaauuuaauuuua

SEQ ID NO: 1040151 - RNA, 22 nt, Human
gggagcuguaguccagauaccg

SEQ ID NO: 1040152 - RNA, 22 nt, Human
uuaugaaagacauuucuguugg

SEQ ID NO: 1040153 - RNA, 22 nt, Human
agugcacaccuuaguacaaagu

SEQ ID NO: 1040154 - RNA, 21 nt, Human
uagcacuucgcuguaauuggg

SEQ ID NO: 1040155 - RNA, 22 nt, Human
gcuggaaggcuaggcucaguug

SEQ ID NO: 1040156 - RNA, 20 nt, Human
uguugauuggugucaucuca

SEQ ID NO: 1040157 - RNA, 22 nt, Human
ccaggaggcagagguuacagug

SEQ ID NO: 1040158 - RNA, 22 nt, Human
aaaguguacuaugucaugaaca

SEQ ID NO: 1040159 - RNA, 22 nt, Human
acagggcaaccucugggagacu

SEQ ID NO: 1040160 - RNA, 22 nt, Human
ccaggggcuggugcugagcugg

SEQ ID NO: 1040161 - RNA, 21 nt, Human
ucagggcagcugcucuucaga

SEQ ID NO: 1040162 - RNA, 22 nt, Human
ggggauggugggaaggcaaucu

SEQ ID NO: 1040163 - RNA, 22 nt, Human
auagauacauuagguaacuugu

SEQ ID NO: 1040164 - RNA, 22 nt, Human
ggguguguuccuaaggaaacca

SEQ ID NO: 1040165 - RNA, 22 nt, Human
ccagggugaccagcuggccuag

SEQ ID NO: 1040166 - RNA, 22 nt, Human
cagcaggcguugggagaaagac

SEQ ID NO: 1040167 - RNA, 22 nt, Human
aaaugugucauauucaaaguca

SEQ ID NO: 1040168 - RNA, 22 nt, Human
ugggcugcuuccucagcugaga

SEQ ID NO: 1040169 - RNA, 23 nt, Human
uggagaugccccacucccugucu

SEQ ID NO: 1040170 - RNA, 22 nt, Human
auucuccaucaccacuggcacu

SEQ ID NO: 1040171 - RNA, 23 nt, Human
uggcccugaaucuguccuggagg

SEQ ID NO: 1040172 - RNA, 22 nt, Human
gagccagcugagcugcacuguc

SEQ ID NO: 1040173 - RNA, 21 nt, Human
agauuguauggaggugagagg

SEQ ID NO: 1040174 - RNA, 22 nt, Human
gagcugccugaacaagcagcag

SEQ ID NO: 1040175 - RNA, 22 nt, Human
gcugucuccauagcuguguguc

SEQ ID NO: 1040176 - RNA, 22 nt, Human
acagauugaucuugagaauuau

SEQ ID NO: 1040177 - RNA, 22 nt, Human
agccccaggcccggacgccucu

SEQ ID NO: 1040178 - RNA, 22 nt, Human
ugagccuggagucguggagggg

SEQ ID NO: 1040179 - RNA, 22 nt, Human
gugucauuaaccaccaugcaaa

SEQ ID NO: 1040180 - RNA, 22 nt, Human
uggcagcagggaggccaguguu

SEQ ID NO: 1040181 - RNA, 18 nt, Human
acaggccucaguccugca

SEQ ID NO: 1040182 - RNA, 22 nt, Human
ugaagaugucagcagggguggu

SEQ ID NO: 1040183 - RNA, 22 nt, Human
aagcugcagacccccugucuca

SEQ ID NO: 1040184 - RNA, 22 nt, Human
cucaggguaaugaaagacgaau

SEQ ID NO: 1040185 - RNA, 22 nt, Human
aaaggucagacuuaggcugggc

SEQ ID NO: 1040186 - RNA, 22 nt, Human
ucccagaggacuguuggugcua

SEQ ID NO: 1040187 - RNA, 21 nt, Human
auccauccaucuuggccuaac

SEQ ID NO: 1040188 - RNA, 19 nt, Human
ugagagugaggaaggcuuc

SEQ ID NO: 1040189 - RNA, 22 nt, Human
ggcaguggugggaggcucgcuc

SEQ ID NO: 1040190 - RNA, 22 nt, Human
agaggagguggugaugcuuuaa

SEQ ID NO: 1040191 - RNA, 22 nt, Human
ggcaucuguccaucucuccagc

SEQ ID NO: 1040192 - RNA, 22 nt, Human
uggcucagagagggagugugga

SEQ ID NO: 1040193 - RNA, 22 nt, Human
ccuggcagaauauuaaagugca

SEQ ID NO: 1040194 - RNA, 22 nt, Human
gcccagcugucuggcagggaug

SEQ ID NO: 1040195 - RNA, 22 nt, Human
acugugugcccugacgccaggg

SEQ ID NO: 1040196 - RNA, 22 nt, Human
ucccugggcaucacguugcuuc

SEQ ID NO: 1040197 - RNA, 22 nt, Human
agggagcucaguuggaagcggu

SEQ ID NO: 1040198 - RNA, 22 nt, Human
aaaaagauguccugaaguuuag

SEQ ID NO: 1040199 - RNA, 22 nt, Human
cugugcuucgcaacuccaaggu

SEQ ID NO: 1040200 - RNA, 22 nt, Human
cuguuuauaaauagaggggagu

SEQ ID NO: 1040201 - RNA, 22 nt, Human
gcuggcuccucuguccucacgg

SEQ ID NO: 1040202 - RNA, 22 nt, Human
cuuagaaauaaugguuucaguu

SEQ ID NO: 1040203 - RNA, 22 nt, Human
cacauuucucuaccucacacaa

SEQ ID NO: 1040204 - RNA, 22 nt, Human
aaggcugcuuuuaacaugcaua

SEQ ID NO: 1040205 - RNA, 19 nt, Human
ugcagcucagggcaggggc

SEQ ID NO: 1040206 - RNA, 22 nt, Human
uggaggugagugugguacagca

SEQ ID NO: 1040207 - RNA, 18 nt, Human
uggguggcuagggaguuu

SEQ ID NO: 1040208 - RNA, 22 nt, Human
cugccacuuucacccagugcuc

SEQ ID NO: 1040209 - RNA, 22 nt, Human
gccuguccacuaaacagccaag

SEQ ID NO: 1040210 - RNA, 22 nt, Human
gccaccagggggcuccagugag

SEQ ID NO: 1040211 - RNA, 22 nt, Human
auucugucuuuuuaaaauaaua

SEQ ID NO: 1040212 - RNA, 22 nt, Human
uccuucagauuccugcuucugg

SEQ ID NO: 1040213 - RNA, 22 nt, Human
gcucucugaggugcuggcagag

SEQ ID NO: 1040214 - RNA, 22 nt, Human
gcucugcuugcaucaugacugc

SEQ ID NO: 1040215 - RNA, 22 nt, Human
agggcugagacuaaggccagau

SEQ ID NO: 1040216 - RNA, 18 nt, Human
gucuggaggucaggagcu

SEQ ID NO: 1040217 - RNA, 17 nt, Human
ucaggauccaggguucu

SEQ ID NO: 1040218 - RNA, 21 nt, Human
agagccugagaucuuccagca

SEQ ID NO: 1040219 - RNA, 22 nt, Human
gcugagaguguaggauguuuac

SEQ ID NO: 1040220 - RNA, 22 nt, Human
cccccuggcaggcuggccucuc

SEQ ID NO: 1040221 - RNA, 22 nt, Human
uguguacucaauugagccauuu

SEQ ID NO: 1040222 - RNA, 22 nt, Human
ccucuuugugccugcaggcugc

SEQ ID NO: 1040223 - RNA, 22 nt, Human
agccaggaauuggacaacacau

SEQ ID NO: 1040224 - RNA, 22 nt, Human
acugucacuccaacugagucgu

SEQ ID NO: 1040225 - RNA, 22 nt, Human
uuauuauuuuguguacagcaaa

SEQ ID NO: 1040226 - RNA, 22 nt, Human
ucugcaggccucgacaaggcca

SEQ ID NO: 1040227 - RNA, 22 nt, Human
agugaaaugacugaaucagaua

SEQ ID NO: 1040228 - RNA, 19 nt, Human
aggcagaggcuuggcuagc

SEQ ID NO: 1040229 - RNA, 22 nt, Human
acaauguaggauauguacuugu

SEQ ID NO: 1040230 - RNA, 22 nt, Human
cugccuggucucaggcaugggg

SEQ ID NO: 1040231 - RNA, 22 nt, Human
cugagauggaguuucgcucuuc

SEQ ID NO: 1040232 - RNA, 22 nt, Human
cugggguggauggguccaaguu

SEQ ID NO: 1040233 - RNA, 22 nt, Human
aggcagagcugauguucuguga

SEQ ID NO: 1040234 - RNA, 22 nt, Human
agagcuggccagggaucacucu

SEQ ID NO: 1040235 - RNA, 22 nt, Human
cagagacauuaagugccaugau

SEQ ID NO: 1040236 - RNA, 22 nt, Human
cugcugcauuccucuuuaugag

SEQ ID NO: 1040237 - RNA, 22 nt, Human
cuggccuuuaaaaugaccuuau

SEQ ID NO: 1040238 - RNA, 22 nt, Human
ggccugcugcuaugacuuccug

SEQ ID NO: 1040239 - RNA, 20 nt, Human
ucucaggguucagcaaagua

SEQ ID NO: 1040240 - RNA, 22 nt, Human
aacaaauguguggcaguguggg

SEQ ID NO: 1040241 - RNA, 22 nt, Human
cugggcuccuaaccauccaggu

SEQ ID NO: 1040242 - RNA, 22 nt, Human
gcaggccuccccugcuggagcu

SEQ ID NO: 1040243 - RNA, 22 nt, Human
ugggccacggggguggagagcu

SEQ ID NO: 1040244 - RNA, 22 nt, Human
cuggcugcaggaaggagugggc

SEQ ID NO: 1040245 - RNA, 22 nt, Human
uguguauuucuggaacagacua

SEQ ID NO: 1040246 - RNA, 22 nt, Human
auuuccauacacccauuucuga

SEQ ID NO: 1040247 - RNA, 19 nt, Human
cugcugggugcugagggag

SEQ ID NO: 1040248 - RNA, 22 nt, Human
aagacagagggaagcaaugaug

SEQ ID NO: 1040249 - RNA, 22 nt, Human
cuggcagguuuggugucuggug

SEQ ID NO: 1040250 - RNA, 20 nt, Human
gagauuuccaaucaugccca

SEQ ID NO: 1040251 - RNA, 22 nt, Human
uaaugcacauagaaguacuuag

SEQ ID NO: 1040252 - RNA, 22 nt, Human
gcucccagcaauugaggcagcc

SEQ ID NO: 1040253 - RNA, 22 nt, Human
agagcugugaaaaugagguuug

SEQ ID NO: 1040254 - RNA, 22 nt, Human
ucuuguccuaagagcuggauuc

SEQ ID NO: 1040255 - RNA, 22 nt, Human
ccuuggcccuagccucaggcaa

SEQ ID NO: 1040256 - RNA, 22 nt, Human
ccaggccugauugggaaucuug

SEQ ID NO: 1040257 - RNA, 22 nt, Human
gagcuggcuaauacugacuuau

SEQ ID NO: 1040258 - RNA, 19 nt, Human
gcuucccaccagccagccc

SEQ ID NO: 1040259 - RNA, 22 nt, Human
ucagaagccggaagugcuccuc

SEQ ID NO: 1040260 - RNA, 22 nt, Human
gcugguccacucccuggaggcu

SEQ ID NO: 1040261 - RNA, 22 nt, Human
ccuggagcacauggcaggaggc

SEQ ID NO: 1040262 - RNA, 22 nt, Human
uuggcuuccaggaucucagcag

SEQ ID NO: 1040263 - RNA, 22 nt, Human
gagcucagcacuaaaaucaugu

SEQ ID NO: 1040264 - RNA, 22 nt, Human
ccaggagguggagauugcagug

SEQ ID NO: 1040265 - RNA, 22 nt, Human
agaggcaggaagagcugauuuu

SEQ ID NO: 1040266 - RNA, 22 nt, Human
aaaguuugagugauuugacaca

SEQ ID NO: 1040267 - RNA, 22 nt, Human
uucccaggcugugcuaccagag

SEQ ID NO: 1040268 - RNA, 22 nt, Human
ggccucuguuuggagccaggau

SEQ ID NO: 1040269 - RNA, 22 nt, Human
uauaucuuauaugugcagguac

SEQ ID NO: 1040270 - RNA, 20 nt, Human
cuuccacacaagaagcacag

SEQ ID NO: 1040271 - RNA, 22 nt, Human
aggcuggcuuggcucuccugug

SEQ ID NO: 1040272 - RNA, 22 nt, Human
cacagcugaaguagccaugugg

SEQ ID NO: 1040273 - RNA, 22 nt, Human
cugcugcugagagcucagccug

SEQ ID NO: 1040274 - RNA, 22 nt, Human
cccagccaaggugcugguguug

SEQ ID NO: 1040275 - RNA, 22 nt, Human
gggauggacuuggggacuccag

SEQ ID NO: 1040276 - RNA, 22 nt, Human
agugcauauaugaagaguauga

SEQ ID NO: 1040277 - RNA, 22 nt, Human
gccagcagggcccaaaugcugg

SEQ ID NO: 1040278 - RNA, 22 nt, Human
uugaagcauuugcuauagcauu

SEQ ID NO: 1040279 - RNA, 22 nt, Human
agaggaugauuuuaaggacacu

SEQ ID NO: 1040280 - RNA, 22 nt, Human
uauaauccauucauugauuucu

SEQ ID NO: 1040281 - RNA, 22 nt, Human
gaggugggagggcagucccuaa

SEQ ID NO: 1040282 - RNA, 22 nt, Human
cucagaguggggcucccugagg

SEQ ID NO: 1040283 - RNA, 22 nt, Human
aauguuguuuuucugcaugucu

SEQ ID NO: 1040284 - RNA, 22 nt, Human
uuuuuccaccguacuuccugag

SEQ ID NO: 1040285 - RNA, 22 nt, Human
cugccugcugccuguggagggu

SEQ ID NO: 1040286 - RNA, 22 nt, Human
ucaggcugguggucagauggcu

SEQ ID NO: 1040287 - RNA, 22 nt, Human
cuccuguauguugggcuucaca

SEQ ID NO: 1040288 - RNA, 22 nt, Human
uggcccugcuguaucaucugcu

SEQ ID NO: 1040289 - RNA, 22 nt, Human
gccugugcuuaacugacgugag

SEQ ID NO: 1040290 - RNA, 22 nt, Human
cugagcugggaguagagacucu

SEQ ID NO: 1040291 - RNA, 22 nt, Human
caaugauucugcaacugugugc

SEQ ID NO: 1040292 - RNA, 22 nt, Human
uccauugucuuugguccuagcc

SEQ ID NO: 1040293 - RNA, 22 nt, Human
ucagcaguggcucucaugcagu

SEQ ID NO: 1040294 - RNA, 22 nt, Human
ucuucagauugcacugagcaag

SEQ ID NO: 1040295 - RNA, 23 nt, Human
uggcagcuguguaagagaaagca

SEQ ID NO: 1040296 - RNA, 21 nt, Human
cagagcagcguucugcugugg

SEQ ID NO: 1040297 - RNA, 22 nt, Human
ucagggcaaugucccucagaag

SEQ ID NO: 1040298 - RNA, 22 nt, Human
agccugagccccauccagcuga

SEQ ID NO: 1040299 - RNA, 19 nt, Human
ucugucacuggggguauuc

SEQ ID NO: 1040300 - RNA, 23 nt, Human
uccucccaaauuucagccucauu

SEQ ID NO: 1040301 - RNA, 22 nt, Human
uaagaacaagcuggggguucca

SEQ ID NO: 1040302 - RNA, 22 nt, Human
ugugccugaguuggcugaguac

SEQ ID NO: 1040303 - RNA, 22 nt, Human
uccucacauggugagccacaca

SEQ ID NO: 1040304 - RNA, 22 nt, Human
ucaggaaagaagaugcucagug

SEQ ID NO: 1040305 - RNA, 22 nt, Human
ggggcggggcucugagaagcau

SEQ ID NO: 1040306 - RNA, 22 nt, Human
agcucacagaaauccugcagga

SEQ ID NO: 1040307 - RNA, 22 nt, Human
ucuggccugaaaguccaugcuu

SEQ ID NO: 1040308 - RNA, 22 nt, Human
uucaagaugccagggacgcggc

SEQ ID NO: 1040309 - RNA, 22 nt, Human
gccugcuggcuguccauugcag

SEQ ID NO: 1040310 - RNA, 22 nt, Human
auguacauuuagaucauuucug

SEQ ID NO: 1040311 - RNA, 21 nt, Human
gcaggggauagaaauggucug

SEQ ID NO: 1040312 - RNA, 22 nt, Human
ccugggcauucuuugaguucuc

SEQ ID NO: 1040313 - RNA, 20 nt, Human
uggagcuguaaucuugucug

SEQ ID NO: 1040314 - RNA, 22 nt, Human
agcugucuccagauacaggauu

SEQ ID NO: 1040315 - RNA, 22 nt, Human
cuuccagagauagggccucaag

SEQ ID NO: 1040316 - RNA, 22 nt, Human
ugcagucuuccagcugcacaaa

SEQ ID NO: 1040317 - RNA, 22 nt, Human
cucuggcuuugcucaugcaucc

SEQ ID NO: 1040318 - RNA, 22 nt, Human
aagcugcccaagacugaagcau

SEQ ID NO: 1040319 - RNA, 20 nt, Human
caggccagagguuugauggc

SEQ ID NO: 1040320 - RNA, 22 nt, Human
uuagaaauacaagugagguuga

SEQ ID NO: 1040321 - RNA, 21 nt, Human
gccauuguuuucuaccuggag

SEQ ID NO: 1040322 - RNA, 22 nt, Human
aagcugccaaugguaagcugcu

SEQ ID NO: 1040323 - RNA, 21 nt, Human
aagcaggacauaugaugcccu

SEQ ID NO: 1040324 - RNA, 22 nt, Human
ccuggcugucguuuugugaaau

SEQ ID NO: 1040325 - RNA, 22 nt, Human
ccuggcugggccugauuucuca

SEQ ID NO: 1040326 - RNA, 22 nt, Human
uuaaugcagaaaucaaacugac

SEQ ID NO: 1040327 - RNA, 22 nt, Human
uccuuccucggggacccagauc

SEQ ID NO: 1040328 - RNA, 22 nt, Human
auaaggcagucacuggaauguu

SEQ ID NO: 1040329 - RNA, 22 nt, Human
uauguuuuucaagugcacacua

SEQ ID NO: 1040330 - RNA, 22 nt, Human
uuuccuuccaaaugcccgggag

SEQ ID NO: 1040331 - RNA, 20 nt, Human
gcugaggucauuaugccuca

SEQ ID NO: 1040332 - RNA, 19 nt, Human
agauggggaagagugugag

SEQ ID NO: 1040333 - RNA, 23 nt, Human
gccugggacucaggaggagcuca

SEQ ID NO: 1040334 - RNA, 22 nt, Human
ggucucuguugccuccaucaag

SEQ ID NO: 1040335 - RNA, 22 nt, Human
agcaggugaauuccuggaugug

SEQ ID NO: 1040336 - RNA, 22 nt, Human
caccagggacaaugcuaggggu

SEQ ID NO: 1040337 - RNA, 22 nt, Human
aggcccugcccagugccacaag

SEQ ID NO: 1040338 - RNA, 22 nt, Human
agcugggaugauaaccucaguc

SEQ ID NO: 1040339 - RNA, 22 nt, Human
agaaaugggccuugggacacaa

SEQ ID NO: 1040340 - RNA, 22 nt, Human
cuggagccggcgagccccagcc

SEQ ID NO: 1040341 - RNA, 21 nt, Human
ucagcagcaucugccuagagu

SEQ ID NO: 1040342 - RNA, 22 nt, Human
aaggcacuagcaagcugccugg

SEQ ID NO: 1040343 - RNA, 22 nt, Human
uuaagucacuuaucuaaagaca

SEQ ID NO: 1040344 - RNA, 22 nt, Human
cacaggugcuccucggggagcu

SEQ ID NO: 1040345 - RNA, 22 nt, Human
uugcagggaccugcagaaagcu

SEQ ID NO: 1040346 - RNA, 22 nt, Human
ggcugagcaauuuugaugacau

SEQ ID NO: 1040347 - RNA, 22 nt, Human
ucaggcagaccaccgugggcag

SEQ ID NO: 1040348 - RNA, 22 nt, Human
cuggcagcauuaacagagagca

SEQ ID NO: 1040349 - RNA, 22 nt, Human
agaaacauuuagauuauauguc

SEQ ID NO: 1040350 - RNA, 22 nt, Human
gcagguggauuaucagaagugc

SEQ ID NO: 1040351 - RNA, 22 nt, Human
ccagcccuguaaggaugaggca

SEQ ID NO: 1040352 - RNA, 22 nt, Human
gcugcccaggguggagccggcu

SEQ ID NO: 1040353 - RNA, 22 nt, Human
ugauuucauaguauauacauga

SEQ ID NO: 1040354 - RNA, 22 nt, Human
acagcagagacacucaggaggc

SEQ ID NO: 1040355 - RNA, 22 nt, Human
acugggaguucuccaugucccu

SEQ ID NO: 1040356 - RNA, 22 nt, Human
cccugagcccauaguugacauu

SEQ ID NO: 1040357 - RNA, 22 nt, Human
ggcagcugggucacaccgaucu

SEQ ID NO: 1040358 - RNA, 22 nt, Human
agccuggaagaaccugaagucu

SEQ ID NO: 1040359 - RNA, 22 nt, Human
gagagaagggggauaugagccu

SEQ ID NO: 1040360 - RNA, 22 nt, Human
aagucagagcaacugagacauu

SEQ ID NO: 1040361 - RNA, 22 nt, Human
caccagcagaagacugagggug

SEQ ID NO: 1040362 - RNA, 22 nt, Human
auacauauaugguacuuccugg

SEQ ID NO: 1040363 - RNA, 22 nt, Human
uugucuguaaagacggccacca

SEQ ID NO: 1040364 - RNA, 22 nt, Human
gggcaugguggugcacaccugu

SEQ ID NO: 1040365 - RNA, 20 nt, Human
gcauugaguauagacagaug

SEQ ID NO: 1040366 - RNA, 22 nt, Human
ugggugcuucgucagcucugag

SEQ ID NO: 1040367 - RNA, 22 nt, Human
cuggguggcgucuggggccagu

SEQ ID NO: 1040368 - RNA, 22 nt, Human
ugcagugggccggaggccaggg

SEQ ID NO: 1040369 - RNA, 22 nt, Human
cagagacagaaaauggaucuag

SEQ ID NO: 1040370 - RNA, 22 nt, Human
agucucugcugguugugccuau

SEQ ID NO: 1040371 - RNA, 23 nt, Human
ccugaagggucaggguccucagc

SEQ ID NO: 1040372 - RNA, 22 nt, Human
cagggcccauggcucagguagg

SEQ ID NO: 1040373 - RNA, 22 nt, Human
ggcgugggaaguggggcuucug

SEQ ID NO: 1040374 - RNA, 22 nt, Human
ugcucugcaagcaggagcaaga

SEQ ID NO: 1040375 - RNA, 22 nt, Human
gccccagguugccugucccagg

SEQ ID NO: 1040376 - RNA, 20 nt, Human
ggcacuggaagcacacagga

SEQ ID NO: 1040377 - RNA, 22 nt, Human
gauaugaaguggcauugugaag

SEQ ID NO: 1040378 - RNA, 22 nt, Human
gcugagguaggagguugcagug

SEQ ID NO: 1040379 - RNA, 22 nt, Human
agcaggugcauggcgagcgcgg

SEQ ID NO: 1040380 - RNA, 22 nt, Human
gucauugcaguggcaaaucaca

SEQ ID NO: 1040381 - RNA, 19 nt, Human
gccagcagaaugaugaggc

SEQ ID NO: 1040382 - RNA, 22 nt, Human
ccaggguguagggauuccagau

SEQ ID NO: 1040383 - RNA, 22 nt, Human
gaagagcuguagccugcucuuu

SEQ ID NO: 1040384 - RNA, 23 nt, Human
ugggccuggaaagccuuagagag

SEQ ID NO: 1040385 - RNA, 22 nt, Human
uugcauugaucccagcuugggc

SEQ ID NO: 1040386 - RNA, 22 nt, Human
gagguggccucaagcagucuuc

SEQ ID NO: 1040387 - RNA, 22 nt, Human
aaaaaugaauucuucaguggca

SEQ ID NO: 1040388 - RNA, 22 nt, Human
gucccuggaauggacucugcgc

SEQ ID NO: 1040389 - RNA, 22 nt, Human
aaaucagucccucuuggaauuu

SEQ ID NO: 1040390 - RNA, 22 nt, Human
uggagcagcuaagccucugaga

SEQ ID NO: 1040391 - RNA, 21 nt, Human
ucucugggaggacuugugaga

SEQ ID NO: 1040392 - RNA, 22 nt, Human
agugauggagcuuccucugcua

SEQ ID NO: 1040393 - RNA, 22 nt, Human
gggcccagcgugguuccaucug

SEQ ID NO: 1040394 - RNA, 22 nt, Human
uuucaaugacacaaaagagaaa

SEQ ID NO: 1040395 - RNA, 22 nt, Human
ugaaagguuaaaaguaguauug

SEQ ID NO: 1040396 - RNA, 22 nt, Human
acuuccugcuaugagcuucugu

SEQ ID NO: 1040397 - RNA, 22 nt, Human
ccagcagaagcucccgcugggu

SEQ ID NO: 1040398 - RNA, 22 nt, Human
gggugggaucuguggagccuca

SEQ ID NO: 1040399 - RNA, 22 nt, Human
uugaaggaggcuccuuuuuaaa

SEQ ID NO: 1040400 - RNA, 22 nt, Human
gcagggcagccacaggcccccu

SEQ ID NO: 1040401 - RNA, 22 nt, Human
ccugggagagccaucuguggcc

SEQ ID NO: 1040402 - RNA, 22 nt, Human
acagaacugggaaaugcacaua

SEQ ID NO: 1040403 - RNA, 22 nt, Human
ccuucagaccuagacaggaauc

SEQ ID NO: 1040404 - RNA, 22 nt, Human
caagagcugugaccucauucac

SEQ ID NO: 1040405 - RNA, 22 nt, Human
ugcauuauaacugaauguuguu

SEQ ID NO: 1040406 - RNA, 22 nt, Human
cugucccaggagcuguaagaca

SEQ ID NO: 1040407 - RNA, 22 nt, Human
aucaguuucuaccauguggaau

SEQ ID NO: 1040408 - RNA, 22 nt, Human
ucccaggcuaggccucugcguu

SEQ ID NO: 1040409 - RNA, 22 nt, Human
cugguucauccccuuccaggaa

SEQ ID NO: 1040410 - RNA, 19 nt, Human
gcucugagaggggcauggg

SEQ ID NO: 1040411 - RNA, 22 nt, Human
ucucaggaauagaguggcagca

SEQ ID NO: 1040412 - RNA, 22 nt, Human
ugcccugugugugcaagcacug

SEQ ID NO: 1040413 - RNA, 22 nt, Human
aagcagaugggacuccaaggca

SEQ ID NO: 1040414 - RNA, 22 nt, Human
cugagccagggccacacaugga

SEQ ID NO: 1040415 - RNA, 22 nt, Human
gcuccuggcuccaggcagccaa

SEQ ID NO: 1040416 - RNA, 22 nt, Human
aggcagaggagaaugaucuucc

SEQ ID NO: 1040417 - RNA, 22 nt, Human
agccacagcccacaggacucuu

SEQ ID NO: 1040418 - RNA, 22 nt, Human
uggccugguccuugucaaggca

SEQ ID NO: 1040419 - RNA, 22 nt, Human
auccaaaccuggacaugagugg

SEQ ID NO: 1040420 - RNA, 22 nt, Human
acaggugaccugcucauaugaa

SEQ ID NO: 1040421 - RNA, 22 nt, Human
ccagagccagagaggugccugc

SEQ ID NO: 1040422 - RNA, 22 nt, Human
cuggcccauggugagcucuggg

SEQ ID NO: 1040423 - RNA, 22 nt, Human
uacauauagacaguuacucuag

SEQ ID NO: 1040424 - RNA, 22 nt, Human
gggcugggauugcuugcuguga

SEQ ID NO: 1040425 - RNA, 22 nt, Human
cugucuccagggcaggugcagg

SEQ ID NO: 1040426 - RNA, 22 nt, Human
uggcucugagacacaggcucuc

SEQ ID NO: 1040427 - RNA, 21 nt, Human
cagggcacacagaggauggua

SEQ ID NO: 1040428 - RNA, 22 nt, Human
ccagucccgcaugguccagaau

SEQ ID NO: 1040429 - RNA, 22 nt, Human
ccccuuccgucucuugaguguc

SEQ ID NO: 1040430 - RNA, 22 nt, Human
ugaaaucuuauacuuugguagu

SEQ ID NO: 1040431 - RNA, 22 nt, Human
caucagcacuaugauuaaagua

SEQ ID NO: 1040432 - RNA, 22 nt, Human
ccagcccugccagagagagcug

SEQ ID NO: 1040433 - RNA, 21 nt, Human
aggugggagaccauguagguc

SEQ ID NO: 1040434 - RNA, 22 nt, Human
aaaugcagcagcuaauugaaaa

SEQ ID NO: 1040435 - RNA, 23 nt, Human
uggagcugggcucagacccuggg

SEQ ID NO: 1040436 - RNA, 22 nt, Human
auuuguaauuucuuaucugugu

SEQ ID NO: 1040437 - RNA, 20 nt, Human
uccuugaaagugggguauau

SEQ ID NO: 1040438 - RNA, 20 nt, Human
gcaggcagggaaugggggug

SEQ ID NO: 1040439 - RNA, 22 nt, Human
uuagauaaauugcaacuugauu

SEQ ID NO: 1040440 - RNA, 22 nt, Human
accagcuguguccuggcugcag

SEQ ID NO: 1040441 - RNA, 22 nt, Human
cugcuuccaugcaauggcaguc

SEQ ID NO: 1040442 - RNA, 22 nt, Human
gcucuggguagccacugccugg

SEQ ID NO: 1040443 - RNA, 22 nt, Human
uguggccuccuguuccugggua

SEQ ID NO: 1040444 - RNA, 22 nt, Human
ugggaccaagucauuucuuuag

SEQ ID NO: 1040445 - RNA, 18 nt, Human
gcagcugacacuggaguu

SEQ ID NO: 1040446 - RNA, 22 nt, Human
cucucugaggaaggagcaucug

SEQ ID NO: 1040447 - RNA, 22 nt, Human
aaaggucaaaaucgugacauug

SEQ ID NO: 1040448 - RNA, 22 nt, Human
ucuuuccuguaacugcuguuca

SEQ ID NO: 1040449 - RNA, 21 nt, Human
agcagaggcagaauguaugca

SEQ ID NO: 1040450 - RNA, 22 nt, Human
auuuaguguguauugcuauuau

SEQ ID NO: 1040451 - RNA, 22 nt, Human
uuguaacagcuguuuauauagu

SEQ ID NO: 1040452 - RNA, 17 nt, Human
ggccuguguggcugcag

SEQ ID NO: 1040453 - RNA, 21 nt, Human
ggcagcccgcccucuccuggc

SEQ ID NO: 1040454 - RNA, 22 nt, Human
gaggccuggguuggaggugcau

SEQ ID NO: 1040455 - RNA, 19 nt, Human
aauguaguguuaugucaac

SEQ ID NO: 1040456 - RNA, 22 nt, Human
ccaaagugcugagauuacaggu

SEQ ID NO: 1040457 - RNA, 22 nt, Human
gaugggggccagggccugcuuu

SEQ ID NO: 1040458 - RNA, 20 nt, Human
ugcuugucaugcacucaggc

SEQ ID NO: 1040459 - RNA, 22 nt, Human
cuuauuauaaaauccuguuuga

SEQ ID NO: 1040460 - RNA, 22 nt, Human
cagcugcaggaacaaaaaugug

SEQ ID NO: 1040461 - RNA, 19 nt, Human
uacauuuguguacacuugu

SEQ ID NO: 1040462 - RNA, 22 nt, Human
gcgaaaaauguguaaauauguu

SEQ ID NO: 1040463 - RNA, 20 nt, Human
cugcugugugugccucagcc

SEQ ID NO: 1040464 - RNA, 22 nt, Human
uaaacaugugagugugcauaua

SEQ ID NO: 1040465 - RNA, 22 nt, Human
ggagcugcucagagccaguccc

SEQ ID NO: 1040466 - RNA, 22 nt, Human
cagagcaguccuugucaaucag

SEQ ID NO: 1040467 - RNA, 22 nt, Human
gcuucccacagcuggacugggg

SEQ ID NO: 1040468 - RNA, 22 nt, Human
agggcagccaugagccuucagg

SEQ ID NO: 1040469 - RNA, 17 nt, Human
ucagagggaugagcagg

SEQ ID NO: 1040470 - RNA, 20 nt, Human
gucucagaauggauuugcau

SEQ ID NO: 1040471 - RNA, 22 nt, Human
uggcaguguauagguggcuccu

SEQ ID NO: 1040472 - RNA, 17 nt, Human
cccagcuggcagugccg

SEQ ID NO: 1040473 - RNA, 22 nt, Human
guuauguaugagggaaugauua

SEQ ID NO: 1040474 - RNA, 22 nt, Human
ggagcugcacgcucugaagccu

SEQ ID NO: 1040475 - RNA, 22 nt, Human
ccaggggaaacagggagcacuc

SEQ ID NO: 1040476 - RNA, 22 nt, Human
ugucccagcagcuggguucucu

SEQ ID NO: 1040477 - RNA, 22 nt, Human
ucacaugcuacugagccagacc

SEQ ID NO: 1040478 - RNA, 22 nt, Human
ucugccagugguuuggcccuga

SEQ ID NO: 1040479 - RNA, 22 nt, Human
agcugcccuucucuugcccuug

SEQ ID NO: 1040480 - RNA, 22 nt, Human
gauuuccuaauguggaucucug

SEQ ID NO: 1040481 - RNA, 22 nt, Human
caguguuccaggcggcagugaa

SEQ ID NO: 1040482 - RNA, 22 nt, Human
cugcugcaggaugggcacucug

SEQ ID NO: 1040483 - RNA, 22 nt, Human
gcucccucugcucaggcacuug

SEQ ID NO: 1040484 - RNA, 22 nt, Human
aggucaccauggcaugcuccac

SEQ ID NO: 1040485 - RNA, 22 nt, Human
auuugagaugguaaauaacuuu

SEQ ID NO: 1040486 - RNA, 22 nt, Human
ccucuggggguccucagagucu

SEQ ID NO: 1040487 - RNA, 22 nt, Human
gugcucaggaagcuguuccugc

SEQ ID NO: 1040488 - RNA, 22 nt, Human
acagaauugauggaaaucucag

SEQ ID NO: 1040489 - RNA, 22 nt, Human
uaaaugugcacagguuagaagg

SEQ ID NO: 1040490 - RNA, 22 nt, Human
aaaaguucccugguuagaaaag

SEQ ID NO: 1040491 - RNA, 22 nt, Human
cuuccugguuugaagcucgccg

SEQ ID NO: 1040492 - RNA, 22 nt, Human
ucaggggcuugaggugcauguc

SEQ ID NO: 1040493 - RNA, 22 nt, Human
ggggcagagcauagcuccaauu

SEQ ID NO: 1040494 - RNA, 22 nt, Human
uccuuuccagccucaccucagc

SEQ ID NO: 1040495 - RNA, 22 nt, Human
uaaauguguuguggaugaaguu

SEQ ID NO: 1040496 - RNA, 22 nt, Human
gcagggcuguucaggagggugg

SEQ ID NO: 1040497 - RNA, 19 nt, Human
uagaaugcccacuuaaaaa

SEQ ID NO: 1040498 - RNA, 22 nt, Human
gggcaugagagggcagcuggca

SEQ ID NO: 1040499 - RNA, 22 nt, Human
gggcugggauggcuugaagauu

SEQ ID NO: 1040500 - RNA, 22 nt, Human
gcuggccucgcaggcaggaugu

SEQ ID NO: 1040501 - RNA, 22 nt, Human
uaugcacauugguuuccucauu

SEQ ID NO: 1040502 - RNA, 22 nt, Human
ggccuugggcagacacgucaca

SEQ ID NO: 1040503 - RNA, 22 nt, Human
uaaguaaauuuauaaugugauu

SEQ ID NO: 1040504 - RNA, 22 nt, Human
uaugcacacaucgcagcaggaa

SEQ ID NO: 1040505 - RNA, 22 nt, Human
guacaguuuucaguguucacug

SEQ ID NO: 1040506 - RNA, 22 nt, Human
agggcagauggaacuuccccga

SEQ ID NO: 1040507 - RNA, 22 nt, Human
uggcagggccuaccccaauauc

SEQ ID NO: 1040508 - RNA, 22 nt, Human
aucauguuccagaaacagugau

SEQ ID NO: 1040509 - RNA, 17 nt, Human
aggccucccuccaggcc

SEQ ID NO: 1040510 - RNA, 22 nt, Human
uggacagguuugggugccuguu

SEQ ID NO: 1040511 - RNA, 22 nt, Human
ucaggcagaugcagggauggau

SEQ ID NO: 1040512 - RNA, 22 nt, Human
ugaaaucugcaugcaaaguccu

SEQ ID NO: 1040513 - RNA, 22 nt, Human
cccuucccuucugggagaucca

SEQ ID NO: 1040514 - RNA, 22 nt, Human
gccuggccugaacuaggaggug

SEQ ID NO: 1040515 - RNA, 22 nt, Human
ugcagggcccuugggguugaac

SEQ ID NO: 1040516 - RNA, 23 nt, Human
cuggggcuuucaaaucugggcag

SEQ ID NO: 1040517 - RNA, 22 nt, Human
aaaugccucugcuguacacaau

SEQ ID NO: 1040518 - RNA, 18 nt, Human
ggccugaggauuucagca

SEQ ID NO: 1040519 - RNA, 22 nt, Human
ucugguuagccaauaaugccaa

SEQ ID NO: 1040520 - RNA, 22 nt, Human
gaaaugugggucaugacccauu

SEQ ID NO: 1040521 - RNA, 19 nt, Human
ccugucugucuucagcuag

SEQ ID NO: 1040522 - RNA, 22 nt, Human
agcucccaggcagucaugagga

SEQ ID NO: 1040523 - RNA, 22 nt, Human
aaagccuugagauccuauaguu

SEQ ID NO: 1040524 - RNA, 22 nt, Human
gcguggugcugcccugcacaca

SEQ ID NO: 1040525 - RNA, 21 nt, Human
guguuuccuguuuauggcuug

SEQ ID NO: 1040526 - RNA, 21 nt, Human
aggcagcucaggcccagagag

SEQ ID NO: 1040527 - RNA, 22 nt, Human
acaguuucuccauuuacaccuu

SEQ ID NO: 1040528 - RNA, 22 nt, Human
gaaaaugugucaucccuacugu

SEQ ID NO: 1040529 - RNA, 22 nt, Human
gagagcugggcuuugggugaag

SEQ ID NO: 1040530 - RNA, 22 nt, Human
ugcccacauucaaaaggugaug

SEQ ID NO: 1040531 - RNA, 22 nt, Human
aagaggucauaccagauaaggg

SEQ ID NO: 1040532 - RNA, 23 nt, Human
ugcauuauccucucugaagacca

SEQ ID NO: 1040533 - RNA, 22 nt, Human
auguccuuccauuuugaucugu

SEQ ID NO: 1040534 - RNA, 22 nt, Human
uccuuuuuaagucguuguggua

SEQ ID NO: 1040535 - RNA, 22 nt, Human
agcucacaguguccuuccucaa

SEQ ID NO: 1040536 - RNA, 22 nt, Human
uuuaaucaggcaaagcauaaua

SEQ ID NO: 1040537 - RNA, 22 nt, Human
uuaaacagacaguaaaugaaac

SEQ ID NO: 1040538 - RNA, 20 nt, Human
ucugaggcugagcucuacuu

SEQ ID NO: 1040539 - RNA, 22 nt, Human
ccagccucacuggcaucaccua

SEQ ID NO: 1040540 - RNA, 22 nt, Human
agucucugcaugaugcagcaca

SEQ ID NO: 1040541 - RNA, 22 nt, Human
cacaggagagcugggaggugcc

SEQ ID NO: 1040542 - RNA, 22 nt, Human
gccugcuggauguggccaggcc

SEQ ID NO: 1040543 - RNA, 22 nt, Human
agagacaggguuuugccauguu

SEQ ID NO: 1040544 - RNA, 22 nt, Human
cacaggaggaggugcccgggcc

SEQ ID NO: 1040545 - RNA, 22 nt, Human
cuggcuggucaucagcaguacg

SEQ ID NO: 1040546 - RNA, 22 nt, Human
gugggacucuucuuuggcagug

SEQ ID NO: 1040547 - RNA, 21 nt, Human
gcagagccugagguucuugag

SEQ ID NO: 1040548 - RNA, 22 nt, Human
ccucugcucccuggugucugag

SEQ ID NO: 1040549 - RNA, 22 nt, Human
cucagaaguucagccuagagua

SEQ ID NO: 1040550 - RNA, 22 nt, Human
agagugggugaucucuguuguc

SEQ ID NO: 1040551 - RNA, 22 nt, Human
auccaguucucagugcuuacag

SEQ ID NO: 1040552 - RNA, 22 nt, Human
gcuggcaccugcaccaagcagg

SEQ ID NO: 1040553 - RNA, 22 nt, Human
agagccaggcaggcaauguuga

SEQ ID NO: 1040554 - RNA, 22 nt, Human
aggacagaccuaggacuggagc

SEQ ID NO: 1040555 - RNA, 21 nt, Human
cugcucuggggaccggcugug

SEQ ID NO: 1040556 - RNA, 22 nt, Human
gucaccagugcuaagaggugga

SEQ ID NO: 1040557 - RNA, 19 nt, Human
ugcucaggccaaggagccc

SEQ ID NO: 1040558 - RNA, 22 nt, Human
uccuggagagugggcgagcaca

SEQ ID NO: 1040559 - RNA, 21 nt, Human
gccucugcugucuuauuguga

SEQ ID NO: 1040560 - RNA, 22 nt, Human
aggacucaucccugcuugucag

SEQ ID NO: 1040561 - RNA, 22 nt, Human
agccuccacagaugcaaagggc

SEQ ID NO: 1040562 - RNA, 22 nt, Human
augcacagacccaaaggccauc

SEQ ID NO: 1040563 - RNA, 22 nt, Human
acaaaugcuuaguucaccaaaa

SEQ ID NO: 1040564 - RNA, 22 nt, Human
gccaggcacaguucuaggugcu

SEQ ID NO: 1040565 - RNA, 22 nt, Human
agcucccagaagccagagucgg

SEQ ID NO: 1040566 - RNA, 22 nt, Human
cagaagaauggugucugagcuc

SEQ ID NO: 1040567 - RNA, 22 nt, Human
cacaggaggaggccagagcgua

SEQ ID NO: 1040568 - RNA, 21 nt, Human
gagcucucaggcaagaagcag

SEQ ID NO: 1040569 - RNA, 22 nt, Human
ggggggugcugaucaguggagc

SEQ ID NO: 1040570 - RNA, 22 nt, Human
agcaggugacccaagcaggcug

SEQ ID NO: 1040571 - RNA, 20 nt, Human
ggcagcaggaguuuccucuu

SEQ ID NO: 1040572 - RNA, 22 nt, Human
gcuuccuucuaccacaucaugc

SEQ ID NO: 1040573 - RNA, 22 nt, Human
cccagcagaccgcugugauggc

SEQ ID NO: 1040574 - RNA, 22 nt, Human
aggagaaguaaggcuagaugau

SEQ ID NO: 1040575 - RNA, 22 nt, Human
ugucauuuaguccucugugugu

SEQ ID NO: 1040576 - RNA, 22 nt, Human
uguaugcaaauuuauuagcaca

SEQ ID NO: 1040577 - RNA, 22 nt, Human
ugcaagaggaauucuagaagca

SEQ ID NO: 1040578 - RNA, 22 nt, Human
uugugaaauguuucaaaauagu

SEQ ID NO: 1040579 - RNA, 22 nt, Human
ccagcagccaccuucucgaaau

SEQ ID NO: 1040580 - RNA, 22 nt, Human
agugcagugguuaggagccagg

SEQ ID NO: 1040581 - RNA, 22 nt, Human
caucagcaggcaacacucuugg

SEQ ID NO: 1040582 - RNA, 22 nt, Human
aggccucagugaucaucaucag

SEQ ID NO: 1040583 - RNA, 22 nt, Human
aaugggaggauuuucucucuug

SEQ ID NO: 1040584 - RNA, 20 nt, Human
uccagcugucuuucagagac

SEQ ID NO: 1040585 - RNA, 22 nt, Human
caaaguuaucaacugcaacauu

SEQ ID NO: 1040586 - RNA, 22 nt, Human
cacugccuccccaggcuccaca

SEQ ID NO: 1040587 - RNA, 22 nt, Human
cagcuggaugggagaccauguu

SEQ ID NO: 1040588 - RNA, 22 nt, Human
gcucucuggguggugggcaaca

SEQ ID NO: 1040589 - RNA, 22 nt, Human
aagcuggagaguuaggugaaua

SEQ ID NO: 1040590 - RNA, 22 nt, Human
cccagcuccagagccagaaaca

SEQ ID NO: 1040591 - RNA, 22 nt, Human
caggaggaacaagagguucugg

SEQ ID NO: 1040592 - RNA, 22 nt, Human
auaaacaguagagaaagguggu

SEQ ID NO: 1040593 - RNA, 22 nt, Human
gagugugucggucagcguggcg

SEQ ID NO: 1040594 - RNA, 22 nt, Human
cagggcagaacauauagauagu

SEQ ID NO: 1040595 - RNA, 22 nt, Human
ucacuuauugcucaucucaugc

SEQ ID NO: 1040596 - RNA, 22 nt, Human
agggaguguaaauggugcucag

SEQ ID NO: 1040597 - RNA, 22 nt, Human
gucagcugucuccccagagugg

SEQ ID NO: 1040598 - RNA, 22 nt, Human
uguguuccuucgucuucccuuc

SEQ ID NO: 1040599 - RNA, 22 nt, Human
gcaggagagccagcaggcuucc

SEQ ID NO: 1040600 - RNA, 22 nt, Human
uguggcccagaugagugugcua

SEQ ID NO: 1040601 - RNA, 22 nt, Human
ucucaggaagauuagggcuaag

SEQ ID NO: 1040602 - RNA, 22 nt, Human
caggcacuggccagucagcaca

SEQ ID NO: 1040603 - RNA, 22 nt, Human
ucugugacuugcgggaggagaa

SEQ ID NO: 1040604 - RNA, 18 nt, Human
uugagggaggggcagagu

SEQ ID NO: 1040605 - RNA, 22 nt, Human
ccuccagggcagacggggagca

SEQ ID NO: 1040606 - RNA, 22 nt, Human
ggcucuggcguccaauggagcg

SEQ ID NO: 1040607 - RNA, 22 nt, Human
ggcagaguggagugcggccucc

SEQ ID NO: 1040608 - RNA, 22 nt, Human
uggcuccuucauucuccugcca

SEQ ID NO: 1040609 - RNA, 22 nt, Human
gcugugcagucuuuggugugcc

SEQ ID NO: 1040610 - RNA, 20 nt, Human
uaucaaucagaaagaagacu

SEQ ID NO: 1040611 - RNA, 22 nt, Human
caguauguuugggagacaugac

SEQ ID NO: 1040612 - RNA, 19 nt, Human
ggaggccuggguauuugcc

SEQ ID NO: 1040613 - RNA, 22 nt, Human
uacagggguaacaguggggaau

SEQ ID NO: 1040614 - RNA, 22 nt, Human
uuuuuccuuagggguuacucac

SEQ ID NO: 1040615 - RNA, 22 nt, Human
cagugggugaugaguccugggg

SEQ ID NO: 1040616 - RNA, 22 nt, Human
gcauuccugagaaugcagagug

SEQ ID NO: 1040617 - RNA, 22 nt, Human
cuuguagaauugaaauggucuc

SEQ ID NO: 1040618 - RNA, 22 nt, Human
uugaagcagagaaauacuugaa

SEQ ID NO: 1040619 - RNA, 23 nt, Human
agacagaggcugaggcuggccgc

SEQ ID NO: 1040620 - RNA, 22 nt, Human
gcagggcacagacagugccaag

SEQ ID NO: 1040621 - RNA, 22 nt, Human
aaguuacuggcaagggcugcag

SEQ ID NO: 1040622 - RNA, 22 nt, Human
gucacaggccuggaugaggggc

SEQ ID NO: 1040623 - RNA, 22 nt, Human
ucuggcucaggagcuguguuca

SEQ ID NO: 1040624 - RNA, 22 nt, Human
uaacaucuuuagcagcucgaac

SEQ ID NO: 1040625 - RNA, 20 nt, Human
ucacaucuggcagcugauga

SEQ ID NO: 1040626 - RNA, 22 nt, Human
caaaugcaugagaaauaagagg

SEQ ID NO: 1040627 - RNA, 22 nt, Human
cugccucuggccucaggcccag

SEQ ID NO: 1040628 - RNA, 22 nt, Human
caagagcucagaaacccuugcu

SEQ ID NO: 1040629 - RNA, 22 nt, Human
cauuguauugaggauacuuaag

SEQ ID NO: 1040630 - RNA, 22 nt, Human
acucccagguugccuggcaggc

SEQ ID NO: 1040631 - RNA, 22 nt, Human
ccugccaggacauugcuugaag

SEQ ID NO: 1040632 - RNA, 22 nt, Human
ugcauuucagaagaaaauucgg

SEQ ID NO: 1040633 - RNA, 18 nt, Human
gggcccuggcguccgccc

SEQ ID NO: 1040634 - RNA, 22 nt, Human
cugagggccuuggcuccugccc

SEQ ID NO: 1040635 - RNA, 22 nt, Human
auaaggcagaaauagggaaagu

SEQ ID NO: 1040636 - RNA, 22 nt, Human
uggcccugcugggucagagcug

SEQ ID NO: 1040637 - RNA, 22 nt, Human
gggcuggaggugagcaggacag

SEQ ID NO: 1040638 - RNA, 22 nt, Human
guggcucuccauugacauggaa

SEQ ID NO: 1040639 - RNA, 23 nt, Human
ugagcugguauuguccaucucca

SEQ ID NO: 1040640 - RNA, 22 nt, Human
ucaugucaguuucuucuauaaa

SEQ ID NO: 1040641 - RNA, 22 nt, Human
ucaggagucugugcaguuccac

SEQ ID NO: 1040642 - RNA, 22 nt, Human
gggcagaggcucuggcccaucc

SEQ ID NO: 1040643 - RNA, 22 nt, Human
cccucugcugccuggcuggguc

SEQ ID NO: 1040644 - RNA, 22 nt, Human
uugcucaggcuuagagcuacua

SEQ ID NO: 1040645 - RNA, 20 nt, Human
uccaagcccuccuuccauuc

SEQ ID NO: 1040646 - RNA, 20 nt, Human
aauuuacucacagaaugaau

SEQ ID NO: 1040647 - RNA, 18 nt, Human
acagaacucaggggcacc

SEQ ID NO: 1040648 - RNA, 22 nt, Human
auuccaguucuccucucuaaag

SEQ ID NO: 1040649 - RNA, 22 nt, Human
gugucccagcagcacauuggcu

SEQ ID NO: 1040650 - RNA, 19 nt, Human
guggccucggagcgcgcgg

SEQ ID NO: 1040651 - RNA, 22 nt, Human
cauaucccauuggccaggacau

SEQ ID NO: 1040652 - RNA, 22 nt, Human
acagccaggagccaugggcagg

SEQ ID NO: 1040653 - RNA, 22 nt, Human
cuuagaaaucgaacucagguua

SEQ ID NO: 1040654 - RNA, 22 nt, Human
caggggcuguggcacauggugu

SEQ ID NO: 1040655 - RNA, 22 nt, Human
gcucagaggcacgaccucuugg

SEQ ID NO: 1040656 - RNA, 22 nt, Human
cccuggccagcucaugucugag

SEQ ID NO: 1040657 - RNA, 22 nt, Human
augaaauaucuugaagaaauuc

SEQ ID NO: 1040658 - RNA, 22 nt, Human
acaauucuggguauuuauauag

SEQ ID NO: 1040659 - RNA, 22 nt, Human
agccuggagguaaugaggaaac

SEQ ID NO: 1040660 - RNA, 23 nt, Human
cucugcaggagagugggcagggc

SEQ ID NO: 1040661 - RNA, 22 nt, Human
cugccugugcaugcagucagaa

SEQ ID NO: 1040662 - RNA, 22 nt, Human
ccuuccaggugcaggcaagccu

SEQ ID NO: 1040663 - RNA, 22 nt, Human
aggcugggaaaccugaaguugu

SEQ ID NO: 1040664 - RNA, 22 nt, Human
ucagggcaaagggcagaguuug

SEQ ID NO: 1040665 - RNA, 22 nt, Human
ccugcagcuccggauuucuggg

SEQ ID NO: 1040666 - RNA, 22 nt, Human
uaauacuuaccuugcagagucu

SEQ ID NO: 1040667 - RNA, 22 nt, Human
aaaugcacugaacacauguugu

SEQ ID NO: 1040668 - RNA, 22 nt, Human
cuggagcuccagggucuccucu

SEQ ID NO: 1040669 - RNA, 22 nt, Human
aggcacugaauauccaguaaaa

SEQ ID NO: 1040670 - RNA, 22 nt, Human
agcccugggaggccagcuugua

SEQ ID NO: 1040671 - RNA, 22 nt, Human
agagcugagaauguggcuuccu

SEQ ID NO: 1040672 - RNA, 22 nt, Human
agcucuggaauaaugaugugau

SEQ ID NO: 1040673 - RNA, 22 nt, Human
cucaguuucuucauauuguagg

SEQ ID NO: 1040674 - RNA, 22 nt, Human
ugugacagaucuuuaaauaaug

SEQ ID NO: 1040675 - RNA, 22 nt, Human
ucccuggacaacagacuucacu

SEQ ID NO: 1040676 - RNA, 22 nt, Human
agucucagaaaauaugcuuuuu

SEQ ID NO: 1040677 - RNA, 23 nt, Human
aaccagauaaauggcuccagggc

SEQ ID NO: 1040678 - RNA, 22 nt, Human
ucucccacugcaagcccaggcu

SEQ ID NO: 1040679 - RNA, 22 nt, Human
gucacacucagaaugacuagag

SEQ ID NO: 1040680 - RNA, 22 nt, Human
cucuggacagcaggugcugugg

SEQ ID NO: 1040681 - RNA, 22 nt, Human
uggcagccacaucucguggauu

SEQ ID NO: 1040682 - RNA, 22 nt, Human
gcuggagcugaguucccugggc

SEQ ID NO: 1040683 - RNA, 22 nt, Human
agaagcagacucugaggcaagg

SEQ ID NO: 1040684 - RNA, 22 nt, Human
agaaauguuguggguuuuguua

SEQ ID NO: 1040685 - RNA, 22 nt, Human
caucaguguggcaguucacugu

SEQ ID NO: 1040686 - RNA, 21 nt, Human
aggcucagcagguguauaaag

SEQ ID NO: 1040687 - RNA, 22 nt, Human
aacagaacccgagugugaaucu

SEQ ID NO: 1040688 - RNA, 22 nt, Human
uucucucauucaaauuaaagug

SEQ ID NO: 1040689 - RNA, 21 nt, Human
aauaaaacaguuggugucaau

SEQ ID NO: 1040690 - RNA, 22 nt, Human
ucagcagggcugugguguggcu

SEQ ID NO: 1040691 - RNA, 22 nt, Human
uggcuucugcuuucaguggagg

SEQ ID NO: 1040692 - RNA, 21 nt, Human
aaacugaccuugccugagaca

SEQ ID NO: 1040693 - RNA, 22 nt, Human
accagcucagaagccagaaaga

SEQ ID NO: 1040694 - RNA, 22 nt, Human
agcagcuggugagcaagcucag

SEQ ID NO: 1040695 - RNA, 22 nt, Human
cugcugagcaucagggcugccc

SEQ ID NO: 1040696 - RNA, 22 nt, Human
gcucccugaaaagaacaaaguc

SEQ ID NO: 1040697 - RNA, 22 nt, Human
caucugccuaaguggcccuguu

SEQ ID NO: 1040698 - RNA, 22 nt, Human
cugagagccuccuguuggcuag

SEQ ID NO: 1040699 - RNA, 22 nt, Human
ccugccaggccagugagcuucc

SEQ ID NO: 1040700 - RNA, 22 nt, Human
aucaguuuaacugucaagagcc

SEQ ID NO: 1040701 - RNA, 22 nt, Human
ugugcuucaucacuucucaguu

SEQ ID NO: 1040702 - RNA, 22 nt, Human
ggccaggcuggucucagacuuc

SEQ ID NO: 1040703 - RNA, 22 nt, Human
gcuggguggaucggaggcucug

SEQ ID NO: 1040704 - RNA, 22 nt, Human
gcucugucaacagcuagcugug

SEQ ID NO: 1040705 - RNA, 22 nt, Human
cagagccuaaaacgacuccacu

SEQ ID NO: 1040706 - RNA, 22 nt, Human
cugcuuugcauagcugccagag

SEQ ID NO: 1040707 - RNA, 19 nt, Human
agacagagcucaguggguu

SEQ ID NO: 1040708 - RNA, 22 nt, Human
agugccaggagcaaggagcucc

SEQ ID NO: 1040709 - RNA, 19 nt, Human
ugucccagacuccgugucu

SEQ ID NO: 1040710 - RNA, 22 nt, Human
uggagccugagucagcggaggc

SEQ ID NO: 1040711 - RNA, 22 nt, Human
uagucccauuuugagguauuug

SEQ ID NO: 1040712 - RNA, 22 nt, Human
acagcuggaggccccauugucc

SEQ ID NO: 1040713 - RNA, 22 nt, Human
uggagcugggguuugaaucugg

SEQ ID NO: 1040714 - RNA, 22 nt, Human
gcuggccugaccugaggcuggg

SEQ ID NO: 1040715 - RNA, 22 nt, Human
caguacuuggucaaggaagcag

SEQ ID NO: 1040716 - RNA, 23 nt, Human
gcucagagguuuuucucuggaug

SEQ ID NO: 1040717 - RNA, 22 nt, Human
cugggccagggaggugucugua

SEQ ID NO: 1040718 - RNA, 22 nt, Human
agauuuagacugccuuaaucau

SEQ ID NO: 1040719 - RNA, 22 nt, Human
ccucccuuggccauagccagcc

SEQ ID NO: 1040720 - RNA, 22 nt, Human
agcuaggaaauugaggcugaga

SEQ ID NO: 1040721 - RNA, 20 nt, Human
gcaaggcacagugaggaggg

SEQ ID NO: 1040722 - RNA, 18 nt, Human
ggagagugagaucaaaca

SEQ ID NO: 1040723 - RNA, 22 nt, Human
agcugucuuucugccuccugau

SEQ ID NO: 1040724 - RNA, 22 nt, Human
agaggccacuuugccugugaug

SEQ ID NO: 1040725 - RNA, 22 nt, Human
uggcagagaugaagaguuguuu

SEQ ID NO: 1040726 - RNA, 22 nt, Human
cuggccuucagacucggacuga

SEQ ID NO: 1040727 - RNA, 22 nt, Human
guggcuugaccaucccugcuac

SEQ ID NO: 1040728 - RNA, 22 nt, Human
ugagaauuacaaaugagucaca

SEQ ID NO: 1040729 - RNA, 22 nt, Human
aggcacugugcugaugucuuau

SEQ ID NO: 1040730 - RNA, 22 nt, Human
ccucuggcaacuucacagccca

SEQ ID NO: 1040731 - RNA, 22 nt, Human
ccuuccaggagucucugcaggu

SEQ ID NO: 1040732 - RNA, 22 nt, Human
ugccagcccaccuuggggccuc

SEQ ID NO: 1040733 - RNA, 22 nt, Human
caaauccagaucccagucguag

SEQ ID NO: 1040734 - RNA, 22 nt, Human
gcugaagcugcagcaggaggaa

SEQ ID NO: 1040735 - RNA, 22 nt, Human
uucugucacuuaggaggucaua

SEQ ID NO: 1040736 - RNA, 22 nt, Human
uggcagcaaguucuugggaggu

SEQ ID NO: 1040737 - RNA, 22 nt, Human
ggcagaggaaggaugaauucac

SEQ ID NO: 1040738 - RNA, 22 nt, Human
cucauggauauaagaacuguuu

SEQ ID NO: 1040739 - RNA, 22 nt, Human
guggcuucuggcugggccucag

SEQ ID NO: 1040740 - RNA, 22 nt, Human
uagcugccuagacagcuauagc

SEQ ID NO: 1040741 - RNA, 22 nt, Human
ggcagcuccucucagcaaaaga

SEQ ID NO: 1040742 - RNA, 23 nt, Human
ugggcaucuccucugugccaggc

SEQ ID NO: 1040743 - RNA, 22 nt, Human
aggccuggugaaugaaguaucu

SEQ ID NO: 1040744 - RNA, 22 nt, Human
uugcauuguugcaaugaaguau

SEQ ID NO: 1040745 - RNA, 22 nt, Human
cacccaggcuagagugcagugg

SEQ ID NO: 1040746 - RNA, 22 nt, Human
gugcaugucggggugcauguca

SEQ ID NO: 1040747 - RNA, 22 nt, Human
aagaacaguugggaggugagcc

SEQ ID NO: 1040748 - RNA, 22 nt, Human
auauaaaguguuuagaaagcug

SEQ ID NO: 1040749 - RNA, 22 nt, Human
uuuucauuuacauuagggaaga

SEQ ID NO: 1040750 - RNA, 22 nt, Human
gcuggcagguccaagauagagc

SEQ ID NO: 1040751 - RNA, 22 nt, Human
aauaugcauguauacaugugua

SEQ ID NO: 1040752 - RNA, 22 nt, Human
agaagccaacagggcaggagag

SEQ ID NO: 1040753 - RNA, 22 nt, Human
agcugcagucaagcugggccac

SEQ ID NO: 1040754 - RNA, 22 nt, Human
ccaaaguccacaguuuacauua

SEQ ID NO: 1040755 - RNA, 22 nt, Human
cugccucuccccagaguggccc

SEQ ID NO: 1040756 - RNA, 21 nt, Human
cugcaucucauagaacauguc

SEQ ID NO: 1040757 - RNA, 23 nt, Human
gggagccaggaccucgcgcccca

SEQ ID NO: 1040758 - RNA, 22 nt, Human
uggcugggcccccaccugccuc

SEQ ID NO: 1040759 - RNA, 23 nt, Human
guggagccacaucacaggcuccu

SEQ ID NO: 1040760 - RNA, 22 nt, Human
gggagggaaggaccuuaugaau

SEQ ID NO: 1040761 - RNA, 22 nt, Human
agcaccuucacaggcucucagg

SEQ ID NO: 1040762 - RNA, 18 nt, Human
ugacagaaccuggagccu

SEQ ID NO: 1040763 - RNA, 22 nt, Human
gcucccagaaccaaggcugggg

SEQ ID NO: 1040764 - RNA, 22 nt, Human
cugcccagaaucacucacucga

SEQ ID NO: 1040765 - RNA, 22 nt, Human
cuggcuuccaugcuguaguggc

SEQ ID NO: 1040766 - RNA, 22 nt, Human
aaggccugggaguacugggaca

SEQ ID NO: 1040767 - RNA, 23 nt, Human
gggauauggaccuuggaggaguc

SEQ ID NO: 1040768 - RNA, 22 nt, Human
cuggguggcagagccugcagug

SEQ ID NO: 1040769 - RNA, 22 nt, Human
guggaggacaaaagaagccuuu

SEQ ID NO: 1040770 - RNA, 22 nt, Human
gcacagggagcaggucucuggu

SEQ ID NO: 1040771 - RNA, 22 nt, Human
agguaggguuaauggagauaua

SEQ ID NO: 1040772 - RNA, 22 nt, Human
acacagggcggaaagcaugaga

SEQ ID NO: 1040773 - RNA, 22 nt, Human
accauuuaauaaguauuuccau

SEQ ID NO: 1040774 - RNA, 22 nt, Human
aagaacauguuaaaagauucac

SEQ ID NO: 1040775 - RNA, 22 nt, Human
cccagcucaagcagagagcuaa

SEQ ID NO: 1040776 - RNA, 22 nt, Human
uugcauugaugucuauacgcug

SEQ ID NO: 1040777 - RNA, 22 nt, Human
cuuccuggccauugccauggca

SEQ ID NO: 1040778 - RNA, 22 nt, Human
gagagcuggccagcuucaguau

SEQ ID NO: 1040779 - RNA, 22 nt, Human
uuuuggucagguuggucucgaa

SEQ ID NO: 1040780 - RNA, 22 nt, Human
acucugaggagugacuagaggu

SEQ ID NO: 1040781 - RNA, 22 nt, Human
ggccugugagcccuugcaugua

SEQ ID NO: 1040782 - RNA, 22 nt, Human
uucaagaugcacaguggcauuc

SEQ ID NO: 1040783 - RNA, 22 nt, Human
augcaguauaaaucauuucugg

SEQ ID NO: 1040784 - RNA, 22 nt, Human
ccuguguguaggccaggggagu

SEQ ID NO: 1040785 - RNA, 22 nt, Human
cagcuggcccuuugguagccuu

SEQ ID NO: 1040786 - RNA, 19 nt, Human
uguggccaugguucagcug

SEQ ID NO: 1040787 - RNA, 22 nt, Human
agggacugagcuaggaucuagu

SEQ ID NO: 1040788 - RNA, 22 nt, Human
gagcucaggagcaucagaagaa

SEQ ID NO: 1040789 - RNA, 22 nt, Human
gggagcaggagccugccugcca

SEQ ID NO: 1040790 - RNA, 22 nt, Human
cugagcauggccgguccauggu

SEQ ID NO: 1040791 - RNA, 22 nt, Human
ugaaggaaugaguauacuguuu

SEQ ID NO: 1040792 - RNA, 17 nt, Human
uccagagcacagagcuc

SEQ ID NO: 1040793 - RNA, 22 nt, Human
ccagagucuuuauauuccugaa

SEQ ID NO: 1040794 - RNA, 22 nt, Human
agauaacuuuuggguauucaug

SEQ ID NO: 1040795 - RNA, 22 nt, Human
caagaaauguuuacugagcauc

SEQ ID NO: 1040796 - RNA, 22 nt, Human
agacaacaccaaaugcuagugu

SEQ ID NO: 1040797 - RNA, 22 nt, Human
aagaagagaaaugugcugcugg

SEQ ID NO: 1040798 - RNA, 22 nt, Human
aucagcaaggcaaucacugcag

SEQ ID NO: 1040799 - RNA, 16 nt, Human
ccuuucucugccuucc

SEQ ID NO: 1040800 - RNA, 22 nt, Human
ugggcagaggcagcagaaaccu

SEQ ID NO: 1040801 - RNA, 22 nt, Human
acaggggauugauuggaagucu

SEQ ID NO: 1040802 - RNA, 22 nt, Human
gugcauuggugcgccacuucac

SEQ ID NO: 1040803 - RNA, 22 nt, Human
uuuccucugaugcugacuugga

SEQ ID NO: 1040804 - RNA, 22 nt, Human
agcugagcucaggcugauguaa

SEQ ID NO: 1040805 - RNA, 22 nt, Human
agugaaaugauaguguaaauac

SEQ ID NO: 1040806 - RNA, 22 nt, Human
ucagaagcaggagugugcacaa

SEQ ID NO: 1040807 - RNA, 22 nt, Human
gucccagagagcacuaguccau

SEQ ID NO: 1040808 - RNA, 22 nt, Human
gaguaagagcuggcuuuggugu

SEQ ID NO: 1040809 - RNA, 22 nt, Human
caggggccaggcugucugcugu

SEQ ID NO: 1040810 - RNA, 22 nt, Human
gccagggggucagcaggcacuu

SEQ ID NO: 1040811 - RNA, 22 nt, Human
ccagggcagugggagaaggugc

SEQ ID NO: 1040812 - RNA, 20 nt, Human
cugagcugagcuccaugggu

SEQ ID NO: 1040813 - RNA, 22 nt, Human
ggcuagaauaauugacuucauu

SEQ ID NO: 1040814 - RNA, 22 nt, Human
uauuuguauuucaugcaguaaa

SEQ ID NO: 1040815 - RNA, 23 nt, Human
gccuggccaccccagggcugcuu

SEQ ID NO: 1040816 - RNA, 22 nt, Human
guccuggggaauacagaagccg

SEQ ID NO: 1040817 - RNA, 22 nt, Human
cugcuuugaaaauaaacuuguc

SEQ ID NO: 1040818 - RNA, 22 nt, Human
ugugccagaaaauaugcugagg

SEQ ID NO: 1040819 - RNA, 21 nt, Human
agagaagggacucuuccaguc

SEQ ID NO: 1040820 - RNA, 22 nt, Human
ucagaguguuuuacuaaacaag

SEQ ID NO: 1040821 - RNA, 22 nt, Human
agcagaacugaugagacuugag

SEQ ID NO: 1040822 - RNA, 22 nt, Human
cugcucugcagcuuggacuccc

SEQ ID NO: 1040823 - RNA, 22 nt, Human
ucccagccugacagugcaucaa

SEQ ID NO: 1040824 - RNA, 22 nt, Human
augaagucuagcaagcauugaa

SEQ ID NO: 1040825 - RNA, 22 nt, Human
uccauggguagcccugguugag

SEQ ID NO: 1040826 - RNA, 22 nt, Human
auuugucucugcacuuuacuca

SEQ ID NO: 1040827 - RNA, 22 nt, Human
gagugaaaaaggaagggccaua

SEQ ID NO: 1040828 - RNA, 22 nt, Human
acaaauguggacauggauaaug

SEQ ID NO: 1040829 - RNA, 22 nt, Human
auagaacagaaacagaugcaca

SEQ ID NO: 1040830 - RNA, 22 nt, Human
aaguucaagagugacauauuag

SEQ ID NO: 1040831 - RNA, 22 nt, Human
gaaugcacucacccaucacuca

SEQ ID NO: 1040832 - RNA, 22 nt, Human
gaaggccauugcguccugggau

SEQ ID NO: 1040833 - RNA, 22 nt, Human
gcugcucuacccaugcaucugu

SEQ ID NO: 1040834 - RNA, 22 nt, Human
agcccuagagcuggaggucagu

SEQ ID NO: 1040835 - RNA, 21 nt, Human
ugcucacagaugugcucagug

SEQ ID NO: 1040836 - RNA, 17 nt, Human
auccccagcaucuagaa

SEQ ID NO: 1040837 - RNA, 20 nt, Human
agacccuguguccuguggcc

SEQ ID NO: 1040838 - RNA, 22 nt, Human
caggugggagccacagcguaca

SEQ ID NO: 1040839 - RNA, 22 nt, Human
uaaggcacccauguucauacag

SEQ ID NO: 1040840 - RNA, 22 nt, Human
gagaccaggaaguacagcagcc

SEQ ID NO: 1040841 - RNA, 22 nt, Human
aagggcagagggaaucccacau

SEQ ID NO: 1040842 - RNA, 22 nt, Human
augugaaagagguguucagugg

SEQ ID NO: 1040843 - RNA, 22 nt, Human
uggagcugagaaguggagcucu

SEQ ID NO: 1040844 - RNA, 22 nt, Human
agaggccagcagugccuaucug

SEQ ID NO: 1040845 - RNA, 21 nt, Human
guauucuuuaugaagugaaaa

SEQ ID NO: 1040846 - RNA, 22 nt, Human
gcacagggcugccaggcggcuu

SEQ ID NO: 1040847 - RNA, 22 nt, Human
ggagagaaauugagguagcaag

SEQ ID NO: 1040848 - RNA, 22 nt, Human
aguggcagagcaggugcuggaa

SEQ ID NO: 1040849 - RNA, 22 nt, Human
ggccaagauggaaggagagaug

SEQ ID NO: 1040850 - RNA, 22 nt, Human
ggcagcaguaggagcuaaucuu

SEQ ID NO: 1040851 - RNA, 22 nt, Human
auccaaaucaugucagaagaac

SEQ ID NO: 1040852 - RNA, 22 nt, Human
cuguaauucacuagggucagcg

SEQ ID NO: 1040853 - RNA, 22 nt, Human
uaaauguggagacucaggaguc

SEQ ID NO: 1040854 - RNA, 22 nt, Human
gagccagccuucuucugagguc

SEQ ID NO: 1040855 - RNA, 22 nt, Human
uguuuuguuuaugagagcacag

SEQ ID NO: 1040856 - RNA, 22 nt, Human
ccuggccucgugcucacggcuc

SEQ ID NO: 1040857 - RNA, 20 nt, Human
caggaggcaaggucaagguc

SEQ ID NO: 1040858 - RNA, 21 nt, Human
aaugugugcuauuuaucuuuu

SEQ ID NO: 1040859 - RNA, 22 nt, Human
gaggccuggcugucagucccca

SEQ ID NO: 1040860 - RNA, 22 nt, Human
agguacagggugaaaguuuaug

SEQ ID NO: 1040861 - RNA, 22 nt, Human
gaggcagcaugguaccuuggag

SEQ ID NO: 1040862 - RNA, 22 nt, Human
gcuggagguuucaccugaguuu

SEQ ID NO: 1040863 - RNA, 22 nt, Human
ggcaggugugagaucgaggcca

SEQ ID NO: 1040864 - RNA, 22 nt, Human
acagagcaugcucaguguguga

SEQ ID NO: 1040865 - RNA, 20 nt, Human
cacaggccuugugagcagac

SEQ ID NO: 1040866 - RNA, 22 nt, Human
ucccagagccucugccacucug

SEQ ID NO: 1040867 - RNA, 22 nt, Human
caggugcucccagagaagugcu

SEQ ID NO: 1040868 - RNA, 22 nt, Human
uaaggcacccgugagcugccag

SEQ ID NO: 1040869 - RNA, 22 nt, Human
agucccagcccaguccuguaag

SEQ ID NO: 1040870 - RNA, 22 nt, Human
ugucaguguauacauacaguau

SEQ ID NO: 1040871 - RNA, 22 nt, Human
cugcugggucuaugcaagugga

SEQ ID NO: 1040872 - RNA, 22 nt, Human
cacugaagguaggaccaaggcu

SEQ ID NO: 1040873 - RNA, 23 nt, Human
auaaggcauaaagguacauugga

SEQ ID NO: 1040874 - RNA, 22 nt, Human
ugggcugcccaagguggccaug

SEQ ID NO: 1040875 - RNA, 22 nt, Human
ucagagaacacagaggugaugu

SEQ ID NO: 1040876 - RNA, 22 nt, Human
ccuucugcuggucaucccagug

SEQ ID NO: 1040877 - RNA, 22 nt, Human
cggggcuguagcacagcugagc

SEQ ID NO: 1040878 - RNA, 22 nt, Human
uguauuuugugaggaucacucu

SEQ ID NO: 1040879 - RNA, 22 nt, Human
ccugccugcaaaaugggacaag

SEQ ID NO: 1040880 - RNA, 22 nt, Human
cuggcucauagagcagcuccaa

SEQ ID NO: 1040881 - RNA, 22 nt, Human
ccagggcauguaacuaauggug

SEQ ID NO: 1040882 - RNA, 22 nt, Human
aaaugguguuucuaaugcuaga

SEQ ID NO: 1040883 - RNA, 18 nt, Human
ucaaagucuggcuccacu

SEQ ID NO: 1040884 - RNA, 22 nt, Human
gugccagggggcacugaacaga

SEQ ID NO: 1040885 - RNA, 22 nt, Human
gggcguggauggucagugcagg

SEQ ID NO: 1040886 - RNA, 22 nt, Human
aagagcugcaucuaagccauga

SEQ ID NO: 1040887 - RNA, 22 nt, Human
ucaggggacuuaggagagaagu

SEQ ID NO: 1040888 - RNA, 22 nt, Human
gcagggccagugcagagaggaa

SEQ ID NO: 1040889 - RNA, 22 nt, Human
gccccugggagcagagccacca

SEQ ID NO: 1040890 - RNA, 22 nt, Human
cagagccugccucuggcugugg

SEQ ID NO: 1040891 - RNA, 22 nt, Human
agaggcugucccuugcuauucc

SEQ ID NO: 1040892 - RNA, 22 nt, Human
ugugaaggcagcagcucugucc

SEQ ID NO: 1040893 - RNA, 23 nt, Human
agccagggcacugguggagauug

SEQ ID NO: 1040894 - RNA, 22 nt, Human
uaaguucauuagacuacagaua

SEQ ID NO: 1040895 - RNA, 22 nt, Human
agcugccaucugaagaacugca

SEQ ID NO: 1040896 - RNA, 22 nt, Human
agggucaggagacacuggcaac

SEQ ID NO: 1040897 - RNA, 22 nt, Human
ccaggaagcggugagggcugcc

SEQ ID NO: 1040898 - RNA, 22 nt, Human
cugcaggauucucccaguugga

SEQ ID NO: 1040899 - RNA, 22 nt, Human
cagcaggcagccauuucacugu

SEQ ID NO: 1040900 - RNA, 22 nt, Human
uugcuuccaguccaagucuguu

SEQ ID NO: 1040901 - RNA, 22 nt, Human
gcugcaggcgccugcggucucu

SEQ ID NO: 1040902 - RNA, 22 nt, Human
cugagauggaguuuugcucuug

SEQ ID NO: 1040903 - RNA, 22 nt, Human
aaaucaguuguuauauuaaaga

SEQ ID NO: 1040904 - RNA, 22 nt, Human
accuuucauuaaagucuguagu

SEQ ID NO: 1040905 - RNA, 22 nt, Human
gagauggggucagcugggacau

SEQ ID NO: 1040906 - RNA, 22 nt, Human
gcaggcugugaggcucagaugg

SEQ ID NO: 1040907 - RNA, 22 nt, Human
caagagcuagaaauugguuaga

SEQ ID NO: 1040908 - RNA, 22 nt, Human
ccugccagggccuuggaagaaa

SEQ ID NO: 1040909 - RNA, 22 nt, Human
augcacagcagugaguucagug

SEQ ID NO: 1040910 - RNA, 22 nt, Human
ucacugaauacuugucucaucc

SEQ ID NO: 1040911 - RNA, 22 nt, Human
ugcagugguugagagcccagac

SEQ ID NO: 1040912 - RNA, 22 nt, Human
gcacagggcccugugcguaggu

SEQ ID NO: 1040913 - RNA, 22 nt, Human
gcuccagguauuugcccuuuua

SEQ ID NO: 1040914 - RNA, 22 nt, Human
acagccagaggugguccugggu

SEQ ID NO: 1040915 - RNA, 22 nt, Human
ucagaacaauugggaaccauua

SEQ ID NO: 1040916 - RNA, 22 nt, Human
caggcaggagccagggauucca

SEQ ID NO: 1040917 - RNA, 22 nt, Human
acuguguccucauguggcagaa

SEQ ID NO: 1040918 - RNA, 22 nt, Human
agagcugcaccuaugcagaccu

SEQ ID NO: 1040919 - RNA, 22 nt, Human
cagagccacugucugccaggca

SEQ ID NO: 1040920 - RNA, 21 nt, Human
agcagcugcaguuucuaucug

SEQ ID NO: 1040921 - RNA, 22 nt, Human
gcccuggccuucaucucagaca

SEQ ID NO: 1040922 - RNA, 22 nt, Human
cacauguuuggcaugucaccaa

SEQ ID NO: 1040923 - RNA, 22 nt, Human
ucuggcucagggcucugaggga

SEQ ID NO: 1040924 - RNA, 22 nt, Human
ucagggcaucaucaugaauaua

SEQ ID NO: 1040925 - RNA, 22 nt, Human
cugcucuggggaagccagaugu

SEQ ID NO: 1040926 - RNA, 22 nt, Human
gcagggcuaauggggcaaguag

SEQ ID NO: 1040927 - RNA, 22 nt, Human
guaacagaaagucaugcucauu

SEQ ID NO: 1040928 - RNA, 22 nt, Human
cugagcucuaaugucagccuug

SEQ ID NO: 1040929 - RNA, 22 nt, Human
agaaaugacacacaugagacau

SEQ ID NO: 1040930 - RNA, 22 nt, Human
cccagcucugcagaccugcccu

SEQ ID NO: 1040931 - RNA, 22 nt, Human
cuuguauuccccuaucucuaaa

SEQ ID NO: 1040932 - RNA, 22 nt, Human
gcucaaggcaggcagacaugag

SEQ ID NO: 1040933 - RNA, 22 nt, Human
agugcauugcaucucugcuuca

SEQ ID NO: 1040934 - RNA, 22 nt, Human
cugccagguuggcgcucgcucu

SEQ ID NO: 1040935 - RNA, 22 nt, Human
ggcuggagugggcuccagaguu

SEQ ID NO: 1040936 - RNA, 22 nt, Human
cuggcagcuucaggacacucgg

SEQ ID NO: 1040937 - RNA, 22 nt, Human
ccagggcaggggcuggaguuca

SEQ ID NO: 1040938 - RNA, 21 nt, Human
agcagaggggacauguuugau

SEQ ID NO: 1040939 - RNA, 20 nt, Human
gauuucaaagcagaguggcc

SEQ ID NO: 1040940 - RNA, 22 nt, Human
ccaggaggcagaaguugcagug

SEQ ID NO: 1040941 - RNA, 22 nt, Human
cacagagagcuacgugcagcgu

SEQ ID NO: 1040942 - RNA, 22 nt, Human
uuuauugcauacacaaauguca

SEQ ID NO: 1040943 - RNA, 22 nt, Human
ucccagagcaguacuccaggag

SEQ ID NO: 1040944 - RNA, 22 nt, Human
uccugagagcagaguccaggug

SEQ ID NO: 1040945 - RNA, 22 nt, Human
aggaccagccuccaggucucuu

SEQ ID NO: 1040946 - RNA, 22 nt, Human
agggaggaucugcuccuugucu

SEQ ID NO: 1040947 - RNA, 22 nt, Human
gugcagggcuggcaccggaggc

SEQ ID NO: 1040948 - RNA, 22 nt, Human
gaguggagcaaaagagguagau

SEQ ID NO: 1040949 - RNA, 22 nt, Human
aagaauguuaguuucugauaca

SEQ ID NO: 1040950 - RNA, 22 nt, Human
agggcagaaguacagacacuua

SEQ ID NO: 1040951 - RNA, 22 nt, Human
caggaaccuaaugaaggcucac

SEQ ID NO: 1040952 - RNA, 22 nt, Human
auggacaggcugagcuuccuca

SEQ ID NO: 1040953 - RNA, 22 nt, Human
cugugucccccucagccaggug

SEQ ID NO: 1040954 - RNA, 23 nt, Human
ggcugagacuacaggcgcuugcc

SEQ ID NO: 1040955 - RNA, 22 nt, Human
ugggcuggcugaacuucaaccu

SEQ ID NO: 1040956 - RNA, 22 nt, Human
guccucugacucagccuuggga

SEQ ID NO: 1040957 - RNA, 20 nt, Human
gaggaaaagcugccaggccu

SEQ ID NO: 1040958 - RNA, 21 nt, Human
aaggccugcuuacugcuaguu

SEQ ID NO: 1040959 - RNA, 23 nt, Human
ugucauugugacuacagaaccag

SEQ ID NO: 1040960 - RNA, 22 nt, Human
agcugagcauuugauccaccuc

SEQ ID NO: 1040961 - RNA, 22 nt, Human
agggcugccauuucuggcccaa

SEQ ID NO: 1040962 - RNA, 22 nt, Human
aggagucacucagggcuucauc

SEQ ID NO: 1040963 - RNA, 22 nt, Human
cuacuucugugaugaaacuaca

SEQ ID NO: 1040964 - RNA, 22 nt, Human
gagcugccaagauuacaaucag

SEQ ID NO: 1040965 - RNA, 17 nt, Human
gccaaaggguuccaauc

SEQ ID NO: 1040966 - RNA, 22 nt, Human
ugggugagugggaaaagcccag

SEQ ID NO: 1040967 - RNA, 22 nt, Human
uuuugucuaagaacuuugcaaa

SEQ ID NO: 1040968 - RNA, 22 nt, Human
uggccucugggaaagcagauuc

SEQ ID NO: 1040969 - RNA, 22 nt, Human
acugcuuuuagaaaucuauaga

SEQ ID NO: 1040970 - RNA, 22 nt, Human
ggcucaagcagucugccugccu

SEQ ID NO: 1040971 - RNA, 22 nt, Human
gaggucaauaauaugugcuuua

SEQ ID NO: 1040972 - RNA, 22 nt, Human
gggagcuggagcuggaagacuc

SEQ ID NO: 1040973 - RNA, 22 nt, Human
accaggcugugaagugagacua

SEQ ID NO: 1040974 - RNA, 22 nt, Human
agggcuggcuccguuaccuuga

SEQ ID NO: 1040975 - RNA, 22 nt, Human
ucagaggagaaguugggaaaau

SEQ ID NO: 1040976 - RNA, 22 nt, Human
ucauugcaccccagucccagcu

SEQ ID NO: 1040977 - RNA, 20 nt, Human
aggagcugaauuagaggguu

SEQ ID NO: 1040978 - RNA, 22 nt, Human
gagagugaaggcuucccagcaa

SEQ ID NO: 1040979 - RNA, 22 nt, Human
ucagcaguuuuauaugcagcuu

SEQ ID NO: 1040980 - RNA, 22 nt, Human
aggucauugaaguuauuuucuu

SEQ ID NO: 1040981 - RNA, 22 nt, Human
ugcucuggggagcuccucugcg

SEQ ID NO: 1040982 - RNA, 22 nt, Human
agccagcuggagaccacuguuu

SEQ ID NO: 1040983 - RNA, 22 nt, Human
gcagaggcauuucugacgcugc

SEQ ID NO: 1040984 - RNA, 23 nt, Human
ugggaguguugggaucucugcuc

SEQ ID NO: 1040985 - RNA, 22 nt, Human
gggguugguuuaaaugcuugag

SEQ ID NO: 1040986 - RNA, 21 nt, Human
ccugcagcaccagaaggagau

SEQ ID NO: 1040987 - RNA, 22 nt, Human
ggccucuggcaggcaggcccuc

SEQ ID NO: 1040988 - RNA, 22 nt, Human
ucuuucagccacuuaccugucu

SEQ ID NO: 1040989 - RNA, 22 nt, Human
gaggguccccaugcagagcuca

SEQ ID NO: 1040990 - RNA, 22 nt, Human
uguggucucguuauguugccca

SEQ ID NO: 1040991 - RNA, 22 nt, Human
ccacagggcucuaggcgcuucc

SEQ ID NO: 1040992 - RNA, 22 nt, Human
ucaaaugcggucauggcuuuua

SEQ ID NO: 1040993 - RNA, 22 nt, Human
gcagggacgccagggacagcaa

SEQ ID NO: 1040994 - RNA, 21 nt, Human
ucaggggcuguguuuuccauc

SEQ ID NO: 1040995 - RNA, 23 nt, Human
cccuggaguaaauucuuggaagg

SEQ ID NO: 1040996 - RNA, 22 nt, Human
ugggaggaaugucacugagcca

SEQ ID NO: 1040997 - RNA, 22 nt, Human
cuuuauguuggggugucuuagu

SEQ ID NO: 1040998 - RNA, 22 nt, Human
caggcaggugcagauuccucuu

SEQ ID NO: 1040999 - RNA, 21 nt, Human
ggccucugucauccugggaag

SEQ ID NO: 1041000 - RNA, 22 nt, Human
ggcuggccucaggguccucgcu

SEQ ID NO: 1041001 - RNA, 22 nt, Human
gggcagggguagcauuccaagu

SEQ ID NO: 1041002 - RNA, 22 nt, Human
aggucacacuuggaucauagaa

SEQ ID NO: 1041003 - RNA, 22 nt, Human
uaauccacaauagagauuaucu

SEQ ID NO: 1041004 - RNA, 22 nt, Human
aagccagggauuccugagggag

SEQ ID NO: 1041005 - RNA, 22 nt, Human
caggguggaagcuguagagugg

SEQ ID NO: 1041006 - RNA, 22 nt, Human
acagagcauauaaagugcuuug

SEQ ID NO: 1041007 - RNA, 22 nt, Human
cauuuguauguuccuccuuagg

SEQ ID NO: 1041008 - RNA, 22 nt, Human
ccuccuggugggcgcuucuggc

SEQ ID NO: 1041009 - RNA, 17 nt, Human
acacagggagagggagc

SEQ ID NO: 1041010 - RNA, 22 nt, Human
cugagaggaugcugcaguggag

SEQ ID NO: 1041011 - RNA, 19 nt, Human
ugaggccaaggucacagau

SEQ ID NO: 1041012 - RNA, 19 nt, Human
caugagcugcucacuuccc

SEQ ID NO: 1041013 - RNA, 22 nt, Human
cagggcaggaauuugacauugc

SEQ ID NO: 1041014 - RNA, 22 nt, Human
cagcccugagagaaccaucuau

SEQ ID NO: 1041015 - RNA, 18 nt, Human
uuccauaauguauguaac

SEQ ID NO: 1041016 - RNA, 22 nt, Human
caugcuuuaccaaagcagugau

SEQ ID NO: 1041017 - RNA, 22 nt, Human
acaaagguggaccauguggcuu

SEQ ID NO: 1041018 - RNA, 22 nt, Human
uacaaaugaguuguaugaacca

SEQ ID NO: 1041019 - RNA, 20 nt, Human
cugccuggaggccucuaccu

SEQ ID NO: 1041020 - RNA, 22 nt, Human
auccuucaaggggcugacagcu

SEQ ID NO: 1041021 - RNA, 22 nt, Human
ucagagugaccuuacauggucu

SEQ ID NO: 1041022 - RNA, 22 nt, Human
cuggcaggaaguuagaugguaa

SEQ ID NO: 1041023 - RNA, 22 nt, Human
ucagugucuugggcuugaaugc

SEQ ID NO: 1041024 - RNA, 22 nt, Human
cagccugacaccagcuuugggc

SEQ ID NO: 1041025 - RNA, 22 nt, Human
ccagguggaaggucugugcucu

SEQ ID NO: 1041026 - RNA, 22 nt, Human
agaugcuucaguguuuaauuua

SEQ ID NO: 1041027 - RNA, 22 nt, Human
ccuggugccacuagagaauguc

SEQ ID NO: 1041028 - RNA, 22 nt, Human
auugaaaggcaaaguaggaagc

SEQ ID NO: 1041029 - RNA, 22 nt, Human
acugccuugaaagauuguugag

SEQ ID NO: 1041030 - RNA, 22 nt, Human
gccugccuguuggcugaggugc

SEQ ID NO: 1041031 - RNA, 22 nt, Human
aaaugaacaguugcauucucug

SEQ ID NO: 1041032 - RNA, 22 nt, Human
ccagcuggugacauccccaacc

SEQ ID NO: 1041033 - RNA, 22 nt, Human
ucagaaauguaagcugaugacu

SEQ ID NO: 1041034 - RNA, 22 nt, Human
agcagagcccuuccauggccuu

SEQ ID NO: 1041035 - RNA, 22 nt, Human
ucagagguaagggcugagagga

SEQ ID NO: 1041036 - RNA, 22 nt, Human
cuggcagcgguuugcagccugg

SEQ ID NO: 1041037 - RNA, 22 nt, Human
acacuuuguuguggcauauacg

SEQ ID NO: 1041038 - RNA, 22 nt, Human
cugaggugcuauggaggauacg

SEQ ID NO: 1041039 - RNA, 22 nt, Human
acagaauuaaaguguuugugga

SEQ ID NO: 1041040 - RNA, 22 nt, Human
guguacaugagaaaucaacuuu

SEQ ID NO: 1041041 - RNA, 19 nt, Human
ucugaggguccagaugcau

SEQ ID NO: 1041042 - RNA, 22 nt, Human
uauugacaauuugugaaacuau

SEQ ID NO: 1041043 - RNA, 22 nt, Human
uuccuauuuccaugaaacacaa

SEQ ID NO: 1041044 - RNA, 21 nt, Human
agcaggaggcagucacagcuc

SEQ ID NO: 1041045 - RNA, 22 nt, Human
cagaacauuccaugugcccugc

SEQ ID NO: 1041046 - RNA, 22 nt, Human
aagccucaccuuuuagaagcua

SEQ ID NO: 1041047 - RNA, 22 nt, Human
uaaaugugucuuuuuaaggccu

SEQ ID NO: 1041048 - RNA, 22 nt, Human
gcagggcugggugggagacaga

SEQ ID NO: 1041049 - RNA, 22 nt, Human
uuuaucuuuggaucuucagaaa

SEQ ID NO: 1041050 - RNA, 22 nt, Human
acagaggucauggagaguucuc

SEQ ID NO: 1041051 - RNA, 22 nt, Human
gccuggguuccaugaucuccag

SEQ ID NO: 1041052 - RNA, 22 nt, Human
cuggaggcugaguugggucucc

SEQ ID NO: 1041053 - RNA, 22 nt, Human
acagagccacuuuggugccuac

SEQ ID NO: 1041054 - RNA, 23 nt, Human
uaguuauuuucucuguaauuugc

SEQ ID NO: 1041055 - RNA, 20 nt, Human
ugcagggcucugcuucucuc

SEQ ID NO: 1041056 - RNA, 22 nt, Human
gcagugcuuuagucuguccuuu

SEQ ID NO: 1041057 - RNA, 22 nt, Human
agcagaaccacagcacuguuga

SEQ ID NO: 1041058 - RNA, 22 nt, Human
uuaagaauggaaugaggaauuu

SEQ ID NO: 1041059 - RNA, 22 nt, Human
ucuggcaggcaaucggcucugg

SEQ ID NO: 1041060 - RNA, 19 nt, Human
aggccugggguuuugcacu

SEQ ID NO: 1041061 - RNA, 22 nt, Human
cugggcagugguggcaucuuug

SEQ ID NO: 1041062 - RNA, 22 nt, Human
uagagcuggaaaacugcaggua

SEQ ID NO: 1041063 - RNA, 22 nt, Human
uuccucugaaauggcuuggaaa

SEQ ID NO: 1041064 - RNA, 23 nt, Human
agccuucaggcaaugucaguaga

SEQ ID NO: 1041065 - RNA, 22 nt, Human
aaaagguaguugccaaauaagg

SEQ ID NO: 1041066 - RNA, 17 nt, Human
ucugccgacugccagcu

SEQ ID NO: 1041067 - RNA, 17 nt, Human
ggugaguguccaggugg

SEQ ID NO: 1041068 - RNA, 22 nt, Human
aggcugcaggucugggucaugu

SEQ ID NO: 1041069 - RNA, 22 nt, Human
ugccagcuccgaggagcugcag

SEQ ID NO: 1041070 - RNA, 22 nt, Human
gggccccuuguaucucuggcuc

SEQ ID NO: 1041071 - RNA, 22 nt, Human
augauacaagcaaaacuaauca

SEQ ID NO: 1041072 - RNA, 20 nt, Human
agugugcauuuagagucugc

SEQ ID NO: 1041073 - RNA, 17 nt, Human
gcagugaaaagagauca

SEQ ID NO: 1041074 - RNA, 21 nt, Human
guuuuaagggagaaaaccuag

SEQ ID NO: 1041075 - RNA, 22 nt, Human
cagucccacaagaucuccacaa

SEQ ID NO: 1041076 - RNA, 18 nt, Human
uccauuguucuacuguga

SEQ ID NO: 1041077 - RNA, 22 nt, Human
gcugagguggcugccuuaguaa

SEQ ID NO: 1041078 - RNA, 22 nt, Human
gaggcagcaucuauggugggaa

SEQ ID NO: 1041079 - RNA, 22 nt, Human
agcccaagcuaugaggugaccu

SEQ ID NO: 1041080 - RNA, 22 nt, Human
agagcugcaauuucauguggug

SEQ ID NO: 1041081 - RNA, 22 nt, Human
ucuggagcuggagggcaaggca

SEQ ID NO: 1041082 - RNA, 22 nt, Human
aggcugcuuccuuacguggcug

SEQ ID NO: 1041083 - RNA, 22 nt, Human
ucugaggcauaaccuguucugc

SEQ ID NO: 1041084 - RNA, 22 nt, Human
cacugagaggucucauuuccaa

SEQ ID NO: 1041085 - RNA, 22 nt, Human
agauuucccucuuguauuugca

SEQ ID NO: 1041086 - RNA, 22 nt, Human
aguggggaagagcaugggcccu

SEQ ID NO: 1041087 - RNA, 22 nt, Human
cugcugcugcuaucuacccagg

SEQ ID NO: 1041088 - RNA, 22 nt, Human
ugggcugcugcggugcucuugg

SEQ ID NO: 1041089 - RNA, 22 nt, Human
agacaggacacaagcugcauaa

SEQ ID NO: 1041090 - RNA, 22 nt, Human
cacagaggcaaccuucuggggu

SEQ ID NO: 1041091 - RNA, 23 nt, Human
acaaaugcccauacaucuaguuc

SEQ ID NO: 1041092 - RNA, 22 nt, Human
gaagagcugcucagaacaugau

SEQ ID NO: 1041093 - RNA, 22 nt, Human
cccaccaguacagaugguagau

SEQ ID NO: 1041094 - RNA, 22 nt, Human
cagaguguuucuuugggugggu

SEQ ID NO: 1041095 - RNA, 22 nt, Human
ugggcaaguaucggacucugag

SEQ ID NO: 1041096 - RNA, 22 nt, Human
aaauguaguauguugcauguau

SEQ ID NO: 1041097 - RNA, 22 nt, Human
gcucuggacccuggaguggcug

SEQ ID NO: 1041098 - RNA, 22 nt, Human
cugggccucaaucucagaguuu

SEQ ID NO: 1041099 - RNA, 22 nt, Human
uggagcucaaaggccuguggga

SEQ ID NO: 1041100 - RNA, 22 nt, Human
cucagggccaaggaugcuguug

SEQ ID NO: 1041101 - RNA, 22 nt, Human
agauaugacuagaagcucauuu

SEQ ID NO: 1041102 - RNA, 22 nt, Human
cagggagaucuuggcuccuggu

SEQ ID NO: 1041103 - RNA, 22 nt, Human
cauuauguucaguagcuuaaaa

SEQ ID NO: 1041104 - RNA, 21 nt, Human
ucccagggccaggugccauca

SEQ ID NO: 1041105 - RNA, 18 nt, Human
cggcagagugcuucuagc

SEQ ID NO: 1041106 - RNA, 21 nt, Human
uucuuuccccagaggacuaaa

SEQ ID NO: 1041107 - RNA, 20 nt, Human
uccugcaguuccuaggaggg

SEQ ID NO: 1041108 - RNA, 22 nt, Human
guuuccauggcucuguuaaugg

SEQ ID NO: 1041109 - RNA, 22 nt, Human
caaacugagcaucagaaaguuu

SEQ ID NO: 1041110 - RNA, 22 nt, Human
gggaaggagccugcuugcuaga

SEQ ID NO: 1041111 - RNA, 20 nt, Human
gggugagauguaggagaggg

SEQ ID NO: 1041112 - RNA, 22 nt, Human
cucagagcccaggguacacccg

SEQ ID NO: 1041113 - RNA, 18 nt, Human
auuuugaacaaugcugua

SEQ ID NO: 1041114 - RNA, 22 nt, Human
agccagacauggcuccugcucc

SEQ ID NO: 1041115 - RNA, 22 nt, Human
ucugccugcuaacuccugcacc

SEQ ID NO: 1041116 - RNA, 22 nt, Human
cugugccuuuguagcugugccu

SEQ ID NO: 1041117 - RNA, 22 nt, Human
ugcucacugaacucuugcuguc

SEQ ID NO: 1041118 - RNA, 21 nt, Human
agaaaaaccagcauguuuuca

SEQ ID NO: 1041119 - RNA, 20 nt, Human
aucagcaacugccacucagu

SEQ ID NO: 1041120 - RNA, 22 nt, Human
ugucaccucuuuggcugcagcu

SEQ ID NO: 1041121 - RNA, 22 nt, Human
acagcagcuggguucccaccau

SEQ ID NO: 1041122 - RNA, 22 nt, Human
cauggaaggcaaaagacacaga

SEQ ID NO: 1041123 - RNA, 22 nt, Human
ucccuguccugggcaaucccag

SEQ ID NO: 1041124 - RNA, 20 nt, Human
cuguggcucaugcaucugcc

SEQ ID NO: 1041125 - RNA, 22 nt, Human
ucauggcacuuagcacaguccu

SEQ ID NO: 1041126 - RNA, 22 nt, Human
aucacgucaugguuugaucugg

SEQ ID NO: 1041127 - RNA, 22 nt, Human
agcaccugcuuaaugugcagug

SEQ ID NO: 1041128 - RNA, 22 nt, Human
uugcaaaagccgaggcacucca

SEQ ID NO: 1041129 - RNA, 22 nt, Human
ccacccuggacaggccucugag
